United States Patent 9,782,462 (MODIFIED POLYNUCLEOTIDES FOR THE PRODUCTION OF PROTEINS ASSOCIATED WITH HUMAN DISEASE) - sequence listing, part 66

SEQ ID NO: 126328 - DNA, 705 bp, Artificial Sequence
  Description of Artificial Sequence: Synthetic coding sequence
atgtaccgcagtactaaaggcgcaagtaaggccaggcgggaccagattaatgccgagatcaggaatctaaaggagttgttgcccctagccgaagccgataaagtgcgactgtcatacttacacatcatgagcctggcatgcatttacacaaggaagggcgtgttcttcgcaggcggcaccccactggccggtccaaccgggcttctgagcgcacaagagctcgaggacattgtggctgccttgcccggcttcctgctggtctttacagcagagggcaagttgctttatttgagcgagagtgtcagtgagcatttgggccactctatggttgatctggtagcgcagggcgactccatctatgatatcattgatccagcggatcacctcactgtgaggcagcaattgaccctcccgagcgcactggatacagaccgcctgtttcgatgtagatttaacacttccaagagtctcagacgccaaagcgcgggcaataaactggtcctgattcgcgggagatttcacgcacaccctcccggagcctattgggccggtaatcctgtgtttacggctttctgcgcaccactggagccaaggccaagaccgggccctggacctggtcccggtccagcaagcctgttccttgccatgtttcagagccgccatgccaaggatctcgcgctgctggacatttccgaaagcgggtag

SEQ ID NO: 126329 - DNA, 1299 bp, Artificial Sequence
  Description of Artificial Sequence: Synthetic coding sequence
atgcccgcaggacgagccgcccgaacatgtgctctgctggccctgtgcttgttgggggccggcgcccaggattttggccccacaaggtttatctgtacttcagtgcccgtagatgctgacatgtgcgccgcctctgttgccgccggcggcgccgaagagctgcggtcgtcagttctgcagctgagagaaaccgtgctgcagcagaaggagactatcctgagtcaaaaagagaccatcagagaactgactgcaaagcttggaaggtgtgaatctcaatccacgctggacccaggcgcgggcgaggccagggcaggggggggtcggaagcagcccggcagcggcaagaacaccatgggagacctgtcccggacccccgcagctgaaaccctttcacaacttggacagacactgcagtccctcaaaacaagactggagaatctcgagcagtactcaagactaaattcctcgtctcaaaccaatagcctgaaagatttactgcagtcgaagatcgatgagctggaacggcaggtgctgtcacgcgtaaacactctggaggagggaaaaggcgggccacggaacgataccgaggagcgcgtgaaaatagagacagccttgacatccctgcaccagagaatctccgaactagaaaaagggcagaaggataacagaccaggggataaattccagctgacctttccactgcggacaaactatatgtatgccaaggtcaagaagagcctccccgagatgtatgctttcacagtgtgcatgtggctgaagagttcggcaacaccgggagtcggaaccccttttagttacgccgtgccaggtcaggcaaacgaactggtcctgatagagtggggaaataaccccatggaaattctaataaacgacaaggtcgctaaactgccttttgtgataaacgatggcaaatggcaccatatctgtgtgacatggacaacccgagatggcgtctgggaagcataccaagatggtactcaaggcggcagcggcgagaacctggcaccatatcaccccatcaaacctcagggagtccttgtgctgggtcaggagcaagatactcttggagggggctttgatgctacgcaggccttcgtgggggaattggcacactttaatatctgggatagaaagctgacaccgggcgaagtatataacctggcgacgtgttctaccaaagctttgtcagggaacgtgatcgcctgggccgagagccatatagagatatatgggggggctacaaagtggacgttcgaagcttgtcggcagattaactag

SEQ ID NO: 126330 - DNA, 585 bp, Artificial Sequence
  Description of Artificial Sequence: Synthetic coding sequence
atgtacgccaaagtgaagaaatcactgcccgagatgtatgcctttacagtctgcatgtggcttaaaagtagcgctactccgggggtcggcacgccattcagttatgctgtcccgggtcaggctaatgaactggtcttgatcgagtggggtaacaatcccatggagattttaattaacgataaggtggctaaactgccgtttgttataaatgacggcaaatggcaccacatttgtgtgacctggacaacacgggatggagtgtgggaagcatatcaagatgggacacagggaggctcaggggagaacctcgccccttaccatccgatcaaaccccagggcgttctcgtgcttggacaggagcaggacactcttggtggaggatttgacgccactcaagcgttcgtaggggagctagcacattttaacatatgggataggaagctgaccccaggggaagtatacaacctcgcgacctgcagcactaaggcactctcaggaaacgtgatagcctgggctgagtctcacatcgagatttacgggggcgcgactaaatggacatttgaggcttgtcggcaaatcaactag

SEQ ID NO: 126331 - DNA, 1296 bp, Artificial Sequence
  Description of Artificial Sequence: Synthetic coding sequence
atgctggcgttgctcgcagctagcgttgcactggcggtggcagcaggggcccaggattcccccgccccgggttccagattcgtctgcacggctctgccacctgaggctgtgcacgctggatgcccacttcctgccatgcccatgcaagggggcgcccagagtcctgaggaggaactcagggctgctgtcctgcaactgcgtgagacagtagttcagcaaaaagagacgctcggcgcccagcgcgaggccatccgagagctaaccgggaaactggcacgatgcgagggcttagccggaggcaaagcccgaggcgctggggctacaggcaaagataccatgggggacttgccgcgtgaccctggccacgtagtggaacagctctcgagatcactgcagacactgaaagaccgcctcgaatcgctggagcaccaattacgcgctaacgtgagcaacgctggattacccggtgactttcgcgaggttctccagcagagactcggagagctggagagacagctgctgcggaaggtcgcagagttggaagacgagaagtccctccttcacaacgagacctctgcgcaccgacaaaagacagagagtaccttgaatgctctactgcagcgggtcacagaactggagcgaggaaactctgcttttaaaagtccagatgcatttaaagtgagtctgcccctgcgcacgaattatctgtacggtaagatcaagaaaaccctccccgaactttatgcattcacaatatgcctgtggctccggagctccgcctcccctggaataggtacacccttctcctatgccgtgcctggccaggccaacgaaattgttctgatcgagtggggaaataaccctattgagttgcttattaatgataaggttgctcagttacctctgttcgtgtcagacgggaaatggcaccatatctgtgtaacgtggactactcgcgatggcatgtgggaagcattccaggacggcgagaagctgggcacaggcgagaatctcgccccttggcaccccatcaagcccggcggggttctcatccttggtcaagagcaagatacagttggcggtagatttgacgctacccaggcattcgtgggggaactttctcagtttaatatttgggaccgggtcttgcgtgctcaggaaatcgtaaatattgcaaactgttccaccaacatgcctggcaatataattccatgggttgacaacaacgtggatgtgtttggaggtgcaagcaagtggcccgttgaaacctgtgaggaacgcttgctggacttgtag

SEQ ID NO: 126332 - DNA, 246 bp, Artificial Sequence
  Description of Artificial Sequence: Synthetic coding sequence
atggcagccgtggcggcggccagcgcagagctacttatcatcgggtggtacatcttccgggtgctgctccaagtgtttctggagtgttgtatctactgggtgggtttcgcattccggaatcccccgggcacccaacccatcgcaaggagcgaagtgtttcgttacagtcttcagaaactcgcttacacagtctctagaaccggaagacaagtactaggagagcggcgccagagggcacccaattag

SEQ ID NO: 126333 - DNA, 165 bp, Artificial Sequence
  Description of Artificial Sequence: Synthetic coding sequence
atggccgctgtagccgctgcctccgccgagcttttgattatcgggtggtacatttttagggtgctgctccaggtatttcggtatagcttgcagaagctggcatacactgtgtcacggacggggcgtcaggttttaggagaacggagacagagagcccccaactag

SEQ ID NO: 126334 - DNA, 270 bp, Artificial Sequence
  Description of Artificial Sequence: Synthetic coding sequence
atgataagtagcgtcaagctgaacctgattctggtgctgtccctctctaccatgcacgttttttggtgctaccccgtcccctcctcaaaggtgtccgggaaaagtgattactttctgatcctgcttaatagctgcccgactcgtctggacaggtcgaaggaactagctttcctgaagcctatcctagagaagatgttcgtgaaacgttcgttccggaatggcgtgggcacagggatgaaaaaaacctcattccagcgggccaagtcttag

SEQ ID NO: 126335 - DNA, 525 bp, Artificial Sequence
  Description of Artificial Sequence: Synthetic coding sequence
gtggtgttgctgtacgcctccacctacgtgctggtctcccttagtatagacaggtaccacgccattgtatatcccatgaaggtgttgatcgtcatcgcttggtctttgtcctttctatttagtattcccaccctgataatttttggaaaacgaactttatctaacggcgaggtccaatgttgggcactgtggccagacgattcttactggaccccatatatgaccatcgtcgctttcctaggatccctcattacatttatttgctgctggtctccatatttcctgtttgatattttagacaattttaacctgctccccgacacacaagagagattttacgcttccgtcattattcaaaacctgccagcactcaacagcgccatcaaccctcttatttactgcgtgttttcgtcatcaatctcattcccttgcagagaacagcgatcacaggatagccggatgaccttcagggagcggactgagcgccacgaaatgcaaattctctctaagccggagtttatttag

SEQ ID NO: 126336 - DNA, 1134 bp, Artificial Sequence
  Description of Artificial Sequence: Synthetic coding sequence
atgcctgcaaacttcaccgaaggatcattcgatagctccggaacaggccagaccttggactctagccctgtggcctgtacagagacggtgacgtttactgaagtcgtggaggggaaggaatggggttcattctactactcattcaagactgaacagcttattacactgtgggtcctttttgttttcactatagtggggaattcagtcgtcctgttctccacatggagacggaaaaagaagagcagaatgaccttctttgtgacccagctggctattacagatagctttaccggcctggttaatatattgacagatatcaattggcgattcaccggtgatttcacagctcctgatctggtatgtagggtggtccgctatttgcaggttgtcttactttacgcctctacctatgtcctggtgtccctgagcatcgatcgataccacgctattgtgtacccgatgaagttccttcagggtgagaaacaagcaagggtccttattgtgattgcctggtcactctccttccttttctcaatccctacactcattatttttggaaaacgcacactgagtaatggcgaggtgcaatgctgggccctctggccagacgattcctactggaccccatatatgacaatagtagcgttccttgtgtactttataccacttactataatcagcattatgtacgggatcgtcataaggacgatttggataaagtccaaaacctacgaaacagtcataagtaactgctctgacggcaaactgtgttcaagttacaacaggggcctgattagcaaagctaaaatcaaagctattaaatactctatcataatcatcttggcatttatctgctgctggtcaccttatttcctctttgacatcttggacaatttcaatctgcttccagacacacaggaacgcttctacgccagtgtgatcatacagaatttaccagccctgaacagcgccattaatcctctcatttattgcgttttctcttcttccatctcattcccctgcagggtgatccgactgcggcaactgcaagaggcagctttgatgctctgtccacaacgggagaattggaagggtacctggcctggcgtgccctcctgggccctgcccaggtag

SEQ ID NO: 126337 - DNA, 1116 bp, Artificial Sequence
  Description of Artificial Sequence: Synthetic coding sequence
atgcctgccaacttcacagaggggtccttcgacagctccggcactggacagaccctggatagctcacctgttgcttgcacagagactgtgactttcacggaggtggttgagggaaaggagtgggggtccttttactacagtttcaaaacagagcagctcatcacattatgggtcctctttgtttttaccattgtgggaaactcggtcgtcctcttcagcacatggaggaggaagaaaaaatccagaatgactttcttcgtgacacagctcgcaattacagacagttttacgggcctggtgaacatccttaccgatattaactggcgctttacgggagacttcacggcccctgacctggtttgcagagtggtcaggtacctccaggtggtcctcttatatgcctccacctacgtactggtcagcttgtctattgacagataccatgccatcgtctatcccatgaagtttctacagggggagaagcaggcgagagtgctcatagtgatcgcctggtctctgagcttcctgtttagtatcccaacacttatcatcttcggaaagcgcactctgtctaatggcgaggtgcagtgttgggcactgtggcctgacgactcgtattggaccccatatatgacaatcgtggcttttcttgtttattttatccccctcaccattatttctattatgtacgggattgttattcggaccatttggatcaaaagcaaaacttatgaaactgtcatcagtaactgtagcgacggaaagctgtgctccagctataataggggtctgatatccaaagctaaaatcaaggcaatcaaatattctattatcataatcttggcgtttatttgctgctggtctccttactttctcttcgatatcctcgacaactttaatcttctccctgatacgcaggagaggttttacgcatctgttattattcagaacttacccgcactgaacagtgctattaaccctctgatttactgcgtgttttcaagctccatcagtttcccatgccgggaacaaagatcccaagactcacgcatgacgttcagagagcggaccgaacgacacgagatgcaaattctgtcaaagccagagttcatctag

SEQ ID NO: 126338 - DNA, 1173 bp, Artificial Sequence
  Description of Artificial Sequence: Synthetic coding sequence
atgcctgctaatttcaccgagggaagcttcgacagctcagggaccggtcagacactagattctagcccagttgcatgtaccgagactgtcacattcaccgaagtcgttgagggcaaggagtggggttctttttactacagtttcaaaaccgaacagctgattaccctctgggtgctatttgtatttaccatcgtgggtaacagcgttgtgctgttctccacatggaggagaaagaaaaaatcacgcatgaccttctttgtaacacagctggccattacagactcctttaccggcctggtaaatattctgactgacatcaattggcggttcacgggggatttcacagctcctgatcttgtgtgccgcgtggtgcgctatctgcaggtggtgctgctgtatgcctctacctatgtgctggtcagtctgtccatcgacaggtaccatgctatcgtgtatccaatgaaattcctgcaaggtgagaagcaagcccgggtgcttattgttatcgcctggtccctgagctttctattcagcattccaacactcatcatcttcgggaagcggacgttgagtaacggtgaggtccaatgctgggccctttggccggatgattcttactggacaccttatatgacaattgttgcatttctggtctacttcatccccctcaccattatcagtatcatgtatgggattgttatccgcacgatttggatcaagtctaaaacctacgagacagtgatctccaactgctcagacggtaagttgtgtagttcgtacaataggggacttattagtaaggcgaagatcaaggcgattaagtattcaatcattatcatccttgcgttcatatgttgctggtcgccctatttcctgtttgatattctcgataatttcaacttgctgcctgacacacaggaaaggttttacgcgagtgtgataatacagaacctgcctgcattgaactcagcaataaatccgttgatctattgtgtttttagctcatccatatcattcccttgccgcgcgaattctagtgtctatttgttggcatgcgacgtgagcgtgctgtgggctcttgtactcactagcgagaaagaatcctgcgaatcctggagacgtaaaggggccaagatcaccggcttccagaacgacgtgcccggggagaactag

SEQ ID NO: 126339 - DNA, 918 bp, Artificial Sequence
  Description of Artificial Sequence: Synthetic coding sequence
atgccagcaaactttaccgaagggagtttcgatagtagtgggaccgggcagaccctggattcgagccccgttgcctgcactgaaaccgtgactttcaccgaagtagtggaaggcaaggaatgggggtcattttattactccttcaagacggagcagctgatcaccctgtgggtgctgtttgtgttcacaatcgttggtaattccgtggtactcttctcaacttggagaagaaagaaaaagtccagaatgaccttcttcgtgacccagcttgctattaccgagaaacaggcacgtgtcttaatcgttattgcttggagcctctcattcctgttctccatccccactctgatcatcttcggcaagcgtactctatcaaatggggaagttcagtgctgggccttgtggccagatgacagctactggactccatacatgaccatcgtggctttcctggtctacttcattcccttaactatcatttcaatcatgtatggtatcgtgattagaactatctggatcaaaagcaagacttacgagactgtaattagtaattgcagtgacggtaagctatgctcttcttataataggggcctgatctctaaggcaaagatcaaagccatcaaatattcgattatcattatcctggcttttatctgctgttggtcaccctattttcttttcgacattctcgacaactttaatctattgcctgatacccaggaaaggttttacgcttccgttataattcagaacctgcctgcacttaattcagctataaatccattgatctactgtgtgttctcaagttcaatcagcttcccttgcagagagcaaaggtctcaggacagcagaatgaccttccgcgagcgaacagagcgtcacgaaatgcagatactgagcaaaccggaatttatctag

SEQ ID NO: 126340 - DNA, 432 bp, Artificial Sequence
  Description of Artificial Sequence: Synthetic coding sequence
atgccggcaaatttcacagagggttcgttcgactcaagcggaacgggtcagactttggacagtagccctgtggcctgtacagaaacagtgacgtttacagaggtcgttgaaggcaaagaatgggggtccttttattatagttttaagacggaacagctgattaccttgtgggttctgtttgtgttcactatcgttggcaattccgtggtcctcttttcaacatggcggagaaagaaaaagagtagaatgacattcttcgtaacccagctcgccatcacggatagcttcaccggcctggtgaatatcctgacggacattaactggcgtttcactggtgactttacagcccccgacttggtgtgccgtgtcgtgaggtatctgcaggtcatggtgatgaaattatttcacatccagaagatgaatatggaatag

SEQ ID NO: 126341 - DNA, 285 bp, Artificial Sequence
  Description of Artificial Sequence: Synthetic coding sequence
atgcccgccaacttcactgagggcagcttcgattctagtggaacaggccagaccctcgattcgtctcctgtagcatgtacggagaccgttacattcacagaagtcgttgaaggtaaagagtggggaagcttctactattccttcaaaacagagcagttaattacgctgtgggtcctcttcgtgttcacaattgttggcaatagcgtagtgttattttccacgtggagacgcaaaaagaagtccagaatgactttcttcgtaacccagctggcgataaccgtctag

SEQ ID NO: 126342 - DNA, 294 bp, Artificial Sequence
  Description of Artificial Sequence: Synthetic coding sequence
atgctgggtaacaaaaggcttgggctgtccggattaacactggccctttctctgctggtgtgtcttggggctctcgcagaagcctatccatccaagccagacaatcccggcgaggacgctccagcagaagacatggcccgctattattctgcgcttcgtcattacattaacctgatcacacgacagcggtacggcaaaaggtccagtcccgagactctcatctccgatctgttaatgcgggagagtactgaaaatgtacctcgaacacgccttgaggatccggccatgtggtag

SEQ ID NO: 126343 - DNA, 294 bp, Artificial Sequence
  Description of Artificial Sequence: Synthetic coding sequence
atgctgggaaacaagaggctggggctctcaggactcacgctagccctgagtctgctcgtgtgtctgggcgctttggccgaggcctatccctctaagcccgacaacccaggtgaggacgcccccgccgaagacatggcacggtactatagtgcgttgaggcactatatcaacctgatcacccgccaaaggtatgggaaacgctcctccccagaaaccctcatctccgatctgctgatgagagagagcacagaaaacgtgcctcgcactagattagaagaccccgccatgtggtag

SEQ ID NO: 126344 - DNA, 294 bp, Artificial Sequence
  Description of Artificial Sequence: Synthetic coding sequence
atgctgggcaataaacgcctgggactgtccggattgaccctcgccctctctttattggtctgtctgggggccttggctgaggcgtaccccagtaagccagataatcccggggaggatgcccctgccgaagacatggccagatactactccgccttgaggcactatattaacctaattacgaggcagaggtatggaaagcgttcatcccccgaaacactgatttcagacctgctgatgagggaatccaccgagaatgttcccagaaccagacttgaggacccagcaatgtggtag

SEQ ID NO: 126345 - DNA, 1155 bp, Artificial Sequence
  Description of Artificial Sequence: Synthetic coding sequence
atgaacagtacattattcagtcaggtcgagaatcacagtgtccatagcaacttcagtgagaagaatgcccagttattggccttcgagaatgatgactgccatctcccactggccatgatcttcacgctggcactcgcttacggagctgtcatcatactgggtgtgtctggtaacctggccttgattatcattatcctcaagcagaaggaaatgcgcaatgtaaccaacatccttatagttaacctaagttttagcgatttgctcgtggcaatcatgtgtcttccctttacatttgtttataccctgatggaccattgggtcttcggtgaagccatgtgcaagctcaacccatttgtccagtgcgtctccatcacagtaagtatcttctctcttgtactcattgctgttgagagacaccaactgatcatcaaccctcgtggctggcgtcccaacaaccggcacgcatatgttggcatcgcagtgatttgggttctggctgtcgcatcgagcctcccattcctaatctaccaggtgatgacagatgaacccttccaaaatgttaccctcgacgcctacaaagacaaatatgtttgcttcgaccagtttccctcagactctcatcgattatcctacacaactttactcctggtgctgcaatatttcggacctctgtgtttcattttcatttgctacttcaagatatacatccgcctgaagaggcggaataatatgatggacaagatgcgagataacaagtatagaagtagtgaaacgaagagaatcaatattatgctactgtcaatcgttgtggcatttgccgtttgctggcttcccctaaccatctttaacacagtctttgattggaaccaccagataattgcaacatgtaaccacaacttgctgtttctcctctgccacctcacagcaatgatttctacttgcgtcaacccgatattctacggattccttaacaaaaactttcagcgagaccttcaattcttttttaatttttgcgacttcagatctagggatgatgactacgaaacaattgctatgagcacgatgcatactgacgtttcgaaaacatcactcaaacaagcatcacccgtggcattcaaaaaaatcaacaataatgacgataacgagaagatttag

SEQ ID NO: 126346 - DNA, 186 bp, Artificial Sequence
  Description of Artificial Sequence: Synthetic coding sequence
atgaactccactctgttctcccaagttgagaaccatagtgtgcactctaatttctcagaaaaaaacgcccagttgttggccttcgaaaacgacgactgccatttgcctctagcaatgatctttacgctggccctggcttacggcgccgtcatcatcctgggtgttagcggtaacctggcactctag

SEQ ID NO: 126347 - DNA, 426 bp, Artificial Sequence
  Description of Artificial Sequence: Synthetic coding sequence
atgatggacaagatgcgtgacaacaagtaccgctcaagcgagactaaacggatcaacatcatgctcctgtcgatcgtggttgcatttgctgtgtgctggctgcccctgaccattttcaacacagtctttgactggaatcaccaaatcatcgccacctgcaatcataatcttctcttcctactttgccacttgactgcaatgatttcaacgtgtgttaacccgatattctacggattcctcaacaaaaacttccagcgcgacctgcaattcttcttcaacttctgcgacttcagatcccgcgatgatgactacgagactatcgcaatgtctactatgcatacagacgttagcaaaacatccctgaaacaagctagcccagtcgccttcaagaagatcaataataatgacgataatgagaagatatag

SEQ ID NO: 126348 - DNA, 78 bp, Artificial Sequence
  Description of Artificial Sequence: Synthetic coding sequence
atgaacagcacactgttttcacaagtggaaaaccacagcgtgcacagcaactttagtgaaaagaacgcacagttgtag

SEQ ID NO: 126349 - DNA, 183 bp, Artificial Sequence
  Description of Artificial Sequence: Synthetic coding sequence
atgaacagtacacttttcagtcaggttgagaaccattcagtgcactctaactttagtgaaaaaaacgcacagctgcttgcttttgagaatgacgactgtcatctgcctctggcaatgatcttcaccctcgccctagcgtatggagctgtgattatactcggggtgtcagggaatttggcatag

SEQ ID NO: 126350 - DNA, 1146 bp, Artificial Sequence
  Description of Artificial Sequence: Synthetic coding sequence
atggggcccatcggagccgaagccgacgaaaaccaaaccgtagaagaaatgaaagttgagcagtacggccctcagacgactccacggggggagctcgtccccgatccagaacctgagctaatcgattctacaaagttaatagaggtacaggtcgtgctgatactcgcctattgcagcatcatcctgttgggtgtaatcgggaattctttggtgatccatgtcgtcattaaatttaaaagtatgagaacagtgactaatttttttatagcaaacctagccgtggcagatctgcttgtaaataccctttgcctaccattcacactcacttataccctgatgggagaatggaagatgggccccgtcctgtgccacttagtgccgtatgcccagggtttggccgtgcaggtgagcaccataaccctaaccgtgattgcccttgacagacacaggtgtatcgtgtaccacctggaatcaaaaatctcaaaaagaatcagcttccttatcattggccttgcctggggcatctccgccttgttagccagccctttagcgatcttccgcgaatactcacttattgagattattcctgactttgagatagttgcctgtacggaaaaatggccaggggaagagaagtccatctatggtacagtatacagtctgagctctttgctgatcttgtacgtgttgccgcttgggattatttccttttcgtacactcgaatctggagcaagctgaaaaatcatgtctccccgggagccgccaatgaccactaccatcagcgccgccagaagaccactaaaatgttggtgtgtgtggtggtcgtttttgccgtatcttggctgcctctgcatgcatttcagctggccgttgacatcgatagccaagttctagatctcaaggagtataagttgatctttaccgtgtttcatatcatcgccatgtgctccacttttgccaacccacttctttatggctggatgaacagcaactatcgcaaagccttcctgagcgcctttcgatgtgaacagcgacttgacgccattcattccgaggtgtccgtgacatttaaggccaagaagaacttggaagtccgcaagaacagcggaccaaatgactccttcactgaggcaacgaacgtgtag

SEQ ID NO: 126351 - DNA, 1146 bp, Artificial Sequence
  Description of Artificial Sequence: Synthetic coding sequence
atgggtccaatcggtgccgaagcagatgaaaaccagactgttgaagaaatgaaggtggagcagtatgggcctcaaactacgccacgtggagaactggttcccgatccggaacctgagctaatcgactctactaaactaatcgaagtacaggttgtcctaatccttgcctactgttccattattctcctgggcgtcattgggaactcattagtgatccatgtggttatcaaatttaaatccatgcgtaccgtgacaaatttctttatagccaatttagccgtggccgaccttctcgtcaacacactttgcctgcctttcactttgacatacacccttatgggagaatggaaaatgggacccgttctgtgccacctcgtaccatacgctcagggtctcgctgtgcaagtaagcacaataacactgacggtgatagctttggatagacaccggtgcatcgtgtatcacctcgaaagcaaaattagcaagcgcatcagctttctgatcatcggcctggcatggggtataagcgccctgttggcatcaccacttgccattttccgggagtacagtctgattgaaattatacccgatttcgaaattgttgcatgcactgagaaatggcccggagaagaaaaatcaatctatggcacagtgtactccctgtcctccctactgatcctgtatgtgctgcccctggggattatctccttttcgtatactcggatatggagcaaactgaagaatcatgtgagcccgggggccgccaacgaccactaccaccaacgccgacagaagacaaccaaaatgctggtatgtgtagtggtagtattcgctgtatcatggttgccattacatgcttttcaactggcggttgatatcgattcccaggtcctggacctgaaagaatataaattgatttttaccgtgttccacataatagccatgtgtagtacatttgctaatccacttctgtatggttggatgaattctaattaccggaaagcattcctgtcggccttcagatgcgagcagcggctggacgccatacacagcgaagtaagcgttaccttcaaggccaagaagaatctggaggttcggaagaattccggtcccaacgattcgtttaccgaagccacaaatgtatag

SEQ ID NO: 126352 - DNA, 1338 bp, Artificial Sequence
  Description of Artificial Sequence: Synthetic coding sequence
atggacctggagctggatgagtactataataagactctcgcgacagaaaacaatacggcggctaccagaaactccgacttccccgtgtgggatgactataagtcatctgtcgacgatctgcagtatttcctcatcggactgtacacattcgtatccttattgggtttcatgggaaatctgctaatcctgatggccctcatgaaaaagcggaatcagaaaaccacagtgaactttctgataggtaatcttgccttctctgatatcctcgtggtactattttgctcacccttcacgttgacatccgtacttctggaccagtggatgtttgggaaagtcatgtgtcatatcatgccatttcttcagtgcgtgtctgtgttggtgtctactctcatcctgatcagcatcgccattgtgaggtaccatatgatcaagcatccaatctcaaacaacctcactgctaatcacggctatttccttatcgcaaccgtgtggacgctgggattcgccatttgtagccccctgcctgtgttccattccctggtggagttacaggagacgttcgggagcgcacttttgtcttcaagatatctctgtgtggagtcttggcccagtgacagctatcgtattgcttttactattagcttgctgttggttcagtatatcctgcctctggtgtgcttgactgtgagccacacgagtgtctgtcgctcaatatcatgtgggctgagtaacaaggaaaataggctcgaggagaatgagatgattaatttgacattacatccctccaaaaagagcggaccacaggtcaagctctccggatcccacaagtggagctattcatttatcaagaagcaccgccggcgctactccaaaaagaccgcttgtgtcttacccgcccctgagcgaccctcacaggagaaccacagccgaattcttcctgaaaactttggtagtgttcggagccagctctcttcttcctccaaatttattcccggagtccctacatgtttcgagataaaacccgaggaaaatagtgatgttcacgaactgagggtgaagaggtccgtgaccaggatcaaaaaaaggagccggtccgttttctaccgactgaccatcctgattttagtcttcgcagtaagctggatgcccctgcatctatttcacgttgttaccgactttaatgataatctgatctcaaacagacattttaagctcgtttattgcatatgtcacttgcttgggatgatgagctgttgcttgaacccgatcttatatggattcctgaataatgggatcaaagcggatctggtgtcactgattcattgcttgcacatgtag

SEQ ID NO: 126353 - DNA, 1338 bp, Artificial Sequence
  Description of Artificial Sequence: Synthetic coding sequence
atggacctggaactggacgaatactacaataagactctggccacggagaacaataccgcagctacccgcaattcagacttccccgtgtgggacgattacaagtctagcgtcgacgacctccagtattttttgatcgggctctacactttcgtgtctctgcttgggtttatgggtaatcttctaatactaatggccctaatgaaaaagcggaatcagaaaactacggtgaatttcttgattgggaatctggctttcagcgatatcttggttgtcctgttttgttccccgttcacactaacctcagtcctgttagatcagtggatgttcggcaaagttatgtgccacatcatgccctttttacagtgcgtttcagtgttggtgtccaccctcatcctgattagtattgctatagtgcggtaccacatgataaagcaccctatctctaataaccttaccgccaatcatggctactttctgatcgccaccgtgtggaccctaggattcgccatctgctctcccttgcccgtgttccattccctggtggagctgcaagagacatttggctccgccttattatcctcgaggtacctgtgcgtcgaatcctggccatctgactcttatcgcatcgcctttaccatctctctcctgttggttcaatatatattacctctcgtctgtctgaccgtgtcacacacgtctgtgtgcagaagcatatcatgcgggctctctaataaggaaaacaggctggaagaaaatgagatgattaacctgaccttgcatccatcaaagaagagcggaccacaggttaagcttagcgggtctcataagtggagttatagtttcatcaagaaacataggagacgctattccaaaaagacggcgtgtgtgcttcctgcccccgagagacccagccaggaaaaccacagccgaattttacctgaaaactttggaagcgtccgcagccagctgtcgtcttcaagtaaatttatcccgggagtccctacatgcttcgagattaagcccgaggagaactcagatgtccacgagctacgtgtgaagcgctccgtcactaggattaaaaaacgctctcgcagcgtcttttacagactcacaattctaatcttagtgtttgccgtgagctggatgcccctacacctgttccacgtcgtgacagatttcaatgataatctgatctctaaccgccatttcaagctcgtgtattgcatttgccaccttctggggatgatgagttgttgtctcaacccaatcctctatgggtttctgaataacggcatcaaagccgacctcgtcagcctcattcactgcttgcatatgtag

SEQ ID NO: 126354 - DNA, 1338 bp, Artificial Sequence
  Description of Artificial Sequence: Synthetic coding sequence
atggatctggaattggatgagtattataataagacattggctaccgaaaataatacggctgccacccgtaattcagatttcccagtgtgggacgactacaaatcctcggtggatgatctccagtacttcctgattggcttatacactttcgtcagcctgctgggattcatggggaacctgctcatcctgatggctcttatgaagaagcgtaaccagaagactaccgttaattttctgatcggcaacttggctttctcagacatcttggttgtactgttctgcagccccttcactctgacctctgtgctcttggaccagtggatgttcggcaaagttatgtgtcatatcatgccctttctccaatgtgtctctgtgctcgtttcaacgctgatactaattagcatcgcaatagtccgatatcatatgataaaacacccgatctctaataacctgacggccaaccacggctactttctgatcgctacagtgtggaccctggggtttgcaatctgcagcccgctgccggtgtttcattcactggtcgagctccaagagactttcggctcagcattgctctccagccgctacttgtgcgtcgagtcatggcctagcgatagctataggattgcctttaccatttccctgctcctcgtccagtatattttgccgctggtatgcctcaccgtgagccatactagcgtttgccggagcatcagttgcgggctgtccaacaaggagaacagactggaggaaaatgaaatgattaatctgactttacatccttccaaaaagtccgggcctcaggtcaagctttccgggtcccacaagtggtcctacagctttatcaagaagcaccgccggagatactcaaagaaaacggcttgcgtgctccctgcaccagaaagaccaagccaggaaaatcactccagaatacttcccgaaaactttggatcggtgcgctctcagctgagtagcagttccaagttcatccccggcgtgccaacatgctttgagataaaacccgaggagaactcagatgtgcacgagctcagggtgaaaaggagtgtgacccgaataaaaaagagatctcggagtgtgttctatagactcacaatcttgatccttgtgttcgcagtttcatggatgcccctgcacctatttcatgtggtaaccgattttaacgataacctgatttccaacagacattttaagctcgtgtactgtatatgtcatctgctgggtatgatgtcatgctgcttaaaccccatcctgtacggtttcttaaataatgggatcaaggcagatttggtcagcctgatacactgcctgcatatgtag

SEQ ID NO: 126355 - DNA, 987 bp, Artificial Sequence
  Description of Artificial Sequence: Synthetic coding sequence
atggataacgcttccttttctgaaccgtggccggccaacgcttctggcccagacccggctctttcatgttcgaatgcctcgactcttgcacctctgcctgcacctttagcagttgccgtccctgttgtatatgccgtgatctgcgctgtggggcttgctggcaattcagctgtgctatacgttctgttgagggccccacggatgaagacagtcaccaatttgtttatactgaatctggcaatcgccgatgagctgttcacactggtgttgcccattaacatcgccgatttcctgctcagacagtggcctttcggggaactgatgtgcaaactcattgtggccattgaccagtacaacaccttctcttcattgtacttcctgacggtcatgtccgccgatcgatatctagtcgtgttagctacagcagaatccagacgagttgcaggaagaacctacagcgccgctcgcgctgtgtcactggcagtgtggggtattgtgacccttgtcgtactcccatttgctgtattcgccaggctcgatgatgagcagggccgccgccaatgtgtgctcgtgtttccacagcctgaagctttctggtggcgagcctcacggctttatacattggtgcttggctttgcgattccagttagtacaatctgcgtcctctatactaccctgctctgccggttgcacgctatgcgcctggattcccatgctaaagctttggaaagggccaagaagcgggtcacctttttggtcgtggcaattctggcagtgtgtcttctgtgctggacaccttatcatctctcaactgtagtagcattaactaccgatctgcctcaaactcccctggtgattgccatctcttactttattacaagcctcagctacgctaacagctgtctgaacccctttttgtatgcttttctggatgcatcattcagaagaaacctcaggcagctgatcacatgcagggctgcagcctag

SEQ ID NO: 126356 - DNA, 1599 bp, Artificial Sequence
  Description of Artificial Sequence: Synthetic coding sequence
atgcttgcggagcctttccccaaagtagtggcgagcctgatcatcctgcacttgagtggggccaccaaaaagggtaccgagaaacagaccacctctgagacacagaaaagcgttcaatgcggtacgtggaccaagcatgccgagggtggcatctttacctcaccaaattatccatccaagtaccccccagatcgggagtgcatatacatcatcgaagctgcccctcgtcagtgtatagaattgtacttcgacgagaaatattccatcgaaccaagctgggagtgcaaattcgatcatattgaggtgcgggacggcccattcgggttctctcccataataggacgcttctgtgggcagcaaaaccccccagtgatcaagagtagcggccgattcctatggatcaagtttttcgcggacggggagctggagtctatgggcttcagtgcacggtacaattttacaccagaccccgatttcaaggatctgggggcactgaagccccttccggcctgcgagttcgagatgggcggatcggaagggatcgttgaaagcattcagataatgaaggaaggcaaggccacagcctcagaggccgtggactgtaagtggtatatccgagcccctcctagaagtaaaatctacttgaggttcctggactatgaaatgcagaacagcaatgaatgtaagcgcaactttgtggccgtgtatgatgggtccagtagtgtcgaggatctgaaggctaaattttgttctaccgtagctaacgacgtcatgctacggactggactgggagttattaggatgtgggctgacgagggtagccgcaactccaggtttcaaatgttgttcacatccttccaagagcctccctgtgagggaaacacgttcttctgccatagcaacatgtgcattaacaacacattggtctgtaatggcctgcagaactgcgtctatccttgggacgagaatcattgcaaggaaaagcggaagaccagcttgctcgatcagctaactaatacttctggcacagtgatcggagtcacttcttgcattgtaataatcctgatcatcatcagcgtgatcgtacaaattaaacagccgcgaaagaaatacgtccaacgtaagagtgattttgatcagaccgtgttccaggaagtgtttgaaccaccacattacgaactgtgcacactgcgaggcactggggccaccgctgatttcgctgacgtggctgacgacttcgagaattaccataaactcagacgatcgtcttccaaatgtatccacgatcaccactgtgggtctcagctgtcctctacaaaaggtagtaggtccaatctatccaccagggacgcgagcatattaacagagatgcctacccagcctggcaagcccctgattccacctatgaaccggcggaacattctcgtcatgaaacacagctactcccaggacgccgccgatgcgtgtgatatcgatgagatcgaggaggtgcctactacttcacacaggctgtccaggcatgacaaggccgtacaaagattttgcctcattggctcgctgagcaagcacgagtccgaatataatacaactagagtgtag

SEQ ID NO: 126357 - DNA, 1602 bp, Artificial Sequence
  Description of Artificial Sequence: Synthetic coding sequence
atgattcacgggaggagcgttctgcacatagtggcaagtctgattattctgcacctcagcggcgctaccaagaagggcacagagaagcaaaccacctctgagacccagaagagtgttcagtgcggtacctggacaaaacatgcagaagggggcatattcacgagccctaactatccttctaaataccctcctgaccgtgagtgcatttatattatcgaagccgcccctcgccagtgcattgagctgtactttgatgaaaagtactccatcgagccctcatgggagtgcaagtttgaccatatagaagttcgcgacgggcctttcggtttcagtcctatcatcgggcgcttctgtggccaacagaatcctcctgtgattaagagcagcggaagattcctgtggatcaaattctttgcagacggcgaactggagagcatggggttcagcgcacgttataactttacccctgatccagacttcaaggatcttggagcactgaagccccttcctgcatgtgagttcgagatgggcgggagcgaaggaatcgttgaatccatccagatcatgaaggaaggtaaggctactgcttcagaggccgtggactgcaagtggtacatacgcgcccccccccggtctaaaatatacctgcgcttcttggattatgagatgcaaaattctaatgaatgtaaacggaatttcgtagcagtgtacgacggatcaagcagcgttgaagacctcaaggcaaaattctgtagcaccgtagctaatgacgtaatgctgagaactgggctgggagttatcagaatgtgggcggacgagggtagcagaaattctcggtttcagatgttgtttacttctttccaggaaccgccatgtgagggcaatacgttcttctgccacagtaatatgtgcataaataatacactggtgtgtaacggcctgcaaaactgcgtgtacccttgggacgagaaccattgcaaggaaaagcgcaaaacatctctgctcgatcagctaactaacacgtctgggacggtgatcggcgtaaccagctgtattgtcatcatcctgatcattatctctgtcattgtccagatcaagcagccgaggaaaaaatatgtacagcgcaaaagcgacttcgaccaaactgtcttccaggaagtatttgagccgcctcattacgagttgtgcactctcagaggaaccggtgccacggccgactttgctgacgtcgccgacgacttcgagaactaccacaagcttcgcaggtcctcttccaaatgcatccacgaccatcattgcggcagccagctgtcttcgacgaaaggcagtaggtccaatctttcgacccgggacgcttcaattctaaccgaaatgccgactcagcctgggaagccgctcatcccgcctatgaaccggcggaatatcctagtcatgaagcactcatacagtcaagatgcagccgatgcgtgcgatatagatgaaattgaagaggtgccaaccacttcccaccgtttgagccgccatgataaagccgtccagagattctgcctgattggatcccttagtaagcatgagagcgaatataatacgaccagagtatag

SEQ ID NO: 126358 - DNA, 471 bp, Artificial Sequence
  Description of Artificial Sequence: Synthetic coding sequence
atgctggccgaaccattccccaaggtcgtagctagtctcatcatcttgcacctgtcaggtgccactaagaagggaacggagaaacagactacctccgagactcaaaaatccgtgcagtgcgggacttggaccaagcacgcggaaggggggatttttacttcacccaactatccatctaaataccctccagacagggaatgcatttatatcatcgaggcagcaccccgacagtgcattgagctgtattttgatgaaaagtacagcattgagccgagctgggagtgcaagttcgaccacatcgaggttcgcgacggtcccttcggatttagccccataatcggaaggttttgcggccaacaaaacccacccgtcataaagtctagtggaagatttctttggattaagttcttcgccgacggggagttagagtctatgggtttctcagcacgttataacttcaccccagaatag

SEQ ID NO: 126359 - DNA, 1602 bp, Artificial Sequence
  Description of Artificial Sequence: Synthetic coding sequence
atgatccatggtcggtcggttttgcatattgtcgcttccctaatcatcttgcacctgagtggcgctaccaaaaagggcacagagaaacagaccacttctgaaacccagaagagtgtgcagtgcggtacctggacaaagcacgcggaaggggggatcttcacctctcctaattacccctccaagtatcctcccgatagagaatgtatttatatcatcgaggcagcgcccagacagtgcatcgaactgtacttcgatgagaagtactctattgagccctcatgggagtgcaaatttgatcacatcgaagtcagagatggccctttcggcttctcaccgatcattggccgcttctgtggacagcagaatccacctgtgatcaagtcctcagggagattcctgtggataaaattttttgctgatggtgagctcgagtcaatgggcttcagcgctagatacaacttcacacctgaccccgatttcaaggacttaggagctctcaaacctctgcccgcatgtgagttcgagatggggggatctgagggcattgtggagtcaatccagattatgaaagagggaaaagccaccgccagcgaggcggttgattgtaaatggtacattagagccccgccaaggagtaagatctacttaaggttcttggattatgagatgcagaatagcaatgaatgcaagcgcaacttcgtggccgtgtatgatggttccagtagtgtggaggacctcaaagccaaattctgtagcaccgtagccaacgatgtgatgcttcgaacaggcctcggagtgatccggatgtgggccgacgaaggctctcgcaattcacggtttcagatgttgtttactagttttcaggaaccaccttgtgaaggcaacactttcttctgtcattctaatatgtgtatcaacaatacactggtgtgcaatgggctccagaactgcgtgtacccatgggatgagaaccactgcaaagaaaagcggaaaacgtcactcttggatcaacttactaacactagcggcactgtgatcggcgtaaccagctgcatagtgataatcctaatcattattagcgttattgtgcaaataaagcaaccaaggaaaaagtatgtgcagaggaaaagcgattttgaccagaccgtgttccaagaagtgtttgaaccaccgcactacgagctgtgtaccctacggggaacaggagctacggccgacttcgccgatgtcgccgacgatttcgaaaactatcataagcttcggcggagcagctcaaaatgcatccatgaccaccattgcgggagccaactgagctctaccaaaggcagccggtcgaaccttagcacccgcgatgcctctattttaaccgagatgcctacccagcccggaaagcctctgatccctcctatgaacaggcgtaacattctagtcatgaagcacagttattcacaggacgccgctgatgcctgcgatatcgatgaaatagaagaggtgccgactacttcccataggctgtctagacacgataaagcagtccagaggttctgtctcatcggctctctgtctaagcacgagagcgagtacaatacaaccagagtgtag

SEQ ID NO: 126360 - DNA, 1017 bp, Artificial Sequence
  Description of Artificial Sequence: Synthetic coding sequence
atgtcaggaagcagtctgcctagcgctttagctctctccctgctcctcgtgtccggcagcttgctgccaggacccggtgcagctcagaacgcagggtttgtgaaatcccctatgtctgagaccaagttaaccggcgacgccttcgaactctattgtgacgtggtagggagtcctacccccgagattcagtggtggtatgctgaagtcaatagagctgagtcttttaggcagctgtgggatggagctcggaaacgacgcgttacagtgaatactgcatacggttctaatggcgtgagcgtgctgcgcattacacgcctgacactggaggattcagggacatacgagtgcagagcttccaacgatcctaagagaaacgatctccgccagaatccatctattacctggatacgtgcacaggccactatcagtgtcttgcagaagcccagaatagtgacctccgaggaagttatcattcgggattcccctgtcctgcctgtgacactgcagtgtaacctgacctcctcttcccatacactgacctattcttattggaccaagaacggagtagaactgtcagccacccggaaaaacgccagcaatatggagtatcgcatcaataagccccgggcagaagacagtggggagtatcattgtgtctatcactttgtgagtgcacctaaggctaatgcaactatagaagtaaaagccgcccccgacattacaggtcataaaaggagtgaaaacaaaaatgagggacaggacgctacaatgtactgcaagagtgtggggtacccccacccagactggatttggcggaagaaagaaaacggcatgcccatggacattgtgaatacgagcgggaggtttttcattattaacaaagaaaattacaccgaactcaacattgtcaatctccagatcaccgaggaccctggagagtacgagtggtgcggtgctacatggccacactctggactctcgtgggagttctggttgaaactttcctcactgtggtag

SEQ ID NO: 126361 - DNA, 1197 bp, Artificial Sequence
  Description of Artificial Sequence: Synthetic coding sequence
atgagcggaagcagcttacccagcgctctcgcactatctctacttctggtctctgggtctttactgcctggaccaggcgcggctcagaatgctggattcgtgaagtcccctatgtccgagaccaagcttacaggagacgcttttgaactgtattgcgatgttgtcgggagccctacaccagagatccagtggtggtatgcagaggtgaatagagcagagagcttccggcaactgtgggatggtgccaggaaacgcagggttacggtaaacaccgcctatggaagcaacggagtgtccgtgttgcgaatcactcggttaacattggaggactcagggacttatgagtgtagagcctctaacgaccccaaacgtaatgacttgagacagaacccatctattacgtggatccgagcccaggccaccatttcggtcctccagaagccgcgcatcgttacgtccgaggaagtgattattcgggactctcccgtgctccccgtgactctacagtgcaatcttacgtcctcatctcatacccttacgtacagctattggaccaaaaacggagtggagttaagcgccacaaggaaaaatgcctcgaacatggagtatcgtattaacaagccacgcgcagaagacagcggcgagtatcactgcgtttaccatttcgtgtccgcccctaaggctaacgctacaatcgaggtcaaggccgcccccgacatcacaggccataagcggagtgagaacaagaacgagggacaggatgcaaccatgtattgtaaatctgtcggataccctcaccccgattggatttggagaaaaaaggaaaatggcatgcccatggatattgtgaatacatccggacggttcttcataattaataaggagaactacactgagcttaacatagtgaatttgcaaatcacggaggaccccggagaatatgagtgtaatgcaacaaatgcaattgggtcagcaagtgtggtgactgtgctgcgcgttagatcgcatttggccccactgtggccctttctgggcattctcgcggagatcatcattttggtggtgattatagtggtgtacgaaaaacggaagagaccagacgaagtccccgacgacgacgaacctgccggtccaatgaagaccaactccaccaacaaccataaggataagaacctgagacagagaaacaccaattag

SEQ ID NO: 126362 - DNA, 849 bp, Artificial Sequence
  Description of Artificial Sequence: Synthetic coding sequence
atgagcggttcatcccttccctccgctctagcactctctctcctcctagtcagcgggtcactacttcctgggcctggggcagcgcagaacgaacctcggatcgtgactagtgaggaagtgatcatccgtgactcacccgtcctgcctgtgacccttcagtgcaatttgacctctagctcacatactctgacgtacagctattggactaaaaacggcgtcgagctgagcgccactcgcaagaacgctagtaatatggagtacaggattaataaaccccgagccgaagactctggggagtaccactgcgtgtatcattttgtgtcggcaccaaaggcgaacgctacaatcgaagtgaaggccgccccagatattactggacacaaacgaagcgaaaacaaaaacgaaggccaggacgccaccatgtactgcaagtccgtgggttatccccaccctgactggatctggcgtaagaaggaaaacggaatgcccatggacatcgtgaacacttctggacggttttttatcattaataaggagaactatacagagttgaacatcgtgaatctgcaaattaccgaagatccaggcgagtacgagtgtaatgccacaaacgctataggcagcgcctcagtggtgactgtgttacgcgtgcgttctcaccttgctccactgtggcctttcctgggcatactggctgaaattatcatcctcgtggtgatcatcgttgtgtacgagaaacggaaacggccagatgaggtgcctgatgatgacgaaccggcaggtccaatgaagacgaatagcaccaataaccataaggataagaacctgcgccagcggaacacaaactag

SEQ ID NO: 126363 - DNA, 582 bp, Artificial Sequence
  Description of Artificial Sequence: Synthetic coding sequence
atgagcggtagttccctgcccagtgccctcgccctatctctgctgttggtgagcggttctctcttgcctggacccggtgccgcccagaatgcggcccctgacattaccggccacaagcgctctgaaaataagaacgaaggtcaagatgcaacaatgtactgcaaaagcgtcggctacccccatcctgactggatctggaggaagaaagaaaacgggatgcctatggatatagtcaacacctctgggagattttttataatcaataaggagaactataccgagttgaatattgtgaacttgcagatcaccgaggacccgggagaatatgagtgtaatgccacaaacgcaatagggagcgccagcgtggttacggtgctaagagtccggtcacatctggcgcctttatggcccttcttgggtattcttgccgaaatcatcattcttgtggtgatcattgtggtgtacgagaaacggaagcggcccgatgaagtgcccgacgacgatgagcctgcagggccaatgaagacaaacagtacgaacaaccacaaggataagaaccttcgccagcgcaacaccaattag

SEQ ID NO: 126364 - DNA, 1185 bp, Artificial Sequence
  Description of Artificial Sequence: Synthetic coding sequence
atgagcgggagcagtctgccaagcgctcttgcactgagcctactgctcgtgtctgggagtttgctacctggccccggtgctgcacaaaacgccggctttgtgaaatcccccatgtccgagacgaagttgaccggcgacgcgtttgagctttactgtgacgtcgttgggagcccaactcctgagattcaatggtggtacgccgaggtcaatcgagccgaaagctttagacaactctgggacggggcacgaaaaaggagggtgaccgttaacaccgcctatggcagcaacggggtaagcgtgctgcgcatcacgagactaacgttggaagactcaggcacctatgaatgcagagcaagcaatgatccaaagagaaatgatttgaggcaaaatccttcaattacctggatcagggcgcaagctactatttctgtgttacagaagccacgcatcgtgacttcagaagaggtcattatcagggactctccagtattacctgtgacattgcagtgcaacctcacttccagctcacacaccctgacatattcttactggacgaaaaatggggtcgagttgtctgcaacacgcaaaaatgcttccaacatggaatacagaatcaataagcccagagccgaagacagtggagaataccactgcgtctaccactttgtgtcagcacccaaagctaatgccacaatagaggtcaaggctgcacctgatatcacgggacataagaggagcgagaataagaatgaaggtcaggatgcaactatgtattgtaagagcgtagggtatccccaccccgattggatctggagaaagaaggaaaacggtatgcctatggacatagttaacacctcaggtaggttttttatcatcaataaagagaactataccgagctgaacattgtgaatctgcagatcacagaggaccctggcgagtatgaatgtaatgctacaaatgctatcggaagtgcctctgtcgtgacagttctgcgtgttcggagccatctcgcaccgctttggccgttcctgggcatcttggcagagatcattatcctggtggtcattatcgtggtttacgaaaagagaaaacgcccagacgaggtaccggatgttcctccgagaaagacaaactctaccaataatcacaaggacaaaaacttgaggcaaagaaatacaaactag

SEQ ID NO: 126365 - DNA, 513 bp, Artificial Sequence
  Description of Artificial Sequence: Synthetic coding sequence
atgatggcgggtatgaagatccagctcgtgtgcatgctcttgctggccttctcttcttggtcgttgtgtagcgattcggaggaagagatgaaagccctggaggctgatttcttgaccaacatgcatactagcaagatatcaaaagcacatgtcccgagttggaagatgaccctccttaacgtgtgctccctggttaacaacctcaactctcctgctgaggaaaccggcgaggtccacgaggaagaattggtggctagacggaaattgcccactgcattggacggtttctccttggaggccatgttgacaatttaccagctgcataaaatttgccattctcgcgctttccagcattgggaattgatccaggaggatattttggacaccggtaacgacaagaatgggaaagaggaggtcatcaagcgaaaaatcccatacatacttaaacgccagctgtacgagaataagcctcgtcggccttatatactcaaacgggatagttactactattag

SEQ ID NO: 126366 - DNA, 348 bp, Artificial Sequence
  Description of Artificial Sequence: Synthetic coding sequence
atgaccctcctgaatgtgtgctccctggtcaataacctgaattcccctgccgaagagactggtgaagttcatgaggaggagcttgtggcacgaaggaagctgcctaccgccctggacggatttagtctggaagctatgctgacaatctaccaattgcataaaatttgtcactccagagcatttcagcactgggagttaatacaggaagatatacttgatacggggaacgacaagaacggtaaggaagaagttattaagcgcaagattccctacatccttaagcggcagttatacgaaaataagccgcgtagaccctacatcctcaagagagactcctactactactag

SEQ ID NO: 126367 - DNA, 288 bp, Artificial Sequence
  Description of Artificial Sequence: Synthetic coding sequence
atgatggccgggatgaagattcagctggtctgtatgcttctcctagcgttctcatcatggtctctttgttccgacagtgaggaagagatgaaagcactggaagcagactttctcacgaatatgcacacctccaagctaattcaggaggatattttagatacagggaatgacaaaaacggcaaggaagaagttatcaagcgtaaaattccgtacatcctgaagcgccagctgtacgagaacaagccgaggcggccttatattttgaagcgcgattcttactactattag

SEQ ID NO: 126368 - DNA, 1257 bp, Artificial Sequence
  Description of Artificial Sequence: Synthetic coding sequence
atgaggctgaacagcagtgcgccagggacgcccggaacccccgctgccgacccattccagagggcacaagctggtctggaagaggcccttctggcacccggcttcggtaatgcatctgggaacgctagcgaacgcgttctggccgcgccatccagcgagctcgacgtgaatactgacatttactccaaagtcctggtgacagcagtttacctcgctttgtttgttgtggggacagtgggcaataccgttaccgcgttcacactcgccagaaagaaaagcctgcagtctctccagagtaccgtgcactatcacttaggatcgcttgcgctgagcgacctgctgacactcttgctagctatgcctgttgagctgtataactttatctgggtccaccatccctgggcatttggagacgccggttgtagaggctattacttcctgcgcgacgcctgtacctacgctactgcgctgaatgtggccagtctgtcagttgagagatatctggctatatgccacccttttaaggcaaaaactctgatgtcgcgatcccgtactaaaaaattcatatcagccatatggctcgccagcgctctactggctgtgcctatgttgttcaccatgggtgagcagaatagatccgcagacgggcaacatgctggaggactcgtctgcacccccactatacatacagctacggtcaaggtcgtcattcaggttaatacttttatgtcctttattttccctatggtggtcatttccgttctgaacaccattattgcaaacaagctgaccgtgatggtgaggcaggcagccgaacagggtcaagtttgcactgttgggggagagcattcaactttcagtatggccatcgagcctgggagggtgcaggccctcagacacggtgtgcgcgtgctccgggctgttgtcattgcgttcgtggtgtgctggttgccttaccacgtgcggcgtctcatgttctgttacataagtgatgagcagtggaccccgtttttgtacgatttttatcactacttctacatggtcactaatgccctattttacgtctcctcaacaatcaacccgattctttacaacctggtcagcgctaatttccgccacattttcttggcaaccctagcctgcctatgccccgtttggcgaagacgaagaaagcgtcccgccttctccagaaaagccgacagcgtgtcttcgaaccacacgcttagttccaatgctacccgggagaccctgtattag

SEQ ID NO: 126369 - DNA, 951 bp, Artificial Sequence
  Description of Artificial Sequence: Synthetic coding sequence
atgggcgtgtgcggttacttgtttctgccatggaagtgtcttgtagtggttagcctgcgcttactgtttttagtgcccacaggagtgccagtgaggagcggggacgccaccttccctaaagccatggataatgtcaccgttcgccagggtgaaagcgccacactccggtgtaccattgataatcgcgtgacccgggtggcgtggctcaaccgtagcacaatcctatatgccgggaacgacaaatggtgtcttgatcctcgcgtcgtgctgctgagtaatacgcaaactcagtacagtatcgaaatccagaatgtggacgtgtacgacgaggggccgtatacctgttctgtccagactgataaccacccaaaaacttctcgtgtccacctcattgtccaggtgagccccaagatagtggagatttcttccgacatctcaatcaacgagggcaataatatttcgttgacatgcatcgctaccgggcgacccgagcctactgtgacttggcgccacatatcaccgaaggctgtgggtttcgtatctgaagacgaatacctagagatccaaggcatcacccgcgaacaaagtggtgactatgagtgttccgcttcaaacgacgtggccgcacctgtggtaagaagggtgaaggtgaccgtgaactaccccccatatatatctgaagccaagggcacaggagtcccggtgggacagaagggcaccctccagtgtgaggcctccgccgttccatccgctgaatttcaatggtacaaggatgacaagcggcttattgaagggaaaaagggtgtgaaggtagagaaccgccctttcttgagcaagttaatcttcttcaacgtcagtgaacacgactatggcaattacacgtgtgtcgcgagcaacaagctaggacacacaaatgcaagcattatgctttttggcgaaacggtgctgtag

SEQ ID NO: 126370 - DNA, 1035 bp, Artificial Sequence
  Description of Artificial Sequence: Synthetic coding sequence
atgggagtgtgcggatatctctttctgccttggaagtgcttggttgtggtctcactccgcctgctgtttctcgtcccaacaggcgtgccagtgaggtcaggggacgctacgttcccaaaagcaatggataatgtcaccgttaggcagggggagagtgccactctgcgttgcacaatcgataatcgtgttacaagagtcgcctggctgaataggtccaccattctgtacgccggaaacgacaaatggtgcttggatccccgtgtcgtattgttatctaacacacagacacagtattccatcgagatccagaatgtggatgtgtatgacgaggggccgtacacttgcagcgtgcagacagataatcatccaaagacgtctagagtgcatctaattgtccaggtgtcaccaaagattgtagagatctcgagcgacataagtataaatgaaggaaataatatctctcttacctgtatcgctaccgggagacccgagcccacagtgacttggagacatatctcacctaaggctgttgggtttgtctccgaagacgaatacctggagatacagggcattactcgcgagcagagcggtgattatgagtgttctgcaagcaacgacgtggcggccccagtggttaggagagtgaaagttaccgtgaactaccccccatatatcagcgaggctaaaggcactggggtgccagtcggtcaaaaggggactctccagtgtgaagccagtgccgttccctctgccgaatttcagtggtacaaagatgacaaacgcctgatcgagggaaaaaaaggcgtaaaagtggagaaccggccttttttgtccaaacttatattcttcaatgtctcagagcatgattatggcaactatacttgcgtcgccagcaacaaactaggccataccaatgcaagtattatgctttttgggcctggtgccgttagtgaagtctcaaatgggacctccaggcgtgctggttgcgtgtggcttctgcctctgctagtgctgcatctgctgctcaagttctag

SEQ ID NO: 126371 - DNA, 1035 bp, Artificial Sequence
  Description of Artificial Sequence: Synthetic coding sequence
atgaaaacaattcaacccaaaatgcataacagtatctcgtgggccatcttcaccggcttggcagccttgtgtcttttccagggggtgcctgtgagaagcggagacgccacctttcccaaggcaatggataatgtgacggtcagacaaggggaaagcgccacgctacggtgtacgattgataatagagttacccgcgtggcctggctcaaccgaagcaccattttgtacgcgggcaacgacaaatggtgcctcgatccccgtgtcgtgctcttatccaacacccagactcagtacagtatcgaaattcagaatgtggacgtgtacgacgagggcccttacacatgtagtgtgcaaacagacaaccatccaaaaacaagccgtgtgcacctcatcgtgcaagtgagccctaagattgtagaaatcagttctgatatcagcatcaacgaaggaaataatattagcctaacatgcatagctactgggaggcccgaacctactgtcacgtggagacatatcagtccgaaggccgtgggcttcgtctcagaggatgagtacttagagatccaaggcattacacgggagcagtcgggtgactacgagtgctctgcttcaaatgatgttgctgcccctgttgtcagaagagtcaaggtgaccgtgaattatcctccctatatttccgaggcaaaaggcacaggggtgccagttggccagaagggaacattgcagtgtgaggctagcgcagtccccagtgctgaattccagtggtacaaggatgacaagcgactgattgagggcaaaaagggtgtaaaagtggagaaccggcccttcctgagcaagcttatttttttcaatgtatctgaacacgactatggcaactacacatgtgttgcatctaataaactaggacatacaaatgccagtatcatgctctttggtcctggcgccgtcagcgaagtttctaacggcacgtctcggagggccggttgtgtttggcttctgccgcttctggttcttcacttactgctgaaattctag

SEQ ID NO: 126372 - DNA, 1041 bp, Artificial Sequence
  Description of Artificial Sequence: Synthetic coding sequence
atgaatggcaagcgaaacggggagggaggcaaacggtggaagtggaaagggactggggtgcccgtgcggtcaggcgatgcaacttttccaaaagctatggacaatgttacagtaaggcagggcgaatctgccacccttcgatgcactatcgacaaccgcgttactcgcgtcgcctggctgaaccgatccacaatactctacgccggaaacgataagtggtgtttggatcccagggtcgtgcttttgtccaatacacaaacccagtattcaattgagattcagaatgttgacgtgtacgacgagggcccttatacctgctctgtacaaaccgacaatcaccctaaaacttctcgtgtacacctaatagtacaagtttcaccaaaaattgtcgagatttcctctgacatcagcataaatgagggtaacaacattagcctaacctgtatcgctacgggtcgacccgagccgaccgtgacgtggcggcacatcagcccaaaagcagtgggcttcgtgtctgaagacgaatatcttgagatccagggcattacacgggagcaaagcggagattatgagtgctccgcaagtaatgatgtagccgcccctgtagtccgaagggtgaaggttactgtgaattaccccccttatattagcgaagctaaggggaccggtgtccccgtgggccagaagggaacactgcagtgtgaggcttccgccgtcccatccgccgagttccaatggtacaaggatgataagcgtctgattgagggcaaaaagggggtgaaggtcgaaaacagaccatttctgagcaaactgatcttttttaatgtctctgagcacgattatgggaactacacctgcgtagcctccaataagctgggacacaccaatgcctctatcatgctgttcgaggtgaagacaaccgcactcactccgtggaagggaccgggagctgttagcgaagtcagtaacggaactagccggcgggcgggatgcgtctggttactgccccttctcgtgttacacctgctcttgaagttctag

SEQ ID NO: 126373 - DNA, 1068 bp, Artificial Sequence
  Description of Artificial Sequence: Synthetic coding sequence
atgaaaacgatccagccgaaaatgcacaactctatctcatgggccatttttacagggttggccgcgctatgcctgttccagggggtccctgtgagaagtggtgatgccacttttccaaaggccatggacaacgtcacagtacggcagggagaatctgccacattgcgctgcaccatcgacaaccgcgtaacacgtgtcgcttggttgaaccgctcgaccattctctatgctggcaacgataagtggtgcttggatcctagagtcgtccttctgagcaacacacagacccaatacagcatagagatacagaacgttgacgtgtatgatgagggcccgtacacatgcagtgttcagactgataatcacccaaagacaagccgggttcatctaatcgtccaggtgtcacctaagatagtggaaatttcttccgatatatctattaacgaggggaacaatattagtctgacatgcatcgctactggccgccccgaacccactgttacgtggaggcatatctcacctaaggcggttgggtttgtcagcgaggacgagtacctcgagattcaaggaattactagagaacagtctggtgattacgagtgttccgcgtctaatgacgtagcagctcccgtcgttcgccgggtgaaggtgaccgtgaattaccccccgtacatctccgaagcaaaaggtaccggggttccagttggccagaaggggaccctccagtgcgaggcttccgcggtccccagtgccgagtttcagtggtataaggacgacaaaaggttgatcgagggaaaaaaaggtgtaaaggtagagaatcggccttttctgtctaagctgatcttctttaacgtgtccgagcatgactacggcaactatacctgcgttgcatcgaataaacttggccatactaatgcttccattatgttattcgaggtcaagaccacagccctgacaccctggaagggccctggcgccgtctccgaggtgtccaacggaacgtcccgacgggccggatgcgtgtggctgctgccgctcctggtgctccatcttctgctaaagttttag

SEQ ID NO: 126374 - DNA, 1068 bp, Artificial Sequence
  Description of Artificial Sequence: Synthetic coding sequence
atgggggtgtgtgggtaccttttcctgccttggaaatgcttggtggtggttagcctacgcttgttatttttggtgcctacaggggttcccgtacggtcaggggacgcaacttttccaaaagcaatggataacgtgacagttcggcagggcgagtctgctacactgagatgcacaattgataaccgcgtgacccgcgtcgcctggctaaataggtcgactatactctatgctgggaatgacaagtggtgccttgatccccgcgtggtccttttaagtaacacacagacccagtacagcatcgaaatccagaatgtggatgtgtatgatgaagggccttacacttgtagcgttcagacggacaaccatcctaaaacctcacgcgtgcatctgattgtccaggtcagccctaagatcgtcgaaatcagcagtgacatatcaatcaatgagggaaacaatattagcctgacttgtattgcgactggtcgtcctgaacctaccgtcacttggcgccatattagccctaaggctgttggcttcgtaagcgaggatgagtatctggaaatccagggtataactagggagcagagcggggactatgagtgttcagcaagtaacgacgtggccgccccagtggtacgaagggtcaaagttacagtgaactacccaccatatatatcagaagcaaagggtactggcgtgccagtgggacaaaagggaactctccagtgcgaagcgagtgccgtcccatccgccgagttccaatggtacaaggacgataaacggttaattgagggtaagaaaggagtgaaggttgagaaccgcccgttcctgagtaagttgatctttttcaatgtatcagaacacgactatggcaactacacctgtgtggcttctaacaaactgggccatacaaacgcatctattatgctgttcgaagtgaagaccaccgcactgaccccatggaagggacccggtgcagtcagcgaagtcagtaatggcacaagtagacgggccggttgtgtctggctccttcccctgctggtgctgcatctcttgctgaaattctag

SEQ ID NO: 126375 - DNA, 2373 bp, Artificial Sequence
  Description of Artificial Sequence: Synthetic coding sequence
atgctgagagggggacgtcggggacagctcgggtggcatagttgggcagccgggccaggaagcctgctggcatggctgatcctagccagcgccggtgccgccccttgcccggacgcttgctgtccccacggcagttccgggttaagatgcactagagatggagcattggacagcctccaccatttaccaggagcagaaaatctcacggaactgtacattgaaaaccagcagcacctgcagcatctggaactgcgcgatctgagaggcctgggtgaattgcgtaacctgaccatcgtcaaaagcggcttaagatttgtggcacctgacgccttccacttcacgccaagactaagccggctgaacctttcattcaacgctctagagagtctgagttggaaaacagtacaggggctgtctctgcaagagctcgtgcttagcggtaacccactgcattgttcctgcgcacttaggtggctccagcggtgggaggaagaaggcctgggaggagtaccagagcagaagctacagtgtcatggccaggggcctctagctcacatgccaaacgcctcctgtggggtgccgactctcaaagtacaggtacctaacgccagcgtggatgtgggggacgacgtgctgctgcgctgccaggtcgagggcagaggactggagcaggctggttggatacttacagaactggaacaaagcgccacagtcatgaagtccggaggccttccctcactggggctaacccttgccaacgtcacttcggacctgaaccgaaaaaacgtgacttgctgggctgaaaatgatgtggggcgagccgaggtgagtgtccaggtgaatgtgtcgttcccggctagcgtgcagctgcataccgctgtggaaatgcatcattggtgcatacccttttccgtcgacggccagccagctccaagtcttaggtggctgttcaacggttcggtgttaaacgagacatcctttatttttacagagttcttagagcctgccgccaacgagacagtgaggcacggctgtctgcggctgaatcaaccaacccatgtcaacaacggcaactacacccttttagccgcaaacccattcggccaggcttcagcgtctattatggcagccttcatggataatccattcgaattcaatcccgaagaccctattcccgatactaacagtacgtccggcgaccctgtggagaaaaaagatgaaacaccttttggtgtctctgttgccgtcgggctggcggtgtttgcttgccttttcctcagcacgcttctgctggtcctcaataaatgcggccggcgcaataaattcggtatcaaccgcccagccgtcctcgccccagaggacggattggccatgtctttgcatttcatgactttggggggcagctccctctcacccacggagggcaaagggtcaggactgcaaggccacattatagagaacccacaatatttctccgatgcatgcgtgcaccacatcaaacgcagggatatcgtcttgaaatgggagttaggggaaggtgcttttggtaaggtctttctggccgagtgtcacaatctcctgcctgagcaggacaagatgctcgtcgcggttaaagcattaaaagaggcaagcgaatctgctcgccaggacttccagcgggaggccgagttattaacaatgctgcagcaccaacacatcgtacgattcttcggggtctgtactgagggtaggccgcttctgatggtattcgagtacatgaggcacggagatctgaataggttcctgagaagtcacggaccagacgccaagctgctagctggaggagaagatgtcgccccaggtcctttggggctggggcagctgttggctgtggcgtcccaggttgctgccggaatggtgtatcttgccggactgcactttgtccatcgcgatctggctacccgtaattgtttggtcggacagggacttgttgtaaaaatcggcgactttgggatgtctcgtgatatttattccacagattactacagagtcggaggtcggaccatgctgcctataagatggatgccgccagagagcattctgtatcggaagtttactactgagtcagacgtgtggtcgttcggagtggtactgtgggagatttttacatatggcaagcagccgtggtaccagctgagcaataccgaagccatagactgtatcactcagggccgggaactcgaaaggccccgggcgtgtccgcctgaggtgtatgctattatgagagggtgttggcagagagaacctcaacagcgtcatagtatcaaggatgtgcacgcaagactgcaagcactggcccaggctccaccggtgtacctcgatgtgctgggctag

SEQ ID NO: 126376 - DNA, 2283 bp, Artificial Sequence
  Description of Artificial Sequence: Synthetic coding sequence
atgaaagaagctgcactaatctgcttggctccctccgtgcctcccattctcaccgtcaagagttgggacactatgcagctgagggctgcacggagcagatgtaccaatctccttgctgcgagttacatcgagaaccagcaacatctgcagcatctagaacttcgtgacctcagagggcttggggaacttcgaaacctgaccattgtgaaaagtggcctccgatttgttgccccagacgccttccactttactccccgactctcccggttgaacctcagcttcaatgcattggaaagcctgtcttggaaaactgtgcagggattatccctccaggaactcgtgctgtctggcaatcctcttcactgctcatgcgcgctgaggtggttacagcgatgggaggaggaggggttagggggagtgccggaacagaagctccagtgccacggccagggaccccttgcccacatgcctaacgcctcctgcggcgtgcccacactgaaggttcaggtaccaaacgcttccgtggatgtaggggacgacgtgctgcttcggtgccaggttgagggccgaggcctggaacaggcagggtggatcctgacagagctcgagcagtccgccactgtcatgaaatccggcggcctcccttctctgggtttaacattggccaacgtaacctccgacttgaaccggaagaacgttacttgctgggctgaaaatgacgtcggcagagccgaagtgtcagtccaggttaatgtgagctttccggcgagtgtgcaactgcatacagctgttgaaatgcaccactggtgcatcccttttagtgttgatggtcagccggctccctctctgagatggctgtttaacggttcagtgctgaacgagaccagctttatctttacagaatttctggaaccagctgccaatgagaccgtccggcatggctgccttaggctgaaccagcctactcatgttaacaacggcaattacactcttcttgcagccaatccattcggacaagcctctgcgtccattatggcagcattcatggataacccctttgagtttaatcctgaggatccaatcccagacacaaactccacaagtggcgaccctgtggaaaagaaagatgaaacaccctttggagtgtccgttgccgtaggtttggcggtcttcgcatgtctcttcctctctaccctgttgctcgtccttaacaagtgcggaaggcgaaataaatttgggatcaatagacccgccgtacttgctccggaggacggattagctatgtccctccacttcatgaccctcggcggcagctctctaagtccgaccgagggcaagggtagcggtctgcagggacacataatcgaaaacccgcagtatttttcagacgcttgcgtgcatcacatcaagcgaagagatatagtgctaaagtgggaactgggagagggcgcatttggcaaagtgtttcttgcagagtgccacaacctgctccccgaacaagacaagatgctggtcgctgtcaaggctctgaaagaagcctcagagtctgcccggcaggatttccagcgagaggcagagcttcttacgatgttgcaacatcagcatatcgtgaggtttttcggtgtgtgtaccgaaggacgaccactgctgatggtttttgaatatatgagacacggtgatctgaataggtttctgcggtctcacggaccagatgcgaagcttctagcaggtggtgaggatgttgctcctggccctcttggactgggccagttgctcgccgtggctagccaggttgccgctggtatggtttacctggccggattgcattttgtccacagggacttggccacacgaaactgtttagtcggccagggcttagtcgtgaagatcggtgacttcggaatgtccagggacatttactccaccgactattatagggtaggcgggcgcacgatgctgcccatcagatggatgccccctgaaagtattctgtaccgcaagtttacaacagagagtgatgtgtggtcctttggagtagtgctctgggagatcttcacttatgggaagcagccgtggtaccagctgtccaacactgaagcaatcgactgcatcacccaagggcgtgagcttgaacggcctcgagcttgtcctcccgaggtgtatgccattatgaggggatgttggcaaagggaacctcagcaaagacacagtatcaaagatgtccatgctagactccaagccctggcccaagctccacctgtgtacctggacgtcctcggttag

SEQ ID NO: 126377 - DNA, 2391 bp, Artificial Sequence
  Description of Artificial Sequence: Synthetic coding sequence
atgctccgaggaggccgacgtgggcaactgggatggcatagctgggctgccggcccagggtcccttctggcctggctaatactggccagcgccggggccgccccatgtcctgatgcttgctgtccgcacggtagctccggtctccgctgcacgcgagatggggccttagacagcctgcaccatcttcctggcgccgagaatctcacagagctatacatcgagaatcagcagcatctgcagcacctggaactgcgcgacctccgtggcctgggtgaattaagaaatctcaccatcgtgaagtcaggtctgcgattcgtggctcctgatgcatttcactttacccccaggttgtcccggctcaacctaagctttaatgctctggaatctctgagctggaaaaccgtgcaaggcctttctcttcaggagctggtgcttagtggtaatccgcttcattgttcttgcgccctgcgctggctgcagagatgggaggaggagggactggggggcgtccctgagcagaaattgcagtgccatggtcagggaccgcttgcacatatgcccaatgccagctgtggcgtgccgactttgaaggtacaggtgcccaatgcctccgtcgatgtcggggacgatgtcctgctccgttgccaggttgagggtagaggcctggagcaggccggatggatcctaactgagttggagcagagcgcaaccgtgatgaagtctggtggcctaccgagcttgggtcttactctcgcaaacgtcacatctgacctaaaccgcaagaacgttacgtgctgggcagagaacgatgttggacgcgccgaggtgtccgtgcaggtgaatgtttctttccccgcgagcgtccagttacataccgctgtggagatgcatcactggtgcatccctttctctgttgacgggcagccagccccttcattgcgctggttattcaatggcagtgttctgaacgagacatcctttatctttaccgaattcttggaacctgccgcaaatgagactgtgcgccacgggtgcctgaggttgaaccaacctacacatgttaacaatggaaattacactctacttgctgccaatccattcggccaagcaagtgcgagcattatggcagcatttatggataatccctttgagttcaaccctgaagatccgatccccgtgagcttcagcccggtcgatactaactcgacctcaggggatcctgtggagaagaaagacgagacccccttcggggtctcagtagccgttggactggcagtgttcgcctgcctgttcctgagtaccctgttactggtccttaataagtgtggccgccgaaataagtttgggatcaaccgtccagctgtgcttgcccccgaggatgggctcgctatgtccctacacttcatgaccctgggcggttcgtctctatccccgactgaggggaaaggcagcgggctccaggggcatataatagaaaacccacagtacttctctgacgcttgtgtccaccacatcaagcggagagacatagtgcttaaatgggaactcggtgagggcgctttcggcaaagtgttcctggccgagtgccacaatcttctgcccgaacaggataaaatgctggtggcagttaaggcccttaaagaggcctccgaaagcgccagacaggatttccagcgcgaggcagagcttctaaccatgctgcagcatcagcacatagtacgattcttcggagtatgcactgaggggcgaccactcctaatggtctttgagtacatgaggcatggggacctgaatagattcctgaggagtcacgggcccgatgccaagctgctggccggtggggaggatgtggctcctggtcccctgggactcggccagctgctcgccgtcgcctcgcaggtggccgccggcatggtctacctagctggactgcatttcgtgcatcgagatctcgcgacccggaactgcttagtgggacaggggcttgtcgttaaaattggcgactttggcatgagccgcgatatctactccaccgattactaccgagttgggggcagaactatgcttcccatccgatggatgccccccgagtctatcttatatcgaaagttcacaactgagtctgatgtttggtccttcggtgtggtgctttgggaaatttttacttatggcaagcagccctggtatcaactgtccaacactgaggcaatagattgcatcactcagggccgggagttagagagaccaagggcctgccccccagaggtttatgctatcatgagggggtgttggcagcgggagcctcagcagaggcatagcatcaaggacgtccatgcccggctgcaggctctggcacaggcccctcccgtgtacctggacgtgcttggatag

SEQ ID NO: 126378 - DNA, 2517 bp, Artificial Sequence
  Description of Artificial Sequence: Synthetic coding sequence
atgagctcgtggatccgatggcacggccccgctatggccagactgtgggggttctgttggttagttgtgggcttttggcgggccgccttcgcctgtcctacgtcatgcaagtgctcagcctcgaggatttggtgctctgatcccagcccgggaatcgttgccttcccgagactggagcccaatagcgtggatccagagaatattacagaaatctttatcgcaaaccagaaacgactggagatcatcaacgaggatgatgtcgaggcctatgtcggtcttagaaacctgactattgtagactccggcttgaagttcgtggcacacaaagccttcctgaagaattccaatcttcagcacatcaactttactcggaacaaattgacctctctcagtcgcaagcacttccggcacctggaccttagcgaattaattctggttggcaacccattcacctgttcttgcgatataatgtggattaagactcttcaggaggccaaatcctctccagatacacaggacctctactgcctaaacgagagtagcaaaaatatacctctggccaacctacagatccctaactgtggcctgccttccgcaaatcttgctgcaccaaatctgacagtggaagaggggaagtcaatcactctgagctgctccgtcgccggcgaccctgtgcccaatatgtattgggacgtgggaaatctggtttcaaagcatatgaatgagacctcgcacacacaggggtccttacgaatcaccaatatttctagtgatgattcaggcaagcaaataagttgcgttgcagaaaacttagtaggggaggatcaggactcagtaaacctcacagtacacttcgctccaaccattacatttctagaatccccgactagcgaccaccattggtgcatcccatttaccgtgaagggcaacccaaagcccgctctccagtggttttataatggcgcaattctcaatgaatcgaagtacatctgtactaaaattcatgtaactaatcacactgagtaccacgggtgtctccaattggacaaccccacacatatgaacaacggagactacaccctgatagctaagaacgagtacggcaaggacgagaagcagattagcgcccactttatggggtggccaggaatagatgatggcgccaatcctaactaccctgacgtaatttatgaggattatgggaccgctgccaacgatataggcgacacaaccaataggagcaatgagatacccagcaccgacgttacagacaaaactggacgggaacatctctccgtgtacgcggtggttgtgatagcttcagttgtcggcttttgcctcttagtcatgctattcctactgaagctcgccagacactccaaattcgggatgaaagatttttcctggtttggttttggcaaggtgaaaagcagacagggagtaggaccggcatcagtcatttctaacgacgacgattctgcttctccattgcaccacatttcaaatggctctaacactccatcctccagcgagggaggaccagacgctgtaattattggcatgaccaaaattccagtaattgagaatcctcagtacttcggaatcactaactctcagctgaagcctgacacgtttgtccagcatatcaaaagacacaatattgtcctaaagcgggaacttggagagggtgccttcggcaaggtgttcctcgctgagtgttacaacctgtgtccagaacaggacaaaatacttgtggcagtgaaaacccttaaggacgctagcgataacgcccgcaaagacttccacagggaggcggagttgttaaccaatctccagcatgagcatattgtgaagttctacggcgtctgtgttgaaggcgatcctctcatcatggtcttcgaatacatgaaacacggcgatctgaataaatttctgcgcgcccacggaccagatgccgtgcttatggccgaaggaaatccacccacagagctgacacagtcccaaatgctccatattgcgcagcagatagcagcaggaatggtctatcttgccagccagcactttgtgcacagagacttagccacaaggaactgcctggtaggagaaaatttactcgtgaagattggcgactttgggatgtcacgagacgtttattccaccgattactacagagtcggaggacatacgatgctcccaatccgttggatgcctcccgagagtatcatgtatcgaaagttcaccacggaatcagatgtgtggagcctaggggtcgtcctgtgggaaatctttacatacggaaagcagccctggtaccaactttcaaacaacgaagtaatcgagtgtataacccaggggcgagtgctccagagacctagaacatgcccacaggaggtctacgagctgatgttaggttgctggcagagggagccacacatgcgcaagaacatcaagggtatacacactttactgcagaacctcgccaaggctagcccggtctatctagacatcttgggctag

SEQ ID NO: 126379 - DNA, 1662 bp, Artificial Sequence
  Description of Artificial Sequence: Synthetic coding sequence
atgtcatcctggataagatggcatgggcccgcaatggcgcgcctttgggggttttgttggctggtggtcggcttctggcgtgccgcgttcgcttgtccaacttcctgtaaatgcagtgcctctaggatctggtgttcagatcctagtcctggtatcgtcgcatttccccggctagagccgaactccgtcgatcccgaaaacatcactgaaattttcatcgccaatcagaagagattggaaattattaatgaggacgatgtcgaggcttatgtaggtctaagaaacctgacaatagtcgacagcgggctcaagtttgtggcacacaaggcctttctcaaaaacagcaaccttcagcatatcaatttcacacgcaacaaattaacgagcctgtcgcggaaacacttcagacacctagacctctcagaacttattttagtcggcaacccattcacatgtagctgcgacatcatgtggattaagaccttacaggaagcgaaatcgtcccccgacacgcaggatttatattgtcttaatgagtcctcgaaaaatatcccactggccaatctccaaatccctaactgcggattgccaagcgccaatctggcagcgccaaacttgactgtcgaagaaggaaagagtatcactctgagttgttccgtcgcaggggaccccgttccgaatatgtactgggatgtaggcaacctcgttagtaaacacatgaacgagacttctcacacacagggctctctgcgcatcacgaatataagcagcgacgatagtggtaaacaaatttcatgcgtggccgaaaatctggttggcgaggatcaggattccgttaacctgacagtacatttcgcccccaccataaccttcctcgaaagtccaacatctgaccatcattggtgcatccccttcaccgtgaagggcaaccctaaacccgccttgcagtggttctacaatggcgcgatacttaacgaatctaaatacatatgtaccaagattcatgttactaatcataccgaataccatgggtgccttcagctggacaaccccacccacatgaacaacggagactacactcttatcgctaagaacgaatacgggaaggacgaaaaacagattagcgcacactttatgggttggcctggcatcgacgacggcgcgaatcccaactacccagatgttatttacgaagactacggcaccgcagccaatgacatcggcgataccactaatcgcagcaacgagattccatcgaccgatgtgaccgataagaccgggagggagcatctgtcggtctacgcagtggtggtgattgcaagcgtggtcgggttttgtctcctggtcatgctcttcctgctcaagctggccagacacagtaaattcggcatgaaagatttctcctggttcggatttggaaaggtgaagagcaggcagggcgtgggtccagccagtgtgatctcaaatgatgacgatagtgcaagtccacttcaccatattagcaacgggagcaacaccccgagtagctccgaaggaggccccgatgcggttatcattgggatgactaaaatcccagtgatagagaacccgcaatacttcgggattacaaactctcaactcaaacccgatacttggccgaggggaagtccaaaaacggcctag

SEQ ID NO: 126380 - DNA, 2469 bp, Artificial Sequence
  Description of Artificial Sequence: Synthetic coding sequence
atgtcatcatggattcgttggcacggtccagcaatggccaggctgtggggcttttgctggcttgttgtgggattctggcgggcagcatttgcctgcccaacgtcttgtaagtgttcagcttcccgtatttggtgtagcgatccctcaccaggaatcgtggcttttccacgtctggagcccaactccgtcgaccctgagaacattaccgaaatcttcatcgccaaccagaagaggctcgagattatcaatgaggatgacgttgaagcctatgttggcttacgcaatcttaccatcgtggacagcggcttgaaatttgttgcacacaaggcgttcttgaagaactctaatctccaacatattaattttaccagaaacaagctcactagtctctcgaggaaacactttcggcacctagatctgtctgagctgattctcgtcgggaatccctttacatgctcctgcgatatcatgtggatcaagaccctgcaggaggccaaatccagccctgacactcaggacttatactgcctgaacgaaagctctaagaacatccccctggctaatcttcagattccaaactgcgggctgccctccgcgaatctcgccgcccctaacctgacggtcgaggaaggtaagtctataaccctttcctgttcagtggctggcgatcctgtgccgaacatgtattgggatgtgggaaacctagtgagcaaacacatgaatgagacgagtcatactcagggttcactgcgaataactaatatatcctcagatgatagtggcaagcagatatcatgcgttgcagaaaatttagtcggcgaagatcaggattctgtgaatctcactgtacattttgcccccaccataactttcctggagagtcccacatccgaccatcactggtgtatcccctttaccgtgaaagggaacccaaagcctgcattacagtggttctataatggcgcgattttgaacgaatctaaatacatatgtaccaaaatccacgttaccaaccacactgaataccacggctgcctccagctggacaatccaacccacatgaataacggagattacaccctcattgccaaaaatgagtacggcaaggacgagaagcagataagcgcacacttcatgggttggccagggattgacgacggtgccaaccccaactaccctgacgtgatatatgaagactatggaacggccgcaaatgatattggcgacactaccaaccgatccaacgagataccctcgacagatgtcactgacaagacaggtagggagcatcttagcgtgtatgcagtggtggtgatcgcctcagtggtcggcttttgcttactggtgatgcttttcctcctcaaattagcccggcattctaagttcgggatgaaaggacccgcttccgtcatttccaatgacgacgattctgcttcacctctgcaccatatcagtaatgggtcaaatacaccatcctccagtgagggaggcccggacgccgtgatcattggtatgacaaaaattcccgtaatcgagaaccctcagtatttcggcatcacaaattctcagctgaaaccggataccttcgtgcaacacatcaaaaggcacaacattgtgctgaagcgagaactgggggagggcgcttttgggaaagtgtttctggctgagtgctataatttgtgtccagaacaggataagattctggtcgccgttaagacgctcaaagacgcctctgataacgctagaaaagatttccatagggaggcagaactcctcactaacctgcagcacgagcatatcgtcaagttctacggtgtgtgcgttgagggcgacccactgattatggtctttgagtatatgaagcacggcgatttaaacaagttcctaagagcccacggacccgatgcagtgctcatggccgaggggaatccgcccaccgaactgacacagagccaaatgcttcatatagcccaacaaatcgccgccggcatggtttaccttgcgtcccagcattttgtccatcgagacctggcgacaaggaactgtcttgtgggcgaaaacttgctggtgaagattggggacttcgggatgtcaagagacgtgtacagcaccgattactacagggttggcgggcataccatgctgcctatccggtggatgcctccggagagtataatgtaccgaaaatttacaacggaatcagacgtttggtccctgggagttgtgttgtgggaaatctttacgtacggcaagcagccctggtaccagctctctaacaacgaagtgatcgaatgtatcactcagggacgggtactccaacgtccacgcacctgcccccaggaggtctacgagttgatgctgggctgctggcagcgggaaccccatatgaggaagaatattaaggggattcacacactgctccaaaacttagcaaaggcgagccctgtataccttgatattctaggttag

SEQ ID NO: 126381 - DNA, 1434 bp, Artificial Sequence
  Description of Artificial Sequence: Synthetic coding sequence
atgtcttcctggattagatggcatggtccggccatggctagactgtggggcttttgctggctggtggtaggattttggagggccgcttttgcctgccctacctcctgtaaatgttctgccagccggatttggtgtagcgacccaagcccggggatcgtggcttttccccgactggagccaaatagcgtcgatccggaaaatatcaccgaaatttttatagcaaaccaaaaacgtctcgaaattatcaatgaggacgacgtcgaggcatatgtgggcctccggaatctcaccatcgttgacagtggcttaaaattcgtagcccataaagctttcctgaaaaattccaatcttcagcacattaattttacacggaacaaattaaccagcctgtcaagaaaacatttcaggcacctcgacctgtccgagctgatcctggttggcaaccccttcacctgcagttgcgacatcatgtggataaagacgttgcaggaagcaaagtcttcccctgacacgcaagacctttactgcctgaatgagagtagtaaaaatattcctctggcaaatcttcaaatccctaattgtggcctaccctccgccaatttagccgcaccaaacctgaccgtggaggaggggaaatccattacactgtcgtgctccgtggccggcgaccccgttcctaatatgtactgggacgtaggcaaccttgtgagcaaacacatgaacgaaaccagtcatacccagggctcccttcgcataacgaacattagcagtgacgatagcggaaaacagattagctgtgtggccgagaatttagttggtgaggatcaggattccgtaaaccttacggtacacttcgcccccacgattacgttcttagaatctcccacttccgaccatcactggtgtatacccttcacagtgaagggaaacccaaagcccgccctccagtggttctataatggcgcaattttgaacgagtccaaatatatttgcactaagatccatgtgactaatcatacagagtatcatggatgcctgcagctcgacaatccaacgcacatgaacaacggcgattataccttaattgccaaaaatgagtacggaaaagatgagaagcagatcagcgctcactttatgggctggcccggcattgatgacggagccaaccccaactacccagacgtcatctacgaggattatggaaccgctgcaaatgacattggagacacaactaatcgcagcaatgagatccccagcaccgatgtaaccgacaaaacagggcgcgagcacctcagtgtgtatgcagtcgtcgtgattgcttcagtggtgggattctgcttacttgtgatgctgtttcttctgaagctggccagacactctaagtttggaatgaagggttttgtgttattccataagattcctttggacggttag

SEQ ID NO: 126382 - DNA, 1614 bp, Artificial Sequence
  Description of Artificial Sequence: Synthetic coding sequence
atgagctcatggatcaggtggcacggaccagcgatggcgagactctggggcttctgctggctcgtcgtgggcttctggagggctgcttttgcctgccccacctcctgcaagtgctccgccagtagaatatggtgctcggatcccagccccggcattgtcgcatttcctcgtctggagcctaactcagttgatcccgaaaatatcaccgaaatttttatcgccaaccagaaaaggctcgaaattattaacgaggacgatgtggaagcatacgtaggattgcggaacctcaccattgtggattccggtcttaagttcgtggcccacaaggccttcctcaagaatagcaacctccagcacatcaactttacccggaataagctcacctctctctccagaaaacatttcagacacctcgatctgtccgaactcattttggttggcaatccctttacttgtagttgcgatatcatgtggatcaagaccctacaggaggccaagtcatcccctgatactcaagacttatattgcctgaatgaaagctctaaaaatattccactagcaaatcttcagattccaaattgcgggctgcccagtgctaatcttgcagctcctaatctcaccgtcgaagaggggaagtctataaccctctcatgttccgtcgccggagaccctgtccctaacatgtattgggatgtgggcaatctggtgtctaaacacatgaacgaaaccagccacacacagggcagtttgcggattactaacataagcagcgacgatagtggcaaacagattagctgtgttgccgagaacctagtgggcgaggatcaggacagcgtgaacctaacagtgcatttcgcccccacaatcacttttttggagagcccgaccagtgaccaccattggtgtatcccttttacagtgaaaggtaatccaaaaccggcactccagtggttctacaacggggctatattgaatgagtcaaaatacatctgcactaagattcacgttactaaccacacggagtatcatggctgcctgcagctggataatcctacccatatgaacaatggagattataccttaatcgccaaaaatgagtatggcaaagatgaaaaacaaattagcgctcatttcatgggatggccaggaattgacgacggcgccaacccgaactaccctgatgtgatatatgaggactacggcactgcagcaaacgacatcggtgatactactaatcgttccaacgagattccatccactgacgtcactgataaaactggcagggagcatctctcggtttacgccgtcgttgtgatagcaagtgttgtaggcttctgtctgctagtaatgctgttcctgctgaagttagcaagacatagcaaatttggaatgaaggggcccgccagtgtgattagtaacgacgatgattcggcatcccctttacatcacatttcaaatggctccaacaccccaagctcctcggaagggggtccagatgctgttatcatcggaatgaccaaaattccagtgatagagaacccccagtactttggaattacaaactcacagctgaagcctgacacttggccacgagggtccccgaaaactgcatag

SEQ ID NO: 126383 - DNA, 2469 bp, Artificial Sequence
  Description of Artificial Sequence: Synthetic coding sequence
atgagctcatggataaggtggcatggcccagccatggccagattgtggggcttttgctggttggttgtcggattctggcgtgccgctttcgcctgtcccacttcttgcaaatgctcagcatccagaatttggtgctccgacccatctcctggaatcgtggcgttccctcggctcgaaccgaattccgtggaccctgagaacataacagagatctttatagctaatcagaagcgtctggagattatcaacgaagacgatgtggaagcctacgtggggttacggaaccttacaatcgtggactcaggcctaaagtttgtggctcataaggcctttctgaaaaactctaatctccagcatatcaacttcacccggaacaaactgacatccttaagtcgcaaacactttcgacacctggatctcagcgaactaatactcgttgggaacccatttacttgcagctgtgacatcatgtggataaagacactgcaggaggctaaatctagtcccgatacccaagatctgtactgcctgaacgaatcgtcaaaaaacatcccactcgccaacctgcagattccaaattgtgggttgccttcagctaacttagctgcaccaaatcttaccgtagaagaggggaagagcatcacattaagttgttctgtcgccggtgaccctgtccctaacatgtattgggacgttgggaacctggtgtcaaagcacatgaacgaaaccagtcatacccagggctcactgagaatcacaaacatctcctcagacgattcagggaaacagatttcttgcgtggccgaaaacctggtcggagaagatcaagactccgtgaaccttaccgtgcactttgctccgaccataacatttctggagagccctacatcagaccatcactggtgcatcccattcactgtgaaaggaaatcctaaacccgcactgcaatggttctacaatggcgcaatattaaacgaatctaaatatatttgcaccaagattcatgtgactaatcacacagaatatcacggatgtctccaattggataatccaactcacatgaataatggagactacacactgattgccaagaacgaatacggaaaagacgaaaagcagatctccgcccattttatgggatggccggggattgatgacggagcaaaccctaattatcccgatgtcatctacgaagattacggcaccgcagctaatgacataggagacaccaccaaccgcagtaacgaaattccctccacagatgttaccgacaagacgggccgcgagcacctctctgtgtatgctgttgtggtcatcgcaagcgttgtgggtttctgccttctggtcatgttgttcctcttgaaactggcccgacactcaaagttcggaatgaaggggccagccagtgtgatctctaatgacgatgattcggcttcacccctgcaccacatctccaacggctcaaacactccttcaagctccgaaggcggacccgatgcggttatcattgggatgacaaagatccccgtgatcgaaaacccccagtactttgggatcactaactcccagctcaaaccagacactttcgtgcaacacataaaacgccacaacatcgtgctgaaaagggagctgggtgagggcgcttttggtaaagtgtttttggccgaatgctacaacctgtgcccagaacaggacaagatcctggtcgcggttaaaacattaaaggacgcgtctgacaacgccagaaaggatttccatcgcgaggccgagctattaaccaacctccagcatgagcacatagtcaagttttatggtgtgtgcgtcgagggtgacccccttatcatggtcttcgagtatatgaagcacggcgacttgaacaagtttctgcgcgcacacggccccgatgcagttctgatggctgaagggaatcccccaacggaactgactcagtcacaaatgcttcatatcgcccagcagattgccgcgggaatggtgtacctggccagccagcatttcgtgcaccgggacttagctacacgtaactgcctagtcggcgaaaacctgctggtcaaaattggggactttggaatgagtcgggacgtgtactcaacggattactacagagtaggcggtcacactatgctaccaatcagatggatgccccccgagtctattatgtatagaaaattcaccacggagtcagacgtgtggagcctgggcgtggtcctgtgggaaatctttacgtacgggaaacagccatggtaccagttatcaaacaacgaagtgatcgagtgtatcactcagggaagagtgctgcagcgccctaggacctgtccccaggaggtgtacgaactgatgcttggatgctggcaaagggaacctcacatgaggaagaacatcaagggcattcacacgttgctgcagaatttagctaaggcatcacctgtgtatctcgatatccttggttag

SEQ ID NO: 126384 - DNA, 2517 bp, Artificial Sequence
  Description of Artificial Sequence: Synthetic coding sequence
atgagttcttggatcagatggcatggtcctgcgatggctcgcctatgggggttctgttggctagtcgtcggcttctggcgtgcagccttcgcctgcccaacgtcttgtaagtgttccgccagcaggatctggtgttccgatccatctcctgggatagtggctttcccccggttggaaccgaattccgtcgatccggagaatatcactgaaatcttcatcgcaaatcagaaacgcctcgagattataaacgaagacgacgttgaggcctacgtgggcctcaggaacctgaccattgtcgacagcgggctcaagttcgtagcccacaaggccttccttaaaaacagtaatcttcagcacattaactttacgagaaacaagctaaccagcctgtccaggaaacacttcaggcacttagacctgtctgaattgattttggtcgggaacccgttcacctgttcatgtgatataatgtggatcaagactctccaagaagccaagtcctccccagatacccaagacttatactgcctcaacgagagctcaaagaacattccactggccaatcttcagattcccaattgtggactgcctagcgccaacctcgctgcaccaaatctgacggtggaagagggcaaaagtattaccctctcatgtagcgtagctggggatcctgtgccgaacatgtactgggacgtgggaaatctcgtgagcaaacacatgaacgagacctcccatacacaggggtctctccgtattacaaacatttcctccgacgattccggcaagcagatcagttgtgttgccgagaatctggtcggcgaggaccaagacagcgtgaaccttactgtacatttcgctccaacaatcacgtttctggaaagccctacgagtgaccaccattggtgcatcccattcaccgtcaaggggaaccctaagcctgcactgcagtggttttataatggcgccattctgaacgaaagtaagtatatatgcactaagattcacgtaaccaatcacaccgagtaccacgggtgcttacagctggataacccaacacatatgaataacggggattataccctcatagctaagaacgagtacggtaaggatgagaaacagatcagcgcccatttcatgggttggcctggaatcgatgatggcgcaaaccccaactatcccgatgtgatatacgaggactacggaactgcggccaacgatatcggtgacacaacgaatcgctccaacgagatccctagcacggatgtgacagacaagaccggccgtgagcacttatcagtgtacgcggtggttgttatcgcaagcgtggtgggtttttgccttttagtcatgcttttccttctgaaactcgcccggcactctaaatttgggatgaaggatttctcatggtttgggttcggcaaggttaagtctcgtcagggggttggtcccgcgagtgtgatctcaaatgatgatgactctgcctcaccccttcatcatatatcaaacggcagcaacacccccagttcttccgagggtggaccagacgcagtcatcattggaatgaccaagattcctgtgattgagaatccacagtattttggtatcaccaacagccagttgaaaccagatacctttgttcagcacataaaacggcacaatatcgtgcttaagagagagcttggagaaggagccttcgggaaagtgttcttggccgagtgttacaacctgtgccccgagcaggataaaatcctggtggcagttaagaccctgaaggacgctagtgataacgctcggaaggatttccacagggaagccgaattgctgacgaatctccagcacgaacacattgtgaagttttatggagtatgcgtcgagggagaccctctcattatggttttcgagtacatgaaacatggcgacttgaataagttcctcagggcccacggtcctgacgccgtgctgatggccgaggggaatccacctactgagctaactcagagccagatgctgcacatcgctcagcagatagcagcaggtatggtatatcttgcctcgcaacacttcgtgcatcgggacctagccacccgcaattgcctcgtgggtgagaatctgttggtgaaaattggagatttcggcatgtcgcgagacgtgtactccacggactactaccgggtagggggacataccatgctcccaattagatggatgccacctgaaagcattatgtatcgcaagttcactacggagtctgacgtgtggtctctcggcgttgtcctttgggaaatttttacctatggaaagcagccatggtaccaactgtcgaacaatgaggtgatcgagtgcatcacacagggacgggtgctgcaaaggccacggacctgcccacaggaggtttacgaattaatgcttggctgttggcaacgggagccccatatgcggaagaatattaagggcattcatacactccttcagaatttagctaaagcttcaccagtctatctggatattcttggttag

SEQ ID NO: 126385 - DNA, 966 bp, Artificial Sequence
  Description of Artificial Sequence: Synthetic coding sequence
atgtggatcaagacactacaggaagctaagtcgtccccagacacccaagacttatattgcctaaatgagagtagcaagaatattccactcgctaacctacagattccaaattgcgggctgcccagtgccaatctcgccgcacctaacctaaccgtagaggagggaaaatctataacactttcctgctccgtggccggagatcctgtgccaaatatgtactgggacgtgggaaatttggtgtccaaacatatgaacgaaacgtcccacacgcaaggctctttaagaataactaatatctcctctgacgattccggcaaacagatatcctgtgtcgcggagaatttagttggcgaggatcaggatagcgttaatctaacagtacacttcgcccccacaattacgttcctggagagccctactagcgaccatcattggtgtattcccttcaccgtgaagggaaacccgaagccagcactgcagtggttctacaatggggctatccttaacgaatcaaagtacatctgtacgaagatccatgtgaccaaccacacagagtaccacggatgtctgcagctcgacaatccaactcacatgaacaacggagactatacactcatcgcaaagaatgagtacggaaaagacgagaaacagattagcgcccattttatgggatggcctggtatagatgatggagcgaacccaaactaccctgatgttatttacgaggattacggtacagccgccaatgatatcggagacaccaccaatcggtcaaatgagattcccagcaccgatgttactgacaagacggggagagagcacttaagcgtgtacgccgtggtggtgattgcctccgtggttgggttttgcctccttgtcatgctcttcctattaaaactggctagacactccaagtttggcatgaagggttttgttcttttccacaagatccctcttgatggctag

SEQ ID NO: 126386 - DNA, 1434 bp, Artificial Sequence
  Description of Artificial Sequence: Synthetic coding sequence
atgtctagctggattaggtggcacggacctgctatggctcgactgtggggcttctgttggttggtcgttggtttctggcgcgccgcattcgcttgtccaacaagttgcaagtgttccgcttcaaggatttggtgctcggatccttctcctggtatcgtggcttttcccaggctcgaacctaattccgtcgaccccgaaaacatcaccgaaatttttattgcgaatcagaagcgtctcgagatcatcaatgaggatgatgtggaagcctacgtagggttgcgtaacttaactatcgttgacagcgggcttaaattcgtggctcataaggcttttctgaagaatagcaacctccagcacatcaactttactcgcaataagcttacaagtttaagccgcaaacactttcgacacttagatttgtcggaactgattctggtaggcaatccctttacctgctcctgtgatattatgtggataaaaacactacaagaggccaaaagcagccccgacacacaggatctctactgcctgaatgaaagctccaaaaatataccactcgctaatctccagatccccaattgtggcctaccaagtgcgaatctggccgcgcccaacctgaccgtcgaagagggtaaaagcataacactgtcttgctccgttgctggcgacccagtgccaaacatgtactgggacgtgggaaacctcgtgtcaaaacatatgaacgaaacatcgcacacccagggctcgctgagaattactaacatctctagcgacgattccggaaagcagatatcttgcgttgccgagaacttggtgggagaggaccaagacagcgtcaacctcactgttcattttgcgccgacaataacgttcttggaaagccccaccagcgatcaccattggtgtattccttttactgtaaagggtaacccgaagcctgccctccaatggttctataatggcgctatcttgaacgagtccaagtacatttgcactaagatccacgtcactaaccacacagaataccacggctgcctgcagctggacaatcccacccatatgaataacggagactacactctcattgccaagaacgaatatggtaaagacgaaaagcagataagtgcccactttatggggtggccagggatcgatgacggagctaacccaaattacccagacgttatctatgaggattatgggacggctgccaatgatattggtgacaccaccaataggtccaacgagattccttcaacagacgttacagataagactggacgggagcacctatctgtttacgccgtggtggtgattgcttccgttgtgggcttctgcttactggtaatgctgttcctcctgaagctggcaagacattccaaatttggaatgaagggcttcgtactcttccataaaattcctttggatggctag

SEQ ID NO: 126387 - DNA, 1839 bp, Artificial Sequence
  Description of Artificial Sequence: Synthetic coding sequence
atggacgtttcactctgccctgcaaaatgcagtttctggcgcatcttcttgctaggtagtgtgtggttagactacgtgggaagcgtgctcgcttgtcccgcgaattgcgtgtgttcgaaaaccgagatcaattgtcgccggcccgatgacggcaatcttttccccctgctggaggggcaggattcgggcaatagcaacggcaatgcttctattaacattacagatatcagtagaaacatcacgagcatacatattgaaaattggagaagtttgcatacactgaacgctgtcgacatggaactgtacaccggtctccagaagcttacaattaagaactccggcctgcgctcaatccagccccgggctttcgcaaaaaacccacaccttcgatatataaacctaagtagcaatcgactgaccactctgtcatggcagctatttcagacactcagcctgcgggagcttcaactggaacagaatttttttaactgttcttgcgacattagatggatgcaactgtggcaagagcagggcgaagccaagctaaacagccagaacttatactgcatcaacgccgacggctcccaactgccactttttcggatgaatataagccaatgtgacctacccgaaatctcagtgagccacgtcaatctcacggttcgcgagggggacaatgccgtgattacctgtaatggctctggtagccccctgccagacgtcgactggatcgtgacagggctccaaagtattaatacacaccagaccaacttgaattggacgaatgtgcacgctattaatctgacactagtaaacgtgacctctgaggataacggttttaccctcacatgtatcgccgagaatgtcgtcggaatgagcaacgcttctgttgcccttacggtgtattatccaccacgggtcgtctctctggaggagcccgaactgagattggaacactgcatcgagttcgtcgtgagaggcaatcctcctcccaccctccactggttacacaatggccaacctttgcgggagtccaagataatccacgttgaatattaccaggaaggagagatctccgaggggtgtctgctgttcaacaaaccaacgcattacaacaacgggaactacaccttaattgcaaagaatcctttggggactgccaatcagaccatcaatgggcactttctgaaggagccgttcccagaatcaactgataactttatcctcttcgacgaggtgtcccccacccctcccattactgttacacacaagcccgaggaggatacatttggagtctccatcgccgtgggactggcagcgtttgcatgtgtattgctggtcgtgctctttgtgatgataaacaaatatggccgcagatctaagtttggaatgaaaggtccagttgccgtcatcagtggcgaagaggacagcgcctcccctttacaccacatcaatcacggcatcaccactccatcgtctctggatgccggacctgacaccgtcgtcatcggaatgacgcgcattcccgtcatcgaaaacccccagtattttcggcaagggcacaactgccacaagccagacacttgggttttcagtaacatcgacaatcacgggattctgaaccttaaggataaccgtgaccaccttgtgccttctacgcactacatctacgaagaaccagaagttcagtcaggggaagtgagctatcctcggtcgcacgggttccgcgagattatgttgaaccctattagcctgcctggacattctaagccactgaatcacggaatctatgtcgaagatgtgaacgtatattttagcaaaggccgtcacgggttttag

SEQ ID NO: 126388 - DNA, 414 bp, Artificial Sequence
  Description of Artificial Sequence: Synthetic coding sequence
atgacacgcatccccgtgatagagaatccacagtacttcagacagggtcacaactgtcacaaaccagacacttatgtgcagcatataaagcgacgagacatcgtgcttaaacgggagttaggggagggggctttcggtaaggtgttcctggcagaatgttataacttgtcgccaactaaggacaaaatgctcgtcgccgtaaaagcactaaaagatccaaccctggcagctagaaaagattttcagcgcgaagctgagttattgacgaatctgcagcacgagcacattgtgaagttctacggggtctgcggagacggcgatcccctcataatggtgtttgagtatatgaagcacggcgacctgaataagttcctgtcctccatatcttccccaaagtcacaccagcaagggtag

SEQ ID NO: 126389 - DNA, 2478 bp, Artificial Sequence
  Description of Artificial Sequence: Synthetic coding sequence
atggacgtgtccctttgtcccgcgaaatgttcgttctggcgtatcttccttctcggttctgtctggctggactacgtgggcagtgtattggcctgccccgctaactgtgtgtgttcaaagaccgagattaactgtagacgccccgatgacggaaacctgttcccactgctcgaggggcaggattctggtaactcaaacggaaacgcttccataaacatcacagacataagtcgcaacataacctccatccatattgaaaattggcgtagtctccatactctcaatgctgttgatatggagctgtacaccgggctgcagaaactcaccataaaaaattctggcctccggagcattcagcctcgcgccttcgcgaaaaatccccaccttcgctatattaacttgtccagtaatcgactgacaactttgtcctggcagctttttcagacactttctctcagggaattgcagcttgaacaaaattttttcaattgtagctgcgatatccgctggatgcaactgtggcaggaacaaggcgaggccaagctgaatagtcagaacctctactgtatcaatgcggacggctcacagctgccactttttcgtatgaatatcagccagtgtgacctgccagaaatatcagtctcccatgtgaacctgactgtgcgggagggcgacaatgctgtgattacgtgtaatggtagcgggtccccgctgccagacgtggattggatagtcaccggccttcagagcataaacacacaccagacaaaccttaattggacaaacgtgcatgctatcaatctgacacttgtcaatgttacttctgaggataatgggtttaccctcacctgtattgctgaaaatgtcgtggggatgtcgaacgctagcgtggccctgacagtatattatcctccacgcgtggtatcgctagaggaaccagagctgcgtttagaacactgtatcgagttcgtcgttcgcggaaaccccccccctacactgcactggctccataacggacagccactgcgagagtccaagataatccatgtggagtactaccaggaaggggaaatctccgaagggtgcctcttgttcaataaacctacccactataacaacggcaattatacactgatcgccaaaaatccgcttggtacggccaatcagaccattaacggccacttcctcaaggaacccttcccagaaagtacagacaattttatactcttcgacgaggtttccccgactccgcctatcaccgtcacacataaaccagaagaagataccttcggcgtatccatagctgttggcttagcagcctttgcatgcgtgctcttggtagtgctctttgtgatgattaataagtatggtagacgatccaagtttgggatgaagggccccgtcgctgttatctccggggaggaggatagtgcgagccccctgcaccatatcaatcacggcattaccacgccaagttctttggatgccggacctgatactgtggttattggtatgacacggatccccgtcatcgagaatccccagtatttccgccagggccacaattgtcacaagccagacacatacgtgcagcacattaaaaggcgagacatcgttctcaagcgcgagctgggcgagggagccttcgggaaggtgttcttagctgaatgttataatctcagtcctacaaaggataaaatgctggtcgcagtgaaggcgctgaaggatcccacgctggctgccaggaaggattttcagagagaggccgagcttctgacaaatctccaacacgagcatattgtgaaattctacggggtgtgtggtgatggcgatcctttgatcatggtgttcgaatacatgaaacacggagatttaaacaaatttctgcgagctcatggccccgacgccatgattcttgtcgacggccagccaagacaggcgaagggagagctcggcctttcccaaatgctacatatcgcttcccagatcgcctctggaatggtctatctagctagccagcattttgttcaccgcgacctagctacaaggaattgcctcgttggagccaacttactggttaagataggggacttcggaatgtcacgagacgtctacagtaccgattactatagggttgggggtcataccatgctgccaattcgttggatgcccccggagtccatcatgtatcgcaagtttaccactgagagcgatgtgtggagttttggcgtgattctttgggagatcttcacctatggcaaacagccctggtttcagttgtccaacactgaggtgatcgaatgcatcacccagggtcgcgtgctcgaacggccgcgggtttgccccaaagaggtttatgatgtcatgctggggtgttggcagcgggaaccccagcagcggcttaacatcaaagagatttacaagattctgcatgcacttggaaaagcgacccctatctatctggacattctcggatag

SEQ ID NO: 126390 - DNA, 2496 bp, Artificial Sequence
  Description of Artificial Sequence: Synthetic coding sequence
atggacgtctctctctgtccagccaagtgcagcttctggcgtatattcctgctcgggtcggtgtggctggattacgtgggatccgtacttgcctgtccagctaattgtgtttgttccaaaactgaaatcaattgcagacgccccgacgatggaaatctatttcctctgctggagggccaggatagcggcaacagtaacgggaacgctagcatcaacattaccgatatttctagaaatataacttcaattcatattgagaattggcggtctctccacacacttaatgctgtggacatggagctctacacaggtctccaaaaactgactattaagaacagcggcctgaggagcattcaaccccgggcctttgccaaaaacccccaccttagatacatcaacttgagctccaatagacttactaccctgagctggcaactgttccagacgctcagtctccgggaactccaactggagcagaatttcttcaactgttcttgcgacattcgatggatgcagctgtggcaggagcagggagaggcaaagcttaacagccagaatctgtactgcattaacgccgatggttctcagctcccgctgtttaggatgaacattagccagtgcgatttgcccgagatctctgtgtctcatgtgaatctgactgtgcgcgaaggcgataatgccgtcataacctgtaatggtagtggcagccctttaccggatgtggactggatcgtgactggtctccagagtataaatactcatcaaactaacctgaactggaccaacgtgcatgccatcaacttaacactcgtcaacgtgacttctgaagacaacggttttaccctgacttgcatcgcagaaaatgtggtgggtatgagtaatgcatctgtggctcttaccgtatactatccacccagagtggtcagcctggaggagcccgaactccgtctggagcactgcattgagttcgtggtcaggggtaacccacctcctactttgcactggctgcacaacggccagcccctgcgcgaaagcaaaatcatacatgttgaatactatcaggaaggcgagatttctgagggatgcctactgttcaataagcctacacactataataacgggaattatacattaattgctaaaaaccccctgggcaccgccaaccagacaatcaatgggcacttcctcaaggagccttttcctgtggatgaggtgagcccaacacccccaatcactgtgacacacaaaccagaggaagacactttcggtgttagcatcgcggtgggattggcagcctttgcctgtgtgctgctggtggttctgttcgtgatgatcaataagtatggccggcgctcaaagtttggaatgaagggccccgtggccgttatatcgggcgaagaggatagcgcctcaccattacatcatatcaatcacgggataactacaccctcttcattggacgccggtccagatacagtggtcatcgggatgacacggattcccgtcattgagaacccccaatattttagacaggggcataactgtcacaagcccgacacatacgtgcagcacataaaacggcgggacatcgtgcttaaacgcgaacttggggaaggtgccttcggcaaggtgtttctagccgaatgttataacctcagtcctaccaaggataaaatgctggtcgctgttaaggccttgaaggaccctactctggctgcccggaaagatttccagcgtgaagcagaactgcttaccaacctacagcacgagcatatcgtgaaattctatggtgtgtgcggcgacggagaccccctcatcatggtcttcgaatacatgaagcacggagatctcaacaagtttctgagagcacacggcccagacgcgatgatcctggtggacgggcagccacgccaagccaagggggagctgggtctctctcaaatgctccacatagcctcacagatcgcctcggggatggtgtacttggccagtcagcattttgtccatcgcgatctagccaccaggaactgcctcgttggagccaatttgctcgtgaaaatcggcgacttcggcatgagcagagatgtctacagcaccgattactatcgtctgttcaaccctagcggaaacgacttttgcatctggtgtgaggttggcggacataccatgcttccaattcgttggatgccgccagagagcattatgtataggaagttcactacggagagcgacgtctggtccttcggtgtgattctttgggaaatcttcacctacggcaaacaaccttggtttcagctgtccaacaccgaagttatagaatgcattacacagggtcgcgtgcttgaacgtcctagggtgtgtcccaaagaggtgtacgacgttatgctcgggtgctggcagcgggagcctcagcagagactcaatattaaggagatttacaaaattttacacgcacttgggaaagctacccccatctatctagatattctggggtag

SEQ ID NO: 126391 - DNA, 2520 bp, Artificial Sequence
  Description of Artificial Sequence: Synthetic coding sequence
atggatgtttcattatgtcccgccaagtgttctttttggcgcatcttcctgctgggatccgtttggctcgattacgtgggctccgttctcgcatgcccggctaactgcgtctgtagtaaaacggaaattaattgtcgccggcccgacgatggaaatctctttccactactcgagggtcaggactcaggtaactctaatggcaatgcctcgattaacatcacagacatctctcgtaacataaccagtattcacatagagaattggcggtctctgcatacattaaacgctgtggacatggaactgtatactggccttcagaaactgactatcaagaattctggactcagatccattcagccaagagcatttgcaaagaatccccatctccggtacatcaacctttcctctaaccgtctgacaacgctgtcctggcagctgtttcagacgctatcccttcgcgaactgcagctggaacagaacttctttaattgttcctgcgacatccggtggatgcagctttggcaggagcagggcgaagctaaactgaactcccagaacctttattgtattaatgcagacggttcacagctcccattgtttcgaatgaatatctcccagtgtgatctgccagaaatttctgtcagtcatgtgaacctgacagtgcgggagggggataatgccgttatcacttgtaacggctccggtagcccactgccggacgtcgattggatcgtcacgggtctgcagagtattaacacccaccagaccaatcttaattggacaaacgtgcacgccatcaacctgacactggtgaacgtcacctcggaggataatggcttcacgctgacttgcatagctgagaacgtcgtgggaatgagcaacgcctccgtggcgcttaccgtctattaccccccacgcgttgtgtctctcgaagagcctgaacttcggctggaacattgtatagagttcgtggtcagggggaatccgccccctaccctgcactggcttcacaacggccagcctctgcgagagtccaaaataatccacgtggaatactaccaggagggcgagatctcagaggggtgcctgctgttcaacaaaccaacgcactacaataatgggaactatacacttatcgccaagaatcctctcggaaccgctaaccaaaccattaatggccatttcctgaaagaaccatttcctgagagtaccgacaattttatccttttcgacgaagttagcccaacccccccgatcacagtgacacacaagcctgaggaggatacttttggcgtatctattgccgtcgggctcgccgcattcgcatgcgtgctcctggtcgtgctgttcgtaatgattaataagtatggacggaggagtaaattcggcatgaaggggccggtggcagtcattagcggagaagaggattctgcttcacccctccatcatattaatcacgggatcaccactccgtcttcattggacgccggacctgataccgtggttattgggatgacaagaattcctgtaattgaaaatccacagtacttccgacagggccacaactgtcacaagccagacacttacgttcagcacatcaaaaggcgggacatcgtgctgaagagggagctgggagaaggggctttcgggaaggtgtttctggctgagtgttacaatctttctccaactaaggataaaatgttggtggctgtgaaagccctgaaggaccctactttggctgcccgcaaggattttcagcgcgaggcagagctgctgaccaaccttcaacatgagcatatagtaaaattttacggggtttgtggagacggcgatcctctgatcatggtcttcgagtatatgaaacacggggatctgaataaattcttacgtgctcacggccccgacgcgatgatcctggtcgatgggcagccacggcaagccaagggagagctcgggctgagccaaatgcttcatatcgctagccagatcgcctccggcatggtctatcttgcctcacaacactttgttcaccgcgacctagctacccgcaactgcctggttggcgccaatctgttggtcaagatcggtgactttgggatgtcacgtgatgtgtacagtacggattactaccgactgtttaacccgtccggaaacgacttctgtatttggtgcgaagtcgggggacacactatgctgccaatccggtggatgccacccgagtctattatgtaccggaagttcaccacggaatctgatgtttggtccttcggagtgattctgtgggagatatttacctatggcaaacagccttggttccagctgtccaatactgaggttatcgaatgtataacccaggggcgagtccttgagcggccacgagtctgcccaaaggaggtgtacgatgttatgctggggtgctggcaaagagaaccccagcagcgcctgaacattaaggagatttacaaaattttacatgccttaggaaaggccactccgatttacctggatattttggggtag

SEQ ID NO: 126392 - DNA, 2478 bp, Artificial Sequence
  Description of Artificial Sequence: Synthetic coding sequence
atggacgtgtccctttgtccagcgaagtgttctttctggcgtatcttccttctggggtcagtgtggctggattacgtgggatcagtgttggcctgtccggctaactgcgtctgtagtaagactgaaattaactgccgcagacccgatgacggcaacctgtttcccctgctcgaaggacaagacagcgggaactcaaacggaaacgcctccatcaatatcaccgatatcagccggaacatcacctccatccacattgaaaactggcggtcactgcacacactaaacgctgttgatatggagctgtacaccgggttacagaaactgactattaaaaactctggactgcggtcaatccaacccagggccttcgcaaaaaacccacacctgcggtacatcaatctgagctccaaccggttaaccaccctttcatggcagctgtttcagactctgagcctgcgggagctgcagttggagcaaaatttcttcaactgtagttgcgatattcgttggatgcaactgtggcaggagcaaggcgaagcaaagctcaactcccaaaacttgtactgtatcaatgccgatggtagtcagctccctttgttcagaatgaatatctcacagtgtgatctgcctgagatttcggtgtcccacgtcaatctaactgtgcgggagggggacaacgctgtcattacttgtaacggcagcgggtcccctttgccagatgtcgattggatcgtcacaggtctgcagtccatcaatacccaccaaacgaacctgaactggaccaacgttcacgccatcaatctgactctagtcaatgtcaccagcgaagataacgggttcacactaacttgcatagccgagaatgtcgtgggtatgagtaacgccagcgtagctctcacagtgtactatcctcctagagtggtgtcattggaggagcctgaacttcggttagagcactgcattgaattcgtcgtgcgaggtaatccccctcctactctccattggctccacaatggacaaccactgcgcgagtccaaaatcatccacgtcgagtactatcaggagggggaaatcagcgaggggtgcctgctgttcaacaaaccaacacactataacaacgggaactacaccctcatcgccaaaaaccccctcggaactgccaaccaaacaatcaatggccactttctgaaggagccttttcctgagtccactgataatttcatcctctttgacgaagtgagtcccacgcctcctattaccgtgacacacaagccagaagaagatacatttggagtgtccatcgccgttgggctggctgccttcgcatgtgtgctactcgtcgtgctgtttgtgatgatcaacaagtacggaagaagatctaaatttgggatgaagggacctgtggcggttattagtggagaggaggattccgctagccctctgcatcacattaaccatggcataactaccccttctagcttagacgccggcccagataccgtcgtgattgggatgacgaggattcccgtcatcgaaaatcctcagtatttcagacaggggcataactgccacaagccggatacttatgtgcagcatattaagcgacgggacatcgtactgaaaagggagctcggtgagggagctttcggcaaggtgtttctggccgagtgttataatcttagccctaccaaagataagatgctggtggctgtgaaagcacttaaggatcccaccttggccgcgcgcaaggacttccagagagaggccgaacttctgaccaacctgcagcacgagcacatagtcaaattctacggtgtttgcggagacggcgatccattgatcatggtctttgaatatatgaagcacggagatctgaataaattcctcagggcccacggccctgacgctatgattctggtggacgggcagcctaggcaggcaaaaggtgagctgggtttaagccagatgttacatatcgcctctcagatcgcatcaggaatggtgtacctcgctagccaacactttgttcatcgggacttagccaccagaaactgcctggtcggcgccaacctcttggtcaagatcggggatttcgggatgagtcgggatgtctatagcaccgattattacagggtgggcggccatactatgctgccaattagatggatgcctccagagtctatcatgtaccgcaaattcactacagagagtgatgtgtggtcctttggtgtgattctctgggagatctttacttacggcaagcagccctggtttcagttgtctaataccgaggtcatagagtgtattactcaaggaagggttcttgagagaccgagggtttgcccaaaggaggtgtatgatgttatgctagggtgctggcagcgggagccacagcaacgattgaacattaaagaaatttataaaatcctccacgcactcggaaaggccaccccaatttacctagacatactaggatag

SEQ ID NO: 126393 - DNA, 1839 bp, Artificial Sequence
  Description of Artificial Sequence: Synthetic coding sequence
atggatgtttctctgtgtcccgcgaagtgttccttttggaggatcttcttattaggctccgtttggctcgattatgtgggatccgtcctagcttgccccgcaaattgcgtctgcagtaaaacagagattaactgccgcagaccggatgatgggaatttatttccactgcttgagggccaggatagcggtaattcgaacggaaatgcctccatcaacatcacagacattagccgaaacatcacatcaatccatatagaaaattggcgctccctgcataccctcaatgcagtcgatatggaactgtataccggcctccagaagctgactatcaaaaactcaggtctcaggtccatccagccacgcgcattcgctaagaatcctcatctgcggtatattaatctgagtagcaaccgtctgaccacactgtcttggcaactcttccaaacgctttctttaagagagctccagctggagcagaatttcttcaactgctcttgcgacatccgatggatgcagttgtggcaggagcaaggggaggctaaactgaactcacagaatctgtattgtattaatgctgacggctcacagctgccattattcagaatgaacattagtcagtgtgatttaccggagatttcggtttcccacgttaatcttaccgtccgggagggagacaacgccgtgattacctgcaatggctctgggtcccccctgccagacgtcgattggatagtcactggcctccaaagcataaacacacaccagaccaatctcaattggacaaatgtccatgccattaacctcactttggtcaacgttacgtctgaggacaacggattcactcttacctgcatcgcagaaaatgtggtgggtatgtctaatgcctcagtggccctgactgtatactacccacctagggtggtgagcctggaagagcctgagttacggctggaacattgcatcgagttcgtggtgcggggcaatccaccgccaaccctacattggctacataatggccagcctctccgcgaaagcaaaatcatacatgtcgagtattaccaagagggcgagataagtgaaggttgtctcctcttcaacaaacctacccattataataacgggaactacaccctgatcgctaagaacccactgggcaccgcaaaccagacgataaatggccattttctgaaagagccgttccctgaatctaccgacaacttcattcttttcgatgaagtgtcacccacccccccaataacagtcacccacaaacctgaagaggataccttcggggtgagcatagcggtcggactggctgctttcgcttgcgtcctgctcgtcgttctgttcgtcatgattaacaaatatggcaggaggtccaagtttggaatgaaggggcccgttgccgtcatctccggcgaggaggacagcgccagccccttgcaccacatcaaccacggcatcacgacgccgagtagcctagatgccggacccgacactgtggtgatcggaatgactcgtatcccggtaatcgagaacccccaatacttccgtcagggccataattgccacaagcctgacacctgggtctttagcaacattgataatcatgggatccttaaccttaaagataatcgtgaccatctggtaccttctacccactatatttacgaagaaccagaggtgcagagtggggaggtgtcctatccacggtcacacggattcagggaaataatgctcaacccgataagcctccctgggcattcgaagccgctgaaccatggcatttatgtggaggatgtcaatgtatatttttcaaaggggcggcacggattctag

SEQ ID NO: 126394 - DNA, 1854 bp, Artificial Sequence
  Description of Artificial Sequence: Synthetic coding sequence
atggaactgtataccgggttacagaagcttaccataaagaatagcggcctcagatctatccagccccgcgcattcgccaagaatccgcacctccggtatattaatctttcctctaatcggctgaccacattgtcatggcagctctttcaaaccctgtccttacgtgaattgcagctcgaacagaatttcttcaattgctcctgtgacatacgctggatgcagctctggcaggaacaaggcgaagctaaactgaattcgcagaatttgtactgtattaacgccgatggttctcagctgcctctatttcgaatgaacatttcccaatgtgacttacccgaaatttctgtttcacacgtgaatttgaccgtgagagaaggcgataacgcagtcatcacctgcaacggctccgggtccccactgcccgacgtggattggattgtgactggactacagagcattaatactcatcagacgaacttaaactggacaaatgtccatgcgatcaatttgacactcgtgaatgttacatccgaagacaatggctttactctgacctgtatcgctgaaaacgttgtcggaatgtccaacgcgagcgtggctctgactgtgtattacccccccagagtggttagcctggaagaacccgaattaagactcgaacactgcattgaatttgtcgtgcgcggtaatcctccgcctacactccattggctgcacaatgggcagccactgcgggagtctaaaattattcatgtggaatactatcaagaaggggagatcagtgaagggtgtcttttattcaataagcctacgcattataataatgggaattatacgctcatagcaaaaaatccactaggcaccgccaaccagacaattaatggacatttcctgaaggagccctttcccgagtctaccgacaatttcatactgttcgatgaagtatctcctacgcctcccatcaccgtaactcataagcctgaggaagacacatttggcgtatccatcgccgtgggcctggcagccttcgcatgcgtgctgctggtggttttgttcgtgatgatcaataagtacggccgtcggtcgaagttcggaatgaaagggccagtggccgtcatcagcggcgaggaggactcggcctctccgttgcaccacattaatcacggtattactacaccaagcagcctggacgccggcccagacactgtagtgatcgggatgacgaggattcctgtgattgaaaacccacagtattttagacaggggcacaactgccataaaccagacacatacgtccagcacattaagcgtcgggacattgtgttaaagagagagttaggagagggagcttttggaaaggtatttctagccgagtgttataatctgagccctaccaaggataagatgctggttgcagtgaaggccctcaaagacccaacactggcagcccggaaagactttcagagggaggccgaattattaaccaacctgcagcatgagcatattgtcaagttctatggggtatgtggggatggggaccctttgattatggtgttcgaatacatgaagcacggtgacctgaacaagttcctccgtgcacatggccctgatgctatgatcctggtggacgggcagcctcggcaagccaaaggagagctgggactgtctcagatgctccatattgcctcacagatcgcaagcgggatggtgtatcttgcttcccaacacttcgtacaccgggaccttgccaccagaaactgcttggttggtgcaaacctcctcgtcaaaatcggcgattttggcatgagtagggatgtgtatagcacagattactaccgagttgtacaagcatag

SEQ ID NO: 126395 - DNA, 774 bp, Artificial Sequence
  Description of Artificial Sequence: Synthetic coding sequence
atgagcattctgttttatgtcatctttttggcatacctgagggggatacaggggaacaatatggatcaacgttccctgcccgaggactcactgaacagtttgatcattaagttgattcaggcagacatactgaagaataagctgagtaaacaaatggtcgacgtaaaggaaaattatcagagcacactacccaaagctgaggcccctcgtgaacccgagagaggtggtcctgcaaaaagcgcttttcagccagtcatcgccatggatacagagctcctgaggcagcagaggaggtataatagtccccgagtgttgcttagcgacagtaccccgttggaacctcccccactgtatttgatggaggattacgtgggatcccccgtcgtcgctaataggacatctcgccggaaacgatacgccgagcacaagagtcaccggggggaatatagcgtgtgtgattcagagagcctgtgggtcacagacaagtctagcgcaatcgatatccgggggcatcaggtgacagtcctcggtgagatcaaaacagggaattcacctgtgaaacagtatttctacgaaacacggtgcaaagaagccaggccagtaaagaacggatgtagggggatagacgacaagcactggaactctcagtgcaagacttcccagacttacgtgagggcactgaccagcgagaacaacaagctggttggctggaggtggatccgcatcgacacctcatgtgtttgtgccctctcgcgcaaaatcggcagaacttag

SEQ ID NO: 126396 - DNA, 813 bp, Artificial Sequence
  Description of Artificial Sequence: Synthetic coding sequence
atggtgaccttcgccaccatcttgcaggtcaataaggttatgtccatcctattctacgtaatcttcctggcttacctgagaggaattcagggcaacaatatggaccagcggtctctccccgaggattcattgaactcattaattatcaaacttattcaggcggatattcttaagaataagctgtccaaacagatggtcgatgtgaaggagaactaccagagtacactaccaaaggctgaggcgcctagagagcccgagcgcggtggccccgccaaaagtgcctttcaaccagtcatagctatggataccgagctcttacgtcaacagcgtcggtataactccccgcgtgttctgctttcggattccaccccgctggaaccgcctccactctaccttatggaggactatgtgggcagccccgtcgtcgccaaccggactagcaggcggaaaagatacgcagagcataaatcccacaggggcgagtactcagtgtgtgacagtgagtcactctgggtgacagacaaatcctcagccatcgatatcaggggccaccaagtgactgtgctgggcgaaatcaaaactggcaattcccctgtgaaacagtacttctatgagacccggtgcaaagaggccagaccagtgaagaacggctgtcgagggattgacgacaagcactggaatagccagtgcaaaacaagccaaacctacgtgcgggcacttactagcgagaacaacaagctggtgggatggcgctggattcgcatcgacactagctgcgtatgtgcactaagccgtaagattggccggacctag

SEQ ID NO: 126397 - DNA, 633 bp, Artificial Sequence
  Description of Artificial Sequence: Synthetic coding sequence
atgctccccttgccctcctgctcactgcctattctgctgctgtttctcctcccatcggtgccgatcgagagccagccccctccctccactctcccaccctttctagcccctgagtgggacctgctgagtccacgcgtggtcctttcaagaggcgcccctgctggacctcccctcctgtttctgctggaagccggtgcctttcgtgaatcagctggagcgcctgctaatcgaagcagacggggtgtatcagagacagctcctgcttcacggcggggcgaactggctgtttgtgacgctgtgagcggctgggtgaccgatcgtcgtaccgccgtcgacttaaggggccgcgaggtagaggtcctgggtgaggtgcccgccgctggtggtagccctctgaggcagtattttttcgagacgagatgtaaggcagataatgccgaggaaggaggacccggggcaggaggtggcggttgtcgcggagtggaccggcggcattgggtcagcgagtgcaaggcaaaacaaagctacgtgagggctttgacagccgacgcacaggggcgtgtggggtggagatggatccggattgatacagcttgcgtctgtaccttgctgtccaggactggccgggcctag

SEQ ID NO: 126398 - DNA, 594 bp, Artificial Sequence
  Description of Artificial Sequence: Synthetic coding sequence
atgcagcggtggaaagccgccgcacttgcatctgtgctgtgttcttccgtccttagcatatggatgtgcagggaagggttactgctgagccacagactgggtccagctctggtacctttacatcgcctgccaaggacgctggacgcgcgtattgctcgactcgcccaatatagagctctgcttcaaggggccccagacgccatggagctcagggagctgacgccttgggctggacgacccccaggtccacgccgacgggccggcccacggcggcgacgtgcgagagccaggctaggcgccaggccgtgcggactgcgtgaactggaagttagggtgagcgagctgggacttgggtacgcctctgatgagacggtcctattccgctattgtgcgggtgcctgcgaagccgccgcgcgtgtttatgatctgggcctgagacgcctgaggcagcgccgaaggttgaggcgggaacgggtacgggcacagccttgctgtaggcccacagcctacgaggacgaggtatcatttctagacgctcacagccggtaccacacggtgcacgagctatctgcacgagaatgcgcatgtgtgtag

SEQ ID NO: 126399 - DNA, 1323 bp, Artificial Sequence
  Description of Artificial Sequence: Synthetic coding sequence
atgtccagctgcagggggcagaaagtcgccggaggcctcagagtcgtaagcccattcccactgtgtcagcctgccggcgaaccgtcccaggggaaaatgcggtcctcttgcgtgctgctcactgctttggtcgcgctggccgcttattacgtgtacattccacttccagggtccgttagcgacccatggaagcttatgttgttagacgccacgttccggggtgcacagcaagtctcaaacctgatccactacctagggctgtcacaccatctcctggcgctgaatttcattatcgtcagcttcggaaagaagagtgcctggtcctcggctcaggtgaaagtcactgacacggacttcgatggagtggaggttcgagtgtttgagggacccccaaagcctgaggagccgctgaaaaggtccgtggtgtacattcatggaggggggtgggcactggcaagcgccaagattcgctactatgacgagttgtgcaccgccatggcagaggagcttaatgcagtcatagtgagcattgagtatagattggtccctaaggtgtactttcctgaacagatccacgacgtcgtacgcgcaaccaagtattttctgaagccagaagtgttgcagaaatatatggtagaccctggcaggatctgcataagcggagactctgccggtggaaatcttgccgccgctctcgggcaacaattcactcaggacgcatcactaaaaaacaaactgaaactccaggctttgatctatcctgttctccaggccctggattttaacacaccatcataccaacagaacgtaaatactccaattctcccaagatacgtgatggtcaaatactgggttgactattttaaaggcaactatgattttgttcaagccatgatcgtcaataaccatacatcactcgacgttgaagaggccgccgctgtgcgagcccggttgaattggacttccctgctaccagcttcattcaccaaaaactataagccagtggttcagaccacgggaaacgcccggatagtgcaggaattgccccagctcctggatgcaagatccgctcctctaatcgctgatcaggccgtgttgcagctactccctaagacatacatactgacctgcgagcacgacgtgctccgggatgatgggataatgtacgccaagcggctggagagcgcgggcgtcgaggtgacgctggatcatttcgaggatggcttccatggctgcatgattttcaccagctggcctacaaatttctccgttggaatccgcacacggaatagctacattaagtggttggaccagaacctgtag

SEQ ID NO: 126400 - DNA, 1227 bp, Artificial Sequence
  Description of Artificial Sequence: Synthetic coding sequence
atgcggagtagctgcgtactgctcaccgccctagtcgctttggctgcctattacgtgtacatacccctccccggctccgtcagtgacccctggaaattaatgctgctggacgcaacgttccggggcgcccagcaggtctccaacttaatccattatctaggactgtcacaccatctgctcgctctgaattttatcatcgtgtccttcgggaaaaagtccgcctggtcctccgcccaggtgaaggttaccgacaccgactttgatggggtggaggttagagttttcgagggtcctccaaagccagaagaacctctgaagcgctctgttgtctacattcatggaggcgggtgggccctcgccagcgccaagatcagatactacgacgaactttgcacagccatggctgaggagttgaatgctgttattgtgagcattgaataccgactggtgccgaaagtgtattttcctgagcaaattcacgacgtcgtgagggctaccaagtacttcctgaaaccggaggtgctccagaaatacatggttgacccaggacgcatctgtatcagcggagactctgccggagggaacttagctgccgcactcggacagcagtttacccaggatgcatctttgaagaacaagctgaaacttcaggccttgatctatccggtcttacaggccctggatttcaacacgccatcatatcagcagaatgtgaacacacctattctccctaggtacgtgatggtaaagtactgggtcgactatttcaagggaaattatgattttgtacaggccatgatcgtgaacaaccatacctccctggacgtcgaggaagccgccgccgtcagagctagacttaattggacttcactactgccagcaagcttcaccaagaactacaaacctgtcgtgcaaacaaccggcaatgcacgcattgttcaggagctcccccagctgctggacgccagatctgccccactgatcgccgatcaagcagtcttgcaactgctccctaaaacatatatcttaacttgtgagcatgacgtgctgcgggatgacggaattatgtatgccaaaaggttggaatccgcaggcgtggaggtgaccttagaccactttgaagatgggtttcacggttgcatgatttttacgagttggcctaccaatttttctgtgggcattcgcacccgaaattcttacattaaatggttggaccagaacctgtag

SEQ ID NO: 126401 - DNA, 1347 bp, Artificial Sequence
  Description of Artificial Sequence: Synthetic coding sequence
atgagttcttgtcgtggccagaaagtcgccggaggtctgcgcgtggtgagcccatttcccctctgccagcctgccggggagccttctcaaggtaagatgcgtagcagctgcgttcttctaactgctctcgtggcactcgccgcgtactacgtgtacatcccgctgcccggcagcgtctccgatccgtggaagctcatgcttctagatgccacttttaggggcgcccaacaggtgagtaacctgattcattatctcgggttatcacaccacctcctggccctaaacttcattatcgtgagtttcggcaaaaagtctgcttggagtagcgcccaggtcaaagtgacagacacagactttgacggggtggaagtcagggtctttgagggccctcctaagcctgaggagcctctgaagcggagtgtggtctacatccacgggggcggttgggcactcgccagtgcttctgcatcctggagtccttctgatgaaattcggtactacgatgaactctgtacggcaatggcggaggagcttaatgccgtcatcgtgagcatcgagtaccgcctcgtgccaaaggtgtactttccagagcagatccacgacgtggttagagctaccaagtacttcttgaagccggaagtgctccaaaagtatatggttgatcccggccgcatctgcataagcggggattctgccggaggtaacctggctgcggcactggggcaacagttcacacaggacgctagcttgaagaataaattaaagctgcaggctctgatctacccagtactccaggccttagatttcaacaccccctcttaccagcagaacgtgaatacccctattctgcctagatacgtcatggtgaagtattgggtcgactatttcaagggtaactatgactttgtccaggctatgatcgtcaacaatcacacctctctggacgtagaggaggccgccgcggttcgcgccagactgaactggacctccctcctgcctgcctcatttactaagaactataagcccgtcgttcagaccaccggcaacgcacggatcgtacaggaactacctcaacttctggatgcacgtagtgccccgcttatcgctgatcaggccgttctgcaactgcttcccaaaacctatatcctgacctgtgagcacgacgttttacgggacgatggcattatgtacgctaaacgcctcgaatctgccggcgtggaagtcaccctggaccactttgaggatggatttcatggatgcatgattttcaccagttggcccacaaatttctcagtgggaattagaaccaggaacagctatatcaagtggttagatcaaaacctctag

SEQ ID NO: 126402 - DNA, 828 bp, Artificial Sequence
  Description of Artificial Sequence: Synthetic coding sequence
atggcagaggagttaaacgctgtgattgtgtcgatcgagtatcgactggtgcccaaggtctacttccctgaacagatccatgatgttgttcgagctactaaatacttcctgaagcctgaagttcttcagaaatatatggtagaccctgggcgtatctgtatctcgggcgacagtgcaggcggaaaccttgcagctgcgttaggccagcaattcactcaggatgcctcactgaaaaacaagctgaagttacaggccttgatatacccagtcttgcaggctcttgattttaatactccctcgtaccagcagaatgtgaatacacccatcctaccaagatacgtgatggttaaatattgggttgactacttcaagggcaactacgactttgtccaggccatgattgtcaacaaccacacgtccctggatgttgaggaagccgccgccgtccgggcaagacttaactggacctcattactccccgccagttttaccaaaaactataagcccgttgtgcagaccacaggcaacgccaggatcgtgcaggaattacctcaactgttggacgcccggagtgcgcctctcatagccgaccaggcagtattgcagcttcttcctaagacctatattctcacatgtgaacatgacgtattgagagacgacggcattatgtacgcaaaaaggctggaatcagcaggcgtagaagtaacactggatcatttcgaagacggttttcacggctgcatgatctttaccagctggccaacaaatttctctgttggtatcagaactcgaaatagctatattaagtggctcgaccagaacctgtag

SEQ ID NO: 126403 - DNA, 2754 bp, Artificial Sequence
  Description of Artificial Sequence: Synthetic coding sequence
atggcctttatccgtaaaaagcagcaagaacagcagcttcagctctatagtaaggagaggttcagtctgctcctccttaatcttgaagaatattactttgaacagcatcgcgcaaatcatatccttcacaaggggtcccaccatgaaagaaaaataagagggtccctgaagatttgttccaagtccgtcatctttgagcccgacagtatatcacagcccatcatcaagattccacttcgtgactgtatcaagatagggaaacatggtgaaaatggcgcaaatcggcatttcacaaaagctaagtccggcgggatctccctgattttctcacaagtgtacttcatcaaagagcataacgtggtggctccctacaagatagaacgggggaagatggaatatgtttttgaattggatgtgcctggcaaggtcgaggacgtcgtggaaacgcttctccaactgcatagggctagctgtctggataagctgggtgaccagaccgccatgattaccgcgatcctccaatcacgcctagccaggacctcattcgacaaaaatcggtttcagaacatctccgagaaactgcatatggagtgcaaggccgagatggtgaccccactcgttacaaaccccggccacgtgtgcatcaccgacactaacttgtacttccagccgttgaatggttaccccaaacccgttgtgcagatcaccttgcaagatgtaagacgtatctacaaacggcgccatggtcttatgcccctgggactggaggtcttttgtacggaagatgacctctgttccgacatctatctaaagttctatgagccgcaggacagggacgacttgtacttctatatcgccacgtaccttgaacatcacgtcgctgaacatacagctgaatcatacatgttacagtggcaacgggggcacctttctaactatcagtacttgctgcaccttaataatctcgccgatcgttcctgcaatgacttgagccagtacccagtcttcccttggatcattcacgattattcctcctccgagctagacctgagcaacccaggtactttcagagacctgtccaagccagtcggcgctctgaacaaggaacgcctagaaagattgctcacaagataccaggaaatgcctgagccaaagtttatgtacggatcgcattactccagcccgggatacgtgctgttttatcttgtgagaatcgcgcccgagtatatgctttgtttacaaaacgggagatttgacaatgctgataggatgtttaacagcattgctgagacctggaagaattgcctcgacggggccacggacttcaaagaactaatccctgaattctatggcgacgacgtttcttttctggtaaattcactgaaacttgacctggggaaaaggcagggggggcaaatggtggacgacgtggagctccccccctgggcgagctcaccagaagactttctccagaagagcaaagatgccttggaatctaattacgtgagcgagcatctgcacgaatggatcgatctgatctttggctataaacagaaggggtccgacgcagtcggagctcacaacgtgttccaccctctgacttacgagggtggggtagaccttaactctattcaagatcccgatgaaaaggttgctatgctgacccagattttggaattcggacagaccccaaaacagctgttcgtgaccccacatcccaggcggatcacacccaaattcaagagtctttctcagacttcctcctacaacgcgtctatggcggactcccctggagaggaatcctttgaggacctcactgaagagtcgaagacactggcgtggaacaacattacaaagttgcagctgcacgaacattataagattcataaagaagccgtaaccggcattaccgtgtctagaaacgggtcctctgtattcacgacctctcaggactctactctgaagatgttcagcaaggaaagcaagatgctgcagcgaagcatttcgtttagtaacatggccctgtcatcatgcctactgctccctggggacgctacagtgattacctcgtcatgggacaacaatgtatatttctactccatcgcctttggccgccggcaggacacccttatgggccacgacgatgccgtgtccaagatctgctggcatgataaccgactctactcagccagttgggactctacagtgaaagtctggtccggcgtgcctgccgagatgccaggtaccaagcgtcatcattttgatctcctggccgagcttgagcatgacgtgagcgtggacactatttcgctcaacgctgcaagcacattgctggttagtgggaccaaagaaggtaccgtgaatatctgggatttgacaactgcgaccttgatgcaccagattccgtgccactcagggattgtgtgtgacactgccttcagccccgattcccgccacgtactctctactgggactgacgggtgcttgaatgttatcgacgttcagacgggcatgttgatcagtagcatgactagcgatgaaccacagcgttgctttgtgtgggatggtaattctgtcttgagtgggagccagtccggcgagttacttgtttgggacctgctgggcgcaaaaattagcgagcgcattcaaggacacactggcgccgtgacatgcatctggatgaacgagcagtgttcgtcaatcataacaggcggtgaggaccgtcagatcatattctggaaactgcagtactag

SEQ ID NO: 126404 - DNA, 2847 bp, Artificial Sequence
  Description of Artificial Sequence: Synthetic coding sequence
atgactggccaggctcgctttcacaggggggcggaagcgtgccgggctatcaggcagtgccgctctagacggcctcgggctgcgcatcctgaaggccgagctggaagtgggaggggcagccggcacgcgagtccaggggtccgacgaggcgggttttcattattactacttaatctcgaggaatactattttgagcagcatagggccaatcacatcttgcataagggatcacatcacgaacgtaaaatccgcgggtcgctcaaaatctgctccaaatctgtgatcttcgaacccgattccatcagccaaccaatcatcaagatccccctgagagactgtatcaaaataggcaagcatggcgaaaatggtgccaatcgacactttaccaaggctaaaagcggcggaataagtctgatctttagccaagtatatttcatcaaggaacataacgtagtggccccatacaaaatagagagaggaaagatggaatacgtgtttgagcttgatgttccaggaaaggtggaggacgttgtagagactttactccagctgcacagggctagttgcctggataagctcggcgaccaaacggctatgataacagccattctccagagccgcctagcccgtacttcttttgacaaaaacaggtttcagaatattagtgagaagctgcatatggagtgtaaggcggaaatggtgacccctctcgtcaccaatccaggccatgtgtgtataacagacaccaatttatatttccagcctctgaacggctaccccaaacccgtcgtgcagatcacactccaggatgtccgaaggatctacaagagacggcacggcctcatgccccttgggctggaagtattctgcactgaggacgacctatgctcagatatttacctcaaattctatgagccacaggacagagacgacctttatttctacatagcgacatatttggagcaccacgtcgccgagcatacagccgaatcctatatgctgcagtggcagaggggccatcttagtaattaccagtatttgttacacttaaataatctcgccgacagatcatgcaacgacctgtcccagtacccagtgttcccctggattattcacgactactcctcttctgagcttgacctctcaaatcccggaacattcagagatttatcaaaacctgtgggcgcactaaacaaggagagattggaacgtctcctgacaaggtatcaggagatgccagaacctaagtttatgtatggctcacactatagctctcctggatacgtccttttctacctagtgcggatagccccggaatacatgttgtgccttcagaatggcaggttcgacaacgccgatcgaatgtttaacagcatcgctgagacctggaaaaattgcctagacggggccacagattttaaggagctgattcccgaattttacggagatgacgtgtcatttctggtgaactctctgaaactggacctgggcaaaagacagggaggacaaatggtggatgatgtggagctccctccttgggcctcatcaccagaagacttcttgcagaagtcaaaggacgctctggagagcaactacgtgagcgagcatctccatgagtggatcgacttgatattcggctacaagcaaaagggcagcgatgccgtgggcgcacacaatgtctttcatccgctgacttacgaaggtggcgtggacctcaatagtatccaagatcccgatgagaaggtggccatgctgactcagatcctcgaattcggccagacccctaagcagttgttcgttacccctcatcccaggaggataacaccaaagttcaagagtttgtctcaaacatcatcatataatgcctccatggctgattcacccggcgaagaatccttcgaagatttaacagaagaaagcaagactcttgcttggaataatatcaccaagctacaattgcacgagcattacaagatccataaagaggcagttactggcatcacggttagcagaaatggatcttccgttttcacaactagccaggacagtaccttgaagatgttctctaaagagagcaagatgctgcagcgaagcataagcttctctaacatggcattatcctcctgcctcctcctgccgggggacgccaccgtgattacgtcatcatgggataataacgtgtatttttattcaatcgcgttcgggcggcgacaggatacactgatgggacacgacgatgctgtgagcaagatatgctggcacgacaacaggctttattcagcaagctgggattccacagtgaaagtgtggagcggtgttccagccgagatgcccggtacaaagaggcatcattttgatctgctggctgagctggagcatgacgtgtccgtggacaccatctcccttaacgcagctagcacgttgttggtctctgggactaaggaaggcactgtcaacatttgggaccttacaactgccaccctcatgcatcagatcccgtgccattctggcattgtatgtgatacagcattctctcctgacagtcgacatgtgctatctacagggacagacggctgtctgaacgtgatcgatgtgcagacaggaatgttgatcagctctatgacatcagacgagccacagaggtgcttcgtctgggacggcaattccgtgctgagtggctcccagagtggggagctcttagtatgggacctcctgggggctaagatcagcgaacggatacaggggcacacgggggccgtgacttgcatttggatgaacgagcagtgttcatccattataactgggggcgaggatcgacagattatcttctggaaactgcagtactag

SEQ ID NO: 126405 - DNA, 1173 bp, Artificial Sequence
  Description of Artificial Sequence: Synthetic coding sequence
atgggggacactttcattaggcacatcgccttgttgggctttgagaagaggtttgttccgagtcagcattatgtctacatgtttcttgttaaatggcaggatttgtctgaaaaagtcgtatacagaaggtttacggaaatctacgaattccataaaactctgaaggagatgtttccaatagaggctggggcgataaatccggagaatagaataataccgcacctaccagcaccgaagtggttcgacgggcagagggccgcggaaaatcgccaaggcaccctgacggagtactgcgggaccctgatgagcctgccaactaagatcagccgctgcccccatttgttggatttcttcaaagtgaggcctgatgatcttaaactccctacggacaatcaaacaaaaaaacccgaaacatacctgatgccgaaggatggtaagagcacagcgactgacatcaccgggcctatcatactgcaaacttatcgcgctattgcgaactatgagaagacaagtggatcggaaatggccctctcaacaggcgacgttgttgaagtcgtggagaaatctgagtcgggctggtggttttgccagatgaaggccaagcgtggctggatccccgcttcctttttggagcccttagacagccccgatgagactgaagacccagaaccaaattatgcaggggagccctatgttgccattaaggcctacactgccgtggagggtgacgaagtctccctgttggaaggagaagccgttgaagtaatccacaaactccttgatggatggtgggtgatccggaaagacgacgtgacaggctactttccttcaatgtacctgcagaagagcggacaggatgtgtcccaggctcagcgtcaaatcaaaaggggagccccacccagacggagtagcataagaaatgcgcacagcattcatcagcgaagccgaaagagattgtcccaagacgcctatagacgaaactcagtgcgctttctccagcagcgccgcaggcaggcgaggccaggtccccagtctcccggctctcctctggaggaggagcgacaaacgcagcgatcgaagccgcagccagcagtccctccgaggccgtctgcagatctgatcctgaaccgatgtagcgagagtaccaagaggaagttggcatccgccgtatag

SEQ ID NO: 126406 - DNA, 444 bp, Artificial Sequence
  Description of Artificial Sequence: Synthetic coding sequence
atgacgaaaaaaccagaaacctatctgatgccaaaggatggtaagagcaccgcaacggacattacgggtcccattatattgcagacatatagagctatcgcaaactatgagaaaacttccggctctgaaatggcgctgagtaccggggatgtcgtagaggttgtggagaaatccgaaagtggacagacctctcaccttaccggcctcctgccactggtgctgagaaatccgcaacctcaggccccttgccagggctctgggagcttggcaccagggagaacccccgctctgctcggcgcgcttaacgttcttcccaccctgtgggtggcattctgcctgagtgtccatccagtggtcgcggtggggatttgtgcctggcaagcgggggccggccatgtgtgcgttttctgcctggatggctatggcacagtgtgctccctgtag

SEQ ID NO: 126407 - DNA, 759 bp, Artificial Sequence
  Description of Artificial Sequence: Synthetic coding sequence
atgggcgatacctttatcagacatattgcactcctcgggttcgagaaaaggttcgttccttctcagcattacgtgcacgtgcccggggagatggccggtccggtgggggagggcgggctgcctgcgctgcatcgggatctaagggtgccttctcctaaatggttcgatgggcagagagccgccgaaaaccgacaaggaacactcaccgaatactgtggcacgctgatgtcactcccgacgaagatatctaggtgtccccatctactggatttttttaaagtgcgtcctgatgacctaaaactccctactgacaaccaaaccaagaagcccgagacttatctgatgcctaaagatggcaagagcaccgccacggatattaccggcccaatcatcttacaaacatatagggcaattgccaactacgagaagacttccggttcggaaatggcactttccaccggagacgttgtggaagtggtggagaagagcgaaagcggacagacctcccatctgacaggactgcttcctctcgtgcttcgcaacccccagccacaggccccctgccagggttccgggagtttagccccgggccgaactccagccctcctcggggcccttaacgtcctgccaactctctgggtggccttctgcctgtctgtgcaccccgttgtggccgtggggatatgtgcttggcaggccggagcaggacacgtgtgtgtattctgtctcgatggatacggtaccgtgtgctctctttag

SEQ ID NO: 126408 - DNA, 1581 bp, Artificial Sequence
  Description of Artificial Sequence: Synthetic coding sequence
atgagcctggtagaggcaatcagcctttggaatgaaggcgttcttgccgccgataagaaggattggaaaggcgctctggatgcattttctgccgtccaggatccacactctagaatctgcttcaatatagggtgtatgtatactattctgaagaacatgaccgaggccgaaaaggcgtttactagaagtattaatcgtgacaaacaccttgccgtcgcctacttccaaagaggcatgctgtattaccagaccgaaaagtacgatttggccataaaggatctgaaagaggccctgatccagttgagaggaaatcagctgatcgattacaaaatcctcggcttgcaatttaaactcttcgcctgtgaggtactttacaatattgcattcatgtacgcaaagaaagaagagtggaaaaaagctgaggaacaacttgctctggcgacgtctatgaaaagcgagccgcggcatagcaagattgacaaagcgatggagtgcgtttggaagcaaaagctatatgagccagtggttattccggtgggcaagttgtttcgccccaacgaaagacaggtggctcagctggccaaaaaagattacctggggaaggccaccgtggtggcctctgtcgtcgaccaggacagcttttctggttttgcaccccttcagccacaggccgcggagccgcctccccggccgaagactccagaaatatttcgcgcactagagggcgaagcacatcgcgtgctgttcggattcgtgccagaaaccaaggaagagctgcaggtaatgccaggcaatattgtcttcgtgctgaagaagggaaatgacaattgggccactgtgatgtttaacgggcaaaaaggactagttccctgcaactatctggaacccgtcgagctaaggatccacccccagcagcagccacaggaggagtcgtcaccacagagtgacattccggctcccccatctagcaaggctcccggtcgaccccagctcagccccggccagaaacaaaaggaggagccgaaggaggtgaaattgtcagtcccgatgccgtataccctcaaggtccactacaaatatacggtagtgatgaagactcagccgggtttgccgtactcccaggtgcgggatatggtgagcaaaaaacttgagctgaggttagagcatactaaactttcctatcgaccacgcgattctaacgaactcgtacctttgtccgaggactcgatgaaagatgcatggggacaagtgaagaactattgcctgactttatggtgcgaaaacacagtcggggatcaaggtttcccggatgagcccaaggagagtgagaaagcagacgcgaataaccagactactgaaccacagctgaagaaaggaagtcaagtggaggctctcttttcttacgaggctactcaaccagaagacttggaatttcaggagggcgatattatactggtgctgtccaaagtaaatgaagagtggcttgagggcgagtgtaagggaaaggtaggtatttttccgaaggtcttcgtggaggattgtgctacgaccgacctggaaagtactaggcgcgaggtttag

SEQ ID NO: 126409 - DNA, 1581 bp, Artificial Sequence
  Description of Artificial Sequence: Synthetic coding sequence
atgtccctggtcgaagctattagtctgtggaatgaaggcgttctggcggctgataaaaaagattggaaaggcgccttggacgccttctctgctgtccaggacccacactcgcgtatatgcttcaatattggctgtatgtacactatccttaaaaatatgaccgaggccgagaaagctttcaccaggtcaatcaatcgtgacaaacacctggcagtcgcgtattttcagagggggatgctttattaccaaaccgaaaagtatgatctcgccataaaggacctgaaagaggccctgattcagttgcggggaaaccagctgatagattacaagatccttggcctccagttcaaactgtttgcatgtgaagtgctgtataacattgcatttatgtatgctaaaaaggaggaatggaaaaaggcggaggagcagctggcattagccacttcaatgaagagcgagccacgacactctaaaatagacaaggcaatggaatgtgtctggaagcagaagctttatgaacctgtggtcattccagtgggcaaactgttccgaccaaatgagaggcaagtggctcaactggcaaaaaaagactacctggggaaggccacagttgtggcctccgtagtcgatcaggatagtttttccgggtttgccccactgcaaccacaggccgccgagccgcctccccgacccaagacccccgagattttcagagccctcgagggggaagcgcacagagtgttgttcggcttcgtaccagagaccaaggaggaactgcaggtgatgcctgggaatatagtatttgttctcaaaaagggaaatgataattgggccacagttatgttcaacggacagaagggactggtgccatgcaattacctggaaccagtcgagctccggatccatccccagcaacagccacaagaagaatccagcccccagtctgacatcccggcaccaccaagtagcaaggcccccggccggccccaactgagcccggggcagaaacagaaggaggagccgaaagaagttaagctttctgtgcccatgccttataccctgaaggtacactataaatatacagttgtaatgaaaacccaacctggccttccatactcccaagtgagagacatggtgagtaagaaactggagttgagacttgagcacaccaaattgtcatatcgcccacgtgactccaacgagctcgtgcctctctccgaagactctatgaaggacgcgtggggacaggtgaagaactattgcctcacactttggtgtgaaaacaccgtgggagaccaaggctttccagacgaaccaaaggagtccgaaaaggccgacgcaaacaaccagactactgagccgcagctgaaaaagggatcccaggtcgaggcccttttctcctacgaggccacccaaccagaggatctagagtttcaggaaggtgatataatcctggtcctttccaaggtgaatgaggagtggctggagggagaatgcaaagggaaggtcgggatttttcccaaggtgttcgtggaggactgcgccaccacagatctcgaatctacccggagggaggtgtag

SEQ ID NO: 126410 - DNA, 1797 bp, Artificial Sequence
  Description of Artificial Sequence: Synthetic coding sequence
ggctcccccgcccgaggcgatgccccaacatgtctgctcagcgtgagttggcaactgtcctggccacccagcttctacctcattatgtctctggtggaagcaatttccttatggaacgagggcgtgctcgccgcggacaagaaggattggaagggcgcattagatgccttttcagccgtccaggacccgcactcgagaatttgctttaacatcggatgcatgtacacaatattaaagaacatgaccgaggctgagaaagctttcacccggagcatcaatcgtgataagcacttggccgtcgcgtacttccaacggggcatgctgtactatcagacagaaaaatatgatctagctatcaaagacctaaaagaggccctgattcagcttaggggcaatcaactgatcgattataaaattttggggcttcagttcaagctgtttgcttgcgaggtgctctacaacatagcctttatgtacgccaagaaggaagagtggaaaaaggctgaagaacagctggccctggccacctcaatgaagagtgagccacgccacagtaaaatcgacaaagccatggagtgcgtgtggaaacaaaaactatacgagccagtggttatccctgtggggaagttgtttaggccaaatgagagacaggtggcccagctggctaagaaagactacctcggtaaagcgaccgttgtggctagtgtcgttgaccaggatagcttcagcggatttgctcccctccagccccaggtgcgtcaatctgatctgttgggagctcaggcgggctctgtgagctctaggcaactgcagcttgacgtggaactggaaccagggtggtctcaagtgcctggcagcaagttcagcgttttcgctccttggcatcacgtgaggggatgggggctggacctggtctctatcctgtgcagggcgttggagggtgaggcccaccgcgtcttgttcggatttgtaccggaaaccaaagaagaactccaggtgatgccagggaacatcgtttttgtgttaaagaaaggcaacgataattgggccacggtgatgttcaatggtcagaagggactggtcccttgtaactacctggaaccagtggagctgaggattcatccccaacagcagccccaggaggaatcttcgcctcagagtgatattcccgcgcctccatcttctaaggcgccgggcagaccacaattaagtcctggccagaaacagaaagaagagcctaaggaggtgaagctgagtgtgcccatgccctacactctcaaggtgcactacaagtacacggtagtgatgaagacccagccaggactcccttacagccaagtgagggacatggtgagtaagaagcttgaactgcgcttggaacacactaagctgagctacaggccacgggactccaacgaattagtccctctgtccgaggatagtatgaaggatgcttggggccaagtaaagaactactgtcttacactgtggtgtgaaaacacagtaggagaccaaggcttccctgacgagcccaaagagagcgagaaagccgacgctaataaccagacaacggaacctcagctgaagaaaggtagccaggtggaggcgcttttctcatacgaggctacccagccagaggacctggagtttcaggaaggagacattattctcgtgctaagtaaagtaaatgaagagtggcttgaaggcgagtgcaaaggaaaggtggggattttcccaaaggtctttgttgaggattgtgcaaccactgatctcgaatctacccggagagaagtgtag

SEQ ID NO: 126411 - DNA, 1446 bp, Artificial Sequence
  Description of Artificial Sequence: Synthetic coding sequence
atgtcccttgtcgaagccattagcctgtggaacgaaggtgtgttagccgctgacaagaaggattggaagggggcgttggatgcgttttcggctgtgcaggatcctcatagccgcatctgttttaatatcggatgcatgtacactattttgaaaaatatgacagaggctgaaaaggctttcacacgctcaatcaaccgtgacaagcatctggccgtcgcctatttccagcgcggcatgctgtactaccagaccgaaaagtacgaccttgcaatcaaggatctgaaagaagcgctgatccagctgcggggaaaccagctgattgactacaagattctggggcttcagttcaagctgtttgcatgcgaaaaacagaaactatacgagcccgtagtgattccagtaggcaaactcttcaggccgaatgagagacaggtggctcagcttgccaagaaagactacttagggaaggctaccgtagtggcatctgttgtggatcaggacagtttttccggctttgccccgctgcagcctcaagcggccgagcccccacctaggcccaagaccccggagattttccgcgcccttgagggtgaggcacatagggtccttttcggatttgtcccagagactaaagaggagctgcaggtgatgcccggcaatattgtctttgtcctgaagaagggcaatgacaactgggcgaccgtgatgtttaacgggcagaaaggtttagtgccatgcaattatttagagcccgtggagctgagaattcacccacagcagcagcctcaggaggaatcatcccctcagagcgacattcccgctccccccagctccaaggccccaggcaggcctcaactcagcccagggcagaagcaaaaggaggaaccaaaagaggtgaagttgtccgtcccaatgccctacacactgaaggtgcactacaaatacacagttgtcatgaagactcagcccggactgccatatagtcaagtgcgggatatggtcagtaagaaactcgagctgaggcttgagcacacaaaactgtcatatagacccagggattcaaatgaactggtcccactttcagaagattctatgaaggacgcctggggccaggtgaaaaattactgtctgaccttgtggtgcgaaaataccgttggggaccagggattcccagatgagcccaaggaatccgagaaggccgacgcaaacaatcagaccacagagcctcaattaaagaaggggtcgcaggtggaggcactattctcttatgaagctactcaaccggaggatctggagttccaggaaggagatatcatcctcgttcttagcaaggtgaatgaggagtggcttgaaggtgagtgcaagggtaaggtcgggatttttcctaaggtatttgtcgaggactgtgcaactacagaccttgagagcactcggagagaagtgtag

SEQ ID NO: 126412 - DNA, 1338 bp, Artificial Sequence
  Description of Artificial Sequence: Synthetic coding sequence
atgtcacttgtggaagctataagcctctggaacgagggtgtgctcgccgctgacaagaaggactggaagggggccctcgatgccttctcagctgtgcaggacccacactccagaatctgttttaacataggatgtatgtataccatactgaaaaacatgactgaggccgagaaagccttcacaaggtccatcaaccgcgacaagcaccttgccgtcgcatactttcaaagaggcatgctctactatcaaactgaaaagtatgaccttgcaatcaaggatcttaaagaggcgttaatacagttaaggggtaaccagttaatagattacaaaatcctcgggttacagttcaaactgttcgcctgcgaagttgttgcttcagtggtagaccaggatagcttctctggctttgcgcctttacagccacaggccgccgaaccccctccaaggccaaagactccagagatcttcagagctcttgaaggagaggcccatagagttctcttcggattcgtcccggaaaccaaggaggaactgcaggtgatgcctgggaacattgtgttcgtgctgaagaaagggaatgacaattgggctacggtcatgttcaacgggcagaaaggcctggtcccctgtaactacctcgagccggtcgaactgagaattcatccccagcagcagccgcaagaagaaagctcacctcagtctgatattccggcgccacccagctctaaggctccaggcagaccgcaactgtcacctggacagaagcaaaaagaggagccaaaggaggtaaagctctctgtacctatgccctacacacttaaagtacactacaagtacacagtcgtgatgaagacgcagccgggcctgccttatagtcaggttcgggacatggtcagtaagaagctggaactaagattggagcacactaagctctcttataggccccgcgattctaacgaactggtcccgctgagtgaagattcgatgaaagacgcatggggccaggtcaagaactattgtctgacactgtggtgtgagaacaccgtaggagatcaagggtttccagacgagccaaaggaatccgagaaagccgatgccaataaccagacaacagagccacagctcaagaagggtagccaggtggaggccctgttttcttatgaagcaacccagcctgaagatttggaatttcaagaaggtgacataatcctagtgctgtcaaaggtcaacgaagaatggctggagggcgaatgcaaaggcaaggtcggtatctttcccaaagtgttcgttgaggactgtgcaacgaccgatctggagagtacccggagagaagtctag

SEQ ID NO: 126413 - DNA, 432 bp, Artificial Sequence
  Description of Artificial Sequence: Synthetic coding sequence
atgcctggcaacattgtgttcgtcctgaagaagggcaacgacaattgggcaaccgtgatgtttaacgggcagaagggcttggtgccatgtaactatttggagccagtggaattaagaatacacccacagcagcagccacaggaggagagttcccctcagtccgacatccccgctccgccttcaagtaaggcccccggccggccccagctcagccccggccagaagcaaaaggaagaacctaaggaggtcaagctttccgtccccatgccatacacccttaaggtgcactataagtacactgtggtcatgaaaactcagccagggttgccctactcccaagttcgggacatggtgagcaagaagctggagttgagactggagcacacgaagctgagctatcgtccgcgcgatagcaacgagctggtcccctag

SEQ ID NO: 126414 - DNA, 171 bp, Artificial Sequence
  Description of Artificial Sequence: Synthetic coding sequence
atgccatacaccttaaaggtccattacaagtataccgtggtgatgaaaactcagcctggcctgccgtacagccaagttcgggatatggtttcaaagaaactagagctgcggctggagcacaccaagctgtcataccggcccagggattcaaacgagctcgtacctctgtag

SEQ ID NO: 126415 - DNA, 1020 bp, Artificial Sequence
  Description of Artificial Sequence: Synthetic coding sequence
atggccgtagcccagcagctaagagcagaatccgattttgaacaactcccagacgatgtcgccattagtgcaaatatcgctgacattgaagaaaagagggggttcacatcacatttcgtgtttgtcatcgaagtaaaaactaagggcggcagtaagtacttgatctataggagatataggcaattccacgccctgcagtccaagcttgaggaaagatttggtccagactcaaagtcttcagcactcgcctgtaccctgccaactctaccggccaaagtttatgttggagtcaaacaggaaatcgctgaaatgcgtatccccgccttaaacgcatatatgaagtccctactgtcattgcctgtctgggtcctcatggacgaggacgtgcgaattttcttttatcagtcgccttacgatagtgagcaagtgcctcaggcccttagacgattaagaccgaggacccggaaagtgaagtccgtgtcgcctcaggggaacagtgtggacagaatggccgcgccacgtgccgaggcactcttcgactttactggcaattcgaaactggaactgaactttaaggctggagatgtgatcttcctgctttcaagaatcaataaagattggttggaaggcacagttcggggtgccacgggaatctttcccttgtcattcgtcaagattctaaaggattttcctgaggaggatgatcctaccaactggctgcggtgctattactatgaagataccatcagcaccatcaaggacattgcggtcgaagaggatctttcttctacccccctgctcaaagacctgttagagctgacgcgaagagagttccagagggaggatatcgcacttaactaccgggatgctgaaggtgacctggtgcggctcctctcagatgaagacgtagctctgatggtgcgccaggcccggggtctgccaagccagaagcgacttttcccatggaagctgcatataactcagaaagataactaccgcgtatataacacaatgccatag

SEQ ID NO: 126416 - DNA, 1047 bp, Artificial Sequence
  Description of Artificial Sequence: Synthetic coding sequence
atggctgttgcacaacagcttagagccgaatctgattttgagcaactccccgatgacgtggcaatatccgctaatattgcagacattgaagagaagagggggttcaccagtcattttgtgttcgtgatcgaggtgaaaaccaagggggggagcaagtacctgatttatcgccgatataggcagttccacgcactccagtccaaactcgaagaacgcttcggaccagattctaaaagcagcgcgctggcctgcacgttgccgacgcttcccgcaaaggtctacgtcggagtgaaacaggagatcgctgaaatgagaataccagctctcaatgcttacatgaagtcccttcttagcctgccagtttgggtattgatggacgaggatgtgaggattttcttttaccaaagtccctacgatagtgagcaggtcccgcaggccctgcggcggctgcgaccccgcaccaggaaagtgaaaagtgtgagcccgcagggtaacagcgtggacagaatggctgccccccgggccgaggccctgttcgatttcactggaaattccaagctggagctaaattttaaagctggagacgtaatctttctgttgtccagaattaacaaggactggttggaagggaccgtacgcggcgcaactggtatctttcccctcagcttcgtcaagatccttaaggattttccggaagaggatgacccgaccaactggctgcgatgttactactatgaagacaccatttctacgatcaaatccgtggcatgggaggggggcgcatgcccggcctttctcccctccctgcgacccctgcctttaactagcccaagtcacggctctctgtcccactctaaggcgcccagcggaagccagatgtcgcacaacgcagtcaccagccaccagcgtcctggatggcccggacaaccacacagtccttttccgcaccccactccacatttccagcccgatgcttctctgttgcagccagttacccctctcggcacaagccgttggagaaaaatttcagctgctctaccatactag

SEQ ID NO: 126417 - DNA, 501 bp, Artificial Sequence
  Description of Artificial Sequence: Synthetic coding sequence
atgcgcataccagctctcaatgcctatatgaaatcattactgtcacttcctgtatgggtcctgatggacgaggacgtgagaatttttttctaccaatccccttacgattcggagcaggtaccgcaagcattacggcgcctccgacctaggacaaggaaagtgaagtcggtctccccacaaggtaattccgttgaccggatggctgcgcctcgcgcagaagccttattcgactttacaggtaattcaaaactcgagttgaacttcaaggctggggatgtcattttcctgttatctcgcattaataaagactggttggaggggactgtgaggggcgccacaggaatattcccactctcgttcgtaaagatacttaaagactttcctgaagaagatgatccgaccaattggctccggtgctattattacgaagacacaatttcgaccattaagagcgtggcgtgggaaggaggcgcttgccccgcatttctgccatccctctag

SEQ ID NO: 126418 - DNA, 480 bp, Artificial Sequence
  Description of Artificial Sequence: Synthetic coding sequence
atgaatgacatctcacagaaggctgagatcctgctttcgtcgagtaaacctgtacccaaaacatacgtccctaagctcggaaagggcgacgtgaaagataaatttgaagcaatgcagagggcccgagaggaacggaaccagcgccggtctagggacgagaagcagaggagaaaagaacagtacatcagggaaagagaatggaaccgtcgaaaacaggaaataaaagagatgctggctagcgacgacgaagaagatgtgagctcgaaggttgagaaggcctatgtgcctaagctcaccggtaccgtgaagggaagatttgctgagatggaaaagcagagacaagaggaacagcggaaaagaacggaagaagagaggaagagacgaattgagcaagatatgttagaaaaaaggaagattcagcgcgagctagctaaacgcgccgagcagaagctggcccggagggatggagcccacctatag

SEQ ID NO: 126419 - DNA, 1836 bp, Artificial Sequence
  Description of Artificial Sequence: Synthetic coding sequence
atgaatgacatctcacagaaagcggagatcaaagaaatgttggcatccgatgatgaagaggatgtgtcctctaaggtggagaaggcttatgtccctaagctgaccggcaccgtgaaaggcaggtttgccgaaatggaaaaacagaggcaggaagaacagcgaaaacggacagaagaagaaagaaaaaggcgtattgagcaggatatgctagagaagaggaagatccagcgcgagctcgctaagagagcagagcagattgaagacataaataatacagggaccgagtcagcctcggaggagggcgacgacagccttctgataaccgtggtcccagtgaagtcctataaaacaagtggtaaaatgaagaagaattttgaggatttagagaaggaacgggaagaaaaggagcgtatcaagtatgaggaagataagagaataagatacgaggaacagcggccgtcactgaaggaagcaaagtgcctttccctggtaatggacgatgagatagagagtgaggctaagaaagaatctttatccccaggcaaacttaaattgacattcgaagagctggagaggcagcggcaagagaatagaaagaagcaagcagaagaagaagccagaaaacgcttggaagaggagaagagagccttcgaagaggccaggagacaaatggtgaatgaggatgaagaaaatcaggacactgctaagatctttaagggctatcgcccgggaaaactgaagctgtcctttgaggagatggaacggcaacggagagaggatgagaagcggaaagccgaggaagaggcccgccgtcgcatagaggaagaaaagaaagccttcgctgaggcccgaagaaacatggttgtggatgacgactcccccgagatgtataagaccatttcccaggaatttctaactcctggcaagcttgagattaatttcgaagagttgctcaagcagaaaatggaagaagagaaacgacgcaccgaggaggaaagaaagcacaaactagaaatggagaagcaggagttcgaacaacttagacaggaaatgggcgaggaggaggaagaaaacgagactttcggactcagccgagagtacgaggagctgatcaaattaaagagatcaggcagcattcaggccaagaatctcaaatccaagtttgagaagatagggcagctgtcagaaaaggagattcagaaaaaaatagaggaggaacgggcgcgacggcgggccatagatctcgaaattaaagagcgggaagccgaaaactttcatgaagaagatgatgtggacgtcaggcccgccaggaagagcgaagccccctttactcataaagtgaatatgaaagcccggttcgagcagatggccaaggctcgggaagaagaagaacagcggaggatcgaggaacagaagctcttaagaatgcagtttgagcagagagagatagacgccgctctgcagaagaaacgcgaggaagaggaggaggaggaggggtctataatgaatggtagtacagcagaggatgaggaacagactcggagcggagctccttggtttaagaaaccgctgaaaaacaccagcgtggtggactctgaacccgtgagatttacagtgaaggtcacaggtgagcctaagccggagatcacttggtggttcgagggcgaaattctccaggacggcgaagactaccagtatatcgaacgtggcgagacgtactgcctctacctgcctgagacattccccgaagacgggggagagtatatgtgtaaagccgttaataacaagggctcagccgcaagcacatgcatcctcactattgaatccaagaactag

SEQ ID NO: 126420 - DNA, 2028 bp, Artificial Sequence
  Description of Artificial Sequence: Synthetic coding sequence
atgaatgacatttcgcagaaggcagaaattctactcagttctagcaagccggtgcccaagacgtacgtccctaagctcggcaaaggagatgtgaaagataaattcgaagcaatgcagcgcgcccgcgaagagcgcaatcaaaggcggagtcgggacgagaagcaaagacggaaggagcagtatatcagggagagggagtggaataggcggaagcaggagattaaggaaatgttggcgtcagacgatgaggaagacgtctcaagcaaggtggaaaaggcctatgtccccaagctgaccgggacggttaaaggccgatttgccgaaatggagaagcagcgacaagaggagcagaggaaaaggactgaagaagagcggaagaggagaattgaacaggatatgctggaaaagcggaagatccaacgtgagctggccaagagggccgagcagattgaagatatcaacaacacgggcactgaatcagcttccgaggagggcgatgattcactgttaattactgtcgttcctgttaagtcctataagacctccggcaaaatgaaaaagaactttgaggatttagaaaaagagagagaggaaaaagagagaataaagtatgaggaagataaaaggatccgctacgaagagcaaaggccttccctgaaagaggctaagtgtctctccctcgttatggatgacgagatagagtccgaggccaagaaggagtctcttagccccgggaaattaaagctgacttttgaggagttggaacgccagcggcaggaaaatagaaaaaagcaggccgaagaggaggcccggaagcggctggaagaagaaaaacgggctttcgaagaggcacgtcggcagatggtaaatgaggatgaggagaatcaggacacagctaaaatctttaaggggtatagacccggtaaactgaaactatccttcgaggagatggagaggcagcggcgcgaagacgaaaaaagaaaggccgaggaggaggcaaggaggcgtatagaggaagagaagaaggcctttgcagaggccaggcggaatatggtcgtcgatgacgattctccagagatgtacaaaactatctctcaggaattcctaactcctggaaagctcgaaattaactttgaggaacttctcaaacaaaaaatggaggaagagaaacgccggactgaagaagagcggaaacataaactcgagatggagaagcaggagtttgagcagctccgacaggagatgggagaagaagaggaggagaacgaaacgttcggacttagccgcgaatacgaggaactgatcaagctgaagcggtccggctcaattcaggcgaaaaacctgaaatccaagttcgagaagattggccagttatccgagaaggaaatccagaagaagatcgaggaagagcgcgcacgcagacgtgccatcgatctcgaaattaaggagagggaggctgaaaacttccatgaagaagatgatgtggacgtcaggcccgcacgcaagtcagaagccccctttacacacaaggtgaacatgaaggcccgttttgagcagatggcgaaagcccgagaggaggaagaacagcggcggattgaggagcagaaactcctgcggatgcagttcgagcagagggaaattgatgccgccctgcagaagaagcgcgaggaagaagaggaggaggagggcagcataatgaacggcagcacagcagaggatgaggaacaaacccgctcaggggccccttggtttaagaaacctctaaagaacacatctgtggtggattccgaacccgttcggttcaccgtgaaggtcacaggcgagccaaagcctgagattacatggtggtttgagggagaaatcctgcaagacggggaggattatcagtacatcgagcggggcgagacatactgtttatacctgccggagactttccccgaggatggcggagagtatatgtgcaaggcagtgaacaataagggatctgctgcctcgacatgtatactcactatcgagagcaaaaactag

SEQ ID NO: 126421 - DNA, 1731 bp, Artificial Sequence
  Description of Artificial Sequence: Synthetic coding sequence
taagtcaaaggacggtttgcggaaatggagaagcagcgccaggaagagcagaggaaacggaccgaagaagaaagaaagcgccggatcgagcaggatatgctcgaaaaacgcaaaatccagagggagctcgccaagcgcgctgaacagatagaagatattaataataccgggaccgagtcagcctctgaagaaggtgacgactctcttctcatcaccgtagtccccgtcaaaagttacaagaccagtggaaagatgaagaaaaacttcgaggacctggaaaaagaaagggaagagaaggagcggataaagtacgaagaggataagcggatccggtacgaggaacaacggccaagtctcaaggaggcaaagtgcctctccctggtcatggatgatgagatcgaatctgaagctaaaaaggaatccttgagtccgggaaagctaaagctgaccttcgaggagctggagcgccagcggcaggagaacagaaaaaagcaagccgaggaagaggcacggaagaggttggaagaagaaaagcgggcttttgaagaggctaggaggcaaatggtgaacgaggacgaggagaaccaggatacagccaaaatctttaaggggtaccgtccaggcaaacttaaactgtcattcgaggaaatggagaggcagcggcgggaggacgagaaacggaaagctgaagaggaagccaggcggagaattgaagaggaaaagaaggcctttgccgaggctagacgcaacatggtcgtggacgatgatagcccggagatgtacaaaacaatttcacaggaatttctcactcccgggaaattggagatcaactttgaagagctcttgaaacagaaaatggaagaggagaaaaggcgaaccgaagaggagaggaagcacaaactcgaaatggagaaacaggagttcgagcagctgcgccaagaaatgggggaggaagaagaagaaaatgaaacttttggactcagccgtgagtacgaggagctgatcaagttgaaacgaagtggatccattcaagccaaaaacctgaagagcaaatttgaaaagattgggcagctgtctgagaaagaaatccagaaaaagatcgaggaggagagagctaggcgtagggccatagacctggagattaaggaacgcgaagctgagaatttccacgaggaggacgacgtggacgttaggcccgcacggaagagcgaggcacctttcactcataaggttaatatgaaagctcgtttcgagcagatggctaaagcccgggaggaagaagagcagcggagaatcgaagagcagaaactgctgcgcatgcagtttgaacagcgggagattgacgccgctcttcaaaagaagcgcgaagaagaagaggaagaggagggatccattatgaatggtagcacggccgaggacgaggagcagaccaggtccggggcgccttggtttaagaaacccctgaaaaacacctctgtggtcgattcggagcctgtcagatttacagtaaaagtgactggggagcccaagcctgaaatcacctggtggttcgagggggagatcctacaagacggcgaagattatcagtatattgaacgtggcgaaacctattgcttataccttcccgagactttccctgaggatggcggagagtatatgtgcaaggcagtcaataacaaggggtcggcagcgtcaacctgcatcctcacaatcgagaccgacgattattag

SEQ ID NO: 126422 - DNA, 966 bp, Artificial Sequence
  Description of Artificial Sequence: Synthetic coding sequence
atgaacgacatctcgcaaaaggcagaaatcaaggagatgttggcctccgatgacgaggaagacgtgagtagcaaagtcgagaaggcttacgttcccaagttgaccggcaccgtaaaagggcggttcgccgagatggagaagcagaggcaggaagaacagcgtaagagaactgaggaggaacgtaaacggcggatcgagcaggatatgcttgaaaagcggaagatacagagagagctggctaaaagggccgaacaaatagaggatattaacaacacaggcaccgagagcgcttccgaggagggcgacgattccttgttgattacagtggttcctgtgaagagctacaagacctccggtaaaatgaaaaaaaatttcgaagacttggagaaggagagagaggagaaagaaagaatcaaatacgaggaggacaagcggatcaggtacgaggagcagcggccatctctgaaggaggcaaagtgcttatccctggtaatggacgacgagatagagtccgaagctaaaaaagaatctttatctcctggcaagctcaagctcacattcgaagagttggagcgccagcgacaagaaaaccgcaagaagcaggccgaggaagaagctaggaagaggctggaggaggagaagcgggcatttgaggaggcccgaagacaaatggtgaacgaagacgaggagaatcaagataccgcaaagatttttaagggatatagacctggaaagctgaagctgtccttcgaggagatggaacggcaacgacgggaggacgagaagcgaaaagctgaggaagaggctcggaggagaatagaggaagaaaaaaaggcgttcgccgaggctaggcggaatatggttgtggacgacgatagtcctgaaatgtataaaaccatctcccaggaattcctgacccctggaaagctggagatcaatttcgaggaactccttaagcaaaagtag

SEQ ID NO: 126423 - DNA, 1308 bp, Artificial Sequence
  Description of Artificial Sequence: Synthetic coding sequence
atgaacgatatatctcagaaggccgagatcttgctgtcatcttctaagcccgtcccgaagacgtacgtgcctaagttgggaaagggcgatgtgaaagacaagttcgaagcaatgcaaagagctcgggaggaacggaatcagcgacgatctcgggatgaaaagcaaagacggaaggaacagtacattcgtgagagagagtggaaccgaaggaaacaggagatcaaagaaatgttggcctctgacgacgaggaggacgttagttctaaggtggagaaagcctacgtgcctaagctcactgggacagttaaaggtagattcgccgagatggaaaaacagcgccaggaggagcagcggaagcgcactgaggaggagcggaagcgtcgtatagaacaggacatgctagagaagcggaagatccagcgagaactggccaagcgagcggagcaggagggtgacgatagcctgctcataacagtagtcccagtgaaaagctacaagaccagtggcaagatgaagaagaattttgaggatctcgaaaaggaacgggaggaaaaggagcggataaaatatgaagaagacaagcgcattcgctacgaagagcaacgaccctctctgaaagaggccaagtgtctttccctcgttatggatgacgagatagagtctgaggctaaaaaagaaagtctcagcccgggtaagctcaaactgaccttcgaagaactggaaagacaaagacaagaaaaccgaaagaagcaggcagaggaagaggctcggaaaagactggaggaagagaaacgggctttcgaagaggcacgccggcagatggtaaacgaggatgaggagaaccaagacaccgctaagattttcaaaggctatcgcccaggtaaactgaaactttcatttgaagagatggagagacagagacgggaggacgagaaacgtaaggcggaagaagaggcacggaggcggatcgaagaggaaaagaaggcctttgctgaagcccgccggaacatggtggtggacgacgactcaccagaaatgtacaagaccatcagccaggagtttctgacgcccgggaaactcgagatcaattttgaagagctgctcaagcagaaaatggaagaagagaagcgtcgaactgaggaagagaggaaacacaagcttgagatggaaaagcaggaattcgagcaactccgccaggagatgggggaggaggaggaggagaatgagacatttggactgtccagagagtacgaagaactcatcaagctgaagcgcagcggatccatacaggcaaagaacttaaagtag

SEQ ID NO: 126424 - DNA, 1989 bp, Artificial Sequence
  Description of Artificial Sequence: Synthetic coding sequence
atgaatgacattagccagaaggcagaaatcttgctctcatctagtaaacctgttccgaagacctacgtgcccaagctagggaagggagacgtcaaagataaattcgaagctatgcagagggctcgcgaagagcgcaatcagcgcagatctagagatgagaaacagcgacgcaaggaacagtacattagggaacgggagtggaatcggagaaaacaagagattaaagaaatgctagcaagcgatgacgaagaggacgtctcctcaaaggtggagaaggcctatgtccccaagctgactggtactgtgaaaggtagattcgccgagatggagaagcaaaggcaggaggaacaaaggaagcgaaccgaggaggagagaaaacggcgcatagagcaagatatgctggaaaaaagaaaaatccaaagagaattagctaaaagagctgagcaggaaggagatgatagtttgctcatcaccgttgtgcctgtgaaatcatataagacgagtgggaagatgaagaagaacttcgaagacctcgagaaggagagggaggagaaagagcgtattaagtacgaggaagataagaggatcagatacgaggagcagaggccatccctcaaagaggctaagtgtctctctttggttatggacgatgaaatcgagtccgaagctaaaaaggaaagcctatcgcccgggaaactgaagctcaccttcgaagagctggagagacagagacaggaaaaccgtaagaaacaggccgaagaggaagcccgtaagaggctggaggaggagaagagagcctttgaggaggcgagaaggcaaatggtcaatgaagatgaggagaaccaggacacagcaaagatattcaaagggtatcggccagggaaactcaagctgagctttgaggaaatggagaggcagcgtagggaggacgaaaagcgcaaggctgaggaagaagctcgtagacgaatcgaagaagaaaagaaagcgtttgctgaagctcggcggaacatggtcgtggacgatgactcacccgagatgtacaaaactattagtcaggagtttttaacaccagggaagctggaaattaattttgaggagcttctcaaacagaaaatggaggaagaaaagagacgaactgaggaggagaggaagcacaaactggaaatggaaaaacaggaattcgagcagttacgccaagaaatgggagaagaggaagaggaaaatgagacctttggcctgtcgagagagtatgaagaactgattaagctcaaacgcagcgggagtatacaagcaaaaaatctgaagagcaaattcgagaagatcgggcagttgtcagaaaaagagatccagaagaaaattgaagaagaaagagcgagacgccgggcaattgatctggagatcaaagagagggaggctgagaatttccatgaagaagacgacgtcgatgtaaggccagccagaaaaagcgaggccccattcactcacaaagtgaatatgaaagccaggtttgaacagatggccaaggcgcgtgaggaggaggagcagcgcaggatcgaggagcagaaactcctgagaatgcaatttgagcagagagagatcgatgcagctctccaaaaaaaaagagaggaagaagaggaggaggagggatcaataatgaatggttccaccgccgaggatgaagaacaaacgcgatccggagctccctggtttaaaaagccattgaagaacacttcggtcgtggattcggaacctgtccgttttacagtgaaagttactggtgaacccaagcctgagattacttggtggtttgaaggcgagatcctgcaagatggggaggattatcagtatatagaacgtggcgaaacatactgcctgtatcttcctgagacctttcccgaggatggcggcgagtacatgtgcaaagcggtgaataataaaggctctgccgcctccacttgtatcttaacaatcgagacggacgactactag

SEQ ID NO: 126425 - DNA, 813 bp, Artificial Sequence
  Description of Artificial Sequence: Synthetic coding sequence
atggagaatcagccagtccggtggcgcgctttacctggcctccctaggccccccggcctgcccgcagcgccttggctgctgttgggagtgctcttactgcctggtacacttcgcctcgccggcggacagagcgtgacgcacacgggtctgcctattatggcatcgctggccaacacggccatttctttctcctgtcggatcacatacccttacacaccccagtttaaagtgttcacagtcagttattttcacgaagacctgcaaggacagcggagcccaaagaagcctaccaattgccaccccggcctggggaccgagaaccaaagccacactctggactgtcaagtgactttagttctgcccggtgcatccgcgacaggcacctattattgctctgtgcactggcctcattccaccgttcgtgggtcaggtacttttatactcgtaagggacgccgggtatagagagcctccacagtctccccagaagttgctgctgtttggttttacgggtctgctgagtgtactcagcgtggtcggaaccgcactgctgttgtggaataagaaacgtatgagaggccccggaaaggatcccacgaggaagtgtccagacccccgcagcgctagctcgccaaagcagcatccgtcagagagcgtgtataccgcactgcagcggagagagaccgaagtgtatgcttgcatcgaaaacgaggacggctcatctcccaccgcaaaacagtctcccttgtcccaagagcgccctcaccgcttcgaggacgatggtgagttgaacttggtgtatgagaacttgtag

SEQ ID NO: 126426 - DNA, 1248 bp, Artificial Sequence
  Description of Artificial Sequence: Synthetic coding sequence
atggccccggtgagtgggtcacggtcccctgacagagaggcctccggttctggggggcggagaaggtccagcagtaaatcacccaaaccctcaaagagtgctcgctccccccgggggcgtagatctcggagccacagctgttctaggtctggtgacaggaacggtctaactcaccagctcggggggctgagccagggttctcgcaatcagtcctaccggagtcgaagtcggagtcggagcagggaaagaccctcagctccccggggcatcccattcgcctcggctagtagcagcgtgtattacggatcttattcacggccgtacggtagcgacaaaccctggccctccctattggacaaagagagagaggagagcctgagacagaaacggctgtcagaaagagagcgcatcggcgagctcggtgcgcctgaggtttgggggctgagtcccaagaatcccgagcctgacagcgacgaacacactcccgtagaggacgaggaacctaaaaaatctaccacaagcgccagtactagcgaggaagaaaagaaaaagaaatcgtctagaagtaaagaaaggtctaaaaaaagacgaaaaaaaaaaagtagcaagcggaagcataaaaaatattccgaagatagcgacagcgactctgactctgagacggactcctcagatgaagacaataagagacgggccaaaaaggccaaaaagaaggagaaaaaaaagaagcaccgctccaagaaatacaaaaagaagagaagtaagaaatcgcgtaaagaatcctctgacagcagctcgaaggaaagtcaggaggagttcctggagaatccctggaaggaccgaaccaaggctgaggagccatctgacctgatcggtcctgaagcccctaagaccctcacctctcaggatgataagcccctgaattacggtcacgcactgctcccaggcgaaggcgcagctatggccgagtacgtcaaagccgggaagcgcatcccaagacgaggtgagattggcctgaccagtgaggagatcgcttcctttgaatgctccggctacgtgatgagcggtagcagacaccgaagaatggaggcggtgagactgcgcaaagaaaatcagatctattccgcagatgagaagagggccctggcctcgtttaaccaggaggagaggcggaaaagggaaaacaagatcctagccagttttagggagatggtgtataggaaaactaaagggaaggacgataaatag

SEQ ID NO: 126427 - DNA, 2073 bp, Artificial Sequence
  Description of Artificial Sequence: Synthetic coding sequence
atggagaagattctgcagatggccgagggcatcgatataggcgagatgccctcttatgacctggtactgtcaaagccttccaagggccagaaacgccacttgtccacgtgtgatggtcagaatcccccaaagaagcaggctggctctaagttccacgcccgacctaggtttgaacccgtacacttcgtagcgagtagctcaaaggatgagcggcaagaggacccatatggtccccaaactaaagaggtaaacgagcagactcacttcgcatccatgcctcgagacatctaccaggattatacccaggactccttctccatacaagacggcaactcacagtactgtgacagcagcggcttcatcttaacaaaagatcagccagtcacagccaacatgtatttcgacagcggaaatccagccccgagcaccacctcccagcaggccaactcccaaagtacaccagagccctcccccagccagacttttccagaatcagtggtcgccgaaaagcagtactttatcgagaagcttacagctactatatggaagaaccttagcaaccccgaaatgactagcggctcggacaagatcaattacacatatatgctgacccgatgcatacaggcctgcaagaccaatcccgaatacatttatgctcccctgaaggagatacctcctgctgatatcccaaagaacaagaagttactgactgacggttatgcctgtgaagtccgctgccagaacatctacctgaccacagggtatgctgggtcaaaaaacggctctcgagaccgagcaaccgagctggcagtcaagctcttacaaaaacggatcgaggtacgcgtggtgagaaggaaatttaaacacaccttcggggaggatctcgtggtttgccaaataggcatgagctcatacgaatttccacctgctctcaagccccccgaggatcttgtggtacttggtaaggacgccagcggccagcccatttttaatgcttcggccaagcactggaccaacttcgtaataaccgagaacgctaatgatgcaatcggaatactcaataattccgcaagcttcaataaaatgtcaatcgaatataagtacgaaatgatgcccaaccggacatggaggtgccgtgtgtttctgcaggatcattgtctcgctgaaggatacggcaccaaaaagacctccaagcatgcagccgcggacgaagccctgaagatcttgcaaaaaacccaaccaacgtatccaagtgtgaagagcagtcagtgtcacaccggtagtagcccccgagggagtggtaagaaaaaggatattaaagacctagtcgtctacgagaactccagtaatcccgtttgcacactcaatgacacagctcaatttaatcgcatgacagtagaatacgtgtatgaacggatgacaggacttcggtggaagtgtaaagttatcctcgagagcgaggtcatcgccgaagccgtgggagtcaaaaagaccgtaaaatatgaggctgctggagaggccgtcaagaccctgaaaaagactcagcctaccgtgattaacaatttgaaaaagggcgcagtggaggatgtaataagtcggaacgagatccagggacgctccgcagaagaggcctacaaacagcagataaaagaagataatattggcaatcaactgctccgaaagatggggtggacgggaggtggactgggcaagagtggagaagggataagggaacccatctctgtgaaagaacaacataagcgcgaaggcctcggcctggatgtcgaaagagtcaacaaaatcgctaaaagagacatcgagcaaataataaggaactacgcacggtcagaaagccatacagacctgacattttctcgtgaattaacaaacgatgaacgcaaacaaatacatcaaattgctcagaagtacggcctcaagtcaaaatcccacggcgtagggcatgaccggtacctggtcgtgggcagaaaacgtaggaaggaggatcttttggaccagctcaagcaggaaggacaagttggtcactatgaactggtgatgcctcaggccaattag

SEQ ID NO: 126428 - DNA, 2073 bp, Artificial Sequence
  Description of Artificial Sequence: Synthetic coding sequence
atggaaaagattttgcagatggccgaaggcattgacatcggcgagatgccaagctatgatctcgtcctgtctaagccatctaaaggtcagaaacggcatttgtcaacttgtgacggacagaaccccccaaagaaacaggccggaagcaagttccacgccaggccacgctttgagccagttcacttcgtggcctcttctagtaaggacgagcgccaggaagatccctatggcccccagaccaaagaagtgaacgagcagacacattttgctagtatgccgcgagatatttaccaggattacacccaggatagtttctctatacaggacggtaacagccaatattgtgactcctccggcttcattttgacgaaagatcaaccagttaccgctaacatgtacttcgactccggcaatcctgccccttctaccacaagccagcaggccaatagccaaagcactccagaacctagcccttcccagacttttccagaaagtgtcgtagccgagaagcaatacttcatcgagaagctgacagcaacaatttggaaaaatctgtctaacccagagatgacctctgggtctgataagattaattatacctacatgcttactcgatgcattcaagcatgcaaaaccaatcccgagtacatttacgccccccttaaggaaattcccccggcagacattcctaagaacaagaagctactgacagacggttacgcgtgcgaggtgagatgccagaatatctacctgacaaccggctatgccggctcaaagaacgggtcaagagatagggcgaccgagttggcggtcaagcttctgcaaaaacgcatagaagtgcgggtcgtgcggcggaagtttaagcatacattcggagaggatctagtggtctgtcagatcggcatgtctagttatgagtttccaccagcactgaagcccccagaagatttggtggtactcggaaaggacgcctcaggacaacccatttttaacgccagcgccaaacactggaccaacttcgtgatcactgagaatgctaacgacgccattggtattctgaacaatagcgcctcgttcaataagatgagtattgaatataaatatgagatgatgccaaataggacctggcgatgccgcgtgttcctccaggaccattgcctggccgagggctatggaacgaagaaaacatcaaagcatgcagccgccgacgaagccttaaaaattttgcaaaaaactcagcccacctaccctagtgtgaagtcttctcagtgccacaccgggtcttctccgcgagggtccggaaaaaaaaaggacattaaggacctcgtggtgtatgagaacagctccaacccagtgtgcaccttgaatgataccgcgcagttcaacagaatgaccgtcgagtatgtctacgagcggatgacgggcctaagatggaagtgtaaagtgatccttgagtctgaggttattgccgaagcagtcggcgttaagaaaaccgtgaaatatgaagccgcaggggaagcggttaaaaccctcaaaaaaacacaacctactgtcataaataacctgaagaaaggggctgtggaggatgtgatctcccgcaatgaaatacagggccggtctgccgaagaagcatacaagcagcagataaaagaggataacatcggtaaccaactcctccggaaaatggggtggactggaggtggcctgggaaagagcggcgaaggtattagagaaccaataagcgttaaggagcaacacaaaagggaggggttgggactcgacgtggaacgggtgaacaaaattgccaaacgtgatattgagcagattatccgcaattatgccaggtcggaatcccacaccgacttgactttctcaagggagctaaccaacgacgaacgcaaacagattcaccaaatcgcccaaaaatatggcctgaaatctaagagccacggggtgggccatgacagatatctggtggtgggtcggaagcggagaaaggaggatctcctggatcagctcaaacaggagggccaggtcggacactacgagctggtgatgccgcaagccaattag

SEQ ID NO: 126429 - DNA, 2118 bp, Artificial Sequence
  Description of Artificial Sequence: Synthetic coding sequence
atggggttcatgttgcccctaatctttaggtattcgcccaggctcatggagaagattctgcagatggcagagggaatcgatatcggagaaatgccctcctatgatttggtcctttcgaaaccctctaagggacagaaaaggcatctgagcacatgtgatggccagaatcctccgaagaagcaggccggctccaaattccacgcacgcccaaggttcgaaccagtgcattttgtagccagctcttccaaagatgagcgccaggaagacccatacggaccacagactaaggaagtaaacgaacagacccacttcgctagcatgccacgggacatttaccaagactacacgcaggattccttctctatccaagacggcaattcacagtattgcgacagctccggcttcattttaaccaaggatcagcccgtcacagcaaacatgtatttcgatagtgggaatccagcaccttctacaactagccagcaggcaaattcgcagtctacacctgagccaagcccctcacagacattcccggaaagcgtggtggccgagaaacaatatttcatcgagaaactcactgctaccatttggaaaaatcttagcaaccctgagatgacatccggtagcgataagattaactacacttacatgctcaccaggtgtatccaggcatgcaagacaaatcccgaatatatttatgcccccctcaaggagattccgccagccgatattccaaaaaacaaaaagctgctcaccgatgggtacgcctgcgaggtgaggtgtcagaacatatacctgaccacgggctatgctggcagcaagaatgggagcagagaccgtgctactgaacttgcagtcaaactgcttcagaaaagaatagaggtgcgagtggtcagaaggaaatttaagcacacctttggggaagacctggtggtatgccagataggcatgtcttcctacgagtttcctcccgcgcttaagccgcccgaagacctggtggttttgggcaaggacgcatctggacagcccatcttcaacgcatcagctaagcattggactaactttgttatcaccgagaacgccaatgatgccatcggcatcttgaataacagcgcctcttttaacaagatgagtatcgagtataagtatgagatgatgcccaacagaacctggaggtgtagggtctttttacaggaccactgcctggctgagggctacggtaccaagaaaaccagtaaacacgccgctgctgacgaggccctaaaaatcttacaaaaaacccagcccacatatcccagtgtgaagtcgagtcaatgtcataccgggtcctcaccccgcggctcggggaagaagaaagacatcaaagacctcgttgtgtacgaaaactcttcaaaccccgtttgtaccctaaacgatacagcccagtttaaccgcatgacagtggagtatgtctatgaaaggatgactggcttgcgatggaaatgcaaagtcattttagaatccgaagtcatagccgaagctgtcggcgtgaagaagaccgtcaaatatgaggccgccggcgaggcagtcaagaccctgaagaagacccagcctactgtgattaataatctgaagaaaggcgccgttgaggatgttattagccgtaacgaaattcagggtaggtcagccgaggaagcttacaagcaacagatcaaagaagacaacattggcaatcagcttcttcgcaagatggggtggactgggggtggactcggaaagagtggcgaagggatccgagagcctatctctgtcaaagagcagcataagagagaaggcctgggcctcgatgtggaacgtgtgaataagatcgctaagcgcgatattgaacagattattagaaattatgcacggtcagagagtcacactgatctgactttttctagagaactcactaacgatgaacgcaaacagatccatcaaatagcccagaagtatgggctgaaaagcaaaagtcatggagtgggacacgatcgctacctagtcgtcggccggaagcggcggaaggaagatctgctcgaccagctgaagcaagagggccaggtgggacactacgagctagtaatgccacaagctaactag

SEQ ID NO: 126430 - DNA, 570 bp, Artificial Sequence
  Description of Artificial Sequence: Synthetic coding sequence
atgctcctacgtgccgcgtggaggagggctgccgtagccgtgactgctgctcccggacctaagcctgcagcaccaactcgcggtctccgactacgcgtcggcgacagagcccctcagtctgccgtgccggccgacaccgccgcagcgcccgaagtggggcccgtgctgcggcctttgtatatggatgtgcaggccacaacccctctggatccgagggtgctcgatgccatgttgccctaccttatcaattactatggaaatccccattcccgcactcacgcttacggctgggagtcagaggctgccatggagcgagctcgccagcaggttgcatctctcatcggagcagacccgcgagaaattattttcacctcaggggctaccgagtcaaacaatattgccataaaaacggaaagtcattctgtaatacaggccggggtgcagtggcatgatctggattccctgcaagccccaccccccgggtttaccccctttagttgcctcagcctactatccagctgggactaccgcaggccccccccccacccagctaactttctttacttctag

SEQ ID NO: 126431 - DNA, 1374 bp, Artificial Sequence
  Description of Artificial Sequence: Synthetic coding sequence
atgctactcagagcagcttggaggcgcgcagctgtggctgtgaccgcagctccaggccctaagccggcagcgccaacacgagggctacgtctccgtgtgggcgatcgggcacctcagtccgccgtcccggcagacaccgcggccgccccagaagtcggccccgtgctgagaccactgtatatggacgttcaagccactacaccattagatccaagggttctggatgccatgttgccctaccttattaattactacggcaaccctcattcaagaactcacgcttacggctgggagtccgaagcggccatggagcgcgctagacaacaggtagccagtcttattggggccgaccctcgggagatcatcttcaccagtggcgcaacagagtctaacaacatcgccattaagggagtggccagattctatcgatccagaaaaaagcacctgataaccacccaaaccgagcataaatgcgtgctcgatagctgtcgctctctggaagcggaggggttccaggtgacgtatctgcccgtacaaaagtcagggatcatcgatctgaaagagttagaggcggccattcagcccgatacctcactggtgtctgtaatgacagtgaacaatgagatcggggtcaagcagccgatcgctgaaattggccggatctgttcttcccgcaaggtatacttccatacagatgcagcccaggccgtgggcaagatccccctggatgtgaatgatatgaaaatcgatctgatgtcaatctcagggcacaaaatctacggccctaaaggggtgggcgccatctatattcggaggcggccgagagtgagagtcgaggctctccagtccggaggggggcaggaacggggtatgagatccgggaccgtgccaacccccctggtagtcgggctgggtgccgcttgcgaagtggcccagcaagagatggagtacgatcacaagcgcatctccaaattatctgagcgcctaatacagaacattatgaagtccctgccagacgtggtcatgaacggcgacccgaagcatcactacccaggttgcattaatctcagcttcgcatacgttgagggagagagtctcttgatggcccttaaagatgtagcattgagtagcgggtcggcctgcacatccgcttccctggagcccagctatgtgttacgggctatcggtacggacgaggacttggctcattcttccattagattcggcatcggacgcttcaccactgaagaggaagtggactacaccgtggagaagtgcatccagcatgtcaaacggctgagggagatgtccccgctgtgggagatggtacaggatggaatcgacctaaagagtatcaaatggactcaacactag

SEQ ID NO: 126432 - DNA, 486 bp, Artificial Sequence
  Description of Artificial Sequence: Synthetic coding sequence
atgttactcagggcagcttggagaagagccgcagtcgcggttactgccgcccctgggcctaagcccgccgctcctactaggggccttaggctccgcgtgggggacagagcgcctcaatcagctgttcccgcagacaccgccgccgcccctgaagttgggcccgttctacgcccgctgtatatggacgtgcaggccacgacgcctctggacccaagggttttagacgcaatgctgccatatttaatcaattactacggcaatccccacagccgtacgcatgcctatggctgggaaagcgaagcggccatggagcgagccagacaacaggtcgcctccctgatcggcgcggatccccgagagatcatctttacctccggagcaacagagtcaaacaatatagctattaaaggggtagcacggttttacagaagcagaaaaaagcatctgattaccaccctttcgggaggggcgggcgggtgtgtttag

SEQ ID NO: 126433 - DNA, 768 bp, Artificial Sequence
  Description of Artificial Sequence: Synthetic coding sequence
atgacggtcaacaacgaaatcggggtcaaacaacctatcgccgaaataggaaggatctgctcatcccggaaggtgtacttccatacggacgcagcccaagccgtgggaaaaattcctctcgatgtgaatgacatgaagattgatctaatgtctatcagcggccacaagatatacgggcctaagggagtgggggccatttatatcaggcgacgaccccgagtcagggtggaggcgctgcaatctggcggagggcaggaacggggcatgaggtcaggaacggttcctacaccgctcgtggtgggcctcggagccgcctgcgaggtggcgcagcaggaaatggagtacgaccacaaaagaatatccaagttgagcgagagactcatacaaaacataatgaaatccctgcccgatgttgtcatgaacggcgaccccaagcaccattatccgggctgcattaatctgtccttcgcttacgtagagggcgaatccctactcatggctctcaaggatgttgcactcagtagcggtagcgcatgcacatccgcctcactggagcccagttacgtcctgagggcgatcggaacggatgaagacctcgctcattccagtatccgattcgggattggcagattcaccaccgaggaagaggtcgactatactgttgagaagtgtattcaacacgtcaagcgtctccgcgaaatgtccccattgtgggaaatggtccaggacggtatcgacctcaagtcaatcaagtggacacagcattag

SEQ ID NO: 126434 - DNA, 1221 bp, Artificial Sequence
  Description of Artificial Sequence: Synthetic coding sequence
atgctgttaagggccgcctggagaagggccgcagtggctgtcacagcggcccccgggccaaaacctgcggcccccacaagagggttgcgcctgagagtgggcgacagggccccacagtcagcggtgcctgccgacacagcagccgcccccgaagtgggccccgtcctccggccactgtatatggatgtgcaggccacaaccccgcttgacccgcgggtactagacgctatgctgccgtacctgatcaactattacggaaaccctcattcccggactcacgcatacgggtgggagagcgaggctgccatggaacgagccagacagcaggtggcgtctcttattggcgccgatccgcgcgagattatcttcacatctggggccacggagtcaaacaacatcgcaatcaaggaactggaagctgccattcagcctgacacttctctggtctcggtaatgactgtcaataatgagatcggtgtgaaacagcccatagctgaaatcggtcgaatctgctcctctcggaaggtatactttcacactgatgcggcccaggcagtgggaaagattcccctcgacgttaatgatatgaaaatcgatttaatgtccatttctgggcataagatctatggacccaagggtgtcggcgcaatctacattcgacgccgccctagggtgcgcgtagaggccctgcagagcggaggggggcaggagagagggatgcgctctggcaccgtccccaccccactggttgttggactcggcgcagcatgcgaagtagcccagcaggaaatggagtatgaccacaaacgtatcagtaaactgagtgagagactgattcagaatatcatgaaaagcttgccagatgttgtaatgaatggggatcctaagcatcactatcctggctgcatcaacctctcattcgcctatgtagagggagaatccctgctcatggctttaaaagatgtagcactctcctccggcagcgcctgcaccagcgctagcctcgaaccaagttacgtcctaagggccatcggcaccgatgaggatctggcccatagctcaatcagattcggcatcggccgcttcaccacggaggaagaggtcgattataccgttgagaagtgcattcaacacgtcaagcggttaagagaaatgtcgcccctgtgggagatggtgcaagacggaatcgatctcaagagcatcaaatggacacagcattag

SEQ ID NO: 126435 - DNA, 693 bp, Artificial Sequence
  Description of Artificial Sequence: Synthetic coding sequence
atgctcaaaaatccttatacaattaaaaagcagcccctgcatcagtttgtccagcgccccctgttccccctgcctgctgccttttaccacccagttcgctacatgtttattcaaactcaggacactcccaatccgaattcgctgaaatttatacctggcaaacctgtgctcgaaacgagaaccatggatttccccaccccggcggccgccttcagaagtccccttgcgcgacagctgttccggattgaaggtgttaaatccgtattcttcggtcctgacttcatcacagttaccaaagaaaacgaggaactcgactggaacttgttaaaacccgacatctacgctaccattatggattttttcgctagcggtcttcctctggtgactgaggaaacgccttctggagaggcagggtcagaggaggatgatgaagttgtggccatgattaaagaacttctcgataccagaatcagaccaaccgtgcaggaggatggcggcgacgtcatatataaaggctttgaggacggaatcgtacagcttaaactgcaagggtcttgtacttcatgccctagcagcattataaccctgaagaatggcatccagaatatgctgcagttctatattcctgaagtagagggcgtcgagcaggtgatggacgacgaatctgacgagaaggaggcgaacagtccttag

SEQ ID NO: 126436 - DNA, 342 bp, Artificial Sequence
  Description of Artificial Sequence: Synthetic coding sequence
atggattttttcgcctccggacttcccttagtgacagaggagacccccagcggcgaagctggctctgaagaggacgacgaggttgtagccatgatcaaggagctgctcgatacgcgcatacgacctaccgttcaggaggatggcggagatgtaatatataagggatttgaggatggtattgtccagctgaagctccaagggagctgcacctcatgtccgtcaagcataatcacgctgaagaatggcatccaaaacatgctgcagttttacattccagaggtcgagggagtcgaacaggttatggacgatgaaagtgatgaaaaggaggcgaattccccatag

SEQ ID NO: 126437 - DNA, 765 bp, Artificial Sequence
  Description of Artificial Sequence: Synthetic coding sequence
atggcagccaccgccagacggggatggggcgccgccgcagtggcggccgggctgaggcggagattttgtcatatgctgaagaacccttacacaatcaaaaagcagccattacaccagttcgttcagcgccccctattcccactgccggcagccttctaccaccctgtgagatacatgttcatacagactcaggacaccccaaatcctaattctttgaagttcatcccgggcaaacctgtgctggaaactcgtacaatggactttccaaccccggccgccgcctttcgatctcctttggctagacagctttttaggattgagggagtgaaatcagtgttcttcggtcccgacttcatcacagttactaaagaaaatgaggagctcgattggaatctgctgaagccagacatttacgctacgattatggattttttcgccagtggactgccacttgtgactgaagagaccccgtcaggagaggccgggtccgaggaagacgatgaagtggtggccatgattaaagagctgctggatacaagaattcgccccacagttcaggaggacggcggcgatgtgatctataaaggatttgaagacggcattgtgcagttgaaactgcagggttcctgcaccagctgtccatcctcaattatcacgctgaagaacggaatccagaatatgctgcagttctatattcctgaagtggagggagtggagcaggtgatggacgatgagtccgacgagaaggaagcgaattccccttag

SEQ ID NO: 126438 - DNA, 300 bp, Artificial Sequence
  Description of Artificial Sequence: Synthetic coding sequence
atggacttttttgcatcaggtctgccactggtgaccgaagagactccaagtggcgaggcaggctccgaggaggacgacgaagtcgtggctatgattaaggaactgttggacactagaataaggcctaccgtccaggaggatggaggcgacgtgatatataagggttttgaggatggaattgtgcagctgaaacttcaaggttcctgtacgtcctgtccttcttctattattactctgaaaaatggtatccagaacatgcttcagttttatattcctgaagtggagggtgtggagcaatag

SEQ ID NO: 126439 - DNA, 342 bp, Artificial Sequence
  Description of Artificial Sequence: Synthetic coding sequence
atggatttcttcgcctcgggtcttccactggtgactgaggaaacaccatcaggagaggcgggctcagaggaagacgatgaggtggttgctatgattaaagaactcctggacaccagaattagaccaactgtgcaggaagatggcggggatgtcatttataaagggtttgaggacggaatcgtgcaactgaaactacagggatcttgcactagttgtccttcaagtatcatcaccctgaagaatggcatccagaacatgttgcagttttatattcccgaggtagagggtgtggaacaggtgatggacgatgagtccgatgagaaggaggctaactccccatag

SEQ ID NO: 126440 - DNA, 291 bp, Artificial Sequence
  Description of Artificial Sequence: Synthetic coding sequence
atggactttttcgcctctgggttgcctctcgtgactgaagagaccccctcaggagaggccgggtcagaagaggacgatgaggttgtggccatgattaaagagttattggatacgagaatcaggcctacagtgcaggaagacgggggcgatgtgatctataagggcttcgaggacgggatagtgcagcttaagctacagggctcatgcactagctgtcccagttctatcataacactgaagaacgggatccaaaatatgttacagttttatattcctgaggtggagggctag

SEQ ID NO: 126441 - DNA, 1464 bp, Artificial Sequence
  Description of Artificial Sequence: Synthetic coding sequence
atggctgctgcactgccccgcacgctgggagagttacaactgtaccggatcctgcaaaaagccaacttgctgtcctattttgacgcttttattcagcaagggggcgatgatgtgcaacagctgtgcgaagccggcgaggaggagttcttagaaatcatggctttggtaggcatggccagcaagcctcttcacgtcagacgcctacagaaggccctgcgcgactgggtgaccaaccccggcctgttcaaccagcccctgactagcctccctgttagcagtatccccatttataagttgccagagggctctcccacatggttagggatttcttgctcatcatatgaaaggagttccaacgccagagagccacatctgaagattcccaaatgcgcggcaactacttgcgtacagtcacttggccaggggaagtctgacgtggtgggctcactggcgctgcaatcagtaggagagagcaggctgtggcaaggtcatcatgctaccgagtcggagcattctctgtcccccgccgatctagggagtcccgcctctcccaaggagagctccgaggcactcgacgcagctgctgccctcagtgtggccgaatgtgtcgagcgtatggcccccaccctgcccaaaagtgatttgaatgaggtgaaggaacttctgaaaacaaataaaaaacttgctaaaatgattgggcacatatttgaaatgaacgatgacgaccctcataaggaagaagaaatccgcaaatatagcgccatctacgggcgcttcgatagcaagcgaaaagacggaaagcaccttacgctgcatgagcttactgtcaatgaagccgcagctcagctgtgcgttaaagacaacgctctcttaactcgaagagacgagcttttcgcgttggcacgtcagatcagccgggaagttacatacaaatacacctaccgtaccactaaatcaaaatgtggcgaacgtgatgaactgagcccaaagcggatcaaggtggaggatggctttcccgactttcaggattcagtacagacactattccaacaggcacgcgctaaaagtgaggagcttgcagccctctcatcccaacagccagaaaaggttatggctaagcagatggaattcttgtgcaatcaggcggggtatgagaggctgcagcatgccgaaagacgcctgtccgccgggctgtaccgccagtcaagcgaggaacattcgccaaatggactgacttccgacaactcggatggacagggggaacgcccactgaaccttcgtatgccaaacctgcagaatcgccagccccatcacttcgtcgtcgacggcgagttgagtcgcctgtatccctcagaagcgaagtcccatagttctgagagcctgggcattctgaaagattatccccactcagccttcacactcgaaaagaaagtgattaagaccgaacccgaggatagtagatag

SEQ ID NO: 126442 - DNA, 1377 bp, Artificial Sequence
  Description of Artificial Sequence: Synthetic coding sequence
atggcagccgccctgcctcggacccttggcgagctgcagctctaccgaattctgcagaaggccaacctgctgagctacttcgatgcattcattcagcaaggtggggatgatgtgcagcagttgtgtgaagccggtgaagaagagttcctggagattatggcgctcgtaggcatggcaagcaaaccactacatgtaagacggctgcaaaaagccctgagagactgggttactaatcccggcctattcaaccaacctttgaccagcctgccggtcagctctatcccaatttacaaattgcccgaagggtctcccacatggttaggcatcagctgttcatcctacgaaagatccagtaacgcaagggagccacacctcaaaataccaaaatgcgccgcaaccacgtgcgtgcagagcctagggcaggggaaatcagatgtggtgggcagccttgccctccagagcgtgggggagagcagactgtggcaaggacaccatgctactgaatctgaacactctctgtccccagctgatctgggctctccagcgtcccctaaggagtctagtgaggcactggacgcggctgccgccctatctgtggccgagtgcgtggagaggatggcacccaccctgcccaagagcgatttaaacgaagtgaaagaactgttgaagacaaataaaaagctggcaaagatgattggccacatttttgaaatgaatgacgacgatccgcacaaggaagaagagattaggaagtattctgccatttacggaaggttcgatagtaaacgcaaagatgggaaacacctgactctccacgaactgactgtgaatgaggctgcagctcagctgtgcgtgaaggacaacgcgctattgacaagaagagacgagttgtttgccttggcccggcagatcagtcgcgaagtaacctataaatatacctatcggaccaccaaatcaaaatgtggggaaagagatgagctgtcccccaagcggatcaaagtcgaggatcagccagagaaagtgatggccaagcaaatggagttcctctgtaatcaggcgggctacgagagattgcagcacgctgagcgcaggctgagtgccgggctgtatcggcaaagctccgaagaacactctcccaacggcctgacgtccgacaactccgacggacagggagaacgccccctgaacctgagaatgccaaatctacagaaccgccaaccacaccactttgttgttgatggagaactgtcacgtctgtatcccagcgaagcgaagagtcattcctccgagtccctgggcatcttaaaagactacccacacagcgccttcacccttgagaagaaagttataaagaccgagcccgaggactctagatag

SEQ ID NO: 126443 - DNA, 1464 bp, Artificial Sequence
  Description of Artificial Sequence: Synthetic coding sequence
atggcagcagccctgccccgcactctaggtgagctgcaactgtatcggattctgcaaaaggcaaatttgttgagttatttcgacgccttcatacagcagggcggggacgatgtacagcagctttgtgaggccggcgaggaagagtttttagaaatcatggctctggttggcatggcctctaagccactacacgtcaggaggctgcagaaagccctgcgagattgggtgactaatccaggcctgttcaatcaacccctgacctcacttcctgtgagtagcattcctatctacaaactgccagagggtagccccacctggctgggaatttcctgttcttcatatgagcggtcaagtaacgcaagggagccgcatctgaaaattccaaaatgcgctgccaccacttgtgtacagtcgttaggccaagggaagagcgacgtggtaggatcacttgccctccagtctgtgggcgagtccaggctgtggcagggtcaccatgccacagagtcagaacattcactttcacccgccgacctaggatcacccgcttctccaaaggagtcttccgaggcactggacgctgccgccgccctttccgtcgctgagtgcgtggagaggatggctcccactctacctaagtcggatctgaatgaggtgaaggaactgctgaagaccaataagaagctggcgaaaatgatcggccacatcttcgagatgaacgatgatgatccgcataaggaggaagagatcagaaaatacagtgccatttatggcagatttgactccaaacgcaaagacggtaagcatttaacactacatgaattgactgtgaacgaggctgcggcccagctgtgcgtgaaggacaatgccctgctgacacgtcgcgatgagctgttcgccctggccaggcagatctcacgcgaagttacgtacaaatacacctacaggaccactaaatcaaagtgcggtgaacgggatgagctctctcccaagcgtataaaggttgaggacggattccctgacttccaggattctgtccagactttgtttcagcaggccagggccaaatccgaggagctggccgctttaagcagccaacagccggagaaggttatggctaaacaaatggagtttctgtgtaaccaggctggctacgaaaggctgcagcacgcagagcgtcgcctgagtgcgggcctgtaccgccagtccagtgaagagcattcccctaacggcctcacatctgataattctgacgggcaaggcgaacgccccctgaacctgcggatgcccaatctgcaaaaccgtcagcctcatcactttgtcgtggatggggaactaagtcggttatatccaagcgaagctaaatcacacagttcagaatccttggggatcctcaaagattacccacacagcgcattcacgctggagaagaaagtgattaaaaccgaaccggaagacagtaggtag

SEQ ID NO: 126444 - DNA, 1461 bp, Artificial Sequence
  Description of Artificial Sequence: Synthetic coding sequence
atggccgccgccctaccaagaactttgggcgagttacagctgtaccgaatattacagaaggctaacctgctcagttattttgatgccttcattcagcaggggggtgatgacgtccaacagctgtgtgaggccggagaggaagagttccttgagatcatggctctggttggaatggccagcaagccactccatgtgaggaggttgcagaaagctctccgcgattgggtgactaaccctgggctcttcaaccagcctctgacatcgcttcctgtgtcctcaatccccatttataagttgcccgaaggatcaccaacatggttaggcatatcctgttcttcatatgagaggtcctctaacgcacgagaacctcacctcaagattcccaagtgcgccgcaactacatgtgtacaaagcctgggtcaaggaaaatctgacgtagtcggcagcctggctctgcaatctgtcggtgagtcccggctttggcaaggtcaccacgctacagagagcgaacactctctgagtccagccgatctaggaagtcctgcgtcccctaaggagtcatcggaggccttggatgctgccgccgcgctgagcgtagctgagtgtgtcgagcgtatggctcctaccctcccgaaaagcgacctgaatgaagtgaaggaactacttaaaaccaacaagaagctcgccaagatgattggccacatctttgagatgaatgacgatgatcctcataaagaggaagagatccgtaagtattctgcaatctatggccgatttgacagtaagagaaaggatggaaaacaccttaccctccatgagcttactgtgaacgaagccgccgctcagctgtgcgtaaaggataacgcgctcctgactaggcgggacgaactcttcgcgctggcccggcaaatatctcgcgaggtaacctataagtacacctaccgaacgaccaaatccaaatgcggagagagggatgagctttcaccgaaaaggattaaagtggaggacggattccctgacttccaggattccgtccagacattgttccagcaagcccgcgccaagtccgaggagctggctgctcttagcagtcagccagagaaggtgatggccaaacaaatggagttcctgtgcaatcaggctggttacgagcggctgcaacatgcagagagaaggctctccgccggcctgtatcggcagtcttccgaggagcacagccctaatgggctgactagcgacaactcagatggacaaggagaacgccccctgaatttgagaatgccaaatctacaaaatcgccagccccatcacttcgtggttgacggggagttgtctagactgtatccgagcgaagcaaaatcccattcctccgagtcccttggtattttgaaggactacccacactcagcctttacattggagaagaaagtaatcaagaccgaacccgaggacagcaggtag

SEQ ID NO: 126445 - DNA, 474 bp, Artificial Sequence
  Description of Artificial Sequence: Synthetic coding sequence
atggcagctgccctgccacgaactctcggcgaactccaattgtaccgtattctgcagaaggccaatctcctgtcttactttgatgcctttatccagcagggaggcgacgatgtccaacagctgtgcgaggctggggaagaagaattcctcgagatcatggctctcgtcggaatggcatcgaaaccattacacgttaggcggctgcagaaggcccttcgtgattgggtaaccaacccgggactgttcaatcagcccttgacctctctccccgtttctagtattcctatatacaaacttccagagggctcaccaacttggctgggtatctcgtgctcctcctacgaacgctcaagcaacgcaagggagccacacctgaaaatccccaaatgcgcggccacgacctgtgtccagtccctggggcagggaaagtccgacgtagtggggtctcttgctttacagtcggtaggagagtag

SEQ ID NO: 126446 - DNA, 189 bp, Artificial Sequence
  Description of Artificial Sequence: Synthetic coding sequence
atggccgctgcgttgcccagaacccttggcgagcttcagctttataggatcttgcaaaaagccaatttattgagctacttcgatgcctttatccagcagggaggcgacgatgtgcagcagctctgcgaggccggggaggaggagttcctggagataatggctctggtaggtatggctagtaaaccttag

SEQ ID NO: 126447 - DNA, 303 bp, Artificial Sequence
  Description of Artificial Sequence: Synthetic coding sequence
atggcagccgccctgcctcggactctgggggaattgcaactgtaccggattctccagaaggcaaatctcctctcctacttcgatgcatttattcaacagggtggtgatgacgtgcagcagttgtgtgaagctggggaggaagaattcctggagatcatggcattagtcggcatggcctctaaaccactccacgtccggcgactccaaaaggctctgcgggactgggtgactaacccaggtctgtttaatcagcctctgacgtcactcccagtctcctctatccctatttacaaactaccttag

SEQ ID NO: 126448 - DNA, 723 bp, Artificial Sequence
  Description of Artificial Sequence: Synthetic coding sequence
tagaaggaattgttgaaaacaaacaagaaactggccaaaatgatcggacatatctttgaaatgaatgatgacgacccacataaagaggaggagattcgaaagtactccgccatttatggtagattcgatagcaagcgtaaggacggcaaacatttgacgcttcacgagctgaccgttaacgaggcagccgcccagctctgtgttaaagacaacgccttgctgacgaggagagacgaattgttcgcactcgccaggcaaatctccagggaagttacctacaagtacacatatagaacaactaaatcgaagtgtggtgagcgggatgagctcagccccaaacggatcaaggttgaacagcctgaaaaagtcatggcgaaacagatggaattcctgtgtaatcaagccggttacgagaggctacagcacgccgaaagacgactctctgccgggctataccgtcagtcatccgaagaacacagccccaatggcttgaccagtgataacagcgatggacagggagagcggcccttaaatctgagaatgcctaacctccagaacagacagccccatcacttcgtcgtagacggcgagctgagtcgcctgtacccctctgaggctaaaagccacagttctgaaagccttggaatcctgaaggactacccccacagcgcgttcactctggagaagaaagtaattaaaaccgaacctgaagatagtagatag

SEQ ID NO: 126449 - DNA, 459 bp, Artificial Sequence
  Description of Artificial Sequence: Synthetic coding sequence
atggcagccgcactcccacgtactctgggagagctacagctctaccgaattctccaaaaagcgaatctgttgtcctacttcgatgcttttattcaacaaggtggggacgatgtgcagcaactctgtgaagctggggaggaggagtttctagaaatcatggccctcgtgggtatggcctctaaacctcttcacgttagacggctgcagaaggcactgcgtgactgggtgactaacccaggtctgttcaaccagccactgacatcgctcccggtgagtagcattcccatctacaagcttcctgaaggaagccccacatggctaggtattagctgcagttcctacgagcgctcctccaatgcgcgggaacctcacctgaaaataccaaagtgtgcggccactacctgtgttcagtcactgggccaggggaagtcagacgtggtggggagcttggccctgtag

SEQ ID NO: 126450 - DNA, 684 bp, Artificial Sequence
  Description of Artificial Sequence: Synthetic coding sequence
atgatcggccacatctttgagatgaacgatgacgatccccacaaggaggaagaaattaggaagtacagtgcaatctatggcagatttgattccaagcgcaaagatggcaagcacctgacccttcacgagttaacggtgaacgaagctgctgctcagttgtgcgtcaaggacaacgccctcttgaccagaagggacgaactatttgcacttgcgagacagatatcaagggaggtgacttataagtacacttaccgcaccacgaaaagcaaatgtggggagagagacgagttgagtcccaagcgtatcaaagtcgagcagccagaaaaggttatggctaagcagatggagttcctgtgtaaccaggcaggatacgaaaggcttcaacacgccgagagaagactctctgctgggctgtaccggcaaagtagcgaggagcattcacctaacggattaactagtgataacagtgatggtcagggagaacggccccttaatctacgtatgccgaacctgcagaatcgccaaccacaccactttgtggtggatggggaactgtcacggctctaccctagcgaggccaagagccactcatctgaatccttgggcattctaaaggactaccctcactccgcattcaccctggagaaaaaggtcataaagacggaaccggaagactcaagatag

SEQ ID NO: 126451 - DNA, 1578 bp, Artificial Sequence
  Description of Artificial Sequence: Synthetic coding sequence
atgcacagggcgccctcccccacagccgagcagcctcccggcggcggtgactctgcaaggagaaccctgcagccacgattgaagccctctgctcgcgctatggccctgcctcgtaccctcggcgagctccagctctatcgcgtcctgcagagggctaatctgctctcgtactacgaaacctttattcagcaagggggggatgatgtgcagcaactgtgtgaggccggagaagaggagtttctggaaatcatggccctggttgggatggctacaaaaccgctgcacgtgcgtaggctgcagaaggccctgagagagtgggccactaatccaggcctattcagccagccagttccggctgtgcctgtctcttctattccgctgttcaagatttccgaaaccgctggaactaggaagggctccatgtccaacggtcacggctcacctggcgaaaaggctgggagcgcccggagttttagcccaaaatcccctctggaactgggggagaaactctcccccttgcccggcggcccgggagctggtgatccaaggatttggccaggtcggtccaccccagagtctgacgtgggtgcgggaggcgaggaggaggcagggtctccccccttctcgccacccgccggcggtggcgtcccggaggggacaggcgccggaggtctcgccgccggcggcacaggtggtgggcctgatagactggaaccggagatggtgagaatggtggtcgaaagcgtagaaagaatttttcgcagctttccccgcggagacgctggtgaagtgactagcctacttaaactcaataaaaagctggcaagatctgtagggcatatttttgaaatggatgataatgattctcaaaaggaagaagaaattcgcaaatatagcatcatatatggcaggtttgattccaaacgcagagagggcaaacagctgtcactgcacgagctaaccattaatgaagccgccgctcagttttgcatgagggacaacactcttctcctgaggcgagtagaactgttttctctgtcccgacaagtagctagagagtccacttacctgtctagcctgaaaggatctcgactacaccccgaagaactgggcggtcccccactgaaaaagttgaagcaggaagtgggagagcagtcccatcctgaaattcagcaacctcctcccggccccgagagctatgtgcccccgtacagaccaagtctggaggaagacagtgcatcattaagtggggaaagtctggatgggcacctgcaagccgtaggaagctgtccgcgcttaaccccaccacccgccgacctgcccctagcactgcccgctcatggtctgtggtcccgccatatcttacagcagaccctgatggacgagggcctccgactggcccggcttgtcagccatgatcgggtgggccgactgtccccctgtgtgccagcaaagccgccactcgcagagttcgaggaagggcttcttgatcgctgccctgcacccgggccacatcccgccttggtcgaggggcgcaggagtagcgtgaaagtcgaggccgaggcaagccgacaatag

SEQ ID NO: 126452 - DNA, 1386 bp, Artificial Sequence
  Description of Artificial Sequence: Synthetic coding sequence
atgcacagggccccctccccgacggcggagcagccgccgggcgggggcgattccgcacgccggacccttcagccaagactcaagcctagtgcccgcgctatggctctacctcggacgctgggcgaactgcagctatatcgagttctgcagagagccaacctcctgtcttactatgaaactttcatccagcagggcggtgacgacgtgcagcagctgtgtgaagctggggaagaagaattcctcgaaattatggccctagttggcatggctaccaagccattgcatgtgaggcggctgcagaaagctctcagggaatgggccacaaacccaggactttttagtcaacccgtgcctgcagtaccagtctctagcatccccctctttaagatttccgaaaccgctggcacaagaaaagggtcaatgagcaatggccacgggtcccccggggaaaaagcaggcagcgcccgcagcttcagcccaaagtcccctctcgaactgggcgaaaagttgagtccactgcccggcggccccggcgctggggacccaaggatatggcccggccgttcaacacccgaatccgatgtgggggccggaggtgaagaggaggctggctccccaccattcagtcccccagccggggggggcgtgcctgaaggtaccggcgcaggaggcctcgcagctggcggcacgggtggtggtccagacagactcgagccggagatggtgagaatggtcgtagagtccgttgaacgcatcttcagaagttttcctaggggcgacgccggcgaggtgactagccttctaaaactcaacaagaaacttgctcggagcgtgggccatattttcgaaatggacgataacgactcccagaaggaggaagagattaggaaatattcaataatctatggacgctttgatagcaaaagaagggagggcaaacagttgtcactgcacgaactgactatcaatgaggctgctgcgcagttctgcatgcgcgacaatactttgcttttgagaagggttgaactctttagcctctcccggcaggtggctagagagtcgacctatctgagttccctcaaaggaagtcgactccatcccgaggaattaggtggtccccccctgaaaaaactgaagcaggaagttggagaacagtctcatcccgagatccaacaaccacctccggggccagagagttacgttccgccataccggccttctcttgaggaagattcagccagcctttcaggtgagtccctcgacggtcatcttcaggagtttgaagaagggctgctggatcgctgtccagcacctggcccccaccctgctctggtggagggccgaagatcatcagtcaaagtggaggcagaggctagccgacagtag

SEQ ID NO: 126453 - DNA, 969 bp, Artificial Sequence
  Description of Artificial Sequence: Synthetic coding sequence
atgcaccgggcccccagccccaccgctgagcaaccccccggcggcggggactccgcgaggcgcaccttgcagcccagactgaaaccatccgcgcgggccatggccctgccaaggacactcggggagttgcagctctaccgggtgctgcaaagggcaaacctgctgtcttactacgagaccttcattcagcaaggcggcgatgacgtgcagcaactgtgtgaagcgggagaagaagaattcctcgaaatcatggccctggtcggaatggctacaaagccactccacgtgaggaggcttcagaaagccctcagggagtgggctactaaccctggactcttcagccaacctgtcccagctgtaccagtgtcgtccattcccttgtttaaaattagcgagaccgctggcacccgtaaagggagtatgagcaatggccacggttcccccggcgagaaagccggcagtgcccgttccttcagtcctaaatctcctttagagttgggggaaaagttatctccactgcccggaggtcccggtgccggagacccacgaatatggcccgggaggtctacacccgaatccgacgtcggggccggcggtgaagaggaagcggggtccccaccattctcgcctcctgccgggggaggggttcctgagggcacaggagcagggggcctggccgcgggagggactgggggcggaccagaccgcttggagcctgagatggtgcgaatggttgttgagtcagtggagcggatattccgcagttttccaagaggagatgcaggggaagtgacctcactcttaaaactgaataagaaattagcccgaagcgtcgggcacatctttgagatggacgataatgactctcagaaagaggaggagatccgcaagtacagtattatctacggccgcttcgactcgaagaggcgtgaaggaaaacagctgagcctccatgaggcatccccgtag

SEQ ID NO: 126454 - DNA, 723 bp, Artificial Sequence
  Description of Artificial Sequence: Synthetic coding sequence
taatcagggtcagcgtctcctgctgtggcggaattatgtcagaacacccctgaaacctttctggaagcctcaaaattgctacttacctatgcggataacattttacggaaccctaatgacgaaaaatatcgaagtatacggattggtaacacagccttctcgactagattactgccggttcgcggggctgtggagtgtctgtttgagatggggttcgaagagggcgagacccaccttatttttcccaaaaaagcgtctgtagagcagttgcaaaaaatcagggatctgattgcaatagaacgcagtagtcgactcgacgggagtaataaatctcacaaggtgaaaagttctcagcagccggccgcctctactcagctaccaacaacccctagcagtaatccctccggtctgaaccagcacacccgtaaccggcaaggccagagcagcgatccccccagcgctagtaccgttgcggcagatagtgcgatcctagaagttcttcagagtaacattcagcacgtgctcgtttacgaaaaccctgccctgcaggagaaagccttagcctgcattccagttcaggaactcaaacgtaaaagtcaggagaagctgtcaagagcgcgtaaacttgacaaggatattattacactgcgcaatttctggaagcaggatgtggatggcgtggcctccgggcctattgtgctgcattgtgctgctgagctttag

SEQ ID NO: 126455 - DNA, 1965 bp, Artificial Sequence
  Description of Artificial Sequence: Synthetic coding sequence
atggcagctgcagcactgggcagctccagcgggtcggccagcccagccgtggccgaactctgccagaatactccagaaaccttcttggaagccagtaaactgctcttgacctatgcagataatattttgagaaatcctaacgacgagaaatatcgatcaatacgaatcggaaacaccgcattcagtacccgcctgctgccggtcaggggtgctgtggagtgccttttcgagatgggctttgaggaaggggagactcacttgatcttccccaagaaagcgagcgtggaacaactgcagaagataagagacctgattgcaatagagagatcatcccggttggacggcagtaataaatctcataaggtaaaaagttcccagcaacctgccgcctctactcagctgccaaccaccccctcttccaacccatctggtctaaatcagcatactagaaacaggcagggacagagctctgaccctcccagcgcctctaccgtggccgccgatagcgccattctggaggtcctacaaagcaacattcagcacgtcctggtatatgagaatcccgccctccaggagaaagctctggcttgtattcctgtgcaagaactcaaaagaaaatcccaggagaagctgagcagagcccgcaagttggataaaggcatcaatatatccgatgaggacttcctgctgctcgagctgcttcactggtttaaggaagagttcttccattgggttaacaacgtgctctgctccaagtgcggagggcagacaagaagccgcgacaggagcctgctaccatctgacgatgagctgaagtggggtgctaaagaagttgaggatcactattgcgacgcctgccagttttccaaccgcttccccaggtacaacaaccctgaaaagctacttgaaaccagatgtggacggtgtggcgaatgggccaattgttttacattatgttgtcgcgcagtgggcttcgaggcacggtatgtatgggattacacagaccacgtttggaccgaggtatattcaccctcccaacaaagatggcttcactgcgatgcctgcgaagatgtctgcgataagcccttactttacgaaataggctggggtaagaagctgagttacgtgatagctttctcaaaagacgaggtggttgatgtcacatggcggtatagttgtaagcacgaagaagtcattgcccggcggactaaagtgaaggaagccttgctgcgtgacactattaacggtctgaataagcaacgtcagttattcctctccgaaaacaggcgaaaagaattgctgcagcgcattattgtggagttagtcgaatttatcagtccaaaaacgccgaagcccggggaactggggggccggatctccgggtccgtggcctggagggtagcccggggtgagatgggactacaaaggaaggagactcttttcataccctgcgaaaacgaaaagatatccaagcagttacacttgtgttacaatatcgtcaaagacaggtacgtccgcgtttcaaacaacaaccagaccattagcggttgggaaaatggcgtgtggaaaatggagagcatcttcaggaaagtcgagactgactggcacatggtctacttggcaaggaaagagggatccagcttcgcgtacattagctggaagtttgaatgcggcagtgtaggactgaaggtggactccatcagtatccggacctccagtcagacctttcaaaccggtaccgtggagtggaagcttcggagtgatactgcacaggtcgagctcacgggcgacaactcccttcattcatacgctgacttttcaggtgccacagaggtcatcctggaggccgagctgtctcgaggagatggagatgttgcatggcagcacacccagttatttcggcagtcgttgaatgaccacgaggaaaactgtcttgagattatcattaagttctccgatctgtag

SEQ ID NO: 126456 - DNA, 1902 bp, Artificial Sequence
  Description of Artificial Sequence: Synthetic coding sequence
gctgccttgggttcctcatctggttccgcctcgcctgccgtagccgaactttgtcaaaatacacccgagacatttctggaggctagtaaactcctgctcacatacgccgataatattttaaggaatcctaacgacgaaaagtataggtccattagaatcgggaacactgccttcagcacaaggctcctgccggtgaggggtgccgtggagtgtctctttgaaatgggcttcgaggagggcgaaactcatctaatattcccaaagaaggcctcggtggaacagctgcaaaaaattcgagatcttatcgccattgagcgttcctccagactggacggctccaacaagagccacaaggtcaaaagcagtcaacaaccggccgcgtcgacccagctaccgacgaccccaagctctaatccctccggcctgaatcagcacacaaggaatagacagggccagtcttctgatcccccatccgcctccacggttgccgccgattctgctatactggaggtactgcaaagcaacatccagcacgtcctggtctatgagaatcctgccctgcaagagaaagctctagcctgtatccccgtgcaggaactgaagcgaaaatcccaggaaaagctgagccgagcaaggaaactggataaaggcatcaatataagcgatgaggacttcctgttgctggagcttctacattggttcaaggaagaattcttccattgggtgaataacgtcttgtgttcgaaatgcggcggacaaacccggtcgcgcgataggtcccttctcccttctgatgacgaactgaaatggggggcaaaagaggtggaggatcattactgcgacgcttgccagttcagcaaccggttcccacggtacaacaatcccgagaagctattggagacgaggtgcggaaggtgcggtgagtgggcaaattgtttcactttgtgttgccgggcagtaggcttcgaggctcgctatgtgtgggactataccgagctgcagcggacattgagcctcaaactgacaactctgaaggagataggaaaaacatttctccggatctcaaagagacagaagctcatccaagtggtagacgtcacttggcgctattcgtgcaaacatgaagaagtgatcgctaggcgcactaaggtgaaggaggctctcctacgagacactataaacggcttgaacaagcagagacagcttttcctaagtgaaaataggagaaaggagctcttgcagaggattatcgtagagctggtggagttcatttctcccaagactcccaaaccaggcgagctgggtggccggatttctgggtcggttgcatggcgagttgcaaggggagagatgggactccagagaaaggagacattatttatcccatgcgagaatgagaagatttctaaacagctccatctctgctataatatagtgaaagatagatatgtgcgggtaagcaacaacaaccagacaataagtggctgggagaatggggtgtggaaaatggagtcgatttttcgcaaggtagagaccgattggcacatggtttacctggcacggaaagaggggtcttctttcgcttatatcagctggaagttcgagtgtggatcagttggcctgaaggtcgactcgatttcaatacgaacaagctcacagacattccaaacaggcaccgttgaatggaagctgcgcagtgatacagctcaggtcgagctgacaggagataatagcctccattcctatgccgatttctctggagccaccgaagtgatcttggaggccgagctgagtcggggagacggtgacgtggcctggcagcatacacagttgttcagacagagcctgaacgatcacgaggagaactgtctggagattatcatcaagttttctgatctgtag

SEQ ID NO: 126457 - DNA, 1677 bp, Artificial Sequence
  Description of Artificial Sequence: Synthetic coding sequence
atggccgcggctgccttggggagctccagcgggtccgcaagcccagccgtggctgagttgtgtcagaatactcccgagacattcctggaagccagcaagctcctgctgacttatgccgataacattctgagaaaccccaatgacgagaaatatcgctcaatccgtataggcaataccgccttttccactaggctgttacccgtgcgtggagctgtggagtgtctgtttgaaatgggctttgaggagggcgaaacacacctgatcttccccaagaaggcttccgttgaacagctgcagaagatccgggacctgattgctatagagcggagctcccggttggacggatcaaacaaaagccacaaagtcaagagcagccaacagcccgccgccagtacacagcttcccactacaccctcgagtaatccctcaggtttgaatcagcacacccgcaaccgccaaggacaatcaagtgatcctccaagcgcgagtactgtggctgcagactcggccattctcgaagtgcttcagtcaaacattcagcacgtattggtttatgagaacccagccctgcaggaaaaggcccttgcctgcatcccggtgcaagaactgaaaaggaagtcccaagagaagctgagccgtgctaggaaactggataagggaatcaacatcagtgatgaggatttcctgctattggagctgcttcattggtttaaggaggaatttttccactgggtgaataatgtcttatgctctaagtgcggcggccagaccagatcacgtgaccggtccctgctgccctccgacgatgaacttaaatggggagccaaagaagtggaagatcattactgcgatgcttgtcagttttcaaatagatttccgcgatacaacaatcccgaaaagctgctggaaacacgatgcgggagatgcggagagtgggctaactgtttcacattgtgctgcagagctgtgggctttgaggcacgatatgtttgggattacacagaccacgtgtggacagaagtgtatagccctagtcagcagaggtggctccattgtgacgcctgcgaagacgtttgcgacaagcctctcttatacgagattggttggggcaagaaactgtcatacgtcattgccttcagcaaggacgaagtcgtcgatgtgacttggcgatacagctgtaagcacgaagaagtcatcgccagaaggacaaaagtgaaggaggcactcttgcgcgacacaataaacggtctgaacaagcagaggcagctgttccttagcgaaaatcgtagaaaagaactcctgcagcgcataatcgtagaacttgtggaatttatcagcccaaagactcctaagccaggtgaactaggaggccgcatctcgggctccgtggcatggcgggttgctcggggtgagatggggctccagcgcaaagaaaccctgttcattccttgcgagaacgaaaaaatatccaaacagctacatctctgctacaatatcgtgaaagatagatacgtgagagtgagtaacaacaatcaaactatctcaggctgggagaatggggtgtggaaaatggagagtatttttcgtaaagtggagaccgactggcacatgattactgtttttaccccgatgttaattttcctcgtgccactgaaactcttctggaaacagaactag

SEQ ID NO: 126458 - DNA, 1839 bp, Artificial Sequence
  Description of Artificial Sequence: Synthetic coding sequence
atgcggaaccccaacgacgagaagtataggtctatccgaataggcaatacggccttttccactcggctacttcctgtgcggggagctgtcgaatgtttattcgaaatgggctttgaggagggtgaaactcacctgatatttcctaaaaaagctagcgtcgagcaattgcagaagatccgcgatcttatcgccatcgagcgttcctcacgcctcgacggttccaataagtctcacaaggttaagtcatctcaacaaccagctgcctcaactcaactgcccaccacccctagttccaatccatctggactgaatcagcatacccgaaaccgacaggggcaaagttcagaccccccttccgcaagcaccgtggcggcggactcagcgatcctggaagtgctgcagtccaacattcagcacgtgctcgtttatgaaaacccagcacttcaggagaaggccctagcctgcattcccgttcaggagctcaagcgaaagagccaggagaagttatctagagcacgaaagctggataagggaattaacatcagcgacgaagattttctgctcctggaattgctacactggttcaaggaagaatttttccactgggtgaacaatgtgctgtgtagcaagtgcggtggtcaaacacggagtagagataggtccctcttgccttccgacgacgagttgaaatggggggctaaggaagtggaggatcattactgcgatgcgtgccagttctcgaataggttccctcgctacaacaacccagagaagctcctggaaaccagatgcggccgctgcggggagtgggccaactgtttcacgctttgctgtcgggcagtgggatttgaggccaggtacgtgtgggattacactgaccacgtgtggactgaggtgtattccccaagtcagcagcggtggctgcactgcgacgcgtgcgaagatgtctgcgataagcctctgctctacgaaattggttggggtaagaagctttcttatgtgatagccttctccaaggatgaggtcgtcgacgtaacttggcgatactcctgtaagcacgaggaggtgatcgcacggcggactaaagtcaaggaggccctgctgcgcgatactatcaacggattaaataagcagcgccagttgtttttaagcgagaaccgccgcaaggaactgttgcagagaataattgtggagctggtagagttcatctcccctaagacacctaaacccggtgagttggggggtcgcatatccggatctgtggcatggcgtgttgcgcggggagaaatggggctgcagcgcaaagaaacactgttcatcccatgcgaaaacgaaaagatcagcaaacagctgcatctctgttataatatcgtgaaagatagatatgtgagggtaagtaataataatcagacaatctccggctgggagaacggcgtgtggaaaatggagagcatatttcggaaggtcgaaacagactggcatatggtgtacctcgcacgcaaagaggggagctctttcgcatatatatcatggaagtttgaatgtggcagtgtcggacttaaggtagactccatctctattagaactagcagtcaaacgttccaaacaggtacagtggaatggaaattacgatctgacacagcgcaagtggaactcaccggcgacaactccctgcattcttacgctgatttttcaggcgcaactgaggtaatcctggaggcagagttgtccaggggggatggcgacgtggcatggcaacacactcagttgtttagacaatctctgaacgaccacgaggaaaattgtctggaaatcatcatcaagttttccgacctttag

SEQ ID NO: 126459 - DNA, 516 bp, Artificial Sequence
  Description of Artificial Sequence: Synthetic coding sequence
atggggttcgaagaaggagaaacgcatttgatttttccaaagaaggcctccgtggagcagttgcagaagatcagggacctcatagcaattgagcggtcgagccggttggatggatcaaacaagagtcacaaggtgaaatcatcacagcagccggctgcttcaacccagttgccaactactccatccagtaacccctccgggttaaaccagcatactcgcaatcggcagggccagtcctctgatcccccgtccgcttctactgtggccgctgactccgccatcctagaggtcctgcagtccaatattcagcacgtgctggtatatgaaaatccggctctgcaggaaaaagcgttggcgtgcatacccgtgcaggagctgaagaggaagagccaggagaagcttagcagggcacgcaaacttgataaggacatcatcactctgaggaacttctggaagcaggatgtggatggggtggccagtggacccatcgttctccattgtgcagccgagctgtag

SEQ ID NO: 126460 - DNA, 1911 bp, Artificial Sequence
  Description of Artificial Sequence: Synthetic coding sequence
atggccgcagcggctctgggctctagtagcgggtctgcttctccagcggtagctgaactctgtcagaacacacccgaaactttccttgaagcatctaaactgctcttaacctacgccgataacattcttagaaacccaaatgatgagaagtacagaagcataaggattggaaatacggcctttagtacccgattattacctgtccggggagccgttgagtgcctcttcgagatgggattcgaagagggcgagacacacctgatcttccctaaaaaggccagtgtagagcagttacagaaaattagggacctgatcgcaatcgagcgctcttcaaggttagatggttctaacaagtcccacaaggtgaagagctcacagcagcccgcagcctctacacagctgccaactacacctagtagcaatcctagcgggttgaatcagcacacccgtaaccgacagggacagagttcagacccaccaagcgccagtactgttgccgcagatagtgctatactggaagtccttcagtcaaacatacaacacgtactcgtgtatgagaaccccgccctccaggaaaaggcgctggcctgcatacctgtgcaagagctcaagcgtaaaagccaggaaaaactgtctcgggcccgaaagctggataagggaatcaacatatctgacgaagattttctgctgctagagctcctccattggtttaaggaggaattcttccactgggtgaataatgtgttatgctccaaatgtggcgggcagactagaagccgagataggtccttgctcccctccgacgacgagctgaagtggggtgccaaggaagtggaagatcattactgtgacgcttgtcagttttcaaaccggttcccccggtataacaacccggagaaactgctggaaactcggtgtggaagatgcggagagtgggctaattgttttaccctgtgttgcagagcggtggggtttgaggcacgttatgtatgggattacacggaattgcaaaggacattgagccttaaactgacaacactgaaagagattggcaaaacttttctgagaattagtaaacggcagaaactgatccaggtggtagacgtgacctggcgctatagttgcaagcatgaggaggttattgctcgccgtacaaaagtgaaggaagcattgcttagagacacaattaacggcctgaacaagcagagacagctgttcctctccgaaaaccggagaaaagaattacttcagagaataatcgtcgaactcgtggagttcatctctcccaaaactcccaaaccaggtgaactggggggtcggatcagtggatcagttgcctggcgagtggcacgcggggagatgggtttgcagagaaaggaaactctgtttatcccttgcgagaatgagaaaatctccaagcagctccacctgtgttacaatatcgttaaagacaggtacgttcgggtttctaataacaaccagacgatctctgggtgggagaacggggtgtggaagatggagagcatctttagaaaggtggaaactgattggcacatggtatatttggcaaggaaagaggggagttcctttgcctatatctcttggaaatttgaatgcggctctgtggggctgaaagtcgacagcatctcaatccgcacgtcctcacaaactttccagaccgggacagtggagtggaaacttcggagcgatactgcccaagtggaattaacgggcgataattccctgcactcttacgccgatttcagcggagcaactgaagtcattcttgaagccgaactgagtaggggtgacggggatgtcgcctggcaacacacccagttattccgccaatcactaaatgatcatgaggaaaattgcctagagatcattatcaaattttccgatctatag

SEQ ID NO: 126461 - DNA, 1188 bp, Artificial Sequence
  Description of Artificial Sequence: Synthetic coding sequence
atggccgccgaagcctccgaaagcggccccgctctccacgagttgatgagagaagctgaaatctctctacttgagtgtaaagtgtgtttcgagaaattcggccaccggcagcagaggcgacccagaaacctgtcctgcggacacgtcgtttgcctggcctgcgtggcggccctagctcacccgagaaccctggcccttgagtgtcctttttgccgacgagcttgtagggggtgcgacacaagtgactgcctgcctgtactgcatctcatcgaactgctcgggagcgcactccgacagagccccgccgcccatcgcgctgcacccagcgctcctggcgcactgacttgtcaccacaccttcggtggctgggggactctggtgaaccctacaggtttagctctctgccccaagactggccgcgtagtggttgtgcatgacggccgacgccgtgtgaaaatcttcgatagcggcggtggttgtgcacaccaattcggagagaagggggatgcagcccaggatatacgttatcccgttgacgtgacgataaccaacgattgccacgtggtcgttactgacgccggcgatcgaagcatcaaggtgtttgatttctttggccaaatcaaattggtcattggcggccagttctcacttccctggggcgtggaaaccacccctcagaatggcatcgttgttaccgatgccgaggccggttcactacatttgctcgatgtggatttcgcagaaggagtccttcggaggaccgagcgactacaggctcacctttgtaatcctcggggggtagccgttagctggctcactggcgcgatagctgtgctggaacacccactcgcgctagggactggtgtctgctcaactcgcgtgaaggttttttcgtcttcaatgcagttggtgggacaggtggatacattcggtctgtctctgtacttcccctccaaaataacagcttccgccgtgacattcgatcatcagggcaacgttattgtagcagacacatccggtccagccattttatgccttgggaaacccgaggagtttcccgtgcccaagcctatggtcacacatggtctgagtcaccccgtggccctgacttttaccaaggaaaattcgctgctggtgcttgatacagcatcacacagcatcaaggtgtataaagtggattggggctag

SEQ ID NO: 126462 - DNA, 903 bp, Artificial Sequence
  Description of Artificial Sequence: Synthetic coding sequence
atggcagcagcagccggcgacgcagacgacgagccccgtagtggtcactcctcttcagagggggagtgcgcagtagctcccgagcctctgaccgacgccgagggtctgttctcttttgctgacttcggctccgccctggggggcgggggcgcaggtctctcagggcgcgctagtggaggcgctcagagcccattaaggtacctgcatgtgctgtggcagcaggacgccgaaccccgtgacgagcttagatgcaagattccggcagggcgactcagaagagcagccagaccccatcggcggctgggccctacaggcaaggaagtccacgctctcaagaggctgcgcgacagcgcgaacgcgaatgacgtggaaaccgtccaacaacttctagaggacggggctgatccttgcgcagccgatgataaagggaggacagctcttcattttgcgtcttgtaatggcaacgatcaaattgtacagctgcttctggaccatggggctgaccctaaccagcgggatggactaggcaacactcctctccatctcgcagcttgtacaaatcatgtgccagttataaccacactcctgaggggaggagcaagggtggacgcactcgaccgggccgggcggacaccattacacctggcaaagtcaaagttgaacatccttcaggaaggccatgcccagtgcctcgaagctgttcgtctggaagtaaagcaaattatccatatgctgcgcgagtatctcgagcgccttggccagcacgaacagcgtgagagactggacgacctttgtacccggctgcaaatgaccagtaccaaagagcaggtagacgaggtgaccgatcttctggcgagtttcactagcctgagtttacagatgcagagtatggagaaacgttag

SEQ ID NO: 126463 - DNA, 387 bp, Artificial Sequence
  Description of Artificial Sequence: Synthetic coding sequence
atgacagaggccgacgtaaatccaaaagcttacccactcgccgacgcacatctcacgaaaaagttactggacctagttcagcagtcctgcaattacaagcagctcagaaagggcgcgaatgaggcaaccaagacactgaatagaggcatttccgaattcatcgtcatggccgccgacgccgaacccctcgaaattatattacacttacccctgttgtgtgaggacaaaaatgttccatacgtcttcgttcggtctaagcaggcactggggcgagcctgcggcgtgagcagaccagtgatcgcatgctccgtcacgatcaaggaaggaagtcaattgaagcagcagatccagagcattcaacagagcatcgagagactgttagtctag

SEQ ID NO: 126464 - DNA, 387 bp, Artificial Sequence
  Description of Artificial Sequence: Synthetic coding sequence
atgaccgaggctgacgtgaatcctaaggcttatccattggcagatgcccaccttacgaagaaattgctggatcttgtgcagcaatcatgcaattacaagcaattgcgcaaaggggccaacgaggccactaaaacactgaatagagggatatcggagttcattgtaatggccgcggatgcagagccactggagatcatactgcacctgcctttattatgtgaagataagaatgtgccctacgtcttcgttcggtccaaacaagccctgggaagggcctgtggagtgagccgcccagttattgcctgtagtgtcacgattaaagaaggctcacagttaaagcagcagattcagtccatccagcaaagtatagaaagactcctggtttag

SEQ ID NO: 126465 - DNA, 399 bp, Artificial Sequence
  Description of Artificial Sequence: Synthetic coding sequence
atgttgcttgtgcagacagaagccgacgtgaatcctaaggcgtatccactcgcagatgcacatttgactaagaagctgcttgacctcgttcagcagtcttgtaactataaacaactccgtaagggcgccaacgaggccacaaagaccctgaaccgaggaatcagcgagttcatcgtgatggctgcagatgccgagccccttgaaattattctccacctgcctctcctttgcgaggacaagaatgtgccctatgtttttgtgagaagcaagcaagccctggggagggcctgcggagtgtctaggccagtgattgcttgctcagtgacaatcaaagagggcagccagctgaagcaacagattcaaagcatacagcaatcaatagaaaggctgctcgtgtag

SEQ ID NO: 126466 - DNA, 2130 bp, Artificial Sequence
  Description of Artificial Sequence: Synthetic coding sequence
atggcaacagcaggcgggggaagcggggccgaccccggcagtagaggtttgctgcgcttgctgagcttctgcgtgctgcttgccggcttgtgtcgtggaaactctgttgagcggaaaatatatatccctctgaataaaaccgctccctgcgtacgcctcctcaacgctacgcatcagattgggtgccagtcctctatcagcggagataccggtgtgattcatgtggtcgagaaagaggaagatcttcagtgggtacttaccgatggccccaatccgccctacatggtcttactggagagcaaacacttcaccagagacctcatggagaaacttaaagggagaacatcccgtatcgctgggttagccgttagcctgaccaaacccagtcctgcctcagggtttagccctagtgttcagtgtccaaatgatgggtttggcgtgtacagtaatagctatgggcccgagttcgctcactgcagggaaatccaatggaacagtcttgggaacggcctggcctacgaagactttagcttccccatctttttattagaggacgagaatgaaaccaaggtgattaaacagtgctatcaggatcataatttatcacagaatggctccgccccaaccttcccgctgtgcgcaatgcagctgttttctcacatgcacgcagtcatcagcactgccacctgcatgaggcgctcgtctatccagtcgacattttctattaaccccgagattgtgtgtgatcccttgtccgattacaatgtgtggtccatgcttaaaccaataaatacgaccggcaccctgaagcccgatgatagagtggtagtagccgccaccagactggacagcagatcctttttttggaatgtggcgccaggcgcggaaagcgctgtcgcgtcttttgttacacagttagcagctgccgaagctctccagaaagccccagatgtgacaacactgccacgcaatgtcatgtttgtgtttttccaaggggagacctttgattatattggtagtagcagaatggtgtacgatatggagaagggcaagttcccggtccagctggaaaacgtggattcattcgtggagttaggtcaggtagctctgcgcacctccctggagctgtggatgcataccgaccctgtatctcagaaaaatgagtccgttcgaaatcaggtggaggacctgctggccactctggagaagagcggcgcaggagttccagctgtgattctgagaagacccaaccagagccagcccctaccccccagcagtctccagaggtttcttagggcacgaaacatctccggggtggtgcttgctgaccattctggggcgtttcacaataagtactatcagtccatttatgacactgcggaaaatattaatgtgtcgtatccagaatggttatcccctgaggaagacctcaattttgttacagacacagccaaggctttggccgacgtcgctacggtattagggcgcgcactgtatgagctcgccggaggcacaaactttagcgacacagtccaggctgatccccagacagtgaccaggcttctctatggtttcttgattaaagccaacaactcatggttccagagcatcctgagacaggatctgcgctcttacctaggcgatgggcctcttcagcactatatcgcagtgtccagccctactaatacaacatacgtcgtgcaatatgcactagcaaatctgaccggcaccgtggtaaatctcactcgcgagcaatgtcaagatccgagcaaagtgccatccgagaataaggatctctatgagtattcttgggtgcaggggccacttcactcaaatgagacggacaggctccccagatgcgtgcggtctacagcccgactcgctcgggccctgagccccgcattcgaactgtcgcaatggagcagcaccgagtattccacatggacggagtcccggtggaaagatatccgcgctcgtattttcctgattgcatcaaaagaattggagttgatcacccttacggtcggattcggcattctcattttttcgctaattgtgacatattgtatcaatgccaaggccgacgtcctgttcattgccccacgagagcccggcgccgtatcctattag

SEQ ID NO: 126467 - DNA, 2070 bp, Artificial Sequence
  Description of Artificial Sequence: Synthetic coding sequence
atggattttaatctgattctggaatctttgtgcaggggcaactcagtcgagcgcaagatttacatccccctgaacaagaccgccccttgtgtgcgactcctaaatgcgactcaccaaattggctgccaatcttcaataagcggagacactggcgtcatccacgtggtggagaaggaagaagatctgcagtgggtgctaacagatggtcctaatcctccatatatggttctgctggagagcaaacattttacccgtgatctcatggagaagttaaaaggcagaacatcccgtatcgcgggcctggccgtctcactgaccaaaccaagtcccgcttctggcttctctcccagcgtgcagtgcccaaatgacgggttcggagtgtactccaattcctatggtcctgaattcgcacattgtcgcgagattcaatggaactctctggggaatggcctggcatacgaggatttcagtttccccattttcctgctggaagacgagaacgagactaaagtcatcaaacagtgttaccaggatcacaacctctctcagaacggtagcgcaccaaccttcccactgtgtgccatgcagttattcagtcacatgcacgccgtgatcagcaccgcgacttgtatgagaagaagttcaatccaaagtacattttccattaatccggagatagtttgtgatcctctatctgattacaacgtctggagcatgctaaagcctattaacacaacgggtacgttgaagcctgacgaccgagtggtcgtggctgcgacccgcctggattctaggtcctttttttggaacgtcgcacctggagccgaatccgctgtggctagcttcgtcacgcagctggctgcagccgaggcacttcaaaaggctcctgatgtgactactctgccgagaaacgtcatgttcgtatttttccagggggagacctttgactatattggctcttcaaggatggtatacgatatggaaaaaggcaaattcccggtgcaactggaaaacgtggatagcttcgtggaacttggacaagtggctttaagaacctctttggaactctggatgcatacggatccagtgagtcagaagaatgagagtgtccgaaatcaggttgaggacttactcgctaccctggagaaatccggcgcaggtgtgcccgcagttattcttagacggcccaatcagagtcagcctcttccaccatcttccctgcaacgattcctcagggcccggaatatttcgggagttgtccttgcagatcacagcggcgcctttcacaacaagtactaccagtcgatctacgacaccgccgagaatattaacgtaagctatcccgagtggctaagtccagaagaggacctaaacttcgtgaccgacacagccaaggcactggccgacgttgcaacagtcctggggcgagcactatacgagcttgcaggcggcaccaatttttctgacaccgtgcaagctgaccctcagaccgtgactcggctgctgtacggatttctcattaaggctaacaattcatggttccaatccatccttaggcaggacctaaggtcctatctgggggatggtccactccagcattacattgccgtctcctcaccaactaacacaacttatgttgttcaatatgcgctggctaatttaacaggaacagtcgttaatctgacacgggagcaatgccaggatccaagcaaagtgccgagtgagaataaggatctctacgagtactcctgggttcagggtccgctgcactctaacgaaacggacaggctgcccagatgtgtaagaagcacagctaggttggctagggctctgtcaccggcgtttgaactgtcccagtggtcttcaaccgagtactctacatggactgagtcacggtggaaggatattcgagcaagaatctttctgatagccagcaaagagcttgaactgataactctgacagtcggattcggtatcctcattttctccctgattgtgacttactgcatcaatgcaaaggctgatgtgctgttcatcgctccaagggaacctggcgccgtaagttattag

SEQ ID NO: 126468 - DNA, 1356 bp, Artificial Sequence
  Description of Artificial Sequence: Synthetic coding sequence
atgcttaaaccaattaatacaaccggcacactgaagcccgacgaccgggtcgttgtggcagccacgcgccttgattcccggagcttcttttggaacgtcgcaccaggggctgagagtgccgtggccagtttcgtgacgcaattagctgccgcagaggccctccagaaagcgcccgacgtgactactcttccaagaaacgtcatgttcgtattcttccagggtgaaacttttgattacatcggatcctcccgtatggtctacgacatggaaaaaggaaagttcccggtgcagctggaaaatgttgactctttcgtggagctggggcaggtagctttacgcactagcctggaattatggatgcataccgatccagtgagccagaagaatgagtccgtacgcaaccaagtagaggatctcctcgccacacttgagaagagcggtgcgggcgttccagcagtaatcctacgtcggccaaatcagtcccagccgttgcccccatcctccttgcagcgattccttcgggctagaaatattagcggtgtggtgctcgccgaccactcgggagctttccataacaaatactaccagagcatctacgacactgcagagaacataaacgtaagctatcccgaatggctcagccctgaggaggacttgaattttgttaccgacactgccaaagccctcgcggatgtagctacagtgctgggccgcgccctctacgaactggctggagggaccaactttagcgacacggtccaggcagaccctcagactgttacaaggttgctgtacggcttcttgatcaaagctaacaactcctggttccaatctattctaagacaggacctgagatcttacctgggggacggaccactacagcactacatcgccgtgtcctcacccaccaacaccacttacgttgtgcagtacgcacttgcaaacttgacgggcactgtggttaatcttacacgcgagcagtgtcaggatccctctaaagtacccagcgagaataaggatttatatgaatattcctgggtgcaggggccgttgcactctaacgaaaccgaccgtttacctcgctgtgtgagaagtacagccagactggccagagccttgtccccagctttcgaactcagccagtggagttctacggagtacagcacttggaccgaatccaggtggaaggacatacgggcccgtatttttcttatcgcaagcaaagagctggagctaatcactttaacagttggatttggaatcctcattttctcactaattgtcacctactgtattaatgcgaaggcggacgttctcttcattgcccccagagaaccgggcgctgtgagttattag

SEQ ID NO: 126469 - DNA, 918 bp, Artificial Sequence
  Description of Artificial Sequence: Synthetic coding sequence
atgctgaaaccaataaataccaccggtacactgaaaccagacgacagagttgtagtggcagctacaagactggattctcgttcttttttttggaacgttgcgccaggggccgaatccgccgtcgcttcctttgtgacacagcttgcagcggcggaagcactgcagaaggcaccagatgtcacaactctgccgcgtaatgtgatgtttgtattctttcaaggagtcgccctcagaacttccctcgagctatggatgcatacagaccctgtgtcccagaaaaacgagtctgtgcgtaatcaggtagaagatctgctcgcaactctggagaagagtggtgccggggtgccagctgttatcctgcgacgacccaaccagtcccagccccttcctccatcgtccctccagcgtttcctaagagctcgcaacatcagcggcgttgtgcttgccgatcactcaggggcctttcataacaagtactaccagtctatctatgacaccgcggagaacataaacgtgtcttatccagagtggttaagccccgaagaggatctgaatttcgttaccgacaccgccaaagcactggctgatgtggcaaccgtgcttggacgggctctgtatgaacttgccggcggtaccaacttcagtgataccgtacaggctgatccacagacggttaccaggctcttgtacggatttttaatcaaggctaacaactcgtggttccagagtatactcaggcaggatcttaggtcctacctgggcgacggcccccttcagcattacatcgctgtctcctccccaaccaatactacctacgttgttcagtacgcccttgccaatttgaccggcacggtcgtgaacctaacccgggaacagtgtcaggacccttccaaggttcccagtgaaaacaaagactag

SEQ ID NO: 126470 - DNA, 2070 bp, Artificial Sequence
  Description of Artificial Sequence: Synthetic coding sequence
atggactttaacctcatcttggaaagtctctgtagaggtaactctgtggagcgaaagatctatatcccactgaacaaaacagccccctgcgttaggcttctcaatgctacccaccagattggctgtcagtctagtatcagtggcgacaccggcgtaatacatgttgtggaaaaggaggaggacctgcagtgggtcctcacggatggccctaatcccccttatatggtcttgctggagtccaagcactttactcgcgatttgatggaaaagctgaagggacgcaccagccgaatcgctggcctggcggtttccctgaccaagccatctcctgcaagcggcttttctccgtctgtgcagtgtccaaatgacgggttcggcgtgtacagtaattcctacggacccgagttcgctcattgccgcgagatccagtggaatagtctgggaaatggcctagcatatgaagatttttcctttccaatctttctgcttgaggatgagaacgagaccaaagtgataaaacagtgttatcaggaccataatctctctcagaatggctcagcaccaacattccctctgtgcgcaatgcagctcttcagtcacatgcatgccgtcatctctacagcaacttgcatgcgtaggtcctcaatccagagcaccttcagtatcaatcccgaaatcgtgtgtgaccctttaagtgattacaatgtgtggtcaatgttgaagcccattaacacgaccggaactttgaagccggacgacagagtcgttgtcgctgccacaagattggattctcggtcattcttctggaacgtggcacctggcgccgaatcagcggtggcttcttttgtcacccagttggctgcagcagaggcactgcagaaagcgccggatgtaactacattgccaagaaacgtcatgtttgtcttctttcagggggagaccttcgattacattgggagctctaggatggtctacgacatggagaagggcaaatttccagtgcaactggagaacgtggattcctttgtggaactcggacaagttgccctaagaactagcctagaactctggatgcacacagaccccgtgagccagaaaaacgagtccgtccgaaatcaggtggaggacttgcttgcgacattggaaaagagcggagcgggcgtccccgccgtgatcctccgcagacctaaccagagccaacccctgcccccttcctccctacaacggttcctgcgcgctcgtaatattagtggcgtggttctagcggaccattcaggggccttccataacaagtactaccagagcatatacgacactgctgagaacattaacgtgtcatatcccgagtggttaagcccagaagaggatctcaattttgtcacggacaccgcgaaggctctcgcagacgtggccactgtgcttggtagggctctgtatgaactggccggtggcactaacttcagcgacacagttcaggccgaccctcagaccgtcacacggctactgtacggctttctgattaaagcgaacaatagctggtttcagtccattctccgccaggatctaaggtcctatctgggcgacggaccactccaacattatatcgccgtcagctcgcctaccaacactacatacgtggtgcagtatgcactcgccaatctgaccggaactgtggtcaatctgacccgagagcagtgtcaggacccttcgaaggtgccttcagaaaacaaggacctgtatgaatattcctgggtgcagggcccgctacattcaaacgaaacagatagactgcccaggtgtgtgcgtagcacagccaggttagcccgagctttgagccccgccttcgagctgtctcaatggtccagtacagagtatagcacctggacagagtctaggtggaaggacattagagcccggatctttctcattgcctctaaggaactggaactgattactttaaccgtgggatttggcatactcatcttctcccttatcgtgacctattgcatcaacgccaaggccgatgtgctgttcatcgcacctcgcgagcccggcgctgtcagctattag

SEQ ID NO: 126471 - DNA, 768 bp, Artificial Sequence
  Description of Artificial Sequence: Synthetic coding sequence
atggcaacagcaggtggaggcagcggcgccgaccctgggtccagaggactcttgcgcctcttgagcttctgcgtgctgctggcagggttgtgccgggggaattccgttgagaggaaaatctatattccactgaacaaaaccgctccttgtgtgagactactgaacgccactcaccagatcggatgccagtctagcatcagtggggacaccggtgttatacacgtggtagaaaaagaggaggacttacagtgggtgctaaccgacggcccaaacccaccctacatggtgcttctggaatctaaacattttacccgggacctgatggagaagctcaagggtaggaccagcaggatagcaggattggctgtgtcgcttaccaaaccttcacccgctagcgggttctcgccctctgttcaatgtccaaatgatggatttggggtgtattcaaattcctatgggcccgaatttgcacattgtcgggagatacagtggaactctctaggcaatggtctggcttacgaagatttttcgttccccatctttctgttagaggacgagaatgaaactaaagtgattaagcaggagaccttcgactacattggttccagtcgcatggtgtacgacatggagaaagggaagttcccagtacaactcgaaaatgttgactcgtttgtcgagttgggacaggtggccctgagaacctcgctggaactgtggatgcacactgacccagtgagccagaagaacgagtctgtgagaaaccaatag

SEQ ID NO: 126472 - DNA, 963 bp, Artificial Sequence
  Description of Artificial Sequence: Synthetic coding sequence
taggggttcggagtctactccaacagttacggtccagagttcgctcactgccgcgagattcagtggaacagtttgggaaatggtttagcgtatgaagacttcagttttcccatctttctgctggaagacgagaatgaaacaaaggtgatcaaacagctgtttagccacatgcacgccgtgatcagtacggcaacatgcatgcgaaggtcaagcatacagagcaccttcagcattaatcctgagatcgtgtgcgaccctcttagtgactataacgtgtggtccatgttaaagcccattaacaccacgggcacgctgaaacccgatgatagagtcgtcgtcgcagcaaccaggctggactctcgctccttcttttggaatgtggcccctggtgctgagagcgcggtggcaagttttgtgactcagttagcagcggcggaggctttacagaaagccccagatgtaacaacattgcctcgcaacgtcatgttcgtgttctttcagggcgaaaccttcgactatatcggcagttctcgcatggtttacgatatggagaagggcaagttccctgtccagctcgagaacgtggacagcttcgtcgagctgggtcaggtagccctgcgcacaagtctcgagctgtggatgcatactgaccccgtaagccagaaaaatgaatctgtccggaatcaggtcgaggacctcctcgccactcttgagaagtcaggagcaggagtacccgcggtgatcctgcgcaggccgaaccagtcgcagccactccccccttcctctttgcagcgctttttgagagctcgcaatatctctggtgtggtactggccgatcactccggcgctttccacaacaagtactatcagtctatctatgataccgcagaaaacatcaatgtttcctatccggagtggttatcaccagaggaggacttgaatttcgtgaccgacactgcatag

SEQ ID NO: 126473 - DNA, 660 bp, Artificial Sequence
  Description of Artificial Sequence: Synthetic coding sequence
agatcatcaatccagtcaactttctccatcaatccagagatcgtttgtgacccgctgtcagattacaatgtatggtccatgctgaaacccatcaatactactggcacgctgaagcctgatgatcgcgtggttgtggcagcgacccggttggccgccgcagaggctttgcagaaagctcctgacgtgacaaccctgcctaggaatgtaatgttcgtgttcttccagggtgaaacatttgactatattggcagctcaaggatggtttacgatatggagaagggcaagtttccggttcagctcgaaaacgtggactcttttgtcgaactcggtcaggtagcccttcgtacatccttggagctctggatgcacactgatcccgtcagccagaaaaatgagtccgttaggaatcaggttgaggacctgcttgctaccctggagaaaagcggggccggcgtgcctgccgtcattctccgtcgcccaaaccagagccagcccctgccaccctcgtccctccagcggttccttagggccaggaacattagcggagttgttctggcagaccacagtggggcctttcacaacaagtactaccagtcaatttatgacacagccgagaatattaatgtgtcttaccccgagtggttgagtccagaagagtag

SEQ ID NO: 126474 - DNA, 828 bp, Artificial Sequence
  Description of Artificial Sequence: Synthetic coding sequence
taaaacgttgccccgggcgcagagtccgccgtggcttccttcgtgacacaactggctgcggccgaggccctgcagaaggctccagacgtgactactctgccccggaacgtgatgtttgtgttcttccagggcgtcgcgctgagaacgagtctggaattgtggatgcacacagatccagtatcacagaaaaatgaatctgtacgaaaccaggtcgaagatctacttgccaccctggagaagtcaggcgctggggtaccggccgtcatcctgagaaggcccaatcaatcccagcccttgcccccttccagtcttcagcgctttcttcgtgcccgcaatatcagtggggtagtgcttgccgaccactccggcgccttccacaataagtactatcagagtatttacgatacagcagaaaacatcaatgtgtcctatccagagtggctctcaccggaggaggacttgaatttcgtgacggataccgctaaagctttggcagatgtggcaaccgtgctgggacgagctctctacgagctggctggcggtaccaacttttctgacacagtacaggcagatccacaaactgtgacgagacttctgtacggatttctgatcaaagctaacaactcctggtttcagtctatcctcagacaagatcttagatcctacctgggtgacgggcctcttcagcactacattgccgtgtcgtcgccgactaataccacatacgttgtacagtacgccttagccaacctcactggcaccgttgtgaacttgacacgcgagcaatgccaagatccttcaaaggtgcccagtgagaacaaagattag

SEQ ID NO: 126475 - DNA, 405 bp, Artificial Sequence
  Description of Artificial Sequence: Synthetic coding sequence
atggccaccgctgggggtgggtccggtgcagatccaggttctcgaggcctactgaggctcctgtccttctgtgtgctcctggctgggctctgtcggggaaacagcgtggaacggaaaatttacataccattaaacaaaactgccccctgtgttagacttctcaacgccactcaccaaattggatgccaaagctcgatctctggagacactggtgtgattcacgtcgtagaaaaggaagaggatctgcagtgggtgctcactgatgggccgaatcccccttacatggtactgctcgaatcaaaacactttacccgtcaaaacgtaaggcttagcgacacattcctgtgcagctttatggaattcctctcttattccagagacctgatggaaaagctgaagggttag

SEQ ID NO: 126476 - DNA, 699 bp, Artificial Sequence
  Description of Artificial Sequence: Synthetic coding sequence
atggccacagccggcggggggtctggcgctgatcccggcagtcggggcctccttcgactcctttccttttgcgtgttgctggccggcttatttctcgacttcgagcctgatccgctgccactttgtccagacgtttctttcttcccacagccacagcctccgactccacaaagcaaaggcacgggcctgtgcaggggcaatagcgtggagagaaaaatatatatccctcttaacaagacagctccttgtgtccgactgctaaacgcaacccaccagattggatgtcagtcctccatcagcggagacacaggtgtcatccacgtcgtggaaaaggaggaggacctgcagtgggtgttaactgacggaccaaatcccccttacatggttctcctggagtccaaacatttcacaagagacctcatggagaagctgaagggccgcacgagtcgtatcgccggtctggctgtgtccttaaccaagccctcgccagccagcggcttttctccgtctgtgcagtgccctaacgacggattcggtgtctattccaactcttatggcccagagttcgctcattgccgagaaatacagtggaactccctgggtaatggacttgcttacgaggatttcagcttcccgatttttctcttagaggatgagaatgaaacaaaggttatcaaacagtgttaccaggaccactag

SEQ ID NO: 126477 - DNA, 1716 bp, Artificial Sequence
  Description of Artificial Sequence: Synthetic coding sequence
atggcaaccgcagggggcggttctggcgccgaccctggcagccgtggattactgcgcctgctgagcttctgcgtactcctggcgggactttgcagaggcaatagcgtggagcgaaagatctacattcccctgaataagaccgccccatgcgtcagattactgaacgccactcaccagatcgggtgtcagagctccatcagtggagacacaggagtcatccatgtcgtggagaaagaagaagatctgcagtgggttctgacagatgggcccaaccctccttatatggttttgctggagtctaagcatttcacccgcgacctgatggaaaaactgaaggggaggacctcaaggattgcgggtctggccgtgtcgttgacaaagccctcccctgcatccggtttttccccttccgtgcagtgtcccaacgatggtttcggtgtttatagcaacagctacggtcccgaattcgcccactgccgagaaatccagtggaacagcctcgggaacggcctcgcgtatgaggacttctcatttccaatttttctcctggaagacgaaaacgagacaaaggtgatcaagcaggaaacctttgattatatcggatccagtcggatggtgtatgatatggaaaaaggtaaattccctgttcaactcgagaacgtggacagtttcgtggagctgggtcaggttgccctgcgtacatctctagagctttggatgcatactgatcctgtgtcccagaaaaatgagtctgttagaaaccaagtcgaagaccttcttgcaactctggaaaagtctggtgccggggtccccgcggtcatactaagacgccccaaccagagccagccactgcccccttcgtccttacagcgatttctgagggcccgcaatatttcaggtgtggttttggctgaccactcaggagcctttcacaacaagtattatcaatctatctacgacacagcagaaaatatcaacgtcagttacccggagtggctgtcccccgaggaggatctgaacttcgtcactgatactgccaaggctctggccgacgtggcaaccgttctgggaagagcactgtatgaactggcggggggaacaaatttcagtgacaccgtgcaagctgatccccaaaccgttactcgcttactgtatggctttctgatcaaagccaacaatagctggtttcagagcatactgcggcaggatcttcgctcttatctgggagacggacccctgcagcattatattgctgtctcttcccccaccaacacaacttacgtggtacagtacgccttagccaacctcactgggaccgtggtgaatctgacccgggaacaatgtcaagacccttcaaaggtccccagcgagaacaaggatctctatgaatattcctgggtgcaggggccattgcattcaaacgagaccgatcggctcccccgctgtgtgaggagcactgccagattggcccgcgccctctcaccagcattcgagttgtcacaatggagctccacggagtatagcacgtggaccgaaagtagatggaaagatattagggcgaggatcttcttaatagcttccaaggaactggaattaattacacttaccgtcggctttggaattctcatttttagcctcattgttacatactgtatcaatgctaaagccgacgtgctgtttattgcccccagggaacctggcgctgtgtcttactag

SEQ ID NO: 126478 - DNA, 642 bp, Artificial Sequence
  Description of Artificial Sequence: Synthetic coding sequence
atgtctcgcgttctggtgccctgccacgtcaaggggtccgtggccctgcaggtgggcgacgttcgtacatctcaaggcagaccgggcgtgctagtgattgacgtgacgtttccttccgtggccccttttgagttgcaagagatcaccttcaaaaactactacaccgctttcttaagtattcgggtgcgacaatatactagcgctcatactcccgccaagtgggtgacatgtctgagggattattgcctgatgcccgacccccattcagaggagggtgcccaggaatatgtaagccttttcaagcaccaaatgctttgcgatatggccagaatctccgagctgaggctcattcttaggcagccaagcccactgtggctctccttcactgtggaggaactgcaaatatatcagcagggtcccaaatcgcctagcgtcacctttcctaaatggttgagccaccccgtcccttgcgaacagcctgccctgcttcgggaaggactgccggatcccagccgggtgagcagcgaagtgcagcaaatgtgggcactgaccgagatgattagagcctctcacacctcagcgcgcattggccgattcgatgtggatgggtgttacgatttgaacctcctttcctacacatag

SEQ ID NO: 126479 - DNA, 642 bp, Artificial Sequence
  Description of Artificial Sequence: Synthetic coding sequence
atgtcccgagtacttgttccgtgccacgtgaaggggagcgtggcgttacaggttggcgatgtgagaacgagtcagggacggcctggagttttggtaatcgacgtgacctttccttccgtggccccttttgagcttcaggaaatcacgttcaaaaactattacactgcatttctctctataagagtgagacaatacacctcagcacacaccccagcaaagtgggttacatgcctcagagattactgcctgatgccggatccccacagcgaggaaggggctcaggaatatgtaagcctgttcaagcaccagatgctgtgtgacatggcccggatcagtgagctgcggcttatcttgcgtcagccgagtcctttgtggttgtctttcacggtggaagaactgcagatatatcagcagggtccaaaatctcccagcgtgacattcccaaagtggctcagccatcccgttccttgcgaacaaccggccctgctgcgcgagggattacccgatccttctcgcgtcagtagtgaagtccagcaaatgtgggctctcactgagatgatacgtgcttcacacacaagcgcccgtattggtcgatttgacgtggacgggtgttacgacctcaacctgctctcctatacttag

SEQ ID NO: 126480 - DNA, 528 bp, Artificial Sequence
  Description of Artificial Sequence: Synthetic coding sequence
atgagtcgagtcctggttccatgccatgtgaagggctccgttgcactgcaggtcggagacgtacgaacctcccagggacggccgggggttctcgtgatcgacgtgactttcccctcagttgccccgtttgagctgcaagaaattacttttaagaattattacactgcatttctgtcaataagagtgaggcaatacacaagcgcccacacccctgccaagtgggtcacctgcctacgagactactgtctaatgccggacccccattctgaagaaggcgcgcaggaatacgtgagtttgttcaagcatcaatcaccttcagtgacttttcccaaatggctctctcatcccgtaccatgcgaacagccagctctgttgcgagaggggctgccggatcctagccgcgtgtcttcggaggttcaacagatgtgggcactgaccgagatgatcagggcctcacacacatccgcaagaatcggacgattcgacgtggacggatgttatgacttgaatctcttatcgtacacatag

SEQ ID NO: 126481 - DNA, 795 bp, Artificial Sequence
  Description of Artificial Sequence: Synthetic coding sequence
atggaaagtgggttcacgtcaaaggacacctatctgtcccactttaacccgagggattacctcgagaagtactacaagtttggctcccggcattccgcagaatcacagatcctgaaacatctcttgaagaacctgtttaagattttttgtctagatggggtgaaaggggatctgctgatagacataggctctgggccaacaatttaccagctcttgagcgcctgcgaatccttcaaagagattgtggtcaccgattacagtgatcagaacctccaggagttggaaaaatggttgaaaaaggagcccgaagcattcgactggtctcctgtcgtgacatatgtgtgtgatctggaaggaaaccgcgtgaaggggcctgaaaaggaggagaaacttcggcaggccgtgaagcaggtcctgaagtgcgatgtgacccagagccagcctctcggcgcagtgccactgccgcccgccgattgcgtacttagtactctttgcctggacgctgcctgccccgatctccccacctattgtcgagcactaagaaatctcgggagcttgctcaagcccggtggcttcctggtgatcatggatgctcttaaatcgagctactacatgattggggagcaaaaattcagtagtcttccattggggagggaggctgtggaggcagctgtgaaagaagccggctatactatcgaatggttcgaggtgatcagccaatcctactcctcaactatggccaacaacgaaggactgttttctctagttgccaggaaactgagtagacccctatag

SEQ ID NO: 126482 - DNA, 795 bp, Artificial Sequence
  Description of Artificial Sequence: Synthetic coding sequence
atggagagcgggtttactagcaaggacacttacctctctcacttcaatcctagagactacctggaaaaatactataaattcgggagccgccacagcgcggagtctcagatcttgaagcacctcctgaaaaacttattcaaaattttttgtttggacggcgttaaaggggacctcctcatagacattggatcagggcctacaatctatcagctgttgagtgcttgcgaaagcttcaaagaaattgtggtgactgactactctgatcagaatctgcaggagttagaaaaatggcttaaaaaagagccagaggcattcgactggtcccccgtagtgacctatgtttgtgacctggagggcaaccgggttaaaggtcctgagaaggaggagaaactgcgtcaagccgtaaagcaggtattgaagtgcgacgttacccagagccagcccctcggggctgttccgttaccccccgccgactgcgtgctctcaaccctgtgtctcgatgcagcctgtcctgatctgccaacatattgcagagcccttaggaacctgggaagcctgttgaagcctggcggattcctggtcatcatggatgccctgaaatcctcttactacatgatcggcgaacaaaagtttagttcgttacccctgggtagggaggcagtggaagctgccgtgaaagaggccggttacactatagagtggttcgaagtcatcagtcagagttattcgagtacgatggccaacaatgagggactgttcagtctggtggcgagaaaactgtcccgaccactgtag

SEQ ID NO: 126483 - DNA, 759 bp, Artificial Sequence
  Description of Artificial Sequence: Synthetic coding sequence
atgaaatctcgcatccctgttgtcctgctcgcctgtggaagtttcaaccccatcactaatatgcatctaagaatgtttgaggtcgcccgcgaccatttgcaccagactggtatgtaccaggtgattcagggtatcatttcccctgtgaatgacacatacggaaaaaaggatctggctgcctcccaccatagggtagccatggcgagactcgccttgcagacctccgactggattagagtcgatccatgggaaagtgaacaggcccagtggatggagacagtgaaagtgttacggcaccaccactccaagctgttaaggagcccaccacagatggaaggtcctgatcacgggaaagcactgtttagcacaccagcggccgtgcctgagctgaaactgctgtgcggagccgacgttcttaaaacgttccagactccaaacctgtggaaggacgctcacatacaagagatagtggagaagtttggcttggtttgcgtgggacgtgtgggccacgatcctaaaggctatatcgccgaaagcccaattctgaggatgcaccaacacaatatccacttagcaaaggaacccgtgcagaatgaaattagcgctacctacatccgcagggcactcggccagggacagtctgtgaagtacctcatccccgacgccgtgataacttacatcaaggatcatggcctgtacacaaagggatccacctggaagggcaagtcaacgcagagcactgaggggaaaacgagctag

SEQ ID NO: 126484 - DNA, 648 bp, Artificial Sequence
  Description of Artificial Sequence: Synthetic coding sequence
atgtatcaagtaatccagggaatcattagcccagtaaatgatacgtatggtaaaaaggatctggctgcatcccaccatcgggtggcaatggcccggctcgccttgcagaccagcgattggatcagggttgacccatgggagtcagagcaggcacagtggatggagaccgtgaaggtgttgcgacaccatcatagcaagctgctaagaagtccaccccaaatggagggcccagaccatggcaaagccctattctcaacgcctgccgcagtgcccgagttaaaactgctctgtggcgcggatgtgttgaaaacatttcagacacccaatctgtggaaggacgcacatattcaagagatcgtggagaaatttggcttggtgtgcgtcgggcgggtgggacatgaccccaagggatatattgccgagagtcctatcctgaggatgcaccagcataacatccacctcgcaaaggaaccggtgcagaacgagatcagtgccacatatatccggagggccctcgggcagggccaaagcgtgaagtacctgattcctgacgccgtgattacatatataaaagatcacggactgtacaccaagggcagcacttggaaaggaaaaagcactcagtctaccgaaggtaaaacctcgtag

SEQ ID NO: 126485 - DNA, 648 bp, Artificial Sequence
  Description of Artificial Sequence: Synthetic coding sequence
atgtaccaggttatccaagggattatctccccagtgaatgatacttacggcaagaaggatctggccgcatcccaccatcgagttgccatggcaagactggctcttcagaccagcgactggatccgggtggatccatgggaaagcgagcaggcccagtggatggaaacggtaaaggtgttaagacaccatcactcaaaacttcttaggagtccaccacagatggagggcccagaccatgggaaggccctgttcagtacacccgccgctgtgcccgaattaaaactgctttgcggagcggatgtcctcaagacttttcagaccccgaatctgtggaaagacgcacatatacaagagatcgtcgagaaattcggactggtgtgtgtagggcgtgttggtcatgaccctaaggggtacattgctgaatcacctattcttaggatgcaccagcataacattcacctcgctaaagaacctgtccagaacgaaatctccgcaacctacatccggagagcactaggtcaggggcaatccgtgaaatatttgatccctgacgctgtcattacctacatcaaggaccacggactgtacaccaagggcagtacatggaaagggaaaagcacgcaatccacagaaggtaagacctcctag

SEQ ID NO: 126486 - DNA, 429 bp, Artificial Sequence
  Description of Artificial Sequence: Synthetic coding sequence
atggaaggccccgaccatggcaaagccctcttctcaactcccgccgcagtgcctgaactcaagctgctgtgtggcgccgacgttctgaaaacattccagaccccaaacctgtggaaagatgcacacatccaggaaattgtcgaaaagttcggactggtatgtgttgggagagtcggtcacgaccctaagggctacattgccgagagccccattctgcgaatgcaccaacataacatccatttggctaaagaacctgtccagaatgagatcagcgccacctacatcagacgggcccttggtcagggtcagagcgtgaaatatcttatccctgatgcggtgataacatatatcaaggaccacggcctgtacactaaagggtcgacttggaagggaaaatcaacacaatctactgaaggcaaaactagctag

SEQ ID NO: 126487 - DNA, 345 bp, Artificial Sequence
  Description of Artificial Sequence: Synthetic coding sequence
atgaagagccgcatcccagtggtcttgctggcctgcggatcatttaatccaattactaacatgcacttacgcatgtttgaggtcgcccgtgaccatctgcaccagacagggatgtaccaagttatccagggaattatctcgcctgtgaacgatacatatgggaagaaggatcttgcggcttctcatcatcgtgtggccatggccagactggctctgcagacctcagactggatacgcgtggatccttgggagtccgagcaggcgcagtggatggaaacagtcaaggtcctacggcatcatcattctaagctgctgcggtccccccctcaaatggaagggccctag

SEQ ID NO: 126488 - DNA, 492 bp, Artificial Sequence
  Description of Artificial Sequence: Synthetic coding sequence
atgaaatctaggatccctgtggtactgcttgcctgcggctctttcaaccccattaccaacatgcaccttcgcatgttcgaggtagccagggaccatctgcaccaaactgccgtgcccgaactcaaactgctatgtggtgccgatgttctgaagacgttccagacgcccaatctgtggaaagatgcccacatccaagagatcgtggagaaatttggccttgtgtgcgtaggacgcgtgggccatgaccccaaaggttacatcgcggagtcccctattctgcggatgcatcaacataatatccatcttgccaaggaaccggtgcagaacgagatttccgctacgtatattcgcagagcccttggccagggacagtcggtcaaatatctgatccctgatgcagtaataacctatattaaagaccacggtttgtatacaaaggggagcacatggaaaggtaagtcaacacagtctacagaaggaaagaccagctag

SEQ ID NO: 126489 - DNA, 3261 bp, Artificial Sequence
  Description of Artificial Sequence: Synthetic coding sequence
atggccaatctgctgaaaactgttgtcaccggatgctcttgtcccctcctgagcaatctcggctcttgtaagggcctgagagttaaaaaggactttctgcggaccttctacacgcatcaggaattgtggtgcaaagccccagttaaaccaggcatcccctataaacagttgacagttggcgtccccaaggagatcttccagaacgagaagcgagtggccctttctcctgctggcgtccagaatctcgtgaaacaggggtttaacgtggttgttgaaagtggagcaggggaggctagtaagttttcagacgatcactatagagtggccggtgcccaaattcagggggccaaagaggtgctcgcttcggatctcgtggtcaaggtgagggcgccaatggtgaaccctactttgggtgtgcatgaagccgacctgttaaaaacctcgggtaccttgatcagctttatataccccgcacaaaacccagaactactgaataagctttcgcaaagaaagaccactgttctcgctatggaccaggtcccacgcgttaccatcgcacagggctatgatgctctctcgagtatggcaaatattgcgggatataaggcggttgtgcttgctgccaatcactttgggagattcttcacaggccagatcaccgctgccgggaaagtccctccagccaaaattctgattgtgggaggcggcgtcgccgggctggccagcgccggagcagctaagtcaatgggcgccatcgtcagaggattcgacactagggctgctgctctggagcagttcaaaagtctaggcgctgagcctctggaagtagatctaaaggagtcgggcgaagggcagggaggctacgccaaggaaatgtctaaggagtttattgaggcagaaatgaagcttttcgctcagcagtgtaaggaggttgatatcctgatctcaaccgccctgatccccgggaaaaaagcccctgtgctattcaataaagaaatgatcgagtctatgaaagagggatcagtggttgtcgaccttgccgcagaagcaggaggtaatttcgaaacaaccaaacctggagaactgtacattcacaagggtattactcacataggttacaccgatcttcccagcaggatggcaacccaggcttctacactgtacagcaacaacatcactaagctcctaaaagccatcagtcctgacaaggacaatttttacttcgatgtcaaggatgatttcgattttggcacgatgggacacgtcatcaggggaaccgtggtcatgaaggacggcaaggtgatcttcccggctcccacacccaaaaatattccacaaggagctcccgtaaaacagaaaactgtggccgaacttgaagccgagaaggcggctactatcacaccttttcgaaaaaccatgagcacagcttctgcctacactgcaggtctgacaggcatccttggactgggcatcgcagcaccaaacctcgccttcagccagatggtgaccacctttggactggccggcatcgtgggctatcataccgtgtggggggtgactcctgctcttcacagccccctaatgagcgtgaccaatgcaatctcgggactcaccgctgtgggaggattggcacttatgggcggtcatctgtacccatctacaacgagccagggcctcgccgccctggcggccttcatctcgtcagtcaacatcgccggggggtttttagtcacccaacgcatgttggacatgttcaagagacctactgatccccccgagtacaattacctgtacttgctgcctgcaggtactttcgtggggggatatctggcggcattatacagcggatataacattgagcagatcatgtatctgggttccggcctgtgttgcgttggcgctctcgccggactgtcaacgcagggtacggctaggctgggcaacgcactgggcatgatcggcgtggctggcggtctggctgccactctgggagtcctcaagcctggtcctgagctgctagcccagatgtcgggcgcaatggcacttgggggaactattgggcttaccattgctaagcgaattcagatttccgatttaccccaactggtagcagcattccactcactggtggggctggccgcagtgttgacctgcatcgccgaatatattattgaatatccgcacttcgcaacagacgcagctgctaatctcactaagatcgttgcttatctcgggacatatattggaggagtgacatttagtgggagcctcattgcatacgggaagctgcaggggctgctgaaatccgcgccgctgctcctcccgggccgacacctgctcaacgcaggattgctcgctgcctctgtgggcggtattatcccatttatggtggacccaagtttcacaacagggataacatgcctggggtccgtgagtgctctgtcagctgttatgggcgtgacattgacagcagcaatcggaggggccgacatgccagtcgtaattacagtccttaattcatatagtggttgggcactgtgtgctgagggctttctattgaacaacaatctattgaccatcgtaggagctcttatcggatcctctggtgcaatcctgtcgtacattatgtgcgtggcgatgaatcggtctcttgcaaacgtgatcctgggcggttatggcacaactagcactgccggaggcaaacctatggagatctcgggtacccacactgaaatcaacctggacaatgctatcgatatgattagagaggcaaactcgatcataatcactccgggctacgggttgtgcgccgctaaagcccaatatcccatagccgatctcgtgaaaatgctgaccgagcagggcaagaaggttaggtttgggattcaccccgttgcgggacgcatgccgggccaactgaacgtccttctggccgaagcgggggtcccctacgacattgtccttgagatggatgaaatcaaccatgactttcctgatacagacttggtcctggtgattggcgccaatgacacagtaaattccgcagcccaggaagacccaaattcaattatcgctggcatgccagtcctggaagtctggaagagcaaacaggttatcgtgatgaagcgaagcttgggagtcggatacgcggcggtcgataaccctattttttacaagccgaacactgcgatgctgctcggcgacgctaagaagacttgtgacgctctgcaagcaaaagtgagagaaagctatcagaagtag

SEQ ID NO: 126490 - DNA, 3261 bp, Artificial Sequence
  Description of Artificial Sequence: Synthetic coding sequence
atggccaacctgttgaagacagtagtcactggttgctcatgcccattactttctaacctcggaagctgtaaggggctgagggtcaagaaggactttcttagaactttctatactcatcaggagctgtggtgcaaagcaccagtgaagcctggtatcccatacaagcagcttacggtcggcgtgcctaaggagattttccagaacgaaaagcgggttgccctgtcaccggccggcgtgcagaatctggtgaaacagggttttaatgtcgttgtggaatccggtgccggtgaggcctctaagttttccgatgaccactaccgtgttgctggcgctcagatccagggggccaaggaagtgttggcctctgatctggtggtgaaagttagagcccccatggtcaaccccacattaggggttcacgaagcagacctgctgaagaccagcgggactttaatcagcttcatctaccccgcccaaaatcctgagttgctgaacaaactaagccagcggaagactacggtgctggcaatggaccaggtccctagggtgaccatagcacagggttacgacgcattaagttcaatggcgaacattgctgggtacaaggccgtcgttttggccgcgaatcacttcggtcgcttcttcactggtcagatcaccgccgcaggaaaggtgccgccggctaaaattctcatcgtgggcggtggtgtggctggcctggccagcgccggtgccgctaagtccatgggcgcgatcgtgcggggatttgacacaagggccgctgcactagagcagtttaagtctcttggggcagagccactcgaggttgacctgaaagaatccggggaaggacaggggggatatgctaaggagatgtccaaggagtttattgaggccgaaatgaaactgtttgcccaacaatgcaaggaagtagacattctcatctcaacggccctgattcccggcaagaaggccccagtcctctttaacaaggagatgatcgagtccatgaaggagggatcagtcgtggtcgaccttgccgccgaagcgggcggcaattttgagactacaaaaccaggagaattgtatatccacaaaggcattacacacatcggatatactgacctcccttcgcgcatggctacccaggctagtactctgtactccaacaacattactaaactattgaaagccatttccccagataaagacaatttttactttgacgtaaaggacgactttgattttgggacgatgggacatgtgattaggggcactgtcgtgatgaaggacggcaaggtcattttcccagcgcccacacccaaaaatatccctcagggggcaccagtaaagcagaaaacagtagccgagctcgaggccgagaaagctgccaccattacaccattcagaaaaaccatgtcgactgcttcagcctacacggccgggctcacaggaattctgggcctcggaattgccgctcctaatctggcgttttcccagatggtcacaacgttcggtcttgcaggaattgttgggtaccacaccgtctggggcgtgacccctgcattacactccccactaatgtccgtgacaaacgccatctctggcctgacggctgtaggggggctcgctctgatgggaggccacttgtacccatccactacaagtcagggcctcgctgctctcgccgcgtttatctcctccgtcaatatagccggagggttcctggttactcagcggatgctggatatgttcaagcggcccaccgatccgcccgagtataattacctgtacctactcccagctgggacattcgtcggaggatatttggccgctttgtacagcggatacaacattgagcagattatgtacctcggctccggcctttgttgcgtgggggctcttgcgggcctcagcacacagggcaccgctcggctgggaaatgccttgggtatgattggtgtcgccgggggtctggctgctacgctgggcgtgctaaaacctgggcccgaactgttagcccagatgagcggcgccatggccctgggggggaccatcggcctgactattgccaaaaggatccagatcagcgacctgccacagctcgtggccgcattccactccctggtgggactggccgcggtattaacttgcatcgccgaatacatcatagagtacccccactttgctacggacgcagctgctaacctaactaagattgtagcttatctgggtacttatattggcggagtgaccttctcaggctccctcattgcatacggaaagctccaaggcctgctgaaatctgctccactgcttctgcctggcaggcaccttctcaatgctgggttgttggctgcctctgtaggcggcataatacccttcatggtagatccaagcttcaccaccgggatcacctgcctcggctctgtgtctgcattatccgcggtgatgggtgtcacgttaacggcagccatcggcggagcagacatgccagtcgtgatcactgtgctcaattcatactcaggatgggcgttgtgtgctgaagggttcctgctgaataataatttattaacaatcgtaggtgcactgatcggatccagtggcgctatcttgagttatatcatgtgtgttgctatgaaccgcagtctcgccaatgtcatcctgggcggatatggcacaactagcacagctggcgggaaaccaatggaaatcagtggcactcacaccgaaataaaccttgacaacgccattgacatgatcagggaggccaacagcattatcataacacccggctacgggctctgtgccgctaaggcccaatacccaatcgcggacctcgtgaaaatgttaactgagcagggcaaaaaggtccggttcgggatccatccagtggccgggcgtatgccaggccagctgaacgtgctcctcgcagaggctggagttccctacgacatcgtccttgaaatggatgagattaaccacgacttcccagacaccgatctggtcctggtgattggcgccaatgacactgtcaattcggctgctcaggaggacccaaatagcattattgctggaatgcctgtcctggaggtttggaaatccaaacaagtgatagtcatgaagcgaagtcttggtgtcggctacgccgccgtggataacccgatcttttacaaacctaacacagctatgttactgggcgatgcgaagaagacatgcgatgctttacaggccaaggtgcgggagtcctatcagaagtag

SEQ ID NO: 126491 - DNA, 600 bp, Artificial Sequence
  Description of Artificial Sequence: Synthetic coding sequence
atggccaacctgctaaaaactgttgtcacgggatgttcctgcccactgctgtcaaacctggggtcatgtaaggggctacgcgtcaagaaagattttcttcgaactttttatacgcaccaggaactttggtgtaaagctcccgtgaaacccggaataccttataagcagttgaccgtaggcgtgcctaaggagatcttccagaatgaaaagagggtcgccctgagcccagcgggagtccagaacctggtcaagcaaggttttaatgtggtcgtcgagtctggcgccggcgaagcatccaaattctcagacgatcattatagggtcgccggtgcccaaatacagggtgcaaaagaggtgctagcctctgacctagtggtcaaagtcagggcaccaatggttaatcccactctgggcgtacatgaggcggatcttctaaagaccagcggaacactgatttcctttatttacccggctcagaatccggagctgctcaacaagctaagccaacgcaagacaaccgttttggccatggatcaggtgcctagggtgactattgctcaaggatatgatgctctctcaagcatggccaacatcgcctag

SEQ ID NO: 126492 - DNA, 654 bp, Artificial Sequence
  Description of Artificial Sequence: Synthetic coding sequence
atggctaatctattaaagaccgtggtgacagggtgttcatgcccactgctctccaacctagggtcatgtaaggggctgagagttaaaaaagattttctgaggactttttacacccatcaagagctgtggtgcaaggcacccgtgaaaccaggaatcccatacaaacagcttaccgtcggagtgcctaaagaaatctttcaaaatgagaagcgtgttgctttaagccccgctggagtgcagaacctagtaaaacagggattcaatgtggtcgtagaatctggcgccggcgaagcatcaaagttctctgacgaccattaccgcgttgccggggcccagatccagggcgccaaggaggttctggcttccgacctggtggttaaagtacgggctcccatggtcaaccctacactcggagtgcatgaagccgatctccttaaaaccagcggcactcttataagctttatttacccagctcagaaccctgaactgctgaacaaactgtcgcagcgcaagacaacggtcctcgcaatggaccaggtaccacgggtgacaattgcacagggctacgacgcactgtcaagcatggcaaatattgccgggtacaaggcagttgtgttggcagcaaaccacttcggaaggttttttaccggatag

SEQ ID NO: 126493 - DNA, 1806 bp, Artificial Sequence
  Description of Artificial Sequence: Synthetic coding sequence
atgctaagctggaatagggtgcgggcaaagctgccgagcagtcagatggtcacaaccttcgggctcgccggtattgtcggttaccatactgtgtggggagtaacacctgcgctccacagccccctgatgagtgttaccaatgcaatctccggcctgacagcagtaggggggctcgcactgatggggggccacctgtacccttctaccacgtcccagggactagctgctctcgctgcattcatttcctccgtcaacatagcaggggggtttctagtgactcagcggatgctcgatatgttcaagagacctactgatccacccgaatataattatctctatctcttgccagcaggcactttcgtgggcggatatctggccgcactttacagtgggtataatattgaacagattatgtacctgggttccggtctttgttgtgtcggtgccctagccggactgtctacccaggggacagcaaggcttggtaacgctctgggtatgataggagtggccggcggcttggctgctacgcttggtgtgctgaagccaggaccagaactactcgcccagatgtccggagctatggcactcggcggcaccataggtttgacgatcgccaagagaatccagatttccgacctacctcaactggtcgccgcatttcatagtctagtcggccttgcggccgtcctcacttgtattgcagaatacattattgagtaccctcactttgcgaccgatgcagccgctaatcttactaagatagtggcttatctcggaacatacatagggggcgtgaccttttctggttctttgatcgcatacggtaagctgcagggactgttgaagtctgccccgctgcttctccctggaaggcaccttctgaacgccggcttactcgccgcttctgtaggagggattatcccttttatggtggatccgtctttcactacaggtattacctgcttggggagcgtaagcgctctgtccgctgtcatgggcgttaccttgacggcagcaattggaggagccgacatgccagtggtgatcaccgtcttgaacagttacagcggctgggctctgtgcgctgaaggcttcctcttgaacaacaatctgctaactattgtgggtgcccttattggctcgtctggagccattctgtcatacatcatgtgcgtagcaatgaaccgttccctcgcgaacgtcattctgggagggtacggaacaaccagtaccgcagggggcaaacccatggagatttccggaactcacaccgagattaatctggataatgccattgatatgataagagaggcaaattccatcataattacccctggttacggcctttgtgcagcaaaagctcaatatcccatcgcagacttggtgaagatgctgacagaacagggcaaaaaggtcaggtttggcatccacccagtggctggaagaatgccaggacagctgaatgttctgttggctgaagctggggtgccgtatgatatcgtgcttgaaatggacgaaattaatcatgacttccctgacaccgaccttgtcttagttatcggagcaaacgacacggtgaactctgctgcacaggaagatcccaacagcatcatagccgggatgcccgttctcgaggtttggaaatcaaagcaggtgatcgtgatgaaaagatccctgggagttggctatgctgcggttgacaatcctattttctacaagccaaataccgctatgctgctgggcgacgctaaaaagacgtgtgatgcccttcaagcaaaggtgcgagagtcctaccagaagtag

SEQ ID NO: 126494 - DNA, 357 bp, Artificial Sequence
  Description of Artificial Sequence: Synthetic coding sequence
atgcgccgagctggcctgggagagggcgtgccccctgggaactacgggaattacggatacgccaatagtggctattccgcctgcgaggaggaaaacgagaggcttactgagtctctgaggagtaaagtgaccgcaatcaagtctctatcaatcgaaatagggcacgaagtcaaaactcagaataaacttctggccgagatggactcacagttcgacagcaccaccggatttctgggcaagaccatgggcaagttaaaaatcctgtctcgcgggagccaaacaaaactcctgtgctacatgatgttgtttagcctgttcgtatttttcatcatctactggataatcaagctgcgttag

SEQ ID NO: 126495 - DNA, 1107 bp, Artificial Sequence
  Description of Artificial Sequence: Synthetic coding sequence
atgaaccccgcagcagaggcagaattcaacatattgctggccaccgactcctacaaagttacacattacaaacagtatccccctaataccagtaaggtttacagctactttgaatgtcgggaaaagaaaaccgagaatagtaagctcaggaaggtgaaatacgaggagaccgttttttatggcctacagtatattcttaataagtatctgaaggggaaggttgttaccaaagaaaaaattcaggaggcaaaggatgtgtacaaggagcactttcaagatgacgtgttcaacgaaaaagggtggaattatattctggaaaagtacgacggccatctccccatcgagattaaggctgtgcctgaggggttcgttattccccgtggtaacgtgttgttcaccgtggagaataccgatcccgagtgttactggcttaccaactggatcgagactatcctcgtccagtcttggtacccaatcacggttgctaccaattcccgtgaacaaaaaaaaatactggcgaaatatctgttagagacctctggcaacttggacggactcgaatataagcttcacgactttggctaccgtggggtgtcctctcaggagactgcaggcattggagcctccgcccatcttgtcaattttaagggcacagataccgttgcaggcttggcactgatcaagaagtactatggcaccaaagatccggtcccagggtactccgtgcctgctgctgaacactctaccatcaccgcctggggtaaggaccacgaaaaggacgccttcgagcacatagtcacgcagttctctagcgtcccagtctctgtggtatctgattcctacgacatttacaacgcatgtgagaaaatttggggggaggatctgcggcacctaatagtgagccggagcacacaagcccccctgatcattcggcctgattcaggcaaccctctggacacagtgctcaaggtactcgaaatcctggggaaaaagttcccggttacggagaactcgaaggggtacaagctgctacccccctacctccgggtgatccagggtgatggcgtggatatcaataccctacaggaagtgtgtgtgctctactag

SEQ ID NO: 126496 - DNA, 183 bp, Artificial Sequence
  Description of Artificial Sequence: Synthetic coding sequence
atgaaccccgcagcagaggctgagttcaatatcctgcttgccaccgattcttacaaggtaacgcattataagcagtacccgcccaatacttctaaggtgtacagctatttcgaatgtagagagaaaaaaactgaaaactccaagcttaggaaggtcaagtatgaggagacagttttctactag

SEQ ID NO: 126497 - DNA, 267 bp, Artificial Sequence
  Description of Artificial Sequence: Synthetic coding sequence
atgaatcccgccgcagaagcagagtttaacatattgttagccactgatagctacaaagttacacattataagcagtatccaccgaataccagcaaggtgtattcctacttcgagtgtagagagaaaaaaactgagaactccaaactgaggaaagtgaagtatgaagagactgtgttctacggattgcagtatatcctcaacaaatacctgaagggtaaagtcgtgaccaaggaaaagattcaagaagcgaaggatgtatacaagtag

SEQ ID NO: 126498 - DNA, 1701 bp, Artificial Sequence
  Description of Artificial Sequence: Synthetic coding sequence
atggcagcagagcaggaccctgaggcccgtgcggcagctcgcccgcttctcacagacttgtatcaggcaaccatggcattgggctactggagagccggtcgagcccgtgacgccgcagagttcgagctcttttttcgcaggtgtccttttgggggagcctttgcactcgcagcaggactgagagactgcgtgcgcttccttcgcgccttccggttacgcgacgcagacgtacaattcctagcatctgttctgccccctgataccgatccagcatttttcgaacacctacgtgccctcgattgctcagaggtgacggttcgggcactcccggaaggtagcctggccttccccggtgtcccccttctgcaggtgagtggccctttgctggttgtgcagttgctggagacaccgctgctatgcctcgtcagttacgctagcctggttgccaccaatgctgcccgccttcgacttatcgccgggcccgagaagaggttgttagagatgggtttgcgcagagctcagggcccagatggtggcctgacagcctccacgtattcctacctcgggggatttgatagctcatctaatgttctggccggccagctgcggggtgtaccagttgcaggaactctggcccattcttttgtaacttcattttccgggagcgaggtgcctccagatcctatgctcgctcccgccgctggagaaggccccggcgtggatcttgctgcgaaggcacaggtttggttagaacaagtttgcgcccaccttgggttgggggtccaggagccacatcccggtgagagggccgctttcgtggcctatgccctcgcatttcccagagctttccagggcctgctggacacgtattcagtgtggagatctgggctgccgaatttccttgccgtggcactggccttgggagaactgggatatcgggcggtaggcgtgaggctggactccggggacctgcttcagcaggcccaagagataagaaaagtcttccgtgcagcagctgcccaatttcaagtgccatggctggaaagcgtgctcatagtagtgagtaataatatcgatgaagaagccctggcccgtctagcccaagaggggtccgaggtaaatgtaatcgggattgggacttcagtggtgacctgtccccagcaaccaagcttgggcggcgtttataagctcgtcgcagtgggggggcaacccaggatgaaactgaccgaggacccagagaaacaaaccctgcccgggagcaaagctgcctttaggcttcttggaagcgatggatcccccctcatggatatgctgcagctcgctgaggagcctgtgccccaggcaggtcaggagctacgcgtgtggccgccaggtgcacaggaaccctgtacagttcgccccgcccaagtcgagcccctgctaagactgtgtttgcagcagggtcagctgtgcgaaccgcttccgtcactagccgaaagcagagccctcgctcagctcagcttaagtcgtctgtctccggaacaccggagactgcggtccccagcccagtaccaggtgggcggtggaccgccatgtcattcggctctgtgtgcccccgccctaacacttccaactgcaccggtgctgtgctccctacaggtggtgttatccgagcggcttcaggctttggtcaatagcctgtgcgctggtcagtccccttag

SEQ ID NO: 126499 - DNA, 1578 bp, Artificial Sequence
  Description of Artificial Sequence: Synthetic coding sequence
atggccgctgaacaagacccagaagccagagccgctgcaagaccgcttctgaccgacctgtaccaggctacaatggctctgggttactggagggctgggagagctagagacgccgcagagtttgaactgttctttagacggtgtcctttcggaggggcttttgcattggcagctggactgcgcgattgcgtccgctttctgcgtgcctttcgtttaagagatgccgatgtgcagtttctcgcaagcgtccttcccccagatactgatcctgcttttttcgagcatcttcgggctttggactgcagtgaggtcacggtccgcgctctgcctgagggttctcttgccttcccaggagtgcccctgctacaggtgagtggacccttactggtcgtgcagctgctggagactcccctgctgtgcttagtgtcttatgcttctctggtggctacgaatgcagccagactgaggctgattgcgggacctgagaagaggttgttggagatggggctgagacgggctcaaggtccagacgggggtctcaccgctagcacttactcatacctgggggggtttgactctagctctaatgtgttggctgggcagctgcgtggtgtgccagtcgccggcactcttgcccattctttcgtcactagtttcagcgggtcggaagttccacctgaccccatgctggccccggctgccggggagggtcctggtgtggatttggcagccaaagcacaagtttggctggaacaggtgtgcgcgcacctcggcctcggcgtccaagaaccgcatcctggtgagagggccgccttcgtggcctatgcactagcttttccaagagccttccaagggctgcttgatacctattccgtctggagatcgggcctccccaattttttggccgtggcgctggccttgggggaacttgggtatagagctgtcggggtaaggctagacagtggagacctcctacagcaggcacaggaaattcggaaggtcttccgcgcagccgcagctcagttccaggtgccctggcttgaatccgttctcattgttgtctccaataacatcgacgaagaggcactagctagactggcacaggagggaagtgaggtaaatgtcataggtattgggacaagcgtggtgacgtgccctcagcagccatcattggggggagtttataagctggtcgccgttgggggacagccccgcatgaagctcaccgaggatccagagaaacagacgctccccggttccaaggcggcttttagactgttggggtccgatggaagtcctcttatggacatgctacaactggccgaggaaccagttccccaagcaggccaggagcttcgggtctggccacccggcgcacaggaaccatgtacagttcgacctgcccagctctgcgagcctctaccttcactggccgaaagcagagcgttggcccaactgtccctgtctcggctgtcccctgagcatagacggctacggtctcctgctcaatatcaggttgttctttccgagagactccaagcactggtgaactccctgtgtgccgggcaatccccttag

SEQ ID NO: 126500 - DNA, 1473 bp, Artificial Sequence
  Description of Artificial Sequence: Synthetic coding sequence
atggcagcagagcaggatcccgaagcacgagctgccgcgagacccctgcttacagatttgtatcaggcgaccatggccctgggctattggcgcgccggacgcgccagagatgccgccgaatttgagttatttttccgccgttgcccattcggaggcgcgtttgctctggcggctggcctgagggactgcgtgaggttcctacgggcttttaggctgagagatgcagatgtgcagttcctggcaagtgtcctgcctcccgacaccgacccagcgttttttgagcaccttagggctctggactgttcagaagtgacagttagagcgttgcccgaggggtctttggctttcccaggtgtgccacttcttcaggtcagcggaccacttctggtcgtccagctcctcgagaccccattactgtgccttgtatcctatgctagcttggtggctaccaatgctgcccgccttagactgatcgctgggcctgagaagaggctgctcgaaatgggactgcgccgcgcgcagggccccgatgggggtctgactgccagcacttacagttatttgggtggttttgacagttcatccaacgtccttgcgggacagctgcgtggggtccccgtcgccggcactttggcgcatagcttcgttactagtttttcgggatccgaggttcctccagaccccatgcttgcacctgcggccggtgaagggccaggtgttgacctcgctgccaaggcccaggtatggcttgagcaagtgtgtgcccaccttggcctgggcgtccaagagccccatcccggtgaacgagctgcttttgtggcctatgccctggctttccctcgtgccttccagggtttgctggacacctatagtgtctggcggtctgggctacccaactttctcgcagtcgcactggctctgggtgagctgggctatagggcagtgggagtcagattggacagcggggacttattacagcaagcacaggagatccgtaaggttttccgagcagctgccgctcagttccaggtcccttggctagagtctgttctgatagtcgtgtcaaataatatcgatgaggaggcgctggctaggctggcccaggaggggagcgaagtgaacgtgatcgggattgggacctctgtggtgacgtgtccacagcaaccatcattgggtggggtgtataagctggtggctgttggcgggcaacctcggatgaagctgaccgaagaccctgagaaacagacactgcctggcagcaaagccgcctttcgacttttgggatcggacggatcacccctgatggacatgctacagttggccgaggaaccagtgccccaggctggtcaggagctccgagtttggcccccaggggcacaagaaccctgtacggtgaggcctgcccaggtggagcctcttttaagactgtgcctccagcagggtcaggtggctgcacctccaccatcctcctag

SEQ ID NO: 126501 - DNA, 1617 bp, Artificial Sequence
  Description of Artificial Sequence: Synthetic coding sequence
atggctgctgagcaggatcctgaagctcgcgctgctgcgcgcccactgctcaccgatctgtaccaagcaacgatggctctgggctattggcgagcgggaagagccagagatgctgctgaatttgaactattttttagacggtgcccctttggtggggcttttgccctagccgctggactgcgggattgtgttagatttctccgcgcttttaggctacgcgatgccgacgtacaatttcttgcaagcgtgctccctcctgataccgaccctgcattcttcgaacatcttagggcactggactgttcagaagttaccgtgagagctttgcctgagggatcactggcctttccaggggtacctctgcttcaggtctctgggcccctcctggttgtccagctcctcgaaacccccctgctgtgtctcgtttcatacgcctccctcgtcgcgacgaacgccgcgcggctccgcctgattgccggaccagaaaagaggctgctggagatgggactaagacgcgcacaaggccccgatggagggctgactgcaagcacctattcatatctgggcggcttcgatagcagttctaatgttttagcggggcagctccgtggtgtccccgtggctggaactttagcccactcattcgtgacgagcttcagtggtagcgaggtcccccccgatcctatgctggcgcccgccgccggggaaggacccggtgtggacctggcagccaaggcacaggtttggttggagcaggtctgtgctcatctcgggttaggcgtccaggaaccccaccccggtgaacgggcagcgttcgttgcctatgccctagccttcccacgtgcattccagggactgctggatacctatagcgtttggcggtctggccttccaaactttctcgcagtggctctcgcgctgggcgagctgggatatcgggctgttggtgtgagactggattcaggcgacctgctgcagcaggcacaagaaatccggaaagtgtttagggctgccgccgcccagtttcaggtgccttggctggaaagcgtcctgattgtcgttagtaataacatcgatgaagaagccctagctaggttagcccaagaaggctcagaggtgaacgttattggaatcgggacgtccgtcgtgacctgccctcaacagccgtcgctgggtggtgtatacaaactggtggccgttggaggccagcctagaatgaagttgaccgaggatcccgaaaagcagacactccccggctccaaggcagcattccgactgcttggatcagatgggtctcctcttatggacatgctgcaattggccgaagagccggtacctcaggccgggcaggagctcagagtctggccccccggagcacaggaaccatgtactgtcagacctgcccaggtcgaacccctattaaggctgtgcctccagcagggccaactgtgcgagccccttccatctctggcagagagtagggccctggcccaactgtctctcagccgcctttctccggagcataggcggctcagaagccctgctcagtaccaagttgtactgtccgaaagattgcaggcactggtaaactcactgtgcgcaggacagagcccctag

SEQ ID NO: 126502 - DNA, 2199 bp, Artificial Sequence
  Description of Artificial Sequence: Synthetic coding sequence
atgccagaggagacgcagactcaagatcaacctatggaggaagaggaagtggaaacgtttgcgtttcaagccgaaatcgcccaattgatgagcctgattattaacactttttattccaacaaagagatcttcctgcgagaactgatctctaactcttctgatgcactcgacaagatcaggtacgagagccttactgatccctcaaagctggattccggaaaagagctgcatatcaatctcatccccaacaaacaggaccgaaccttgactattgtggacactgggattggcatgactaaggctgatctgatcaataacctaggtacaatcgccaaatctggaacaaaagcctttatggaggctctgcaggccggggctgatatctccatgattggacagttcggcgtggggttttattctgcgtatctggttgccgagaaagtgaccgtgatcactaagcacaatgatgacgagcagtacgcgtgggagtcttctgccgggggatctttcaccgtcagaacagatactggcgaacctatgggaaggggtacgaaggtcattctgcatttgaaagaagatcaaaccgagtacttggaggaaaggcgaattaaggaaatcgtgaagaaacacagtcagttcatagggtatccaatcaccctgttcgtggaaaaggaaagagacaaggaggtgtccgatgacgaggcagaagagaaggaggacaaagaggaagagaaagagaaagaggagaaagagtccgaggataaaccagaaatagaggacgtggggtcggacgaggaggaggagaagaaggacggtgataagaagaaaaaaaagaagattaaagagaagtatattgaccaggaggagctgaacaaaacgaagccgatttggaccagaaatcctgatgatattacgaacgaggagtacggcgaattttacaagagcttgacgaatgattgggaggatcatctggccgtgaagcatttctccgtggagggccaattggaattccgcgcccttctgtttgtccctcgacgcgccccattcgatttgttcgagaaccgcaaaaagaagaacaatatcaaattgtatgtgcgacgcgtcttcatcatggataattgcgaggaactgatccccgagtatctgaattttatacgcggggttgtggattctgaggatttgcccctgaatatcagcagggaaatgctgcagcagtccaagatactgaaagtcatccgaaaaaacctcgtgaaaaagtgcctcgagctatttacagagctggcggaggacaaggaaaattataagaagttttacgaacagtttagcaagaacattaagctcggcattcacgaagacagccagaaccgaaagaagctgtccgagctgctcaggtattacacctctgccagtggtgacgagatggttagtctgaaagactactgcactaggatgaaagagaatcagaagcatatttattacataacaggagagaccaaagaccaagtggccaatagcgctttcgtggaacggctccgaaaacacggcctggaggtaatttacatgatagagccaattgacgaatactgcgtacagcagttgaaggaatttgaaggtaaaacgttggtctctgtgaccaaggagggcctcgagctgcccgaggacgaagaggagaagaagaagcaggaagaaaaaaaaactaagttcgagaatctttgcaagattatgaaggatatcctggaaaaaaaggtggagaaagttgtggttagtaacagattagtgacttcgccttgctgcattgttacctccacttatgggtggacagctaacatggagcgcataatgaaggcacaggctctacgcgacaattccacaatgggctacatggccgccaagaaacacctggagataaacccagatcatagtattatagagacactgaggcaaaaagccgaggccgataagaatgataaatctgttaaggacctggtcatccttctctatgagactgctctcctctctagcggtttctcgctggaagatccccagactcatgctaaccggatttacaggatgatcaagctcgggttggggattgatgaagacgaccccacggctgatgacaccagcgccgcagtcaccgaagagatgccccctctcgagggggacgacgatacttcaaggatggaggaggtggattag

SEQ ID NO: 126503 - DNA, 2910 bp, Artificial Sequence
  Description of Artificial Sequence: Synthetic coding sequence
atggaaggcgaccgcgtggccgggcgccccgtgctgtctagtttaccagtacttcttctactgcctttgttaatgctgagggcagctgccctccatcccgacgaactatttccacacggagagtcctggggggaccagctgctgcaagaaggtgacgatgagagctcggccgttgtgaaacttgcaaatcctttgcacttctatgaggcccggttcagcaatctctatgtgggcacaaacggaatcatcagcacccaggattttcctagagagactcagtatgtggattatgactttcccaccgatttcccagctatcgcgccatttctggccgatatcgatacgtcacacggccgtgggagggtgctgtatagagtcaacgggaaagtaagcggccacctgcacgtcggccatacccctgtgcacttcacagatgtcgatcttcatgcctacattgtgggaaacgatgggcgagcatacacagctatcagccatatcccccaacccgccgcacaggccctcctcccccttacacctattggcggactgtttggttggctgtttgccctcgagaaaccaggctcagaaaacgggttttcgttggctggggccgccttcactcacgacatggaagtcacattttatcctggcgaggaaaccgtccgcatcacccaaacggctgagggactggaccccgagaactatctctctattaagaccaatattcaaggccaagtgccttatgtgagcgctaacttcaccgctcacatcagcccttataaggaactctaccattattcagactcaacggttacctctaccagcagtagggactattccctcacatttggggcgatcaaccaaacctggtcctatcggatccatcagaatattacctatcaggtttgcagacatgcaccaagacatcctagtttcccaaccacccagcaactgaacgtggaccgggtctttgccctgtataacgacgaggaaagggtgctccggtttgcagtgacaaatcagatcggacctgtaaaggaagacagcgacccaacccctggaaatccctgctacgatgggagtcatatgtgcgacacaactgctagatgccatcccggtactggggtggattacacctgcgaatgtgcatccggctaccaaggcgacggcagaaattgcgtggacgaaaatgaatgtgcgaccggattccaccgctgcggcccaaattccgtttgtatcaatttgcctggctcctatcggtgtgagtgccggtcaggttatgagtttgcagacgacagacatacatgtattctgattactcccccggcgaatccgtgcgaagatggctcccatacctgtgctcccgccggtcaggctcggtgtgttcaccatggaggcagtactttttcttgcgcttgtttgccgggttatgcgggagacggtcatcaatgtacagacgtagatgaatgctccgaaaatcggtgccacccggccgctacgtgctacaacactcctgggagcttctcttgccggtgccagcctggctattacggagatggattccagtgtatacccgatagtacttcttccttgaccccctgtgagcagcagcagagacatgctcaagcacagtacgcttatccaggcgcgcgcttccacattccacaatgcgatgaacaggggaatttccttcctctccagtgccacggttcaactggattctgttggtgcgtggaccccgacgggcacgaggtgcctggcacccagaccccaccaggcagtacccccccccattgcggcccttctcctgagcccacccaacggcctccgacaatctgcgagcgatggcgtgagaacttgctcgagcactatggcgggaccccccgggatgatcagtatgtgccccagtgtgacgacctcggacattttatccccctacaatgccatggaaaatcggacttttgctggtgcgtggataaggacgggagggaggttcagggcactcgatctcagcccggcaccacaccagcctgcatccccaccgtcgcgccccccatggtgcgccccacccctcgtcctgacgtgactcctccttctgttggaacattcctgctttatacacaggggcagcagatcggctatctccctctgaatggtacgagacttcaaaaagatgctgctaaaaccctgctatcactccacggatcaatcatagtcggaattgactacgactgcagagagcgcatggtgtattggaccgatgtggccgggcgcaccataagccgggctgggctggaactgggagctgagccagagactatcgtgaatagcgggttgataagccccgagggactcgcgatcgatcatattcgacggaccatgtactggaccgactccgttcttgataagatcgagagcgccctcttagatggcagtgagcgcaaagtgctcttctacactgatcttgttaatccgagggccatagctgtggatcccattcgtggtaacctgtattggaccgactggaatagagaggcaccaaaaatcgagacgagttctctagacggagagaaccgcaggatcctgattaataccgatattggtctgcctaacggactgacatttgacccattctctaaactgctgtgctgggcagacgctggaaccaagaagttggaatgtacactgccggatggtaccggacgtagagtaatacaaaacaacttaaaatatcccttcagtatagttagctacgctgatcatttctatcacacagattggagacgcgacggtgtggtgagcgttaataagcactccgggcagtttaccgatgagtacctccccgagcagagatcgcacctgtatggcattactgccgtctacccttactgccccaccgggcgtaaatag

SEQ ID NO: 126504 - DNA, 3543 bp, Artificial Sequence
  Description of Artificial Sequence: Synthetic coding sequence
acaccgcaaactgagcggataacccattccagtatcagctggagctttctgctgcgattctcacggggtaaactgctgatgctgagagcggcagcactgcacccagacgagctctttccccacggtgagtcatggggagaccagttgcttcaggagggtgatgacgagtcctccgcagtagtcaagctcgcgaatcccctccatttttacgaggccagattttcaaatctttacgtcggcaccaacgggatcataagtacacaggatttccccagagagacccagtacgtcgattatgacttcccaacagatttccctgcgatcgctcccttccttgcggacatcgatacgagtcacggcagaggtagagtgctatatagggaagacacatcaccagctgtgctggggttggcagcccgctatgttcgggccgggtttccccgttccgcaagattcacccccacacacgcttttctcgcaacatgggaacaggtaggggcctatgaagaggtcaagcgcggcgccctgccctctggcgaactgaatactttccaggctgtgctggcatcagacggcagcgactcttacgcactcttcttataccctgccaacggtctgcaattcttggggacaagacccaaggaatcttacaatgtgcagttgcagctgccggccagagtgggcttttgtcgcggggaagccgacgatcttaaaagcgaggggccttatttctcattgacttcgactgaacaaagcgtgaaaaatctttatcagctctccaacctcgggatcccaggcgtctgggcatttcacattggctccacctctccacttgataacgtcaggcccgcagcagtgggcgatctctccgccgcgcacagctcagtgcccctgggtcgatctttttcgcacgccaccgccctggaaagcgactataatgaggacaatcttgactattatgatgtgaatgaagaggaggccgaatacctgcctggagagcccgaagaggctcttaacggccacagcagcattgatgtctcatttcagagcaaagttgacaccaagccactagaagagagcagcactctggatccccatacaaaagaaggcacctcgctaggggaagtcggtgggcccgacctgaaggggcaggttgaaccatgggacgaaagggagacccgcagccccgcccccccagaagtggatcgcgacagcctggctcccagttgggaaactccgccgccataccccgaaaacggctccatccagccctaccccgatggcggccctgtgccttcggagatggatgtgcctcccgctcatcccgaagaggaaatagtgctcaggtcatacccagcctctgggcatacaactccgctatctcgtggtacatatgaagtgggcctggaagataatatcgggagcaatactgaagtgttcacatataacgccgcaaataaggaaacttgtgaacacaatcataggcagtgttcaagacatgcattttgcactgattatgctaccgggttctgctgccactgtcagagcaagttctacgggaatggaaaacattgtctgcccgaaggcgcaccacaccgagttaacggaaaggtttccgggcatcttcacgtgggtcacacacccgtgcactttacagacgttgacttgcacgcgtacattgtggggaacgatggccgggcctacactgccattagccacatcccccagcctgctgcacaagcgttgctgcccctcactcccatcggtgggctgttcgggtggttgtttgcccttgaaaagccgggatctgagaacggtttcagcttagctggagcagcgttcacacacgacatggaggtcacattctaccctggtgaagaaaccgtgaggattactcagacagccgaaggcctggacccagaaaactacctgtccattaagacaaacattcaagggcaagtcccatatgtgtctgctaacttcacggcccacatcagcccctataaagaactttaccactactctgattctacagttacaagcacatcgagtcgggactactccctcaccttcggcgcaattaaccaaacttggtcctatagaattcatcaaaatatcacttaccaggtctgccgccacgctcccagacatccgagcttcccaaccacccaacagttgaatgtggaccgcgtgttcgctttgtacaatgacgaggaacgtgtgctgcggtttgcagtgaccaatcagatcggcccagtcaaagaagacagtgaccccacacccggtaatccttgctatgatggaagtcacatgtgcgacactaccgctcggtgccacccaggcacaggcgtggactatacatgtgagtgcgcgtcaggctatcaaggcgacggtcggaactgtgtcgatgaaaatgagtgtgccaccggatttcaccgctgtggacctaatagcgtttgcattaacctgcctggttcctaccgctgtgagtgtcggagcgggtatgagtttgcggatgacaggcatacctgtatcttaattacgccaccagctaacccgtgtgaagatgggagccacacttgcgcacccgcgggtcaagcccgctgtgtacaccatggcggatccacatttagttgcgcatgtctgcctgggtatgccggcgacggccatcagtgtaccgacgtggatgaatgttcagaaaacaggtgccaccctgcggctacctgctacaacacacctggatcattctcatgcagatgccagcctggctactacggtgacggattccagtgcatccccgattccacgtccagtttaacgccgtgtgaacagcagcaaagacacgcacaggctcaatacgcgtaccccggtgcaaggtttcacattccccagtgcgacgagcagggaaattttctaccgcttcagtgccacggttccacgggtttttgctggtgcgtggatcccgacggccacgaggtccccggtacacagaccccgcccggaagcactccaccacactgcgggccttcacccgaacctacccagaggccaccgaccatctgtgaaaggtggcgcgaaaatctcttagagcactacgggggcaccccacgcgacgaccagtatgtgccccagtgtgacgacttgggtcacttcatccctctgcagtgtcatgggaagtccgacttctgctggtgtgtggacaaggacgggagagaagtacaggggactcgcagccagccagggacgacccccgcttgcatcccaacggttgctcctccaatggtgaggcccacgcccaggccagatgttactcccccatctgtggggacattcttactctatacccagggtcagcagattgggtatttacctctgaacgggacacggctgcagaaggacgccgccaagactcttctgagcttgcacgtgaagtggattagccctgtgggcgggagggccgcgtggctgtcccagtgggagcctccacacagaccctgctgcagtgaagtggactggtgtagagaagtgctagaggggttttag

SEQ ID NO: 126505 - DNA, 3825 bp, Artificial Sequence
  Description of Artificial Sequence: Synthetic coding sequence
atggaaggtgatcgggtgaagctcgccaaccccttacacttttacgaggcccgcttttcaaatctgtacgtgggaactaatgggatcatttctacacaagattttcccagggaaactcagtatgtagactatgacttccctacagacttcccggctattgcccctttcctggctgacatagataccagccatggtagaggtagggttctgtatagagaagacaccagtcccgcagtcctgggcctggctgcgcggtatgttagagctggcttcccccgctctgcgaggtttacccccacccatgctttcctcgctacttgggagcaggtgggggcttacgaggaagtcaagcgcggcgccctgccatctggagaattaaataccttccaggccgtgctggcctctgacggctccgatagctacgcactattcctgtatcccgctaacggcctgcagtttcttggtactcgccctaaagagtcctacaatgttcagctccagctgccagccagggttggcttttgtagaggagaggccgatgatttaaagtctgaggggccttatttcagtctaacaagtacggaacagtcagttaaaaatctttaccaattatcaaacctgggcatcccgggagtttgggctttccatattggatccacatcaccgctggacaatgttcgacccgcggcagtgggcgatctctccgcagcgcactcgtcggtacccctgggtcgcagtttttcccacgcaactgctctggaatctgactataatgaggataacttagactactacgacgtcaacgaagaagaagcggaatatctgcccggagaacccgaggaagccctaaatgggcattctagcattgacgtatccttccaatctaaggtggatactaaacctctcgaggagtctagcacgctcgatccacatactaaggaaggcacgagtctgggcgaggtgggaggaccagatctgaaaggccaggtcgaaccctgggacgagcgcgagacgcggtctcccgctcccccagaagtggatagggactctctagccccttcatgggagactccccctccctatcctgagaatgggtccatccagccttatcctgacgggggaccggtcccatccgaaatggatgtgcctcctgcccaccctgaagaggaaattgtgcttcgctcctatcctgcttcggggcacaccactcctctgagtcgcggaacgtacgaagtgggacttgaggataatatcggatctaacactgaggtatttacttataacgcagccaacaaagagacgtgcgagcacaaccaccggcaatgtagcaggcatgcgttttgtaccgactatgccacagggttctgctgccactgtcagtctaagttctacggaaacggcaaacactgtcttccagagggggccccccaccgagtgaatgggaaagtctccggacacttacatgtgggccatactccagtgcatttcaccgacgtcgacctgcacgcatatatcgtaggcaatgatggccgggcatacacggccatttcccatattccccagccggccgcccaagctttgctccctctaacgcctatcgggggcctgtttggctggcttttcgcgcttgagaagcctggaagtgagaacggtttttcgttagccggcgccgcatttacccacgacatggaagtgacattttacccgggcgaggaaactgtgagaattacccagaccgctgagggattagatccagaaaactaccttagtataaagacaaacatacagggtcaggtgccgtacgtatcagctaatttcactgctcacatctcaccctacaaggagctttaccactatagcgacagcacggtcacctccaccagttcccgcgactactcattgacttttggcgcgattaatcagacctggagttaccgaattcaccagaacattacctatcaggtttgccggcacgcaccccggcaccctagttttcccacaacacagcaattgaacgtagaccgggtgttcgccctttataacgacgaagagagagtgctgaggttcgctgtgacaaaccagatcggccccgtcaaagaggattcagatcctactccagggaacccatgctatgacggatctcatatgtgtgatacgaccgcccggtgtcatccagggacaggcgtagattacacctgcgaatgtgccagcggttatcagggagacggaaggaattgtgttgatgagaacgagtgcgctaccggcttccatcgctgtggccccaactccgtttgtattaacctcccaggatcctaccggtgtgagtgcagatccggctacgaattcgcagatgaccggcacacatgcatatacgtcgatgaatgtagcgaaaatcggtgccacccagctgccacgtgctacaatacacctggctccttttcctgtagatgccagcccgggtactatggcgacggctttcaatgtatccccgattccacgtcctccttgaccccatgtgagcagcagcaacggcacgcccaggctcagtacgcgtacccaggcgcaaggttccacatccctcagtgtgacgaacaggggaactttctgccactccagtgccatgggtcaaccggattctgctggtgtgttgaccccgacggtcatgaagtgcctggcacccaaactccccctggctctacacccccacactgtggcccctcgcctgagccaacgcagcgcccacccaccatctgcgagaggtggcgtgaaaaccttctggaacactacgggggtactccccgggacgatcagtacgtgccgcagtgtgatgatctgggacatttcatccctctgcagtgccatgggaaatcagatttttgctggtgcgttgacaaagatgggagggaagtgcagggtacaagaagccagcctggcacgacgcctgcctgcattcctacagtggccccccctatggtacgaccaaccccccgccctgacgtgactccaccctctgtaggaacattcctactgtatacgcagggccagcagatcggttacctccccctcaatggtacgcggttacagaaagacgcagccaagactctgctgtctctgcatggctctatcatcgtcggcatcgactacgattgtagggaacggatggtctattggaccgatgtagccggtcgcaccatttctcgcgccggactggagctgggcgcggagccggaaacaattgttaattccggactcatctcaccagaaggattggccatcgaccatatacggcgtaccatgtactggactgacagcgtactggataagatagaaagtgccctgcttgacgggtcggaacggaaagtcctgttctatactgatctagttaaccctcgagctatagctgtggatcccattcgcgggaacctctactggaccgactggaaccgggaagccccaaaaatcgaaacaagctcactggatggagagaaccgcagaattcttatcaatacagatatcgggctgcctaatgggctgacatttgatccatttagcaagctactgtgctgggctgacgcggggacaaaaaagctcgaatgcaccttgcccgacggcacgggccgtagagtcatccagaataatctcaagtacccatttagtatagtgagctacgccgaccatttctaccataccgattggcgacgggacggcgtggtttcagtgaataagcattccggacaattcaccgatgaatacctccccgagcaacgctcacatctctacggaataacggcagtatatccatattgcccaactgggcgcaaatag

SEQ ID NO: 126506 - DNA, 3837 bp, Artificial Sequence
  Description of Artificial Sequence: Synthetic coding sequence
atgaccgctcgaggacttgctcttggtcttcttctgttgctattgtgtccggcccaggtgtttagtcagtcgtgcgtgtggtatggagagtgcggcatcgcttatggagataagcgatacaattgcgagtatagcggtcctccaaaacccttgcccaaagacggctatgatcttgtgcaggagctctgcccaggtttcttcttcgggaacgtgtcactgtgctgcgatgtgagacaattgcagactctgaaagacaacctgcaacttccccttcaattcctgagcaggtgtccttcatgcttttataatctgttaaatctcttttgcgaactcacatgcagccctcgccaatcacagttcctgaacgtcacggcaactgaggactacgtggacccagtgacaaaccaaactaagaccaacgtcaaagagctgcagtactatgtcggtcaaagctttgctaatgcaatgtacaacgcatgccgcgatgtggaggcacccagttccaatgacaaggcactcggtctactatgcgggaaagacgccgatgcttgtaatgccaccaactggatcgaatatatgttcaataaagataatggacaggccccgttcaccattacgcccgtgttttctgacttcccagtgcacggcatggagcctatgaacaacgctacaaaagggtgtgatgagtcggttgacgaagtaactgcgccatgttcttgtcaggattgcagcattgtgtgtggtcccaagccacagcctcctccgccccctgcgccatggacgatccttggcctggatgccatgtacgtaataatgtggattacatacatggccttcctgctcgtattcttcggggcctttttcgccgtgtggtgttacaggaagcggtattttgtgtctgagtacacacccatcgacagcaatatcgccttctctgtaaatgctagtgacaagggcgaggcgtcgtgctgtgatcccgtgtctgccgcctttgagggctgtttacgacgcctgtttacacgatggggatctttctgcgtgcgaaatcccggatgtgtgattttctttagcctggtgttcatcaccgcatgttccagtgggctcgtttttgtgcgcgtcacaacaaacccagtagatctgtggtccgctccctcaagccaggccaggctggaaaaggaatactttgatcagcacttcggcccattcttccggacggaacagctcattattagggctccactcaccgacaagcacatctatcagccctacccctcaggggcagatgtcccttttggtccccccctggacatacagatacttcaccaggttcttgatcttcaaatcgctatcgagaatatcactgcatcgtatgacaacgagaccgtgaccttacaggacatatgcctcgcccccctctcaccatataataccaattgtaccatactctccgtgctgaattactttcagaattctcacagcgtgctcgaccataagaagggggacgacttcttcgtgtacgcggattaccacactcatttcctctactgcgtgcgagcccctgcttctcttaacgacacatcccttctgcacgacccttgtttggggacattcgggggcccagtcttcccttggctagtgttgggaggctacgacgatcagaattacaacaacgccaccgcattggttatcacttttccggttaacaactactacaatgacactgaaaagcttcagcgcgcccaggcgtgggaaaaagagtttatcaacttcgttaaaaactacaagaatcccaacctgaccatcagttttaccgctgaacgatcaatcgaggacgaattgaaccgggagtcggacagcgacgtgtttactgtagtgatttcatatgccatcatgttcctctacatcagcctggcgcttgggcacatgaaatcttgccgcagactactcgttgacagcaaggtgagcctgggtatcgctggaattctgatcgtcctgtcatccgtggcatgcagcctgggcgtcttttcctatattggactcccccttacgttgattgtcatagaggtgataccttttcttgttctcgcagtcggcgttgataatatcttcattctggtgcaggcctaccagcgcgacgaacgacttcaaggggaaaccctggatcaacagttggggcgagtgctaggagaagtcgccccctccatgtttctgtcatcttttagcgaaaccgtagccttctttctcggggcactgtccgtcatgccagcagtccacacgttttccctctttgctgggctagccgtctttatagactttctcctgcaaattacctgtttcgtcagtcttctgggactggatattaaaaggcaggaaaaaaaccgcctggacattttttgctgcgtgcgcggtgcagaggacggtacatcagttcaggctagtgagtcctgcttgttcaggttctttaaaaactcttactcacctttactccttaaggattggatgcgtcctatcgtgattgccatcttcgtcggtgtgctatcattttcgatcgcagtgcttaacaaggtggacatcggactcgaccagtcattgtcgatgcccgacgattcttacatggtcgattattttaagagcattagtcagtatcttcacgccggtccccccgtgtacttcgtgcttgaggaaggacacgactataccagttccaaggggcagaacatggtttgcggagggatgggctgcaataacgacagcctcgtgcaacaaatcttcaatgccgcccagctagataattatacacgaattggtttcgccccctcttcttggatagacgattatttcgattgggtgaagccccagtcatcgtgttgcagagtcgacaatattaccgatcaattctgcaatgcaagcgtcgtggatccagcatgtgtgaggtgccggcccttgaccccagagggcaaacaaagaccgcagggtggtgattttatgcgctttctgcctatgttcctctccgacaaccctaaccccaagtgtggcaagggtggccatgccgcgtacagttccgcagtaaacatactgcttggccatgggacacgggtgggagccacatattttatgacctatcataccgtgctccagacttcagcagattttatcgacgcactgaaaaaagctaggctcatcgcatctaacgtgaccgaaacaatgggtatcaacgggtcggcataccgggtgttcccctacagtgtgttctacgtgttctacgagcagtacttaaccatcatcgatgatacgatattcaacctgggcgtctccttgggcgcaatatttcttgtgacaatggtgcttcttggctgcgagctgtggtccgccgttattatgtgcgctactatcgcaatggtcctggtaaacatgtttggcgttatgtggctgtggggaatttccttgaacgcggtatctctggtgaatttagtgatgtcatgcggcatttcagtcgaattttgctcacacataacacgagcattcactgtgtctatgaaaggcagccgtgtcgaaagggctgaagaggcactggcacacatggggtctagcgtgttctctggcatcacgctgaccaaattcggcggaattgtggtgttagcgtttgccaagagccagatctttcagatattttactttcgcatgtacctggcaatggttctcctgggcgccacccacggactgattttcctccccgtccttcttagttatatcgggcccagcgtgaataaggccaaaagctgcgccacagaagagagatataaaggcaccgaaagggagagattgctgaatttctag

SEQ ID NO: 126507 - DNA, 2883 bp, Artificial Sequence
  Description of Artificial Sequence: Synthetic coding sequence
atgtacgtgataatgtggattacatacatggcattcttactggtcttctttggcgcattttttgcagtctggtgttatcggaaaaggtactttgttagtgagtacaccccgatcgattccaatattgcattttccgttaatgcttccgataaaggaacagcctggctactgacaagtaccttcccctctagccccgtattgccaggggaggcaagttgctgtgaccctgtcagtgctgcattcgagggctgtctgcgccgcttgtttacgagatggggttccttctgtgtacgaaacccaggctgtgtgatatttttctctctagtcttcattaccgcttgtagctctgggctcgtgttcgtgagagtgaccactaatcccgtggacctatggagtgccccatcttctcaggctaggctagaaaaagagtacttcgatcagcattttggcccatttttccgcacggaacagcttattattagagccccactgaccgataaacatatctatcaaccttatccatccggagccgacgtgcctttcggccccccccttgatattcagattctgcaccaggttttggatttgcagatcgctatcgaaaacatcaccgcatcctatgataatgagacagtcacattacaggacatctgtctcgcccccctctctccatacaacaccaactgcacgatcctaagtgttcttaattacttccagaactcacactcagtgttggaccacaagaagggtgatgatttctttgtttacgccgattatcatacgcactttctctattgtgtgcgattcatcaactttgttaagaactacaaaaatcctaacctgacaatctccttcaccgctgagcgaagcatcgaagacgaattgaaccgagaatcagactctgacgtgttcaccgtggtcatctcctacgctataatgttcctgtatatttcactagccctcggccatatgaagagttgtcgccgtcttttagtggacagcaaggtaagtcttggcatcgcaggtattcttatcgtcctttccagtgttgcttgctccttgggggttttctcgtacatcgggctgccactgacgcttattgttatcgaagtaataccctttttggtcctggccgtaggcgtcgacaatatctttatcttagtgcaggcttaccagagagacgagagactccaaggagagaccctggatcagcagctcggccgagtgttgggagaagtggcaccatctatgtttcttagcagctttagcgagaccgtggcgttcttcctgggtgccctgtcagtcatgcctgctgtgcataccttttctctgttcgccggcctggctgtattcattgacttcctgctgcaaatcacttgttttgtgtcgctgctaggtctcgatattaaacggcaggaaaagaaccggctcgatatattctgctgtgtcagaggagctgaggacggaacaagtgtgcaagcctctgaatcatgcctgtttcgattctttaaaaactcatacagtccattgctcctgaaggattggatgcgtcccatcgtgattgcgattttcgtcggcgtgcttagcttttcaattgcggtcctgaacaaggtggatataggtctcgaccagtcattgtcaatgccggacgatagctatatggtggactacttcaaatccattagtcagtatctgcacgccggccccccagtctactttgtgctagaggagggccacgactacacatccagcaaaggtcagaacatggtgtgtggcggcatgggctgtaacaatgatagcctggtccagcaaatctttaacgcagcgcagttggataactacacgcgaatcggcttcgcgccgagttcttggatcgacgactattttgactgggtgaagcctcagagctcctgctgtcgtgtagataacatcaccgatcaattttgcaatgcatcagtagtcgatcccgcctgcgttcgctgccgcccattgacacctgaaggaaaacagcgcccccagggcggagatttcatgcggttcttaccgatgttcctaagtgacaaccccaaccctaagtgtggaaaaggcggacacgccgcctactctagcgccgtaaatatcctgctgggtcacggcacgagagtgggggccacatacttcatgacgtaccatacagtattgcaaacatctgcagattttatcgacgcccttaaaaaggcacgcctgattgcgtctaacgtaaccgaaactatgggcatcaatggaagtgcctatcgggtcttcccatacagcgtgttttatgtgttttacgagcagtatttgacgataattgacgacacaatcttcaacttgggcgtgagcctgggagcgatctttctcgtaaccatggtgctgctgggctgtgagctgtggagtgctgtcatcatgtgcgctactatcgccatggttttggttaacatgttcggggtcatgtggctttggggcatatctcttaacgcagtgagtctagtaaacctcgtaatgagctgtggcatttccgtggaattttgcagtcatatcacccgggcttttaccgtgagcatgaaggggagcagagtggaaagggctgaggaagccctggcccacatgggttcttctgtcttctcggggattaccttgacaaagtttggagggattgtagtgcttgccttcgccaagtcacaaattttccagatcttttactttcgaatgtacttagcaatggtcctgctcggagccacccacggcctgatttttttacccgtccttctctcatatattgggccttccgttaacaaagccaaatcttgcgctaccgaagagagatataaaggtacggagcgcgagcggctgctgaacttctag

SEQ ID NO: 126508 - DNA, 2331 bp, Artificial Sequence
  Description of Artificial Sequence: Synthetic coding sequence
atgtataacgcatgtcgggatgttgaggcaccatctagcaacgacaaggctttgggcctgctgtgcggaaaagatgcagacgcatgtaatgccacaaactggattgaatatatgttcaacaaggataacggccaggcgccgtttaccattacaccagtgttttccgatttcccagtacacgggatggaacccatgaataatgcaacaaagggatgcgacgaatctgtagacgaggtgacggcgccctgtagctgccaggactgtagcatagtctgcggccctaagcctcagcctccgccaccgccagcgccgtggactatcctcggacttgacgccatgtacgtaataatgtggattacatacatggcattcctgctagtgtttttcggtgcattttttgccgtgtggtgctatcgcaagcgctacttcgtctcagaatacacccctattgatagtaatatcgcttttagtgttaacgcgtctgataaaggcgaagctagctgttgtgacccagtgtctgcagcctttgagggttgtctgcgaagactgttcacacggtggggaagcttttgcgtgcggaatcccggatgcgttatcttctttagcctagtctttatcaccgcttgtagttccggacttgtgtttgtgcgcgtgaccacaaatcctgtcgatctgtggagcgctcccagttcccaggccaggctggaaaaagaatatttcgaccagcatttcggtccattctttcgcacagagcagcttattattcgcgcccccctgaccgataaacacatctatcaaccttatccttctggcgcagacgtccccttcgggccgccattagatattcagatcttgcaccaggtcttggatctacagattgctattgaaaacattacagcctcttacgacaacgagactgtcacgcttcaagatatttgcctcgcaccgttgtcgccatataacaccaactgcacaattcttagcgttctaaactatttccagaatagtcattccgtgttagatcacaaaaagggggatgatttcttcgtttatgccgattatcacactcacttcctgtactgtgtgcgcgcaccagctagcctgaacgacaccagcctgctgcacgacccctgtctgggcacattcggtgggcccgtattcccttggcttgtcctgggcggatatgatgatcaaaattataataacgcaactgccctcgtgattactttccccgtgaacaattactacaatgataccgagaaactgcaacgcgctcaggcctgggaaaaggaattcattaacttcgtcaaaaattacaaaaatcccaatctgacaatttccttcaccgctgagagatctattgaagatgaactgaatcgagagagtgactcagatgtgtttaccgtggtaatatcttatgccataatgttcctgtacattagtctcgctcttggccatatgaagtcctgcagacgactgttggtcgacagtaaagtctccctgggtatcgctggcattttgattgtcttaagttcggtcgcctgcagcctcggagtatttagctacatcggattgccgcttactttgatcgtgatcgaagtgatacccttccttgtgcttgcagtcggtgtggacaacatttttattctcgtgcaagcctaccaacgggacgagaggttacagggcgaaactctggaccagcaactggggcgggtgctgggcgaagtggccccttccatgtttctgagctctttctcagaaacagtggctttcttcttaggggctctctcggtgatgccagcagttcacaccttttctctattcgccggcctcgctgtctttattgactttttgctgcagatcacatgctttgtgtcccttttggggcttgacataaaaagacaggagaagaacaggctggatatattctgctgtgtgcgtggggccgaggacggaacaagcgtacaagctagcgagagctgcttattccgttttttcaaaaacagttatagtcccctgctgctgaaggactggatgcgcccaatagtgattgccatttttgtgggagtcctgtcatttagcatcgccgtcctgaataaagttgacataggtttggaccaatccctgtctatgccagacgacagctatatggtggattatttcaagtcgatcagccagtacctgcacgccgggcctcccgtgtactttgtcctggaagaggggcacgactatacatctagtaagggccaaaacatggtgtgcggaggcatggggtgtaataacgactccctggtgcagcagatctttaatgcggcccagcttgacaactag

SEQ ID NO: 126509 - DNA, 369 bp, Artificial Sequence
  Description of Artificial Sequence: Synthetic coding sequence
atgcggtttcttgctgccacatttttactcctcgccttatccaccgctgcacaggccgaacctgtgcagttcaaggactgtgggagtgtagatggggtgattaaggaggtcaacgtatcgccgtgccctacacaaccgtgtcagctgtctaaaggccaatcttactccgtgaacgtgacattcactagtaatattcagtccaaatccagcaaagctgtggtgcatggcatactaatgggggtcccagtccctttccccatccctgagcccgacggctgtaagtccggaatcaactgccccatccagaaggacaaaacttacagttacttaaataaactgcccgtcaagtccgagtatccaagcgtatag

SEQ ID NO: 126510 - DNA, 456 bp, Artificial Sequence
  Description of Artificial Sequence: Synthetic coding sequence
atgcgattcttggccgctacctttctgttgctggccctgagcacagcagcgcaggccgagcccgtccagtttaaagattgtggctccgtcgacggcgtcatcaaagaggtaaacgtgtccccatgtcctacccagccctgccagctttccaaggggcaatcctacagcgttaatgttacctttacctcaaacattcaaagcaagagcagcaaggcggtagtccatgggatcctcatgggggtgcccgtcccattcccaatacccgaacctgatggatgtaagagtggcatcaattgtcccatacaaaaagataaaacctactcttatctgaataaacttccagtcaaatccgagtacccgtccatcaaactggttgtagaatggcagttacaggacgataagaatcagtccctgttctgttgggagattcccgtgcagattgtaagtcacctgtag

SEQ ID NO: 126511 - DNA, 1053 bp, Artificial Sequence
  Description of Artificial Sequence: Synthetic coding sequence
atggacttgaaagcactgctgtcttcgctcaatgactttgccagcctgtctttcgctgagagttgggacaacgtcggcctcctggtcgaaccttctcccccacacacagtaaatacattgtttcttactaatgatctgacagaggaagtgatggaggaggtgcttcagaagaaggcagacttgatcctgtcttaccatcctccaatttttcggccgatgaagcgcattacctggaacacctggaaagagaggttggttataagggccttggaaaaccgagtggggatctacagtccacatactgcttacgacgcagccccccaaggggtgaacaattggctcgccaaaggcttgggggcctgcacctcaagacccatccacccctctaaggcgcccaattacccaacagagggaaatcaccgagtggaattcaacgtgaactacactcaagatctggacaaggtgatgtcagctgtcaagggaattgatggggtaagcgtcacttcattttccgctcggacaggcaacgaggaacaaacccgtattaacctaaactgcacacaaaaggcactgatgcaagtcgtagattttctttcaaggaataagcaactgtaccagaagactgagattctctctctcgagaaacccctccttttacataccgggatggggcgcctctgtaccctggacgagtcagttagcctcgcaactatgattgaccgtatcaaacgccatctgaagctgagccatattaggcttgccctcggcgtgggtcgcacccttgagtctcaagtgaaggtggtcgctttgtgcgcaggttccggtagttcagtcctgcagggagtggaggccgacctttaccttaccggtgaaatgtctcaccacgacacactggacgcagcatcccaaggaattaatgtaatcttatgtgaacactctaataccgagcgaggattcctgtcagatctgcgggatatgcttgattcccatctggagaacaagattaacattattctctcggaaaccgaccgcgatcctctacaggtcgtgtag

SEQ ID NO: 126512 - DNA, 759 bp, Artificial Sequence
  Description of Artificial Sequence: Synthetic coding sequence
atgctctcctcatgtgttcgtccagtaccaaccacagtcagattcgtggatagtttaatctgtaatagcagtagatcatttatggatctaaaggccttgctcagcagcctgaacgattttgccagcttgtccttcgccgagtcttgggataacgttggcttactggtggagcccagtccaccccacactgtgaacaccctttttttaactaatgatctcaccgaggaggttatggaagaggtgctgcagaagaaagcggacctgatcttatcttaccaccctccgatttttaggcctatgaagcggattacttggaatacctggaaagagaggcttgtgattagagctctggagaacagagttggaatctattcacctcatacagcctatgatgcagcaccgcagggggtgaacaactggctcgcaaagggtctcggggcctgcacctcccggccaatccacccctctaaagcccctaactatcctaccgagggcaatcatcgggtggaattcaacgtgaactatacacaagacctggacaaagtaatgtcagctgtaaaggggatcgacggggtaagtgttacctcttttagcgccaggaccggcaacgaagagcagacaaggatcaatctgaactgcacccagaaagcgctgatgcaggtggtggatttcctttcgcgcaataaacagctgtatcagaagcatcaggacaacaccttctataaatccgccgggtgtcagcttaaatttgtgacatag

SEQ ID NO: 126513 - DNA, 1134 bp, Artificial Sequence
  Description of Artificial Sequence: Synthetic coding sequence
atgctctcatcatgtgtgaggccagtacctacaacggtgcgatttgtggattcactcatctgtaattcgtctcgcagcttcatggatttgaaagcacttctgtccagcctgaatgatttcgccagcctgagttttgcggagagctgggataatgtcggactactagtggagccctccccccctcacactgttaacactctctttctcaccaacgatctgacagaagaggtcatggaggaggtgctccagaagaaagctgacctgatcctgagctaccacccacctatcttccgtcccatgaagaggatcacatggaacacctggaaggagagactggtgattcgtgccctggagaatcgagtgggaatctatagtccacataccgcatacgatgcagcgcctcagggggtgaacaattggttggccaaaggacttggggcatgtacttcccggcctatccacccgtccaaggctccaaactacccgacggagggaaaccatagggtcgaattcaatgtgaactacactcaagacttggacaaggttatgtccgctgtaaagggcatcgacggcgtcagcgtgacctccttctctgcaagaacaggcaacgaagagcaaaccaggatcaacttgaactgcacacagaaagctcttatgcaggtagtcgatttcttgtctagaaataagcaattgtatcagaaaaccgaaatcctttctctggagaagccgcttttgctgcacaccggtatgggtcggctgtgcacccttgacgaaagcgtctcgctggcaacaatgatcgaccggatcaaaaggcatctcaaactgagtcacataaggctggcactgggtgtcggtagaacactggaatcccaggtgaaggtcgtggctctctgtgctggctcagggagtagtgttctacaaggcgtcgaggcagatctttacctcaccggagaaatgagccaccacgacaccctggatgccgcctcccagggtataaatgtcattctgtgtgagcactctaatacagaacgtgggtttctgagcgatctcagggatatgttggactctcacttggaaaacaagattaatatcattctgagtgaaaccgatcgagatccattgcaggtggtgtag

SEQ ID NO: 126514 - DNA, 489 bp, Artificial Sequence
  Description of Artificial Sequence: Synthetic coding sequence
atggacctgaaggcactcctatcttctctgaacgacttcgcatccctgtcctttgccgaatcctgggataatgttggactgctagtagaaccaagcccgccccacaccgtgaataccctgtttctgacaaatgatctgacagaggaggttatggaagaggtcctacagaaaaaggctgatctgattctgagttaccacccccccatcttccgtcctatgaagaggatcacgtggaatacctggaaggagcgtctggttattcgggccttggagaatcgagtgggtatatactcccctcatacagcctatgacgctgcaccgcagggcgtgaacaattggttggccaaaggactgggagcttgcaccagtagacctatccatccctcaaaggcacctaattacccaaccgagggaaaccatcgcgtagagttcaacgtgaactacacccaggacttagacaaagtcatgtctgccgttaaaggaatctag

SEQ ID NO: 126515 - DNA, 1134 bp, Artificial Sequence
  Description of Artificial Sequence: Synthetic coding sequence
atgcttagcagttgcgtacggcccgtcccgaccacagtgagattcgttgactcccttatttgcaactcctcacggtcctttatggacctgaaagccctactgtcctcactgaatgacttcgccagcctctcctttgccgagtcctgggacaatgtcggtctgctggtggaacccagtcctcctcacaccgtcaacactttgtttttgaccaacgacttgacagaggaggttatggaggaggtgctccagaaaaaagcagatcttatcctgagctaccacccccccatcttcagacctatgaaacggataacctggaatacgtggaaggagcgcctggtgattagagccctggagaatcgagttgggatttatagcccccataccgcgtacgatgcagctccccagggtgtcaataattggttggcaaaagggctgggcgcgtgcacctcacgccctattcacccctctaaggctcctaattaccctactgaaggtaaccatagggtggagttcaacgtgaattacacacaggacctggataaggtgatgtcggcggtgaaagggattgacggggtttccgtcaccagcttttctgctcgtaccggcaatgaggaacagacacggatcaaccttaattgcactcagaaggcgttgatgcaagtcgtggactttttatctcgcaataagcagctgtaccagaagacagagatcctctcactcgaaaagcctctgctactgcacacaggcatggggcgactgtgcacacttgatgagtccgtgtcgctggcaacgatgatcgaccgcattaaacgtcatcttaagctctctcatattagactggcactgggggtgggtagaacgctggaatctcaggtcaaagtcgtcgccctttgcgctggctcggggtcctcagtgctgcagggcgtggaggccgacttgtatttaacaggagagatgagccatcacgacacgttggacgccgcatcccaaggcataaatgtgattctctgtgaacacagtaacacagagcgggggttcctaagcgatctgagggacatgttagactcccatctggagaacaagatcaatatcattctaagtgagacagaccgggatccattacaagtagtgtag

SEQ ID NO: 126516 - DNA, 858 bp, Artificial Sequence
  Description of Artificial Sequence: Synthetic coding sequence
atgctctcctcttgtgtcagacctgtgccgactacagtgcgattcgttgacagtctcatttgtaactcatccagatcctttatggaccttaaggccctgctctcgtccctgaatgactttgcatcactttcatttgcagagtcttgggataatgtcggcctgctggtcgagccctctccgcctcacacagtaaacacgctgtttctaacaaacgatctcaccgaagaagttatggaagaggtcctacagaaaaaggcagatcttattctatcctaccacccccccatctttaggcctatgaaaaggattacctggaacacatggaaggagagattggttattcgcgcactcgagaatcgggtaggcatttatagcccccataccgcctacgatgcagccccccaaggagtcaacaattggctggctaaaggtcttggagcatgcactagcagacccatccacccttccaaggctccaaattaccctacagaggggaatcatagggtagaatttaatgtgaattacacgcaagacctcgacaaggtgatgagtgcagtgaaaggcattgatggtgtgagcgtaacaagtttcagcgcgcggacaggtaatgaggagcagactcgcatcaatctgaactgcactcaaaaagccctgatgcaagtcgtggatttcctatccaggaataagcagctataccagaaaacagagatcctgtctctcgaaaagagcttgaagagcaagtcttggccttgtgtgctcgtgctcggcgcagccttttgccgcgttcttcggcttactttcacatctcaagtccgctgccccatcatgatcctgtggatgttactcccaaaagagtag

SEQ ID NO: 126517 - DNA, 1134 bp, Artificial Sequence
  Description of Artificial Sequence: Synthetic coding sequence
atgcttagctcctgcgtgcgtcctgtcccaactacagtcagattcgtcgactccctgatttgtaacagtagtcgttcctttatggacttgaaagctctcttatctagcctgaatgacttcgctagcctctctttcgctgaatcctgggacaatgtaggcctccttgtggaaccgtcccccccccatacagtcaatactctatttctgaccaacgacctgaccgaagaggtcatggaagaggtcttgcagaagaaagccgatctcatactgagttaccatccgccaatattccgacccatgaaaagaatcacctggaatacttggaaggaaagactggtgattcgcgctctggaaaatcgggtggggatatacagtccccacaccgcttatgatgccgctcctcagggggtgaataactggctagcaaagggtctcggggcctgcaccagcagaccaattcatccctcaaaggcccccaactatcctaccgaggggaatcatcgtgtcgaattcaacgtgaactatacccaggatttggacaaagtgatgtccgcagtcaaggggatcgacggagtttcagtgaccagcttctctgctcgcactgggaatgaagagcagacccgcatcaacctgaattgcactcagaaggctctgatgcaagttgtggacttcctgagccggaataagcagctctaccaaaaaaccgaaattctctccctggaaaaaccactcctcctccacactggaatgggtaggctttgtacactggatgagagtgtgagcctggcgaccatgatcgacaggattaagcgacacttaaaactgagccatattagactcgccctaggtgttgggaggactctcgaaagtcaggtcaaagtagtggcattgtgtgccgggtcaggctcgagcgttttgcagggagtagaggctgacctgtaccttactggggaaatgagccatcacgacaccctcgatgcagctagtcagggcatcaatgttatcttgtgcgaacactcaaacactgagcgcggatttctcagcgatcttagggacatgcttgactcgcacctggagaataaaatcaatatcatcctgagtgaaaccgaccgcgacccgttgcaagtggtttag

SEQ ID NO: 126518 - DNA, 630 bp, Artificial Sequence
  Description of Artificial Sequence: Synthetic coding sequence
atggaccttaaggcattacttagtagtttgaacgacttcgcttcactgtctttcgcagagagctgggacaatgttggcctgctggtagagccctctccaccccatacagtcaacactctgttcctgaccaacgatctgacggaggaggtgatggaagaagtactccagaaaaaagcagacctcatcttatcctaccaccctcccatcttccgtcctatgaagaggattacctggaatacctggaaagagaggttagttataagggcattagagaatagagtggggatttatagcccacatacagcttatgatgcagcacctcagggtgttaacaactggctggctaagggcctgggcgcctgtacttcacgacctatccatccttcaaaggcacccaactacccaacagagggaaaccacagggtggaattcaacgtaaactacacccaagacctagataaggttatgtcggcggttaagggcattgatggagtatctgtcacctccttcagtgccagaactggcaacgaagaacagaccagaatcaaccttaactgtacccaaaaggccttaatgcaagttgtggactttctcagcagaaataagcaactgtaccagaaaaccgaatag

SEQ ID NO: 126519 - DNA, 492 bp, Artificial Sequence
  Description of Artificial Sequence: Synthetic coding sequence
atgctgtcttcttgcgtgcgcccagtgccaacaactgttaggttcgttgacagtcttatctgcaattcatctcgatcctttatggatctcaaagctttattgtcatccctgaacgacttcgcgtctctgtctttcgcagaaagctgggataacgtgggcttactcgtcgagccaagtcctcctcacactgtaaacaccctgttcttgaccaatgacctcaccgaagaggttatggaggaggtgctccagaaaaaggctgacttgatcttgtcctaccatccccctatctttcggccgatgaagcgtattacttggaacacatggaaagaaaggttggtgatacgcgcacttgagaatcgagtgggaatttatagcccacacaccgcatatgacgcagcccctcagggcgtgaataactggctcgccaaaggcctaggtgcctgtactagccggcccatacacccaagcaaagctcccaactaccccacgtag

SEQ ID NO: 126520 - DNA, 4749 bp, Artificial Sequence
  Description of Artificial Sequence: Synthetic coding sequence
atggccggcccagggggatggagggatcgggaggtcacagatctggggcacctacctgaccccacaggaatttttagtctcgataagactataggcctcggcacatatgggcggatttacctgggcctacatgaaaagacaggagccttcacagcggttaaagtgatgaacgcgcgcaagacacctctacctgagattgggcgcagagttcgcgtcaacaagtaccagaaaagcgtgggatggagatacagcgatgaagaggaagacttaaggaccgagctgaatctgctgcgaaagtattccttccacaaaaacatcgtctccttctatggcgcatttttcaagctctctccgcctgggcagcgacatcagctgtggatggtcatggaactgtgcgcagctggaagcgtgactgatgtggttaggatgaccagcaaccagtcactgaaggaagactggattgcctatatttgcagggaaatcctccaggggcttgctcacttgcacgctcatagggttattcatagggatattaagggccagaacgttcttctgacacataacgctgaggtcaagctggtggatttcggggtgtccgcccaagtgtcaagaaccaacgggcgacgaaatagttttatcggaaccccctattggatggcccctgaagtcatcgactgtgacgaagaccctcgtaggtcttacgactaccgttccgatgtctggtcagttggcattaccgccatcgaaatggccgagggcgccccgcctctttgtaacctgcagcccctggaggcactgtttgtgatcctccgagagagtgcccctaccgtgaagtccagcggttggtccaggaaattccacaacttcatggagaagtgcactataaagaactttctgttccgaccaacctccgcaaacatgctgcagcatccattcgtccgcgatatcaaaaatgagaggcacgtggtggagtctttaacgagacatctaaccggcatcataaagaaacgacagaagaaaggtattcccctcatctttgagagggaggaagccatcaaggagcagtatactgttagacgattcaggggcccctcctgcacacatgagctgctgagactgcccacctcctccagatgccggcctttgcgcgtgcttcatggggaaccttcacagccccggtggctccctgaccgcgaggaaccccaagttcaggctctgcagcagttgcaaggcgcagcaagagtctttatgcccctgcaggcactggattcggccccaaagcctctaaaaggacaagcgcaggccccccagagactgcagggtgccgctagggtctttatgccccttcaggcacaggtcaaggccaaggcttcgaagccgctgcagatgcaaattaaggcccctccgcgcctgaggcgggcggctcgggtcctgatgcccctgcaggctcaggttcgtgctcctagactcttgcaagtccagagccaggtgtcgaaaaagcagcaggctcaaacccagacatcggagccgcaagatttggaccaggttcccgaggagtttcaggggcaggaccaagtgcccgaacagcagagacaaggacaggctccagaacagcagcagcgccataatcaggttccggaacaggaactggaacagaaccaggccccagagcagcctgaggtgcaagagcaggctgcagagcctgcccaggcagagaccgaggcagaggagcctgaatccctcagggtgaatgcacaggtgtttttgccattgctgagccaggatcaccacgtgcttctgccacttcacttagatacccaggtgctgatccccgtcgaggggcaaactgagggtagcccacaggcacaggcctggactctcgagcctccacaggccattggatcggtccaggctctgatcgaagggctatcaagggacttactgcgtgcccccaatagtaacaattccaaacccttagggccgcttcagacactgatggagaacctgagcagtaatcgcttctactcacaaccggaacaggctagagaaaagaagtcaaaagtgtccacactccgacaggccctggcgaaacgactgagccccaaacgcttccgggccaagtcctcttggcggcctgaaaagcttgagcttagcgatcttgaggccagacgccaaagacggcaacggcgctgggaagatattttcaaccaacacgaagaggaattgcgacaggtcgataaggacaaagaagacgagagcagcgataacgacgaagtcttccactccatacaggccgaagtgcaaattgagcctttgaaaccgtatattagcaaccccaaaaagatcgaggtgcaagagaggtctccttcagtgccaaataaccaggatcacgcccatcatgtgaaattttccagcagcgtcccccagcgaagtctcttggaacaggctcaaaaacctattgacataaggcaacgatcttctcagaatcggcagaattggctcgctgcatcggagagtagctccgaagaggaaagtccggtcaccggtaggcgatctcagtctagccctccatatagtacgatcgaccagaaattattggtcgacatccacgtcccagacggttttaaagtcggtaaaattagtccacccgtgtacctgactaatgagtgggtgggatacaatgcattgtctgagatttttagaaacgactggctgacccccgcacccgttatccagccacccgaggaagatggagactacgtagagctgtatgacgcttcagccgacacggatggggatgatgacgacgagtcgaacgacacgttcgaagacacttatgatcacgccaacgggaatgacgacctcgacaatcaggtcgatcaggccaacgacgtatgcaaagatcatgatgatgataataataagtttgtagacgacgtgaataacaattattatgaggcacccagctgcccgagagctagttatgggagagatggctcctgcaagcaggatggatacgacggcagtagggggaaggaggaagcctacagggggtatggaagtcacacagccaataggagtcacggtggatctgccgcatctgaagacaacgccgccatcggcgatcaggaggaacacgccgcaaacatcggctccgaaagaagagggtctgaaggggacggcggaaaaggagtggtccgcaccagtgaagagtctggggcactcggcctcaatggggaggagaattgctctgaaacggacgggccgggcctcaaaaggcctgccagtcaggacttcgaatatctccaggaggagccaggaggcggcaatgaggcatctaacgccatcgactctggagctgccccctccgcccctgaccacgaatctgataacaaggatatatctgagtcctcaacgcagtcagatttctcagctaaccactcaagtccatccaaaggctctggcatgagcgccgatgccaactttgcttcagccattttgtatgctgggttcgtggaagtgcctgaggagtcccccaagcagccttctgaggtgaatgtgaacccactgtacgtcagcccggcctgcaagaaacccctcattcacatgtacgagaaggagtttactagcgaaatttgctgcggatccttgtggggagtgaatctgctgctcggcactcgctcgaatctttaccttatggataggagtggtaaggccgacatcactaaactcattaggaggcgaccattcaggcaaatccaggtacttgaacctctgaatctgctcatcaccatcagcggccacaaaaaccgccttcgcgtctatcatttgacctggctgcggaataaaatacttaacaacgaccccgaaagtaaaagaaggcaagaggagatgttgaagacagaagaggcctgcaaagccatcgataaacttacaggatgcgagcactttagcgtccttcaacacgaagaaacaacttatattgctatcgcgctcaagtctagtatacacctttatgcttgggccccgaagtcattcgatgaatccaccgcgattaaagtgtgcatcgaccaatcggccgatagcgagggcgactatatgagttatcaggcatacattagaatccttgcaaagatccaggctgcggatccggtcaaccgctttaagcgccctgacgaactgctgcacctcctcaagctgaaagtgttcccaacccttgaccataaacccgtcactgtcgatctggctattggctcagagaaaaggctgaagatattcttcagcagcgccgacggatatcacctgatagacgccgagagcgaagttatgagtgacgtgaccctgcccaagaaccccctcgaaatcattatcccccagaacatcataattctgcccgactgtctgggcattgggatgatgctaactttcaacgccgaggccctgagcgtagaggccaacgagcagttatttaagaagatcttggagatgtggaaggatattccttcaagtattgcattcgagtgtactcagcggacgaccggctgggggcagaaggctatcgaagtgaggtcgctgcagagtcgagtccttgaatcggagctgaaaaggagatctatcaagaagctgcgattcctgtgcacaaggggtgataagctgttttttacgagtaccctgcgaaaccaccactctcgggtgtatttcatgactcttggcaaactggaggagctgcaaagtaactacgacgtgtag

SEQ ID NO: 126521 - DNA, 4752 bp, Artificial Sequence
  Description of Artificial Sequence: Synthetic coding sequence
atggctggtcctggcgggtggcgggacagagaagttacagatctcgggcacctgcccgatcccaccggtattttctctcttgacaagacaatcggcctgggtacctacggcaggatatacctaggcctgcatgagaaaacgggagcctttacggcagttaaagtaatgaacgcacggaaaactcctctgcctgagattggcagacgggttcgtgtcaataagtatcaaaaatccgtagggtggcggtactcagacgaagaggaggatctccgtaccgagctgaatctgctgcgaaagtactctttccacaagaatatcgtgagtttttacggcgcgtttttcaagctgtctcctccgggccagcgacaccagttatggatggtcatggaattgtgcgccgcaggcagcgtcacagatgtagttaggatgacgtccaatcagtcccttaaagaagactggatagcgtatatatgccgggaaatcctccaggggttagcccaccttcacgcgcacagggtgatacatagggacattaaaggccagaatgtcctattaactcacaatgccgaagtgaagctggtggatttcggcgtgtctgcccaggtatcgagaactaatggaagaagaaatagcttcataggtactccctattggatggctccggaagtgatcgattgtgatgaggatccaagacgctcctatgactacagatcagatgtgtggagcgtgggtatcaccgccatagaaatggcggaaggggcaccaccgctctgtaatttacaacctttggaggcactcttcgtgatactcagagagagcgccccgacggtaaaatctagtggctggagccgcaagttccataatttcatggagaagtgtaccatcaaaaacttcctgtttcggccaacttcagctaatatgctccagcacccattcgtgcgagatatcaaaaatgagcggcatgtggtcgagtcccttaccaggcatttgaccgggattataaaaaaacggcagaaaaaaaaaggaatcccattaattttcgaaagggaagaagccatcaaggagcaatatacagtgagacgcttcaggggcccaagctgtactcacgagctgttgcgcttaccaacctcgagtcgatgccgtccgcttcgcgttcttcacggcgaaccatcacagcctcgatggcttccagacagagaggagccccaggtgcaagcactgcaacagctgcagggagccgctcgggtattcatgcctctgcaggccctggactccgcgccaaaacccctgaagggccaggctcaagctccacagcggttacagggcgccgccagggtgtttatgcctctgcaggcccaagtgaaggcgaaagcgtcaaaacctctccaaatgcaaataaaagcacctccccggcttagacgcgcagcccgcgtcttgatgcctctgcaagcacaagtgcgggcccctaggttgctccaagtgcagtcacaggtcagcaaaaaacaacaggcacagactcagacatcagagccccaagatctcgatcaggttcctgaggaatttcaagggcaggaccaggtgcctgagcagcagaggcaaggacaggcccccgagcagcagcagcgtcacaatcaagttcctgagcaggagctcgaacagaaccaggcacctgaacagccagaggttcaggagcaggccgccgagcctgctcaggccgagaccgaagccgaggagccagagagcctacgcgtcaacgctcaagtctttctgccgcttttatctcaggatcatcatgtgctcctaccgctccatctggacacccaggtgcttatccctgttgaggggcagactgaaggtagcccacaggcacaggcatggacactcgagccccctcaagccatcggttccgttcaggcgctgattgaggggttaagccgtgatctgcttagggctccgaattccaataattctaaacctttgggtcccctgcaaactctcatggaaaatttaagttccaaccgtttctactcacagccagaacaagcaagggagaaaaaatctaaggtctcaaccctgcgccaggctctcgctaagaggctgtctcccaagagattccgtgcgaagtcaagctggagacccgagaagctagagctttctgaccttgaagctaggcgccaacggcggcagagaagatgggaggacattttcaaccaacacgaagaagaactgcggcaagtggataaggataaagaagacgaatcctcggacaacgacgaggtgttccacagtatccaagcggaggttcaaatagagccactaaagccgtacatctccaacccaaaaaaaatcgaggtgcaggagcgttcgcctagtgtgcccaacaatcaggatcacgcccatcacgtcaagttttcatcctcagtgccgcagcgaagtctgctcgagcaggcccagaaacctattgatatccggcagagatcctctcagaacaggcagaactggctcgcagcatctgaaagtagcagtgaagaagaatcacccgtgactggacgacgatcacaaagctcaccaccctacagcaccatcgaccagaagttgctggtggacattcatgtgccggacggttttaaagtcggtaagatctctccccctgtctacctcaccaatgagtgggttgggtataatgctcttagcgaaatattccggaatgactggctcacaccagctccggttatacagcctcccgaggaagacggtgactatgtagaactgtacgacgcctcagccgacaccgatggagatgacgacgacgaaagtaatgacacatttgaagacacatacgaccacgctaatggcaacgacgatttagataatcaggtcgaccaggccaacgacgtgtgcaaagaccatgatgatgacaacaacaagttcgtcgatgatgtgaacaacaattattatgaggcaccatcatgcccaagagccagctatggccgagacggaagttgcaagcaagatggctacgatggatctagagggaaggaagaagcctaccgcggttatggcagccatacagcgaatagatctcatggaggttcggcagcatccgaggataacgccgctataggagaccaggaagagcatgctgctaatatagggagcgagcgtcgcgggtctgagggcgacggcggcaagggagtcgtgcgcacctctgaagagagcggcgccttggggctcaatggcgaagagaattgttcagaaaccgatggccctggactcaaacgacccgccagtcaagactttgagtacctacaagaagagccaggtggcggaaacgaggcttcaaatgcaatagatagtggcgcagcccccagcgctcccgaccatgagtctgataacaaggacataagcgaaagtagcactcagtcagatttttccgccaatcactctagtccctccaaaggcagtggaatgtcagccgatgctaacttcgcgagcgccatactctacgctggatttgtggaagtccccgaggagagcccaaagcaaccaagcgaggtgaatgtgaatcccctatatgtcagccccgcctgcaaaaaacctttgatccacatgtacgaaaaggagtttacctccgagatctgttgcggaagcctctggggcgtgaatctcctcctcgggaccagatccaatttgtacctcatggaccgatccggaaaggcggacattaccaagctgatcagaagaaggccgttccgccagatccaggtactagaacccctaaacctgcttatcacgattagtgggcacaagaatcggctgagggtctatcacctgacgtggctaagaaacaagatactgaacaatgaccccgagtcaaagagacgacaagaggaaatgttaaaaacggaggaagcttgcaaagccatcgataagctgacaggatgcgaacacttctcagtgttgcagcacgaggagacaacatacatcgccattgctctgaaaagcagcatccatttgtatgcgtgggcaccgaagagtttcgacgaatctacggcaataaaagtgtgtatcgatcagtctgcggactctgagggtgattatatgagctatcaggcctacattcgaatcttggccaagatacaggcagcagatcccgtgaatcggtttaagcgtcctgacgaattgctgcatctactcaagctcaaggtctttcccacattagatcacaagcctgtcacggtcgatctcgcaattggaagcgagaagaggctgaagatattcttctcctctgctgacggctatcaccttattgacgccgagtcagaggtgatgagcgatgtaacactgccaaaaaatcctctggagatcatcattcctcagaacattattattctgccagactgtctagggatcggcatgatgctgaccttcaacgcggaagccctctcggtggaggccaacgagcagctgtttaaaaagattctggaaatgtggaaagatatcccatcgagtattgctttcgagtgcacacaaaggacgacaggctggggacagaaggcaattgaggtgcggtccttacagtctcgggtgctggagtcggagctcaagcgtcgctctatcaaaaagttacggtttttatgtacacgtggagacaagttgttctttacgagtacactgcgaaatcaccatagccgggtgtattttatgacccttgggaaactagaggaattgcagagtaactacgatgtttag

SEQ ID NO: 126522 - DNA, 567 bp, Artificial Sequence
  Description of Artificial Sequence: Synthetic coding sequence
atggctgggccaggagggtggagagacagagaggtcacagatctgggacacctgccagacccgacagggatcttttcactggataaaactataggtctgggcacctacggtagaatctatctagggctgcacgagaaaacaggcgcatttacggctgttaaggtcatgaacgcacgtaagacccctctgcccgaaatcgggaggcgagttcgcgtgaataaatatcaaaagtcagtaggctggcgatactccgacgaagaggaggaccttcgcactgaattaaacctgctgcgcaaatattcgttccataagaatatcgtctcattctatggcgcgtttttcaaactgagccccccaggccagagacaccagttgtggatggtcatggagttgtgcgctgctggatccgttaccgacgtcgtgcggatgacatctaaccaaagcctgaaggaagattggatcgcatacatctgtcgggaaatcctccaaccgaaggtgatcttcttagggaccgggtgtagcgattcttctttgaaaaaagaattgtgcctgaaacatcagaactag

SEQ ID NO: 126523 - DNA, 492 bp, Artificial Sequence
  Description of Artificial Sequence: Synthetic coding sequence
atgcaagtcccaagagaacggatcaagatcgctttccgactgtggatacccatccttgtgattcggatagtcgtcgcagggacatggcctcaggctcctggactgagcaccttaggtctgaatataatcatcctgcccgactgtctcgggatcggaatgatgctgacctttaatgccgaggcactctcagtggaggccaacgagcagctgttcaaaaagattctcgagatgtggaaagacatcccatccagcatcgcattcgagtgcacacaacgtaccacaggctggggtcagaaggcgattgaggttagatccttgcagagcagggtgctggaaagcgagttaaaacgtaggagcatcaaaaagctgcgcttcctttgtaccaggggagacaagctgttttttacaagcacgctacgaaaccatcactccagagtgtactttatgaccctgggcaaactggaggagctgcagtcaaactacgatgtatag

SEQ ID NO: 126524 - DNA, 1449 bp, Artificial Sequence
  Description of Artificial Sequence: Synthetic coding sequence
atgcttaaattccaagaggctgctaaatgtgtatcaggttccacggccatcagcacctatcctaaaacactgattgcaagaaggtatgtactacagcaaaaactcggcagcggctctttcggaactgtgtatctcgtgtccgataagaaggcaaagcggggggaagagctgaaggtgctgaaagaaatcagcgtgggggaacttaatcctaacgaaaccgttcaagccaatctagaagcccagctgttgtcaaaactggatcatccagctatagttaaattccatgcatcctttgttgaacaggacaatttctgcatcataacagaatattgcgaaggaagagatcttgacgataagatccaggagtacaagcaggctggtaaaatctttccggagaatcagattatagagtggttcattcagcttctgctaggcgtagactacatgcacgagcggagaatcctgcatagggatttaaagtccaagaatgtcttcttgaaaaacaatttgttaaaaataggtgatttcggcgtaagtcggcttctgatggggagttgcgaccttgcaaccaccttgaccggtactccacattacatgagccccgaggcactgaagcaccaggggtacgacaccaagagcgatatctggagtcttgcctgcattctctatgaaatgtgttgcatgaaccacgcctttgccggttccaactttctttcaatagttctgaagatcgtggaaggtgataccccatctttaccagaaaggtaccctaaggagctgaacgccattatggaaagcatgttgaacaaaaatccgtctctgcgcccaagcgctattgagatcctcaaaatcccttatcttgacgagcaactgcagaacttaatgtgtagatattccgagatgacacttgaggacaaaaacctggattgtcagaaagaagccgcacatatcataaatgccatgcagaagcggattcatttacagaccctgagagctctgtcggaggtccaaaagatgactccccgagaacgaatgcgtcttcgaaagctccaggctgccgatgaaaaagcccggaagctgaagaagatcgtcgaagagaaatatgaggagaacagcaaacgcatgcaggagctgcgctcacgaaatttccagcaacttagtgttgacgttctgcatgagaagactcacctcaaagggatggaagaaaaggaggagcaacctgagggaaggctgtcttgttcacctcaggacgaagatgaggagcgctggcagggcagagaagaagaatcagacgagcccacccttgagaatttgcctgagtcacaacccattcctagcatggacctccacgagcttgagtcaatcgttgaagatgccactagcgatctgggctaccatggcgattgcaacttgatatccctagatgaatattggaaaaacgaaaagtag

SEQ ID NO: 126525 - DNA, 1938 bp, Artificial Sequence
  Description of Artificial Sequence: Synthetic coding sequence
atgctcaaatttcaggaggccgcaaagtgcgttagcgggagcaccgccattagtacctaccccaagaccctgattgccagacgatatgtgttgcagcagaagctggggagcgggagttttgggaccgtatacctggtctctgacaaaaaagcaaaaaggggggaggaactgaaggttctgaaagagatcagcgtcggcgagctcaaccccaatgagacagttcaggccaatctggaggctcagctgctgtcaaagctcgaccaccctgctattgtaaagttccacgcctcgttcgtggaacaagacaacttctgcatcattacagagtattgcgagggtcgcgatctggatgacaagatacaggaatataaacaggccggaaaaattttcccggaaaatcagatcatcgagtggtttatacagctgctgctgggggtggattacatgcatgagagacggatcctgcatcgggacctcaagtcgaaaaacgtgttcttgaagaataacctgctcaagattggcgactttggcgtcagtagattgctcatgggctcgtgcgacctggctacaactctcaccgggaccccacattacatgagcccagaagccctaaaacaccaaggctatgatacaaaaagtgatatatggagcttggcatgtatcttgtatgagatgtgctgcatgaatcacgctttcgccggctctaactttctaagtatcgtcctcaagatagtggagggggacaccccatctctgcccgaacgctatccaaaggagttgaacgccattatggagagtatgttgaacaaaaacccctcactgcgtcctagtgccattgagatactgaagattccatatcttgacgagcaactccagaacctgatgtgccggtattcagagatgaccctggaggataagaacctggactgccaaaaggaagcagcccatattataaatgcaatgcaaaagaggatccacctgcagacgcttagagccctgagcgaggtgcagaagatgactccccgggagcgcatgcgtctccggaaactgcaggccgcggacgagaaggcccggaagctgaagaagatagtggaagagaagtatgaagagaactctaaacgaatgcaggagctgaggagtcgaaactttcagcaactaagcgtggacgtcttgcatgagaagactcacctgaaaggcatggaggagaaagaggaacagcctgagggccgcctctcctgcagcccccaggatgaagacgaagagaggtggcaggggcgggaagaggaatccgacgaacctacactggaaaacttgcccgagtcccagcctatcccttctatggacttacacgagttggaaagcattgttgaagatgccactagcgacctcgggtatcacgagatccctgaggatccactggtcgcagaagagtattacgccgacgcctttgactcctactgcgaggagtctgacgaagaggaggaagagattgccctcgagaggccggaaaaagagatccggaacgaaggctctcagccagcctacaggactaatcagcaggacagcgacattgaggccctggcccggtgtctcgaaaacgtactaggctgcacatccctagacaccaaaactataacgacaatggcagaagatatgtctcccgggcccccgatctttaactcagtgatggcccggactaaaatgaagcgcatgcgcgaaagtgccatgcagaagctcggaaccgaagtttttgaggaggtgtacaattacctgaaacgggcacgtcatcagaacgccagcgaggccgaaatccgggaatgtctggaaaaggtcgtacctcaagctagtgattgctttgaggttgaccaattattgtactttgaggagcaattattgatcacaatgggaaaagagccaactctccagaatcacctttag

SEQ ID NO: 126526 - DNA, 1386 bp, Artificial Sequence
  Description of Artificial Sequence: Synthetic coding sequence
atgcacgagagacggatattgcaccgtgacctcaaaagcaagaatgttttccttaagaataacctgcttaaaattggggatttcggagtgtcaaggctgcttatgggctcctgcgatctcgccactaccctaacgggtactcctcattacatgtctcctgaggcactgaagcaccaaggctatgacacgaaatccgatatttggagcctagcctgtattttgtatgaaatgtgctgcatgaatcacgcatttgcgggttctaatttccttagcatagtgctcaaaattgtcgagggcgacactccaagtttacccgagagatacccgaaggaactgaacgccattatggagtccatgctcaacaaaaaccccagcctgcggccatccgcaatagagatcctcaagatcccctacctggacgagcaactacagaatctaatgtgtcgatattccgagatgaccttggaggacaaaaaccttgattgccagaaggaggcagcccacatcattaatgctatgcaaaaacgaattcatctgcaaaccttgagagcgctttccgaggtgcagaaaatgaccccgagagaacgaatgcgtctgcggaagttgcaagccgcagatgagaaagccaggaagctcaagaaaattgtagaggaaaaatacgaagagaatagtaagcggatgcaggagcttcgcagtaggaattttcagcagctgagtgtggatgtcctccatgagtctgacgagcccaccctggagaacctcccagaatctcagcctatcccgtcaatggacctgcacgaattagagagtattgtcgaggacgctacctccgatttggggtaccatgagatcccggaggacccccttgtggccgaagagtactacgccgacgcatttgatagctactgtgaggagtcagatgaggaggaagaggaaatcgccctggaacgaccagagaaagagatcaggaatgaaggttcacagccggcctacagaaccaatcagcaggatagcgatatcgaagctctggcccggtgcctagaaaacgtgctggggtgtactagtctcgatacaaagaccatcactaccatggccgaggatatgtctcccgggccacctatctttaatagcgtcatggccagaacgaaaatgaaaagaatgcgcgagtcagcgatgcaaaagctggggactgaagtgtttgaggaagtctataactacctgaagcgagctagacaccagaatgcatccgaagctgaaattcgcgagtgtctggaaaaggtcgtgccccaagccagcgattgttttgaggtggaccagctgctttacttcgaagaacaattactgattactatgggcaaggagccaaccttgcagaatcatctttag

SEQ ID NO: 126527 - DNA, 1938 bp, Artificial Sequence
  Description of Artificial Sequence: Synthetic coding sequence
atgctcaagttccaggaagctgccaaatgtgtgtcagggtcaacagctatcagcacctacccaaaaaccttaattgctcgccgttacgtgctccagcagaagctgggatccggctcatttggcacagtgtatcttgtgtcggacaagaaggcaaaaaggggagaagaactgaaagtgctgaaagagatcagcgtgggagaattgaatcctaatgaaacggtccaggccaacctcgaggctcagctcctgtctaaacttgatcaccctgctatagtaaaattccacgcctccttcgtcgagcaggataacttttgcattatcacagagtattgcgagggtcgggatcttgacgataaaattcaagagtacaagcaagccggaaagatcttccctgagaatcagattattgagtggtttatacagctgctcttgggcgtcgactacatgcacgagcggaggattttgcaccgggacctaaaaagcaaaaacgtctttctcaagaataaccttctgaaaattggcgactttggagtttcaagacttctcatgggcagctgtgatctggctaccaccttgacaggtacaccacactacatgtctcctgaggctctaaagcaccagggatacgataccaaaagcgacatctggagccttgcttgtattttatatgaaatgtgctgtatgaaccacgcattcgctgggtccaacttcttaagcatcgtgctcaagatagtggagggagatacaccatctttgcccgaacggtatcccaaggaactgaatgctattatggagtccatgctaaataaaaatcctagtctccgtccgagtgctattgagattctgaaaatcccctatctggatgaacagctccagaatctgatgtgccggtattctgagatgaccctggaagacaagaatttagattgtcagaaggaggctgcccacatcattaacgctatgcagaagcggattcacctgcaaaccttacgggccctgagcgaggtccagaagatgacccctagggagcggatgaggctgaggaagttgcaggccgcagatgaaaaggcaaggaaactgaagaagatagtagaagagaagtacgaagaaaactccaaacggatgcaggagctccggtcccggaatttccagcaactttccgttgatgtcttgcacgaaaagacccacttaaagggcatggaagagaaggaggagcagcctgaaggccggctgtcctgttcaccccaggatgaggacgaagagagatggcagggtcgggaggaggagagtgatgagcctaccctcgagaacctacccgagagccaaccaattccatcaatggatctccatgagctcgagtccattgtcgaagacgcaacatcggacctcggttaccatgaaatccctgaggatcccttggtcgccgaagagtactacgctgatgcttttgactcctactgcgaagagtcagatgaagaggaagaagaaatcgcactggaacggccggagaaagagatccgcaatgaaggcagtcagcccgcctaccgcacgaaccagcaggatagcgacatagaagcactggcaagatgcctcgagaacgttctgggatgtacatctctggacacgaagacaatcactactatggccgaagatatgtcccctgggccaccaatattcaacagtgtaatggctagaaccaagatgaagaggatgcgggagagtgcaatgcagaaactgggtacagaagtgttcgaggaggtgtacaactatttaaagagggcaaggcaccagaatgcctccgaagcggagatcagggagtgtctggagaaggtggtgccccaggcttcagattgcttcgaggtggaccaactgttgtacttcgaggagcaacttttaatcacgatggggaaagagccaactctacagaatcacctgtag

SEQ ID NO: 126528 - DNA, 1449 bp, Artificial Sequence
  Description of Artificial Sequence: Synthetic coding sequence
atgctaaagttccaagaggccgcaaagtgcgtctcgggctctaccgcgatctctacctaccccaaaacattgatagctcgcagatacgtactgcagcagaaattaggcagtggaagctttgggactgtgtatctagttagcgacaagaaagctaaaaggggagaagagctaaaggtcctgaaagaaatctcagtaggcgagctcaaccccaatgagacagtgcaggctaatttggaggcccagctactgagtaagcttgaccatcccgcaattgtgaaattccacgcatccttcgtggaacaagacaatttttgcattattaccgaatattgcgaggggagagatttagacgataagatccaggagtataagcaggccggaaagatatttccagagaatcagattatcgaatggtttatacagttattactgggcgtcgattacatgcatgaaagaaggatcttgcatagggacctgaagtcaaagaacgttttcttgaaaaacaacctgctcaagatcggagacttcggtgtcagccgcctgctgatgggctcctgtgacctggctacgactctcactgggaccccacactatatgtcccccgaggcactgaaacaccagggatatgacaccaagagcgacatttggagtctcgcttgtattctatatgaaatgtgctgtatgaatcacgcctttgccggctcaaactttttgtctatagtgcttaagatcgtagaaggagacactccatccctacctgagaggtacccaaaagagctcaacgccatcatggaaagtatgttaaataagaatccctcgctgcggccgtcagccattgagattctgaaaatcccttatctggacgaacagctacagaacctcatgtgcaggtatagcgagatgactctggaggataagaatctggattgccagaaagaagccgcgcacattatcaacgctatgcaaaagagaatccacctgcaaaccttgagggccctgtcggaggtgcaaaagatgactccccgggagcggatgcggttgcggaaactgcaagcggccgatgagaaagcacggaaacttaaaaagattgttgaggaaaagtacgaagaaaacagtaagcgcatgcaagaactcaggtcccggaattttcaacagctatccgtcgacgtcctgcacgagaagacccacctcaaaggcatggaagagaaggaggagcagccagaagggaggctgagttgctccccacaggacgaggacgaggagcgttggcaaggccgggaggaagagtcggacgagcctacactggaaaacttacccgaatctcagccgattccttctatggacttacacgagctggagagcattgttgaggacgccacttctgaccttggctatcacggagattgcaatctcatctccctggacgagtactggaagaacgaaaagtag

SEQ ID NO: 126529 - DNA, 1938 bp, Artificial Sequence
  Description of Artificial Sequence: Synthetic coding sequence
atgctgaaattccaggaggccgccaagtgtgtctcagggtctactgctatttcgacataccctaagactcttattgcccggaggtatgtgctacaacagaagctagggagcggatccttcggtactgtatacttggtgtcagacaagaaggcaaagaggggggaggagcttaaggtgttgaaggagatctccgttggggagctgaaccctaatgaaacagttcaggcaaatttagaggcccagctgctatccaagcttgaccaccccgcaatcgtcaagttccatgctagttttgtcgaacaggacaacttttgcataatcacggagtactgtgaaggaagggatcttgatgataagatccaggaatataagcaggcaggcaagatctttcctgaaaatcagatcattgaatggtttattcaactgctgttgggcgttgactacatgcacgaaaggcgcattttgcatcgtgatcttaagtccaagaatgtcttcttgaagaacaatctcttgaaaattggggacttcggagtttcgcgacttttgatgggctcgtgcgacctcgcaactacgcttacaggaacccctcactacatgagcccagaagctttgaaacaccaggggtacgataccaagtcagacatatggagtttggcctgtatcctctacgagatgtgttgtatgaatcacgcctttgcgggctctaacttcttgtctatagtcctgaaaatcgttgaaggagacaccccctccttgcctgagagataccccaaggaactgaacgctattatggagtcaatgctcaataaaaatccatccctccggccgtctgcaatcgagattctgaagattccctatctggatgaacagctgcaaaaccttatgtgccgctactctgagatgacacttgaagataagaacctagactgccagaaggaggcagcacatatcattaatgcaatgcaaaagcggatccatcttcagaccctgagggcattgagtgaggtgcaaaagatgacacctcgggagagaatgcgtctccgcaaattgcaagcggcagacgagaaggcccgtaagctcaaaaaaatagttgaagaaaagtacgaggagaattcaaaaagaatgcaagaactgagatcaaggaacttccagcagctcagtgttgatgtgctgcatgaaaaaactcacctcaaagggatggaagagaaggaagaacagcccgagggccgcctatcctgttcccctcaggatgaagatgaggagcggtggcagggacgagaggaagaatcagatgaacccactctcgaaaatctccctgagagtcaacccataccaagcatggatctccatgagttggaaagtatcgtcgaggacgccactagcgacttgggatatcatgagatacccgaagatccgctggtagctgaggaatactacgctgacgcatttgattcctactgtgaagaatcagatgaagaagaggaagagatcgcactcgagcgacccgagaaggaaatccgcaacgaaggaagccagcctgcctatcggaccaatcagcaggattctgacatcgaggcactcgcccgttgcctggaaaatgtgcttgggtgcactagtcttgatacgaagaccatcactactatggccgaggacatgagtcctggcccaccgatcttcaacagtgtgatggcaagaaccaaaatgaagcggatgagggaatccgctatgcaaaagctcggaacagaggtgtttgaggaagtatataactacctgaaaagagcgagacaccagaacgcctcagaggccgaaatcagggagtgtcttgaaaaggtggttccacaggcttccgattgtttcgaagttgaccagctcctgtactttgaagagcaactgctgattaccatggggaaagagccaaccctgcagaaccacctgtag

SEQ ID NO: 126530 - DNA, 1413 bp, Artificial Sequence
  Description of Artificial Sequence: Synthetic coding sequence
atgctcaagttccaagaagctgcaaaatgtgtttcaggatctaccgccatcagtacatatccaaaaactctcattgcacgtcggtacgtcctccagcagaagctcgggtcagggagttttgggactgtgtatttagtgtccgacaaaaaagccaagaggggtgaggagttgaaagtcttaaaagaaatcagcgtgggcgagctgaaccctaacgagacagtacaggcaaatctggaggcccagcttttgagcaagctcgaccaccctgcaatcgtgaagttccacgccagttttgtagagcaggataatttctgtatcatcacggagtactgtgaagggagggatcttgacgataagattcaggaatacaaacaggccggcaagatctttccagagaatcagatcatcgaatggttcatccagcttctgctgggtgtagactacatgcacgaaaggcgcatcctgcatcgagatctgaagtcaaaaaacgtgttcctaaaaaacaatttgcttaagatcggcgacttcggagtgtcacgcctgctgatgggtagttgcgatttagcgaccactcttaccggtacaccgcactacatgtcccccgaagctttgaaacatcaagggtacgatacaaagtcggacatctggtcactcgcttgcatcctgtatgaaatgtgttgtatgaaccatgcctttgctgggtccaatttcctaagtatcgttctaaagattgtcgaaggcgatacaccatcactgcccgaaaggtaccctaaggaattgaatgccatcatggagtcgatgctgaataagaatccctcattgcgtccatcggctattgagattctgaagataccatatctagacgagcagttgcagaacctgatgtgcagatactctgaaatgactttagaggacaaaaatttagattgccagaaagaagccgcccacattatcaatgctatgcaaaaaagaatccacctgcagaccttaagggcactgtcagaggttcaaaagatgacccctcgagagcggatgaggcttcgcaaactccaggccgccgatgagaaggctcgtaaactaaagaaaatcgtcgaggagaaatacgaagaaaattctaaacgaatgcaggagctaaggagtagaaatttccagcagctgtccgttgatgtgctgcacgagaagacccacctgaaaggcatggaagagaaggaagagcagcctgagggtcggctaagctgtagcccccaggatgaggacgaggagagatggcagggcagggaggaagagtccgacgagcccaccctcgagaatcttcctgagtcacagccaatcccaagcatggatctccatgaattagaaagcatcgtcgaagacgcaacctccgaccttggctaccacgccactcacagctag

SEQ ID NO: 126531 - DNA, 2079 bp, Artificial Sequence
  Description of Artificial Sequence: Synthetic coding sequence
atggaaaaatatgaacgcattagggtggttggcagaggagcctttgggattgttcatctgtgtttgcggaaggcagatcagaaacttgtgataatcaaacagattcccgtggagcagatgacgaaggaagagcgccaggctgcccaaaatgaatgccaggtgctaaagctacttaaccatcccaatgtcatagaatattatgagaatttccttgaagataaggctctgatgattgcaatggagtacgccccaggggggaccttagctgagtttattcagaaacgatgcaattcactactggaagaagaaactatccttcattttttcgtgcagattttgctagcccttcaccacgtgcacacgcatctgattctccaccgagacctgaaaacacagaatatcttactagacaagcaccgtatggtcgtcaaaattggtgattttggcatctctaaaatcctgtctagtaaatctaaggcgtatacagtggtgggaacaccatgctacatcagtcctgagctttgcgagggaaagccctacaaccagaaatctgatatttgggcgctcggctgcgtactgtacgaattggctagcttaaaaagagcattcgaagccgcaaatctgcccgcattggtgttaaaaataatgagcggcaccttcgcccctatcagcgatcggtactccccagaactgaggcagttggtgctgtctctgttgtcactcgagccagctcagcgtccacctctgtcacatatcatggctcagcccctctgcatacgggccctactaaacctacatacggatgtgggaagcgtgagaatgaggagggccgagaagagcgtggccccctccaacactggcagtcgaactacatctgttcgatgcagggggatacccaggggacccgtcagacccgctatccctcctccccttagttctgtctacgcctggggcggtggcctgggcacaccattgcgactgccaatgctgaataccgaggttgtgcaggttgccgccggtcgcacgcaaaaagccggggttaccaggagtggacgccttattctgtgggaggccccaccgctgggagccgggggcggaagtctgttgccgggggcagtggagcaaccccaaccccagttcatctccagatttcttgaaggccagtcgggcgtcacgattaaacatgtcgcatgtggcgattttttcactgcgtgtctgaccgatagaggcatcatcatgacgtttggttctggctcgaatggttgtctagggcacggcagtctgactgacataagccaacccaccatcgttgaggcactgctgggatacgagatggtccaggtggcgtgtggcgcttcacacgtgctggccttgtctaccgaacgcgaactctttgcttggggaaggggtgatagtggtcggctgggcctcggcaccagagagtctcatagctgtccacaacaggtgcctatgccccccgggcaggaagcccaacgggtggtttgtgggatagattcttctatgatcctcacggttcccgggcaggctctcgcatgtggaagtaacagatttaacaagttgggactcgaccacctgagtctgggggaggagcctgtgcctcatcagcaggtggaggaggccctgagcttcacgttgttagggagcgcgccacttgatcaggaaccccttctgtcaattgatctgggtactgcacactcggcagctgttacagcttccggagactgctacacctttggaagcaaccaacacggtcagctgggcacaaatactcgaagaggcagcagggcgccctgtaaggtgcagggactggaaggcatcaagatggcaatggtagcctgcggcgacgcgtttacagttgcgataggagctgagtcggaagtgtacagctggggaaagggcgccaggggtcgtctgggcaggagagacgaagatgctggtctgcccaggcctgtgcagctggatgagacccacccctatacagtgacatcagtgtcctgttgtcacggcaacaccctgcttgccgtccggtcagtcaccgatgagcctgtacccccttag

SEQ ID NO: 126532 - DNA, 1383 bp, Artificial Sequence
  Description of Artificial Sequence: Synthetic coding sequence
atggaaaagtacgagcgcataagagtggtcggtcgcggggcctttggcattgtccacctctgtctccgaaaagccgatcagaagttagtcataatcaagcaaatccccgtagaacagatgaccaaggaggagagacaggccgcccagaacgaatgccaggtgttgaaactgttgaaccatcctaatgtaatagagtattacgaaaatttcctcgaggacaaagcgctgatgattgcgatggagtacgcgcctggtggcactctcgcagaattcattcagaagcgctgtaactccctgctggaggaggagaccatcctacatttctttgtgcaaatcttgctggccctccatcatgtccacactcacctgattctacacagagacctgaaaacgcagaacatactgttggataagcacaggatggtggtgaaaatcggtgacttcgggatctccaaaattttatcgagcaaatcaaaagcctacacagttgtgggtactccatgttacatttcccctgagctttgtgaaggtaagccatataaccaaaaatcagatatttgggccttggggtgcgtgctgtacgagctagcttcactgaaacgtgccttcgaagctgcaaatctccccgctttggttttgaagattatgtcgggcacatttgcccccatatcagacagatacagtcccgaactcaggcaacttgtcctgtcccttctgtccttggagcctgcccagaggccccccttatctcatatcatggcacagcccctatgcatcagagccttactgaatttgcatacagacgtggggagtgtcaggatgcggcgtccagtacagggtcagcgagcagtcttgggcgggcgcgtatgggcgccatctggatccaccgggggacttaggcagcgcgaaacttggggaaagtcatcactgcccgcatgtcgtaatgtgaggagggtgttcgtattacggccccccagtgtactgcaaggcagagaggtccggggccctcagcagcaccgggagcaagaccaccaatgcccgctccagagataccctccaggaacctgtgaagcttcgcatccaaccaccactgtggtgagcgtgtgcctgggctggtgggcagggcacccaccagcagccgccaatgcccagcacaggggaggacctgggggttcgtgggcccacgctgaatctcgaagacacgctctctgggcctctcaccccgttggcggacccactccgcggtgtcggcgccgccagtccccatcctgggggtccggcgcagctactgcccccgtgcacctcgctttccccgggggcccggtggggtgcgatcaccaggcgcgtggtctgtggggtctcttgcattgtctgcccgactag

SEQ ID NO: 126533 - DNA, 2940 bp, Artificial Sequence
  Description of Artificial Sequence: Synthetic coding sequence
atgtctgtgctcggagaatacgagcgccactgcgattcaataaacagcgattttggtagcgaatccggcgggtgcggagatagcagccctgggccatctgcatctcaaggaccaagggcaggcggtggtgcagccgagcaggaggagttacactacattcctattcgggttctgggcagaggcgcgtttggagaagccacgttgtatcgcaggactgaggatgactctctggtggtgtggaaagaggtcgacctcacccggctcagcgagaaggagcgtagggacgccctgaatgagatagtaattttggctctcctccagcacgacaatataatcgcttactataaccattttatggacaacacaacacttctcatcgaattggaatactgtaatggcggcaacctgtacgataagatactccgccagaaggacaagctgttcgaagaagaaatggtcgtgtggtacctttttcagatagtttccgccgtgagctgtattcataaggcaggcatactccacagagacatcaaaactttgaacattttcctgacaaaagctaacctgattaagctaggcgattacggactagccaagaagctcaattctgagtatagtatggccgagactctcgtgggaacgccatattacatgtctccggagttgtgccagggcgttaagtataactttaaatcagatatctgggcggtcggctgtgtgatctttgaactgcttactctcaagcggacctttgacgcaaccaacccactgaacctctgcgtgaagatcgtgcaggggatcagggcaatggaagtagactcctcacagtactctctggagctcatccaaatggtgcactcctgtcttgatcaggatccggagcagcggccaaccgcggatgagctgctggatcgcccgttactgcgaaagaggcgtcgggaaatggaggaaaaagtaacactgttgaatgcccctaccaaaaggccaagaagttcaacggtgacagaagcccctattgccgtcgtgacctctcgaacatctgaagtgtacgtgtggggcggcgggaaatcaacgccacagaagctggatgtaattaaaagcggctgcagcgcacgccaggtctgtgcagggaatacacattttgcggtggtcaccgtggagaaagaactgtacacatgggtcaatatgcagggtggaaccaagctccacgggcagctcggccacggagacaaggcatcctacaggcagccaaagcacgtggagaagctccagggaaaggcgatcagacaggtgtcctgtggagatgactttaccgtttgtgtcactgacgaaggccagctgtacgccttcggctccgactactatggctgtatgggagtggacaaggtagcaggccccgaagtgttagaacccatgcaactgaatttcttcttgtcaaatccagttgaacaagtctcttgcggggacaatcatgtcgtagtcctgacccggaacaaggaagtctatagttggggctgcggagagtacggaagactcgggctggactctgaggaggattattataccccacagaaagtggacgttcctaaggctctgataatcgtggcggtgcagtgtgggtgtgatggcacgttcctgctcacccagtcaggcaaggtgttggcttgtggcctcaatgagtttaacaaactcggtttgaaccagtgcatgagcggcataataaaccacgaggcgtaccacgaggtgccttataccacttcattcacactggctaaacagctgagcttctataagatcagaaccatcgctcctggaaaaacgcacacagctgcgatagacgagagaggacggttgctcacatttggctgcaataaatgcggtcagctgggtgtgggcaactataaaaaacgcctgggcattaacctgctgggtggccccctcggcggcaaacaggtaattagggtatcatgtggagatgaatttacaatcgccgccacggacgataaccacatcttcgcctgggggaacggtggaaatggacgcctggctatgactcctacagaacgtcctcacggaagtgatatatgcacttcatggcccagacctattttcggatccctccaccacgtgcctgacttgtcctgtagagggtggcataccattttgattgtggagaaggtgttaaacagcaagaccatacgatctaatagctctggactctctatcggcacagtgttccagagttctagccctggcggcggtggcggaggtggaggtggggaggaggaggacagccaacaggaaagcgaaacccccgacccctccggtggttttcggggaaccatggaggcagatcgaggcatggagggcctaatctcgcctacagaggctatgggtaacagtaacggtgcaagttcatcctgtccaggatggctccgcaaggaactggaaaatgccgaatttatccctatgccagatagccctagtcccctctctgctgcattctcagagagcgagaaagacacgctcccttacgaggaactccaggggctgaaggtggctagcgaggctccccttgagcataagccccaggtggaagctagctccccccgtcttaatccagctgtaacttgcgcaggcaagggcaccccactcacaccaccagcgtgcgcttgcagttctctgcaggttgaagtagagaggctgcagggcctagtactgaagtgcttggccgaacagcagaagcttcagcaggaaaacctgcaaattttcacacagctccaaaagctcaataagaagcttgagggagggcagcaggtagggatgcactctaaggggactcagacggcaaaggaggagatggaaatggaccccaagccagatcttgattccgatagctggtgcttgctcggcaccgattcatgccggccttcgttgtag

SEQ ID NO: 126534 - DNA, 1545 bp, Artificial Sequence
  Description of Artificial Sequence: Synthetic coding sequence
atgtctgtcctgggggagtacgaaaggcattgcgactctataaatagcgacttcggctctgaatcaggagggtgcggcgatagctctcccggtccttccgcttcacagggcccccgggcaggtgggggggcgttcggcgaggccaccttatatcggcggaccgaggacgactcgctggtagtctggaaagaggtcgacctgactcgtttgtccgagaaggaacgcagagatgccctgaatgagatcgtgatcctggccctgctacagcatgataacattatcgcttattataaccactttatggacaacaccacattgcttattgagctggaatattgtaacggcggaaacttgtacgacaaaattctgcggcagaaggataaactgttcgaggaagagatggttgtgtggtatctctttcagatagtttctgctgttagctgtattcacaaagccgggattttacacagagatatcaagacactcaatatctttttgaccaaagcaaatttgattaaattaggcgattatggcctcgccaagaaactcaacagtgaatatagcatggcagagactctcgtgggcactccctactacatgagtcccgaactgtgtcaaggcgtgaaatacaattttaagagcgatatatgggctgtgggctgcgtcatctttgagctcctcaccctgaaacggacctttgatgcaaccaatccactgaatctttgtgttaaaattgtccagggtatcagggccatggaggtggacagcagccagtactctctcgagctgatccagatggttcattcgtgtctggatcaagatccagaacagaggccgaccgcagatgagctgcttgaccggccactgttaagaaaaaggaggagggagatggaggagaaggtgaccctgctcaacgcgcccacaaagagaccccgttctagcactgttaccgaggcgcccatcgcagtggttacttcacgcacaagcgaggtgtatgtatggggcggaggtaaatctacaccccagaagctggacgtcatcaagtccggttgcagcgcccgccaagtatgcgctggcaatacccacttcgccgttgtgacagtggaaaaagaattgtacacatgggtgaacatgcagggcggcacaaaacttcacgggcaactgggacacggcgacaaggctagctaccgacaacctaagcatgtggaaaagctgcagggaaaggcgattcggcaagtttcttgtggcgatgactttaccgtgtgtgtgacagatgagggacagctatatgcttttgggagcgactactatgggtgtatgggtgttgacaaagttgccggcccagaagtcctagagccaatgcaactgaatttctttctgagtaatcctgtggaacaagtgtcatgcggtgataatcacgtggtcgtcctcacccggaacaaagaggtgtatagttggggttgtggtgagtacgggcggggttcactcgtgtctgtccatttttttacaggcatccagcccgactttaaggtagtctgtatctag

SEQ ID NO: 126535 - DNA, 3777 bp, Artificial Sequence
  Description of Artificial Sequence: Synthetic coding sequence
atggagaagtacgtccgcctacaaaaaatcggcgaagggtcattcggaaaagctatactcgtgaagtctactgaagacggccgccagtacgttattaaggagattaacatctcccggatgagctccaaggagcgcgaggaatcacggcgagaggtcgccgtgttagcaaacatgaagcatcccaatatcgtgcagtacagggaaagcttcgaggagaacgggagtctctatattgttatggactattgtgaaggaggtgacctctttaagagaatcaacgcgcagaaaggagtcctgttccaggaggaccagatcctggactggttcgtccagatttgcttagcactgaaacacgttcacgacaggaaaattcttcaccgtgacatcaaatctcagaacatctttctgactaaggacggtaccgtccagctgggggatttcgggattgctcgggtgctgaacagtacggtcgaactcgctcggacctgtatcggcacaccctattacctttcacccgagatatgtgaaaataagccctacaataacaaatcagacatttgggcactgggatgcgtcctgtacgagctgtgcaccttgaaacatgccttcgaggcaggctccatgaagaacctagtgctgaaaataatttccgggagctttccgcccgtcagcctgcattactcttacgatctgcgatccctcgtgtctcagcttttcaaacgcaaccccagagacaggccttccgttaactcaatattggagaaggggtttattgcgaagcgaatcgaaaagtttctgagcccacagctgattgccgaggaattttgtcttaagacattcagcaaattcgggagtcagcccatacccgccaagcggcctgcaagtggacagaacagcatttcggttatgccagcccagaagatcacgaagcccgcagcaaagtatggcattcctctggcttacaagaagtatggcgacaaaaaactgcacgaaaagaaacccctacagaagcacaagcaggcacaccagacccccgagaaacgggttaacaccggcgaagagaggcggaagatctccgaggaggctgcccgaaagagacggctagagttcattgagaaggaaaagaaacagaaagatcagataatttccctgatgaaggcagaacaaatgaagcgccaggaaaaagagcggctagagagaattaatcgtgcacgagaacagggatggcgtaacgtactgagcgccggcggtagtggagaggtgaaagctcctttcctggggtcaggtggcacaatcgcacccagctctttctcttcacggggtcagtacgagcactatcatgccatcttcgatcagatgcagcagcagcgagctgaagataacgaagcaaaatggaagagggagatctacgggcgggggctgcctgaaagaggaattctgccaggagtccgaccaggattcccttatggagcagcgggtcaccatcactttccggacgccgacgatataagaaaaacacttaagcggctgaaggcggtcagcaaacaggccaacgctaatcggcagaaaggtcagctcgcagtcgagcgggccaaacaggtggaggaattccttcaaaggaagagggaagcgatgcaaaataaggcccgggccgagggccacatggtctatttggctcggcttcgccaaatcagactacagaacttcaacgagaggcagcaaatcaaggccaaactgcggggggaaaaaaaagaggcaaaccattccgaaggccaggaaggttcagaagaggctgatatgagacgcaagaagattgagagccttaaggcccacgctaacgctagagcggctgtgcttaaagagcagctggaacgaaagagaaaagaagcttacgagagggaaaaaaaggtctgggaagagcatcttgttgccaaaggcgtcaaatcatctgacgtctcccctcccttgggccaacatgagaccggggggtcccctagtaagcagcaaatgcggtcagtgattagtgtgacctcagctcttaaggaggtgggcgtggacagctccctaaccgacactagggagaccagcgaagaaatgcagaaaacaaacaatgccatatcaagcaaacgcgagatccttcgcagacttaacgaaaatctgaaagcccaagaggacgagaaagggaaacaaaacctctccgataccttcgaaatcaacgtgcacgaggacgctaaggagcacgagaaggagaaatcagtgagtagcgaccggaagaaatgggaagctggcggacagttagtgatacccctcgacgagttgactttggacacatcatttagcacaaccgaacgccacactgtaggtgaggtgatcaaacttggaccaaacggttctcccagacgcgcgtgggggaaaagtccgactgatagcgtattaaaaattctgggcgaggctgaactgcaactgcagaccgaacttttagagaacacaacaatccggtctgagatttctcccgagggagagaagtacaaaccactgatcaccggagagaaaaaagtccagtgcatctcccacgagatcaacccatccgcaattgtagactcccccgtggagaccaagagcccggaattctctgaggcctctcctcagatgagcctcaaactggagggaaacctggaggagcctgacgaccttgagaccgagatactccaggagccgagcggaacaaataaggatgagtcacttccttgtaccatcaccgacgtctggatatctgaggagaaggaaactaaagagacgcagagtgctgaccgaattacaatacaagagaacgaggtgtcagaagacggcgtctctagcaccgtggaccagctttccgatattcatattgaacctgggactaacgattcgcagcactccaaatgcgacgtcgataagtcggtgcagcctgagcccttctttcacaaagttgtccacagcgagcacctaaaccttgtgccccaggtacagtcagtgcaatgcagtcctgaagagagctttgcctttcgaagccacagccatttgcctcccaaaaacaaaaacaaaaattcattgttaattggtctaagtactggcctgtttgacgccaataaccctaaaatgcttcggacttgttcccttcctgatctgtctaagctctttcggaccctcatggatgtgcccaccgtgggcgatgtcagacaagacaaccttgaaattgatgaaattgaggacgagaatatcaaagagggcccctccgacagcgaggatatcgtgtttgaggagaccgacactgacctccaggagcttcaagccagcatggaacaactgttgcgagagcagccgggggaggaatacagcgaggaagaagagagcgttcttaagaatagtgatgtcgagccaacggccaacggtacagatgtggcagatgaggatgataatccaagcagtgagtcagctctgaatgaggaatggcattctgacaattctgatggcgaaattgcctctgaatgtgagtgcgactccgtatttaatcacctggaagaactcaggctgcatctggagcaggagatgggctttgagaaattttttgaggtgtacgagaagatcaaggccatccacgaggatgaggacgaaaatatcgagatatgcagtaaaattgtacaaaatatcctcggcaatgagcaccagcacctatatgcaaaaattttacacttggtcatggccgacggggcataccaggaggacaacgacgagtag

SEQ ID NO: 126536 - DNA, 3861 bp, Artificial Sequence
  Description of Artificial Sequence: Synthetic coding sequence
atggagaaatacgtgcgcttgcagaaaataggtgaggggtcctttggtaaagcgatactggtgaagtcaaccgaggatgggcgacagtacgtcataaaggagataaacatcagccggatgtcgagcaaagagcgggaagaatcccgccgcgaagtagctgttttggctaacatgaagcatcccaatatagtgcagtatagggaatccttcgaggagaacggatctttgtacatcgttatggactattgtgagggaggagacctgtttaagcgaatcaacgcccagaagggagtcctgttccaggaggatcaaattctcgattggttcgtacagatctgcctggccctcaaacacgttcacgaccggaagatcctgcaccgggatattaagtctcagaacattttcctcactaaagacgggacagtgcaactgggggacttcgggatcgcacgcgtgctgaattcaacagtggagcttgctcgaacctgcataggtactccatactacctgagccctgaaatttgtgaaaacaagccttacaataataagagtgacatctgggctctggggtgcgtgctctatgagctctgcacactcaagcacgcctttgaggctggcagtatgaaaaatctcgtccttaagattatttccggctcctttcccccggtttcgctacattactcttacgatctacgcagcctcgttagtcaacttttcaagcgaaaccctagggataggccttcagtaaacagtatcttagagaaagggttcatcgcaaaacgaatcgagaagtttctgtctccgcagctcatagcagaagaattctgtctgaagacatttagcaaatttggatcgcaaccgattcccgccaaacgaccggcttcagggcaaaactctatctctgtgatgccagcgcagaagatcactaagcccgctgcaaagtatggcataccgttggcctacaaaaagtacggtgataaaaaactgcatgagaagaagcctcttcagaagcacaagcaggcgcaccagactccagagaaacgagtgaatactggagaagaaagaaggaagatctctgaggaagccgccaggaagagaagactcgagtttattgagaaggagaaaaagcaaaaggatcagatcatctctttaatgaaggccgaacagatgaagcgtcaagaaaaggaacggctcgagagaattaatcgcgcacgggaacagggctggcgaaacgtgttgagtgctggcggctccggcgaggtgaaagccccctttctggggagtggaggaaccatagcccccagctccttctcatcccgggggcaatatgaacactatcacgctatttttgatcagatgcaacaacaaagagctgaagacaacgaagctaagtggaaacgggagatatatggcaggggtctcccagagcgtgggattctgcccggcgtccgcccaggtttcccatacggagccgctggccaccaccatttccccgatgctgatgatattcgcaaaaccctgaagagactgaaggctgtgagcaagcaggccaacgcaaaccgccaaaaagggcagcttgctgtcgagagagctaagcaagtagaggagttcttgcaaaggaaacgagaagccatgcagaataaggctcgcgcagaggggcatatgggaattctccagaacctagcggcgatgtacggcggtagaccctcttcttctcggggtggcaagccccgcaacaaggaggaggaggtgtatctcgcacgactcagacagatcagactccaaaatttcaacgaacgccagcaaatcaaggctaaactacgaggcgagaaaaaggaagcaaaccattccgaagggcaggaaggatcagaggaagccgacatgcgaaggaagaagatagagtcactgaaggctcatgcaaacgcaagagccgccgtcctgaaggaacaactggaacggaaacgaaaagaagcttacgaaagggagaaaaaagtatgggaggagcacttggtggccaagggagttaaatcctctgacgtaagcccgcctttgggacagcacgagaccggtggctccccttccaaacagcagatgcggagtgtgatttccgtgacgagcgctctgaaggaggtcggggtagattcttcgctcacggacactcgtgaaactagtgaagaaatgcagaaaacaaacaatgcaatttcttctaaaagagagattttaagacggctaaatgagaatctaaaggcacaggaggatgaaaaaggtaagcaaaacctgtctgacacatttgagataaacgttcacgaggacgccaaagaacatgaaaaagagaagagtgtgagctccgatagaaagaaatgggaagctgggggacagctggtgattcccttagacgagttgacactagatacttctttcagcacaactgagcgacataccgtcggcgaggtcattaaactaggtccaaatggtagcccacgtcgcgcttggggcaaatctcctacagacagtgtgctgaagatccttggggaagcagagctacagcttcaaaccgagctactcgaaaatacaacaattcgatctgagatcagccccgagggtgagaagtacaaacccctcattactggagaaaagaaagttcagtgcatttctcatgagatcaatccttctgcaattgtcgattccccagttgagaccaagtcacctgagttttcggaggccagtccccaaatgtcactcaaacttgaagggaatctggaggaaccggatgacctcgaaactgagatccttcaagagcccagtggtactaataaggacgagagtttgccatgtaccatcacggatgtttggatctctgaggaaaaggaaacaaaagagactcagtcggctgaccgcataaccattcaggaaaatgaagtgtccgaggacggagtttcatctacggtggaccagctgagcgatattcacattgagcccggaaccaacgatagccagcattctaagtgcgatgtcgataagagcgtccagccggaaccattcttccacaaggtagttcattcagagcacctgaatcttgtacctcaggtccaatccgtacagtgctcaccggaggaaagtttcgctttcagaagccattcacacctgcctccaaagaacaagaataagaactcactccttatcggcctatctaccggactcttcgacgctaataaccctaaaatgttacgaacctgtagcctaccagatctgagcaaactattcaggaccttaatggatgtgccaacagtcggggatgtgcgacaggacaacctcgagattgatgagattgaggatgagaatattaaggaggggccaagcgatagtgaggacatagtatttgaagagaccgacaccgacctccaggaattacaagccagcatggagcaactactgagggaacagccgggggaggaatacagtgaagaagaggaatcagtgcttaagaattcagacgtggagcctacagcaaatggcactgatgtcgcagacgaggacgacaacccatcgagcgagagtgccctcaatgaggaatggcactcagataacagtgatggtgagatagcgagcgagtgcgagtgtgactccgttttcaatcacctggaagagctgaggttgcaccttgagcaggaaatggggttcgaaaagttcttcgaggtgtacgaaaagataaaagctatccatgaagatgaggacgaaaatattgaaatttgttcaaagatagtgcagaacatcttaggtaatgagcatcagcatctctacgcaaagatcttacaccttgtgatggctgacggggcctatcaggaagataatgacgagtag

SEQ ID NO: 126537 - DNA, 3645 bp, Artificial Sequence
  Description of Artificial Sequence: Synthetic coding sequence
atggagaaatacgtgaggctccagaagatcggggagggctcattcggtaaggcaattttggtgaagtccacagaggatggcagacaatacgtcattaaagaaatcaatattagcagaatgtccagtaaagaacgtgaagagagtcggcgggaggtggccgtcctcgccaatatgaaacacccgaatatcgtccagtatagggaaagcttcgaggagaacggcagcctgtatattgtgatggattattgcgagggaggtgacctgttcaaacgcatcaacgcccagaagggagttctctttcaggaagaccaaatcctggactggtttgtgcaaatctgcctggctctcaaacacgtgcacgatagaaagattcttcaccgcgatattaagtctcagaatatctttcttactaaagacgggactgttcaattgggcgactttgggatagcccgggtcctgaatagcacggtcgagctggcaaggacctgtatcggcaccccctattacttgagccccgagatctgcgagaataagccctacaataataagagcgatatttgggctctgggctgcgtattgtacgaactgtgtacactcaaacatgcctttgaagccggatctatgaaaaatctcgtgctgaagattattagtggaagttttcccccagttagtctccactactcttatgacctgaggtccctggtcagccagcttttcaagcgcaatcctcgggaccgccccagtgtgaatagtatcctggaaaaaggatttattgcaaaacgcattgaaaagtttctttccccgcagctgatcgcggaagagttctgcctgaaaacattttcaaagtttggctctcagccaatccccgccaagagacccgcatctggccagaactccattagcgttatgcccgcccagaagatcaccaaacctgctgccaagtacggaatccccctggcttataaaaaatatggagataaaaagctgcatgagaaaaagccgcttcaaaagcacaagcaggcccaccagacacctgagaagcgcgttaatactggagaagagagacgcaagatatccgaggaggctgcgaggaagcgtcgactcgagtttatcgaaaaggaaaagaagcagaaagatcagatcatctctctgatgaaagccgaacagatgaaacgccaggagaaggagcggctggagaggataaacagggctcgtgagcagggctggagaaacgtgttatccgctggcggctcaggggaggtgaaggccccattcctgggcagcggagggaccattgccccctcttccttctcctctcgggggcagtacgagcactatcacgctatcttcgaccaaatgcagcagcaacgtgccgaggataacgaagccaaatggaagagggagatatatggcagaggcctgccggagcggcagaaaggacagcttgcagtcgaaagggcaaagcaagtggaagaatttctgcagagaaaacgtgaagccatgcaaaataaggctagggccgaaggacacatggtctatctcgcccgactgcgacaaatacgcttgcagaattttaacgagcgacagcagattaaagccaaactgagaggagaaaaaaaggaggctaaccattccgagggccaggaggggagcgaggaggctgatatgcgtaggaaaaagatcgaatctctaaaggctcacgcaaacgcccgagcagccgtgctcaaggagcagctcgaacggaaacgcaaggaagcttatgagagagagaagaaagtgtgggaggaacacctcgtagctaaaggggtgaagtcatccgacgtgtctccacccctgggtcagcacgagacagggggtagtccatctaagcagcagatgagatctgtgattagcgtcacgtccgcactcaaggaggtcggggtggactctagcctgactgacacccgggagacatctgaggagatgcagaagaccaacaatgccatctctagcaaaagggagattctgagacgcctgaacgagaatctgaaggcacaagaggacgagaaggggaagcaaaatttatcagatacattcgagatcaacgtgcacgaagacgccaaagagcacgagaaggagaagtcagtatcgagtgacagaaagaaatgggaggccggcggccagctggtcataccacttgatgaactaactttggacaccagctttagcacgacagagcggcatacagtcggagaggtcataaagctcggccccaacgggtccccgcgtcgcgcgtggggtaagtctcctaccgactcggtcctgaagattctcggggaggccgaactgcaactgcagacggaactgctggagaataccaccataaggtcagaaatctcacccgagggagagaagtataaaccattgatcacaggggaaaagaaagtgcagtgcatctcacatgaaatcaacccctctgccatagttgacagcccggtggagacaaaaagcccagagttctctgaagctagcccgcagatgtccttaaaactagaggggaacctggaggagcccgatgacctggagaccgagatactacaggagccatctggtacaaataaagacgaatcgctgccctgtacaattactgatgtatggatctcggaagagaaagaaaccaaagagacacagtcagctgacaggattaccatccaagaaaatgaggtgtccgaagacggtgtgagcagtaccgtcgaccagctgtctgatatccatattgagccaggaacgaacgacagtcaacacagtaagtgtgatgtagataaatccgtccagcctgaacccttctttcataaagttgtccatagcgaacatctgaacctggtacctcaggtgcagtctgttcagtgcagtccagaagagtctttcgctttccgcagtcacagccatctgccacctaaaaataagaacaaaaactccctcctgatcggactgtcaacagggctattcgatgccaataatcctaagatgctgcgtacttgctctctcccagacctctcaaaacttttccgtactctgatggatgtccccaccgtcggagacgtgcgacaggataacctggagattgatgagattgaggatgaaaacatcaaggaggggcccagtgactctgaggatatagtcttcgaggagacagacaccgaccttcaagagttacaggctagtatggagcagctgctcagagaacagcctggagaggagtactccgaggaggaagaatccgtcctgaagaacagtgacgtagaacccactgcaaacggtacagatgttgctgacgaagacgacaacccatcttccgaaagtgccctcaacgaagagtggcatagtgacaactctgatggagagatcgcatctgaatgtgaatgcgactcagtgtttaatcatcttgaggagcttcgcctgcacttagaacaagaaatggggtttgaaaagttttttgaagtctacgaaaagatcaaggctatacacgaggatgaggatgaaaacatcgaaatttgcagcaaaattgtgcagaacatcctggggaatgaacaccaacatctctacgcaaaaattctccacctggtcatggccgatggagcataccaggaagacaacgatgagtag

SEQ ID NO: 126538 - DNA, 3570 bp, Artificial Sequence
  Description of Artificial Sequence: Synthetic coding sequence
atggagaagtatgtgaggctgcagaaaatcggagaaggctcgtttggcaaggccattcttgttaaatccacagaagacggcagacagtacgtcattaaggagatcaatatctcacggatgtcttccaaagagagagaagaaagtcggagggaggtggccgttctagctaatatgaaacaccctaatattgtccagtatcgagaatccttcgaggagaacggaagcctgtacatcgtgatggactattgtgagggtggcgacttgttcaaacgcataaatgcccagaagggggtgctctttcaggaggatcagatcctagactggtttgttcaaatctgtctggccctaaaacacgtacacgacagaaaaattcttcaccgcgacatcaagagtcagaacatatttctcactaaggacggaactgtccaactgggcgactttggaatcgcacgtgtcctgaattcaactgtagagttagcacgtacctgtatcggcaccccctactacttgtcccccgagatctgtgaaaataaaccttataataacaaatccgatatttgggcgctgggctgtgtattatacgaactgtgtacactcaagcacgctttcgaagccggatccatgaaaaacctcgtgctcaaaataatttctggctcattccccccggtgtccttgcactattcctacgatctacggtctctggtgtcccagctatttaaaaggaatcctcgcgacagaccctctgtgaactctattttggaaaaaggatttattgccaagcggattgagaagttcttgagtccacaattgatcgcggaagaattttgcttgaaaacattttctaagttcgggtcccagcccattcccgcaaaaaggcccgcgtcaggacagaactcaataagtgtaatgccagcgcaaaaaatcaccaagcccgccgcaaaatacggaatcccactggcttacaaaaagtacggagataagaaattgcatgagaagaaaccgttacaaaagcacaaacaggctcaccagacacccgaaaagcgcgtaaatacaggggaggaacgcaggaagatctcagaagaagcggcaaggaagcgtagactggagttcatagaaaaagagaagaagcagaaggaccagattatttccctcatgaaggctgagcagatgaagcgccaggaaaaggagcgtgctccattcctgggaagcgggggtactattgcacccagttcatttagctctcggggacagtatgaacactaccatgctatctttgaccaaatgcagcagcaacgggctgaggataatgaagccaaatggaaacgcgaaatctacgggagaggactgcctgagcgccagaagggacagttagccgtggaacgggcaaagcaagtagaagaatttcttcagagaaaaagggaggcaatgcagaacaaggccagagccgagggccacatggtatatctggcacgcttgcgccagatccgcctccaaaattttaacgaacgccagcagatcaaggccaaattgagaggagaaaaaaaagaagctaaccactctgaggggcaagagggcagcgaggaagccgacatgcgacgtaagaaaattgagtccttaaaagcccacgcgaatgctcgcgccgccgttctgaaggaacagctcgagcggaaaaggaaagaagcttacgagagggagaagaaagtgtgggaggagcaccttgttgccaaaggtgtgaagagctctgacgtgagcccacccctgggtcaacacgaaacaggcggatcaccttcaaagcagcaaatgaggtccgtcatctcagttaccagcgcattaaaagaggtgggcgtcgatagctctttgaccgacacccgcgaaacaagcgaagagatgcagaagacgaataacgcaatcagctctaaaagggaaattctgcgcagactcaacgagaatctgaaggcccaggaagatgaaaagggtaaacaaaatctgagcgatacattcgaaattaatgtccatgaagatgcaaaagagcatgaaaaggaaaaaagcgtctccagcgaccgtaagaaatgggaagccggcgggcagctcgtcattcccttggacgagctgaccctggatacatccttctccaccacagaaaggcacacggtcggagaagttatcaaactcgggcccaacggctcaccccggagggcgtggggtaagagccccacggatagcgtacttaagattctaggggaagctgagctccaactgcagacagaactcctagagaacacgactattaggagtgagataagccctgaaggagagaaatacaagcctctcataaccggagaaaagaaagtgcagtgcattagtcacgaaattaatcccagcgccatcgtcgactcaccagtggaaaccaagtctcctgaattcagcgaggctagcccgcagatgtcactgaagcttgagggaaacctagaagagccagatgatcttgagacagaaattctccaggaaccctccggtaccaataaggatgaatccttaccttgcacgatcaccgacgtatggattagtgaggagaaggagaccaaggaaactcagagtgccgatcgtatcactattcaggagaatgaagtgtccgaggacggcgtgtcatctacagtggatcagcttagtgatattcatatcgaaccaggaaccaatgattctcaacatagcaaatgcgacgttgacaaaagcgtgcagccagagccgttctttcacaaggtagtccactccgagcaccttaatctggtcccccaagtgcagtcggtgcaatgctctccagaggagtccttcgcatttaggtcccattcccacctgccccctaaaaacaaaaacaagaacagtttacttattgggttaagcaccggcctgtttgacgccaacaacccaaaaatgctccggacctgctcactgccggatctgtcgaagctgttcagaaccctaatggatgtccccaccgtgggcgacgtgcggcaggataatctggagatcgacgaaatagaggatgagaatataaaggaaggcccaagtgactccgaggatatagtcttcgaagagactgacaccgacttgcaggagctccaggcatccatggaacagctgcttcgggagcaaccaggcgaggaatattctgaagaggaggagagcgtgctcaagaactcagatgttgagcctacagccaacgggaccgacgtagctgacgaggacgacaatccctcctctgagagcgctctaaacgaagagtggcactctgataacagcgacggagagattgcctccgagtgtgagtgtgactcagtgtttaaccacctggaggagctgagactccatttggaacaggagatggggttcgagaagttcttcgaagtgtatgagaagatcaaagcgattcatgaggatgaggatgagaatatagagatatgctctaaaatcgttcagaatatcttaggaaacgaacaccaacatttgtatgccaagattttgcacctcgtgatggcagacggcgcctaccaggaggacaatgacgagtag

SEQ ID NO: 126539 - DNA, 1155 bp, Artificial Sequence
  Description of Artificial Sequence: Synthetic coding sequence
atgccctctcgggctgaagattacgaagtgttatacactataggcactggcagctacggccggtgccagaagatacgacggaagtcggatggaaaaattcttgtgtggaaagaactagattatggctcgatgacggaagccgagaaacagatgcttgtgtccgaggtgaacctgctgcgcgaactaaagcaccccaatatagtcagatactatgatcgcattatcgatcgaacgaacacaaccctatacatcgtgatggaatactgcgaggggggggatctcgcaagtgtgattactaagggaaccaaagagagacagtatctagacgaggaattcgttcttcgagtgatgacacagcttacactggccctgaaagagtgtcaccggcgttctgacggcggacacactgtgcttcatcgggacctgaagccagcaaatgtatttctcgatggtaagcagaatgtgaagttaggtgactttggcctggccaggatcctcaatcacgacacctcctttgcgaagacattcgttggtaccccctactacatgtctccagaacagatgaataggatgtcatataatgagaaatccgatatatggagcttgggctgcctgctgtatgagttgtgtgccctcatgccgccgtttacagctttctctcagaaagaacttgccggaaagattcgtgaaggaaagttcagaaggatcccttatcgctactccgatgagttaaacgagattatcactaggatgctaaatctcaaagactaccaccggccgtccgttgaagaaatcctggagaacccactgattgccgatctcgtggcagatgagcagcggagaaacctggaaaggcggggcagacaacttggtgaacccgagaagagccaagatagctcacctgtgctatccgagcttaaattaaaagagatccagctacaagagcgcgagcgggctcttaaagcccgcgaggaaaggttagagcagaaggagcaggagctctgcgttagagagcggcttgccgaagacaagctggctagggcagaaaatctgttgaagaattatagcctgcttaaggagagaaagttcctctcgctggcatccaatccgggaatgagaataaacctcgtgaaccggagctggtgctataagtag

SEQ ID NO: 126540 - DNA, 1338 bp, Artificial Sequence
  Description of Artificial Sequence: Synthetic coding sequence
atgccctctagggctgaggattacgaagtcttgtatacaattggcacggggagctatggcagatgtcaaaagattaggcgcaaaagtgacggcaaaatcctggtatggaaggagttggactacgggagcatgacagaggcggagaagcagatgctggtgtctgaagtaaatttgctgcgcgagctcaagcaccctaacattgtgagatattacgatcggattattgataggaccaatacaactctgtacattgttatggaatactgcgagggtggcgacttagccagcgtgattaccaagggaacgaaggaacgacagtacctggatgaggagtttgttctacgcgtaatgacccagctgaccctagcactgaaggagtgccacagacgtagcgacggcggccacaccgtcttgcatcgcgacctgaaacccgcgaatgtctttctcgatgggaagcagaatgtcaaactgggagattttgggctcgcccgcatcctgaatcacgatacatcttttgcaaaaacttttgtgggaaccccatactacatgagtcccgagcaaatgaataggatgtcatataacgagaaatctgacatatggtccctggggtgtttgctctacgaattatgtgcactgatgcctccatttaccgcattctcccagaaggaacttgccggcaagattagggaagggaaatttcgccgaatcccctaccgctattctgacgaactgaatgaaatcattactcggatgctgaacctcaaagattatcaccgcccctccgtggaagagatattggagaatccactgattgcagatttggtggcagatgagcagcgcaggaatctggagagacgcggtcggcagctgggcgagcctgagaaaagtcaggattcttcccccgttctaagcgagctgaaactgaaggaaattcagcttcaggagcgtgagagagctctgaaggccagggaagagaggctagagcagaaagaacaagagttgtgtgtgagagaacggcttgcagaagataagctggcaagagcggagaacctgttgaaaaactatagcctgctgaaagaaagaaagtttctctctctagcatccaacccagaactgctgaacctgccctcatctgtgatcaagaagaaagtacatttttccggtgagagcaaagagaacatcatgcggagtgagaattccgaatcacaactcacgagtaaaagcaagtgcaaggatctgaaaaagcgactgcacgcagctcagctgagggcacaagccctgagcgacattgaaaaaaattatcagctcaaatctcggcagattctgggcatgcgatag

SEQ ID NO: 126541 - DNA, 1209 bp, Artificial Sequence
  Description of Artificial Sequence: Synthetic coding sequence
atgactgaagccgaaaagcagatgctggtgagcgaggtcaacctcctgcgtgagcttaaacacccgaatatcgtgagatattacgatcggatcattgacaggacaaacactaccctctatatcgtcatggagtactgcgaaggtggtgatttggcaagcgtcattaccaaaggtaccaaggaacggcagtatctggatgaagagttcgtgctcagagtgatgactcagctaactctggcactcaaggagtgccaccgtaggtctgatggcggccacaccgtgttgcaccgtgaccttaaaccagccaacgtattcctcgacgggaaacagaatgtgaagctgggcgattttggtctcgccaggatccttaaccacgatactagtttcgcgaagaccttcgttggcactccctactacatgtctcctgaacagatgaaccggatgagttataatgagaagtccgacatatggagcctgggttgtctgctttacgagctgtgtgcattaatgccgccattcaccgcattctcgcagaaagaactcgctgggaaaattcgggaagggaaatttaggcgaatcccttaccggtacagcgacgagctgaacgagatcattacacggatgctcaatctgaaagattatcacagaccttccgtggaagagattcttgagaacccattaattgcagacctagtggccgacgagcagcgccgaaatctggaaaggagaggccgacaactgggggagcctgaaaaatcccaggacagctcacctgttctatccgaactcaaattgaaggagattcagttgcaggagcgggagagagccctgaaagccagggaagagagactggagcaaaaggagcaggagctgtgcgttagagagcgcctcgccgaagataaactcgcacgggctgaaaatctcctcaaaaattactcccttctgaaggagcggaagtttttatctctcgcctctaatcccgagttactcaacctgcctagctccgtcattaagaagaaggtccacttcagtggcgaatctaaagagaacattatgagatccgaaaacagcgagagccaactgaccagcaagtcaaagtgtaaggacttgaagaagaggctgcatgccgcacaactgcgtgctcaggccctcagtgatattgaaaaaaactaccaacttaagagccgccagatcctcggtatgaggtag

SEQ ID NO: 126542 - DNA, 1521 bp, Artificial Sequence
  Description of Artificial Sequence: Synthetic coding sequence
atggatgattacatggttctccgcatgatcggggaagggtcatttgggcgtgcattgctggttcagcacgagtcttccaatcagatgttcgcgatgaaggagatcaggctcccaaagtcattctcaaacacccagaatagccgtaaagaagccgtgctattggcgaagatgaaacaccccaacattgtggccttcaaagagtcctttgaagctgaggggcacctgtatatagtgatggagtattgcgacgggggggatctcatgcaaaagatcaaacagcaaaaagggaaacttttccctgaggacatgattctgaactggtttacacaaatgtgtctgggtgttaatcacatacataaaaaaagggtgttacatcgcgatattaaatccaaaaacattttcctgacacaaaacggcaaggtcaaactcggtgactttgggtccgctcgcctgttgagcaaccctatggcgttcgcatgcacctacgtcggcaccccatactatgtcccacctgagatctgggaaaacctaccatacaacaacaaaagtgatatttggagcctcggatgcattctgtatgagttatgcacgttgaaacacccattccaggccaacagttggaagaacttgatcctgaaagtatgtcagggttgtattagtcctcttccaagtcattatagctatgagctccaatttctggtgaaacagatgttcaagcgcaaccctagtcacaggccgagcgctaccacactcctttcaagaggaatcgtcgctcggctcgtgcagaagtgtctgccacccgaaatcataatggagtacggtgaggaggtgttagaggaaattaagaacagcaaacataacaccccccgcaaaaaggccaatcctagtcgaataaggattgccttggggaacgaagcctctaccgttcaggaggaggagcaggaccggaagggaagccacaccgaccttgaatctataaacgagaatctagtggaatcagcactccgccgtgtgaatagagaggagaaaggtaataagtctgttcacttacggaaggcctcctcaccaaacctccacagaaggcagtgggagaaaaacgtgcctaacacagctctgacagctcttgagaatgcttccatcttgacatcttcactcactgcggaggatgacaggggaggctccgttataaagtactctaagaacaccactcgaaaacaatggctcaaggagaccccagacaccttactaaatattctgaaaaatgcggacttgtctctggcctttcagacatacacaatctataggccaggcagcgaaggtttccttaagggacctctgtctgaagagaccgaggctagtgacagcgtggatgggggacatgattccgtaatcctcgatccagagaggctcgaacccggtttggatgaggaagacaccgattttgaagaggaggatgataaccctgactgggtgtcggagctcaagaaacgggccggatggcaagggctttgtgatcgctag

SEQ ID NO: 126543 - DNA, 1521 bp, Artificial Sequence
  Description of Artificial Sequence: Synthetic coding sequence
atggacgattacatggttttgcgaatgattggagagggcagctttggccgagccttgctggtgcagcacgaatcatccaaccagatgtttgccatgaaggaaatacggctgccgaaatctttttcaaatactcagaattccaggaaggaagcagttctgctggccaagatgaagcatccaaacatcgttgcattcaaagagagttttgaggcagagggccacctctacattgtgatggagtactgcgatggaggcgacctcatgcagaagataaaacagcaaaaaggcaaacttttccccgaagatatgattctgaactggtttacacagatgtgcctcggtgtgaaccacatccacaaaaagcgggtgctccatcgcgacattaaaagtaaaaacattttcctaacacagaacgggaaggtgaagctgggagactttggttctgcccggctgctctcaaatccaatggctttcgcctgtacctacgtcggaactccctattacgtcccccccgagatctgggagaacctcccctacaacaataagtctgatatctggagtctcggctgtatcctctatgaactctgcacactcaagcatccgtttcaggcgaactcctggaaaaatttaatcttaaaggtctgtcaggggtgcatctctcctttaccaagccactactcatatgaactgcaatttctggttaagcagatgttcaagcgcaacccctctcatcgcccatctgcgacaactttattaagtcgggggattgtcgctcgtttggtacaaaagtgcctacccccagaaataattatggaatacggggaagaagtcctggaagagattaagaattccaaacacaataccccccgtaaaaaagctaatccatcccgaatcagaatcgccttgggaaatgaagcctccaccgtgcaagaggaagagcaggatagaaaaggcagccataccgacctcgaatctattaatgagaatcttgtcgaatctgctctgcgtcgagttaatagggaggaaaaaggcaataagtccgtacaccttcgtaaagccagctccccgaatttacaccggagacagtgggagaagaatgtccctaataccgctttgactgccctggaaaacgcgtctatactgactagttcgctcacagcagaggatgataggggaggatccgtgatcaagtattccaaaaatactaccagaaaacagtggctgaaggagacacccgataccctgttgaatatcctgaagaacgcagacttgagcctagcctttcagacttatacaatctatcggccaggatcggaaggcttccttaagggaccattatcagaagaaaccgaagcatccgacagcgtggacggcggacacgactctgttattctggaccccgagcggctggaaccaggacttgacgaagaggacaccgatttcgaggaagaggacgataacccagattgggtgtcagaattaaaaaagcgtgctggttggcaggggctctgcgatcgctag

SEQ ID NO: 126544 - DNA, 1470 bp, Artificial Sequence
  Description of Artificial Sequence: Synthetic coding sequence
atggacgattatatggtgctcagaatgatcggagagggcagtttcggacgtgcactgctcgtacagcacgagtcatcaaatcagatgtttgctatgaaggaaatcaggttacctaagagtttttctaacacccaaaacagtagaaaggaagccgtgctcctcgcaaagatgaagcaccccaatatcgtagcctttaaggagtcctttgaggccgaaggacacctgtacatcgtcatggaatactgtgacgggggtgacctgatgcaaaagataaagcagcagaaaggcaagctcttccctgaagatatgatactgaattggttcacccagatgtgtctcggtgtgaaccatattcataaaaaacgggtactccatcgggacattaaatccaagaacatttttctcactcagaatggaaaggtcaaactcggagacttcggcagcgccaggctgctcagtaatcccatggcatttgcgtgcacgtatgtaggcactccatactacgtgccaccagagatttgggaaaatctgccctataataataaaagcgatatctggtcactgggatgcattctttacgagttgtgtactttaaaacatccattccaagcaaattcctggaagaatttgatcttaaaggtctgccaaggttgtataagcccactccctagtcattattcatacgaactgcagtttctggttaaacaaatgtttaaacgaaacccatcccacaggccctccgccacaactctgttgagtcggggaatagtggcaagactggttcaaaaatgcctgccgcccgagatcatcatggaatacggggaagaggtgttagaggaaattaagaacagcaaacacaacaccccacgaaagaagcaggaggaggagcaagaccggaagggctcacacaccgatctggagtcgatcaacgagaacctggtggaaagtgccctgcgaagggtgaaccgcgaggagaagggcaataagtctgtacacctcagaaaagccagcagcccgaatctccatagacgccagtgggagaagaacgtgcccaataccgcgttgaccgcgttagaaaatgcctccattttgacttctagtctcaccgccgaggatgaccgcggcggtagcgtcattaaatatagcaaaaacaccacccgcaagcaatggttaaaagaaactccggacactctattaaacatcctcaaaaatgctgacctaagtcttgcttttcaaacctatacaatatatcggcctggcagtgaggggttcctgaaggggccccttagcgaagagacggaagcatcagacagcgtagacggtggtcatgactccgtcatcctggacccggaaagactggagcctggtttggatgaggaggatacagatttcgaggaggaagacgacaatccagattgggtcagtgagctgaagaagcgggctggctggcaggggctatgtgatcgttag

SEQ ID NO: 126545 - DNA, 1533 bp, Artificial Sequence
  Description of Artificial Sequence: Synthetic coding sequence
atgcagttcgggcgtgcccacggagattgcgtttccggagctcaactgtgcggatgtccatctatggatgactacatggtgctcagaatgatcggagagggctcctttggccgggcgctattggtgcagcacgaaagcagtaaccagatgttcgccatgaaggagataagacttccaaaaagcttttcaaatacccagaacagcagaaaggaagctgttctgctggccaagatgaagcatcctaatatcgtggcctttaaggagtcttttgaggccgagggacacctatatattgttatggagtattgcgacggaggcgacttaatgcagaaaatcaaacagcagaaaggcaaactttttcccgaggatatgatcctgaactggtttactcagatgtgccttggggtcaaccacattcacaaaaagcgcgtgctgcaccgggatatcaaatctaagaacatctttctgacacagaatggtaaggtgaaactcggcgattttggtagcgctcgcttactcagcaatcctatggccttcgcctgcacttatgtggggacaccctactatgtgcccccagagatttgggagaatctcccttacaataacaagagcgacatctggtctctgggatgtattctgtatgagctctgcactctaaagcaccctttccaggcaaacagttggaaaaatttgatcctgaaggtctgtcaagggtgcatctcaccgctccccagccattacagctacgagctgcagttcctggtgaagcagatgtttaagaggaaccctagccaccgcccgtccgccaccactctgctgagcagagggatcgtggctaggcttgtccagaaatgcctccctcccgaaattataatggaatacggggaggaagtcctcgaggagataaagaacagcaagcacaatacacctcggaagaagcaggaggaagaacaagacaggaaggggagtcatacagatttggaaagtattaacgagaacttagtggaatctgctcttcgccgcgtgaacagagaggagaaaggcaacaagtctgtgcacttacgcaaagcctcctcacctaaccttcatcgccgacaatgggagaagaatgtgcccaatactgcactgactgcactggaaaatgccagcatcctcacttcgtcactcacggccgaagatgaccgcggcggttcagtgataaagtatagtaaaaatacaacacgcaaacagtggctcaaggagactcccgatactctcctgaacatactgaagaacgccgaccttagcctggcgtttcagacatacactatctaccgtcctgggagtgaaggattcctgaagggccctctgtctgaagaaactgaagctagcgactccgtggatggaggtcatgatagtgtgatcctggaccccgagagactcgaaccagggttggatgaggaggacaccgatttcgaggaagaggatgacaacccggactgggtctccgagctcaagaagcgggctggatggcagggcctttgtgaccgctag

SEQ ID NO: 126546 - DNA, 177 bp, Artificial Sequence
  Description of Artificial Sequence: Synthetic coding sequence
atggatgattacatggtactccgtatgattggcgaagggtcttttgggagggctctgctggtgcagcatgaatccagtaatcagatgtttgcaatgaaagaaatcaggctgccaaagtccttttctaatacccagaattcacggaaagaggctgtgctccttgccaaaatgaaatag

SEQ ID NO: 126547 - DNA, 510 bp, Artificial Sequence
  Description of Artificial Sequence: Synthetic coding sequence
atggctagaggcggagatacaggttgcaccggcccatccgagactagtgccagcggagccgccgctatagcactgcccggtttggagggtccagctaccgatgcacagtgtcagactctccctctcactgtcctgaaatcccgttcgccatctccgcggtcgctcccacccgctttatcctgccccccacctcagccagccatgctggagcatctgtcaagcctgccaactcagatggactacaagggccagaaattggctgagcagatgttccagggtatcattctctttagtgctattgtcggatttatctacgggtacgtggctgaacagtttggatggacagtgtacatcgttatggccggcttcgcattctcatgcctgctcactttgccaccttggccaatctatcgaagacatcccctgaagtggctccccgtacaggaaagttccactgacgataagaaacctggtgaaaggaagataaagaggcacgcaaagaataattag

SEQ ID NO: 126548 - DNA, 2259 bp, Artificial Sequence
  Description of Artificial Sequence: Synthetic coding sequence
atgccactagcagcctattgttacctgagggtggtgggtaaggggtcatacggcgaagtgaccctggttaagcaccgccgcgacggcaaacaatacttacatgaaaaacacatcctgcaccgagatctgaaaacgcaaaatgtcttcctgaccagaaccaacattatcaaagttggagatttgggaatcgcccgagtgctggaaaatcactgtgacatggcatccacacttataggtacaccttactacatgtctcctgagttgtttagtaataagccatataactataagagtgacgtgtgggccctcggctgttgtgtctacgaaatggcaactctcaaacatgcgtttaatgctaaggatatgaacagcttagtctaccgaatcatcgaggggaagcttcctcccatgcctagggattactccccagaattggcagagttaatacgcaccatgctgtcaaagcgacccgaggagcgacctagcgtgcgctctatcttgcgccagccctatataaagcgacagatttctttctttctcgaggcaactaagataaaaacatctaaaaataacatcaaaaatggggactcccagtcaaaacccttcgccaccgtggtctctggcgaagccgaatccaaccacgaggtcatccatcctcagccactgtcaagcgaaggatcacagacatatatcatgggggagggcaagtgcctatcccaagagaagccccgtgcttcaggactgctgaagtcccctgccagcttgaaagcgcacacttgcaagcaggaccttagcaatacaacagagctggctacaatctcgtctgtgaacattgatatcctccctgccaagggcagagattccgttagcgatggcttcgtgcaggaaaaccagcctcggtaccttgacgcctctaatgaattggggggcatctgctctatcagtcaggttgaagaggaaatgctccaggataataccaagtcctctgctcaacccgagaatctgatccctatgtggagctcggacatagtcactggcgagaagaacgaacctgtgaagccgctgcagcccctgatcaaagaacagaaacctaaagaccaaagcctggcactctcaccgaagttggagtgcagcgggactatactcgcacattctaacctgaggcttctgggctcctccgatagcccagcctccgcatcgcgcgtcgccgggatcactggggtgtgtcaccatgctcaggaccaggtggcgggcgaatgcataattgaaaagcaaggccgtatccacccggatttgcagccacacaactctggttcggagccatcgctgagtcgtcaacggaggcagaaacgccgggagcagaccgagcatagaggcgagaaaagacaagtgcgccgcgacttgtttgccttccaagagtctccacccaggtttctcccctcacatcccatagtgggtaaagtggacgtaacttctactcagaaggaagccgagaatcagcggagagtggtcacaggcagcgtgtcttcctctcgttcttccgaaatgagttccagcaaagatagacccctttcggccagagaaagacgtcgattgaagcagtcacaagaggagatgtcatcaagcggaccctcggtgagaaaggccagcctcagtgttgcaggaccaggtaaacctcaggaagaggatcagccattgccagctagaaggctaagttctgactgttctgtgactcaggagcgcaagcagattcattgtctatcagaggatgagctttcttcttcaacaagctccacagacaaatccgacggggactatggggaaggaaagggacagacaaatgagatcaacgccctcgtgcagctgatgacacagacactgaaactggattccaaggagagctgtgaggacgtgcccgtggcaaatcctgtctccgagtttaaactccatcgcaaataccgcgacaccctgattctccacggaaaggtggcagaggaggcagaggaaatccatttcaaagagttgccctcggcgatcatgcctggatcggagaaaatccgccgccttgtggaagtgcttagaactgatgtgatccgtggtttgggcgtgcagctgctcgagcaggtgtatgatctactggaggaagaggacgagtttgacagggaggtgagactgagagaacacatgggcgagaagtataccacctactccgttaaggccagacagttgaagttttttgaagaaaatatgaatttctag

SEQ ID NO: 126549 - DNA, 942 bp, Artificial Sequence
  Description of Artificial Sequence: Synthetic coding sequence
atggccggacaaccaggacacatgccccacggcggaagctccaataacctgtgtcacacattggggcccgttcatccgccagacccccaaagacaccctaacacgctgagcttccggtgttcactggccgactttcagatcgaaaaaaagatcggtagaggtcaatttagcgaggtttacaaagccacttgcctgctggaccggaagaccgtggccctgaagaaggtccagatctttgagatgatggacgcaaaagcccgacaggattgcgtaaaggagatcggcctgctgaaacagctcaatcaccctaatatcataaagtatctggatagtttcatagaggacaatgagctgaacattgtcctcgagctggcagacgctggcgatctttcccaaatgattaagtattttaagaagcaaaaacgattaattcctgaaagaaccgtgtggaaatacttcgtacagctatgcagtgcggtggagcacatgcacagtagacgggttatgcatcgtgatatcaagcccgcgaacgttttcataaccgcgacgggcgtcgtgaagcttggagacctgggcctcggtagattcttcagctctgaaacaactgctgcgcatagtcttgttggtacaccatactatatgtcaccggagcggatccacgagaatggctacaatttcaaatcagatatctggtcacttggctgcttactctacgagatggccgcgctccagagtcctttctacggtgataagatgaaccttttttccctgtgtcagaaaatcgagcagtgtgactatccgccactgccaggcgagcattattccgagaaactgcgggaactggtctcaatgtgtatctgccccgatcctcaccagcgacccgatatcgggtatgttcaccaggtggcaaaacaaatgcatatttggatgagtagcacatag

SEQ ID NO: 126550 - DNA, 624 bp, Artificial Sequence
  Description of Artificial Sequence: Synthetic coding sequence
atggccggacaaccgggtcacatgccacacggggggtcttcaaacaacctgtgccatactcttgggcccgtacatcctcctgatccccagcgccatccaaacaccctgtcctttcgatgtagtctcgccgatttccaaattgaaaagaagattgggcgtggccagttttccgaggtgtacaaggccacatgcctgctggacagaaagacggtcgccttgaaaaaagtgcagatatttgagatgatggacgccaaagcccggcaggattgcgtcaaggagatcggacttctcaagcaattaaatcatcctaacataattaaataccttgactccttcatagaagacaatgagctaaatatagtgctggagcttgcagacgccggggatctatctcagatgattaagtatttcaagaagcagaagcggcttattcccgagaggactgtatggaaatatttcgttcaactctgttcagcagtagagcatatgcatagtagacgcgtgatgcacagggacattaaaccagctaatgtatttattacagcaactggggtggtgaaactaggggacctaggtttggggaggttcttcagctctgagacaaccgctgcccatagtctgtag

SEQ ID NO: 126551 - DNA, 1044 bp, Artificial Sequence
  Description of Artificial Sequence: Synthetic coding sequence
atgccacggagagaggtgtgctgggaggctgctcactttcgccaggaggaacagagcctgcccagacctagagttagggcactggtacgcttagcatgtcgaatggccggccagcccggacacatgcctcacggcgggagctcgaacaatctatgccacacactgggcccggtacatccaccagacccacagagacaccctaacaccttgagtttccggtgctctttggctgattttcagatcgaaaaaaaaattggcagaggtcagtttagtgaggtgtacaaagctacctgtcttttggataggaaaaccgttgccttaaaaaaggtacagatttttgaaatgatggatgcgaaggcaagacaagattgcgttaaggagattgggttactgaagcagctgaaccatcctaacataatcaaatacctggatagctttatcgaggataacgagcttaacattgtcttggagttagcggacgcaggagacctgtcccagatgatcaaatattttaagaaacagaagcgcctgatcccagagcggacagtctggaagtacttcgtgcagctgtgttctgcggttgagcacatgcacagccgccgcgtgatgcatagagacataaagccagcaaacgtgttcattactgctacaggcgtggttaaattaggcgatttaggcctgggcaggttctttagctcagaaactacagccgcccattcattagtgggtaccccttattacatgtctccagaacgtatacacgagaatgggtataattttaaaagcgacatttggtcccttggctgtttattgtacgagatggccgccctgcagtcccccttttacggggataaaatgaacttgttttccctatgtcagaagatcgagcaatgcgactatcctcctttgcctggagaacattattctgagaagttgagggaactagtgagcatgtgtatttgtcccgaccctcaccaacgccccgatattggctacgtgcatcaagttgccaagcagatgcacatctggatgtcttcgacctag

SEQ ID NO: 126552 - DNA, 738 bp, Artificial Sequence
  Description of Artificial Sequence: Synthetic coding sequence
atggctggccagcctgggcatatgccacacgggggatctagtaacaacctgtgtcatactttagggcccgtccacccccctgatccacagcagctgaaccaccctaatataatcaagtacctagatagcttcattgaggataacgagttgaacattgtgctcgaattagctgacgccggggaccttagccagatgatcaaatattttaagaagcagaaacggctaatcccagagcggacggtgtggaagtacttcgtgcagctgtgcagcgccgttgaacacatgcactctcgccgggtaatgcaccgggacattaagcccgccaacgtgtttataactgccaccggggtcgtgaagctcggcgaccttgggttgggaagatttttctcgagcgaaaccactgctgctcacagtcttgtaggcacgccctactacatgtcgccggaacggatacatgaaaatggttataatttcaaaagcgatatctggtccctgggatgcctgctgtatgagatggccgcactccaatctcctttttacggagacaaaatgaatctcttctctctttgccagaagatcgagcaatgtgactatcctccattgcccggcgagcattactccgagaagctgcgggagctggtatccatgtgcatctgccctgatccccaccagaggccagatattggctatgttcaccaggtggccaagcaaatgcacatttggatgagctccacttag

SEQ ID NO: 126553 - DNA, 942 bp, Artificial Sequence
  Description of Artificial Sequence: Synthetic coding sequence
atggctggccagcccggtcacatgccccacggagggagttcaaataacctatgccatactctgggccccgtgcaccctccggacccacaacggcaccccaacactctgtcatttcgatgtagtcttgcagacttccagatagagaaaaagatcggacgcggccagttttctgaagtctacaaggccacatgcctgctggatcggaaaaccgtggctctgaagaaggtgcagatatttgagatgatggacgcaaaggctcgacaggattgtgtgaaggagatcggacttctgaagcagctgaaccatccaaacatcattaaatacttagactcctttattgaagataatgagctaaacattgtgctggagctggccgatgccggcgatctgtcgcagatgatcaaatattttaagaagcagaagcggctgatcccagaacggacggtctggaaatatttcgttcagctgtgttcagcggtggaacacatgcacagccggcgcgtcatgcaccgagacattaaacccgccaatgtctttatcaccgcaacgggcgtcgttaaactgggtgatctgggtctgggtcggttctttagcagcgaaacgactgccgcgcactctcttgtgggtacaccctattatatgtcgcccgagcgaatccacgagaatggatacaactttaaatcagacatatggagcctgggatgtctgctgtacgagatggccgccctgcagtcgcctttttacggtgataaaatgaatttgtttagcttatgtcagaagattgagcagtgcgactacccccctctcccgggtgagcactacagcgagaaactgagagagctcgtttctatgtgcatatgccctgatcctcatcagaggccagatatcggctacgtgcatcaagtcgcgaaacagatgcacatctggatgagttcaacatag

SEQ ID NO: 126554 - DNA, 1044 bp, Artificial Sequence
  Description of Artificial Sequence: Synthetic coding sequence
atgccgcgtcgcgaggtttgctgggaggctgcccacttccgtcaagaggaacagtcactcccccggcctagagtgcgggcgctcgtacgcctcgcctgcaggatggctgggcagccaggacacatgccccacggtgggtccagtaacaacttatgccatactcttggacctgttcatccgccagatcctcagaggcaccctaacacactatcgttcaggtgctcactggctgacttccaaatcgaaaaaaaaatcggcaggggccagttttctgaagtgtacaaggccacttgccttctggacaggaagacagtggcccttaagaaagtgcaaatcttcgagatgatggacgcaaaagcacgccaggactgcgtcaaggagatagggcttctaaaacagttgaatcatcctaacataataaagtacttggattccttcattgaggataatgagctgaacatcgttctcgagctagctgacgcgggcgatttgtctcaaatgatcaagtatttcaagaagcagaagagactgatcccagaacgcaccgtctggaagtatttcgtacagctttgctctgcggtagagcatatgcacagtcgccgagtgatgcatagagatatcaaaccagcgaacgtgttcattacagccacaggggtagttaagctcggagaccttgggctaggaagattcttctcctcagagacaacagcagctcacagtctcgttggcaccccttattatatgtctccagaacgaattcatgagaatggctataacttcaaatccgacatttggtcactagggtgtctcctttatgaaatggccgccctccaatcccccttctatggcgacaaaatgaacctcttctcactctgccaaaagatcgaacagtgtgactaccccccactgcccggggaacattacagcgagaagctgcgagagctcgtaagcatgtgtatttgtcctgatccacatcagcgtcctgatatcggctatgtgcaccaagtggcaaaacaaatgcacatttggatgtcctccacatag

SEQ ID NO: 126555 - DNA, 663 bp, Artificial Sequence
  Description of Artificial Sequence: Synthetic coding sequence
atggcaggccagcctggtcacatgccccatggagggagtagcaataacttgtgccacacactcggacccgtgcacccccccgatccccagaggcacccgaacactctatccttcaggtgtagcttggctgatttccagatcgaaaagaagattggcagggggcagtttagcgaagtctacaaggccacctgccttctggatcggaagactgtagcgctgaagaaggtgcaaatttttgaaatgatggatgcaaaagcaagacaggattgcgtcaaggaaatcggacttttgaaacagctcaaccaccccaacatcattaagtatcttgactcttttattgaagataatgaactgaatatagtgctggagctggcagatgcaggagaccttagtcagatgattaaatacttcaaaaagcagaagcgcctcatccctgaacgtaccgtctggaaatactttgtccaactgtgtagtgccgtggagcacatgcacagccggagggtgatgcacagagacatcaaacccgcaaacgtgttcatcaccgccactggtgtggttaaactgggcgacctcggtctcgggagatttttttcatcagagacaacagccgctcatagcctggtaggaacaccctactacatgagccctgaacgtatacactag

SEQ ID NO: 126556 - DNA, 585 bp, Artificial Sequence
  Description of Artificial Sequence: Synthetic coding sequence
atgccccgccgtgaggtctgctgggaggcagcccattttaggcaggaggaacagtccctgcctcggccgcgcgtaagggcgctggtgcggctggcttgtcggatggccgggcagccaggacatatgccacatggtggatcatccaataacctgtgccacaccttaggtcccgtgcacccaccagatccccagaggcaccctaataccttgtcatttaggtgttcccttgctgacttccaaatcgagaaaaagattggccgcggacaatttagcgaggtctacaaggcaacctgtcttctggatagaaaaactgtcgccctcaagaaggtgcagatcttcgaaatgatggacgccaaagcccgtcaggactgtgtgaaggagatcggactgttgaaacagctaaaccaccccaacattattaaatacctggacagcttcattgaagacaacgaattaaatattgtactagagcttgccgacgcaggagacctgtcccagatgattaaatactttaagaagcaaaaaagactcattcccgagcggacagtctggaagtattttgtgcagttgtgctccgccgtctag

SEQ ID NO: 126557 - DNA, 669 bp, Artificial Sequence
  Description of Artificial Sequence: Synthetic coding sequence
atggccgggcagccaggccacatgccccacgggggcagtagcaacaacctgtgccatacgcttggcccagtgcatcctcccgacccccagcgccatccaaatactctctccttccgctgttccctggccgatttccagattgaaaagaaaatcgggcgaggccaattttccgaagtctataaagcaacatgcctgctggatcggaaaacagtggcactcaagaaggtgcagatcttcgagatgatggacgcaaaagcacgacaagattgcgtgaaagagatcgggctcttgaagcagctcaaccatcctaacatcattaagtatcttgactcctttattgaagataacgagctgaatatcgttctggaactggctgacgccggcgatctgtcccagatgatcaaatacttcaagaaacagaaacgattgataccagaaagaacagtctggaaatacttcgtacaactgtgttcagctgtcgaacatatgcatagccggcgagttatgcacagggacatcaaacctgctaacgtgttcatcacagccacaggcgtggtaaaattgggcgacctgggccttggcaggttcttctcatctgagactaccgcagctcatagcctggtggggactccctattacatgtcccctgagaggattcatgagaactag

SEQ ID NO: 126558 - DNA, 660 bp, Artificial Sequence
  Description of Artificial Sequence: Synthetic coding sequence
atggctggccaaccaggccacatgccccacggaggatccagcaataatctctgccatacactggggcctgtgcacccaccagatccccagcgacaccccaacaccctctcctttcgctgctccctagcggacttccagatcgagaaaaagattgggcgcgggcagttttcagaagtgtataaagcgacctgtcttctggaccgcaaaactgtcgcccttaaaaaggtccagatttttgagatgatggacgcaaaagcgcggcaggactgtgtgaaagaaattgggctgcttaaacaacttaatcatcccaacatcattaagtacctggactccttcatcgaggacaacgagttgaacatcgtgctagagctggctgatgctggtgatctctcacaaatgattaaatacttcaagaagcaaaagaggctgattcccgagcgaaccgtgtggaaatattttgtacagctctgttctgccgtggagcacatgcacagcaggagagtgatgcacagagatataaagcctgctaacgtgttcatcacagccactggggtcgtcaaactcggggatctcgggctgggtcggtttttctccagtgagacaaccgccgcccattcactagttggaacaccttactacatgtcccctgaacggatttag

SEQ ID NO: 126559 - DNA, 516 bp, Artificial Sequence
  Description of Artificial Sequence: Synthetic coding sequence
atggccggacaacccgggcacatgcctcatggaggctcaagcaacaatttatgccataccctaggcccggttcacccccctgatccccagagacatccaaacaccctgtcattccgatgctcccttgccgacttccaaattgagaagaaaattggcaggggtcagttctccgaggtgtacaaggccacgtgtctcctggacagaaagacagtcgctcttaagaaggtacagatctttgagatgatggatgccaaagcccggcaggattgtgtgaaagaaattggtctgctaaaacagttgaatcaccccaatatcatcaaatatttggactccttcatagaagataatgaactcaatatagtactggagctggccgacgcaggggatctgtcacaaatgattaaatactttaagaagcagaaaagattgatccccgagcgcaccgtttggaaatacttcgtgcagctgtgctccgcagtcgagcacatgcactctcgccgagtgatgcataggtag

SEQ ID NO: 126560 - DNA, 606 bp, Artificial Sequence
  Description of Artificial Sequence: Synthetic coding sequence
atggctgggcagcccggccatatgccccatggaggaagctccaacaacttgtgccacactctcggacctgtgcatcctccggatccgcagcagctcaatcatcctaacataatcaagtatcttgactcttttatcgaggataacgaactgaatatcgtgttggagctcgcagacgccggcgatctgtctcagatgattaaatacttcaagaaacagaaaaggttgatccctgagagaaccgtgtggaaatacttcgtccaattgtgctccgcagtcgagcacatgcactcgcgtagagtgatgcatagagacatcaaacctgctaacgtttttattacagctaccggcgtggtgaaactgggcgatttgggactgggccgattcttttccagcgagaccactgccgctcacagtttggtggggacgccctactatatgtcaccagagagaatccatgaaaacggatataacttcaaatctgatatttggtccctcggatgcctgttgtacgagatggccgccctgcagagcccattctacggcgacaagatgaacttattcagcctgtgccagaagattgagcagtgcgactaccctccattatag

SEQ ID NO: 126561 - DNA, 1017 bp, Artificial Sequence
  Description of Artificial Sequence: Synthetic coding sequence
atggaagccaccggatgggactcacggtgcagccccggcacgcaggtgcgcgcactggttcgattagcctgtagaatggccggccaacccgggcacatgccacacggaggtagctccaacaacctgtgccatacgctaggtcctgtgcaccctccagaccctcagaggcacccaaacacactgagctttcgatgcagcttggctgattttcagattgaaaagaaaatagggaggggtcagttttctgaagtgtacaaagcaacctgtcttctagatagaaagactgtcgctttgaagaaagttcagatttttgaaatgatggatgctaaggctagacaggattgcgtgaaggaaattggtctgctgaagcagctgaatcatcctaacattatcaagtatctggactcttttatagaggacaatgagcttaatatagtgttggagttggccgatgcgggggatttgagccaaatgattaaatacttcaagaagcagaaaagacttatcccagagcgcactgtttggaagtactttgtccagctctgtagcgcggtggagcatatgcacagccgccgagtgatgcaccgtgacatcaaacccgccaatgtttttataaccgctaccggcgtggttaaactgggcgatcttggcctcggtaggttctttagctctgagaccacggcagctcattctcttgtaggtaccccttattatatgtccccagaacggattcacgagaacggctacaactttaagtcagacatttggagcttaggttgtttactgtatgagatggccgctttacagtcaccattttatggcgacaagatgaatctctttagtttgtgccagaagatagagcagtgcgattacccgccccttcccggcgagcactattcagagaagctgcgggagttggtcagtatgtgcatctgccccgatccccatcagcgaccagacattggttacgtgcatcaggtggctaaacagatgcacatttggatgtcttccacttag

SEQ ID NO: 126562 - DNA, 996 bp, Artificial Sequence
  Description of Artificial Sequence: Synthetic coding sequence
atgggccggagacggccggcaccttttcgggcactagtgcggctagcatgcagaatggcagggcagccggggcatatgcctcatggcggatctagtaacaacctgtgccataccttagggcccgtacatccccctgacccgcagagacacccaaatactctgtctttccgatgcagccttgcggactttcagatcgaaaagaaaatcggcagagggcagtttagcgaagtttacaaggccacctgccttcttgaccggaaaacagtggcactcaaaaaagttcaaattttcgagatgatggacgctaaagctcgtcaagattgcgtgaaagaaatcggtctgctcaagcagttgaatcatcccaacattatcaaatatctggattctttcattgaagataacgaactcaacattgtactggagttggcagacgcgggtgacttgtcccagatgattaaatactttaagaagcaaaagaggcttattcctgaaagaaccgtatggaaatactttgtccagctctgcagtgctgttgaacatatgcactctcgacgggtgatgcaccgagacatcaagcctgcgaacgtgtttattactgcgacaggagtggtgaagctgggagatttgggtcttggccggtttttttcctctgagaccacagcggcccatagtctggtgggcacaccctattatatgtcgcccgagaggatccatgagaatggatataattttaaatcagacatttggtcgctaggatgtctgctgtacgagatggcggctctccaatctcccttctatggggataaaatgaatcttttttccctgtgtcagaagatcgagcagtgcgactatccacccctcccaggggagcattattctgagaagctgcgcgagctcgtgagcatgtgcatctgtcccgatccacaccagaggcctgacattggatatgtgcaccaggtggccaaacagatgcacatttggatgagtagcacctag

SEQ ID NO: 126563 - DNA, 942 bp, Artificial Sequence
  Description of Artificial Sequence: Synthetic coding sequence
atggccggccagcccggccatatgccccacggtggttcttcaaataatctctgccacacgttgggaccggtccacccacccgaccctcagagacatcctaatacactttccttcaggtgcagcctggccgattttcagatcgaaaagaagatcgggcgagggcaattttcggaggtgtacaaggccacttgcctgcttgaccgtaagactgtggccctgaagaaagtgcagatcttcgaaatgatggacgccaaagcccgtcaggactgcgtgaaagagataggactgctgaagcaattaaaccatcccaacatcattaagtacctggattcattcatcgaagacaatgagctcaatattgtgctggaacttgccgacgccggggacctgtcccagatgataaagtatttcaagaagcagaaacgactgataccggagagaactgtgtggaagtactttgttcagctttgttctgcagtcgagcacatgcactccagacgggtaatgcatcgcgacataaagccagccaacgtgttcataaccgccactggggtggtgaagctcggggaccttggactaggccgatttttctcctcagagaccaccgcagcccactcactcgtgggtacgccttactatatgagccccgagcgcattcatgagaacggatacaacttcaaatctgacatttggtccctgggatgcctgctctatgagatggccgcgttgcagagcccattctacggcgacaagatgaatctctttagtctctgccagaagatcgaacagtgtgactacccccctctgcctggcgagcattatagcgaaaaactccgggagcttgtttcaatgtgtatatgtcctgatccacatcagagacctgacatcggctacgtgcatcaagttgctaagcaaatgcacatctggatgagcagtacatag

SEQ ID NO: 126564 - DNA, 942 bp, Artificial Sequence
  Description of Artificial Sequence: Synthetic coding sequence
atggccggacagcctgggcacatgcctcacggaggaagttccaataacctttgtcacaccctggggcccgttcatccaccagatccacagcggcacccgaacaccctttccttcagatgttcactggccgactttcaaattgaaaaaaagatcggacgcgggcagttctccgaggtgtataaagctacatgcctattggaccgcaaaaccgtggcactgaagaaggtgcagattttcgagatgatggacgccaaagccaggcaggactgcgtgaaagaaatcggactgctgaaacagctgaaccaccccaatataattaagtatcttgacagcttcattgaagacaatgagctgaatattgtcttggaactcgccgacgccggagatttatcacagatgattaaatattttaagaagcaaaagaggctgatccctgagaggaccgtctggaaatattttgtacagctgtgctctgccgtcgagcacatgcacagtaggcgggtaatgcatcgcgatattaaaccggctaatgttttcattacagcaaccggagtggtgaagcttggcgacctcggcctgggccgattcttcagtagtgagaccaccgccgcgcattccttggtcggcaccccatattatatgagtcctgagcggattcacgagaacggatacaacttcaaaagtgacatctggtccctcggttgcctcctgtatgaaatggctgctctgcagtcacctttttatggggataagatgaatctgttctccctatgtcagaaaattgagcagtgtgactatccgcccttgccaggtgagcattatagcgaaaaactgagggaactggtgagtatgtgcatttgtcccgatccccaccaaaggccggatataggctatgtgcaccaggtcgctaagcagatgcacatttggatgagcagcacctag

SEQ ID NO: 126565 - DNA, 909 bp, Artificial Sequence
  Description of Artificial Sequence: Synthetic coding sequence
atggacgagcagagtcaaggcatgcaggggccccccgtgcctcagtttcagccccaaaaggcattacgtccggatatgggatataataccctggctaattttcgcatcgagaaaaagattggccgcggtcagttttcggaggtgtaccgagcagcatgcctccttgacggtgttcctgtggcactcaaaaaagtacagatcttcgatctgatggacgctaaggcccgcgctgactgcatcaaggagatcgatttgttgaagcaactgaaccacccaaatgttatcaagtactatgctagctttatcgaggacaacgagctaaatatcgtcctggagctggcagacgcaggagacttatcccggatgatcaaacactttaagaagcagaagaggctcattcccgagcggactgtctggaagtacttcgtgcagttgtgcagcgcgttggagcacatgcactctaggagggtcatgcatcgggacataaagccggctaatgtattcataaccgcaactggcgttgttaagctcggagatctgggtctcggtcggttctttagctccaagaccaccgcagcgcattcgctggtgggaacaccttactacatgtctcccgagcgcatccatgagaacggctataattttaagagcgacatctggagcctgggctgcctgctctatgaaatggcagccctgcagtctcccttttacggggacaaaatgaacctttattccctgtgcaagaaaatcgagcagtgcgattaccccccattgccatcagatcattatagcgaagaactgaggcagctggtgaatatgtgcatcaaccctgatcctgagaaacgacccgatgtaacctacgtgtatgatgtggctaagaggatgcacgcgtgtacggcctcttcttag

SEQ ID NO: 126566 - DNA, 249 bp, Artificial Sequence
  Description of Artificial Sequence: Synthetic coding sequence
atggacgaacagtcacagggcatgcagggcccacctgtgccccaattccagccccaaaaggccctccggcccgatatgggatataatacactggctaatttccgaattgagaagaagataggccgcggccagttttccgaggtttacagggctgcgtgcctgcttgacggcgtccctgtggctttaaagaaagtgcagatatttgacctgatggacgcaaaggcccgagcagattgtatcaaggagtag

SEQ ID NO: 126567 - DNA, 99 bp, Artificial Sequence
  Description of Artificial Sequence: Synthetic coding sequence
atggatgagcagtcccaaggcatgcagggacctccggtaccacagtttcaaccccagaaggcactgaggcctgatatggggtataacaccctcgcatag

SEQ ID NO: 126568 - DNA, 909 bp, Artificial Sequence
  Description of Artificial Sequence: Synthetic coding sequence
atggatgagcagagccagggtatgcaggggcctccagtcccccagttccagccccagaaagcattacggccggacatgggctataacaccctggccaactttcgcatcgaaaaaaagatcggcaggggacagttctcagaggtctacagggcagcttgcctactcgatggcgtgcctgtcgctttaaagaaggtacagatctttgacttgatggacgccaaggcccgggcagactgtatcaaggagattgatctcctgaaacagctcaatcaccctaacgtgatcaaatattacgcaagcttcattgaggataatgagctcaatatcgttcttgagctcgctgacgctggcgatctgtccaggatgatcaaacacttcaagaaacagaagagactcattcctgagaggaccgtttggaagtactttgttcaactttgcagcgcactggagcatatgcattctcgacgcgtaatgcatcgggatattaagcctgctaacgttttcatcaccgccaccggtgtagttaaactcggcgatttgggtctgggcaggttctttagctccaaaaccactgccgcccactccctggtaggaaccccctactacatgtctcccgagagaattcacgaaaacggatataatttcaaaagcgacatatggtctctcggttgtttgctgtacgagatggcagccctacagagcccgttctacggggataagatgaacctttacagtctatgcaaaaagattgaacagtgtgattatccccccctgccatcagatcactattctgaagagctcaggcagttagtgaacatgtgtattaatccggatcctgaaaaacgcccagatgtgacgtacgtgtacgatgttgctaaacgaatgcacgcgtgcactgcctccagttag

SEQ ID NO: 126569 - DNA, 189 bp, Artificial Sequence
  Description of Artificial Sequence: Synthetic coding sequence
atggatgagcagagccaaggcatgcagggtcccccagtgccccagtttcaaccacagaaagcactccgtcctgacatgggctataacaccttggcgaattttcgcatcgaaaagaagatcggcagagggcagttctcagaggtttaccgagcagcgtgtttacttgatggtgtgccagtcgccctctag

SEQ ID NO: 126570 - DNA, 3729 bp, Artificial Sequence
  Description of Artificial Sequence: Synthetic coding sequence
atggaaaagtatgtgagacttcagaagatcggggagggctcatttggaaaggccattctggtgaagtcgactgaagatgggcgccagtacgtaatcaaagagattaacatttcgaggatgagcagcaaagagagggaggagtccaggcgggaggtggcagtcttggccaacatgaaacacccaaacatagttcaataccgagagtcattcgaagagaacggaagtctttatattgttatggattactgtgaggggggggatctgttcaaacgcattaatgctcaaaaaggagtgctatttcaggaagaccaaattctagattggtttgtgcaaatttgcctggcactcaagcacgtccatgaccgaaagatcttgcaccgggacatcaaaagtcagaatatatttttgactaaggatgggacagtccaactgggggatttcggcatcgcacgtgtgctgaactctaccgtcgagttagcccgaacatgtatcggaactccctactacctgtctcccgagatctgtgagaataaaccttacaacaataaatcagacatctgggcactcgggtgtgtattgtatgagctgtgcaccctgaaacacgcttttgaggctggttccatgaagaatttggtactcaaaatcattagcggttctttccctcccgttagtttacattactcatacgatcttcggagtcttgtgtcccagctgtttaaaaggaaccctagagacagaccatctgtgaactctattctcgaaaaggggttcatagccaagcggatcgagaaatttttaagtcctcaattaatagcggaagagttctgtctgaagacgttttcaaaatttggatcccagccaatccccgcgaagagaccagccagcggccaaaatagtatctccgtgatgcccgctcagaaaatcacgaaacctgcagctaagtatggcatccctctggcttacaagaaatacggtgataaaaagctgcacgaaaagaagcctctgcaaaaacacaaacaggcccaccagacccctgaaaagcgggtgaacaccggagaggaacgacgcaaaatcagtgaagaagccgcccggaaaagaaggctagagttcattgagaaagagaagaagcagaaagaccagataataagtctcatgaaagcagagcagatgaaaaggcaggagaaagagcgactggagaggatcaaccgggctagggagcagggatggcgcaatgttctcagcgcaggaggcagcggtgaagtcaaggcgccctttctgggcagtggagggacaatcgctccaagtagcttttcctctcgaggccagtacgagcactaccacgccatcttcgatcagatgcaacagcagcgcgccgaggataatgaagctaaatggaaaagagagatctacggccgcggcttacctgagcgccagaagggacagcttgctgtcgaacgcgcgaaacaggtcgaagagtttctgcagcgtaagagggaggcgatgcagaataaagctcgggccgaaggccatatgggaatactgcagaacctggcggcaatgtacgggggccgcccctccagctctcgggggggcaaaccacgtaacaaggaagaagaagtttatcttgcacggttaagacagatccgcttgcagaattttaacgagaggcagcagataaaggctaaattacgcggggagaagaaggaagctaaccactctgagggccaggaaggctctgaggaagctgacatgagacggaagaagatcgaatccctcaaagcgcatgcgaacgcccgggctgcagtactgaaggagcaattagagcggaagcgcaaggaggcttatgaaagggaaaaaaaagtctgggaagagcatttggtggccaaaggggtgaagtcaagcgatgtgtctccccccctgggccagcatgagacaggaggctccccaagtaagcagcaaatgcgctcagtgattagcgttactagcgccctgaaggaagtaggggtggactccagtctaacggatactagagaaacttccgaggaaatgcagaagaccaacaacgctatcagttctaagcgtgagattctgaggagattaaacgaaaacctgaaagctcaggaggatgagaaagggaagcaaaatttgtccgatacatttgaaattaacgtgcacgaggacgctaaggagcacgagaaagaaaagtcagtatcctctgaccggaaaaagtgggaggctgggggccaattagtaattcccttggacgagttaacgctggatacatcattttcgacaactgagagacataccgttggcgaggttattaagctgggtcccaacggctctccccgcagggcctggggcaaaagcccgaccgactcagtactcaaaatattgggcgaggcggagctacaattacagactgagcttttggaaaataccaccatcagatctgaaataagtccagagggtgagaagtataaacccctgatcaccggggagaaaaaggtgcagtgcatttcacacgaaatcaacccgtctgcaattgtagatagtccggtagagaccaagtcaccagagttcagcgaagcgagccctcagatgtccttaaaattggagggtaacctggaggagccagacgacttagagacggagattctgcaagaaccctccgggaccaacaaagacgaatccctgccctgtaccattacggatgtgtggatcagcgaggagaaggagacaaaggagacacaaagtgccgatagaattactattcaggagaatgaagtgtcagaggatggcgtgagtagcaccgttgatcaactgtctgatattcatatcgagcctggcacaaacgacagccagcattcgaaatgtgatgtggacaagtcagtgcagcccgagcctttttttcataaggtcgtacactccgagcatttgaacctggtgccccaggtgcaaagcgtgcagtgctcccccgaggaatcctttgccttccggtctcattctcatctgccgccaaaaaacaagaataagaattcgctcttaattgggctgtctacgggcctctttgatgccaacaatcccaagatgttaagaacatgtagcctgccagatttgtccaaactgtttcgtactttgatggatgtgcccacggtgggtgacgtacgacaagacaatctggagatcgatgaaatcgaggacgaaaacattaaggaggggccaagcgatagtgaagacattgtgttcgaggagaccgacactgaccttcaggagctgcaggctagcatggagcagctgttgagagaacagcccggtgaagagtattccgaagaggaggaatccgtcctaaaaaattctgacgtggagcctacggcgaatggaactgacgtggctgatgaggatgacaatcccagctccgagtccgcgctgaacgaagagtggcacagtgacaattctgatggagagattgcttcagagtgtgagtgtgattccgtgtttaatcatctggaagaacttcgtctccacctggagcaagaaatgggctttgaaaaatttttcgaagtgtacgaaaagatcaaagctatccacgaggatgaggacgagaacattgaaatatgcagtaagatcgtgcagaacatcctgggcaacgaacatcaacacctatatgccaaaattctgcacctcgtgatggcagatggggcctaccaggaagacaatgacgagtag

SEQ ID NO: 126571 - DNA, 1800 bp, Artificial Sequence
  Description of Artificial Sequence: Synthetic coding sequence
atgctgaaattccaggaggcagcaaaatgtgtgagcggaagcacggccattagtacctatcctaaaaccctgatcgcaaggcgttatgtgctacaacagaagttagggtcgggatcattcggcacagtttatctggtgagtgataagaaggctaaacgcggggaggagctcaaggtgctgaaagagattagcgtgggcgaactgaacccgaacgagaccgtgcaggcgaacttggaagctcagctgctctcaaaacttgaccaccccgctatcgtgaagttccacgcatcttttgtggagcaggacaatttctgtatcatcaccgagtactgtgagggacgtgatttggatgacaagattcaagaatacaagcaagccgggaagatctttccagaaaatcaaatcatagagtggttcattcaactgctgctcggtgttgactacatgcacgaaagacggatcctgcatcgtgacttaaaaagcaagaatgtgtttctcaagaacaacctgctaaagattggagacttcggagtttccagattgttgatgggatcctgtgatctggccactacactgacgggcactccccactacatgtcaccagaggccctcaagcaccagggctacgacaccaagtcagacatatggtccctggcgtgtatactctacgagatgtgttgcatgaatcatgcgttcgctggcagcaattttctgagcatcgtgctgaaaatcgtggagggtgacaccccttccctcccggaacggtaccctaaggagctgaacgcaattatggaatcgatgctgaataagaacccctctctcagaccctcagctattgagattctcaagattccttaccttgatgagcagttgcagaatctgatgtgtaggtacagcgagatgactctggaggataagaacttggattgccaaaaggaagctgcccatattatcaacgccatgcagaaaaggattcaccttcagacgctccgcgcattaagcgaggtccaaaaaatgactccaagggaacgtatgcggctcagaaagctgcaggctgcggatgagaaagccagaaagctgaagaagatcgtggaagaaaagtacgaggaaaattcaaagcgcatgcaggagcttcggagccgcaatttccagcagctgtcagtggacgtcttgcacgaaaaaacccatctgaaaggtatggaggagaaggaagagcagccagagggaagacttagctgttcgccgcaggacgaggacgaagagcgatggcaggggcgagaagaagagtcagacgaacctaccctcgaaaatctgcctgagtcacagcccattcccagtatggacttgcacgaattggaaagcatcgtggaggatgccacctccgatctcggttatcacgagattccggaggatccattagtggccgaggagtattacgctgacgcctttgattcctattgcgaagaaagtgatgaagaggaagaagaaattgctctggagcggccggagaaagagatcaggaacgaggggtcccagcccgcgtatagaactaatcagcaagactcagatattgaggccctggcgcggtgtctggagaacgtgctaggatgcacaagcctcgaccagccctgccgctcatggggccagaagtacttaaaacggagcatcattaccagccgagaacagggcattcgcatgcttgcaaagcaaagatccgccagcgtatggaaaaaatggtgcttgaaaccagccaccgtgctgaaatggacttcatcctgcacccttaaaagcagttgctag

SEQ ID NO: 126572 - DNA, 459 bp, Artificial Sequence
  Description of Artificial Sequence: Synthetic coding sequence
atggactctggcactgaggaatatgaactcaacggaggactgccaccaggcacccccggctccccagacgcttctccagccaggtggggttggcggcacgggccaataaatgtgaatcattatgcctcaaagaagtccgcagcagagagcatgcttgatattgctctgttgatggccaacgcatcacagctgaaggctgtggtggaacaggggcccagtttcgccttctacgtcccactagtggttctgatctccatatctctagtgctgcaaattggcgtcggtgtgctattaattttcctggtgaagtatgacctgaacaacccagcaaagcatgctaaactggattttcttaataatttggccaccggcctggtctttattattgtggtcgtcaacattttcataacagccttcggggtgcagaagcctctgatggacatggctcctcagcagtag

SEQ ID NO: 126573 - DNA, 567 bp, Artificial Sequence
  Description of Artificial Sequence: Synthetic coding sequence
atggctggattatcacggcaactctgcgccctgtctcatccgaaaaaggctgctgagactcagaccgccgaacccggtggagcgcacgccgtgtgctcacgccaccccgtccgggtgaaaggacttgagggcagcgagatggagtctgcgcgagaaaatattgatctacagccaggcagctccgaccctcgctctcaacctattaatctgaaccactatgccactaaaaagagcgtcgccgagtctatgttagatgtcgcactgtttatgtctaacgcaatgagacttaaggccgtccttgagcagggtccttcttctcattactatacgacattagtgacgctgatctccttgtctctgctgcttcaggtagtgattggagtcctacttgtggtgatcgcccgattgaatcttaatgaagtggaaaagcagtggaggctcaatcagctgaataatgccgcaaccatcttagtcttctttaccgtggtcattaacgtcttcattacggcatttggcgcacacaaaactggattcctagctgcccgggcatcgcgcaatcccctatag

SEQ ID NO: 126574 - DNA, 273 bp, Artificial Sequence
  Description of Artificial Sequence: Synthetic coding sequence
atgctcgacgtcgcactgttcatgtctaatgctatgcggttaaaagccgtattggagcaggggccttcgagccactattataccaccctggtgacactgatcagcttgtccttactgttgcaggtcgtgatcggggtactcctggtggtaataggtgaggagccttcacttcagagcgacctgttgcccaggcatccatggttggcagagcgccctcatgtgtcacctggacctccttgtatcggcaccggcagcttcgcaactactcgatag

SEQ ID NO: 126575 - DNA, 1401 bp, Artificial Sequence
  Description of Artificial Sequence: Synthetic coding sequence
atgccaggcgactcttcccctggcaccttaccactgtgggacgcaagccttagtcctcccttgggccctgatccgggagggttctcccgcgcttctcacgcgggagataagtcacggcccccagcgccagagctggggagtccaggcgccgtccgaccacgcgtcggctcctgcgcacctgggccaatggaactgcgcgttagcaacaccagttgcgaaaacggtagcctgcttcacctttactgcagctctcaggaggtcctgtgccagattgtgaatgacctgtcccccgaagtgccttctaatgcaacttttcattcctggcaggagcggattcggcagaactatggcttttatattggcctcggcctggcctttttaagcagcttccttattggctcatccgtgatcctgaagaagaagggcctcctaaggcttgttgctacaggggccacccgcgccgttgacggcggattcgggtacctgaaggatgccatgtggtgggctgggttcctcacaatggccgccggggaggtggccaatttcggagcatacgcatttgcacccgctacagtcgtgacccccctaggagccttgagcgtcctcatctctgcaattctgagcagttatttcctccgtgaatctctcaatctgctggggaagctgggctgcgtcatctgcgtggcaggcagcacagtgatggtgatccacgccccggaagaagagaaggtgacaacgatcatggaaatggcctccaagatgaaggatacagggttcatcgtcttcgccgtgctcctcctcgtgtcctgcctaatactgatctttgtaattgcccctcgttacggccagagaaacattctgatatacattattatttgcagcgtcatcggagcctttagcgttgccgctgttaagggtcttggcatcacaatcaaaaatttctttcagggcctgcctgttgtgaggcacccccttccgtatattctgtctcttatactcgccctatccttatcgacccaagtaaactttctgaatcgcgctttagacatttttaacacctctctggtgttccccatttactacgtcttcttcactactgtcgtcgtgaccagttctattatcttgttcaaagaatggtatagcatgagcgccgttgacatagcagggacgctgtctggttttgtcacaattatattgggcgttttcatgctccatgcctttaaggatctggatatcagctgtgcaagcctacctcacatgcataaaaatcccccgccaagcccagctccagagcccacagtgatacggcttgaagataagaacgtgctggtggataacattgagctggccagcaccagcagtccagaggaaaagccaaaagtctttatcattcacagctag

SEQ ID NO: 126576 - DNA, 1344 bp, Artificial Sequence
  Description of Artificial Sequence: Synthetic coding sequence
atgccaggggacagcagtccgggtacactacctctgtgggacgccagtctgtccccacctttggggccagaccccgggggtttcagcagagcatctcatgcaggggataagagccgccccccggcccccgaactcgggtccccaggagctgtgcgcccgagagtgggaagttgtgcgcccggaccaatggaattgcgagtctccaatacatcttgtgagaatggatccctgttgcacttatattgctccagccaggaagtcctgtgccaaatcgtcaatgatctcagccctgaagtgcccagcaatgcaactttccattcctggcaggaaagaattcggcagaactacggcttttacattgggcttgggctcgcttttttgagtagcttcctcattggatcgtctgttatcctcaagaagaagggactgctacgactcgttgccactggcgcgacccgagccgtcgccgcaggggaggttgctaattttggtgcatatgcctttgcgcctgccactgtagtaactccactgggcgcactatcagtgctcatctcagctatcctctccagctactttcttcgggagagcttgaacctgctaggaaaactgggctgcgtgatctgtgtagccggttccacagtcatggtgatacacgcaccagaagaggagaaggtgaccacgattatggaaatggcctctaaaatgaaggataccggtttcattgttttcgccgtgctgctgctggtcagttgcttgattctcattttcgtgatagcaccaagatacggacagaggaacatattaatttacattattatctgctccgttatcggagctttctccgtcgctgccgttaagggcctcggcattaccatcaaaaatttttttcagggcctgcccgtcgtgcggcacccccttccctacatactgagtcttatacttgcactgagcctgagtacccaggtgaactttcttaatagggcactggacatctttaacacgtctttggtgttcccaatctactatgtattcttcaccactgtggttgtgacttccagtattattctgttcaaagaatggtactctatgagcgctgtcgatattgccggaaccctgagtggatttgtgacaattattctgggggtatttatgttacacgctttcaaggacttggatatttcttgtgcgagtctccctcacatgcataaaaaccccccgccttctcccgctcccgagcccacagtgataagactagaggacaagaacgtgttggtggacaacatagagcttgccagtacctcatcacctgaggagaagcctaaggtctttataatccacagctag

SEQ ID NO: 126577 - DNA, 8415 bp, Artificial Sequence
  Description of Artificial Sequence: Synthetic coding sequence
atgaacggagatatgccccatgtgcctattaccactctcgctggaatcgcttccctgactgacctgctgaatcaactgcctttaccctctcctctgcctgctacgactacaaaaagtctgctcttcaacgcccgaattgcagaggaagtaaactgcctcctggcatgccgcgacgataacctagtctcgcaactagtgcactcgctgaatcaggtgtcaaccgatcatatcgagctcaaggacaaccttggtagcgatgatcctgagggagacataccagtgttactccaggctgtgctggctcggtctcctaatgtcttccgcgagaagtccatgcagaatcgctacgtccagagcgggatgatgatgtctcaatataagctgagtcagaactccatgcattcttcccctgcttcgagtaactaccagcagaccactatttcccatagccccagcagccggttcgtgcctccacagacttcctcaggtaacaggtttatgccacagcagaacagccccgtgccaagtccatacgcccctcagagccctgcaggatatatgccttacagccacccctcctcctataccacccatccacaaatgcagcaagcttcagtgtctagtcctattgtggccggtggcctgagaaacatccacgataataaagtctccggtcccttgagcggaaattcggcaaatcatcatgcagacaaccccagacacggctcctctgaggattatttgcatatggtgcatcgactcagtagcgatgacggcgactccagcacaatgcggaatgctgcatccttcccactgaggagccctcaacccgtgtgttccccggctggatctgagggcacacccaaagggagcaggcctccactcatacttcaatctcagtcattgccctgctcttctccacgggacgtgccccctgatattctgctggactcacccgagaggaaacaaaaaaagcagaagaaaatgaagctaggaaaggatgaaaaagagcagagtgaaaaagcagccatgtatgatattataagctcaccttccaaggacagcacaaaactgaccctgagactgagccgggtgagatctagtgacatggaccaacaggaggacatgattagtggtgttgagaacagtaatgtcagcgagaatgatatccccttcaacgttcagtaccccgggcagacgtctaaaacacctatcacgccgcaggatataaataggcctctgaatgctgctcagtgtctgagccagcaagagcagaccgccttcctgccagcaaatcaggtccctgtgctgcagcagaacacctccgtggctgctaagcagccacagaccagtgttgtacaaaatcagcagcaaatctcccagcagggtccaatctacgacgaagtagaactggatgcgctcgctgagattgaaagaattgagagggaatcagctattgaacgtgagcgcttctctaaagaggtccaggataaggataagccactcaaaaagagaaagcaagactcatatccgcaagaagccgggggcgctaccggtgggaacagacctgcttcccaggagaccggaagcaccggcaacggctcgcggccggcattgatggtatctatcgatctgcatcaggccggtagggtagattcccaggccagcattacgcaggattccgatagtattaagaaaccagaggaaatcaagcagtgcaacgacgcccccgtgtcagttctacaggaggatatagttgggtccctgaaaagcacccccgagaaccacccagagacccccaaaaagaaatcggaccctgaattatcaaaatcagagatgaaacagtcagagtctcgcctggccgaatcgaagcctaacgagaatagactggtcgagaccaaatcttcagagaacaagctagaaactaaggtggaaacccagaccgaggaactgaaacaaaatgagtccaggactaccgagtgtaagcaaaacgagagcaccatcgtggagcccaagcagaacgaaaatcgattgagcgatacaaaaccgaatgacaataaacaaaataacggtaggtcagagaccactaagtctaggccagagaccccgaaacaaaagggagagtcaagacccgagacacccaaacaaaagagtgatgggcatcccgagacccctaaacagaagggggatggccggcccgagacccctaagcagaagggtgagagccggccggaaactccaaaacagaaaaacgaaggacgcccagaaactccgaaacatcgtcatgacaataggagagactccgggaaaccatctactgaaaaaaagcctgaagtaagcaaacataaacaagacaccaaatctgacagtccacgtctaaagtctgaaagagcagaggccctgaaacagcgccctgacggtcgtagcgtgtctgaaagcctaaggagggatcatgataataagcagaaatccgatgatcggggagaatcagagcgacaccgtggtgatcagagtcgcgtgaggagacctgagacactgcgatcatcatcccgcaacgagcacggaattaagagcgactcgtctaaaaccgacaaactggaacgcaaacaccggcatgaatctggcgactcgcgtgaaagacccagctccggtgaacaaaaatcacggccagactcaccaagggtcaagcagggggactctaataagtcaagatcagataagctgggatttaagtctcctactagtaaggacgataagaggaccgagggaaacaaatccaaggtggatacaaataaagcccaccctgataataaggccgagttcccaagctacctcctaggcgggcgcagcggggctctgaagaactttgtcattcccaagatcaagagagacaaggatggcaatgtcacacaagaaaccaaaaagatggagatgaagggggagccgaaggataaagtggagaagataggcctggtggaggatctgaacaaaggagcaaaacccgtagtggtcctgcagaaactgtccttagatgacgtgcagaaacttataaaggatagggaggacaagtcgcggtcctctctgaagcccattaaaaataaacctagcaaaagtaataagggatcaatcgatcaatcagttctcaaggagctgccccctgaactactggcagagattgaatccacgatgccactctgcgagcgagtgaagatgaataagcgaaaacgttccaccgttaacgagaaaccaaagtacgctgaaatttccagcgacgaggataacgacagtgacgaggcgtttgagtcatccagaaagaggcacaagaaagacgacgacaaagcctgggagtacgaagagcgggataggcgaagctctggcgaccaccgtcgcagtggacattcccacgaggggaggcgatccagcgggggcggtcggtaccggaacaggagtcccagtgattctgacatggaagactattcccctcctccctccctttcagaggtggctcggaagatgaagaaaaaggaaaaacagaagaagcgaaaggcctatgagcccaagctgacgccagaggaaatgatggatagcagcacattcaaaagattcaccgccagtatcgagaatattctcgacaacctagaggacatggacttcacagcatttggcgacgatgatgagatccctcaggaacttttgctgggcaagcaccagttgaatgaactagggtcagaaagcgcaaagatcaaggccatgggcataatggacaagctcagcactgataagaccgtcaaagtgctgaatattctggagaaaaacatacaggatggcagtaaactcagcaccctgctcaatcacaacaatgataccgaagaagaggaacgcctgtggagggacttaattatggaaagagttaccaagtccgcggacgcttgcctgacgactatcaatatcatgacatcgccgaatatgccaaaggcggtgtatatcgaggatgtcatcgaacgcgtgattcaatacacgaaattccatctgcagaacacgctgtacccacagtatgatccagtatacagacttgacccacatgggggggggctgttatctagcaaagcaaagcgggcaaagtgctcgacccacaagcagcgggtcatcgtgatgctgtacaacaaagtctgcgacattgtgtcctcactatccgagctgttggagatacagctgttaactgacacaacaatactccaagtaagctccatgggtatcaccccttttttcgtggaaaacgtgtcggagcttcagctctgtgctatcaaactcgttacagcggtctttagtcgatacgaaaagcatcgccaactcatcctcgaagagatatttacgtccctggcacgattgccaacctccaaacgtagcctcaggaactttaggcttaactcgagcgacatggacggagaacctatgtacatccagatggtaaccgccctcgtcctacagctgattcagtgcgtggttcacttgccatcaagcgaaaaggactccaacgcagaggaggattctaacaaaaagatagaccaagacgtcgtgattacaaactcatatgaaactgctatgcgcaccgctcagaatttcttgtcaatattcctgaaaaaatgtgggagcaagcagggagaggaagactaccggcccctttttgaaaattttgtgcaggacttattgtccaccgttaataagccggagtggcctgcggctgagctcctgttatctctgttaggaagactgctcgttcatcagttttcaaacaagtcaaccgaaatggccctcagagtcgcgagcttggattacctggggacagtagccgcccgactgcggaaagatgcagtgacctccaaaatggatcaggggagcattgaacgaattctgaagcaggtgtccggcggagaagacgaaatccagcaactgcaaaaggcactcctggattacttagatgaaaacacagagaccgacccctccttagtgttttcgagaaagttctatattgcccagtggtttagggacacaacccttgagactgaaaaggcaatgaagtctcagaaggacgaagaaagttccgagggcacccatcatgctaaggagatcgaaaccacggggcagatcatgcacagagctgaaaaccgcaagaaattcctcaggagcattatcaagaccacaccttctcagttttccacactgaagatgaactccgacactgtcgactatgatgacgcctgtctgattgttcgctatcttgccagtatgaggccttttgcccagtcattcgacatttacctgacccaaatcctccgggtgttaggcgaaaacgccatagcagtcagaaccaaggccatgaagtgcctgagcgaggtggtcgccgttgatccctccattctcgcaagattagacatgcagagaggagttcatggccgactgatggacaactcgactagcgtaagggaggccgccgtggaactgctcggacgatttgttttgtgccgccctcaactcgccgagcagtactacgacatgcttatcgagcgaattctggacacagggataagcgtcagaaaacgggtcattaagatactgcgggacatatgtatcgagcaacctacttttcctaagattacggagatgtgcgtaaaaatgataagaagggtcaatgatgaagaaggtatcaaaaagcttgtcaatgagacattccagaagctctggtttactccaacaccacacaacgacaaagaggcgatgacccgaaagatccttaacatcaccgacgtggtcgccgcatgtcgggatacaggatatgattggtttgagcagctgttacagaacctgctgaagtccgaggaagactccagctacaagccagtgaaaaaggcttgtacccagctggtcgataatctggtggagcacatccttaaatatgaggagtcactcgccgattctgacaataagggagtcaattctgggcgtcttgttgcctgtataaccaccctgttcttattcagtaaaatccgcccacagctcatggtaaaacacgccatgacaatgcaaccttatctgaccacaaaatgtagtacccagaatgactttatggtaatttgcaatgtggcgaagatacttgagctggtcgttccactcatggaacacccaagtgagacatttcttgcaactatagaagaggatctgatgaagcttataattaaatatggaatgaccgtggtccaacattgcgtttcttgcttgggtgccgtggtgaacaaggtgacacaaaattttaaattcgtttgggcatgtttcaatagatattacggagccatatcaaaactgaagagccagcatcaagaggatcccaataacaccagcctgctcactaataagcctgcactcttacggtcactgtttaccgtcggggcactctgcagacacttcgatttcgacttggaagattttaagggtaattccaaggttaatataaaagacaaagtcctggagctgcttatgtattttaccaagcatagcgacgaggaggtgcagaccaaggccatcattggcctgggtttcgcattcatccagcatcctagcctgatgttcgagcaagaggtaaaaaatctctacaacaacatcctgtcagacaaaaattcatccgtgaacctcaagatccaggtactgaaaaacctacagacttacctacaggaagaagacaccagaatgcaacaggccgatagggattggaaaaaggtggccaagcaggaggacctcaaggagatgggcgatgtgtcctccggaatgtctagttccatcatgcagttgtatcttaagcaggtgctggaagccttctttcatactcagtcttccgtcagacacttcgccttgaacgttattgccttaacgttaaaccaggggctcattcatcccgttcaatgcgtgccatatctcattgccatgggtactgacccagaacccgctatgaggaacaaggcagatcagcagctagtggaaatcgataagaaatacgctggtttcattcacatgaaggccgttgccggcatgaaaatgtcataccaggtacaacaggctattaacacatgcttgaaggaccctgtgagaggtttccgacaggatgagtccagctccgccctttgctcccacctttacagtatgatacggggaaacaggcaacatcggcgcgccttccttatttctttacttaatctgtttgacgatacagcgaaaacggatgtcaccatgctgctctatattgcagacaacctggcatgcttcccctatcagacccaggaagagcccctcttcataatgcaccacatcgacataaccttgtctgtgagcggatccaatttgttacaaagctttaaagagagcatggtcaaggacaagcggaaagaaagaaaaagctcaccttccaaagaaaatgagtcttctgattctgaggaagaagtgtcacgtccccggaagagtcgaaagagggtcgacagtgatagtgactccgattccgaagatgacattaatagcgtgatgaagtgccttcccgaaaattccgccccactgatagaatttgcaaacgtgagccagggcatacttctcctcttgatgctcaagcagcacctcaagaatctttgcgggttcagtgattccaaaatccagaagtacagcccttccgagtccgccaaggtctatgacaaagccattaatagaaaaaccggagtacacttccacccaaagcaaacgttggattttctgcgaagtgatatggcaaatagtaaaatcacggaggaggtaaaaaggtccatagttaagcaatacctggatttcaaactccttatggagcacttggatcccgatgaagaagaggaggaaggcgaggtgagcgcctccactaatgctcgcaacaaagctataacctccctgttgggaggtggcagccctaagaataataccgcggcggaaactgaggacgacgaatcagatggggaggacaggggcggtggaaccagcggcagccttagacgctcaaagcggaactcggatagcaccgaattggccgctcagatgaacgagtctgtagatgtcatggacgtcatcgctatatgttgccccaagtataaggaccgcccacaaatagccagggttgtgcaaaagactagctctggattcagcgttcagtggatggcaggctcatattccggatcctggactgaagccaagagaagagacgggaggaagttagtcccttgggtcgatacaattaaggagagcgacataatctacaaaaaaatcgccctaacctcagcgaataaactcaccaataaggtcgtacagactctgcgctctctgtatgctgcaaaagatggaaccagctcatag

SEQ ID NO: 126578 - DNA, 8094 bp, Artificial Sequence
  Description of Artificial Sequence: Synthetic coding sequence
atgaatggagacatgccccatgtgccaataacgaccctggcagggattgccagcttgaccgatctgctcaaccaactgccactgccttctcccctcccggccacaacaacaaagtctcttctctttaatgcccggattgcggaagaggttaactgcttgctggcatgtcgtgacgataacctcgtcagtcagctggttcactccctgaatcaggttagtaccgaccatatagaactcaaagacaatcttgggtcagatgaccctgagggggatattcctgttctgctgcaggccgtgctggcaaggagccccaatgtctttagagagaagtcaatgcagaatcgctacgtgcagagcgggatgatgatgagccagtacaaactgtcgcagaactccatgcatagctccccagcctcaagtaactatcagcagacaaccattagccattctccctcgagccgtttcgtgccgccgcaaactagttctggtaacaggtttatgcctcaacagaacagtccagtgccttcgccttacgctccccaatctccagccggatatatgccttattcacatcccagcagctacaccactcaccctcagatgcagcaggcctccgtgagcagtcccattgttgccggcggcctgaggaacattcacgacaataaagtcagcggcccgctgagcggcaacagtgccaatcaccacgccgacaatccacgacatggaagctccgaggactatctacacatggtccatagactttcgtccgacgacggtgatagctcgacaatgcggaatgcagcctctttcccacttagaagtccacagccagtgtgttctcccgcagggtctgaagggacacccaagggtagtagacctccactgattcttcagtctcagagtctaccttgtagtagtccccgggacgtcccaccagacatcctactggacagtcctgaacgcaaacaaaaaaaacagaagaagatgaaactgggcaaggacgaaaaagagcaaagcgagaaagccgccatgtatgatatcatctcctccccgagcaaggactctactaaacttacactcaggctctctcgcgtgagatcatctgatatggatcagcaagaggacatgatctccggggtagagaactctaatgtgtccgaaaacgatattccgttcaatgtgcagtatcccggtcagacctcaaagacaccgatcactccccaggacataaatcggccacttaacgcagctcagtgtctgtcacaacaggagcagactgcatttctgccggccaaccaggtgcctgtgctgcaacagaacacttccgtcgcggcgaagcagcctcaaactagtgtggtgcagaaccagcaacagatctcccagcagggaccaatttatgatgaggtggagctcgatgctctggccgagatcgaacggatcgaacgagagtcagccatcgagagagaaaggttctccaaagaggtgcaggataaagataagccactcaagaagaggaagcaagactcatatcctcaggaagctggaggtgccacgggaggaaatcgcccagccagccaagagacaggctccacaggcaacggcagtcggccggccctcatggtgtctattgacctgcatcaggccggccgggtggacagccaggcaagtataactcaggactccgattcgataaagaaacctgaggaaatcaagcaatgtaatgatgcccctgtttctgttctccaggaagacattgtgggatccctgaagtctactcccgaaaatcacccagaaacacctaaaaagaaatctgaccccgagttgtctaaaagcgagatgaagcagtctgaatccagattggccgaatcaaaaccaaatgaaaatcgtctcgtggaaacaaagtcttctgagaacaaactggaaactaaggtggaaactcaaactgaggaattaaaacagaacgaaagcaggactactgaatgcaagcagaatgagtccactatcgttgaaccaaaacagaacgagaacagactgagcgacaccaaacccaatgataataagcagaacaatgggcgaagcgaaacaacaaaaagcaggcccgaaacgccgaagcagaaaggcgagtccaggcccgagacacccaaacagaagtccgatggacaccctgagacccccaagcagaagggcgacggcaggccggaaacccccaagcagaaaggcgagtccagacctgagacacctaagcaaaagaatgagggccggcccgagacaccaaaacatagacacgacaaccggcgtgattccggcaaaccatccaccgagaagaagccggaagtttccaagcataagcaagatactaagagcgactcaccaaggttgaagtctgaacgtgcagaagctctgaagcagaggcctgatgggagaagtgtctctgagagcttacgcagggaccacgataacaaacagaaaagcgatgaccgaggcgaatcagagcgccatcggggggaccagtcccgtgtgcggagacctgagacgctgcgcagcagctcccggaacgagcacggaataaagtctgacagctccaagaccgacaaactggagcgcaaacaccggcacgaaagcggcgacagtcgcgagagaccaagcagtggggaacaaaagtcccggcccgacagcccaagggtgaagcaaggcgacagcaataaaagtagaagtgacaagctgggctttaagagcccgaccagcaaagacgacaagaggacagaggggaataaatccaaggtggacactaacaaagctcatccggacaataaagctgaatttccaagctacctactgggcggcagatctggtgcccttaaaaattttgtgattcccaagatcaaaagggacaaggatggcaatgtgacccaagagacaaaaaagatggagatgaagggggagcccaaagataaggtggagaagatcggactagtcgaggaccttaataagggcgccaaaccagtggtcgttttgcagaaattgagtttagacgatgtgcaaaagctgataaaagatagggaagataaaagccgatcctccctgaagcccatcaaaaacaagcctagcaagtccaataaggggtccatagatcagtcggttctgaaggaactcccgccagagctgctggcggaaatcgagtcgacaatgcccctctgtgaaagggtgaagatgaacaagaggaagcgatcgactgttaacgaaaaacctaagtatgccgagatcagctccgacgaggataacgatagcgatgaggcctttgaaagcagcagaaagaggcacaaaaaggatgatgacaaagcttgggagtatgaggaaagggaccggcgttcaagtggcgaccaccgacgatcagggcatagccacgaaggccggcggagcagcggcggtggtcgataccggaatagatctccatctgatagtgacatggaggattacagtcctccgccttcattgtctgaagttgcccgcaagatgaaaaagaaagagaagcagaagaaacgaaaagcatacgagcccaagttaacacctgaagaaatgatggactctagcacgtttaaaaggttcacagcatctattgagaatattctcgacaacctggaagacatggattttactgccttcggcgatgacgatgagatcccgcaagagctcttactcggtaaacaccagttaaacgaattaggctcagaatctgccaaaatcaaagctatgggaattatggataaactgagtacagacaagaccgttaaagtcctgaacattttggaaaaaaacattcaggacggttctaaacttagcacactgctgaatcataacaatgatactgaggaagaagaacgcctctggcgcgacctgatcatggagcgggtgacgaaatcggcagatgcctgcctgactacaattaatatcatgacctcacccaacatgccaaaggctgtctacattgaggacgtgatagaaagggtaattcagtacaccaagttccacttacagaataccctgtacccacaatatgacccagtctatagattggatcctcacggaggagggctcctatcttctaaggctaagagggccaaatgctccacacacaagcagcgtgtgattgtgatgctgtacaacaaagtgtgcgatatcgtgagctctctatctgagctcctagagatccagcttctgacagacaccaccattctccaggtatcctctatggggatcactcccttctttgtcgagaacgtctcagagttgcaactgtgcgcgatcaaattggttacagccgtgttcagcaggtacgaaaaacatcggcagctgatcctggaggagatttttaccagcctggcacgcctcccgacgtctaagagaagcctgcgcaatttccggttaaactccagcgacatggatggggagccaatgtatatccagatggtgaccgctctggtgctccagcttattcagtgcgtggtgcatttaccaagttctgagaaagatagtaatgcagaagaggatagcaacaagaaaatcgaccaggacgttgtcattactaattcctacgaaaccgcgatgcgcacagcacagaattttctcagtatcttcctaaaaaagtgtggcagcaaacaaggagaagaagactacagacctctgttcgaaaattttgtacaggacctattgtcaactgtgaacaagcctgagtggcccgcagctgaattgctcctcagcctgctcggaaggctgctggtgcaccagtttagtaataaatcaacggagatggccctacgggttgcatcactagattatttaggcacagtggctgctagactgagaaaggatgcagtgaccagtaagatggaccaagggagcatagagagaattctaaaacaggtctctggtggagaggacgagattcagcagctgcagaaagctctcctggactatctggatgaaaataccgaaactgacccctcacttgtgttcagtaggaagttttacatcgcacagtggttccgcgacacgacactggaaacagaaaaagcaatgaaaagtcaaaaggacgaggagagttccgaaggtacccatcatgcaaaggaaattgaaaccaccggccagattatgcacagagctgagaaccgcaaaaaattcttgagatcaataattaagacaactccatcacaattctcaactctcaaaatgaacagcgacacggtggattacgacgatgcttgtctgattgtaagatatttggcatcaatgcgtccatttgcccagtccttcgacatttacctcactcagatactccgggtcctaggagaaaatgctatcgcagtgaggactaaggccatgaaatgtctgtctgaagtggtcgctgtggatcctagcattctagctcgattagatatgcagcgcggcgtccacggcagacttatggataattctactagtgtcagagaggctgcagttgagctcctaggtaggtttgtcctatgccgaccacagctggctgagcaatattacgacatgcttatagagcggatcctggatacaggcatcagcgtgcgtaagcgcgttatcaaaatactgcgggacatttgcattgagcagcccacatttcctaagatcaccgagatgtgcgtgaagatgattcggcgagtgaacgatgaggaaggcattaaaaaactcgtcaacgaaacattccagaagctgtggttcacaccgacccctcacaacgacaaggaagctatgactcgcaaaatcctaaatataaccgatgtcgtggccgcctgtcgggacactggttacgattggtttgaacaactactccaaaatttgctgaaatcagaggaagatagctcgtacaagcccgtcaagaaagcatgtactcagttggtcgacaacctggtcgagcatattctgaagtacgaggagagtctggctgacagtgataacaagggcgtgaactccgggagacttgtagcttgcattacaacccttttcctgttctctaagattcgccctcagctgatggtaaagcatgcaatgaccatgcaaccataccttaccaccaaatgtagcacacagaacgactttatggtgatttgtaatgtagccaaaatcctggagctagtggtccccctaatggaacacccatccgagacatttctggctacaatcgaggaagaccttatgaaattgatcatcaagtatgggatgacggtagtgcagcattgcgtgtcgtgtctcggggctgtggtcaataaggtcacccaaaacttcaagtttgtgtgggcttgttttaatcggtactatggagctataagcaagttgaaatcacagcatcaggaagatcctaacaataccagtttgctgacaaacaagcctgccctgctgcgaagcctgttcacagtcggagctctctgccgtcattttgatttcgatcttgaagacttcaagggaaactccaaagtaaacattaaagacaaagttctggagcttctgatgtatttcacgaaacactcagacgaggaagtgcagactaaagcaatcattggattgggtttcgctttcattcagcacccaagcttgatgtttgaacaggaggtaaagaacctctataacaatatcttgtctgacaagaattcgagcgtcaacctaaaaattcaggtgctgaagaacctgcaaacttacctccaggaagaggatacacggatgcagcaagctgatcgggactggaaaaaagtggcgaagcaggaggacctgaaagaaatgggagacgtgagtagcggcatgagttcatcaataatgcagctgtatctgaaacaggtgctagaggcattttttcacacccaaagctccgtgaggcatttcgccttaaacgtgatcgcgttgacactcaaccaaggcctgatacaccccgtccagtgcgtgccatatctgatcgccatgggtacggatcccgagccagccatgaggaataaggccgaccagcagctggtcgagatcgataagaaatacgctggcttcattcacatgaaggccgtggctggcatgaaaatgtcttatcaggtgcaacaggccatcaacacatgcttaaaggatcctgtaagaggcttccgccaggatgaatcctcttccgccctctgtagccatttatactcaatgatccgaggcaaccggcagcacagacgcgcgtttctcatttctctgctgaacctgttcgatgacactgccaaaacggatgtcactatgctgttatatattgcggacaacctggcctgctttccgtatcagacacaagaagagcccctgttcataatgcatcacatagacatcaccctgagcgtttccgggtctaaccttttgcagtccttcaaggaatcaatggtgaaagacaaaaggaaagagcggaaatcttcccccagcaaagagaacgagtcctcagattctgaggaagaggtctcacgaccaagaaagagcagaaagcgggttgattctgacagtgacagtgacagcgaggacgatattaactcagtgatgaagtgcctgcctgagaactctgcacctttgatagagtttgccaacgtgagtcaagggatcctgctactcctaatgctgaagcagcatctgaagaatctttgtggattctccgactctaaaattcagaagtactcccctagtgagtcggcgaaggtgtacgataaggcaataaatcgcaagacaggcgtacatttccatcctaagcagaccctagattttctccggagcgacatggcaaacagcaagattacagaggaggtgaagcgctcaatcgttaaacagtacctcgacttcaagttgcttatggaacatttggacccagatgaagaggaggaggagggcgaggtatcggcaagcactaatgcaagaaacaaagcgataacttcactgctcggcggcggctccccgaaaaacaacactgcagcagaaacagaagacgatgagtccgatggcgaagaccgggggggggggacttcaggcgtcaggaggcgcaggagccagagaatttcgcagcgtatcacatag

SEQ ID NO: 126579 - DNA, 867 bp, Artificial Sequence
  Description of Artificial Sequence: Synthetic coding sequence
atggagaggccacaaccagacagcatgcctcaggacttgagtgaggctcttaaagaggctacaaaggaagtacacacacaggcagaaaacgcggaattcatgagaaatttccagaaaggacaggtcaccagagacgggtttaagctcgttatggctagcctgtaccacatttacgtggccctcgaagaagaaattgaacgaaataaggaatcacccgtattcgcacccgtgtacttcccggaagagttgcataggaaagcagccctggagcaagacctcgcattttggtacggtcccaggtggcaagaggtgatcccatatacgcctgctatgcagcgctatgtcaagcggcttcacgaggtggggcgtactgagcccgagctgcttgtcgctcatgcttatacacgttacctgggcgatctatctggtgggcaggtgctgaagaaaattgcacagaaggccctcgatctgcctagtagcggcgagggacttgctttcttcacattcccgaacatagcctcagcaacaaaatttaagcagttgtaccggtcaaggatgaactccctcgagatgaccccagcagtccggcagcgcgtcattgaggaagcaaaaacggctttcctcctgaatatccagctgtttgaggagcttcaagagctcttgacccatgatactaaagaccagtctcccagtcgcgcccccggattgcgtcagagggcaagtaataaggtacaggactctgcaccagtcgagacacctagaggcaaaccccccctgaatacccgttcccaggctccgctgttgagatgggttctcacgctttcttttttagtggcaacagttgccgtgggtctttatgccatgtag

SEQ ID NO: 126580 - DNA, 4305 bp, Artificial Sequence
  Description of Artificial Sequence: Synthetic coding sequence
atggaggaccacatgttcggcgtccaacaaatacaacccaatgtcatatcagtgcggctgtttaaacgaaaagtgggaggccttggatttctagtcaaagaaagggttagtaagccacccgttattatctccgatctgattagaggaggagcagccgaacaatctggcctgatccaggcgggggacataatcctggctgtgaacggccgccctctcgtggatctgagttatgattcagccctggaggtgctgaggggcattgcctccgagacccacgtcgttctgattctacggggtcccgaggggtttactacccacctggagacaaccttcaccggcgatggaacacccaaaaccatccgcgtgacccagcccctgggcccaccaaccaaggcagtggaccttagccatcaaccccctgcgggaaaagagcaacccctggcagtggatggcgcctcgggtcctggaaacggcccgcagcacgcctacgatgacggacaggaagctgggagcctgcctcacgctaacgggcttgcaccccgcccaccaggacaagacccagccaagaaggcaacacgagtgtccctccaaggaagaggggaaaacaatgaactgctcaaggaaattgagccagtcttgtcactgttgacgagcgggtcccggggagtgaaaggtggggctccagccaaggccgagatgaaagatatgggaattcaagtggatcgagaccttgacgggaaaagccacaaacctttgcctctcggcgtggaaaatgatagggtctttaacgacctgtggggaaagggtaacgttccggttgtgctgaacaatccctacagcgaaaaagagcagcctcccacgagcgggaagcagtcgcccaccaaaaacgggtcccccagtaagtgtccgaggtttttgaaggtgaaaaattgggagacagaagtcgtcttgacagacaccctgcatctgaagtctactctggagacaggttgcaccgagtatatctgcatgggctctatcatgcacccatcacagcatgcccggagacctgaagatgtgcggacaaagggacagttattccctctcgccaaagaatttatcgaccagtactatagctcaatcaagaggtttggcagcaaggctcacatggagcgcctggaagaagtgaataaggagatcgacacaacttcaacataccagcttaaggatacagagctgatttacggggctaaacatgcctggcgaaatgccagtcgatgtgttggccggatccagtggagcaaattacaagttttcgacgcacgggattgtacaaccgcccacggaatgtttaactacatatgcaatcatgtgaagtacgcaacgaacaaggggaatctgcgatccgccattactatatttccacagcggaccgacgggaagcacgacttcagggtgtggaacagccagctgatcaggtacgctgggtacaagcagccggacggatctactttgggggaccccgccaatgtgcagttcacagagatctgtattcagcaagggtggaagccccctaggggacggtttgacgtgctgcccctgctgcttcaggctaatggtaatgaccccgaactgtttcaaattcccccggaattggtgctcgaagtgcccattagacaccctaagttcgagtggtttaaagacttaggcctaaaatggtatggattgcctgcggtgtcgaacatgctcctggaaataggagggctagaattctctgcgtgtccttttagtggctggtatatgggcacagaaattggcgtgcgcgattactgtgataacagcaggtacaatatactggaagaagttgcaaaaaagatgaacctggacatgcggaaaacgtcttcattgtggaaggaccaagccctggtcgaaatcaacattgcggtgctgtactcattccaaagcgataaggtgacaattgtagatcatcatagtgccactgagagcttcatcaagcatatggagaatgagtacaggtgcaggggaggatgtccagccgattgggtctggatcgtgcctcccatgagcggaagtatcaccccagtttttcaccaagaaatgctgaactatagactgacccctagctttgaataccagcctgacccctggaatacccacgtgtggaaaggcaccaatggaacgcctactaaacgccgcgccataggctttaagaagttagctgaggctgtgaaattctccgcaaagctgatgggacaggctatggcgaagagggtcaaggcaaccatcctctacgccaccgagactgggaagtcgcaggcctacgccaagacgctctgtgagatcttcaagcacgcgttcgatgctaaagttatgtctatggaagaatacgacatagtgcatttggaacacgagacccttgttttagtcgtaacttctacatttggcaatggcgatccacctgagaacggagaaaagtttggatgtgctttaatggagatgagacaccctaacagcgtccaagaagagcgaaagtcatacaaagttagattcaattcagtgagcagttattcagactcccagaaatcaagcggagatggaccagatctgagggacaacttcgagagcgcaggtccacttgcaaacgtgaggttcagcgtttttgggctcggaagtcgtgcttacccgcatttttgtgcctttggacacgccgtggacacgctcttggaagagctgggaggggagagaattctgaagatgcgggagggagacgaattgtgtggacaggaagaggcttttcggacttgggctaagaaggtgttcaaagctgcgtgcgacgtcttctgcgtgggggatgacgtaaacatcgagaaagcaaacaacagtctcatttcgaacgacagatcctggaaacgtaacaaattccgcttaacgtttgttgccgaagccccagaactcacacaaggtttatccaatgttcataaaaaacgcgtttctgcagctagactactgagtaggcagaaccttcagtccccaaaatcctctagatccactatctttgtgcgcctccatacgaacggcagccaagagctgcagtatcagcctggagatcatctgggcgtcttcccaggaaatcacgaggacctcgtgaacgccctcatagagaggctggaagacgcccccccggtgaatcaaatggtcaaggtggaactcctggaggaaagaaatacagcactaggcgtgatttcaaactggactgacgaactgcgtttacccccttgcactatattccaggccttcaagtactatcttgatatcaccacccctccaactccattgcaactgcagcagttcgctagcttggctacatctgagaaggagaaacaacgtcttttagtgctctcaaaaggactgcaggagtacgaagagtggaaatggggcaagaacccaactatcgtcgaggtactcgaagagtttccttctatacagatgcccgcaactttactgctaacgcaactatccctgctacagccacgctattacagtatcagcagcagcccagatatgtatccagacgaggtccatctgacggttgctattgtcagctatcgtaccagagatggcgaagggccgattcatcacggcgtttgctcatcgtggctgaaccggatacaggcagatgagcttgtgccatgttttgtgcgtggggctccctcattccacttgcctaggaacccacaggtgccttgtattctggtcgggccaggtaccggcatcgccccattcaggagtttttggcagcagagacagtttgacatacagcacaaggggatgaatccatgccccatggtgctggtgttcggttgcagacagtctaagatcgatcatatctaccgcgaggaaacgttgcaggccaaaaacaagggtgtcttccgcgagctctatactgcatactccagagagcctgacaaaccaaagaaatatgtacaggacatcctccaagagcaactcgccgaatcagtgtaccgagcccttaaggagcagggcggacacatatacgtatgcggagatgttactatggccgctgacgttctgaaggcaattcagcgcattatgactcagcaaggaaagctctcggctgaggacgccggcgtgttcatttccagaatgcgggacgataatcggtaccatgaggatatcttcggggtgacactccgcacctacgaagtcactaatcggctgcggagcgaatctattgcattcattgaagagtcaaagaaggataccgacgaggtattctcaagctag

SEQ ID NO: 126581 - DNA, 4407 bp, Artificial Sequence
  Description of Artificial Sequence: Synthetic coding sequence
atggaggaccacatgttcggtgtccagcagattcagccgaacgtcatcagtgtgaggctgttcaagcgcaaggtaggaggcctgggcttcttagtgaaggagcgggtatccaagcctcctgtgatcataagcgaccttattcgcgggggagcagcagaacagtctgggttgattcaagccggagatataattcttgcagtgaacgggagacccctcgtggatctcagttatgacagcgcccttgaagtccttagagggatagcctccgagacccatgtggtcctgattcttcgcgggcctgagggttttaccacacacctggagaccacatttacaggagacggtacccctaagacaatccgggtcacccaacccctagggccacctaccaaggccgtcgacctctctcaccagcctcccgccggcaaggaacagcctctcgccgtcgatggagcaagtgggccgggaaatgggccccaacacgcatacgatgacgggcaggaggcaggttcgttgccacacgccaatggtctggcacctaggcctccagggcaggatccagcaaagaaagccacccgggtaagcctccagggccgcggcgagaataatgagcttctgaaagagattgagcctgtgttgtctttgctcactagcgggtcccggggagtgaagggcggggcccccgctaaggccgagatgaaagatatgggaatccaggttgatagggatttggacggcaaaagccataagcctctcccgctaggtgtggagaacgaccgcgtgtttaacgacctatggggtaagggcaatgttccagtagtacttaataacccctatagtgaaaaagagcagccacctacatctgggaaacagagccccacaaaaaacggatctccaagtaagtgccctcggtttctgaaagtcaagaactgggaaaccgaagttgtgctgaccgacacccttcaccttaagtcgaccctggagacgggttgtaccgaatacatctgcatgggctccattatgcatccttcccagcacgccagacgacccgaggatgttaggaccaaaggtcagctgttcccgctggccaaggagttcatagaccagtattatagctccatcaagaggttcggcagcaaggcacacatggagcggcttgaggaggtcaacaaagagatagacacgacctcaacttaccaacttaaggacacagagttgatctacggcgcgaagcacgcctggaggaatgcttcccgctgtgtcggtcgtatccaatggagcaaactgcaagttttcgatgccagggattgtactactgcgcacggtatgttcaactacatctgcaaccacgtcaagtacgcaaccaacaaaggtaatctgcgaagtgctatcaccatcttcccgcagagaacagacggaaagcatgactttcgggtgtggaactcacagcttatccgctacgccgggtataagcagccagacggcagtacgcttggagatcctgccaatgtgcaatttaccgagatctgcattcagcaagggtggaagccgcctcgcggaagattcgatgtgctgcctctgctcctacaggcgaacggcaacgaccccgaactgttccaaattccgccggagctggtgctcgaggtccccattagacatcccaagtttgaatggtttaaggacctgggcctgaaatggtacggcctgcctgccgtgagcaacatgttgctcgaaattgggggactggaattctctgcctgtcctttctctggttggtacatgggtactgagattggggtccgcgattattgcgacaactcgaggtacaacatactggaagaagtggctaagaagatgaacctggacatgagaaaaacatctagtctctggaaggaccaggccctggtcgaaataaacatagcagtgctgtacagctttcagtccgataaggttacaatagtcgaccatcatagtgctacagagtcttttatcaagcacatggagaatgagtacaggtgccgcggtggctgccccgctgactgggtttggatcgtgcctcctatgagcgggagcatcaccccagtcttccaccaggaaatgctgaattaccggcttactccttcatttgagtatcaaccagatccctggaacacgcatgtttggaaggggactaacggcacacccacaaagagacgcgccatcggcttcaaaaagctggccgaagctgtcaaatttagcgcaaaactgatgggtcaggctatggcaaaacgagtcaaggctacgatactgtatgcaacagaaacaggtaagtctcaggcgtatgcaaagacactctgcgagatatttaaacacgctttcgacgccaaggtcatgagtatggaagagtacgacatcgttcatttggaacatgagacgctggtcctcgtcgttaccagtacctttgggaacggagacccccccgaaaatggggagaagttcggttgcgctctcatggaaatgcggcaccccaatagcgtgcaagaggagaggaagtacccagagcctctgagattctttcccagaaaggggcctcccctccccaacggcgataccgaggtccacgggctagccgccgcgcgtgactcccagcaccggtcgtataaggttcggtttaatagcgtgtcatcatactctgactcccagaagtctagtggcgatggcccagacctccgtgacaattttgaaagcgctggaccccttgctaacgtccgcttttccgtctttggcttggggtcccgggcttatccccatttctgcgcgttcgggcacgccgtggacacgcttctggaggagttgggcggagagcggattctgaaaatgcgcgagggcgatgaactgtgtggccaagaggaggccttcagaacttgggccaagaaggtctttaaggccgcttgcgacgtattttgtgtcggagacgatgtgaacatcgagaaggcaaataatagtctgatatcgaatgaccgctcatggaagaggaataagttccggctgacctttgtcgccgaggcccctgagctaacccaggggttatcgaatgtgcacaaaaagcgggttagcgcagcaagactcttatcccggcaaaacctgcagtctccaaaaagctctagaagtactatctttgtgcggctgcataccaacggttcgcaggagctccagtatcaacctggagatcatctgggtgtatttcctggtaaccatgaggacttagtaaatgctttaatcgagcggctggaggatgctccaccagtgaaccagatggtgaaggtggaactgctggaggaacggaacacagctttgggggttatttcaaattggacggatgagctgagactgccaccttgcaccattttccaggcatttaagtactatctggacattaccacgcctcccacaccattgcagctacagcagttcgcgtccttggctacttcggaaaaagaaaaacagcgattactcgtgctttccaaagggttgcaggaatacgaagaatggaagtgggggaagaacccaacaattgtcgaggtgctggaggaatttcctagcatacagatgccagctaccctgctgctgacacagctctccctgctccagccccgctactactccatttctagctctccagacatgtaccccgacgaggtacatctgacggttgccattgtgagctaccgcaccagagatggagagggtcctatccaccacggggtttgtagctcctggcttaaccgaattcaggctgacgagctggtcccctgtttcgttagaggcgccccatcttttcacttaccgcgtaacccacaggttccatgcatacttgttggaccaggaaccggcattgctccttttagatcattctggcagcaaaggcagttcgacatacagcacaaaggcatgaacccgtgtccaatggtgctggtgtttgggtgccgccaatccaaaatcgatcacatttatcgggaagagacactgcaggctaagaataagggcgtatttcgggaattatacacggcctactcccgggagcccgataaacctaagaagtatgtacaggacattttacaggagcagctcgcagagtcggtttaccgggcgctcaaggagcagggtggccacatttacgtatgcggggatgtgaccatggcagccgacgtcctgaaggctattcagcggatcatgactcagcaggggaaattaagcgccgaagacgcaggagtgttcatcagcagaatgcgggatgacaaccgttatcatgaagacattttcggggtcacactgcggacctacgaggtgaccaaccgtttgagatccgaatcgattgctttcattgaggagagtaaaaaggacaccgatgaagtgttctcttcctag

SEQ ID NO: 126582 - DNA, 1224 bp, Artificial Sequence
  Description of Artificial Sequence: Synthetic coding sequence
atggaagaccacatgtttggcgtgcagcagatacagcccaatgtcatttctgtgcgcctcttcaagaggaaagttggtggcctcgggtttctggtgaaggagcgagtcagtaaacccccagtcataatcagcgatttgattagggggggagcagccgaacaaagcggcctgatccaagctggggacattatcctggctgtcaatgggaggccattagtggacctgtcatacgatagcgctttggaggtgctgagagggatcgcgtcggaaacccacgttgtcctcatcctgagaggccccgagggcttcacgactcatttggagaccacctttaccggcgacggaacacccaagacaatacgtgtcacccagcctctgggaccccctacaaaggctgtggacctctcacatcagccacccgcaggaaaggaacaaccactcgcagtggacggggcctccggacccgggaatgggccacagcacgcatatgatgacggccaagaggcaggcagtctgccccatgctaacggactcgccccacgacctcccggccaggatccagccaaaaaggccaccagggtgtccctacaagggcggggggagaataatgaattgctcaaggagatcgagccggttctttccctccttacaagcggcagccggggagttaagggcggcgcaccagcaaaggcagagatgaaggacatgggcatccaggtggacagggacctggatggcaaatctcacaaacccctccccttgggtgtggaaaacgatcgggtttttaacgacctatggggtaaggggaatgtccctgtggttctgaacaacccttacagcgaaaaagaacagatgcgcaagctgaggatcaccgagggttttggcgcccagagaggttctcacaaccatccgccaccacaggagaatagtccgccgcaaaggatggcggctccacccagcgtacatgctagctcaaggagccggacgggcagactgcgttggtttagtttgactccctccaccttgagggcacattggaagcgggacgcactaagtacaagcgcctgggctccctcctgcatcttgctttccatgcagggcggactcaagacaagcgcgcagaaggacagctctagcctctcccctaaatcgttgctcatcaacactatacatcagctgaaagatctggccccgaaaccgacctggaaggggtggaaacgctag

SEQ ID NO: 126583 - DNA, 3993 bp, Artificial Sequence
  Description of Artificial Sequence: Synthetic coding sequence
atggaggatcatatgttcggggtgcagcagatccagccgaatgtgatatctgttaggctcttcaaacgcaaagtcggcgggctagggtttctcgtgaaggagcgcgtctcgaaacctccagtgatcatcagtgaccttattaggggaggggccgcagaacaaagcggcttgatacaggccggcgatattatactggctgttaacgggcgcccacttgtggatctttcttacgacagcgctttagaagtgctgcgtggaatagccagcgaaactcatgtcgttctcatcctaaggggacctgagggatttacaacccacctcgaaacaacatttacgggggacggaacgcctaagaccatccgcgtcactcagccgctggggcctccaactaaggccgtagatctgagccaccagccacctgccggtaaagagcagcccctggcagtcgatggcgcttcagggcctggtaacggccctcaacacgcctatgacgatggccaggaggctggatctctcccgcatgccaacgggctcgctccccgcccccccggccaggaccccgccaagaaagcgacccgggtgagtctccaggggcgaggagaaaataatgaactcctgaaggaaatcgagccagtgttgagtctcctgacctcaggctcccgcggcgtgaaggggggcgccccagcaaaagctgagatgaaggacatggggatccaggtggaccgtgatcttgatggcaagagtcacaaacccttgccattgggggttgagaacgatcgcgtatttaacgatctctggggaaagggcaacgtccccgtggtcctgaacaacccctattccgaaaaggagcagcccccgacctccggcaagcagagtccaaccaaaaacggatccccttcgaagtgcccacggttcctgaaggtgaagaattgggagacggaagttgtgcttacagatacactgcacctgaaaagcaccctcgagactggttgtaccgaatacatctgcatgggatcaatcatgcacccatcacagcacgcgcgccgccccgaggacgtgcggaccaagggacagctctttcctctcgcaaaagaattcatcgatcagtactatagcagcatcaagaggtttgggagcaaagcacacatggaacgcctcgaagaagtgaataaagagattgacactacaagtacataccagctcaaagatacagaactcatctatggggctaagcatgcatggcggaatgcttctcgatgcgtaggtagaattcagtggtcaaagcttcaagtgtttgatgcaagggattgtactaccgcacacggaatgttcaattatatatgtaaccacgtcaaatacgccacgaataagggtaacctgcgttcggctatcaccatattccctcaacggacagacggcaagcatgactttcgggtctggaactcccaattgatacgctatgcaggctataaacagcctgacggcagtaccctgggggacccagccaacgtgcagtttaccgaggaagtggctaagaagatgaacctagatatgaggaaaacctctagcttatggaaagaccaggccctggtcgagataaatattgccgtactctattctttccagtccgacaaggtcactattgtggatcaccactcagctaccgagagttttatcaaacatatggagaatgagtatcggtgccgcgggggctgtcccgctgactgggtgtggattgttccacctatgagcggctcgatcacacctgtcttccaccaggaaatgctcaactatagactgactccatcctttgaatatcagccagatccatggaatacccacgtgtggaaaggcaccaacgggactcctaccaagcgcagagctatcgggtttaagaagctggccgaagcagttaagtttagtgccaaactgatggggcaggcaatggccaaacgcgtcaaggctacaatcctttatgcaacagagacaggcaagagccaggcctatgcaaagaccctgtgcgaaatttttaaacatgcatttgatgcgaaggtgatgtccatggaggagtacgatatcgtgcatttggaacacgaaaccttggtgctggttgtaacatctacgtttggcaatggcgaccctcctgaaaacggcgaaaaatttggctgcgcattaatggagatgcgacacccaaattctgtccaggaagaaaggaagtcttataaggtgaggttcaactccgttagcagctacagcgactcccaaaagagctcaggcgatggtcccgatttgagggacaacttcgaatcagctggaccactggccaacgtcaggtttagcgtttttgggcttggcagccgggcctacccacatttttgcgcttttgggcacgctgtggatactctgctggaggagctgggcggcgagagaatcctaaagatgcgcgaaggggacgagttgtgcggacaggaggaggcattcagaacctgggctaagaaggtgttcaaagctgcatgcgacgttttttgtgtgggggacgacgtcaacatcgagaaagcaaacaatagtctgatttctaacgaccgctcttggaaacgcaacaagttccgactcactttcgtagctgaggcgcccgagctcacgcagggactgtcgaacgttcacaaaaagagggtctccgctgctcgactcctgtctagacaaaatctccagagtccaaaatcttcgcgcagtaccatcttcgtccgtctgcatacaaatgggtcacaggagctccagtaccagcctggagaccatctcggcgttttcccaggaaatcacgaagatttagtgaacgcgctaatcgaacgactcgaggatgccccacctgttaatcagatggtgaaagtggagctgttagaggagaggaataccgcgctgggagtgatctccaattggactgacgagctgcgactcccgccatgtacaatcttccaggcttttaaatactacctggatattaccactccaccaactcccctgcaactacagcagttcgcatcactcgctacatccgaaaaggaaaagcaacgcttgcttgtcctatccaaaggactgcaggaatatgaggaatggaaatgggggaagaacccaacaatcgttgaagtgctcgaagaatttcccagcatccagatgccagctacactgttactgactcagctgtctcttctgcagccccgctactattcgatttcaagttctcctgacatgtatccagacgaggtgcacctgactgtggccatcgtaagctataggacccgggacggagaaggacccatacatcatggagtttgcagtagttggctgaatagaatccaggctgatgagctggtaccttgtttcgtgcgaggagccccaagttttcacctccctcgtaacccccaggtgccttgcattctcgtcgggcctggaacagggatcgcccccttccgatctttttggcagcaaagacaatttgacattcagcataagggcatgaacccttgtcctatggtactcgttttcggttgccgccagagtaagattgatcatatttacagggaggagaccttgcaagctaaaaacaagggcgtgtttcgggaactttacacagcctacagccgggaacctgataaaccgaagaagtatgtgcaagacattctgcaggaacagcttgctgagagcgtgtacagagccctgaaggagcagggcggtcacatctatgtgtgcggtgacgtcactatggctgctgacgtgctaaaggccatccagagaattatgacgcagcagggcaagctgagtgccgaagacgctggcgtcttcatctcaagaatgcgcgacgacaacaggtatcatgaggatatctttggtgtcactctccggacctacgaagtaacgaaccggctaaggtccgaatcaattgcattcatcgaggaaagtaagaaagacacagatgaccaagtgtttaaaacctag

SEQ ID NO: 126584 - DNA, 3621 bp, Artificial Sequence
  Description of Artificial Sequence: Synthetic coding sequence
atggaagaccacatgttcggagtccagcagattcagccaaatgtaattagtgtcagactattcaagcggaaagtcgggggcctgggctttctcgtgaaggagcgggtctcaaaaccacctgtcatcatctctgacctcatcaggggaggagctgccgaacagagtggcctaatccaggccggtgacattatcctagcagtgaatggtcgtcccctcgttgatctatcttacgactcagccctggaggtacttagaggtatcgcgtcagaaactcacgtagtcctgatcctgaggggtcctgaggggtttaccacccacctcgaaactaccttcactggtgacggaacacccaaaacgatccgagttacccagccgctgggtcctccgacgaaggccgtggacttgagtcaccaacctcctgccgggaaggagcagcccctcgctgttgacggagcgagcggtcccggcaacggcccccagcatgcctatgacgatggtcaggaggcgggttctctccctcatgctaacggcctcgcccctcgcccacctggtcaagacccagccaaaaaggctacaagagtgtcgttgcagggccggggggagaataatgagttgttgaaggagatcgaacctgtgctgtcacttctcaccagcggtagccgcggagtcaaaggcggcgccccggcaaaggctgagatgaaggacatgggcatccaagtggaccgagatttagacggaaagtcacataaacctctacctctgggggttgaaaatgaccgagtctttaacgacctttggggcaagggcaatgtgccagtcgtactcaataatccctatagtgagaaggagcagcctccaacttctggaaaacagtcccctacaaaaaacggttcccccagcaagtgccccagattcctcaaagttaagaactgggagacggaggtggtactcacagacacattgcatttaaagtccaccctagagacagggtgtacggagtacatctgcatgggctccatcatgcacccctcccaacatgctcggaggcctgaagacgtgcgaacaaagggccaattgtttcctctggccaaagagttcatcgatcaatattatagtagcataaaacgtttcggctctaaggcccacatggaacgacttgaggaggtgaacaaagagattgataccaccagtacgtaccagctaaaagacacggagcttatttacggggccaaacatgcatggcgcaatgcctcaagatgcgtcggaagaatccagtggtctaagttacaggtttttgatgcaagggactgcacaactgcccacggtatgtttaattacatctgcaaccatgtgaaatatgccaccaataagggcaatctgcgctccgcaattactatctttccccagaggacggacgggaagcacgactttagagtttggaacagccagcttattcgctatgcgggctataaacagcccgacggctcaactttgggtgaccctgccaacgttcagtttaccgaaatatgtatccagcaaggctggaaaccgcctagagggagatttgacgtgttgccccttcttctccaagctaacggcaatgatcctgagctgtttcaaatccctcctgaactggtactggaagtgcctatccgccacccaaaattcgaatggtttaaagatctggggctgaagtggtacggactcccggctgtgagcaatatgcttctggaaattgggggactcgagttcagcgcgtgtcctttttccggatggtacatgggtaccgaaatcggcgtgcgagattactgtgataactcgaggtacaacatcttggaggaagtcgctaaaaagatgaacttggatatgcgaaaaacctccagtttgtggaaggaccaagccctggtggagatcaatatcgccgtcctgtatagctttcagtctgacaaagttaccattgtcgatcaccactctgccaccgagtcatttatcaagcacatggagaacgagtataggtgccgcgggggatgccccgccgactgggtgtggattgtcccccccatgagcggttccattactccagtgtttcatcaggaaatgctaaactatcggctgaccccctcgtttgaataccagcctgatccttggaatactcacgtgtggaaaggcaccaatggtacgcccacaaaacggcgcgccattgggttcaagaagctggctgaagcagtcaagttttcagccaagttgatgggccaggcgatggctaagcgtgtgaaagcgacaatcctgtatgccactgagactggaaagagccaggcctatgcaaagaccctatgcgaaatatttaaacacgctttcgatgcgaaggtcatgtctatggaagaatatgatatcgtgcacctcgagcatgagaccctcgtgctggtggttacaagcacattcggcaatggtgatccccccgaaaacggagaaaagtttggatgcgccctgatggagatgcggcacccgaattccgtgcaggaagaacgcaagtcatataaagtgcgctttaattctgtctcaagctactcagattcccagaaaagttcaggggacggccccgacttacgagacaatttcgaaagcgctgggcccctggcaaacgtgagattcagtgtgtttggacttggctctagggcttatccccatttttgcgcattcggtcatgctgtcgacacacttttggaggaactgggtggggaacgaatcctgaagatgcgggagggggacgaactgtgcggccaggaagaagcatttcgcacatgggccaaaaaagtctttaaagccgcttgtgatgtattctgcgtgggcgatgatgtgaacatcgagaaggccaataattcacttatctcaaacgacaggtcctggaaacgaaacaagtttcgactgacatttgtcgccgaggcccctgagctgacccagggcctcagcaatgtccacaagaagcgggtcagcgccgccagattactgagcaggcagaacctgcagtcgccaaaatcctcccgcagtaccatttttgtgaggctgcacaccaacggcagtcaagagctccaatatcagcctggcgatcatttgggagtttttcccgggaatcacgaagatttagttaatgcactgattgagcgccttgaggacgccccacctgtgaaccaaatggtgaaagttgaactgcttgaggaacgcaacacagcccttggcgtgattagcaactggacagatgaacttagactcccaccttgtaccatctttcaagcttttaagtactacctcgatatcactacccctccaacgcccctgcagttacagcagttcgcatctcttgccacatctgagaaggaaaaacagcggcttttggtattatctaaggggcttcaagaatacgaagaatggaagtgggggaagaaccctaccatcgtggaagtgctggaggaattcccctcgatacaaatgcccgctactttgctccttacccagctgtcactactgcaacctcgatattattcgatcagtagctcacctcatacacacacgttgagcgaaaccaggccatccccgttgcccctttcatcacaatgctgttag

SEQ ID NO: 126585 - DNA, 204 bp, Artificial Sequence
  Description of Artificial Sequence: Synthetic coding sequence
cacccaaatagtgtgcaggaggaaaggaagtaccccgaaccgctgcgtttctttccccgtaagggccccccgctgcccaatggtgatacagaagtgcacggattggctgccgctcgggattcccagcataggtcctataaggtgaggttcaatagtgtcagcagctactccgatagtcagaagtcatctggcgatggcccctag

SEQ ID NO: 126586 - DNA, 1521 bp, Artificial Sequence
  Description of Artificial Sequence: Synthetic coding sequence
atgccgagcaagactaagtataacctggtagatgacggacatgatttgaggatccccctgcacaatgaggatgctttccagcacggcatttgtttcgaggctaaatatgtgggatccctagacgtgccccgcccgaactctcgggtagagatagttgcagccatgcgacgtatcagatacgaattcaaagcaaaaaacatcaagaaaaagaaagtcagtataatggtgtcagtcgacggagtcaaagttattttgaaaaagaagaagaagctgctgctgctgcagaagaaggagtggacttgggacgaatcaaagatgctcgtgatgcaggatccaatttaccgtatattttacgtctctcatgacagtcaggatctcaagatatttagttatatagcccgggacggggcctccaacatcttcagatgtaatgtattcaaatcaaaaaagaaatcccaggcaatgcggattgtccggacggtgggccaggcgtttgaagtgtgtcacaagttaagcctgcagcacacgcagcagaacgcagacgggcaagaggacggcgaaagcgagcgcaactctaactctagcggcgaccccggcagacaattgaccggcgccgaaagagcttctacggctaccgcagaagaaacagacatcgacgcagtcgaggtacctctgcccggaaacgacgttctagagttctctcggggtgtcactgatctggacgccgttggaaaggaaggaggttcccacaccggctcgaaggtgtcacatccccaggaacctatgctcaccgcctcccctcggatgctgctgccttcttcttcgtcgaagcctcccggtcttgggacagagacgcccctgagcactcaccaccaaatgcagctgctgcagcagctattgcagcagcagcaacagcagacacaggtggccgtggctcaggtgcatctgctcaaagatcaattagcagcagaagctgccgcgcgcctcgaagctcaggcacgggttcatcagcttctgctacagaataaggacatgctgcagcacatcagcctcttagtcaaacaggtgcaggaactggaactgaagttgtccggacagaatgccatggggtcacaggacagtctgctggagatcaccttccgctcaggcgccctaccagtcctgtgcgatcctaccaccccgaagcccgaggatctgcatagccccccactaggagccggactcgcagactttgctcaccctgctggaagtcccctgggacggcgggattgtctcgtcaagttggaatgctttcggtttctccccccagaggataccccaccacccgctcagggtgaagcattgctgggcggcttagaactgatcaagttccgagaatccggcattgccagtgagtacgaaagtaacaccgacgaaagcgaagagagagactcttggagtcaagaagaactacccaggctgttaaatgttttgcagagacaggaacttggcgatggactggacgatgaaatcgcagtatag

SEQ ID NO: 126587 - DNA, 636 bp, Artificial Sequence
  Description of Artificial Sequence: Synthetic coding sequence
atgagcctcagcagtctctgtcccgtattttccgccgcggcatcttctctgcaggttcacctgttaaaagaccaattggcagccgaggccgcggcacgactcgaggctcaggcaagggtccaccagcttctactgcagaacaaagatatgttgcagcacatcagtctgctcgtgaagcaggtccaagagctagagctcaagctgtcaggccaaaatgccatgggctcccaggattccctactggaaattacctttagatcaggagctctccctgtcttatgcgacccaacgacccctaagcctgaggacctccattcaccccccctcggggctggcctcgcggacttcgctcatcctgcaggctcacccctgggacgccgggattgcttggtgaagctggaatgttttaggttcttaccccctgaggacacccctccacccgctcaaggagaggctctgctggggggcctggagctgatcaagttcagagaaagcgggatcgcgagtgagtacgaatctaacaccgatgagtccgaggagcgggattcctggtcccaagaggagctccctagactattaaacgtgcttcagcgacaagagctgggtgacggactggacgacgaaatcgcagtgtag

SEQ ID NO: 126588 - DNA, 1506 bp, Artificial Sequence
  Description of Artificial Sequence: Synthetic coding sequence
atgccatccaagacgaagtataacctggtggacgacggacatgatctgcggatcccactgcacaatgaggacgcctttcagcacggtatttgttttgaggcaaagtatgtgggatctttggacgtgcctcgtcctaattctagggtggagattgtggcagcgatgaggcggattaggtatgagttcaaggcaaagaatattaagaagaaaaaggtctccatcatggtctccgtagatggggtcaaggtgattctaaaaaaaaaaaaaaagaagaaggaatggacctgggacgaaagcaagatgctagtgatgcaggatcccatttacaggatattctatgtttcacatgattcccaggatttgaagatcttctcttacatcgccagagatggtgctagtaacattttcagatgcaatgtgtttaaaagcaaaaaaaagagtcaagcaatgagaatagtgcggacagtagggcaggcctttgaagtatgtcacaagttgagcttgcagcacacacagcagaacgcggacggacaggaagatggagagtccgagcgaaactcaaattctagtggggatcccggcaggcagttaacaggcgcagaacgggcctccactgcaactgcagaagagactgacatcgacgcagttgaagtccctttgcccggaaatgatgtcctggagttcagcaggggcgtgacggatctcgatgctgtgggtaaagaaggaggaagccacaccgggtccaaggttagccacccccaagagcccatgctcacagccagccctaggatgttgttgccctcctcttcatccaaaccccccggactaggaaccgaaacgccactgtctacccaccatcaaatgcagctcctgcaacagcttctgcagcagcagcagcaacagacacaagtggcagtggctcaggtccacctgctgaaggatcagctcgctgccgaggcggctgcccgcctcgaggcccaagctcgggtgcaccagctgctcctccagaacaaagacatgctgcagcacatcagtttacttgtcaaacaggtgcaggaactggagctcaagctgtccggacagaatgcgatgggcagccaggacagtcttctggagatcaccttcaggtctggagccctgcccgttctttgcgatccaaccactccaaaaccagaggacttgcactccccaccccttggagctggtctggctgattttgctcaccctgcaggctccccactgggaagacgagactgtctggttaaactggaatgttttcgatttctgcctcccgaagacacccctcctccagcccaaggagaagccctcttaggcgggcttgagcttattaagtttcgtgagtccggcattgcttcagagtatgagtccaacaccgatgagtcagaggaaagggactcctggagccaggaggagctgccgcgtctactgaacgtgttacagcgccaagagctaggggacggtctggacgacgaaatcgccgtgtag

SEQ ID NO: 126589 - DNA, 2190 bp, Artificial Sequence
  Description of Artificial Sequence: Synthetic coding sequence
atggcctgcccttggaaattcctattcaagaccaagttccatcagtatgccatgaacggtgagaaggacatcaacaacaacgttgagaaagcgccttgtgccacatcctcccctgtcacccaggacgaccttcagtaccataacctctcgaaacagcagaacgaatccccccagcctctggtcgagactgggaagaaatctccggaatcattagtaaaactggacgccacccccctgtcctccccaagacatgtgagaatcaaaaattggggcagcggcatgacatttcaggacacgcttcaccacaaagcaaaaggcatcctgacatgcaggtcaaaaagctgtctgggatctattatgaccccaaagagtctcacacggggtccacgcgataagccaacccctcctgacgagctgctgccacaggcgatagagttcgtcaaccagtattatggctccttcaaagaggcaaaaatcgaggaacacttggcccgcgtggaggccgtgaccaaagaaatcgagaccacaggcacgtaccagctcacaggagatgagctcattttcgctaccaagcaggcctggcgtaatgcccccaggtgtatcggtagaatccagtggagcaacctgcaggtattcgacgcccgttcatgctcaactgccagagagatgttcgaacatatctgccgacacgtgagatactccacgaacaatggaaatatccgctctgcaatcacggtgtttccacagaggtccgacgggaagcatgattttagagtctggaatgctcagttgatccgttacgccggatatcagatgccggacgggtctatccggggggatccagcaaatgtcgagtttactcagctgtgtatcgatctggggtggaagcccaaatatggcaggttcgacgtggtgccactcgtattgcaggcaaacgggcgcgaccctgaactctttgagatcccaccggacttggtgctcgaggtggcaatggaacaccctaagtatgaatggtttcgagagcttgaactcaaatggtacgcgctccccgcagtcgccaacatgctgttggaggtgggaggtcttgaattccctggctgcccttttaatggttggtacatgggaactgaaataggtgttcgcgacttctgcgatgtgcaaaggtacaacatcctggaagaggtgggcagacggatggggcttgaaacccacaagctcgctagtctatggaaagaccaggccgtggttgagatcaacatcgcggtgcttcacagcttccagaagcagaacgttaccattatggatcaccattcagccgctgaaagcttcatgaagtatatgcagaatgaataccgcagcagaggcggttgcccagccgattggatctggctggtcccacctatgtccggttctatcactcccgtattccatcaagagatgctcaactatgtgctgtcccccttttactactatcaggtcgaagcatggaaaacccacgtctggcaggatgaaaagaggcgtccaaagcgtagggagattcccctgaaagttctggtgaaggctgtgctattcgcttgtatgttgatgcggaaaaccatggcctctcgagtgcgagtcactatactctttgcaaccgaaaccgggaagtccgaggccctggcatgggatcttggcgcattgttcagttgtgccttcaatccaaagaaactgaaaaagtcactgttcatgttaaaggagcttaataataagttcagatatgccgtctttggtttaggcagcagtatgtacccacgattctgtgcgtttgctcacgacatcgaccagaaactgagtcaccttggagcgtctcagctaacccccatgggagaaggagacgagttgagcggccaggaggacgcttttaggtcctgggccgttcagacattcaaagctgcctgtgaaacattcgacgtgcgaggcaagcaacacatacagatcccaaagttatacacatcaaacgtcacatgggatccccatcactacagactggtccaggacagccagcccctgcccgctgcgtctacctcccccagaattccacctattctagcgagcagttcgggtctcgcccaggcctctagaccaagcgcagttagcgggtctaatggatccatgactccttctacgcgcgaatgcggcgaagccgcctag

SEQ ID NO: 126590 - DNA, 3462 bp, Artificial Sequence
  Description of Artificial Sequence: Synthetic coding sequence
atggcatgtccctggaagtttctgtttaagaccaagttccatcagtacgcgatgaatggcgaaaaagatatcaacaataacgtagagaaggcaccatgtgccaccagctcacccgtcacccaggacgacctgcaatatcacaatctatctaaacaacagaatgagagccctcagcctctcgttgaaaccgggaagaagagccctgaaagcctggtgaaactggatgcaaccccactgtcatcccctaggcacgtccggattaagaactgggggtctggtatgacctttcaagatacactgcatcacaaggcaaagggcatcctaacctgtaggtctaagtcctgtcttggctcaatcatgactcctaaatcattgacccggggcccccgcgataaaccaacccctcccgatgagttgttgcctcaggctattgagttcgttaaccagtattacggatcattcaaagaggccaagattgaggaacatctggcccgagtggaggccgtcacaaaggagattgagaccacagggacttaccagctcacgggggacgagctgattttcgccactaagcaggcctggaggaatgcccctaggtgcatcggcaggatccagtggtccaatctgcaggtgttcgatgccaggtcgtgcagtacagctcgagagatgttcgagcacatctgtcgtcacgtcagatattccacaaataacggaaacatccggtcagccattaccgtattccctcagaggtccgacggaaaacatgactttagagtctggaacgcgcaactcatccgatatgctggctaccaaatgccagacggcagtattcgtggtgacccagccaatgtggagtttacacagctgtgcatcgatctgggctggaagccaaagtacggacgctttgacgtggtcccactagtcttgcaagcgaatggacgcgacccggagctattcgaaatcccacccgatctggtccttgaggttgccatggagcatcccaagtacgaatggtttcgggagctcgagctaaaatggtacgccctcccggccgtggccaatatgctgcttgaggtcggcgggctggagttccccgggtgtcccttcaacggctggtacatggggacagagatcggcgtacgagatttttgcgatgttcaacgctataatatcctggaagaggtggggcgtagaatgggcctggaaacgcacaagctggcctctctttggaaagaccaagcagtcgtggaaatcaacatcgccgtgttacatagcttccagaagcagaatgtgacgataatggaccatcactcagctgcagaatctttcatgaaatatatgcagaacgaatatcgttcaaggggaggttgcccagctgactggatctggctggtgccacccatgtccgggtctatcactcctgtgttccatcaggagatgctgaactacgtactgtcgcccttttattactatcaagtagaggcttggaagacccatgtgtggcaagacgagaaaaggcgacccaagcggcgtgaaatccccctgaaggtgctcgtgaaggctgtcctttttgcctgtatgctgatgcgtaagaccatggcctcacgggttagggtgaccatcctgttcgcgactgaaacagggaagtcggaggccctcgcctgggacttaggggctttattcagctgcgctttcaatcctaaggtggtgtgtatggacaaatatagactttcttgcctcgaggaggagcgtctccttcttgtggtaacaagcacctttgggaacggagactgccctgggaatggcgagaagcttaaaaagtccctatttatgctgaaagagctgaacaacaaattcaggtacgctgtgttcgggttaggttctagcatgtaccctcgcttctgtgcatttgctcatgacattgatcaaaagctgtcacacctaggggccagtcagcttactcccatgggcgaaggggacgagctctctggccaggaagacgcatttcggtcatgggcggtgcaaacgtttaaggcagcttgtgaaactttcgacgtgcggggaaaacaacatatccaaattcccaagctgtacacaagtaatgttacctgggacccccatcactaccggctcgtccaagacagccaaccactagatttaagcaaagccctgagctctatgcacgccaagaatgtttttactatgcggctcaaatctagacagaatctgcagtcccccacttcttcccgcgcaactattctagtcgaattatcatgcgaggacgggcaggggctgaattatctgcctggtgagcatctaggagtatgtcccggtaaccaacccgccctcgtacagggcatcctggaacgggtggtcgacggcccaactccacatcaaaccgtacggttagaagcgctggacgagtccgggagttactgggtctcagataagaggctgcccccatgttcgttgtcccaggccctcacctattttctagacattactacacccccaactcaactcctactgcagaagctcgcacaggtcgccactgaggaacctgagcgacagcgtctagaggccctctgccaaccaagcgaatatagcaaatggaagttcaccaatagccccacttttctcgaagtcttagaagaattcccttctctccgtgtgagtgcaggctttctgttgagccaactacccatcctgaagccacgcttttacagcataagttcaagcagggatcatacacccacggaaatccatctgactgttgcagttgtgacctaccatacaagggacggtcaaggtcccctccaccacggagtttgcagtacttggctgaactccctcaagccccaggaccccgtcccctgcttcgtccggaacgcctcaggatttcatttaccggaggatccaagtcatccttgcatcctcatcggaccggggacaggaatcgcacccttcaggagcttttggcagcaacgcctgcatgattcacagcacaagggggtgcgtggcgggcgaatgacgttggtctttggatgtcgacgccctgatgaggatcacatctatcaggaggaaatgctagagatggcccagaagggcgtgcttcacgcggtccacaccgcgtacagccggctccccgggaagccaaaggtctacgtgcaggacattctgaggcagcagctggcctctgaagtactcagggtgctccacaaagaacctgggcacttgtacgtttgtggagacgttcggatggccagagatgtagcacacaccttgaagcagctcgttgccgctaagctgaagctaaacgaagaacaggttgaagattatttcttccagttgaaaagtcaaaagcggtatcatgaggacatttttggggctgttttcccttatgaggctaaaaaagacagggttgcggtgcagccatccagccttgaaatgagcgcactgtag

SEQ ID NO: 126591 - DNA, 3345 bp, Artificial Sequence
  Description of Artificial Sequence: Synthetic coding sequence
atggcttgtccttggaagttcctctttaaaactaaatttcatcagtacgcgatgaatggcgagaaggacatcaacaacaacgtggagaaagctccttgcgccactagtagccctgtgacacaggacgatctccagtaccacaacctgagtaaacagcagaatgagtctccccagccgctagtcgagacaggaaaaaagagcccggaatctctcgtcaaattggacgccacgcctctgtctagcccaaggcatgtccgcataaagaactgggggagtggtatgacgtttcaggatacattacaccataaagccaagggaatcctgacgtgtcgtagcaaatcttgtctaggttccataatgacacctaaatctctgacacgaggtccccgcgacaagccgacccctccggatgaactccttccccaagccatcgaattcgtcaatcagtactacggcagcttcaaagaggccaaaatcgaagagcacttggcacgtgtggaggctgtaactaaagagatcgagaccaccggcacatatcagttaacaggggatgagcttatcttcgccactaagcaggcctggcgcaatgcgccacgatgcatcggaaggatacagtggtctaacctgcaggtgttcgatgcccgatcatgctccacagccagagagatgttcgaacatatctgccgacatgttcgctattccaccaataacgggaacattagatccgccataacagtcttcccacaaaggtccgacggaaagcacgacttcagggtgtggaacgcccagttatgcatcgacctggggtggaagcctaacggccgggaccccgagttattcgaaatacccccagacctagtcctggaagtagccatggagcaccctaagtacgagtggtttagggaattggagctcaagtggtacgccctccctgccgtcgccaacatgcttctggaggtgggcggactggaatttccaggatgcccgttcaatggatggtacatgggtactgagattggcgtccgggatttctgtgacgtacagcggtacaatatcctggaagaggtgggaaggagaatgggcctggaaacgcataaattggcttccctgtggaaagaccaagccgtggttgaaatcaatatcgcagtgttacactctttccagaaacagaacgtaaccatcatggaccaccacagcgcagcagagtcttttatgaagtacatgcagaacgagtatcgcagccggggtggatgtccggctgattggatttggctagtccccccaatgtcagggtcaatcactcccgtcttccaccaggagatgctcaactacgtgttaagtcctttctattattaccaagtcgaagcatggaaaacgcatgtgtggcaggacgaaaagcggagaccgaagcgccgtgagataccattaaaggtgttagtaaaggcagtgctctttgcgtgtatgctgatgcggaaaactatggcatccagggtgagggtgactattctctttgccacagaaaccggaaagagtgaagctttggcctgggatttgggagccttattttcttgtgccttcaatcctaaggtggtttgcatggacaagtaccgcctgtcctgtctcgaggaagaacgcctcctgcttgtcgtcaccagcacattcggcaatggcgactgtcctgggaacggggagaagctgaaaaaatctctttttatgcttaaagagctgaataacaagttcagatatgccgttttcggcctgggctcctctatgtatcctcgcttctgcgccttcgcacatgacatcgaccagaagcttagtcatctcggggcaagtcagctgacgcccatgggggaaggggacgaactgagcggccaggaagacgctttcagaagttgggccgtccaaacatttaaagcagcttgcgaaacatttgatgtaaggggaaagcaacatattcagatacctaaactctacaccagcaatgtgacatgggacccgcatcactatcgactggtgcaggattcccagcccttggaccttagtaaggctttgagcagcatgcacgccaagaacgtctttaccatgcggttgaaatccaggcagaacttgcagagccccacatccagtcgtgcaacaatcctcgttgagctttcttgcgaagacggtcagggactaaattacttaccaggcgaacatttgggcgtctgcccaggcaatcaacccgcgctggttcaggggatccttgagagggtggtggacggccctacaccccaccagaccgtgcgcctggaggccctcgacgagtcgggctcatattgggtgtcagacaaacgtttaccaccatgctcactgtcacaggcactcacgtacttcctggacatcaccacaccccccactcaactcttgttacagaaattagcacaagtggctacagaggaaccggagcgacagaggctagaggcgctctgccaaccttccgagtatagcaagtggaaattcactaactcccccacatttttagaagtgttggaggaattccccagcttacgcgtctctgctggatttttactctcccagctgcccatactaaaacccagattttacagtatatctagctctcgagaccatacaccgactgaaattcatctaactgtcgctgtggtgacctatcatacaagagacggccagggccccctccaccacggagtctgctcaacctggttaaattccctgaagccacaggacccggttccctgtttcgtgcggaatgctagcggattccacctccccgaggatccctctcacccatgcattctcatcggccctggcacgggtattgcaccttttcgctctttttggcagcaacggttgcacgactcccagcataaaggcgtgcgcggaggaaggatgacactggtgttcggctgccgacggcccgacgaagaccatatctaccaggaggagatgctggagatggctcaaaaaggagtcctgcacgctgtgcacactgcttatagcaggctgcctggcaagcccaaggtctacgtgcaggacattctcagacagcagttagcttccgaagtcctcagagtcttgcacaaggagcctggacacctctacgtgtgcggcgacgtacgtatggcacgtgatgtagcccacacattgaaacagttggtggcggccaagttgaaacttaacgaggagcaggtcgaggactacttttttcaactgaagtcacagaagcggtatcatgaagacatcttcggggccgttttcccatacgaagccaaaaaagatcgagttgcagtccagccttcttccttggagatgtcagcattatag

SEQ ID NO: 126592 - DNA, 3612 bp, Artificial Sequence
  Description of Artificial Sequence: Synthetic coding sequence
atggggaatcttaaaagtgtggcgcaggaaccgggacctccgtgtggcttgggcctgggcttaggcttaggcctgtgtgggaagcaggggcccgcaaccccggcacccgaacccagcagagcacctgcttcgctcttacccccagcccctgagcactccccaccttcctcacctctgacacagccacctgaggggccgaaatttccccgggtgaagaactgggaagtgggcagcatcacatacgacacactgtccgcacaggcacagcaggatgggccatgcaccccaaggcgatgcctgggaagtttagtgtttcctcgcaagcttcagggacgcccatccccagggcctcctgcacccgagcagctgctttcccaggcccgggattttataaaccagtattatagttctatcaagagaagcggcagccaggcccacgaacagcgcttgcaggaggtggaggcggaagtcgccgctactggcacctaccaactgcgtgaaagcgagctggtcttcggcgcaaaacaggcgtggaggaatgctccacgatgcgtgggcagaatccaatgggggaagttgcaagtgtttgatgcacgggattgtaggtctgctcaggaaatgtttacctacatctgcaaccacattaagtacgccacaaataggggaaacttgaggagcgctattacggtcttccctcaacggtgtcccggtcgcggagacttccgaatctggaactcccaattggtgcggtacgcgggttaccgccagcaggatggatctgtgagaggcgaccctgccaacgtcgagatcacagaactttgcatccagcatgggtggaccccaggaaatggccggttcgacgtgttgccactgctcttgcaggctcccgatgatcctccggagctgtttctactgccccctgaactggttctggaagtgccactagaacaccccacgttggagtggttcgcagccttagggttgagatggtatgccctacccgctgttagcaacatgctgctcgagatcggagggctggaattccccgctgccccgttctcaggctggtatatgagcaccgagattggcacaagaaatctttgtgatccccatcgctataatatcctcgaggatgtcgctgtgtgtatggaccttgatactcgcactaccagttcgctttggaaagacaaagcggcagtagagattaatgtggctgttctgcactcttaccagctggctaaagttactatagtggatcaccacgcagcaacagcttcgttcatgaagcaccttgaaaacgagcaaaaggctagaggtggatgtcctgccgactgggcatggatcgtgccacctatttccggcagcctgactccagtttttcatcaagagatggtcaactatttcttatccccagcttttaggtaccagccggacccttggaagggatccgctgccaaaggtacaggtattacacggaaaaagactttcaaagaagtggccaacgccgttaagatctctgcgtccttaatgggtacggtaatggccaagcgggtcaaggccaccatcctgtacggctctgagacagggcgagctcaatcatatgcccagcagcttgggcgactgttcagaaaagctttcgatcctcgggtgctgtgtatggatgaatacgatgtagttagccttgagcacgaaaccttggtcctcgtcgtcacatcaacttttgggaatggcgatccccctgagaacggcgagagcttcgccgccgccctgatggaaatgagcggaccctacaattcctccccaagacctgagcagcataaaagctacaagattaggttcaactccatctcttgctccgacccattggtgtccagctggcggagaaagagaaaagaatcgtcaaataccgattccgctggtgctctcggcacactgcggttctgcgttttcggacttggatccagggcgtatccccatttttgtgcctttgctcgcgccgttgacactcggctggaagagctggggggcgagaggctgctccagctggggcaaggcgacgaattgtgtggacaggaggaagcctttagaggatgggcccaggccgcatttcaggcggcttgtgaaaccttttgcgttggcgaagatgccaaggcagccgcacgggacatcttctcccctaaaagatcatggaagaggcagcgctaccgattatccgctcaggcggagggtctgcaactcctgcccggtctgatccacgttcacagaagaaaaatgtttcaggcaaccatccggtccgtggaaaatctgcagagctccaagagcacacgggctactatcctcgttagactcgataccggggggcaggagggtttacaatatcagcctggagatcatattggggtttgtccaccgaacagacctgggctggtcgaagcgttactcagtagggtcgaagaccctcctgcccccacggaaccagtggccgtcgagcagctggagaaaggatctcccggcggcccccctcctgggtgggttcgggatcctcgcctaccaccatgcaccctcaggcaggccctgacatttttccttgatattactagtccaccatccccgcagctgctgagactcctgagtaccttagctgaggagcctagagaacagcaagagttggaggccctgagccaggacccacggaggtatgaggagtggaagtggttccgctgcccaacactgctggaagtgcttgagcagttcccctctgtggcactcccagctcctctgttacttacgcagctgccgctcctgcagccaagatactacagcgtatcctccgccccaagtacgcatcctggagagatccacctcaccgtagcagtgcttgcttatcggacacaagatgggctcggacccttacactatggggtgtgctctacttggttgtcacagcttaaacctggggacccggtgccctgcttcatccggggcgccccctcgttcaggctgccacccgacccatcactgccgtgtatcctcgtaggccccggcacgggaatcgctccttttcgaggcttctggcaggaaagactccacgatattgagtcaaagggcctccagcctactcctatgacactggtgtttgggtgtcgatgtagccagctcgaccacctctatcgtgacgaggtacagaatgcacaacagagaggggtgtttggccgcgtgcttacggcatttagcagagagcctgataaccccaagacatacgtccaggacattctccgcacagagctggcagccgaggttcatagagtcctttgcctggaacgcggccacatgttcgtgtgtggggatgtaactatggccacaaacgtactgcagaccgtgcagaggatactcgccacagagggagatatggaactggatgaagcgggggacgtaattggcgtgctccgggatcagcagagataccacgaagatatctttggactcaccctgaggacccaagaggtgacttctaggattcgcacccaaagcttcagtttacaagagagacaactgcggggtgccgtgccctgggccttcgacccaccgggctcagacaccaactcgccctag

SEQ ID NO: 126593 - DNA, 2994 bp, Artificial Sequence
  Description of Artificial Sequence: Synthetic coding sequence
atgttcacctacatctgcaatcacattaagtacgctaccaacagagggaatctcagatccgccattactgtattcccacaacggtgcccaggtcggggcgatttccgaatatggaactcccagctggtccgctatgccgggtatagacaacaggatggatccgttagaggcgaccctgcaaatgtcgaaatcaccgaactgtgtatccagcacggctggactcccggcaacggccgattcgacgtgctgccactgcttcttcaggcaccagatgaccctccagagctgttcctgcttcctccagagctggtgctggaggtcccactggagcatcccaccttggagtggtttgctgcacttggactacgctggtacgcccttcctgccgtcagcaatatgctgctcgaaatcggcgggctggagttccctgcagctcctttctccgggtggtacatgtccaccgagattgggactcggaacctgtgtgatccccataggtataacatcttggaggacgtagccgtgtgtatggatctcgatactcggacaacaagcagtctctggaaggacaaggctgccgtagagattaacgtggcagtgctgcatagctaccaactcgcaaaagtcacaatcgtcgaccatcacgcagctactgcttccttcatgaagcacctcgaaaatgagcagaaggcaagaggtggttgtccagcagattgggcatggattgtgcccccaatatcaggctccctgactccagtgtttcaccaggaaatggtcaactattttttgagtcccgcatttagatatcagcctgacccctggaaaggctccgccgctaagggcaccggtatcacaaggaaaaagacttttaaggaagtagcaaatgccgtaaaaatttcggcatcattgatggggaccgttatggcaaagcgtgttaaggccactattttgtacgggagcgagactgggcgcgcccagtcttacgctcagcaactgggtcggctgttccgaaaagccttcgacccgcgggtgctctgcatggatgaatacgatgtggtgagccttgagcacgagaccctggttctggtagtaacttcaacatttggtaatggtgatccgcccgagaacggagaatcatttgcagccgcgctcatggagatgtccggaccctataattctagccctcgaccagaacagcataagtcttacaagatccggttcaactcaatctcttgttccgatcctttagttagctcctggagaagaaaacggaaagagtcctccaacaccgactccgccggggcccttggaactttacggttttgtgttttcggtcttggatctcgagcctacccccacttttgcgccttcgcgagggccgttgatacacggctcgaggagcttggtggggagcgcctcctccaacttggacagggtgacgaactgtgtggtcaggaggaggccttcagggggtgggctcaggccgcctttcaggccgcctgcgagaccttttgtgtgggggaagacgccaaggccgccgcccgcgacatttttagcccaaagcgtagctggaagcgccaacgctacaggctctctgctcaggccgaaggcctgcaattgctgcccggcctgattcacgtccataggagaaaaatgtttcaggccacgattagatcagtggaaaacctacagtcgagcaagtcgacccgtgctactattctggtcaggctagatactgggggacaagagggcctacaatatcagcccggggatcacatcggcgtctgccctccaaatagaccgggccttgtcgaggccctccttagtcgtgttgaggacccccccgctccaacagagccagtcgcggtggagcaacttgaaaaaggtagtcccggcggtcccccacctggctgggtgagggacccaagacttccaccatgcaccctgcggcaggccctcacattctttctggacattacgagtcctcccagtccacagctccttcgcctcctcagtaccctggccgaggagcctagggaacagcaggagctggaagcgctatctcaggaccctcgccggtacgaagagtggaagtggtttcgctgccccacactgcttgaggtgctggagcagttcccgtcagtggcccttcctgcaccgctgctcctgacccagctgccattgctacaaccaagatactacagcgtgagttcggctccctccactcatcctggcgagatacatcttactgtagcagtcctcgcctatcgcactcaggacgggctgggccctctgcactatggagtttgctccacttggctgtctcaactcaaacctggggacccagtcccttgctttatccgaggtgccccttcttttagacttccccctgatcccagtttaccgtgcatcctggtggggccagggaccggcattgcaccttttcggggcttttggcaagaacggttacatgacatcgagtccaagggccttcaacctacccctatgactctagtctttggttgcagatgcagccagcttgatcacctgtacagagatgaggtgcaaaacgcacagcagcgcggcgtctttgggcgcgtgttaacagccttctcacgggaacccgacaaccccaagacttacgtccaagatattctacgcactgagttagccgccgaagtacaccgggtgctttgccttgaacggggccatatgttcgtgtgtggagatgtgacaatggctactaacgtgctgcaaacagtacagcgcatactcgcaactgagggggatatggagttggatgaggcaggcgacgtcatcggcgtattaagggatcagcagcgctatcacgaagatatcttcgggctcacacttaggacacaggaggtgacatcacggattcgtacccagagcttctctctacaggaacgccaactgagaggcgctgtgccttgggcctttgatccaccgggcagcgacactaacagcccctag

SEQ ID NO: 126594 - DNA, 1521 bp, Artificial Sequence
  Description of Artificial Sequence: Synthetic coding sequence
atgcgtgacccgcttactgactgtccctataataaagtgtacaagaatctgaaagagttctctcagaatggtgaaaacttctgtaaacaggtgacaagcgtgctgcaacaacgcgccaacctggaaatctcatatgccaaaggtctgcagaaattagcttccaagttatccaaggcactgcagaacacacgtaagtcttgcgtgtccagtgcatgggcctgggccagtgagggtatgaagagcactgctgatttgcaccagaagctcgggaaggccatagaactcgaagctatcaagcctacataccaagtgctcaacgtgcaagaaaagaagcgaaaatctctggataacgaggtggagaaaaccgctaacctcgtcatctcaaattggaaccaacagattaaggctaagaagaaactcatggtcagcaccaaaaagcacgaagcgcttttccagctggtggaatccagcaagcagagcatgactgaaaaggaaaagaggaagctgctgaacaagctgacaaagtctaccgagaagctggagaaggaagacgagaattactatcagaagaacatggcaggctactccactagactgaagtgggagaacacccttgagaattgctatcagagtattctggagctggagaaagagaggatacagctgctttgcaataaccttaatcagtactctcaacacatatcattattcggacagactctgactacctgtcacacacaaattcactgcgcaatcagtaagatcgacattgagaaggatattcaggccgtgatggaggagacagccatcctttccaccgagaacaagagcgagttcctcctgacagattattttgaagaagaccccaactccgctatggacaaggagcggcggaagtcgctgctgaagccgaagttgcttcgtcttcagcgagatatcgaaaaggcaagtaaggataaagaggggctggaacggatgcttaaaacctattcctctacgagttctttctctgacgccaaatcacagaaggacaccgccgctttaatggacgaaaacaacctgaagttagacctcttagaagctaatagctacaagctgtcctccatgcttgctgagttggaacagaggccccagcccagccatccttgtagcaattcgatttttcgctggagggaaaaggagcacacacatagttatgttaaaataagtcgcccttttctgatgaagagactggagaacatcgtttcaaaagcatcctccggcgggcagtcaaaccctgggagctcaacaccagcacctggcgctgcacaactctcttccaggttgtgcaaggcactgtattcattccaggcccgccaggatgacgaattgaatctggaaaagggagatattgtaattattcatgagaaaaaggaaggagggtggtggttcggctcactgaatggtaagaaaggccacttcccggctgcgtatgtggaagaactcccatctaacgctggcaacacagcaaccaaggcatag

SEQ ID NO: 126595 - DNA, 1287 bp, Artificial Sequence
  Description of Artificial Sequence: Synthetic coding sequence
atgaagtctacagcagatctccatcaaaaacttgggaaggctattgagctcgaagccatcaaacctacttatcaggttctgaacgtgcaggagaaaaagaggaaatcactggataatgaagtggagaagaccgccaatctggtgatatcgaattggaatcaacaaattaaggccaaaaagaagctcatggtgagcactaaaaaacatgaagcattgtttcagttagtggagtcctccaagcagtccatgacagaaaaggagaaacggaagctcttgaacaaactgactaagtctaccgaaaagctagagaaagaggatgaaaactactatcagaagaacatggcagggtacagcactaggttgaagtgggagaataccctggagaattgttatcagtcaattctggagctggaaaaggaacggatccagctactgtgtaacaatctgaaccagtattctcagcacatcagcctgtttggccagactctgacgacatgccatacccagattcattgtgcaatctctaagattgacatcgaaaaagacatccaggctgttatggaagaaaccgcaatactgagcactgagaataaaagtgagttcttgctcaccgattactttgaagaagaccccaattcggctatggacaaggagcgccgaaaatcgctgttaaagcccaagctgttaaggttgcagcgtgatatcgaaaaggcttctaaagataaggagggccttgaacgaatgctgaaaacttattcatcaacaagttcattctcagatgcaaaatcgcagaaggacactgccgctcttatggatgaaaacaacctgaaactggatttgctggaagctaactcatataagctgagtagcatgctcgccgaactcgaacagcgccctcagccatcacatccttgctccaattcaatctttcgctggagggagaaggaacacacccacagctacgtgaagatatcgcgcccatttctgatgaagaggctagaaaatatcgtgtctaaggcttcttccgggggacagtccaaccctggctcctcaacaccagcacccggcgccgcacagctgtcaagtcggctctgtaaagcgctgtactcattccaagcacgccaagacgacgaactgaatctggagaaaggtgatatagtgatcatccacgaaaagaaagagggtggttggtggtttggaagccttaacgggaagaagggtcacttccctgctgcctatgttgaagaactgccaagtaatgcagggaacactgctactaaggcttag

SEQ ID NO: 126596 - DNA, 1692 bp, Artificial Sequence
  Description of Artificial Sequence: Synthetic coding sequence
atgagagaccccctgacagattgcccttataataaggtctacaagaatctgaaggaattcagccagaacggagagaatttttgcaaacaggtaacatcagtgctgcagcaaagagctaatctggaaatctcctacgctaagggtctgcaaaagctggcttccaagctgtccaaggcactgcagaatacacgtaagtcatgcgtgagcagcgcgtgggcgtgggcctcagagggtatgaagtctacagcggatcttcaccagaaacttggaaaagccattgagctcgaagctatcaagcctacttatcaggttctcaatgttcaggagaaaaagcggaagtctctcgacaacgaggttgagaaaacagctaatctggttatttcgaattggaaccagcagattaaggctaagaagaaactaatggtgtccactaaaaagcacgaggctctgttccaacttgtcgaaagtagcaagcagtctatgactgaaaaggagaagcggaagttgcttaataagttaacgaagagtaccgagaagctcgagaaagaggatgagaactactatcagaagaatatggcgggatactccactcggttgaagtgggaaaacacccttgaaaactgttatcaagtaactcacagcatctgtctgtacgccttctgggtaaagcgtgcttggggaaaatgtgtcagtgacttgaggtaccaagataccttcctgcctgggaatttgccacccctctggtttggctacgacatcgtgaaaagattaatcatgcgcctgtgcagcgtttgtctccagtccatactagagttagagaaggagcgcatacaactcctgtgcaacaacttgaatcagtattcccagcatatcagtctgttcggccaaacacttaccacatgccacactcagatccattgcgctatcagtaaaattgatatcgagaaggacattcaggctgtgatggaggagaccgccatcctgagcacggagaacaaatcagaattcttgttaaccgactattttgaagaggatccgaattcggccatggacaaggaaagaaggaagtcactcctcaagccaaagctattacgtctgcagcgggatattgagaaagccagcaaagataaagaaggcctcgaaagaatgttaaagacttacagttcaactagttcattttcggacgctaagtcccagaaagacactgctgccttgatggatgaaaataatctcaaactggatctgctggaagctaactcttataagctgagcagcatgctggctgaactggaacagaggccacagccatcccatccatgctcaaacagcattttccggtggagagaaaaagaacatacacattcatatgtcaagatatctagaccctttctaatgaaacgactggagaatattgtctctaaggcaagttcaggaggccagagtaatcccgggtcatcaaccccagcacccggagccgctcagctgagttcgcggttgtgcaaagcgctgtactcattccaagcacgccaagacgacgagctcaatctcgaaaagggggatatcgtaattatccatgagaagaaggaaggagggtggtggttcgggtccttaaacggaaagaagggccatttccccgcagcatacgtagaagagcttccttccaatgccggtaacacagcaactaaagcatag

SEQ ID NO: 126597 - DNA, 1692 bp, Artificial Sequence
  Description of Artificial Sequence: Synthetic coding sequence
atgcgtgatccactgaccgattgtccgtataacaaggtgtacaaaaatctcaaggagttctcccagaacggcgagaacttttgcaaacaggtaacatccgtgctccagcagcgagcaaacctggagattagctatgcaaagggactgcaaaagctggctagcaaactgagcaaggcgctccagaacaccaggaagagttgcgtgtccagtgcttgggcctgggcctcggagggcatgaagagtacagccgatttgcaccagaaactgggaaaggccattgagctggaagccattaaaccaacctatcaggttttgaatgtgcaggagaagaagcgaaagagcttggataacgaagtggaaaagactgcaaacctggtgattagcaattggaatcaacagatcaaagccaagaagaaacttatggtgagcactaagaagcatgaggcgctattccagttagtggaaagtagcaagcagagcatgactgagaaagaaaaacggaaacttctgaacaagctcacaaaaagcactgaaaaacttgaaaaagaggatgagaactattaccaaaagaacatggccggatactcgacaaggctaaaatgggagaacaccctcgagaattgctatcaggttacccacagtatttgcctgtacgccttttgggttaaaagggcttgggggaaatgcgtgtccgatctgaggtatcaggacactttcctgcctggcaatctgccccctctatggtttggctatgatattgtgaagcggctcataatgaggctatgcagtgtctgcctgcagtcaatccttgagctcgagaaagagaggattcaactcctgtgcaacaacctgaaccagtactctcagcacatttcactgtttggtcagacattgaccacctgccacactcagattcattgtgccatatctaaaatagatatagaaaaggacattcaggcagtgatggaagagaccgccatactgagtactgaaaataagtctgagttcttgctgaccgattatttcgaggaggaccccaacagtgccatggacaaagagcgaaggaagtctcttctaaagcccaaattactgcggttgcagagggacatcgaaaaggcctccaaggacaaggaagggctcgagcgaatgctaaagacctactccagcacgtcatccttttccgacgcaaaatcgcagaaagatactgccgcccttatggatgaaaataacctcaagcttgatctcctggaagcaaactcttataaactcagcagcatgttggccgagctagaacagcggcctcaacctagtcacccttgttctaatagcattttccgatggcgagaaaaggagcatacgcattcgtacgtgaaaatatctcgtccatttctaatgaagcgcctggagaacatagtgtcaaaggcgtcctccggcggacagtctaatcctggatcatccacccccgcacccggcgcagctcagctatcgtctagactgtgcaaggccttatactcatttcaagccagacaggacgacgagttgaatctggagaaaggggatattgtcataatacacgagaagaaggaaggtggctggtggtttggatcccttaatggaaagaaaggccatttcccagcagcctacgttgaggagcttccgagcaatgccggaaacactgccactaaagcatag

SEQ ID NO: 126598 - DNA, 939 bp, Artificial Sequence
  Description of Artificial Sequence: Synthetic coding sequence
atgacctttgggctgcgcaagcggttgtctgaagagagaggattttctctcatgcctcgagctatggctatcagttcctcaagctgtgagctccctttggttgcagtgtgtcaggtgactagtacaccagacaaacagcagaacttcaagacctgtgcagagctcgtgcgcgaagccgcacgcttgggtgcctgtttggccttcctccctgaagcgttcgacttcatcgcccgcgatcccgctgaaacccttcacctatctgaacctctggggggaaagctgttggaggagtacacccagctggcacgagagtgcggactctggctgagtctcggtggtttccatgaacggggacaggactgggagcaaactcagaagatttacaattgccatgtcctcctgaatagcaagggggccgtcgttgccacctatcgtaaaacacatctgtgcgacgtggagatccctggacaaggacccatgtgcgagtccaactccacaatgccagggccttctctcgaaagcccagtatcgacaccggcagggaaaatcggactagccgtgtgttacgacatgagattcccggagttgtccctcgcacttgctcaggccggcgccgaaattctcacttacccatccgcttttggcagtatcaccggacctgcccactgggaggtcctgctgagagcaagagctattgagactcagtgttacgttgtagccgccgcccagtgcggacggcatcatgaaaagagagcgtcatatggccatagtatggttgtggatccttggggcacagtggttgctcggtgctcagaaggccccggcctttgcctcgctcgaatagacttaaattacctccgccagctgcgccggcacctacctgtatttcaacataggcgaccagatttgtacgggaacctcggccacccccttagctag

SEQ ID NO: 126599 - DNA, 732 bp, Artificial Sequence
  Description of Artificial Sequence: Synthetic coding sequence
atgttgggatttattactaggcccccacaccggtttctgtctttgctttgtcccggcctccgcatcccacagctgagcgtcctatgcgcgcaacctcgtccaagggcaatggctatttcctcatcttcgtgcgaactacccctcgtcgctgtttgccaagtaacatcgacccctgacaagcagcagaattttaaaacctgtgccgagctggtccgggaagccgctcgtctgggtgcatgcttggccttcctgccggaggcgttcgactttattgcacgcgatccagccgagaccttgcatctgagcgagccactggggggaaagctgctggaggagtacacccagcttgcccgcgaatgcggcttatggctttctttgggcggattccatgagcggggtcaagactgggagcagacgcagaaaatttacaactgccacgtgcttctgaacagcaagggtgctgtggtggccacctatagaaagacccatctgtgcgatgtggagatccccggccagggtcccatgtgtgaaagcaacagcactatgcccggcccctccttagaaagtccggtaagtacacctgctggtaaaattggattggcggtatgttatgacatgcgttttccagagctctccctggctctggcccaagcaggggcggaaatccttacatatccaagcgccttcgggtcaattaccggaccggcacactgggaacctgtgtcatcatag

SEQ ID NO: 126600 - DNA, 984 bp, Artificial Sequence
  Description of Artificial Sequence: Synthetic coding sequence
atgttgggatttattacaaggcctccgcataggttcctaagcctgttatgtccaggtctgcgaatccctcagctctctgtgttatgcgctcaacctcgaccaagggccatggcgatctcgtcatcctcttgcgaactcccgcttgttgccgtgtgtcaggtgaccagcactcccgacaagcaacagaacttcaaaacgtgcgccgagctggtgcgcgaggcggcacgccttggtgcatgtctggcctttcttccagaagcgttcgacttcattgccagggatccagcagaaacactccacttaagcgaacccctgggaggtaaattactggaggaatacacgcaactggcacgcgagtgcggcctgtggcttagtctgggtggttttcacgagcggggccaagactgggagcagactcagaaaatttacaattgccacgtcctgctcaattcaaagggcgctgttgtcgctacatacaggaaaacacacctctgcgacgtggagatccccggccagggacccatgtgtgagagcaattctaccatgcccggcccaagccttgaatcccccgtctccacccctgcgggtaagatcggactcgccgtgtgctacgacatgcggtttcctgagctctccctcgccctggcccaggccggtgccgagatcctgacctacccaagcgcatttgggagtattaccggacctgctcattgggaagttctcctgagggccagggctatcgagactcagtgctacgtagtggctgcagcacagtgcgggcgtcaccatgagaaacgagcctcatacggacatagcatggtggtggacccttgggggacagttgtggcccggtgctctgagggccctggtctgtgccttgcaagaatcgatctgaactatctgcggcaactccgccggcatctccctgtgtttcagcatcggagaccagacctctacggtaacctcggacatccactgtcttag

SEQ ID NO: 126601 - DNA, 876 bp, Artificial Sequence
  Description of Artificial Sequence: Synthetic coding sequence
atggcaatttcctcctcaagctgcgaactaccacttgtcgctgtgtgtcaggtgaccagtacgccagacaaacagcagaattttaagacctgcgccgagctggtgcgcgaagccgctcgactgggcgcctgtttggcattcctccctgaagcattcgattttattgcgagagatcctgccgagacattgcacttgagcgagcccctgggtggaaagctgctggaagagtatactcagctcgcgcgggagtgtggcctctggttatctctgggaggattccatgaaaggggtcaggactgggaacagacccagaagatctacaattgtcatgtgcttttaaactctaagggggccgtggtagccacctaccggaagactcacctgtgcgatgtggaaatcccagggcagggacccatgtgtgagtccaattccacaatgcccggccctagcctcgagagtcccgtgtcaacaccagcaggaaaaatcggcctggcggtctgttacgatatgagattccccgagctctctctcgcactcgcccaggccggcgctgaaattctgacatacccatcggccttcggcagcatcaccggtcctgctcactgggaggtgttacttcgggccagagcgatcgagacccagtgttacgtggtagctgcagcccaatgtggacgccatcatgagaaacgggcctcttacggccatagtatggtggtggacccctgggggacggtcgtggcgaggtgctccgaagggcccggcctgtgtcttgcacgcattgacctcaactatctacggcagttgcggcgacacctccccgtgtttcaacacaggcgccctgacctttatggcaacctgggccatcccctgtcttag

SEQ ID NO: 126602 - DNA, 822 bp, Artificial Sequence
  Description of Artificial Sequence: Synthetic coding sequence
atgagcctaactaacactaagacaggtttttcggtgaaggatatcttggatctacccgacacaaacgatgaagaagggtcggtggccgaggggccagaggaagaaaacgaagggcccgagccggctaagcgagccggacctctgggccaaggcgcgctcgacgctgtacaaagtctgcccctaaagaacccattctacgacagttcagataatccatacacaaggtggctggcgtctactgaggggcttcaatattcactccatggtctggccgctggtgcgcctcctcaggactcaagcagtaagagcccagaaccgtcggctgacgagtccccagataatgataaggaaactcccggcggcggtggtgacgcaggaaaaaagaggaagcggagagtgctgttttccaaggcccaaacatacgagctggaacgccgctttagacagcagcgttatctgtccgctccggaaagagagcacctggccagtctcataagactgacacctacacaggtgaaaatttggttccaaaaccaccgatataagatgaaacgggcacgcgctgaaaaaggaatggaggtgactcctctaccatccccaaggcgcgtagccgtgccagttctagtcagggatggtaagccctgccacgctcttaaagcacaggaccttgccgctgccaccttccaggcaggcattcccttttctgcatattcggcgcagagtctacagcacatgcaatataatgcacaatattcttctgccagtacacctcagtaccccacagcccacccactggtacaggcacagcagtggacatggtag

SEQ ID NO: 126603 - DNA, 1065 bp, Artificial Sequence
  Description of Artificial Sequence: Synthetic coding sequence
atgagcctctctccaaagcacaccacgccattctccgtttcagatattttgagtcctatcgaggagacctataaaaagttttctggtgctatggacggcgcaccacccgggctcggcgcccccctgggggccgccgcagcctatagagcaccacccccaggaccgtcctcccaggctgctactgttgcgggaatgcaaccgtcccacgcgatggccggtcacaacgcggccgcggctgccgcggcggccgcagccgctgctgccgcagccgccacttatcacatgcctccaggtgtgtctcagtttccgcacggcgcaatgggatcctattgcaacggtggcctgggtaatatgggcgagctgcctgcctacaccgacggtatgcgagggggagctgccaccggatggtatggtgcaaatcccgatcctcggtattcatctatcagtcgtttcatggggcccagcgcgggtgtgaatgttgccggtatgggaagtctgaccggaattgccgatgctgccaagtctctggggccactccacgccgccgctgctgcagctgcaccaaggcggaaacggcgcgtgctgttctcacaggcacaagtgtacgagttggagagaaggtttaaacagcagaagtacctgtccgctcctgagcgggaacatctggccagcatgattcatcttacacctactcaggttaagatttggttccagaatcaccgctacaaaatgaaacggcaagccaaagacaaagccgcccaacagctccagcaggagggaggcctgggaccaccccccccgcccccaccttctccacgtcgggttgccgtaccagtcttggttaaagatggtaagccgtgtcagaatggcgcgtcaacacccaccccaggtcaggccggccctcagcctccagcaccaactcccgcaccagagctggaagaactcagccccagcccaccagctctacatgggcctggggggggcctggctgcgctggatgcagctgccggtgaatattctggcggggtgttgggcgccaacctcctgtacggtcggacttggtag

SEQ ID NO: 126604 - DNA, 975 bp, Artificial Sequence
  Description of Artificial Sequence: Synthetic coding sequence
atgttcccttcacctgcacttacgccaacaccattttccgttaaagacatcctgaatctcgagcagcaacagaggtcactggcagctgccggagagctgagtgcacgtctcgaggctaccctcgccccctcttcctgtatgctggcagccttcaaaccagaggcctacgccggtccagaggcggctgctccaggactgccagagctgcgagccgagctaggcagagcacctagcccagccaagtgtgctagcgccttccctgctgctcccgcattctacccccgagcatacagcgatccggatcctgccaaagatcctcgtgcggagaagaaagaactatgtgcactgcagaaggccgtagagctcgaaaaaaccgaagccgataacgccgaacgccctagagctaggcggcgtaggaaacctcgggtgctctttagccaagctcaagtgtatgagctcgagcgccgattcaaacagcagcggtatttaagcgcacctgagagggatcagctcgcaagcgtgctgaaacttacctccacccaggtaaagatctggtttcagaatcggcgttataagtgtaaaagacagaggcaggatcaaacattggaattggtaggcctgcctccaccccccccaccacccgccagaaggatagccgtgcctgtcctcgtgcgggacggtaagccatgtctgggggattctgctccatacgcgccagcatacggagttgggttgaacccttatggttacaacgcttatccagcttaccctggatacggcggcgccgcctgttctcctggatactcttgtactgccgcctaccccgcaggaccgtcccctgctcaaccggccacagcggcagctaataataatttcgtgaatttcggcgtaggggatctgaatgccgtgcagtcccccggaatcccgcagtccaacagtggagtgtccacattgcatggtatcagagcctggtag

SEQ ID NO: 126605 - DNA, 339 bp, Artificial Sequence
  Description of Artificial Sequence: Synthetic coding sequence
atgtttcctagccctgccctgacacccacacccttcagtgttaaggacatattgaacctggaacagcagcagcgctccttagcagcagcgggcgaactgtctgcgcgattagaggcaaccctggccccatcctcctgcatgctggcagcgtttaaacccgaggcttatgcgggacctgaggccgctgcccccggcctcccagagcttagggctgaacttggtcgcgcccccagcccagctaaatgtgcttcagccttccccgctgcaccagcattttatccaagagcctactccgatcccgaccctgccaaggatccacgcgccgagaagaaggcctag

SEQ ID NO: 126606 - DNA, 456 bp, Artificial Sequence
  Description of Artificial Sequence: Synthetic coding sequence
atgtttccctcccccgctctcacacctaccccatttagtgtgaaagatatactcaaccttgagcaacagcagaggagtctagctgcagcgggggagctgtccgctagactcgaggcgacactcgcccctagcagttgcatgctcgctgcttttaaacccgaggcatacgcaggtccagaggctgctgctcctggcctgccggaactgagggcggagcttgggagagccccatcccctgcaaagtgtgcttccgcctttcccgcagcccctgccttctacccacgcgcctatagcgatccagatccagcaaaggatccaagggccgagaagaaaggctgcgagctgccacgcggccagaggccaccagttcttttttcttccgcactttcccaaccagactttcttcagatgctgtcggaaacttgccgttggttgcccgtgcacctggcggaatag

SEQ ID NO: 126607 - DNA, 906 bp, Artificial Sequence
  Description of Artificial Sequence: Synthetic coding sequence
atgctcctgtccccagtgacctcaacaccctttagcgttaaggatatacttcggctggagcgcgaacggtcctgccccgccgcaagccctcaccctcgggtgcgcaaaagcccagaaaatttccagtacctcagaatggacgctgagccccgaggatccgaggtgcataacgcaggcgggggcggtggcgaccggaagctcgacggatctgaaccgcccggtggcccatgtgaggccgtgctggagatggacgccgaaagaatgggagaaccccagcctgggctaaatgccgcatccccactaggaggtgggactcgggtcccagaaaggggtgtgggcaactccggagactccgtgcgcggggggcgaagcgaacagccaaaggctagacaaaggaggaaacctagagtattgtttagtcaagctcaagtcctcgcactggagcgacggttcaaacagcagaggtacctttcagctcccgagagggaacacttggcttccgccttgcaactcacctctacacaggtgaagatatggtttcagaacagaaggtacaagtgcaagcgccagaggcaggacaaatcactggaactcgccggccacccccttacccccaggagagtggctgtgccggtgcttgttagagacggtaaaccttgtttaggccctggccccggcgctccagcctttccaagcccatactcagcagccgtttccccatattcttgttacggaggctactctggagcgccatacggggcagggtacggcacctgctacgccggcgccccatctgggccagcaccacacaccccactcgcctctgctggcttcggccacggggggcagaatgccactccccagggacacctggcagcaactttgcagggcgtccgggcctggtag

SEQ ID NO: 126608 - DNA, 660 bp, Artificial Sequence
  Description of Artificial Sequence: Synthetic coding sequence
atggacgccgaaaggatgggggagccccaaccaggactgaacgccgccagcccacttgggggggggactagagtccctgaacggggcgtgggcaactcgggcgactccgtaagaggtgggagatcggaacaacctaaggcccgccaacgtcgcaagcccagggtcttgttttcccaggcccaggtcttggcgcttgaacgcaggtttaaacagcagagatatttatctgcccctgagagggagcatctggcttcagcattacagctgacttccacccaggtgaaaatctggttccaaaacagaaggtacaaatgtaaacggcagcggcaagacaaatctcttgaattagccggtcatcccctcaccccaaggagagtggctgtgcccgtcctcgtacgcgatgggaagccctgtctgggtcctggccctggggcacccgccttcccctccccttattccgcggctgtctctccatactcttgctatggcggctactctggcgcaccttatggcgccggctatggtacctgttacgccggagctccaagcggtcccgctcctcacacgcctcttgcttctgctggcttcggtcacggcggacaaaatgctacccctcagggacatctggccgccacactccagggggttagagcatggtag

SEQ ID NO: 126609 - DNA, 720 bp, Artificial Sequence
  Description of Artificial Sequence: Synthetic coding sequence
atggcgacaagcggtcggctgtcattcactgtgagatcactccttgacctgccggaacaagacgcacagcatcttccaagacgcgagccagagcccagagccccgcagcccgatccttgcgcagcctggctcgattcagaacgtggacattatccatcttctgacgaatcaagcttggagacttccccacctgactcttcccagcgcccttccgcacggcccgcgtcgcccgggagtgatgctgagaagagaaagaaacgccgagtgctgtttagtaaagctcagacccttgagctagaacgcagatttaggcagcaacggtacctttctgctccggaaagggagcaactggcttctcttcttaggttgacaccgacacaagtgaaaatttggttccaaaaccatcgatacaagttaaaacgggctagggcccctggcgcagctgaatcccccgacctggccgccagtgccgaacttcacgcggcaccaggactcctaagacgcgtcgtggttccagtgctcgtgagggacggccagccctgcggcggaggtgggggaggcgaggtaggaactgccgctgctcaggaaaagtgcggcgctccacctgcagctgcctgcccgctgcccggttacccggccttcgggcctggatcggcactcggcttgtttccagcctatcaacacttggcgagtcccgctctagtgtcctggaactggtag

SEQ ID NO: 126610 - DNA, 1002 bp, Artificial Sequence
  Description of Artificial Sequence: Synthetic coding sequence
atggccgtgcgcggagccaacacactcacgagcttttccatccaggccatactaaataagaaagaagaaagggggggcctcgccgcccccgagggacgccctgctcctggaggtaccgctgcaagcgtcgccgccgctccagccgtgtgttgctggcggctgtttggagagcgcgacgcaggagcccttggaggtgccgaggactccctcttggcctcacccgccgggactcgtacggctgctggacgaaccgctgaaagcccagaggggtgggactcagattctgcattgagcgaggagaatgagagtcggcgtagatgtgccgatgcccgtggagcctcaggagcagggttggcgggcggcagcttgagtcttggccagcctgtgtgtgagctggcagccagtaaagacctagaggaggaagccgctggccgctccgactccgagatgtccgcaagcgttagcggagacaggagcccgagaaccgaggacgatggcgttggacctcgcggcgcccacgtgagtgctctctgtagcggcgcagggggtggcgggggatcaggcccagctggcgtcgccgaggaagaggaggaaccagccgctcctaaaccgcgcaagaagcgatccagagctgccttcagccacgcacaggtctttgagttggagcggcgcttcaaccatcagaggtacttaagcggccctgagagagctgacctggctgcttccctgaaacttactgagacgcaggtcaagatttggttccagaatcggaggtataagacgaagcggcggcagatggcagcagatctgcttgccagtgctcctgccgccaaaaaggtcgccgtaaaagtcctcgtgagagacgaccagcgccagtacctccctggcgaggtactcaggcccccttccctcctgcccctgcaacctagttactactacccctattactgcctgcccggctgggccctgtcgacctgcgccgcggccgcaggcacgcagtag

SEQ ID NO: 126611 - DNA, 798 bp, Artificial Sequence
  Description of Artificial Sequence: Synthetic coding sequence
atggagtccaatctgcagggaacatttctgctgaacaacacgccactcgctcaattcccagagatgaaagctcctgtctgccaatacagtgttcagaacagcttttataagctcagtcctccaggactcggtccccagctcgcagccggaactccccatgggatcaccgacatcctttctcgaccagtggctgcacccaacaacagcctcctttccgggtaccctcacgtagcaggctttggcggcttaagttcccaaggagtttattattctccccaggtcggcaatttttccaaggctggcaacgaataccctacacgcacacggaattgctgggctgacaccggccaagactggagaggcgggaggcagtgtagcaacacgcctgatcctttaagcgattctatccacaaaaaaaagcatacaagaccgaccttcaccgggcaccagatctttgcattggagaagacctttgaacagaccaaatacctggccggtcccgaacgggccagattggcatactccttaggaatgacagagagtcaggttaaggtgtggttccaaaaccgccgaacaaagtggcgtaagaagtctgccctggagcccagttccagcacgcctcgggcccccgggggcgccggagccggtgccggaggggatagagcaccgtccgagaatgaggatgatgaatataataaacccttagatccagatagcgacgatgagaaaattcggctgctgcttcgcaaacatagagcagcgttttcagtgctgtcccttggcgcccacagtgtatag

SEQ ID NO: 126612 - DNA, 408 bp, Artificial Sequence
  Description of Artificial Sequence: Synthetic coding sequence
atgcagcaggggcagttagcacccgggtcaaggctgtgtagcggaccttggggattacccgaattgcagcctgccgcgccatcttcgtctgcagcccagctgccttggggggagagctggggcgaagaggctgatacccccgcctgccttagcgcgtcaggcgtctggttccagaatcggaggactaaatggcggaagaagtccgcactggagccatccagttcaaccccgcgtgccccggggggagctggggcaggggctggaggagatcgggctccaagtgaaaacgaggacgacgagtataataagcctctcgaccccgatagtgatgacgaaaagattcggctgctgttgagaaagcatagagcagctttctccgtgctgagcctcggagcccacagcgtttag

SEQ ID NO: 126613 - DNA, 2928 bp, Artificial Sequence
  Description of Artificial Sequence: Synthetic coding sequence
atgcgttggggacatcacctgccacgggcaagttgggggtctggttttagaagggctcttcagagacctgacgatcggattccattcctgattcattggtcctggcctctgcaaggtgaaagaccattcggtcctccacgcgcatttatcaggcatcatggaagtagcgttgatagtgctcccccgccagggcgccatggtcggctcttcccttccgcttctgctactgaggctattcagcgacaccggagaaacctggctgagtggttctctaggctgcctagagaggagcggcaatttggaccgacatttgcactggacaccgtgcacgtagaccctgtgattcgtgaatcaacacctgacgagttactcagaccccccgcagagctggcactagagcatcagccccctcaggccgggctgccaccactagcactcagccagctctttaaccccgatgcttgtggacgacgggtccagacggtcgtgctgtacggcaccgttgggacggggaagtcgactcttgtgagaaagatggtgctggactggtgctatgggaggctacctgcctttgagctactgattcccttttcttgcgaggatctttctagtctggggccagccccagcctccctgtgtcagctagtggcccagcggtacaccccactgaaagaggtgcttccactcatggcagctgcgggctctcacctcctgttcgtcttacatgggctggagcacctgaacctcgacttccggctcgcagggacgggcctgtgttccgatcctgaagagccacaagagccagctgccatcattgtgaatctgctgcggaagtacatgttgccccaggctagtatactcgtgaccacccgcccttccgccattggcaggatcccctctaaatacgtcggcaggtacggtgagatttgtggtttctctgacactaacctgcaaaagctctattttcagctgagactgaatcagccctattgtgggtatgccgtggggggctctggggtctccgccacacctgcgcagcgcgaccatctggtgcaaatgctatctcgaaacctggaagggcaccaccagattgctgcagcatgctttctgccatcgtattgctggctcgtctgcgccactctgcattttctccacgcgcctacccccgccgggcagacactgacatcaatctacacgtcctttctaagattaaacttctccggggaaacgctcgactcgactgatccctctaacctcagtcttatggcttacgccgccagaacaatgggaaagttggcatatgaaggcgtaagttctagaaaaacttatttttcagaggaggacgtttgcgggtgtctcgaagctggcatcagaacagaagaggaatttcagctgctgcacatttttagaagagacgccttgcggttcttcctggccccctgtgtggaaccaggtagggcaggaacttttgtgttcactgtgcctgcgatgcaagaatatctcgccgcattatacatcgtcctgggacttaggaagactacactgcagaaggtaggaaaggaagtcgctgagctcgtcggacgagtgggtgaagacgtctcactagtgctcggaataatggctaaacttcttcctcttcgtgccctcccactgctgttcaacctcatcaaagtggtgccgagggtgttcggccgaatggtgggcaaatcaagggaagctgtagctcaggccatggtgttggaaatgtttagagaggaggactactataatgacgatgtactggatcagatgggagcctccatcctgggagtggaagggccgcggcgtcaccccgacgaacccccggaagacgaagtgtttgagcttttccctatgttcatgggtggactcttgagcgcccataatcgtgccgtgctggcgcagctgggttgtccgatcaagaacctggatgccctggaaaatgctcaggccatcaagaaaaaactgggaaagctggggagacaagtgctcccgccctccgaactgctggaccaccttttcttccactatgagtttcagaaccagcgctttagcgccgaagtgttgtcctcacttcgccaacttaacttggccggagtgagaatgactcccgtgaaatgcaccgtggtcgcagccgtgcttgggtccgggcggcacgccctggacgaggtgaatctggctagttgtcagctcgatccggcggggctgagaactctcctcccagtgtttctcagggcgcggaaattggggttacagcttaatagcctaggtccggaggcgtgcaaggacctgcgggatctgctgttacacgatcagtgtcagatcactacgctgagattgagtaataaccccctcactgctgctggggtcgccgtcctgatggagggactcgccggaaatacatcagtgacgcacctgtccctgctgcatactggactcggggatgagggcctggagctcctcgctgcgcagcttgatcggaataggcagcttcaagagctcaacgtcgcttacaacggagcaggggatacagcagccctggcactggcccgcgccgcccgtgagcacccgtctttggaactgttacacctctattttaatgaattgtccagtgagggaagacaggtgctgagagatctgggaggtgctgccgagggcggcgcccgagtggttgtctccctgaccgaaggaacggcagtgtccgaatactggtctgtcattctctccgaagtgcagcgaaatctgaattcttgggacagagcccgcgtgcagaggcatctggaactgctgttacgggatctggaggatagccgtggtgccacgctgaatccctggcggaaggcccagttactgcgagtggaaggtgaggtgagagcattgctggagcagcttggatcctctgggtcatag

SEQ ID NO: 126614 - DNA, 345 bp, Artificial Sequence
  Description of Artificial Sequence: Synthetic coding sequence
ggcatctccaagctcaaaatggtgaatcaatgttttggactgggcgacgggacgtgccttctcagcatacaactggagggcccaaaacacgtcgcgttcgggtggccagagtgccctgaggctcccctacctacgctccctccaccccccttgaaagaacccttaacagtatccccacgagggtcccacttgatgagtgcaatgccaggcgtctcaccttcgcggtgcgtgggaagcttccccagttgtctcatgcttacttgcggccacagggggtgtccccacataggagccttctcaagcagcagctgtcctctttgccataatggcatgatggcctggtag

SEQ ID NO: 126615 - DNA, 2928 bp, Artificial Sequence
  Description of Artificial Sequence: Synthetic coding sequence
atgcggtggggccaccacctgcctcgagcgagctggggctcagggtttagaagagccctgcaaaggccagatgatagaatcccttttctgattcactggtcctggcccctacagggtgaacggccattcggacccccacgggcattcatccggcatcacggaagctctgtggatagtgcacctccaccaggtagacacggccgtttgttccccagtgcatccgctaccgaggccatccagcggcatagacgtaatctggccgaatggtttagcagactcccaagagaggaaagacaatttgggcctacgttcgcgctagatacagtgcacgtcgatcccgtcatcagagaatctacgccggatgaactcctgcgaccccctgccgagcttgctcttgaacaccaacccccccaggcgggtttgcccccactggccctgtcccaattgtttaaccccgatgcttgtggacgacgtgtacaaacagtagtactgtatggtaccgtcggcaccggaaaatctacactggtgcgcaagatggtcctggactggtgttacggccgattacctgcctttgaactactgattcccttcagctgcgaggacctgtcgagtttggggcctgcaccagcatctctgtgtcaattggtggcccagcgatacacgcctctcaaggaggtgctgccccttatggcggctgccggaagtcaccttcttttcgttttacatggtcttgagcatttgaacctagattttagactcgcagggaccggtctctgcagcgatcccgaagaacctcaggaacccgccgctataatcgtgaacctgttgaggaaatacatgcttcctcaggcaagcatacttgtgaccacacgtcccagcgcgatcggacggatacccagcaaatatgtcggtcggtatggtgaaatttgtgggttctccgacacgaatctgcaaaagctttactttcagctaaggctcaatcaaccctattgcggatatgctgttggggggtccggtgtttccgccactcccgcccagcgggaccatcttgtgcagatgctgtctagaaacctcgaaggtcaccatcagattgctgccgcatgttttctaccctcttactgttggctggtctgcgcaacattgcattttctccatgcccccactcccgccggtcagacgctaaccagcatttacaccagcttcttgcgcttgaacttctctggtgaaactctcgattccaccgatccaagtaatttatcactgatggcttacgccgcccgaaccatgggcaaacttgcttacgaaggtgtctcaagcagaaaaacttacttcagcgaagaagatgtgtgcggatgccttgaggcaggcattcggacagaggaagaattccagctgctgcacatattccggcgcgatgcattaagattttttctggccccatgcgtcgaacccggacgagccggtactttcgtctttaccgtgccggccatgcaggaatacctcgccgcactatatatcgtgctggggttgaggaagaccactctccaaaaagtgggaaaagaggtggcggagctggtgggcagggtaggcgaagacgtctccctggttctgggcatcatggccaaacttctacccctgagagcattgcccttgctcttcaacctgattaaggtcgttcctagggtctttggacggatggtgggcaagagtagggaggccgtggctcaggcaatggtcctggaaatgttcagggaggaggactactacaacgatgacgttctcgatcagatgggagcctcaatcctaggggttgaaggccccaggcggcatcctgatgagcccccagaggacgaagtgtttgagctgttccccatgtttatggggggccttctgtccgcacacaatagagccgtactggcccagctgggctgccctatcaaaaacctggacgcactggagaatgctcaagcaattaaaaagaaactgggcaagctgggccggcaggtcctgccaccctccgaactgctggaccatctgtttttccattatgaatttcagaaccagagattcagtgccgaagtgttaagctccctgaggcagcttaatctggcaggcgtcagaatgacacctgtgaagtgcaccgttgtggcggccgtcctggggagcggccggcacgcgctcgatgaggtgaacctggcttcctgtcaattggaccccgcgggcctgcgcacgctccttccggttttcctgagagcacggaaacttggcctccagctgaattcgcttggcccagaggcctgcaaggacctgcgcgatctcctgctgcacgaccagtgccaaatcaccacactccggctgagcaacaaccccctcacagccgccggggttgcggttctgatggaggggctggctggtaataccagtgtgactcaccttagcctgcttcacacaggcctgggagacgaagggcttgaattactcgctgctcagcttgaccgcaatcggcagctccaggagctgaacgtggcttacaatggggccggggacactgctgccctggcactcgctcgcgccgcacgagaacatccctcgttagaacttctgcatttatactttaatgagttgtcttcagaggggaggcaggtactcagggatttaggaggtgccgccgaaggcggcgcaagagtggtggtgagcctgaccgagggaactgccgtctcggagtattggtctgtgattctatcagaggtgcagaggaacctgaatagctgggatagggcccgggtgcagcggcacctggagctgctcctgagggacctggaagactcaagaggcgcgactttgaacccgtggaggaaggcccagttactgagggtcgagggagaggtgcgggcactgctggaacagctcggatcctccggttcctag

SEQ ID NO: 126616 - DNA, 2766 bp, Artificial Sequence
  Description of Artificial Sequence: Synthetic coding sequence
atgcgctggggacatcatctgcccagggcaagctggggcagcggattccgtagggcgctccaacgccccgatgaccgcatccctttcctcatccactggagttggccactccaaggagagcgaccttttggcccaccacgggcttttattcggcatcacggtagctcagtcgactctgctcctccccccggtcggcacggtcggcttttcccctcggcttccgccacagaagctatccaacgccacagacgtaatctggccgaatggttcagtcggttgcctagggaggaacggcaattcggacccacttttgctttggataccgtacatgtggatcccgtgatcagggagagtacccccgacgagcttctgcgccctccagccgaactggcactggagcaccagcctccacaggcgggactgcctcccctggctctatcacagttatttaaccccgacgcctgcggcagaagagtacagaccgttgtgctgtacggaacagtggggaccggtaaatctactctagtgaggaagatggtactggactggtgttatggtagattaccagctttcgagctcctcatccccttcagctgtgaagatctgagttccctggggcctgcccctgcgtcattgtgtcagttagtggcgcagcggtatacccccctgaaagaagtcttgcctctcatggctgccgcgggctcccatctgctcttcgtactgcacggactagagcacctgaatctggacttcaggctggccggaactggtctgtgcagtgatcccgaagagcctcaggagccagctgctattatagtaaatctgttaagaaaatatatgttgccacaggcctccatcttagttacgacccgaccatcagcgattgggcgaattcctagtaagtatgtcgggcgctatggggaaatatgcggatttagtgacacaaacctgcagaagctgtactttcaactccggctcaaccagccttattgcggctacgccgttggcggttcaggggtttccgccacccctgcccagcgagaccacctggtacagatgcttagcagaaatttggagggccatcatcaaattgccgccgcatgttttctcccctcttactgctggctagtctgcgctacacttcatttcctgcacgcacctacgcccgctggccagacattaacttccatctacacctccttcctccggctgaatttctctggagaaacactcgattcaacagacccttcaaatcttagcctgatggcatatgctgcacggaccatgggtaagctggcctatgaaggagtcagctcccgcaaaacctacttctcagaagaagatgtgtgcggatgtctggaagctggcattcgaactgaggaggaattccagcttctgcacatctttcgtcgggatgcgctaagattttttctcgccccatgcgtggaaccaggtcgtgccgggacttttgtgttcaccgtcccagcaatgcaggaataccttgctgcgttatacatagtcctgggtttacgcaaaaccaccctccaaaaagtagggaaagaagtggcagaactagtgggcagggttggagaggacgtgtctctggtgctgggaattatggcgaaacttctacccctgcgggccttgccgctgttgttcaatctgattaaggtcgttcctagagtgtttggccggatggtcggcaagtctagggaggctgtggcccaggccatggtactagagatgtttcgcgaggaggactactataatgacgatgtcctggatcagatgggagcttccatcctcggcgtagagggtccccggaggcatcctgacgaaccaccagaggatgaagtgtttgagctgttccctatgtttatggggggtctactgagtgcccataatcgggcagtccttgctcaactgggctgtccaataaagaatttagatgctctggaaaatgctcaggcaataaaaaagaaattagggaagcttggtcgccaggtcctccctccatctgagctcctcgaccacctatttttccattacgaatttcagaaccagcgcttctcagctgaggtcctgagctctcttagacagctgaatctcgccggggtgcgtatgacacccgtgaaatgtaccgtggtcgccgcagtgttggggagcgggcgccacgccctggatgaagtgaaccttgcctcctgccagctggaccccgcaggactgaggactcttctcccagtgttcctaagagcaaggaagctggggcttcagcttaactcactgggtccagaagcgtgtaaggacctacgggatcttcttcttcatgatcagtgtcagattaccaccctgaggctgtcaaacaaccccctcacagccgccggcgtcgctgtgctgatggaaggattggcagggaatacatccgtgacccacctctctttactgcataccggcttgggagatgagggactggagcttctggctgctcagctggaccgaaaccgccagcttcaggagctgaacgtagcatataacggagctggcgacactgctgcactagccttggctcgagctgctcgcgagcacccttcacttgagctgctccagggggtggccatccaaatgtgctggaaactcccgctgctcccctatgcccacttgtggactcctaggatgccttctcattggtgtttccttttaatcctgatgccccctctgccccagtggtatgacggcctggtggctcctcgaggtcgttgcacctag

SEQ ID NO: 126617 - DNA, 2928 bp, Artificial Sequence
  Description of Artificial Sequence: Synthetic coding sequence
atgcgttggggtcaccatctgccacgagctagctgggggtcaggctttagacgcgctttgcagaggccagatgaccggattcccttcctgatccattggagctggccactgcaaggcgagcgcccatttggcccacccagggcatttatccggcatcacggtagctccgtcgatagcgcaccccccccaggccgccacggaagactctttccttccgccagcgccaccgaggcgatccaacgtcatagaagaaatctggccgagtggttttctcggctaccccgcgaggaacgtcaattcggtcccacgttcgccttggataccgtgcatgtcgatccggttattcgggagtcgacccccgacgaactgcttcggcccccggccgagttagcactagaacaccagccaccccaagccgggctgccaccactcgcactgtcacagctttttaaccccgatgcctgcggtagacgagtacagacagtggtcctgtacggaacagtgggaacagggaaatccacactcgtgcgcaaaatggttctggactggtgctacggccggctgccagcttttgaactactcattcccttttcatgtgaggacctctcatctcttggacccgcacctgctagcctgtgtcaactagtcgcccagcgctacaccccgctcaaagaggtactcccattaatggccgctgccggctctcatcttttgttcgtgcttcacggcctggagcacttaaatttagatttccgtttggccggcaccggactgtgcagcgaccctgaagaaccccaggagccggctgctattattgtcaacttgctgcggaaatacatgttgcctcaggccagtatcctagttacaactcgaccctccgctattgggcgtattccaagtaagtatgtcggcaggtacggcgagatatgcggcttcagtgatactaatctccaaaaattgtactttcagcttcgattgaaccaaccctactgtggctacgcagtcgggggtagcggggtgtccgcaacgcctgcacagagagatcacctcgtccagatgctgagtcgaaatctcgagggccatcatcagattgctgcagcctgttttctgccttcctattgttggctcgtctgtgccacgttacactttctccatgcgcccacacctgctgggcaaacactgacatccatctacactagttttctgcggttaaatttctcaggcgaaactctggactccactgacccctccaacttaagtttaatggcttacgcagctagaaccatgggcaaactggcctacgagggagtgtcgtcacggaagacttacttcagcgaggaagacgtgtgcggatgtctcgaggcaggaatcaggaccgaagaggagtttcagctactgcacatatttcgcagggatgccctgcggttttttctggcaccctgtgtggagcccggacgagcagggacatttgtctttacagtgcctgccatgcaggagtaccttgctgctctttacattgtgttaggattaagaaaaacgaccctgcagaaagtgggcaaagaagtggcagagctcgtggggcgggtgggcgaagacgtgtctttggtcttaggcatcatggctaagctgctgccactgagagctctaccgcttttgttcaatctaatcaaggtggtgcccagagtttttggacgcatggtgggaaagagccgagaggccgtcgcacaggctatggtgctggagatgttcagggaggaagactactataacgacgatgtgttggaccagatgggagcttctatcttaggagtggaaggacccagacgccacccggacgagccacccgaggacgaggttttcgaattatttccaatgtttatgggcggcctcctttccgctcacaaccgcgcagtcttggcccagctggggtgtccaatcaagaatctggacgccttagaaaacgcacaggctatcaagaaaaagcttggaaagctgggaagacaggtgctgccacctagtgaactgcttgatcacctgttctttcactacgagttccagaaccagcgcttctcagccgaggtactgtcatccctgaggcagttgaatctggctggcgtcagaatgactcccgtgaagtgcaccgtggtagccgcagttctggggtcaggtaggcatgcactagatgaggtgaatctggccagctgccagctagaccctgccggcctccgcacgctgttgcccgtgttcctgcgtgctaggaagcttggactgcagctcaactcactcggaccggaggcctgtaaagatctccgcgatttactgctgcatgaccagtgtcagatcacaaccctgaggcttagcaataaccctctaacagctgctggtgtggcagtgttaatggaagggctcgccggaaacaccagcgtgacgcacctgagcttgctgcacacagggctgggcgacgaaggattagagctgctcgcagctcaattagatcggaacaggcagctccaagagttaaacgtggcctataacggggccggagatacagccgccctggctctcgcccgggccgctagggagcacccgagcctcgaattactgcacctgtatttcaacgaactatccagtgagggcagacaagttctgcgggatctgggcggcgctgcagaaggaggcgcaagggtcgttgtaagtttaaccgaggggaccgccgtgagcgagtactggtcagtcatactgtcagaggtgcagcgtaacttaaatagctgggatagggctcgcgtgcagagacacctggagctgcttttacgtgatctggaagacagccgcggagcaaccctgaatccatggcggaaggcccagctgctgcgtgtcgaaggagaggtgagggcccttcttgagcagctcggctcaagcggatcttag

SEQ ID NO: 126618 - DNA, 2766 bp, Artificial Sequence
  Description of Artificial Sequence: Synthetic coding sequence
atgagatgggggcaccatctgccgcgagcgtcttgggggtccggattcaggagagcattacagaggcccgatgatcggataccatttttaatccattggtcctggcctctgcaaggagaacggccgtttgggccacccagggcctttattcggcaccatgggagctctgtagattctgcccctccccctggcaggcacgggaggctgtttcccagcgctagtgcgaccgaagcgatccagaggcatagacggaacctcgctgaatggttctccagacttcctcgtgaagaacgacagttcggcccaaccttcgcactggacaccgtccatgtcgaccctgtaatccgagaaagcacgcctgacgagctgctcagacctccagcggaattagctctcgagcaccagcctccccaagccgggcttccgcctctagcattgtcccagttattcaatcctgacgcctgcggtcgcagagtccagaccgtggttctttatggtaccgtgggaactggtaaatccaccctcgtacggaagatggtgttagactggtgctatgggcggctcccagcctttgaactccttatccctttcagctgcgaggatttgagcagtttgggtcctgcccccgcttcactgtgtcagctggtagcccagagatatacgcccttaaaagaggttttaccgctgatggctgccgccggttcacatctgctgttcgtcctgcatggccttgagcacctcaaccttgatttccgcctggcagggacgggcctttgttccgacccggaagaacctcaggagccagctgcaatcattgtcaacttattgagaaaatacatgcttccccaggcttcaatcctagtgacaactcggccaagcgccatcggccgcattccgtcaaaatatgttggaagatatggagaaatttgcggcttctcagacacaaacctgcaaaaactatacttccagctgcgcctgaaccagccctactgcggttatgccgttgggggcagcggcgtaagtgcaacgcctgcccaaagagatcacctggtacagatgctctcacgcaatcttgaaggacatcaccaaattgctgctgcgtgttttctccctagctactgctggctggtgtgtgctaccctgcattttcttcacgcacctacgcccgccggtcagactctgaccagcatatatacttcatttctgagactgaacttcagtggagaaacactagattcgactgatccatccaatctgagcctgatggcgtatgctgcacggaccatgggcaaattggcttatgaaggcgtctcaagtcggaagacttacttttcggaagaagatgtgtgtgggtgcctggaagctgggatcaggaccgaggaagagtttcagctattacatatttttcggcgggatgctcttcgcttttttctcgcaccatgtgtggagcctggtcgcgccggaactttcgtgttcaccgtgccagccatgcaggagtacctcgccgctctgtatatcgttctggggctccggaagaccacacttcagaaagtaggaaaggaagttgccgagttggtcggtagggtgggggaggacgtttccctcgtgttgggaattatggccaaactgctgcccttaagagcccttccgctactgttcaatttgattaaggtagtgccccgggtatttggacggatggttggcaaaagtcgggaggcagtagcccaggccatggtattggaaatgttcagggaggaggattattataacgatgacgtgctggatcagatgggggccagcatcctgggagtggaaggcccacggagacatcccgatgagcctcccgaagacgaggttttcgagctttttccaatgtttatgggaggcctcctctcagcccataaccgcgctgtattggcacagctgggatgtccaatcaagaacttggatgccctggagaacgcacaggcgattaagaaaaaactgggtaagctcggacggcaggtcctgcctccttcggaactgctggaccacctgttcttccactatgagtttcagaaccagcggttttcagctgaggtcctgtcttctctccgccagcttaacctggccggtgtgcgcatgacccctgtgaagtgtaccgttgtggccgcagtgctgggctcgggccggcatgccctcgatgaagtcaatctcgcatcctgccaactggaccctgcaggcttgaggactctcctacccgttttcctgagggcaaggaagcttgggttgcaactgaatagtctcggtcccgaggcctgcaaagacctccgcgacttgcttctccacgatcaatgtcagatcacaaccctccggctgtccaataaccccctcaccgccgctggagtggccgtccttatggaggggttagcaggtaatactagcgttacccacctcagtctgctccacacaggcttgggggacgaaggactggagctcctggcggcacagctcgaccggaaccgccagctacaagagctgaatgtggcatataatggcgctggtgatacagcagctctggcacttgctcgcgcggcacgcgagcacccaagcctggaattgctgcagggggtggccatccagatgtgttggaaattgccgctgctaccatatgcccacctgtggacgcccaggatgccttcccactggtgtttcctgctcattctgatgcctcccctgcctcagtggtatgatggcctggtggctcctagaggcaggtgtacctag

SEQ ID NO: 126619 - DNA, 3111 bp, Artificial Sequence
  Description of Artificial Sequence: Synthetic coding sequence
atgaagatggcaagcacacgatgcaagctagccaggtatcttgaagatttagaggatgtcgatcttaagaaatttaaaatgcacttagaggattatccaccgcaaaaggggtgtatccctctgccaagaggccagactgagaaggcagaccacgtggacctggctacacttatgattgactttaacggggaggagaaggcatgggccatggccgtgtggatcttcgctgcaatcaaccgcagagacctgtatgagaaggcaaaaagagatgagccaaagtgggggagcgacaacgcgagagtgagcaatccaaccgtgatatgccaagaggactctattgaagaggagtggatgggccttctagagtacctcagtaggattagcatctgtaagatgaagaaagattataggaagaaataccgcaagtacgtgcgaagccgtttccagtgtattgaggaccgtaatgcgcgccttggagagtctgtgagtctgaacaagaggtatactagactgcggctcattaaggagcaccgctcacagcaggaaagagagcaggagctgctggcaataggtaaaactaagacatgcgagagtcctgtatcaccaattaaaatggagcttctattcgaccccgacgacgagcactctgagcctgtccacactgtcgtgtttcaaggggctgcagggatcggtaagacgatcctggccagaaagatgatgctcgactgggcatccggaaccctgtatcaggatcgcttcgactatctgttctacatacactgtcgcgaggtctcattagtaactcagcgatctttgggagacctcattatgtcatgttgccccgaccctaacccacctatccacaaaattgtgcgaaagccaagccgaatactcttcctcatggatggttttgacgagttacaaggcgccttcgacgagcacattggcccactctgcacagattggcagaaagccgaacgcggagatatacttttatctagtctcataaggaagaaactgttgcctgaagcttctctattgatcacaacccggccagtcgccctggagaagttacaacatctattggatcatcccaggcatgtagaaatactcggtttctcagaggcaaaacgtaaagaatacttcttcaagtacttctccgacgaagctcaagccagagccgcattttctctgatccaggagaacgaagtgctatttacaatgtgctttataccattggtttgctggatcgtttgtacaggtttgaaacagcagatggaaagcggcaagagcctcgcccagacctccaagactacgacggccgtgtacgtttttttcctgtctagtctcctgcagccccgagggggcagccaagaacacggcctgtgcgcccacctctggggcttgtgcagcctggccgccgacgggatctggaatcaaaagatactgttcgaggaatccgatcttcggaaccacgggctccagaaggcagatgtgtcagctttcctgagaatgaacttattccagaaggaagtggactgtgagaagttttattcatttattcatatgactttccaagagttctttgctgcaatgtactatctgctcgaggaggagaaggagggacgcaccaatgtgcctgggtcacggctgaagcttccttccagggacgttacggtgctcctcgaaaactatggaaagttcgagaagggatacctgatattcgtggttcgttttctgtttggtctggtaaaccaagaacggacaagctatttggagaagaaactgtcatgtaagataagccagcaaattcggctggagctgttgaagtggatcgaagtaaaggccaaggcaaagaaactgcaaattcagccctctcaactggaattgttttactgtctgtacgagatgcaggaagaagattttgtccagagagcaatggattacttccccaagattgaaatcaacttgtctacgcgcatggaccatatggtgagtagcttctgtatagagaactgccacagagtcgagtctctaagcctggggtttctgcacaatatgcccaaagaggaagaggaagaggaaaaggagggcagacatctagatatggttcaatgcgttttaccctcttccagccacgcagcatgttctcatggactggtcaattcacatctgacgagttcattttgtcgaggattgttctctgtgctcagcaccagccagagtttgaccgagttggacttgagtgacaattctctgggcgatccaggcatgagagttctttgcgaaacattgcaacacccaggatgtaatatcaggcgcctatggctggggcgttgtggcctctctcacgagtgctgctttgacattagcttggtgctgagctccaaccagaagttggtagaactggacctgagtgacaacgccctgggcgattttgggattagactgttgtgtgtgggcctgaagcatctgctgtgcaaccttaaaaaactctggctggtgtcatgttgtctcacatcagcgtgttgtcaggacctggcctcagtactgagcacctcacactctctaacccgcttgtatgtcggcgagaatgcattgggagattcaggagtggcaatcctctgcgaaaaagccaagaatccacagtgtaatcttcaaaaactcggcctggtcaacagcggcctaacttctgtttgctgcagcgcactgtcatctgttctgtcaaccaatcagaacctcacccacctttatcttagaggcaatacgctgggggataaaggcattaaactactgtgtgaaggcctgctgcaccccgattgcaaactgcaggtcctcgagttggataattgtaacctgactagccattgttgctgggacctctcgacgctgctcaccagcagccaaagtttacggaagttatcactggggaacaatgatctgggcgatctaggtgtcatgatgttctgcgaggtgttgaagcagcagagctgtctgctccaaaatctcggcctctcagaaatgtacttcaactacgagaccaaatccgctctcgaaactctgcaggaagagaagcccgaactgacggtggtgtttgaaccctcatggtag

SEQ ID NO: 126620 - DNA, 2769 bp, Artificial Sequence
  Description of Artificial Sequence: Synthetic coding sequence
atgaaaatggcaagtacgagatgcaagttagccagatacctcgaggatcttgaggacgttgatctaaagaagttcaagatgcacctggaggattacccgcctcagaaagggtgtatccctcttcccagaggccagaccgaaaaggcggaccacgtggatttagcaactctcatgatcgattttaatggagaggagaaggcgtgggcaatggcggtttggatctttgctgctattaacagaagagacctgtacgagaaagctaaaagagatgagcccaagtggggttctgataatgcccgcgtgagcaatcctacagttatatgccaggaagactcgattgaggaggaatggatgggcctgctggaatacctgagtcgcataagtatctgtaagatgaaaaaagactacaggaagaaatatcggaagtatgtgcgctctaggttccaatgcatcgaagatcgtaacgctcggctgggcgagtctgtctctcttaataaacgctatactagattacggcttataaaagagcataggtcacagcaggagagggagcaggagctactggccatcggaaagactaagacatgtgagagcccggtgtcccctatcaagatggagcttcttttcgaccccgatgacgagcattccgaacccgtccacactgtggtcttccagggcgccgccgggattgggaagacaattctggccagaaagatgatgctggactgggcttctggtacattgtaccaagacagattcgactacctgttctatattcactgccgtgaggtttcactggtgacacaacgaagtctgggtgatttaatcatgagctgctgtcctgaccccaacccccccattcataagattgtgaggaagccatccagaattctattcctaatggatgggtttgatgaactgcaaggagccttcgatgaacacatcgggccactttgtaccgattggcaaaaagccgagcgaggagacatactcctgagcagccttattagaaaaaagctactacctgaggcaagcttgttaatcaccacacggcccgtggctctagaaaaactgcaacatctactggatcatcccaggcacgtggaaatccttggattctcagaagccaagcgtaaggaatacttttttaagtatttttcggacgaggcccaggcccgggcagcattttccctcatccaggaaaacgaagtgctgtttaccatgtgctttatccccctcgtctgctggatcgtgtgtaccgggttgaagcagcagatggagagtggaaagtccctcgcccagacgagcaaaactacgacagcagtatatgtgttcttcctctcatctctcctgcaaccgcgcggtgggtctcaggaacacggcctgtgtgctcatctgtggggactgtgtagcctggcagcagacggtatttggaatcagaagatcctcttcgaggaaagtgaccttcggaatcatggcctgcagaaggctgacgtgtcagcgttcttgcgaatgaatctgttccagaaggaagtagattgtgagaagttctacagtttcatacatatgacattccaagaattcttcgccgctatgtattatctgctggaggaagagaaagagggccggactaacgtaccaggttccaggctcaagctaccgtccagagacgttaccgtgctgctggagaattatggaaagttcgagaaagggtacctgatttttgtggtgcggttcttgtttgggctggtcaaccaggagcgcacaagctacctggagaagaaactgagctgcaaaattagccagcagatccgccttgagttgctcaaatggatagaggtcaaagctaaggctaaaaagctgcagatccaaccatcccagctagaactgttttattgtctgtacgagatgcaggaagaggattttgtccagcgggccatggattacttccccaagatagaaatcaatctgagcacacgcatggatcatatggtctcctcattttgcattgagaactgtcatcgggttgagtctctttcactcggcttcctgcacaacatgcctaaggaggaagaggaggaagagaaagaagggcgacacctggacatggtccagtgcgtgctgccgtcatcatctcatgctgcgtgctcccacggtctggggaggtgcggcctatcgcacgagtgttgcttcgacatatctctggtgctgtcttccaatcagaaattagtggagttggacctctcagataatgccctcggcgattttggaattcggctgttgtgcgtgggactgaaacatctcctctgcaacctgaaaaagctttggctggtcaattctggattgacttctgtgtgctgctcggccttatcctctgtgcttagtactaatcagaacctgactcacttgtacctccgaggaaacacactcggagacaaaggaattaagttgctctgcgaaggattgctgcacccggattgtaagctgcaggttctggaacttgataactgcaatctgactagccactgctgttgggatctcagtacactgttgacatccagccagtccctgcgcaagctttcactgggaaataacgatttgggagatctcggcgtgatgatgttctgcgaggtgctgaagcagcagtcctgtttgctgcagaacttgggattatctgagatgtattttaactatgaaacaaaaagcgctttggagaccttgcaggaagagaagccggagttgacagtggtgttcgagccatcctggtag

SEQ ID NO: 126621 - DNA, 2940 bp, Artificial Sequence
  Description of Artificial Sequence: Synthetic coding sequence
atgaaaatggccagcacaagatgtaaactagcaaggtaccttgaggatctggaagacgtcgatttgaagaaatttaagatgcatctggaagattacccccctcagaaagggtgcatccctcttcctagggggcagactgagaaggccgaccatgtggacttagccaccttgatgatagactttaatggcgaagaaaaagcttgggcaatggcagtgtggatattcgctgccattaatcggagagacctctacgaaaaagcgaagagagatgagcctaagtggggaagcgataacgctcgggtgagcaacccaaccgtaatatgtcaggaggacagcatagaggaggagtggatgggactcctcgagtatttgtctcgtatctccatctgcaagatgaaaaaagactatcgcaagaaataccgcaaatacgtgcgatcacgctttcagtgtatcgaggatagaaatgcgagactgggcgaaagtgttagtcttaacaaacgatacactagactcagactgattaaggaacaccggtcccaacaagagcgggagcaggagctgctggccatagggaagaccaagacgtgcgagtctcccgtgagcccgatcaagatggagttgctgtttgaccctgatgacgagcattctgagcctgtacataccgtcgtgtttcaaggggccgcgggaatcggtaaaactattttggcacgtaaaatgatgcttgattgggcaagcggcactctgtaccaggacagatttgattatcttttctatatacactgtcgggaggtttcgcttgttacacagagatccctgggcgacttgattatgtcatgctgtcccgatccgaatccaccaatacacaagatcgtccgcaaaccctctcgtatcctctttctcatggacggatttgatgagttgcaaggcgcctttgatgagcatattggacctctgtgtaccgactggcagaaagcggaaaggggagacatcctattgagctccttaatccgcaaaaagctgcttccagaggcaagcctactgatcacaactcgccctgtggccctcgaaaagctgcagcaccttctcgatcacccccgccacgtagaaattttgggcttcagtgaagcaaagagaaaagaatatttctttaagtacttctctgacgaggctcaggcacgggccgccttctcactcattcaggagaatgaagtcctgtttactatgtgtttcataccactggtgtgttggattgtgtgtaccggcctgaagcagcaaatggaaagcggcaaaagcttggcccagacgagtaagactacaaccgccgtgtacgtgtttttcttatcatctctcctgcagccaaggggaggcagtcaggagcacggcctgtgcgcacacctctgggggctatgttctctggccgctgacggcatctggaaccagaagattctgttcgaggagtctgatctgcgtaaccacgggctgcaaaaggccgacgtcagcgctttcttacgaatgaacttgttccagaaagaggttgattgcgagaagttctactcctttattcacatgacattccaggaattcttcgctgccatgtactacctcctggaagaagagaaagaaggcaggactaacgttccaggtagcaggcttaaactgccttctcgtgacgtgaccgtgctgctggaaaattacggaaagttcgaaaaaggttatttgattttcgtggtccgattccttttcgggttggtcaaccaggaacgcacctcctatctggagaagaagttgagctgcaaaattagccagcagatacggcttgaattacttaaatggatcgaggtgaaagccaaggctaagaaactgcagatccagccttcccagcttgagttgttctactgcctgtatgaaatgcaggaggaagattttgtgcagagggcgatggactattttccaaagattgaaattaacttgtccacccgtatggaccacatggtgagcagcttttgtatcgaaaactgccaccgtgtagagtctttatcactcggcttcctgcataatatgccaaaagaagaagaggaagaagagaaggagggaagacacctggacatggtgcagtgtgtcttaccttcttcctctcatgcagcctgtagccatggtctggtgaacagccatcttaccagctccttctgccggggcctctttagcgtcctctccacttctcagagtttaaccgagctggacctgtccgataattccctaggggaccctggcatgagagtgctgtgtgaaaccttacagcaccccggttgtaatattaggagactgtggttaggacgttgcggcctcagccacgaatgctgcttcgacatctccctggtgctctcctcaaatcaaaagcttgtcgagctagatctttccgacaacgccctcggcgatttcgggatcagactcctatgtgtgggccttaagcacctcttatgtaacctcaaaaaactatggctggtcaacagtggtctcacttcagtgtgctgcagcgcgctttcaagtgtgctgtcaacaaatcagaacctgacgcatctgtatctccgggggaacactctgggcgacaagggaataaaactgctgtgcgagggactgcttcatcccgattgcaagctccaggttctggaactagacaactgtaacttaacatcacattgttgttgggatctgagcacgctgcttactagcagccagtccctacgcaaactcagcctcggtaataatgacttgggtgacctgggcgttatgatgttttgcgaggtgttaaagcaacagtcttgccttctgcagaatctgggactcagcgagatgtatttcaattatgagacaaagtcagcgctggaaacacttcaggaagagaagccggagctgacggtggtcttcgagccttcgtggtag

SEQ ID NO: 126622 - DNA, 2940 bp, Artificial Sequence
  Description of Artificial Sequence: Synthetic coding sequence
atgaaaatggcctccaccagatgtaagctggcccgctatctggaggatctggaagacgtagatttgaagaaattcaagatgcatctggaggattaccctccccagaagggctgtattcccctcccaagggggcagacagagaaagccgaccatgtggatctggccacacttatgatagatttcaacggcgaggaaaaggcttgggcaatggccgtctggatattcgcagcaattaaccggagggacctgtacgaaaaagcgaaacgagacgagcctaaatggggttctgacaacgcacgggtgagcaacccgacagttatctgccaggaagattctatagaggaggaatggatgggtttgctggaatacctcagcaggattagtatatgtaaaatgaagaaggactatagaaagaaataccggaagtatgtgagaagcaggttccagtgtatcgaggatagaaatgccaggctgggagagagtgttagcctgaacaagcggtatactagactccggctcatcaaagagcacaggtcacagcaggagcgcgagcaggagcttttggccattgggaagacaaaaacctgcgagtccccggtctcccctataaaaatggagctactttttgaccctgacgatgagcacagcgaacctgtgcacaccgtcgtttttcagggagctgctggaattggcaaaactattctcgcaagaaaaatgatgttagattgggcttcaggtacgttgtaccaagacagattcgactacctgttttatatccattgcagagaggtgtcgctcgttacccagagatctctgggggatctaatcatgtcgtgttgcccagacccaaatccaccaatccacaaaatagtgcggaaaccatcccggatcctgtttcttatggatgggttcgatgagcttcagggtgcatttgacgagcacataggcccactgtgtactgattggcagaaagctgaacgtggggatattctgctgagctctctgattcggaaaaaattgctgccagaagcttcgctgcttataaccactaggccagtggcgctcgagaaactacagcacttgctcgatcatccccggcatgtcgaaatcctgggattttctgaggctaaacggaaagaatatttctttaaatatttttcagatgaagcacaggctagagcggccttctctctaattcaggagaatgaggtgctgttcacaatgtgcttcatccccctcgtgtgctggattgtgtgcaccggcctcaaacaacagatggaatccggaaagtcgctcgcacagacatctaaaaccaccactgctgtttatgtgttcttcctgtccagtttacttcagccacgcggcggatcccaggaacatgggctctgtgctcacctttggggattgtgtagtttagccgctgacgggatatggaaccagaaaatcctctttgaggaatctgacttgaggaatcacggtttgcagaaggcggatgtatccgctttccttagaatgaacctcttccagaaggaggttgactgcgaaaagttctattcttttattcacatgacatttcaagaattcttcgccgccatgtattacttgctggaagaggagaaggaggggcggaccaacgtgcccggctcgcgtctgaaactcccctctagggacgtgacagtgttgctcgagaattacggcaagtttgagaagggatacctgatcttcgttgtcaggttcctatttggtcttgtgaatcaggagaggacaagctatcttgagaagaagctgtcatgtaagattagccagcaaattagactagaactgctcaagtggatagaagtgaaagccaaagccaaaaaacttcagatacagcccagccagctggagttattctattgtctgtacgagatgcaggaggaggactttgtacagcgcgcgatggactattttccaaagattgagatcaacctgagtacacgtatggatcatatggtgtcatcattttgcatagaaaactgtcatagagtagaatcattaagcttaggctttttacacaatatgcctaaagaggaggaggaagaggaaaaagaggggcggcacctggatatggtgcagtgcgtgctgccttcaagttcccacgctgcttgctcccacggccttgtgaatagccacctgacctcctcattttgtagggggcttttcagtgtgctgagcacttcacaaagcctcactgagcttgatctctctgataactctttgggcgacccagggatgcgtgtgctgtgtgagacgctgcaacacccaggatgtaacatccgacggctttggctggggcgttgcgggctgagtcacgagtgctgcttcgacataagtcttgtcctctcatcaaatcagaagctggttgagctagatttgagtgacaacgccctcggagactttggtatcaggcttctctgtgtgggcctgaaacatctgttgtgtaaccttaaaaagctgtggttagttaactcaggactgacatcagtgtgctgctcggcgctgtcgtccgtcctttcaaccaaccagaacctgacccatctttacctcaggggaaatacactcggcgacaaaggcatcaaattactgtgtgagggcctgcttcaccccgactgtaagctgcaagtcctcgaactggacaactgcaatctaacgtctcattgttgctgggatctcagtactctgctgacatccagccagagcctcagaaagctgtcccttggtaataatgatctcggcgatctcggtgtgatgatgttctgcgaagtactgaaacagcagtcttgtttgctccagaacctcgggctgtcggagatgtactttaattacgagacgaagagcgccttagagacactccaggaagagaagcccgagctaactgtggtgtttgaacctagctggtag

SEQ ID NO: 126623 - DNA, 2940 bp, Artificial Sequence
  Description of Artificial Sequence: Synthetic coding sequence
atgaagatggcgagcacaaggtgcaagctggctcgttaccttgaggacctggaggacgtggacctgaagaagttcaaaatgcatctcgaggattatccaccccagaaaggttgcatccctcttcctagaggacagacagagaaggctgaccatgtcgaccttgctactctaatgatagattttaatggagaggagaaggcttgggcaatggctgtgtggatcttcgcagcaattaacaggcgggatctttatgaaaaagccaaacgcgacgaacctaagtgggggtctgacaatgctagggtgtctaatccaactgtgatctgtcaggaggactcaatcgaggaagaatggatgggactcctggagtatctatccagaataagcatctgcaagatgaagaaggactaccgaaaaaaatacagaaaatatgtgcgatcccgcttccagtgcatcgaggatagaaatgccagactaggggaatccgtcagtctcaacaagaggtataccaggttgcgcctgataaaagaacatagatcccagcaggagcgcgaacaggaactgctcgctattgggaaaactaagacttgcgagtcaccagtgagtccaattaagatggaactgttattcgacccggacgacgagcactcagagcctgttcacacagtggtatttcagggggctgctggcatcggcaaaactatattagcgcggaagatgatgctggactgggcgtccggaactctatatcaggataggtttgattatctgttttacatccactgtcgagaagtgtccctggtcacgcaacggtcattgggtgaccttatcatgtcctgttgtccggaccctaacccacccatccataaaattgtgagaaaacccagtcgcatattgtttcttatggatggctttgatgagctgcagggtgccttcgatgagcatataggccctttgtgtaccgactggcagaaggccgagagaggcgacattctgctcagctcacttatcaggaaaaaattattgcccgaggccagtctgttaattacaactcggccagttgccctcgagaaactgcagcacctgctcgatcacccacgacacgttgagattttgggtttttcagaggccaaacggaaggagtacttcttcaaatacttctctgacgaggctcaagcgcgcgccgcgttctctctgattcaagaaaatgaggtgttattcactatgtgcttcatccctctggtctgctggattgtttgtacagggcttaagcagcagatggagagcggcaaaagccttgcacaaacatctaaaactaccactgccgtctacgtgttcttcttatctagtctcctgcaacccaggggcgggagtcaggagcatggactttgtgcacacctgtggggactgtgttctcttgcggccgacggcatttggaaccagaagattttatttgaagaaagtgaccttagaaaccacggtttacagaaggccgatgtgtccgctttcctgcgaatgaacctgttccagaaagaggtggactgtgagaaattctactcttttatccacatgacattccaggagtttttcgcggcaatgtattacctactggaggaagaaaaagaaggccggacaaatgttcccgggagcagactcaagctaccctcacgcgatgtgacagttctattggagaattatggtaaatttgaaaagggttacctaattttcgtggtgcgctttctgttcggactggtgaatcaggagcgtacctcttatctggagaaaaagctaagctgcaaaatcagccagcagatcagacttgagctcctcaaatggattgaggttaaggctaaagctaagaaactgcagatccagccctcccagcttgaactgttttactgtctgtacgagatgcaggaagaagacttcgtgcaacgggccatggactactttcccaagattgagattaatttgtcgacacgtatggaccacatggtaagtagtttttgtattgagaactgccaccgggtggagtccctgagtttaggcttcctgcacaacatgcccaaggaagaggaggaggaagagaaggaagggaggcatctagacatggtgcagtgcgtattaccatcatcttcgcacgctgcctgttcccacgggctgggccgttgcggtttatctcatgagtgctgctttgatatctcacttgtgctctccagtaaccagaagttggtcgaattggacctgtctgacaacgcactcggagactttggaataaggctcctttgcgtgggactgaagcatctcttgtgtaatctcaagaagctttggctggtctcatgttgcctgaccagcgcctgctgtcaggacctggcaagcgtgcttagcacctcccatagtctgactcgattgtatgtgggcgaaaatgcgttgggggattcaggggtcgcgattctgtgtgaaaaggctaagaacccacagtgtaatctccagaaactgggcctggtgaattctggcctgacttccgtgtgttgctcagcacttagtagcgtactgtctacaaatcaaaacctgacacacctgtacctgcggggcaatactttgggcgataagggtataaagctactttgcgaaggcctcctgcaccctgactgtaaactacaagtccttgagctggacaactgtaatctgacctcgcattgctgctgggacctgtctactttactgacctctagtcaatctctaagaaaactttcccttgggaacaatgatctcggcgatctgggagtcatgatgttttgcgaggtgttgaaacagcaaagttgtctgctccagaacttagggctgtcagagatgtacttcaactatgaaactaagagcgcgctggaaaccctgcaggaggagaagccagaactcacagtcgtgtttgagccctcttggtag

SEQ ID NO: 126624 - DNA, 3111 bp, Artificial Sequence
  Description of Artificial Sequence: Synthetic coding sequence
atgaaaatggcctcaaccagatgcaagctcgctcgttatctagaagatttggaggatgtggacctcaagaaattcaaaatgcatcttgaagattatccaccccagaaagggtgcattcctctgccccggggccagactgaaaaagccgaccacgtggatcttgcgaccctgatgatcgacttcaacggtgaagaaaaagcatgggccatggcggtctggattttcgccgcgatcaataggcgggatttgtatgaaaaagcaaagcgcgacgaacccaagtggggcagtgataacgcacgggtgtcgaatccaacagtcatctgtcaggaagactcaatcgaagaggaatggatgggcctcctggagtacctctcccgcatctcaatttgcaaaatgaaaaaagactaccgcaagaaataccgtaagtatgtcagaagcaggttccagtgtattgaggaccggaatgcacgattgggagagtcagtttccctgaataagcgctataccagactcaggctgatcaaagagcatcgctcacagcaggaaagggaacaggagctgctagccatcggtaagacaaaaacatgtgagtccccggtaagccctatcaaaatggaactgctgtttgaccccgatgatgaacattccgagcctgtgcacaccgtggtgtttcagggtgccgccggtattggcaagacgattctcgcgcgaaagatgatgctcgattgggcatccggcaccttgtatcaagatcgctttgattatctgttttatatccactgccgagaagttagcctggttactcagcgatccctcggagatctcatcatgagctgctgccctgaccccaaccctcctattcataaaatcgtaagaaaaccttcgcggatcctttttctgatggatggatttgacgaactccagggagcctttgatgaacacattggccctctgtgcaccgattggcagaaggccgagaggggcgatatcttactgtcttcattgatcaggaagaagctcctgcctgaagcgtctctactcatcaccactaggccagtcgctctggaaaaactgcaacacctgttagaccacccaaggcacgtggagattttgggcttcagcgaagcgaagaggaaagagtattttttcaaatatttctctgacgaagcccaagctcgcgctgcgttctctctgatacaagaaaatgaagtactcttcacgatgtgttttatcccattggtgtgttggattgtgtgcacaggcctgaagcagcaaatggaaagcgggaaatcgctggcacagacaagcaaaaccaccactgctgtgtatgtcttcttcttgagttctctcctccagccgcggggtgggagccaggaacacggactatgtgctcacctttgggggttatgttcactcgcagcggacggaatttggaatcagaaaatcctcttcgaggaaagcgacctcagaaatcacggcctccagaaggcggacgttagcgcgtttcttagaatgaatttatttcagaaggaagttgattgtgaaaagttttactctttcattcatatgacttttcaggaattctttgctgctatgtattacctgctcgaggaagaaaaggagggtaggaccaacgtgcccggcagccggctgaagctgccctcaagggatgtcaccgtgttactggagaattacgggaagtttgagaagggttacctcatttttgtggtacgattcctcttcggacttgtcaaccaagagagaaccagctatctcgagaaaaagctgagttgtaaaatctcacaacagatcaggctggaactgctcaagtggatagaggtgaaagccaaagctaaaaaactgcaaatacaaccttcacaattggagttattctactgtctgtacgagatgcaggaggaggacttcgttcaaagggctatggattatttccccaaaatcgagattaacctttctactaggatggaccatatggtttcatccttttgcattgagaattgccaccgagtggaaagcctctctctgggctttcttcacaacatgccaaaagaggaggaggaggaagaaaaggaaggcagacacctggacatggtacagtgtgtccttccatccagctcacatgccgcttgcagtcatggcctggttaacagtcacctgacttctagcttctgccgaggactgtttagtgtactgtctacaagccagagccttaccgagttagacttgtcagataattcattaggtgaccccggcatgagggtactgtgcgaaactcttcagcaccccggttgcaacattcgccgcctgtggctgggacggtgtgggttatcacatgagtgttgctttgatattagcctggtcctttcatctaatcagaagttggtcgaactggacttgtcagacaacgcattaggcgactttggtatccgccttctttgcgttggcctgaaacatctcctttgcaacctcaaaaagctttggctcgtgtcatgttgtctgacctccgcttgttgtcaggatcttgcctccgtgctatcaactagccactccctgacaagactttacgtgggagaaaatgcccttggcgactccggagtggccatcttatgtgaaaaggccaaaaacccccagtgcaatctccagaaattggggttagtgaactccggcctcacctccgtatgctgcagtgctcttagctccgtcctctccaccaaccagaatttgacccatctgtacctacgagggaatactctgggagacaaaggcatcaaattgctatgtgagggactgctacacccggattgtaagttgcaagttctcgaactggataactgtaatctcacctcgcactgctgctgggatctctccacactgctcacatcgagtcaatccctgcggaaactttcgctcgggaataacgacctcggggacctgggtgtgatgatgttttgtgaggtacttaagcaacaatcctgtctccttcaaaatttgggcctgagtgaaatgtatttcaactacgagaccaaatctgccctcgaaacgctgcaggaggagaagccagagcttacagtggtgtttgaaccctcctggtag

SEQ ID NO: 126625 - DNA, 1512 bp, Artificial Sequence
  Description of Artificial Sequence: Synthetic coding sequence
atggagtacatggcagagagtactgacagatctcctggccacatcctgtgctgcgagtgcggggtgccaattagccccaatcctgccaatatctgcgtcgcctgtctgcgctccaaggtggatatcagccagggtattcctaaacaggtgagtatctcgttctgcaagcagtgtcagcgctatttccagccccctgggacttggatccagtgtgcactggagtcaagggaactcctggctctctgcctcaagaaaattaaagctcctctttctaaagttaggttggtggatgctgggttcgtttggacggagccacatagcaagaggctgaaagtgaagctcaccatacagaaagaagtgatgaacggtgcgatcctccagcaagtattcgtagtggactacgttgtccagagtcagatgtgcggtgactgccaccgagtagaagccaaggacttttggaaagctgtgatacaggtgcgacaaaaaacacttcacaagaagacattctactatcttgagcagctcattctgaaatatgggatgcaccagaatacgttgagaattaaagagattcacgacggactggacttctattactcctctaaacaacacgcccagaaaatggtagaatttctacagtgcacagtcccttgccgctacaaggcaagtcagcggctcatatcccaggacatacattcaaatacctataactacaaatctacattcagcgtggagatagtgccaatatgcaaggataacgtggtttgtctgagcccaaagctggcccagtctttgggtaatatgaatcaaatttgtgtatgcattagagtcacttcagctatccatcttatcgatcccaacaccttgcaggtagccgatattgatgggtccaccttttggagccacccgttcaacagcctgtgccatccgaaacagctggaggagttcatcgtcatggaatgtagcatcgtccaggatatcaaacgggcggccggcgccggaatgatctccaaaaagcatacactgggggaggtttgggtccagaaaacctccgaaatgaataccgataagcaatacttctgtcgcactcacctgggccaccttctaaatcccggagacctggtacttggcttcgacctcgctaattgtaacctcaatgatgagcatgtcaataagatgaactcagatcgcgttcccgacgttgtcctcatcaagaagtcctatgaccggacgaaaaggcagcgaagaagaaactggaagttgaaggagctagccagagagcgcgaaaacatggatactgacgacgaaagacaataccaggacttcttagaggatctggaagaggacgaggcaatcaggaaaaatgtcaatatatacagagacagcgcaatccccgtggagtcagataccgatgatgaaggagctccccggattagccttgcagagatgctggaagatttgcatattagccaggatgccacaggcgaggaaggcgcttccatgctgacatag

SEQ ID NO: 126626 - DNA, 1512 bp, Artificial Sequence
  Description of Artificial Sequence: Synthetic coding sequence
atggaatatatggcagagtcaaccgaccggtctcccggtcatatcctgtgttgtgagtgtggtgtaccgatttcacccaatcctgccaacatctgcgttgcctgtttacgctcaaaggtcgatatcagccaaggcatacccaagcaggtgtcaattagcttttgtaaacagtgccagcgctattttcagccacctggaacttggatccagtgtgccttggaaagtcgcgagctattggcattgtgcctgaaaaaaataaaagcacctctcagcaaagtgagactggtagatgcggggtttgtatggacagaaccgcactcaaaacgcctaaaggtgaagctgaccattcagaaagaagtcatgaacggcgcaatccttcagcaggtgttcgttgttgactacgtagtccagtctcagatgtgcggcgactgccaccgagtagaggccaaggatttttggaaagcagttattcaagtgcggcagaaaacactacacaagaagacattctattatctagagcaacttatcctcaagtatggcatgcaccaaaacaccctaagaattaaggaaatccatgacggcttggacttttattacagctctaaacagcacgctcagaaaatggtggagttcctccaatgcaccgtgccctgtcggtacaaggcttcacaacggctgattagtcaagacatacattcgaatacttataattacaagagcacattttcagttgagatcgttcccatatgcaaggacaatgttgtgtgcctgagccctaaacttgcccagtctttgggaaacatgaaccagatttgcgtctgcatacgagtgaccagtgcaatccacctgatcgatccgaacacactgcaagtggccgatatcgacggaagcacgttttggagtcatccgttcaacagcctttgccatcctaagcaactggaagagttcatagtgatggagtgctcaatcgtgcaagacataaaacgcgctgcaggagcaggtatgatctcaaaaaaacacactcttggtgaggtgtgggtacaaaagacttcagagatgaacacagacaagcagtatttctgtcgcacacacctcggtcatctgctgaatcctggggatttggtgctaggattcgatctggccaactgtaacctgaacgacgagcacgtaaataagatgaactccgaccgcgtccccgatgtcgtgttgattaaaaaatcctacgacaggacaaaaaggcagagaaggcggaactggaaactgaaggagctggccagggaacgtgagaatatggacactgacgacgaaaggcagtatcaggactttttggaagacctggaggaagacgaagcgattcgtaaaaatgtaaatatttaccgcgattctgctattcccgtagaaagcgacaccgatgacgagggggctccccggatttccctggccgagatgctagaggacctgcacatttctcaggatgctacgggcgaagagggggcatctatgctgacgtag

SEQ ID NO: 126627 - DNA, 471 bp, Artificial Sequence
  Description of Artificial Sequence: Synthetic coding sequence
atggagtatatggctgagagtactgacaggtcacccggccatattctttgttgcgagtgtggagtaccaatctctcccaaccctgctaacatttgtgtcgcttgtctgcgaagcaaagtggacatatctcaagggattccgaagcaggtgagtatctccttttgcaaacagtgccagcgttacttccagccccccgggacttggattcaatgcgccctggaaagcagagagctgctggccctatgcctgaagaaaataaaggctcctctgtccaaagtgagattggtggatgcaggctttgtctggacagagccacactcaaaacgactgaaggtgaaactgactatccagaaggaagttatgaatggggctattctgcagcaggtcttcgtggtagattacgtcgttcagtcacagatgtgcggtgactgtcatcgcgttgaagcaaaagacttttggaaggccgtatag

SEQ ID NO: 126628 - DNA, 657 bp, Artificial Sequence
  Description of Artificial Sequence: Synthetic coding sequence
atggaatacatggccgaaagtaccgaccgtagtcctggacacatattatgctgcgagtgtggggttcccatttccccgaaccccgccaatatctgtgtggcctgtctccgtagtaaagtcgacatatcacaggggatcccaaaacaagtctccatctccttctgcaagcagtgtcagcggtactttcagccacccggaacctggatccagtgtgctttggaatcgcgggagctgctagcgctgtgtctgaagaagataaaggcaccactcagtaaagtcaggctcgttgacgccgggttcgtctggactgaaccacactcaaaaaggctgaaagtcaagcttaccatccagaaggaggtcatgaacggcgctattctgcagcaggtcttcgttgtcgactatgtggtacagtctcagatgtgcggagattgtcaccgcgtggaagcaaaagacttttggaaggccgttatccaggtgcggcagaaaacgctgcataagaagaccttctactatctggaacaacttatcttgaagtacggaatgcaccaaaacactctgagaataaaggaaattcatgacggccttgacttctattattcaagtaagcagcatgcccagaaaatggtcgagtttctccagtgcactgtgccctgctag

SEQ ID NO: 126629 - DNA, 297 bp, Artificial Sequence
  Description of Artificial Sequence: Synthetic coding sequence
atggagtatatggccgaatccacagatcggagtcctgggcacattctctgttgcgaatgcggagtgcccatttctcctaatccggccaatatttgcgttgcatgtctgcgctccaaagtcgatataagccagggaatcccgaagcaggttagtataagcttctgtaaacagtgtcagcgttactttcagccacccggcacatggattcagtgtgccctggagtctcgcgaactgttggctctgtgtcttaagaagattaaagcaccactgtccaaagttcgtctggtggacgcctag

SEQ ID NO: 126630 - DNA, 489 bp, Artificial Sequence
  Description of Artificial Sequence: Synthetic coding sequence
atggaatacatggcagagagcacagaccggtctccaggccatatactatgttgtgagtgtggcgtgccgatttccccaaacccagctaacatttgcgttgcctgcttacgctccaaggtggacatcagtcagggcatccctaaacaggtcagtatctccttttgtaaacaatgccagcgctacttccagccccccggcacatggattcagtgcgcactggaaagtcgtgagctcctcgccttgtgcctgaagaagattaaagcccccttatctaaagtacgactcgtcgatgcaggattcgtgtggactgaaccgcactctaagaggctgaaggtgaaacttacgatacagaaggaggtaatgaacggtgcgatcctccagcaggtgttcgtggttgattatgtcgtccagtctcagatgtgtggcgactgccacagggtcgaggcaaaagatttttggaaagcggtgatccaggtacgccagaaatag

SEQ ID NO: 126631 - DNA, 657 bp, Artificial Sequence
  Description of Artificial Sequence: Synthetic coding sequence
atggagtacatggctgaaagcacagatcgtagccctgggcatatactttgttgtgaatgcggagtcccgatctccccgaacccagcaaacatttgcgttgcttgtctacgttccaaggtggatatttctcagggaataccaaaacaagtcagcatcagcttctgtaaacagtgtcagcgctacttccagcctcccggcacgtggattcagtgcgctcttgaatcccgcgagttgttggccctgtgccttaaaaagataaaagcaccactctctaaagttcggctggtcgatgcaggattcgtttggaccgaaccgcattctaaacggctcaaagttaagctgactatacaaaaggaagttatgaacggggccatcctgcagcaagtttttgtggtcgactacgtggtgcagtcccagatgtgtggggactgtcatagagtggaggccaaggacttctggaaagcagtcatacaagtgcggcaaaaaactctacataaaaaaaccttttactacctggaacagctaattctgaaatatgggatgcaccaaaatactttaagaattaaagaaatccacgatggactggatttttactactcctccaagcagcacgctcaaaaaatggtggagtttctccaatgcaccgtgccatgttag

SEQ ID NO: 126632 - DNA, 1152 bp, Artificial Sequence
  Description of Artificial Sequence: Synthetic coding sequence
atgaacggcgcaatattgcagcaagtctttgtcgtggactatgtggttcaaagtcaaatgtgcggcgactgtcaccgcgtcgaggcaaaggacttctggaaagcagtgatacaagtccgccagaagaccctgcataaaaagacgttttactacctagagcagctcattctgaagtacggcatgcaccaaaacactcttaggataaaggagattcatgacggcctggacttctactacagctcaaagcagcatgcccagaagatggtcgaattcctccaatgcactgtaccatgcaggtataaggcatcccagcgcttgattagtcaggatatacacagcaatacatacaattacaaatcaaccttcagcgtggaaatcgttccaatttgtaaggacaatgtggtgtgcctgtctcccaagttagcacagagcttgggcaacatgaatcaaatctgcgtttgtatcagggtgacttctgctatccatctaatcgatccgaacactctgcaagttgccgacatcgatggatcaactttctggagtcacccgttcaatagtttgtgccacccaaaacagttagaggagttcatcgtgatggagtgcagcatagtgcaagacattaaacgtgccgccggcgccgggatgatctcaaagaagcacaccttaggcgaggtgtgggtccagaaaacgagtgagatgaatacagacaagcagtacttctgcaggactcacctgggccacctcctaaaccctggcgacctcgtgttagggttcgacctggcaaattgcaacctgaacgatgagcatgtcaacaaaatgaattccgaccgggtacctgacgtcgtgctgatcaagaagtcatacgatcgtactaagagacagcggaggagaaattggaaactgaaagaactcgccagagagcgcgagaatatggacactgatgatgagaggcagtaccaggattttctggaggacctggaagaggacgaggcgattcggaagaatgtgaatatttatcgagacagtgccataccagtcgaatcagacacggatgacgaaggggcaccgcgtatctcactagcggagatgctagaagacttacacatctcacaagatgccacaggggaagagggcgcaagtatgttaacgtag

SEQ ID NO: 126633 - DNA, 2949 bp, Artificial Sequence
  Description of Artificial Sequence: Synthetic coding sequence
atgtccagtaagatggtgatcagcgaacctggtctcaattgggacatctctcctaaaaacggcctgaaaacctttttttctagagaaaattacaaggaccatagtatggcgcctagcctgaaggaactgcgcgtgttatctaatcggagaatcggcgagaacctaaatgccagtgctagctcagttgagaatgaaccggctgtatcaagtgcgacccaggcgaaggagaaggtgaagacaacaattggtatggttctgctgcctaagccccgagtcccctacccgagattcagccgcttctcccagagggagcagcggagttatgtcgatctcttggttaagtatgccaaaatacccgcaaattccaaggcagttggaatcaataaaaatgactacctgcagtatcttgatatgaaaaaacacgtgaatgaagaagtgaccgaattcctgaaatttctccagaatagcgctaagaagtgtgcacaagattataatatgctctcagatgacgcccgcctgttcactgaaaagattctgcgtgcttgcattgaacaggtcaagaagtactcagaattctataccttgcacgaggtgactagtctgatgggcttctttccattccgggtggagatgggattgaagctcgaaaagactttgttggcattaggctctgttaagtatgtcaagactgtattcccatctatgcctatcaaattacaactgtcaaaggacgatattgccactatagagacttctgagcagactgcggaggctatgcattacgacatatcaaaggaccctaacgcggaaaaactggtttcccggtaccatccacaaatcgccttgacctcccagtcgcttttcactttgttgaacaaccatggaccaacatataaagagcagtgggagatccccgtgtgcatccaggtcatcccagtggcggggtctaagcctgttaaagtgatatatataaattcgccactgccccagaagaagatgacaatgagagagcgcaaccaaatctttcacgaggtgccgctgaaattcatgatgtctaagaacactagcgtacccgtgtccgccgtctttatggacaaaccagaggagttcatttccgaaatggatatgagttgcgaagtgaacgagtgccgcaagatcgaatccctggagaacctatatcttgacttcgatgatgacgtgactgagttggagacttttggggtcactaccacgaaggtatccaaatccccatcacctgcatcaacatccacagttcctaatatgaccgatgcaccgacggccccaaaggccgggacaactacagtcgccccttctgctcccgacattagtgcaaatagccgcagcttgagccagattctcatggagcagcttcaaaaggaaaaacaattggtcaccgggatggatggtggacccgaagaatgcaagaacaaggacgaccagggatttgagagttgtgaaaaggtgtcaaatagcgacaagccgctgatccaagactcagacctcaaaacttcagatgccctgcagctggagaactctcaggagatcgaaactagtaataaaaatgatatgactattgatatcctccatgctgacggtgagcgcccgaacgtattagagaatttagataattctaaagaaaaaactgtcggcagtgaagctgccaagaccgaggacactgtactgtgttccagcgataccgacgaagagtgcctcatcatcgatactgagtgcaagaacaattccgacgggaaaactgccgtggtaggtagtaatctatccagcagaccagcctctccaaactctagttctggccaggccagcgtggggaatcagactaacactgcttgctctcctgaggagtcttgcgtgcttaagaaacctattaaaagagtgtacaaaaagttcgatccagtgggagaaatccttaaaatgcaggatgagctgctgaaacctatttcacgaaaagtgcccgagctccctctgatgaacctggaaaactccaagcagccaagcgtgtccgaacagctgtccggcccaagcgattcctcctcctggcccaagtcaggctggccatccgccttccagaaacctaagggccggcttccctacgagctgcaggattacgttgaggacacaagcgagtacctggcgccgcaagaagggaatttcgtttacaagctgttctctctgcaggaccttttactcctggtccggtgcagtgtccagagaattgagacccggccccgttctaaaaagagaaagaagatcaggcgacagttccctgtttatgtactgccaaaggtagaataccaggcatgttacggggtggaggccctgaccgaatccgaactttgcagattgtggaccgagagcctgctgcacagtaattccagcttttatgtcgggcacattgacgcctttaccagtaagctgttcctcctggaggaaatcacgagcgaagaattgaaggagaaattaagcgccctgaaaatttcaaatctcttcaacattctgcagcacatcttgaagaagttgtcttccctgcaggaaggctcttatctgttgtctcacgcggcagaggactccagcttactgatctacaaagcttccgatggcaaagtaacccgtacagcatacaacctctacaagactcactgcggactccctggtgtcccttcctcgctctccgtaccatgggtgccactcgatcccagcctgcttctgccataccacatccatcacggcaggatcccatgtacttttccacccaagtcccttgacacaacgacgcagcagaagataggggggacacggatgcccaccagaagccatcgtaatcccgttagtatggaaacaaaaagcagctgcctccctgctcagcaagtggagacagagggagtggctccccacaagagaaagattacctag

SEQ ID NO: 126634 - DNA, 2538 bp, Artificial Sequence
  Description of Artificial Sequence: Synthetic coding sequence
atgaaaaaacacgtgaacgaggaggtgacagagtttctgaagttcctgcagaattccgccaaaaaatgcgcccaggattataatatgctgtctgacgacgctaggctattcaccgaaaagatcctccgcgcatgcattgaacaggtgaaaaagtacagtgagttttacacgctgcatgaagtaacgagcttgatgggcttctttccctttcgtgttgaaatgggcttaaaacttgaaaaaacgcttctggctttgggctctgtgaaatacgtaaaaaccgtgttccccagtatgccgattaaactgcaactgagtaaggatgatatcgctactattgaaacttctgagcaaaccgctgaggccatgcactatgacatctctaaggaccctaatgcagagaaattggtgagccggtaccatccgcagattgcgctgacatcacagtctctgtttaccctgctgaacaatcatggcccaacctacaaggaacaatgggaaatcccagtttgtattcaggttatcccagtggcgggatcgaagcccgtgaaggttatttacatcaattcaccactacctcaaaaaaagatgaccatgagagaaaggaaccaaatcttccacgaagtgcctctgaagttcatgatgtccaaaaacacatccgtgccagtgtctgccgtgtttatggacaaacccgaggaatttatctccgaaatggatatgtcatgtgaagttaacgaatgccgcaagattgaatcactggaaaatctgtaccttgatttcgatgacgatgtgactgagctggaaaccttcggagtgaccaccacaaaggtctccaaatcaccatcaccggccagcacttccacggtccccaacatgacagatgcgcccacagcccccaaggccggtacaactactgttgcaccatctgcgcctgacatttctgcaaactcacggagtctgtcacagatcttaatggagcagctgcaaaaagagaaacagctggtcacagggatggacggcgggccagaggaatgcaaaaacaaggatgaccaggggtttgagtcatgtgaaaaggtgtccaactcagataaacctttaatacaagacagtgacctgaagacgtctgatgcactgcagctggaaaatagtcaggaaattgaaacctccaataaaaacgacatgacaatcgatattctacacgccgacggcgaaaggcccaatgtcttagagaacctcgacaactccaaggagaaaactgtgggcagcgaggccgctaaaaccgaagacacagttctttgtagttcagatactgatgaagagtgtcttatcatagacactgagtgtaagaataattctgacggcaagacggctgtcgtgggttctaacctctcctcacgacccgccagtcctaatagctcaagcggacaggcttccgtaggaaatcagactaacacagcttgtagccccgaagagtcatgcgtgctgaagaagccaatcaagcgtgtctacaaaaaatttgatcccgttggggagatcctgaaaatgcaagatgaactcctgaagcccatcagccgcaaagtgcctgagctgcctctgatgaacctcgagaactccaaacagccgagcgtatcagaacagctcagcgggccatccgattcgtcttcttggcccaaatccggctggccatcagcttttcagaagccaaagggacgcttaccttatgagcttcaggactacgttgaagataccagcgaatacctggccccacaggaaggcaatttcgtgtacaagctcttttccctccaagacctgctcctcttggtccgatgtagcgtgcagcgaatagagaccagaccgaggtccaagaagaggaagaagataaggcgacagtttcccgtctatgtcctgccaaaagtggagtaccaagcttgttacggggtcgaggcgctgactgaatccgagttgtgtcgactgtggactgaaagccttttgcacagcaattcaagcttctacgtcggacacatcgacgctttcacttcaaagctgttcttacttgaggagatcacttcagaagaacttaaggaaaaactgagcgcattaaagatttccaatctttttaacatcctccagcatatcttgaagaaactgtcttcactccaagaggggagctacctgctgtcacacgcagcagaggatagctctctgctgatctataaagcctctgatggcaaggtcacccgtacagcctataatctgtacaagacgcactgcgggctgccaggagttcctagcagtctgtccgtcccatgggtccccctggatccttctctgctattaccataccacatccaccatggcagaatcccctgtaccttcccaccaaaaagccttgacacgaccacccaacagaagatcgggggaacacgtatgccaacacgctcgcaccgcaatcctgtgtctatggaaacaaaatcaagctgtttgcctgcccagcaggttgaaaccgagggagtcgcaccacataaacggaagatcacctag

SEQ ID NO: 126635 - DNA, 1017 bp, Artificial Sequence
  Description of Artificial Sequence: Synthetic coding sequence
atgtcaagtaaaatggtcatctcagagccaggcttaaactgggacatctcccctaagaacggacttaagactttcttctcccgcgagaactataaggaccacagcatggccccctcactcaaagagcttagagttttaagtaaccgcagaatcggggaaaatctgaatgcatcagcatccagcgttgagaatgaaccagcagtgagcagcgcaactcaagccaaagaaaaagtaaaaacaaccatcggcatggtgcttttacccaagccccgggtgccttaccctagatttagtcgttttagccaacgcgaacagcgctcttacgttgacctgctcgtgaaatacgccaaaatccctgcgaactctaaagctgttggaatcaacaagaatgactacttgcagtacctcgatatgaagaagcacgtcaatgaagaggttacagagttcttgaaattcttgcaaaattccgccaaaaaatgtgcccaagattacaatatgctatccgatgatgcccggctgttcaccgaaaagatactccgtgcctgtatagagcaggttaaaaagtattctgagttttacaccctccacgaagtgacgtccctgatgggtttctttccattcagggttgaaatgggattgaagctggagaagacacttctggcactgggctccgtcaagtatgtcaagactgtgttcccatccatgccgattaaactgcagctttccaaggacgacatcgccaccatagagacctccgaacagaccgcagaagccatgcactacgacattagtaaggaccccaatgccgagaaactggtgagtaggtatcatcctcaaatcgcccttactagtcagtctctttttaccctgctgaacaatcacggccccacgtataaggagcagtgggagataccagtttgtatccaggtgatccctgtcgccggctccaaacccgtgaaggtgatttacattaattcaccattaccacagaaaaaaatgactatgagggagagatag

SEQ ID NO: 126636 - DNA, 438 bp, Artificial Sequence
  Description of Artificial Sequence: Synthetic coding sequence
atgtcatcaaagatggtgatctcagagcccggtctcaattgggacattagccccaaaaacggactcaagacttttttctccagagagaattataaagatcattctatggcaccttctctgaaggaactgagagtactcagcaacagacggatcggagaaaacttgaatgccagtgcatcctccgtggagaatgagccagctgtctctagcgccacacaggcaaaggaaaaggtcaaaactaccatcgggatggttttgctgccgaaaccccgagtcccttacccaaggttctctcgattctcgcagagggagcagcgtagttacgtcgacctcctggtcaagtacgctaaaatcccagccaactccaaagccgtcggcatcaacaagaatgactacctgcaatacctggatatgaagaaacacgtcaacgaagagtag

SEQ ID NO: 126637 - DNA, 300 bp, Artificial Sequence
  Description of Artificial Sequence: Synthetic coding sequence
atgagctctaaaatggttatctccgagcccggactcaactgggacatctcaccaaagaacggacttaagacattctttagccgcgagaattacaaagaccacagcatggctccatctctgaaggagctacgagtgctttctaatagacggatcggcgaaaacctaaatgccagcgccagttccgtggagaatgagccagcagtttcatcagcaacccaggcgaaagagaaagtgaaaacaaccattggtatggtcctgctcccaaagccaagagttccctatccgaggttttcacgatag

SEQ ID NO: 126638 - DNA, 285 bp, Artificial Sequence
  Description of Artificial Sequence: Synthetic coding sequence
atgtccagcaagatggtgatcagtgagcccgggctgaattgggacatctctcctaagaatggcctgaagaccttttttagccgggaaaattacaaggatcattccatggccccatctctaaaagagctgcgagtgctatcgaaccgaaggatcggggagaatcttaatgccagcgccagctcagtggagaacgaacctgcggtgtcatccgccacgcaggcgaaggaaaaggtcaaaactaccattggcatggtgctattgcctaaaccccgcgtcccctactag

SEQ ID NO: 126639 - DNA, 846 bp, Artificial Sequence
  Description of Artificial Sequence: Synthetic coding sequence
atgggacagaagaaacagaggcctgcgcgggccggtcagccacactcctcatctgatgccgcccaagctcctgcagaacagccgcacagctcaagcgatgctgcccaagccccatgcccacgagagagatgtctgggacccccaacgacgccgggaccttatcgctcaatctatttctcttctcccaagggccatcttacacggttaggccttgagttctttgaccagccagccgtccccttggccagggcattcctgggccaggtgctcgtgagacggttacccaacggcactgaactgagagggaggatcgtggagaccgaagcctacctgggtcctgaagacgaagccgcacattcaagggggggccgccaaactcctcgcaacaggggaatgttcatgaagcccgggacattatacgtgtacattatttatggcatgtacttctgtatgaacatcagttctcagggcgacggtgcctgcgttctccttcgcgctctagaacccctggaagggctcgaaacaatgaggcagctacgctctactctcaggaaaggcaccgcgtctcgtgtcctaaaggatcgcgaactctgttccgggcccagtaagttatgtcaggcccttgctatcaacaagtccttcgaccagagagatcttgcacaggatgaagctgtgtggctcgagcgaggtcctctggagccttcagaaccagcggtggttgccgctgccagggtcggtgtgggccacgcaggagagtgggctagaaagcctttgaggttctacgtcagaggtagcccatgggtgtccgtcgtggatcgggttgccgagcaagacacacaggcctag

SEQ ID NO: 126640 - DNA, 924 bp, Artificial Sequence
  Description of Artificial Sequence: Synthetic coding sequence
atggaggctgacaaggacgacactcaacagatactgaaggagcactctcccgatgaatttatcaaggatgagcagaacaaaggactgattgatgagatcacgaaaaagaatattcagctgaaaaaggaaattcagaagctagaaacggaactgcaggaggctaccaaggaatttcagatcaaggaggatatccctgagacgaagatgaaatttctgtctgttgagacgcccgaaaacgactcgcagctttctaatatctcttgcagcttccaggtcagtagcaaggtcccgtatgaaattcagaaaggccaggccctaattacatttgaaaaggaagaagtcgcgcagaatgtcgtaagcatgtctaagcaccacgttcagattaaggacgtcaatttggaggtgactgctaagcctgtgcctctgaattccggtgtgcgcttccaggtgtacgtggaggtgagcaaaatgaagatcaacgtcactgagattccagacaccttacgagaagaccagatgcgcgacaagctcgaactcagtttcagcaagagcagaaacggggggggggaagtcgaccgagttgactatgatcgccagtccggaagcgccgtcatcaccttcgttgagattggtgtggctgataaaattctcaagaagaaggagtaccctttgtacatcaatcagacttgccaccgggttaccgtgagcccatacactgaaattcacctgaaaaagtatcagatcttttcggggacttccaagcgcactgttctcctcactggcatggaaggaatccagatggacgaggagatcgtggaagaccttattaacatccactttcagagagcaaaaaacggaggcggtgaagtggatgtggttaagtgttcactggggcagccccacattgcttatttcgaagagtag

SEQ ID NO: 126641 - DNA, 90 bp, Artificial Sequence
  Description of Artificial Sequence: Synthetic coding sequence
atggaggccgataaggacgatacccagcagattttgaaagagcattcccccgatgagttcatcaaagacgaacagaataaagggctgtag

SEQ ID NO: 126642 - DNA, 1185 bp, Artificial Sequence
  Description of Artificial Sequence: Synthetic coding sequence
atgagcagggaaatgcaggatgtagaccttgcggaggtcaagccactggtggagaagggcgagaccataacgggtctgctgcaggagtttgatgttcaggagcaagatatcgagacactacatggatccgtgcacgtcactctgtgcggaacacccaaaggcaaccgacccgtgattttaacttatcatgacattgggatgaaccataagacgtgctataacccgctgtttaattacgaagacatgcaagagattacccagcactttgccgtctgtcatgtggacgcaccagggcagcaggatggcgccgcgtcctttcctgccgggtacatgtatccctccatggaccagttagctgaaatgttgcccggggtgttgcagcagtttggcttaaagtccattattgggatgggtaccggagccggcgcttacatcctcactcgatttgcgcttaataaccctgagatggtcgagggcctggtgctaattaatgtgaacccttgtgccgagggttggatggactgggctgcatctaagatttccggctggacacaggctctgcccgacatggtcgtgtcgcacctgttcggtaaggaggaaatgcagagtaacgttgaggtggtgcatacctacagacagcatattgttaacgatatgaatcctggcaacctccatttgtttattaacgcctacaacagcaggcgcgatctcgagatagaacggcccatgcccggaactcataccgtaacgcttcagtgccctgctctgttggtcgtgggagactcctcacctgccgttgatgccgttgtcgagtgtaattcaaagctggatcccacaaagaccactcttctcaagatggcagattgtggcggacttccccagatctcgcagcccgcaaaactggccgaggcttttaagtatttcgtgcaggggatgggctatatgccgagtgccagcatgacccgattaatgcgctccaggactgcaagcgggtcgtctgtcacctccctcgacgggactcggtcaagatcccatacgagcgaaggcacccggtctcgctcacatactagtgagggaaccagaagcaggtcccatactagtgagggtgcgcatctggatatcacacctaatagtggcgccgccggaaactcagctggacctaagtctatggaagtgtcctgttag

SEQ ID NO: 126643 - DNA, 975 bp, Artificial Sequence
  Description of Artificial Sequence: Synthetic coding sequence
atgtctcgtgaaatgcaggacgttgacctggcagaagtgaaaccccttgtcgagaaaggggaaaccattaccggattgctgcaggagttcgacgtccaggaacaagacatagaaacactacacggttctgtccacgtgaccctgtgtggaaccccaaaaggcaacagaccggtaatcctcacgtatcatgatattggtatgaaccataagacatgcgcttacatcttgactagatttgccctgaataaccctgagatggtggagggattggtcctgatcaacgtgaatccctgtgccgagggttggatggattgggctgcttctaagatctcggggtggacccaggcactgccagatatggtcgtgagtcacctgtttggcaaagaagagatgcagtccaacgttgaagtcgttcacacatatagacaacacattgtgaacgatatgaatccgggaaatttgcacctctttataaacgcttataattctagacgagatttagaaatcgaacgtccaatgccgggaacacacaccgtaacccttcagtgcccagccctcctcgtggttggagattcttccccggcagtggatgcagtcgtggaatgcaattccaagttggatcctacaaaaacaaccctgctcaaaatggcagattgcggtgggctccctcagatatcacagcccgcaaaacttgctgaggccttcaaatattttgtccaaggcatgggatatatgcccagcgctagtatgacaaggctgatgaggtctcgcacagcctctggctctagtgtgacctccctagacggcacgcgttcccgctctcacacgtctgaagggactaggtctcggtcgcacacctcagaggggactcggagccgtagccacacctcagaaggggctcacctggatattactcctaattccggcgccgccggtaattctgcaggccccaaatctatggaagtaagctgttag

SEQ ID NO: 126644 - DNA, 1185 bp, Artificial Sequence
  Description of Artificial Sequence: Synthetic coding sequence
atgtcacgcgaaatgcaagatgtcgatctggccgaagtcaagcccctggtggagaaaggggagacaatcacggggttactgcaagagtttgacgtccaggagcaggacatcgagacactccacggaagtgtacatgtcacgttatgcggaacccccaagggaaaccggccagtgatcctgacctaccacgacattgggatgaatcataagacttgttacaaccccctatttaactatgaagatatgcaggagattactcaacatttcgcggtttgtcatgtggacgctcccggacagcaggacggggctgcatctttccccgcaggttatatgtaccccagcatggaccaattggctgagatgttgcctggtgtgcttcagcagtttggactaaaatcaattattggcatgggaacaggtgcaggagcgtatattctgacgcgctttgcattgaataatccagagatggtggaggggcttgtactcatcaatgttaacccatgtgctgaaggctggatggattgggccgcctctaaaataagcggttggactcaggctctgccagacatggttgtgagccatttgtttggtaaagaggagatgcagagcaacgtggaagtggtccatacttacaggcaacacatcgtgaatgacatgaaccctggaaacctacatctattcattaacgcctataacagtagacgagacctggagattgagcgccccatgcccgggactcacacggttaccctgcagtgtcccgccctcttggtggtcggggactcatctcctgctgtggatgccgtcgtggagtgtaattcaaagcttgatcctacgaagacgactcttcttaaaatggctgattgcggaggactgccacaaatttctcaacccgccaagcttgcagaggcatttaaatactttgtccaagggatgggctacatgccctccgcgtcaatgacaagactcatgaggtcgcgcactgctagcggcagttctgtgacgtctttggacggtaccaggtcccgcagtcacacttctgaaggcaccaggtcgcggagccatacatccgaaggtactaggagcaggagtcacacttctgaaggggcccacctggacataacccccaattcaggggctgcagggaacagcgctggaccaaaatctatggaagtctcctgttag

SEQ ID NO: 126645 - DNA, 498 bp, Artificial Sequence
  Description of Artificial Sequence: Synthetic coding sequence
atgtctcgggagatgcaagacgtcgatctcgctgaagtcaaacctcttgttgagaagggcgagactattaccgggctgctccaagagttcgacgtccaggaacaggatattgaaaccctgcacgggtccgtccacgtgacattgtgcggcacacctaaagggaaccgacctgtcattctcacataccacgatatcggtatgaaccacaagacttgttataatccactgtttaattatgaagacatgcaggagatcacccaacattttgcggtgtgccacgtggatgcgcctggccagcaagatggggcggccagtttccccgcggggtacatgtacccatcaatggaccagcttgctgagatgttacccggggtcctccagcaatttggcttgaagtcaatcatcggcatggggacaggggccggagcctacattctcaccagattcgccctgaataatccggagatggtcgaggggctggtgctgatcaatgtgtag

SEQ ID NO: 126646 - DNA, 477 bp, Artificial Sequence
  Description of Artificial Sequence: Synthetic coding sequence
atgagtcgtgagatgcaggatgtagacctggctgaggtgaaacctcttgtcgaaaagggcgagactatcaccgggttattgcaggaatttgatgttcaagagcaagacattgagaccttacacggcagtgttcatgtgaccctgtgtggcacgccaaagggcaacagacccgtgatactcacctaccacgacatcggcatgaatcacaagacctgctacaacccgctgttcaattatgaagacatgcaggaaatcacacagcatttcgctgtgtgccacgttgacgccccaggtcagcaggatggtgctgcgagttttccagccggttacatgtacccttcaatggaccaattagcagaaatgctgccaggggtgctccagcagttcgggctcaaaagtatcattggtatgggcaccggggctggagcctacatccttacccggttcgccctgaacaaccccgaaatggtcgagtag

SEQ ID NO: 126647 - DNA, 402 bp, Artificial Sequence
  Description of Artificial Sequence: Synthetic coding sequence
atgagtagggagatgcaggacgtggatctggcagaggtgaagcccctggtggagaaaggtgagacaatcacagggctcctgcaggaatttgacgttcaggagcaggatattgagaccctacatgggagcgttcacgttactctctgcggcacacccaaggggaatcgaccagtgatcctcacctaccacgatatcgggatgaaccacaagacatgctataacccacttttcaactacgaagacatgcaggagattacacagcactttgcagtttgccacgtggacgcccctggccagcaggatggcgcagcttcatttccggctggatacatgtatcccagcatggatcagctcgccgagatgctgcctggtgtacttcagcagtttggcctcaaatcgtag

SEQ ID NO: 126648 - DNA, 477 bp, Artificial Sequence
  Description of Artificial Sequence: Synthetic coding sequence
atgtcccgggagatgcaagacgtggacctcgccgaggtgaaacctttagtggaaaagggcgagacaattacgggcctcctgcaagaatttgacgttcaggagcaggacatcgagacacttcatggctccgttcatgttacgctttgcggtactccaaaaggcaataggcccgtcatcttgacctatcacgacattggaatgaaccacaagacctgctataatcccttgttcaactatgaagacatgcaggagattacacagcacttcgcagtttgccacgttgacgcaccgggacagcaggacggcgccgcttcctttccagccggttatatgtatccttcaatggaccagctggctgagatgctccccggagtgctgcaacagttcggcctcaagtctattattggcatgggtaccggggctggcgcctacattctgactaggttcgcccttaacaatcccgaaatggtagagtag

SEQ ID NO: 126649 - DNA, 669 bp, Artificial Sequence
  Description of Artificial Sequence: Synthetic coding sequence
atggactgggccgccagcaagataagcggatggacgcaggccctgcctgatatggtggtctctcatctgttcggcaaggaggagatgcagagcaatgtcgaagtagtacacacctaccgacaacatatcgttaatgacatgaatcccggcaatctgcatcttttcatcaatgcatataactcacggcgggatctcgaaatcgagagacccatgccaggaacgcacacagtaactctgcaatgtccggctctcctggtggttggagactcatctcccgcagtcgatgcagtcgtcgaatgcaactccaagttggaccctacaaaaacaactttactaaaaatggccgactgtgggggtctcccccagatctctcagccggcgaaactggcagaggccttcaaatattttgttcagggaatgggctacatgccaagtgcctccatgactcggctcatgagatcccggacagcttctggctccagtgtgacatcactcgatggtactaggtccagatcccacacctccgaagggaccaggagccggagtcacacttccgaaggcacccgatcccggagtcacacctctgaaggcgctcatttggatatcactcccaactcaggagccgctggcaatagcgcagggcctaaaagtatggaggtgtcctgttag

SEQ ID NO: 126650 - DNA, 450 bp, Artificial Sequence
  Description of Artificial Sequence: Synthetic coding sequence
atgtcccgggaaatgcaggacgttgatttggctgaagtgaagccccttgtggagaaaggtgagaccatcaccggtctgctgcaggagttcgatgtccaagaacaggatattgaaacgctccacggatctgtgcatgtgactttatgtggcacaccccctgccaaactggcggaggcattcaaatacttcgttcaaggcatggggtatatgccttctgcgtctatgacccgactcatgcgtagcagaaccgccagcgggtctagcgtcacatcattagatggcactagaagtcgatcccacacaagtgaaggtaccaggtccaggtctcatactagcgaagggactcggtccaggtcgcacacttccgaaggtgcccaccttgatattaccccaaacagtggcgcagccggtaattcggccggaccaaagagcatggaagtgagctgctag

SEQ ID NO: 126651 - DNA, 942 bp, Artificial Sequence
  Description of Artificial Sequence: Synthetic coding sequence
atgcaggagataacacagcattttgcagtgtgtcatgtcgacgcacctggtcaacaggatggcgccgcctcttttcctgcaggttatatgtacccaagtatggatcagttagccgagatgcttcctggtgtgctgcagcagttcggcctgaaatcaattatcggtatgggcaccggagccggcgcctatatactcactcgttttgctctaaataacccggagatggttgaaggtttggtgctcatcaatgtaaatccctgtgccgaaggctggatggactgggccgctagcaaaatcagtggctggacacaggccctccctgatatggtggtatcacacctttttggaaaagaagaaatgcagtccaacgttgaagtcgtccacacgtacagacagcatattgtaaatgatatgaaccccggcaatctccatctcttcataaatgcctacaattctcggcgagacctcgaaatagagaggcctatgccaggcacccacacagttacacttcagtgcccagccctgttggttgtgggagacagcagtcccgcagtggatgccgtggtggagtgcaactccaagctggatcccacaaaaactactctgcttaagatggctgactgcgggggccttccgcagatctcacagcctgccaaacttgccgaggcctttaagtacttcgtgcagggtatgggttacatgccctccgcatccatgacccgtctcatgcgtagtcgtactgcatccgggtcctctgtcacaagtcttgacgggactagaagccggtctcatacgagcgagggcacaagaagccgaagccataccagcgaaggcacaaggagcaggtcccatacatccgagggtgcccatctggatatcacaccaaatagcggggccgccggtaattcggcgggacctaaaagcatggaagttagttgttag

SEQ ID NO: 126652 - DNA, 288 bp, Artificial Sequence
  Description of Artificial Sequence: Synthetic coding sequence
atgagcagggaaatgcaggacgtggatctcgcagaggtgaagccactcgtggagaaaggagagacgatcaccggcctcttgcaggagttcgatgtgcaaactaagcccgcaaccaccccttcatcgacaacccgcacctgccgaagatctccatcaacactaccaagtgccacttggacaccactggcatctaggacagcgcaacccccctccccacagggcacatgcacacctccctggatctcgtggctgaagtgtttcctggagagctttaatagtttagggtag

SEQ ID NO: 126653 - DNA, 1491 bp, Artificial Sequence
  Description of Artificial Sequence: Synthetic coding sequence
atggcagacgagtcagagaccgccgtgaaaccccccgcccctcctttgccacagatgatggagggtaacgggaacggacacgagcattgctccgattgtgaaaatgaggaggacaacagctacaatagaggaggcctcagccccgccaatgatacgggcgccaagaaaaagaagaagaaacagaagaagaagaaagagaagggatccgaaaccgacagcgcccaggatcaaccagtcaaaatgaatagtctcccggcagaacgcatccaggagattcagaaagccatagaactgttttctgtgggccagggtcccgcaaagacgatggaggaagccagcaagagatcctaccaattttgggacacccagcccgtgccgaaattaggagaagtcgtgaacacccacggaccggtcgaaccggacaaagataatataagacaggaaccatatacactcccccagggctttacatgggacgcactagacctgggggaccggggagtactcaaagaactctacaccttgctgaatgagaattacgtcgaggatgacgataacatgttcaggtttgactatagccccgagttcctgctctgggccctaagaccacccgggtggctgccgcagtggcactgcggcgttcgtgtggtttcaagccggaagctggtgggcttcatctccgctattccggccaacattcatatatatgatactgaaaagaagatggtggaaatcaactttttgtgcgttcataaaaaattaagatctaaaagggtggcccccgttctcatccgagaaattacaagacgagttcacctcgaagggattttccaggcagtctataccgcaggagtagtcctcccgaaacccgtgggcacatgtcggtattggcaccgctcccttaacccccggaagcttatagaagtgaagtttagtcacttatcccggaacatgaccatgcaacggaccatgaaactgtatcgcttgcccgagacaccaaaaacagccggcctgagacccatggagactaaggacattccagtggtgcaccagctcctgactcggtacctaaagcagtttcaccttaccccagtaatgtcgcaggaggaggtggaacattggttttaccctcaggaaaatatcatagatacattcgttgtggaaaatgcgaatggagaggtaactgacttcctgtccttctataccctcccctcaactatcatgaatcatcctactcacaagtctctgaaggcagcttactcattttataacgtgcacacacagacccccctacttgacctcatgtcagacgccctggtactcgccaaaatgaaaggctttgacgtatttaatgctctggatctgatggagaacaagacgttcctggagaagctgaagttcggtatcggtgatggaaatttgcagtactacctatataactggaagtgcccttctatgggtgccgagaaagtcggcttggtcctccagtag

SEQ ID NO: 126654 - DNA, 414 bp, Artificial Sequence
  Description of Artificial Sequence: Synthetic coding sequence
atggccgatgagtcggaaacagccgtgaagccaccagcccctccactccctcagatgatggaaggcaatgggaacggacatgagcattgcagcgactgcgaaaacgaagaagacaattcttataacaggggcgggctgagccctgcaaacgacactggcgcaaaaaaaaagaagaaaaagcagaagaagaagaaggaaaaagggagtgagaccgattccgcacaggaccagcctgtgaaaatgaacagcctgcccgctgagcggatccaggagatccagaaggccatcgagctgttctccgtgggacaggggccagcaaagacaatggaggaggcctccaagagatcgtatcagttttgggacactcagcccgtccccaaacttgccaagaggaccgtgcaccctcccgaatag

SEQ ID NO: 126655 - DNA, 1491 bp, Artificial Sequence
  Description of Artificial Sequence: Synthetic coding sequence
atggcggacgagtccgagaccgctgtgaagccccccgccccgccattgcctcagatgatggaggggaatggcaatggacacgagcactgctccgattgcgaaaacgaggaagacaattcctataacaggggagggctctcccccgctaatgacactggggccaaaaaaaagaagaaaaagcagaaaaaaaagaaggagaaagggagcgagactgatagtgcgcaggaccagccagtgaagatgaattccctgcctgcagagcgaatccaggaaatccagaaagccatcgaacttttctcagtggggcagggccccgctaaaaccatggaggaggctagcaagcggtcatatcaattctgggatacgcagccggtgccgaagctcggggaagtggttaacacacacggccctgtggagccggacaaggacaatataagacaagaaccttacactctgcctcagggctttacatgggacgccctcgacctgggggaccggggcgtgcttaaagagctgtatactttattaaacgaaaattacgtggaggatgacgacaacatgttccggtttgactactcccccgagttcctgctgtgggctctcaggccccctggatggctcccgcaatggcactgtggggttcgcgtcgtgtcttcccggaaactggtgggatttatctcagccatcccagcgaatatccacatctatgatactgagaaaaaaatggtagaaatcaactttctctgtgttcataagaagctgcgctctaagagggtcgcgccagtgctgatccgggagattactcgaagggtgcatctagaggggatctttcaggcagtgtatactgccggagtcgtgctgcctaagccagtcggcacctgcagatattggcaccgatcacttaatcctagaaagctcatcgaggtgaagttctcgcacctgtcccggaatatgacgatgcaacggacaatgaaactctaccgcctgcctgaaaccccaaagactgcgggccttcggcctatggagactaaggatatccctgtcgtccaccaactgctaacacgatacctcaaacagtttcatctgactcctgttatgtctcaggaagaagttgagcactggttttaccctcaagagaatattatcgacacatttgtggtggaaaacgctaacggcgaggtgaccgatttcttgtccttttacacgttgcctagcaccattatgaaccacccaactcataagtccctgaaagccgcatattctttctacaacgtccatacacaaactcccctgctggacttaatgagtgacgcactggtactggctaaaatgaaaggattcgacgtcttcaatgctttggatcttatggagaataagacattcctagaaaaactgaagttcggtatcggcgacggaaacttacagtactatctgtacaattggaagtgtccatctatgggcgcagaaaaagttgggctcgtgttacagtag

SEQ ID NO: 126656 - DNA, 1590 bp, Artificial Sequence
  Description of Artificial Sequence: Synthetic coding sequence
atggctgaggattcggaaagcgccgcttcacaacaatctctggaactggacgatcaggacacctgcggcatagacggcgacaatgaggaggaaacagaacacgctaaaggttccccaggcggctacctgggggccaagaagaagaagaaaaaacaaaagaggaagaaagagaagccaaactccggggggaccaagtccgattcagcctccgactctcaggagataaagattcagcaaccaagcaaacataataccatctggcagcagattagcgcaggggcggcaatggggtcagcaactatggagggagaatggaccgggatgaggaacgatcataaaaacccctcagtgcccatgcagaagcttcaggacatccagagagccatggagttactttctgcatgccaggggccagcacgaaatatcgacgaagccgccaagcaccggtaccaattttgggatactcagcctgttcctaagctcgatgaagtaataacatcacacggggcaatagaaccagataaagacaacgtcagacaggagccctactccctgcctcaaggtttcatgtgggatacactggacctttccgatgcggaagtcctgaaggaactttacactttgttgaacgaaaactacgttgaagatgacgacaacatgttccggtttgactactccccagagttcttactctgggctctgaggcctccgggctggttgctgcagtggcattgtggagttcgggtgtcctccaataaaaagctcgttggatttattagtgctatccccgccaacatcagaatctacgactctgttaaaaaaatggtggagataaatttcttgtgtgtacataaaaaactgcggtctaaaagagtggctccagtgctgataagagagattacaaggcgggtgaacctggagggtatttttcaggctgtatatacggctggagtggtgctgcctaagcctattgcaacatgtcgctactggcatagatccctgaaccctagaaaattggtcgaagtgaagttctcccacctgagccgaaacatgactctgcagagaactatgaaactctaccgtctgcctgatgtcacgaaaacctcaggactccggcctatggaacccaaagatatcaaaagtgtcagagagttgataaacacctatctgaagcaatttcatctggcccccgtgatggacgaggaggaagttgcacactggtttcttccacgggaacacatcatagacactttcgttgtggagtcaccgaatggtaaactgactgatttcctatctttttatactctcccctccaccgttatgcatcatcctgcccacaagtccctcaaagctgcatattctttctataacatacacaccgaaacccccttgttggatctaatgagcgatgctttaatcctcgcaaagagcaaggggtttgatgtgtttaatgcactggacctgatggagaataagacctttcttgagaagctgaagttcgggatcggcgatgggaacctacaatattatctttacaactggcggtgccctggaacggattccgagaaggtgggcctggtcctccaatag

SEQ ID NO: 126657 - DNA, 1458 bp, Artificial Sequence
  Description of Artificial Sequence: Synthetic coding sequence
atgagacgcagacgtagcacaccaaaggaggtgctggaaggaatctgggaacctaagagaaagagaaggaatcgtagagaaaaacggaggaatcagatccctgaggcccccagccagacccgacatcttatcccgcgtcgtctaaaattcagcagtctgcggaatactacgccgagcggcagcaggttccagcgcgaacagccgtggaatccttctgtgccaatgcaaaaactacaggatatccagcgggccatggagctattgtctgcttgccagggtcctgctaggaatatcgatgaggccgccaagcatcgataccagttctgggacactcagcccgttcctaagctcgatgaggttatcacttcccacggcgccatcgaaccagataaggataacgtcaggcaggagccatactccctgccccagggattcatgtgggacacactcgacttatcagatgcagaggtgctcaaggagctgtacactctgctaaacgaaaattatgtggaggacgacgacaatatgtttaggttcgactacagccctgagtttttgctgtgggcacttcggccaccagggtggctgctacagtggcactgcggagtgcgggtgagttctaacaaaaagctcgtcggtttcatttccgctattccagcaaacattcggatctacgactcagttaaaaaaatggtagaaatcaattttctgtgcgtccataaaaagcttagatctaagagggtagcaccggtgctgatccgggaaattactagacgcgttaatttagaaggaatcttccaagccgtgtatactgccggtgtagtccttcccaaacctattgctacttgccgttactggcaccggagcttaaaccctcggaaactcgtggaggtaaagttttctcacttatcacggaacatgacactacagcgcaccatgaaactctatagactgcctgatgttaccaaaacgtccggcctgcggcctatggaacccaaagacattaagagcgtgcgagaactaattaacacatatcttaaacagttccacctcgccccagtgatggacgaagaagaggttgcacattggttcctcccccgggagcatatcatcgataccttcgtggtggagtccccaaacggcaagttaacagacttcctgtctttctataccttaccctccacagttatgcaccatcccgcacacaaaagcctgaaggccgcctattctttttacaatatccatactgagaccccactcctggacctcatgtctgatgccctgattctggcaaagagtaaaggcttcgacgtcttcaacgccttggatcttatggaaaacaaaactttcttggaaaaactgaagttcgggatcggggatggcaatctgcaatactacttatataactggagatgtccaggaacagactctgaaaaggtaggcttagtattgcagtag

SEQ ID NO: 126658 - DNA, 1497 bp, Artificial Sequence
  Description of Artificial Sequence: Synthetic coding sequence
atggctgaagacagtgaatcggccgccagtcagcagtccctagagttggacgatcaagacacatgtggcatcgacggtgacaacgaagaagagacggaacacgctaagggaagcccgggtggctatctgggagccaagaaaaagaagaaaaagcaaaaacgtaagaaggagaaaccaaactccggtgggactaagagtgatagcgcctctgacagccaggagattaagatccaacagccgtcgaagaacccaagcgtaccgatgcagaagctacaggatatccagagagctatggagctgctgtccgcctgccagggcccggcgcggaacattgatgaggccgctaaacacagataccagttttgggacacccagccagtgcctaaactcgatgaggtcattaccagccacggagcaatcgaaccggataaagataatgtcagacaggaaccctatagcttacctcaggggttcatgtgggatacgcttgatctgtctgacgcagaagtgcttaaagaactgtacaccctactgaatgaaaattacgtagaggacgacgataacatgtttagatttgactactctccggagttcttactttgggctctgcggccaccagggtggctgcttcagtggcactgcggggtgcgggtgagttcaaacaaaaagttggtgggattcatcagtgcgattcctgcgaacatacgtatttacgattccgttaaaaaaatggtggagatcaacttcctgtgtgttcacaaaaagttgaggtctaagagggtggcaccggtgctgatcagagaaatcacaagaagggtaaacctcgaaggcatttttcaggctgtgtacacagccggcgtcgtgctgccaaagccaatcgccacgtgccggtattggcacaggtccctcaatcccaggaaactggtagaggtgaaattttcccacttgtcgaggaatatgaccctacaaaggacgatgaaactgtatcgtcttccggacgtgacaaagacctcaggactgcgcccgatggaaccgaaagacatcaaatccgtgcgggagctaattaacacgtacctgaagcagttccacctggcaccagtaatggatgaggaggaggtggcccactggttcctcccacgtgagcatataatcgacacgtttgttgttgagagtcccaacggcaagttgactgacttcttgtctttttacaccctaccttccacagttatgcaccaccctgcccataagtcgttgaaggctgcatactctttttacaatattcatacagaaaccccactattagacctcatgtcagacgccctgatcttggctaaaagcaagggctttgacgtgttcaacgctctcgacctgatggaaaataagacctttctcgagaagcttaagtttggcatcggggacggcaacttacagtactacctttacaattggcgatgtcccggcactgattctgagaaggttggactcgtccttcaatag

SEQ ID NO: 126659 - DNA, 234 bp, Artificial Sequence
  Description of Artificial Sequence: Synthetic coding sequence
atgtccgacgccctgatcctggccaaatcgaagggatttgatgtgttcaacgcccttgatcttatggagaataaaaccttcctcgagaaactgaagtttggaattggcgacggaaatttacagtattatctctataactggaggtgtcctggtactgatagtgagaagggcagcggaaattttgtgaatgctaatggtaaattattgcctgacgtttgccgcagacctccctag

SEQ ID NO: 126660 - DNA, 1458 bp, Artificial Sequence
  Description of Artificial Sequence: Synthetic coding sequence
atggcttccccgtggcgaggcgcccatgaggtcttggagggaatctgggagccaaaaagaaagcgcaggaaccgtcgtgagaaacgcaggaaccaaattcctgaggcacccagccagacccggcatctcatccctaggcggctgaaattttcttccctccgtaacaccacaccctccggcagtcgtttccagcgtgagcaaccttggaatccctctgtcccaatgcagaagctccaggacattcagcgcgcaatggagctgctgagcgcctgccagggtcccgcaagaaatatcgacgaagccgcaaagcatcgttaccagttctgggacacacaaccagtaccaaaactcgacgaagtgatcaccagccatggggctattgaacccgataaagacaatgtccggcaggaaccctacagcttgcctcagggtttcatgtgggataccttggatctgagtgatgcagaggtcctaaaagagttatacacacttctgaatgaaaactacgttgaggatgatgataacatgtttaggtttgactacagtcccgagtttctgctgtgggccctgcgcccccccggctggctgcttcagtggcactgtggggttagagtgagctccaataaaaaactagtggggtttattagcgccatcccggctaatatcagaatctatgactccgtcaagaagatggttgaaatcaatttcttgtgtgtccataagaaattgcggagcaagagagtagcccctgtcctgatacgagagataacccgaagagtgaacctggaaggaatattccaagcagtgtatacggcgggcgtggttttgcctaaaccaattgctacttgcaggtactggcaccgctctctgaatcctcgcaaactcgtggaggtaaaattttcccatctgagccgcaacatgaccctgcagaggactatgaagctgtatcgtctgcccgacgttaccaaaacctccgggctgcgaccaatggaaccaaaagacattaagagtgtgcgcgagctcattaacacatatcttaagcagtttcatctggctccagtgatggacgaagaagaagtcgcacactggtttttgcccagggagcacatcatcgatacctttgttgtggagtcacctaacggtaaactcactgacttcctgtcgttttacacccttcccagtacggtcatgcaccaccccgcccacaagtcactgaaggccgcttattcgttctataacattcacacggagacacccttgctggatttaatgtcagatgctctgatcttggctaagtctaagggttttgacgtgtttaacgccttggatctcatggagaacaaaacctttctggaaaaacttaagttcgggatcggggatggcaatctgcagtactacctctacaactggcgctgtcccggtacagattccgaaaaggtggggttggtcctgcagtag

SEQ ID NO: 126661 - DNA, 933 bp, Artificial Sequence
  Description of Artificial Sequence: Synthetic coding sequence
atgttccggttcgattatagccccgagtttttgctatgggctctgaggccacctggttggttattgcagtggcactgcggggtgagggtgagcagtaataagaagttagtagggtttatcagcgccatccctgccaacatccgcatttacgatagcgtgaagaagatggtggagattaattttctttgtgtgcacaagaagctaaggtccaaaagagtagcccccgttctgattcgcgagatcacgaggcgagtgaacctggagggcatctttcaggctgtgtacaccgcgggagtggtactgcctaaacccatcgccacttgcagatattggcaccgttcacttaacccacgtaaacttgttgaagtaaaattcagtcacctctcacgaaatatgaccttacagagaacgatgaaactgtacaggcttccagacgtcacaaagacgagtggtttacgacctatggaaccaaaagatattaagagcgtccgtgagctgattaatacttatttgaagcaattccacctcgcccccgtcatggatgaggaggaggtcgcacattggttcctgcctcgggagcacatcatcgatacctttgtcgttgagagccccaatgggaaactgacagatttcctgagcttctacacactgccctccaccgtgatgcaccaccccgcccacaagagcttgaaggcagcatactcgttctacaacattcatacagaaacccccctcctggatttaatgtccgacgccctcattctggctaagtccaaaggatttgacgtgtttaatgctctggacctcatggagaacaaaacatttctcgagaagctcaagtttggtattggagacggcaacctccagtattatttatataattggcgttgccctggaactgattccgagaaagttggattggttctacagtag

SEQ ID NO: 126662 - DNA, 459 bp, Artificial Sequence
  Description of Artificial Sequence: Synthetic coding sequence
atggaagccgttctgaacgagcttgtgtccgtggaagacttgctaaaatttgaaaaaaagttccaatctgaaaaagccgccggcagcgtgagtaagtctactcagtttgaatatgcatggtgtttggtgcgcagcaagtataacgatgacataaggaagggcattgtgcttttggaagaacttctccctaaggggtcgaaggaagagcagcgggactatgtgttctatctggcagtgggcaactatcgattaaaagaatatgaaaaagccctgaaatacgtccgcggactgctgcagacggagccacagaacaatcaggccaaggagttggagcggctgatagataaggccatgaagaaagatgggctggtcggtatggctatcgtcggaggcatggccttgggggtcgccggtcttgctggtctaataggtctcgctgtgagcaaaagtaagtcctag

SEQ ID NO: 126663 - DNA, 2076 bp, Artificial Sequence
  Description of Artificial Sequence: Synthetic coding sequence
atggcgcttctgttaaccctcacctcccctgatcttgaaggcacgtgggatacacgagacaaagacggctttaaagcacaggagggccctcctctcgccgtgcctgagttccctgtctgcgggttgtatcggatttacggtgtctgcggctccttctcaagtttcttcatcatcaggtgttccctttgtgcccttgaaactctaaaatctcctcagcacgatccgctggagattcctgagcagtcactgaagctgattcccctggtgagtggtaaaagggaactcaccagagggcagaaggctggcgaaaaaccactggcggccggaccaggggaggaggagttgctgaggggatctgccccccacgcccaggacacacagtctgaagaactcccaccatcatgcaccatcagcggcgagaagaagccccctgccgttagtggcgaggccaccggagcagacgccgggcgtttgtgcccacctcctaggagcagggccccgcacaaagacaggactttggccaggtctaggcctcagacacaaggtgaggactgctcactgcctgtgggagaagttaaaatcgggaagcgtagttactcaccggcccccggtaagcagaagaagccgaatgccatgggcctggcacccacctcctctcccggagccccgaatagtgcgagggcgacacacaatcctgtaccttgcggctcagggcggggaccttgccacctagcaaacctcctctccacattggcacagagcaaccagaacagggaccataagcaaggacctccagaagtcacgtgtcaaatcagaaagaagactcgcacactgtaccgcagtgaccagctggaggagctagaaaaaatttttcaggaagaccattatccagactcagataagcgacgagagatcgcacaaaccgtcggcgtgacacctcagagaattatggttaagggcgcaggaagcctggtcgctggatggtctggcggaggaccaactattgagaccttggagctacagagcgagagatccgccgtggcttgggtctggttccagaacaggagggcaaagtggcgaaaaatggagaaattaaatggtaaggagtctaaggacaaccccgcagcaccaggccccgcttctagtcagtgctcctccgccgccgaaatattaccagcagtgcctatggagcctaaaccagacccctttcctcaggagtctccactcgatactttccccgagcctcctatgctgcttacgtccgaccaaactctggccccaacacaaccaagtgagggcgcccagcgtgtcgtgactccacctttgtttagtcctccgcccgtccgacgagcagacttacccttcccactgggacccgtgcacactccccagttgatgccgttgcttatggacgtcgccggaagcgactcatcgcacaaggatggcccatgtggcagctggggtacatctataaccctcccacccccttgcagctacctcgaggagcttgagccccaggactatcagcaaagcaaccagcccggtccattccaattctcacaagctcctcagccacccctgtttcagagtccccagcccaagctgccttatctcccgacgttccctttctcaatgccctcaagtttgactcttccccctccggaagatagtttgtttatgttcccttgcggccctagcgggggcacttctcaagggtattgtcccggcgcaagctcaggccagattctcatgcagccaccagccggtaacattggaaccgcttcctggagcgacccttgtttgcctgagctgccattcccggggcctttctgtccccaggccctgggtcacccaccgggcggtgacggttactttcccgacctttttccaaccccctgccctcaggctttgggaaggcaacccagctccgccctttcatggatgcccgagggggcaaggccaggcacgggcccgctgctgagcaaagccaaagaggagccccccgcggcatctttggaccagcctagcgctcttgaggaggctcggggtgacgataaaaacagccacgttccatag

SEQ ID NO: 126664 - DNA, 699 bp, Artificial Sequence
  Description of Artificial Sequence: Synthetic coding sequence
atggaacgttgcccttcccttggcgtaactttatacgcccttgtggttgtccttggactgcgcgctacgcctgccgggggccagcactatttacatattaggcccgcccccagcgacaacctgcctctggtcgatctgatcgaacaccctgaccccatattcgaccctaaagagaaggacctaaacgagactctactccgcagtctgctgggcggacactacgaccccgggttcatggccacgtcacctcctgaggatcgtcctggggggggcggcggtgcggctggcggtgcagaagacctggccgagttagaccagttgctgagacagcgccctagcggagctatgccctccgagatcaaggggttagagttctccgaggggctcgctcaaggaaaaaagcaacggctctcaaaaaagttgcgcagaaagctccaaatgtggctgtggtctcagacgttttgccctgtgttgtacgcttggaatgatctgggctcccgcttctggccacgctatgttaaggtcggctcctgtttcagtaagagatcctgtagcgtcccagaaggaatggtttgcaagcccagtaagagtgtccatcttacagtgttgcgttggcgctgccagcgtcgggggggacagaggtgtgggtggatccccattcagtacccgatcatctccgagtgtaaatgttcatgttag

SEQ ID NO: 126665 - DNA, 990 bp, Artificial Sequence
  Description of Artificial Sequence: Synthetic coding sequence
atggggacagcggccgccgccgcggccgccgccgcagctgccgccgccggcgagggagcccgctcgccttcccccgcggcagtgagcctcggtcttggagtggctgtggtctccagcttggtgaatggatcgacatttgttctgcaaaaaaaggggatcgtgagggccaaacgaagaggtacctcttacctcaccgatatcgtgtggtgggctggcacaattgccatggccgtcggccagattgggaacttcctggcttacacagcagtgcctacagtgctagtcacgccactaggagctctgggggtgccttttggttctatattggccagttacctcctgaaggaaaagctaaatattctcgggaaactcggatgcctgctcagctgtgcaggctctgtcgtattgatcatccattcccccaaatccgaaagtgtgaccacacaggctgagcttgaagaaaaactgaccaaccccgtttttgtcgggtatttgtgcatcgtactcttgatgctgctgttgctcatcttctggatcgcaccagctcatggtcctacgaacattatggtgtatattagcatctgctccctattggggagttttacagtcccaagtacaaaggggatcggcctggccgcccaggatattcttcacaataatccatctagccagagggcactctgtctgtgtctcgttctactggccgtgttgggatgctccattatcgttcagttccgatatattaacaaggccttagaatgtttcgacagcagcgtatttggtgccatttattatgtcgtgtttaccactctggtcttactggctagcgcgattctcttcagggagtggagtaatgtaggcctggtcgattttctggggatggcatgtggttttaccacagtttcagtgggaatcgttctcattcaagtatttaaagagttcaatttcaatctcggagaaatgaacaaatccaatatgaagactgattag

SEQ ID NO: 126666 - DNA, 765 bp, Artificial Sequence
  Description of Artificial Sequence: Synthetic coding sequence
atggccgtgggccagatcggcaacttcttggcctacactgccgtcccaacagtcctggtgacaccccttggcgcgctaggagtcccctttggctccatcctcgcttcctatctcctgaaagagaaactgaacatactcggaaaactcgggtgcctgttgtcatgtgctggatccgtagtgttaatcatccacagcccaaagtcagagtcagtgaccactcaggcagagttggaggagaaacttaccaacccagtgttcgtcgggtacctttgtattgtcctcctcatgttgctgctattaatattctggatcgccccagcccacgggccgaccaatattatggtgtacattagcatctgcagcctcttgggctcatttacagttccctcaaccaagggcatcggcttagctgcccaggatatactgcacaacaatccttcaagtcagcgggccctatgtctgtgtcttgtgttgcttgctgtgctgggctgctctataatcgtccagtttcggtacatcaacaaggcacttgaatgcttcgactctagcgtcttcggcgcaatatactacgtcgttttcacaactctcgtactcctggccagcgctattttgtttcgcgagtggagcaatgtcggcctggttgacttcctcggaatggcctgtggatttaccacagtgtccgtgggaatagtcttgatccaggtctttaaggagttcaatttcaacctcggcgagatgaataaatcaaacatgaaaacagactag

SEQ ID NO: 126667 - DNA, 480 bp, Artificial Sequence
  Description of Artificial Sequence: Synthetic coding sequence
atgctgttactgttgattttttggattgccccagcgcatggccccaccaacattatggtgtacattagcatttgctctctgctcggtagtttcaccgtcccttcaacaaaggggatagggctcgccgcacaagatatcttgcataataacccctcttcccaaagagccctttgcctctgtctcgtgctgctggccgtgctggggtgttccataatcgtccagttccgatatatcaataaggcattggagtgttttgactcatccgtcttcggcgccatttactacgtcgtgttcaccacgttagtgctccttgcttctgctatcctttttcgggagtggtccaacgtcggcttagtcgacttcctaggcatggcttgtggctttacgacagtcagcgtcggcatcgtgctcattcaagtgtttaaagagtttaatttcaacctcggggaaatgaacaagagcaacatgaaaaccgattag

SEQ ID NO: 126668 - DNA, 765 bp, Artificial Sequence
  Description of Artificial Sequence: Synthetic coding sequence
atggccgtcggtcaaatcggcaattttctggcatataccgcagtccctactgtccttgtaaccccgctgggcgctcttggcgtgccattcggctccatattggctagctatcttctgaaagaaaagctgaacatccttgggaagctgggctgtctgttatcatgcgctgggagtgttgttctgattatccatagccctaaatcggaatccgtgaccacacaggcagagcttgaagagaagctaactaacccggtgtttgttggctacctgtgcattgttttgctgatgctactactgctgatcttctggatcgcccccgcccacggtccaacaaacattatggtttatatttcaatctgctccctgctgggatcattcacggtgccctctaccaaaggaattggcctagctgctcaggatatcctacacaacaatcccagttcacagcgggccttgtgcctatgcctggtactgctcgctgtactggggtgctccattattgtacagtttcggtatataaataaagcccttgagtgtttcgactctagtgtgtttggtgcaatctactatgttgtgttcaccacgctggtcttgctagccagcgcaatcctctttcgcgagtggtcaaacgtggggctggtcgattttttgggcatggcctgtggctttactaccgtgagtgtcggcatcgttttaatccaggtcttcaaagagttcaacttcaacctgggcgagatgaacaaaagcaacatgaagactgactag

SEQ ID NO: 126669 - DNA, 1083 bp, Artificial Sequence
  Description of Artificial Sequence: Synthetic coding sequence
atgtcccagggtcgtgggaaatacgatttttacatcggtctgggtctggcgatgagctccagcatatttattggggggagtttcatcctgaaaaagaaagggctcctaaggttagctcgtaaagggtcaatgagggcgggtcaaggcggccatgcttatcttaaagaatggttatggtgggctgggctgttatccatgggagccggagaggtggcgaacttcgccgcatacgcgtttgcgcccgccacattggttactcctttgggagccctttcagtgctggtgtctgccatactgtcatcttatttcctgaatgaacgcctaaacttacatggcaaaatcggctgcctgcttagcattcttggatccactgttatggtgatccacgcccccaaagaggaagaaattgagaccctcaacgaaatgtcccacaagctgggcgatcccggattcgtggtattcgcgaccttagtagtaattgtagcccttatcttaatttttgtggtggggccccgtcatggccaaactaatatcctagtgtacatcactatttgtagtgtcattggtgcattttccgtgtcctgtgtgaaaggactgggaattgccatcaaggagctttttgctggaaagccagtgctgcgtcatccactggcctggattctgctgctttctcttatcgtgtgcgtgagtactcaaattaactatctgaaccgggccctcgacatcttcaatacaagtatagtcacaccaatatactatgtgttcttcacaacctcagtgctaacatgctccgctatcttatttaaagagtggcaggatatgcccgtggacgacgtgattggcactttgagcgggttttttactatcatcgttggaatcttccttctccacgcctttaaagacgtgagcttctcactcgctagtttgccagttagcttccgtaaagacgagaaggccatgaatggaaacttatccaacatgtatgaggtgttgaacaataatgaggagtcacttacctgcggaatagagcagcatactggggaaaatgtctcacgcaggaatggaaacttaacagccttttag

SEQ ID NO: 126670 - DNA, 1026 bp, Artificial Sequence
  Description of Artificial Sequence: Synthetic coding sequence
atgagtcagggacgaggcaagtatgacttctatatcggacttggccttgctatgtcgtccagcattttcattggcggcagcttcatcctcaaaaagaaaggccttttacgccttgcccgaaaagggtctatgcgcgccgtcggggctggtgaggttgctaattttgccgcctacgcctttgcccctgcaactctcgtaacacctctgggtgcgctgtcagtactcgtctctgccattctgtccagctacttcctcaacgaaagacttaacctgcatgggaaaataggttgccttctttccatactcggaagcaccgtgatggttatccatgccccgaaggaggaggaaatcgaaacacttaacgagatgagccacaagctgggtgatcccgggttcgtggtctttgcaacactcgtggtgattgtcgcactgatcctgatattcgttgtgggccctaggcacggacagacgaatatccttgtgtacatcaccatctgctcagtaattggtgcattctccgtgtcttgtgtaaaagggcttgggattgcgattaaagagctgttcgccggaaaacctgtgctccggcacccactcgcttggatcctgctgctgtctctaattgtctgtgtctctactcagatcaattacttgaaccgcgcgttggatatctttaacacgagtattgtgacccctatatattacgtcttctttaccacatctgttttgacatgctcagccatactctttaaggaatggcaggatatgccggtggacgacgtgatcgggaccttatcaggcttctttactattatcgttggtatattcctcctgcacgccttcaaggacgtgtccttttccctggcctccttgcctgtcagttttcggaaagatgagaaggccatgaacggcaacctctccaacatgtacgaggtcctgaataataacgaggagtcactcacatgtgggatcgaacagcataccggagagaatgtctcccgcaggaacgggaacttaacagccttttag

SEQ ID NO: 126671 - DNA, 1083 bp, Artificial Sequence
  Description of Artificial Sequence: Synthetic coding sequence
atgtcccaggggcggggaaaatacgatttctacatcggcctcggtctggctatgtcatctagtatctttatcgggggctctttcatattgaaaaagaaaggcctgctgagactcgctcggaagggcagcatgagggcaggccagggaggacatgcctacttgaaggagtggctatggtgggcagggctgttgtctatgggagctggcgaggtcgctaatttcgccgcctatgcgtttgccccagcaacattagtcacaccactgggcgcgctcagcgtcttagtgtccgctatcctcagcagttacttcctcaacgaaagactgaatctgcacggtaagattggctgccttttatctatcctcggctctacagtgatggtgatccatgcccccaaagaagaggagattgaaaccttaaatgagatgtcccacaaattaggtgacccaggtttcgtcgttttcgcaaccctggtcgttatcgttgccctgatcctcatattcgtcgtgggccctcgacatggacagacaaatattctagtatacatcacaatctgctccgtgattggcgcctttagtgtgtcttgcgttaaggggcttggaatcgcgattaaagaactgttcgccggcaaaccagtcctcagacaccctttagcctggatccttctcctgtcacttattgtgtgcgtcagcacccagatcaactatctgaacagagccctcgacatatttaacacctcaatcgtgacacctatctactatgtttttttcacaacaagcgtgctcacatgttccgctatccttttcaaagaatggcaggacatgccagtggatgatgtgatcggcacactctctggattcttcacaattatcgttggcatttttctgctgcatgcattcaaagacgtgtcattttccttagcatcgctccccgtctcctttagaaaagatgagaaagcaatgaacggcaatttatctaatatgtatgaagtgttgaacaataatgaggagtctttgacctgcggaatcgagcaacacaccggggaaaatgtgagccgtcgcaatgggaatctgacagcattttag

SEQ ID NO: 126672 - DNA, 1083 bp, Artificial Sequence
  Description of Artificial Sequence: Synthetic coding sequence
atgagtcaggggagagggaaatacgatttctacattgggttggggctagctatgtcctcttcgatatttatcggtggatccttcatcttgaaaaaaaaaggattactcagacttgccagaaaaggcagcatgagagccggccagggcggccacgcctatctgaaagagtggctttggtgggccggactactgtcaatgggtgcaggagaggttgccaatttcgccgcctatgctttcgcaccggccaccttagtcaccccccttggtgcgcttagtgtgctagtctccgctatcctgtcaagttacttcctcaacgagcgcctgaacctgcacgggaagattggctgcctcctgtcgattctaggatccacagtgatggtgatacacgcccccaaggaggaggagattgaaactcttaatgagatgtctcataaactgggagatccaggtttcgtggtcttcgcaactctggtcgtgatcgttgctttaattttgattttcgtagtgggtccacggcatggacaaacaaacatccttgtctacattaccatttgcagtgtcattggggcattttccgtgagttgtgtgaagggattggggatagcaataaaggaactttttgcgggcaagccagtgctgcgacatcccctggcatggatcctcctcctaagtctaattgtttgcgtcagtacacaaatcaattacctgaaccgggccttggatattttcaacaccagcattgtgacaccaatctattatgtcttcttcacaacaagcgtgttgacttgctccgctatactgttcaaggagtggcaggatatgccagtggatgacgtgatcggaacgctgtccggatttttcactataatcgtggggattttcctgcttcatgccttcaaagacgtatccttctccctggcatccttgcctgtgagcttccggaaagacgaaaaagccatgaatggaaacttgtctaacatgtacgaagtgctgaataataacgaagagagtctcacttgcggcatcgagcaacacactggagagaacgtctccaggagaaatggaaacctgacagctttttag

SEQ ID NO: 126673 - DNA, 1026 bp, Artificial Sequence
  Description of Artificial Sequence: Synthetic coding sequence
atgagccaggggcggggaaaatatgacttctacatcggtctcggccttgccatgtcgtcttccatcttcattggcgggtcattcatcctaaagaaaaaaggactgttacggctggccagaaaaggctcgatgcgggcagttggcgccggagaggttgctaactttgctgcctatgccttcgcaccagcaacgcttgtgacccctttgggggcactgtccgtgctggtgagcgcgatcctgtcatcttacttccttaacgagagacttaatctccacggtaaaatcggttgcctgctgagtattctcgggagcacagtcatggtcattcacgcccctaaagaagaagaaattgaaactctaaatgagatgtcacacaagctcggtgacccgggttttgtggttttcgccacgttagtagtgatcgtagcgctgattctgatctttgtggtgggtcccagacacggacagaccaatattctggtgtatattaccatatgttccgtaatcggagccttctcagtgtcatgtgtgaaagggctgggcatcgccatcaaggaactcttcgctggaaaacccgtgctgcgccaccctctagcctggatcctgttgttgagcctcattgtgtgtgtatctacacagatcaattacctgaatcgagccctagacatattcaatacatcaatcgtaactcccatctattatgtgttcttcaccacttcagtgttgacatgtagtgctatcttgttcaaggagtggcaagacatgcccgtggacgacgtaatcggcacactgagcgggtttttcactatcattgtcggcatcttcctgctccatgccttcaaagacgtgtccttctcactggcatccctgccagtatctttccgcaaagatgaaaaagccatgaatggaaacctcagcaacatgtatgaggttctcaataataacgaagagagtctgacatgcggtatcgaacagcacacgggtgagaacgtgagccgccgcaatggcaaccttacagcattttag

SEQ ID NO: 126674 - DNA, 180 bp, Artificial Sequence
  Description of Artificial Sequence: Synthetic coding sequence
atgtcccagggtcgggggaagtatgacttctacattggcctgggactcgctatgtcatcttctatcttcatcgggggatccttcattcttaagaagaaaggtcttctgcgccttgcgagaaagggctcgatgcgggccggccaagggggtcatgcttacctgaaggaatggctgtggtag

SEQ ID NO: 126675 - DNA, 900 bp, Artificial Sequence
  Description of Artificial Sequence: Synthetic coding sequence
atggaagagctggaacagggactgttaatgcagccctgggcatggcttcaactggctgagaacagtctcctcgcaaaggtattcattacaaagcaaggctacgcactcctggtatcagacctgcaacaggtttggcacgaacaggtggacaccagcgtggtgtcgcagcgcgccaaagagctgaataaaagactgaccgccccacctgccgccttcctgtgtcaccttgataacttgctcaggcctctcttgaaagacgccgctcacccttcagaggcaacgttttcgtgtgattgtgtcgccgacgcattgattctgcgggtccgatccgagttatccgggctcccattttactggaacttccactgtatgctggcaagcccgtctctggtctcccagcatctgataaggcccttgatgggaatgtctctggccctgcaatgccaggtaagagagctagccacgctccttcatatgaaagacctagaaatacaggattatcaggagtcgggtgccacattaatccgggaccgcctgaaaacagagccttttgaagaaaacagttttcttgagcaattcatgattgagaagcttccagaagcttgctctatcggtgatggaaagccgttcgttatgaatctgcaggatttatatatggctgtgactacccaggaggttcaagttggtcagaaacaccaaggcgcaggcgatccacatactagcaattccgctagcctgcagggcatcgactcacagtgcgttaaccagcccgagcaactggtgtcatcggctcctactctcagcgccccagagaaggagtccacgggaacatcgggaccccttcagcggcctcaactgtcaaaagtgaaaaggaagaaaccaagagggcttttttcttag

SEQ ID NO: 126676 - DNA, 951 bp, Artificial Sequence
  Description of Artificial Sequence: Synthetic coding sequence
atggaggagctggaacaggggcttcttatgcagccatgggcatggctacagcttgccgagaatagtcttctcgcgaaagtgttcatcacaaaacaggggtacgcactactggtgtcggatctacagcaagtctggcacgaacaagttgacacaagcgtggtgtcacagagagccaaggagctgaataaaagactgaccgccccacctgcggccttcttatgtcacctcgataatctcctccgaccacttttaaaagacgcagcacatcccagcgaggctacttttagctgtgactgtgtggctgacgccttgattctacgagtgcgttcagagctgtccggcttacctttctattggaacttccattgcatgctggcaagtccgtctttggtgtcccagcatttgatacggccactgatgggcatgtcactagccttacaatgccaagtgcgtgagttagccacactgctgcacatgaaggacctggagatccaggattaccaggagagcggggccacccttattagagatagactgaaaactgaaccgttcgaggagaactctttcctcgagcagtttatgatagaaaagctgcccgaagcctgttccatcggagatggcaaaccatttgtgatgaacttacaggacctgtatatggcagtcacaacccaagaggtccaggttggccagaagcatcagggggctggggacccgcatacctctaatagcgccagcctgcaaggcatcgattctcaatgcgtgaaccaacctgaacagctagtctcctcagcccctacactcagtgcaccagagaaggaatccactgccctgtgcagggacctaagctgtcagcgctcccgcgggcggagtcagggagtctcaagcgtcaatcttctctggcctcagcttctgagaatggatttggagaattctttccaggctagtccctag

SEQ ID NO: 126677 - DNA, 690 bp, Artificial Sequence
  Description of Artificial Sequence: Synthetic coding sequence
atggaagaactggaacaggggctccttatgcagccctgggcatggttgcagctggccgaaaacagtttgctcgctaaggttttcattactaagcagggatacgccctactggtgagtgaccttcagcaggtgtggcatgagcaggttgacacttctgtggtgagtcagcgcgccaaagaattaaacaagagactcacagctcccccagctgcctttttatgtcatctggataacctcttaagacctctgcttaaagacgccgcccacccgtccgaagcaacattcagttgcgattgcgtggctgatgccctcattctcagagtgcgctcagagctcagtggcttgcccttctattggaatttccattgcatgctggcatccccctcgctcgtaagccaacatctgatacgccccctgatggggatgtcactggcgctacagtgtcaagtcagagagctggccaccttgctccacatgaaagatctggaaatccaggattatcaggaatccggcgcgaccctgattcgggacagactcaaaaccgagccgtttgaggagaactcatttctggaacagtttatgatcgagaagttgccagaagcctgctcaatcggggacggaaagccttttgtgatgaatctgcaagacctgtacatggccgtaaccactcaggaggtgcaggtcggttag

SEQ ID NO: 126678 - DNA, 804 bp, Artificial Sequence
  Description of Artificial Sequence: Synthetic coding sequence
atggctaattgtgagaggaccttcatcgcgatcaaaccagacggcgttcaacggggccttgttggagaaattatcaaaaggtttgaacagaagggtttcaggttggtgggcctcaagttcatgcaggcttctgaggatctgctgaaagagcattatgtggatttaaaggaccgaccattctttgccgggcttgtgaaatacatgcacagtggcccagtggtggctatggtgtgggagggcctaaatgtggtgaaaactggacgtgtgatgctaggagaaactaacccagccgattccaagcccggtaccattcggggcgacttttgcattcaggtggggagaaccatggccaacttagaacgcacatttattgccatcaagcccgacggagttcagcggggacttgtgggtgagatcattaagaggtttgaacagaaagggttccgcttagtggctatgaagtttctgcgcgcgagtgaggaacatcttaagcaacattacattgatttaaaagatcgcccatttttccctggcttggtgaaatacatgaatagtggtccagtggtagccatggtttgggagggccttaacgttgtcaagaccgggagggtgatgctgggggagacaaaccccgctgactccaaacctggaaccatcagaggcgacttttgtatccaggttgggcgcaacattatccacggatccgacagcgttaagtcagcagagaaggagatcagcctttggttcaagccagaagaactggtggactacaagtcctgcgcgcacgactgggtgtatgagtag

SEQ ID NO: 126679 - DNA, 234 bp, Artificial Sequence
  Description of Artificial Sequence: Synthetic coding sequence
atggtatgggaagggttaaatgtagtgaaaaccggccgggtgatgctgggagaaaccaatccggcggactctaagcccggaacaatccggggcgatttctgtattcaggttgggcggaatattatacacggcagtgattcagtcaagtccgccgagaaagagatttcgttgtggttcaaacccgaggagctggtcgactataaatcttgcgctcatgactgggtgtacgagtag

SEQ ID NO: 126680 - DNA, 234 bp, Artificial Sequence
  Description of Artificial Sequence: Synthetic coding sequence
atggtttgggaaggactgaacgtagtcaaaactggacgcgttatgctgggcgaaaccaatccagcggactctaagcccgggaccattaggggcgacttctgtatccaggtgggacgaaatattatccacgggagtgatagcgtgaagtcagccgagaaggaaatctcactgtggtttaagccagaagaattggtcgactataagtcctgtgcgcatgattgggtctacgagtag

SEQ ID NO: 126681 - DNA, 459 bp, Artificial Sequence
  Description of Artificial Sequence: Synthetic coding sequence
atggccaatctcgagcgaacattcatcgccattaagccagacggggttcaacgcggactcgtgggagaaatcatcaagcggtttgagcagaaggggttccgactcgttgccatgaaattcctgcgggccagtgaagagcaccttaagcagcattacatcgatctgaaagaccggcccttttttcccgggttggtgaaatacatgaattccggcccagtggtagctatggtttgggagggcttaaacgtcgttaaaactggaagggtgatgctgggagagactaacccggccgacagcaagccaggaacaatcagaggggatttctgtatacaggtcgggaggaacattatccatggctctgacagcgtaaagtctgccgaaaaagagattagcttgtggtttaaacccgaggagttggtagactacaagtcctgcgctcacgactgggtatacgaatag

SEQ ID NO: 126682 - DNA, 459 bp, Artificial Sequence
  Description of Artificial Sequence: Synthetic coding sequence
atggcaaacttggagcgcacattcatcgcgatcaagccggacggcgtgcaacgaggcttggtgggagaaattatcaagagattcgagcagaaggggtttcgcctggtggccatgaaattcctgcgcgcttctgaagagcacctcaagcaacactacattgacctcaaggacagacctttctttcccggcttagtgaagtatatgaactcaggaccagttgtggccatggtgtgggagggtctgaatgtcgtgaagaccgggcgggttatgctgggtgagacgaacccagctgacagcaagcccggtacgatacggggcgacttctgcattcaggtcggacgaaacattatccacggctccgattctgtgaaatccgctgagaaggaaatcagtctatggtttaagcccgaagagcttgtggattacaagtcatgcgcccatgactgggtttacgaatag

SEQ ID NO: 126683 - DNA, 459 bp, Artificial Sequence
  Description of Artificial Sequence: Synthetic coding sequence
atggcaaacttggagcgcaccttcatcgctattaagcccgatggcgtgcagcggggattagtgggcgagattataaaaagattcgagcagaaaggctttagattggttgccatgaaattcctgagggcctctgaagagcatctgaagcagcattatatcgacctgaaagatcgccccttctttcctggactggtcaaatatatgaattcaggtcccgtggtcgccatggtgtgggagggcctcaacgtggtcaagaccggcagggtgatgctcggagagactaatccagccgattcaaagcccggtacgatacggggtgatttctgcatacaagttggccgcaacataattcatggctctgactctgtgaaatccgctgagaaagagattagtctgtggttcaaaccggaggagctcgtagattataagtcttgtgcccatgactgggtgtacgagtag

SEQ ID NO: 126684 - DNA, 459 bp, Artificial Sequence
  Description of Artificial Sequence: Synthetic coding sequence
atggcaaacctagaacggacctttattgcaattaaaccggatggcgtgcaaagaggattggtaggggagataattaagagattcgagcagaagggctttaggctagtggccatgaaatttcttcgtgcctcggaggagcatcttaaacagcattatattgacttgaaggatcggcccttctttccagggctggtaaaatatatgaactctggcccagttgttgctatggtatgggagggcctgaacgtggtgaagacaggacgagttatgctgggagaaactaacccagccgattcaaaacctgggaccatccggggcgacttttgcatccaggtcgggaggaatatcatccatgggagcgactccgtcaagtctgctgagaaagagatctccctctggttcaagccagaagagctcgtcgattacaaatcttgcgcccacgactgggtatatgagtag

SEQ ID NO: 126685 - DNA, 459 bp, Artificial Sequence
  Description of Artificial Sequence: Synthetic coding sequence
atggcaaatttggaacggacattcatagctatcaaacctgatggggtccagcgcggactagtgggcgagataattaagagatttgagcagaaaggcttccgcctggtggcaatgaagttcctgcgcgcgtctgaggagcatcttaaacagcactacatcgatctgaaggaccgtccgtttttccccggtctggtgaagtacatgaattctggccccgtggtggccatggtctgggagggactgaacgtggtgaagacagggagggttatgctgggggaaaccaatcccgccgactccaaacctggcaccatacgaggcgatttttgcattcaggtggggcgaaatatcatccatggtagcgactctgtgaaatctgcggaaaaagaaatatccttatggttcaaacccgaagagctggtggactataagtcctgcgcccacgactgggtgtatgagtag

SEQ ID NO: 126686 - DNA, 879 bp, Artificial Sequence
  Description of Artificial Sequence: Synthetic coding sequence
atggtgttgctctcgaccttaggtatcgtgttccagggcgagggccctcctataagctcttgtgacaccgggacaatggccaactgcgagagaacctttatcgccattaaacccgatggggtgcagcgggggctggtgggtgagattatcaaaaggttcgaacagaagggctttcgactggttggtctgaagttcatgcaagcctctgaggacctcctgaaagaacattatgtcgaccttaaggatagacccttttttgcaggactggtgaagtacatgcacagcggcccagtagtggcaatggtgtgggagggactcaacgtggtcaagaccggcagagttatgctaggggagactaaccctgcagatagtaaacctggaactattcgcggcgacttttgtatacaagtggggcggaccatggccaacctcgagcgcacattcattgctatcaagcctgatggtgtgcagaggggactggtcggagaaatcatcaaaaggtttgaacaaaaggggtttcgcttagtggccatgaagttcttaagagcctccgaggagcacttgaaacagcattacattgacctgaaagaccgcccctttttccccggattggtgaagtatatgaattctggccctgtggtggcaatggtatgggaagggctgaacgttgtgaagacaggccgggtcatgctaggcgaaacgaatcctgctgatagtaagcccggaacaattaggggcgatttctgtatccaggttggaagaaatatcatccatggctccgactctgtgaagagtgccgaaaaggaaatatctttatggttcaaacccgaagaacttgttgactataagtcttgtgcacacgactgggtatacgagtag

SEQ ID NO: 126687 - DNA, 1188 bp, Artificial Sequence
  Description of Artificial Sequence: Synthetic coding sequence
atggtgagtgcagccggtctgtctggtgacgggaagatgaggggagtgttgcttgtactcctcggcttgttatattcttctaccagctgtggagtccaaaaagcctctgtgttttatggccctgacccaaaggaaggcctggtcagctcaatggagttcccttgggtcgtatcactccaggatagccagtacacccatctggccttcgggtgcatcctcagtgaattttgggtcctgtcaattgcgagcgccattcagaaccggaaggatattgtggtgatcgtgggtatctctaatatggacccatctaaaatcgcgcataccgagtaccccgtcaatacaatcattatccatgaggatttcgataataactcgatgagcaacaacatcgccctcctgaagaccgacaccgccatgcactttggtaatcttgtccagagcatctgtttcctgggaaggatgcttcacacacctccggttctccaaaactgttgggtttcggggtggaatccaacttccgccaccggaaaccacatgaccatgtcagtgctgagaaaaatctttgtgaaggatctggacatgtgtcccctgtacaaactgcagaagactgaatgcggctcgcacaccaaagaagagaccaagaccgcctgccttggtgaccctggctcgcccatgatgtgccagctgcagcagttcgatctctgggtcctgcgcggtgtgctaaacttcggaggcgagacctgtcccggtctgtttctctatacaaaagttgaggattattcaaagtggatcaccagcaaggcagagcgtgccggcccccccctgagtagtttgcaccactgggagaaattgatcagtttttcccaccatggaccaaatgcaaccatgacccagaaaacgtactctgattccgaactcgggcacgtgggatcctacctgcagggtcagcgcaggaccatcacccactcacggctcggcaacagttcccgcgactcactggatgttcgtgaaaaagatgtaaaggagtccggcaggtctccggaggcgagcgtgcaacccctgtactacgactactacgggggggaggttggtgaggggcggatttttgccggacagaatcgcctctaccagcccgaggaaattatcttggtctctttcgtgctcgtgtttttctgcagtagcatttag

SEQ ID NO: 126688 - DNA, 639 bp, Artificial Sequence
  Description of Artificial Sequence: Synthetic coding sequence
atggaaattagtatgccacccccccagatctatgtcgagaagacactcgcaatcataaaaccagacattgtggacaaggaggaagaaatacaagacataattctacggagcggattcaccatcgtgcaacgtagaaagctgaggctttcccccgaacagtgcagcaacttctacgttgagaaatatggcaaaatgttttttcctaaccttaccgcgtacatgagttctgggccactggttgcaatgattttagcccgtcacaaggccatctcctactggctcgaactgctcggcccaaacaacagtttggtagctaaagaaacacacccagactccctgcgagcgatttacggtactgatgatctcaggaacgcactccacggttcgaatgattttgctgccgcagaaagagaaatccgatttatgttccctgaagtcattgttgagccaattcctatcgggcaagccgccaaggactatctcaaccttcatattatgcccactctcctggaaggtctaaccgaattgtgcaagcaaaagcccgccgatccactgatctggctggccgactggctcctcaagaacaatcctaataaacctaagctgtgtcaccatcctatcgtggaggagccatactag

SEQ ID NO: 126689 - DNA, 561 bp, Artificial Sequence
  Description of Artificial Sequence: Synthetic coding sequence
atggcctccatattgcgaagcccccaggcccttcagctcaccttggcccttatcaaacctgacgccgttgcgcaccccttgatacttgaggctgtacaccagcagatactcagcaacaagtttttaattgttcgcatgagagagctgctctggaggaaggaggactgccagcgcttttaccgggagcacgaaggacgcttcttctaccagaggcttgtggagttcatggcgtcagggccgattcgagcctacatcctggcacacaaagatgcaatccaactctggagaacgttaatgggaccgacccgggttttccgggcaagacatgtggccccagactccatacgaggcagcttcggcctcacagacacccggaacactacccacggctcagactcagtcgtgagcgctagccgcgagattgccgccttttttccggatttttcagagcagaggtggtacgaggaggaagaaccacagttgaggtgcgggccagtgtgctattcacccgaaggaggcgtccactatgttgctggcacaggaggccttgggccggcttag

SEQ ID NO: 126690 - DNA, 585 bp, Artificial Sequence
  Description of Artificial Sequence: Synthetic coding sequence
atgacccagaatctcggaagcgagatggcctcaatattgagatctccccaggcactgcagctgacgttggctttgatcaaacccgacgcagtggctcatccgctaattctcgaagccgttcatcaacagatcctgagtaataaattcctcatagtcagaatgagagaactgttgtggaggaaagaagattgccagagattctacagggagcacgagggaaggttcttttaccaacgcctggtcgaattcatggcaagtggtccaatacgcgcttacatcttggcccataaggatgccatccagctctggcggacactcatgggtcccacccgtgttttccgggctagacatgttgcccctgattcaattaggggatcctttggcctaaccgacactcggaacaccacacatgggagcgatagtgtcgtatccgctagccgagagatcgccgccttcttcccagacttctcagagcagaggtggtacgaagaagaggaaccgcaactgcggtgcgggccggtctgctacagcccagagggaggcgtgcattacgtggctggaacaggtgggctcggccctgcctag

SEQ ID NO: 126691 - DNA, 561 bp, Artificial Sequence
  Description of Artificial Sequence: Synthetic coding sequence
atggcaagtattctccgcagcccacaggccctccagctgaccttagcccttatcaaacctgacgccgttgcccaccccttgattttagaagcagttcatcagcaaatcctgagtaacaaattcctgattgtgcgcatgcgcgagttgctgtggagaaaggaggactgccagcggttttaccgcgagcacgaaggacggtttttctatcagcggctcgtggagttcatggctagcggtcctatccgcgcatatatccttgcacacaaagacgccatccagttgtggcgtacactcatggggcctacgagagtctttagggcccgacatgtagctcctgacagtattaggggctccttcggactaacagatactcggaatacgactcacggctccgactctgtggtgtcagcttctcgcgagatcgcggctttttttcctgattttagtgagcaacgatggtatgaagaggaggaacctcagctcagatgcggcccggtgtgctattctccagaggggggagtgcactacgtagcggggaccggcggcctgggtccagcctag

SEQ ID NO: 126692 - DNA, 360 bp, Artificial Sequence
  Description of Artificial Sequence: Synthetic coding sequence
atggcctcaatactgcgcagcccgcaagcactgcagctgactctggccctcatcaaacctgatgcagtggcccatcccctgatcctagaagccgtgcaccaacagatcttgtcaaacaaatttctgatagtgcgcatgagggaacttctctggcggaaggaggactgccagaggttttatcgggaacacgaagactcggtagtttccgcttccagagaaattgccgctttcttccctgactttagcgagcagagatggtacgaggaagaggagccacagttgcgatgcgggcctgtctgctactctccggagggcggcgtgcactatgttgcgggtaccggtggactcgggcctgcctag

SEQ ID NO: 126693 - DNA, 561 bp, Artificial Sequence
  Description of Artificial Sequence: Synthetic coding sequence
atggccagcatcctgcgctctccacaggcactacagctgaccctcgccctcattaagccagacgccgtggcacatccattaattctggaagccgtgcaccagcagattctatccaataaattcctgattgtcagaatgcgggagctcctgtggcgcaaagaggattgccagcggttctacagggagcacgaaggtcgatttttttaccaacgtctggtggaatttatggcaagcggacctattcgtgcatatattctcgctcacaaggacgcaatccagctgtggcggactctaatgggacccacccgggtgtttagagcacgtcacgtggcacccgatagcatcaggggaagtttcggacttaccgacacccgcaataccactcacggcagcgattctgtcgtgagcgcatcacgagagattgccgccttctttcctgattttagcgagcagaggtggtacgaggaggaagagccccagttacgctgtggtccagtctgctactcaccagaaggtggcgtgcattatgtggcagggaccggtggactcggaccagcttag

SEQ ID NO: 126694 - DNA, 492 bp, Artificial Sequence
  Description of Artificial Sequence: Synthetic coding sequence
atggctagtatcctgcgaagcccccaggccctccagttgaccctcgctctgatcaagcccgacgcagtcgcacacccgctcattctcgaggctgtccatcagcaaatcctgtccaataagtttctcatagtaaggatgcgcgagcttctgtggcggaaggaggattgtcaaagattctatagagagcacgaagccggacagtcagagccaacttcactgccaacccgcatgcccagcagttccggggggcgtagctgggatcccccagaatgttccgagcatgcgatgtggccacaaatcctgtctgtgggcgtgagtgcttcattgactcctgccactcccccaatggttcggacactatggtttcagccagctgagcgcttgcagccaagcagccttaccagtgttaactcagccggaatgcggaggaagagtccgtcctgcgctgtcgcactgtgtgccattgctcagcgggaagtgtccaccatgtag

SEQ ID NO: 126695 - DNA, 561 bp, Artificial Sequence
  Description of Artificial Sequence: Synthetic coding sequence
atggctagcatattgagaagtccccaggccctgcagctcaccctagcactgattaagccagatgctgtggctcatcctctgatcctagaggctgttcatcagcagatcttatctaacaagtttttaattgtccggatgcgcgaactcctatggcgcaaagaggactgtcagaggttttaccgagagcatgaagggcgcttcttctatcagagactggtggagttcatggcttcgggccctattcgcgcctatatcctggcccataaagacgcgatccagctttggcggacactgatggggcccaccagagttttcagggccaggcacgtcgcacccgactcaattaggggtagttttggcttgactgacaccaggaataccacccacggaagcgattcagtcgtgtctgctagccgggagatcgccgccttcttcccggatttttccgagcagcggtggtatgaagaagaagaaccccagcttaggtgtggtcccgtgtgctattctcctgagggaggcgtccactatgtggccggaacaggcgggctcgggccggcatag

SEQ ID NO: 126696 - DNA, 1131 bp, Artificial Sequence
  Description of Artificial Sequence: Synthetic coding sequence
atgaatcactccgagcgcttcgtgtttatagctgagtggtatgacccgaatgcaagtctgctgcgtagatacgaattactgttttaccccggagacggatcagtggagatgcatgacgtcaagaaccatcggactttcctgaagaggaccaagtatgacaatctccacttggaagatctgtttattggcaataaggtgaatgtgttttcacgacagcttgtactgatcgattatggcgaccagtacactgcgcgccaactgggctccagaaaagaaaaaaccctcgcacttattaaacctgatgcgatcagtaaagcaggagagatcatcgaaattatcaacaaggccggtttcacaattacaaagctcaaaatgatgatgttgtccagaaaagaggcactggatttccacgtagatcatcaatctcgcccctttttcaatgaactgatacagttcatcaccacaggtcctatcattgcaatggaaatcctgcgtgatgatgccatttgcgagtggaagcgtctgctgggacctgcgaatagtggtgtagcgcggactgacgcctccgagtctattcgtgcactgtttgggactgatggtatccgcaatgcggcccacggacccgatagcttcgcgtcagccgcccgagaaatggagctctttttcccaagctctggcggatgcggccctgccaataccgccaagtttacaaattgtacctgctgtattgtaaagccccacgccgtttcagagggcctgctcgggaagattcttatggccattagagacgcaggttttgaaatttccgctatgcagatgttcaatatggaccgggtgaatgtcgaggagttttatgaagtatacaaaggggtggtgacagagtaccatgatatggtgactgagatgtactcaggaccctgcgtcgcaatggagatccaacagaataatgctactaagactttccgcgaattctgcggccccgctgatcccgagatcgccagacatctgcgccccgggaccctgcgcgccatcttcggtaagactaagatacagaacgctgtccactgtaccgacctgcccgaggatggactgctcgaggtacagtatttctttaagatcctcgacaattag

SEQ ID NO: 126697 - DNA, 1023 bp, Artificial Sequence
  Description of Artificial Sequence: Synthetic coding sequence
atgcatgacgtgaagaaccaccgcacttttctgaaaaggacaaagtatgacaacctgcaccttgaagatctgttcattgggaacaaggtgaatgtattcagcaggcagctggtgttgatagattacggagatcagtacactgctaggcagctgggttccagaaaagagaaaacccttgcacttattaagccggacgcaatcagcaaggccggggaaatcattgagattatcaacaaagcaggctttaccatcactaagctcaagatgatgatgctgagtaggaaggaggcacttgactttcacgtggaccaccaatctcggcctttttttaacgaactgattcaatttattacaaccgggccgatcatcgctatggagatcctgagagatgacgccatctgcgaatggaagaggctgctggggcctgccaactcaggtgtggctcggactgacgcttccgagtcaattcgggcgctatttgggacagacggtattagaaacgccgcccatggtcccgatagttttgcctcagctgcccgcgaaatggaactcttctttccatcctctggggggtgcggaccagctaacaccgccaagttcacgaattgcacatgttgcattgtaaagcctcacgccgtgagcgaaggactcctcggtaaaatactgatggccatcagggatgcaggttttgagattagtgcgatgcagatgttcaacatggatcgagttaacgtggaggaattctacgaagtatataagggcgtggtgacagaatatcacgatatggttaccgagatgtattcggggccatgtgtcgcgatggaaatccagcagaacaacgccactaagacattccgagaattttgtggacctgctgatcccgaaatcgctcggcacttaagacctggcacattgcgggctatttttggcaagacgaagatccagaacgcagttcactgcacagacctgcctgaggatgggcttctcgaagtgcaatacttctttaaaatcctcgacaactag

SEQ ID NO: 126698 - DNA, 1416 bp, Artificial Sequence
  Description of Artificial Sequence: Synthetic coding sequence
atgcagagcaataagacattcaatcttgaaaaacaaaaccatactccgcggaaacaccaccaacaccatcatcagcaacagcaccatcagcaacagcagcagcaacctccacctccacctattccagccaatggccaacaagcctcctcccaaaacgagggtcttaccatagatctgaaaaacttccgcaagcctggagagaagaccttcacacagcgcagcaggctgttcgtcggaaatcttccccccgacatcacggaggaggagatgcgcaagctgttcgagaaatatgggaaggccggggaggtgttcatccataaggacaaggggttcggattcatccggcttgaaaccagaactctggccgagatcgctaaagttgaattggacaacatgcctctgcgaggtaagcagttacgggttcggttcgcctgtcactcagccagtctgaccgtccgtaatcttccccagtacgtcagcaatgagcttctggaggaagcgttctcagtgtttggccaagtggagagggccgtggtgatagttgatgaccgaggccgccccagcgggaagggtatcgtggagttctctgggaagcccgcggcgcggaaagcactggatcggtgtagtgagggctcctttcttctaacaacttttcctagaccagtcaccgtggagccaatggatcagttggacgatgaagagggactacctgaaaagctggttattaagaatcagcagtttcacaaggagcgggagcagccgccccgatttgcccagcccggcagcttcgagtatgagtatgctatgagatggaaggccctgatcgagatggagaagcagcagcaggaccaggtggaccggaacatcaaggaggcccgggaaaagctggagatggagatggaggctgctcggcacgagcaccaggtgatgctgatgcgtcaggacctcatgcggagacaggaagagctgagacgaatggaagagctgcacaatcaagaggtgcagaagcgtaagcagctggaactgcggcaagaagaagagcggcgtcgcagggaggaagaaatgaggagacagcaggaagagatgatgaggcggcagcaagagggcttcaagggcacattccccgatgctcgggagcaggaaatcagaatgggccagatggcaatgggaggtgcgatgggcattaacaatcgaggtgccatgccacccgccccggtgcctgcaggaacccctgcacccccaggaccggccacaatgatgccagacggcacactggggctaactccgcccaccacagagagatttgggcaagcagcaacaatggaaggcatcggggccataggaggaacacctcctgccttcaaccgggcagcacctggggcagaattcgcgccgaataagcgaaggcgatactag

SEQ ID NO: 126699 - DNA, 1416 bp, Artificial Sequence
  Description of Artificial Sequence: Synthetic coding sequence
atgcagtctaataaaaccttcaacctcgaaaaacagaatcataccccccgtaaacaccatcagcaccaccaccaacagcagcatcaccagcaacagcaacagcagccaccaccccccccaatccccgcgaacggacaacaggcatcctcgcagaatgaaggcttgacaatcgacctcaaaaattttaggaagcccggagagaaaaccttcacacaacgatctagactctttgtgggcaacctgccacccgacataactgaagaagagatgcgcaaactgttcgaaaaatatggcaaggcaggtgaggtgttcatacataaggacaagggatttggattcattcgtctggagacacggactctcgcagagattgccaaagtggagctggacaatatgccgctgagaggtaaacagcttagggtgaggtttgcttgtcattcggcctctcttaccgttaggaatcttccacagtacgtgtctaatgagctgcttgaagaagccttctccgttttcgggcaggtagagcgcgcagtcgtaattgtggacgatcgcgggaggcctagtggcaagggaatagtggagttcagcggaaagccagcggcaaggaaggcgcttgatagatgctccgaagggtcattcctgctgaccacctttccacggccagtcacagtcgagccgatggaccagttggacgacgaggaagggcttcccgagaaactggttatcaaaaatcaacagtttcacaaggagagagaacagcccccccgttttgcccagcccgggtcattcgagtatgaatatgccatgagatggaaggcccttatagagatggagaaacagcaacaggatcaagtggataggaacatcaaagaagcccgggaaaaactggagatggaaatggaggccgcccgtcatgagcaccaggttatgcttatgagacaggacctgatgcggagacaagaggaactgcggagaatggaagagttgcataatcaagaagttcagaaaagaaaacagcttgagctccggcaggaagaggaaaggaggcggcgcgaagaagagatgagaaggcagcaagaggaaatgatgagacgtcagcaggagggcttcaaaggtacttttccagacgcgagggaacaggagatccggatggggcaaatggcaatgggaggcgccatgggaatcaacaaccgtggcgctatgccacccgctcctgtgcccgcaggaacccctgcgcccccaggccccgcaacaatgatgccggatggtaccctggggttgacccccccaactactgaaaggtttggccaggcagccactatggagggcatcggagctattggaggaacccctccggcctttaatcgggcagccccgggagccgagttcgcccccaacaaacgccgcagatattag

SEQ ID NO: 126700 - DNA, 1416 bp, Artificial Sequence
  Description of Artificial Sequence: Synthetic coding sequence
atgcagtctaacaagaccttcaacctcgaaaagcagaatcatacgcctaggaaacaccatcaacaccaccatcaacagcaacatcatcagcagcagcaacagcaaccaccaccgcctcccatcccagcaaacggccagcaagcatcctcccagaatgaggggctcacaattgatttgaaaaactttagaaaaccgggagaaaaaacattcactcagagaagtcggctgttcgttggcaacctacccccagacataaccgaagaagaaatgagaaagctgtttgagaaatacgggaaagctggcgaggtatttattcataaagataagggatttggatttattcggcttgagacccggactttggcagaaatcgctaaggtggaactcgataacatgccactccggggcaagcagctgcgggtccgcttcgcctgtcacagtgcttccctgactgttcgaaacttgccacagtatgtgtcgaacgaattgctcgaagaggccttcagcgtgttcggccaggtggaaagggccgtggtgatagtcgacgaccgtgggcgcccatccggaaagggcattgtagagtttagtggaaagcctgctgctaggaaagcactggataggtgctccgagggttctttcctgctcacaacattcccaagaccagtaacagtggaacctatggatcagctcgatgacgaggaaggactgcccgagaagctggtcatcaagaatcagcagttccacaaggagcgcgagcagcccccacgatttgcccagccaggtagcttcgaatatgagtatgctatgaggtggaaggcactcatcgaaatggagaagcagcaacaggatcaggtggataggaacatcaaggaggccagagagaaactggagatggaaatggaggccgcacggcacgaacaccaggtgatgctgatgcggcaggatcttatgcggcgacaggaagaattgcggagaatggaggaattgcacaatcaggaagtccagaagcgtaaacagctagaactgcggcaggaggaagagcgacggagaagggaagaggagatgaggcgacagcaggaggagatgatgcgtagacagcaggagggctttaagggcacgttccctgatgcccgcgagcaggagatccgcatgggccagatggcgatgggtggggctatgggtatcaataaccgcggcgcaatgccccctgctccagtgcctgcgggaacccccgcacctcccggacccgccacaatgatgccagacgggaccctgggcctcacccctccaacaacagagcgattcggacaggccgctaccatggagggtatcggagcgataggcggcactccgccggcctttaatcgcgccgctccgggtgccgagtttgcccctaacaagagacgacgctattag

SEQ ID NO: 126701 - DNA, 747 bp, Artificial Sequence
  Description of Artificial Sequence: Synthetic coding sequence
atgcaaagcaataagacattcaacttggaaaaacagaaccacactcctcggaaacatcaccagcatcatcatcagcagcagcaccatcaacagcagcaacaacagccgcctccaccacctatcccggcaaacggccagcaggctagttctcaaaacgagggactcactatcgatttgaaaaactttcgcaagcccggcgagaaaacatttacacaacgttctcgcttatttgttggcaacctgccacctgacatcacagaggaggaaatgagaaagctatttgaaaaatatgggaaagcgggggaagtattcatccataaagataagggtttcgggttcatacgcctagagaccaggaccttagcagaaatcgctaaagtggagctggacaatatgcccctgcggggcaaacagcttcgggtacgattcgcatgtcactccgccagccttacagtaagaaacctccctcaggaaagggagcaacccccccgtttcgcccaaccgggttcgtttgaatatgagtacgccatgagatggaaggccctgattgagatggagaagcagcagcaagaccaggtggaccgcaacataaaggaggctcgagagaaactcgagatggagatggaagcagctaggcacgaacatcaagtgatgctgatgcgccaggatcttatgagacgccaggaggagctccgtaggatggaggaactgcacaatcaggaagtgcaaaaaaggaagcagttgtag

SEQ ID NO: 126702 - DNA, 708 bp, Artificial Sequence
  Description of Artificial Sequence: Synthetic coding sequence
tagcctgacatcactgaagaagaaatgagaaagcttttcgaaaagtacggtaaagccggtgaggtatttatccacaaagacaaggggttcggttttattaggcttgtcgagcgcgccgtggtgatcgttgacgaccgcggtaggccaagtggaaagggaatagtggaatttagtggcaaaccagccgcaagaaaagcactggaccggtgttccgagggctcattcctgttgaccacctttcctcgacctgtgacggtcgagccaatggatcagctggacgatgaagagggtctgcctgaaaagctggtgattaagaatcagcagttccacaaggaacgggaacagccccctcggttcgcgcagcccggcagtttcgagtatgagtacgcgatgagatggaaggcactcattgagatggagaaacagcagcaggaccaggtggatcgcaatataaaagaggcacgtgagaaactagaaatggagatggaggccgcccggcacgaacatcaagtcatgctcatgagacaggacctaatgcgcagacaagaggagctgcgtcggatggaggaactccacaaccaggaggtgcagaaaagaaagcagcttgaattgcgccaggaggaagaacgccgtcgacgggaggaggagatgcgccgccagcaagaggagatgatgagaaggcagcaggaggggttcaaagggacctag

SEQ ID NO: 126703 - DNA, 375 bp, Artificial Sequence
  Description of Artificial Sequence: Synthetic coding sequence
atgcaatccaacaaaaccttcaatttggagaaacagaatcacaccccaaggaaacatcaccagcaccaccaccagcagcaacatcaccaacagcagcagcagcagcctccccctcctccaattccagcaaacggtcagcaggcttcctcgcagaacgaagggttgaccattgacctcaaaaactttcggaagccaggagagaaaacctttacgcaacggagtagactattcgtggggaacctccctccagacatcaccgaagaggagatgcgcaagctctttgaaaagtacgggaaggagacacggactctggccgagatagccaaggtggaacttgacaacatgcccctaaggggcaagcagctgcgagtttag

SEQ ID NO: 126704 - DNA, 201 bp, Artificial Sequence
  Description of Artificial Sequence: Synthetic coding sequence
atgcaaagtaataagacgttcaacctcgaaaagcagaatcataccccacgaaaacatcaccaacatcaccatcagcagcagcaccaccagcagcagcaacagcagccacctccaccccccattcccgccaatgggcaacaggcttcctctcagaacgaagggctcactatcgacctgaagaatttcagaaaaccaggctag

SEQ ID NO: 126705 - DNA, 624 bp, Artificial Sequence
  Description of Artificial Sequence: Synthetic coding sequence
atgcaatcaaacaagacctttaacctggagaaacagaaccacacccccagaaagcatcatcaacatcaccatcagcagcaacatcaccagcaacaacaacagcaaccaccccctccccccatcccagcaaacggccagcaggcttccagccagaatgagggactgaccatcgacttaaagaactttcggaaacccggtgagaagacgtttacacagcgctccagattatttgtgggaaatctcccacctgacatcaccgaagaggagatgcgcaaactctttgagaaatatgggaaggctggagaagtgtttatccacaaagataaggggttcggctttattaggcttgaaactcggacattggccgaaatcgccaaagtcgagcttgataacatgccccttcgtggtaagcaactgagagttagatttgcctgtcacagcgcctcactcacagtccggaatctgcctcagtacgtgagtaacgaactcctagaagaggcgttcagcgttttcggtcaggtcgagagagctgtggtgattgtggacgacagggggcggccctccggcaaagggatcgtggagttttctggtaagcccgccgcccgaaaagcacttgacaggtag

SEQ ID NO: 126706 - DNA, 1149 bp, Artificial Sequence
  Description of Artificial Sequence: Synthetic coding sequence
atgcgcaagctctttgaaaaatatgggaaggctggtgaggtgttcatccacaaggacaagggctttggcttcattcgactggagactcgcacactcgcagagatcgcaaaggtcgagctcgacaacatgcctttacggggcaaacagcttcgagtcaggttcgcatgtcactcagcatctctgactgttcgtaatctcccacagtatgtgtcaaatgagctcctcgaggaggcattctcagttttcgggcaggtcgaacgggcggtggtaatcgtggacgacaggggacgacccagtggcaaggggatcgtcgaattcagtggtaagccagcggcccggaaagccctggacagatgctcggagggatccttcctcctcactacatttccccgccccgtgaccgtagagcccatggaccaactagacgacgaggaggggctcccggaaaaactagtgattaaaaatcagcagtttcataaggaacgtgagcagcctcctagatttgctcagccagggtcattcgagtatgagtacgccatgagatggaaggccctcattgaaatggagaagcaacagcaagatcaagtggatcggaatattaaagaggctagggaaaaacttgaaatggagatggaggccgcaagacacgagcatcaggttatgctcatgcgccaggatctgatgcgcagacaggaggaactacgtaggatggaggagctacacaatcaggaagtccaaaagaggaagcaactcgaactgagacaggaggaggagcgcaggagacgggaagaggagatgcgccggcagcaggaggagatgatgaggcggcaacaagaaggtttcaaagggacatttcccgacgctcgagagcaggagatcaggatgggacaaatggcaatgggtggcgctatgggcatcaacaatcggggcgccatgcccccggccccagtgccggccggcacccctgctccgcctggccctgcaacaatgatgccagacgggactctagggctgacccccccaacgacagagcgttttggacaggctgccacaatggagggcattggtgcaataggcggaactcctcctgccttcaacagagctgctccaggtgccgagttcgcaccaaataagaggcgccgatactag

SEQ ID NO: 126707 - DNA, 3048 bp, Artificial Sequence
  Description of Artificial Sequence: Synthetic coding sequence
atgggagcggagaggcggctgctaagtattaaagaagcttttaggctggcccaacagccacatcaaaaccaggctaaattagtcgtggcacttagccggacatacagaactatggatgataagacagtgtttcacgaagagttcattcactatctgaaatacgttatggtggtgtataagagagagccggccgtggaacgggtgatcgaatttgcagctaaattcgtcacaagcttccatcagagtgacatggaagacgatgaagaggaggaggacggggggctcctgaattatctgtttacattcctgctgaaatcccacgaagccaatagcaacgccgttcggttcagagtgtgcctcctcattaacaagctgctaggctccatgccagaaaatgcccagattgacgacgatgtgttcgataaaattaataaagccatgcttattcgcctcaaggataagatccctaacgtcaggatccaagccgtccttgcgttatccagactgcaggaccccaaagatgatgaatgcccagtggtgaatgcctatgcaacattaatcgagaacgattccaaccctgaggttagacgtgccgtgctctcctgtatcgctcctagtgctaagacactcccgaagatagtgggcaggaccaaggatgtcaaagaagccgtgcgtaaactcgcataccaagttctggctgaaaaagttcacatgcgggccatgtctattgcccagagggtcatgctactgcaacagggcctgaatgaccggagtgatgcggtcaaacaggcgatgcaaaagcacctgctgcagggctggctgaggtttagcgaaggcaacatcttggagctgctgcacagactggatgtcgaaaacagttccgaagtggcagtgtctgtgttaaatgcactgttttccattactcctttaagtgaattagtgggattgtgtaagaacaacgatggccgtaagcttattccagtggagaccctgactcccgaaatcgccctctactggtgtgcactttgcgagtatcttaagtctaaaggcgatgaaggggaagagtttctggagcagattctgcctgagcccgtggtctacgccgattacctcctgtcttacatccagtcaatccccgtggtcaatgaggaacaccggggcgacttctcttatattgggaatttgatgaccaaagagttcataggacagcagttgatcctcatcataaagagccttgacacttccgaagagggggggagaaaaaaactgctggccgtgcttcaagaaattctgatcttgcctaccatccccattagcctggtgtctttcctggtagagcgtcttctgcatatcattattgacgataataagcgcacccaaattgttaccgagatcatctccgaaatacgggcccccatagtaacagtgggggtcaataatgatcctgcagacgtaagaaagaaagaattgaaaatggcagaaattaaagtgaagctgatcgaagccaaggaggctttggaaaactgcataaccctgcaggacttcaatagggctagcgaacttaaagaagagatcaaagccctggaagacgccagaataaatctgctaaaagaaaccgagcaattggagataaaagaggtccatatcgagaaaaacgatgcagagactctgcagaaatgcttaatactgtgttacgagctattgaagcagatgtccatctcaacaggcttgagcgccactatgaacggcattatagagagtctgattttaccagggattattagcatccatccggtagtgcgcaaccttgccgtcttgtgcctcggatgctgtggtctgcagaaccaggacttcgctcggaaacatttcgtccttttacttcaagttctgcagattgatgacgtgaccataaaaattagcgctttgaaagctatcttcgaccaactcatgactttcgggattgagcccttcaagaccaaaaagatcaagactcttcattgtgagggaaccgaaattaacagcgacgacgagcaggagtctaaggaggtagaggagacagcgaccgcaaaaaacgttttgaaactgctcagcgacttcttggacagtgaggtgtccgaactccgaaccggcgccgcagaagggctggccaagctgatgttctccggcctgctggtcagcagtagaatcctgagccgcctgattctgctgtggtacaatccagtgacagaggaagacgtgcagctgagacactgcctaggagtgtttttcccggtgtttgcttacgccagccgaacaaaccaagagtgctttgaggaggcattcttacctacactacagacattagctaatgcacccgccagttcccctctagcggagatcgatataaccaatgtcgcagagctgctcgtggaccttactaggccctcgggactcaatcctcaggcaaaaacctctcaggattatcaggccctaaccgtgcacgacaatctggccatgaaaatttgcaatgaaattcttacgagcccttgtagtcctgagattagggtgtacactaaggccctctcatccctggaattgtcttcccatctggcaaaagatctcctggttctgcttaacgagatcctggagcaggttaaggatcgcacatgcctccgggccctggagaagattaagattcagctggaaaagggaaataaggagttcggagaccaggccgaggccgcccaagatgcaactctgaccaccaccaccttccaaaacgaggatgagaagaataaagaggtttacatgacgccccttcggggagtgaaggctacccaagcttcaaagtccacccagctgaaaaccaacagaggtcagcgaaaggtgacggtttcggccagaacaaaccgacggtgtcagacagctgaggccgactctgaaagcgaccatgaggtgccagagccagagtccgagatgaaaatgaggctcccccggcgggctaaaaccgcagcattggagaaatccaagttaaacttagcccagttcttgaacgaggacctgagctag

SEQ ID NO: 126708 - DNA, 951 bp, Artificial Sequence
  Description of Artificial Sequence: Synthetic coding sequence
atgtccggcgatagcagcggtcgcggacccgagggccgtggcaggggccgtgatccacaccgcgataggaccagatcgagaagtcggtctcgatctccactgagcccaaggagcaggaggggcagcgcgcgtgaaagacgcgaggcgccagagcgcccatcattagaggacacagagccttccgactccggcgacgagatgatggatccggcctcattggaggccgaagcagaccagggcctatgtcggcagattcgccaccagtatcgcgcgctgattaattcagtgcagcagaatagagaagatattctcaacgctggagataagctcacggaagtgctggaagaagccaacaccctcttcaatgaagtgagtcgcgccagagaagccgtgctggacgcacactttctggtcctcgcctcagacctcgggaaagagaaggccaagcagctgaggagcgatttgtcaagcttcgacatgcttagatacgttgaaacgctgttgacacatatgggggtcaacccattggaagcagaggagttaatccgggatgaagattctccagattttgaatttatagtatacgactcttggaaaatcaccgggcgaactgcagaaaacacattcaacaagacacacacatttcattttctgttgggcagtatctacggcgagtgtcccgtacccaagccccgggtagacaggcccagaaaggtgcctgtgatccaggaggaaagggccatgccagcacagttacgcaggatggaggaatctcaccaggaagccaccgaaaaagaggttgaacgcattctgggactgctgcagacttatttccgggaagaccgagattcccttactctctcaccgcggctcgaatgcagtgggacgatctccacacactgcaacctgcatttactcgacagcagtaactcccccgcttcagcttcatag

SEQ ID NO: 126709 - DNA, 1158 bp, Artificial Sequence
  Description of Artificial Sequence: Synthetic coding sequence
atgtcaggggacagcagtgggcggggtcccgaaggaagaggacggggcagggatccacatagggatcggacccgcagtcgctcccggtccaggtcacctctaagccctcgctcccgtaggggatccgcacgagagagacgtgaggcgcctgagcgcccgagcctcgaggatactgaaccctcagattccggtgatgagatgatggaccccgcctcattagaggcagaggcagaccaggggttgtgtagacagattcggcaccagtacagggctctcattaattcagtgcagcaaaatcgtgaagatatactgaatgcgggcgacaagcttactgaagtcctcgaggaggccaatacgctgtttaacgaagtctcccgtgcgcgggaggctgttctagacgcacacttccttgtgctcgctagtgatctggggaaagagaaggccaaacagctcagaagcgacctgtcttctttcgatatgcttcggtatgttgaaacacttctcacccacatgggggttaatccattggaggcggaggaattgattcgggacgaagattcccctgacttcgagttcatcgtctatgatagctggaagatcacgggccgaacagctgagaatacatttaataagactcacaccttccacttcctgcttggttccatctatggggaatgtccggtgccaaaacccagggtggaccggcctagaaaagttcccgtgatccaggaggagcgcgctatgcctgcccagctcagacgtatggaggagagccaccaggaggcgactgagaaggaggtggagaggatcctggggcttctccagacctattttcgtgaagatccagacacgcctatgagtttttttgacttcgtggtggacccccacagtttcccacgcacagttgagaatatttttcatgtgagcttcatcattcgcgacggtttcgccaggatcaggctggatcaagaccggctaccggtaatcgaaccggtctccatcaacgaagagaacgagggattcgagcataatactcaggtgagaaaccagggtatcatagccctgagctatcgggactgggaggagatagtcaaaacatttgaaatcagcgagccggtgattaccccgagccagagacagcagaaacccagcgcttag

SEQ ID NO: 126710 - DNA, 519 bp, Artificial Sequence
  Description of Artificial Sequence: Synthetic coding sequence
atgttacggtatgtcgaaacgcttttgactcacatgggagtcaatccactggaagccgaggagctaatccgagatgaggattcccccgatttcgagtttattgtttacgacagctggaagattactggccgcaccgccgagaacacctttaacaagacacatacgtttcactttctgctgggctctatttacggtgagtgtcccgtacccaaaccgcgagtggacaggccaaggaaagtccctgttatccaagaggagcgagccatgccagcccaattgaggaggatggaagagagtcaccaagaagccaccgagaaggaggtggagcgtatactgggcctgctgcagacctacttccgcgaggatccagatacccccatgtcatttttcgattttgttgttgacccacactcctttccccgcactgttgaaaatatttttcacgtctctttcatcatccgggacggctttgcgcggatccgcctggaccaggacagactccctgtcatcgggaagtag

SEQ ID NO: 126711 - DNA, 2574 bp, Artificial Sequence
  Description of Artificial Sequence: Synthetic coding sequence
atggcgaaagccaagaaggtgggggctaggaggaaagccagcggcgcccccgccggagccagggggggtcctgccaaagccaacagcaatccattcgaggttaaggtgaatcgtcagaaattccagattctgggacgcaagacccgtcacgacgtggggcttcctggggtgtcccgggcgcgtgccctgcgcaaacggacccaaacacttctgaaggagtacaaggagagagacaaatccaacgtatttcgggataagcggttcggagaatacaacagtaacatgtccccagaagagaagatgatgaaaaggtttgctctggagcagcagcgccatcatgagaaaaaatccatttacaacctgaatgaagacgaggaactgactcactatggtcagtccctggcagatattgagaaacataatgatatcgtggactctgattccgacgcagaagatagaggtaccctgtccgcagagcttactgctgcacacttcggcggaggcggagggctgctgcacaaaaagacccagcaggagggagaggagcgggagaagcccaaatcccggaaagaactgattgaggaactaatagccaagtccaagcaggagaagcgggaaaggcaagcccagagggaagatgccctcgagctcacggagaagctggaccaagactggaaggaaatccagaccttgctgtctcataagacgcccaagtcagagaatcgggataagaaggagaagccaaagcccgatgcttacgacatgatggtgcgcgagctcggctttgaaatgaaggcacaacctagcaatagaatgaagaccgaagctgaactagccaaggaagaacaggagcacttgaggaagctggaggctgaacggctaaggcggatgctggggaaggacgaagatgaaaatgttaaaaaacccaagcatatgtcggcagatgacttgaacgatggtttcgtgctggacaaggacgatcgcagactgctgtcttataaggacggcaaaatgaatgtcgaggaggatgtgcaagaggaacaaagcaaggaagcttctgatccggaatcgaatgaagaagaaggtgatagttctgggggagaggataccgaagaatcagactctccggatagccacctggatcttgagtctaatgttgaatccgaggaagaaaacgagaagccagcaaaggagcagagacagacccccggtaaaggtcttatatctggcaaagaacgggcaggcaaagccaccagggatgagctgccgtacaccttcgccgcccccgagagttacgaggaacttcgcagccttctccttggaagaagcatggaggaacagctgcttgtcgtggagcgcatccagaagtgtaaccacccgtctctggccgaggggaacaaggccaagctggagaaattgttcggatttctacttgaatatgttggcgacctcgctacagatgaccctcccgatcttacggtgattgataaactagtcgtccatctgtatcatctctgccagatgtttccggaatctgcctcagacgctatcaagttcgtattgagggatgccatgcatgagatggaggaaatgattgagacaaagggacgggccgctctcccaggacttgacgtcctgatttatcttaagatcaccggactcctgttccctacatccgatttttggcacccagttgtgacaccagctctagtgtgtttgtcacagctcctaacaaagtgccctatcttgtcactgcaagacgtggtgaaagggctgttcgtgtgctgcctgtttctggaatacgtcgcactcagtcagcggttcatccccgagttaatcaatttcctgctcgggatcctgtacatcgcgaccccaaacaaagcctcccaaggatccacgctagtgcacccttttcgggcgctcggcaaaaattctgagcttctcgttgtgtctgcacgagaagacgtagccacgtggcagcaaagcagtctcagcttgagatgggcgagtaggctgagagcccccacctccacagaagcaaatcatattcggctgagttgtctagctgttggtctggcgctactcaagcgttgcgtgcttatgtatggaagcctgcctagcttccatgcgattatgggtccgctccaagcattgctgacggatcatctcgccgattgtagccatcctcaagagctgcaagagctgtgccagagcaccttaacagagatggaaagccagaaacaactgtgtcgccctctcacctgtgaaaagagcaaacccgtcccgctcaagctgttcacgcccagactggtgaaggtgctggagttcggtaggaagcagggcagcagcaaggaagagcaggaaagaaaaaggttgatccacaaacacaagcgcgagtttaagggggccgtccgagagattcgcaaagacaaccagtttctggccagaatgcaactgagcgagatcatggagcgggacgccgagaggaaacgcaaagtaaaacagctgtttaacagcttggcgacccaggagggcgagtggaaggctctcaagcgcaagaagttcaaaaagtag

SEQ ID NO: 126712 - DNA, 2421 bp, Artificial Sequence
  Description of Artificial Sequence: Synthetic coding sequence
atggccaaggccaagaaagtcggggcaagacgcaaggcaagtggcgctcctgctggggcacgcggcggcccagcaaaagctaattccaaccccttcgaagtgaaagtcaaccgacagaagttccagatcttgggaaggaaaactagacacgacgtggggctgccaggggtctcaagggccagagctctgaggaaaagaacgcaaacgctactgaaggagtacaaggagagggacaaaagcaatgttttcagagacaagcgctttggtgagtataattctaatatgtctccggaggaaaaaatgatgaaacgctttgctctcgaacagcaacgccaccacgagaaaaaaagcatctacaatctgaacgaagatgaggagctcacccactatgggcagtcactagccgatattgagaagcacaacgatatcgtggactctgacagcgatgctgaggataggggcaccctgtccgccgagctgaccgctgctcacttcggaggaggggggggactcctccataaaaagacacagcaggaaggagaagaacgcgagaagccaaagtcccgcaaggaactgatcgaagaactgatagcaaaatcaaagcaggagaaaagggaacggcaggcccagcgagaggacgcgctggaactgaccgagaaactcgatcaggattggaaggaaatccagacgcttctcagccacaaaaccccaaagtcagagaatagggacaaaaaagagaaacccaaacctgacgcgtatgacatgatggttcgggaactgggatttgagatgaaggcacagccgtccaatcgcatgaagactgaggctgaacttgccaaagaggaacaagaacatctgagaaaactggaggctgagcgcttgcggcgaatgcttggaaaagatgaggatgaaaatgttaaaaagccaaaacatatgtccgccgacgaccttaacgacggcttcgtgctggacaaagacgataggaggctactcagctacaaggatggcaagatgaatgtcgaggaagacgtgcaagaagagcaatccaaagaagcctccgaccctgaaagcaatgaggaagaaggagactcatctggcggcgaggacaccgaggaatcagattcccccgactcccacttagatctcgagtccaatgttgaaagcgaggaggaaaatgaaaagccggccaaggagcagcgccaaacccctgggaagggcctgatctctggaaaagagcgtgctggaaaagcaacccgggatgagctaccctacacattcgccgcacccgaaagttatgaggagttgcgctctctgctcctgggtaggtctatggaggaacagctgctcgtggtggagaggatccagaagtgtaatcatccctcccttgctgaggggaataaagccaaactagagaagctctttggcttcctgcttgaatatgtaggggaccttgctacggatgacccgccagatctgaccgtgattgacaaattagtagtgcatctttaccacttgtgtcagatgtttcccgaatcagcgtctgacgccattaagttcgtgctgcgcgatgccatgcacgaaatggaggagatgatcgaaacaaagggaagagccgcactgcctggtctagacgtgctaatctatctgaaaattacagggctgctatttccaacctccgacttttggcatcccgtagtcacacccgcactcgtgtgtctgtcccagctcctaacgaaatgccccatcctgtcgcttcaggacgttgttaaaggtctatttgtgtgctgcttgtttctggaatacgtggcccttagccagaggttcattccagaactgattaactttttgttaggaatcctgtatatcgcgacaccgaacaaggcttcccaaggcagcactttggtgcacccgttcagggcactgggaaagaactccgagcttcttgttgtcagcgctagagaagacgtggccacctggcaacagtcctcattgagtcttcgctgggcttccaggctgcgggccccgacgtctacagaagctaaccatattaggctctcatgccttgcggtgggcctggcactgttaaaacggtgcgtactgatgtatggcagtctgccaagcttccatgccattatgggacccttgcaggcactcctgaccgaccacctcgccgactgcagccacccacaggagctgcaggaactgtgccaatctactctgactgagatggaatcccagaagcagctttgcaggccgcttacttgcgagaagagtaaacctgtgcccctgaagttatttacccctagactagtctcaaacagtcgcccccaagttatccatcttccatggcctcccaactatcggtgtgaacctcagcacccagccaaaaaggtgattttcttcagagtaatcatgctgtag

SEQ ID NO: 126713 - DNA, 2574 bp, Artificial Sequence
  Description of Artificial Sequence: Synthetic coding sequence
atggcaaaggcgaaaaaggtgggggctcggcgtaaagcaagtggggcccccgctggcgcacgaggtggccctgctaaggcaaactctaacccattcgaagtcaaggtaaaccggcagaaatttcagattttgggaaggaagacccgccacgacgtgggcctgccgggcgtttccagggcccgcgccttgcggaagcggacacaaacactgttgaaggaatacaaagaaagggataagagtaacgtattccgcgataagcggttcggcgagtataactcgaatatgtctcctgaggaaaaaatgatgaaacgctttgccctcgagcagcagcggcatcatgagaagaagagcatctacaacctgaatgaggacgaagaattgacccactatggccagtccctggcagatatcgaaaaacacaacgacattgttgattcagactccgacgccgaggaccggggcacactgagcgccgaacttacggccgcacacttcggtggcggaggggggttgttgcacaagaaaacccagcaggagggtgaggaacgggagaagccgaagtctagaaaggaattaatcgaggaactgattgctaagagcaaacaggaaaagcgtgagcgacaggcccagcgcgaagatgccctggagctcaccgagaagctggaccaggactggaaggagattcagacacttctgtctcacaagactccaaaatccgagaatcgagacaaaaaggagaaacccaaacctgacgcttacgatatgatggtgagggagcttggctttgaaatgaaggctcaacctagcaacaggatgaaaacggaggcggagttagccaaagaggaacaggaacacctcaggaaacttgaggcagaaagattaaggagaatgttagggaaggatgaggacgagaacgtcaagaagccaaagcacatgtctgcagacgacttgaatgacggatttgttctggataaggatgaccgccgcctactgagctataaggatgggaagatgaacgtagaagaggacgttcaggaggaacagtcaaaagaggcgtctgacccggaaagtaatgaagaagaaggcgacagtagcggcggagaagataccgaagagtccgactcaccagacagccacctggatctcgagagcaacgtcgagagcgaagaagagaacgaaaagcctgcgaaagaacagagacagacgcctggaaagggtttaatctccgggaaagagagagcggggaaggccactagggatgagctcccttacacatttgcggctcctgaaagctatgaggaattgaggtcactgctgctcggaagaagcatggaggaacaacttctggtggttgagaggatacaaaaatgcaatcacccaagcctggcggaaggtaacaaagccaaactagagaagctctttgggttcctgctcgagtacgtgggtgatctggccaccgatgatcctcccgatctaacagtgatagacaagctggtcgtccacctctaccacctatgtcagatgttccctgagagcgctagtgacgccataaaattcgtactgagagatgccatgcacgaaatggaggagatgattgaaaccaaggggagagcggcgctgccaggactggacgtgttgatatatctcaagatcacaggactgttattccccacttccgatttctggcaccctgtagtgactcctgccctggtctgcctgtctcagctcttaaccaaatgccctattttgtccctgcaggacgtagtgaagggtctctttgtctgctgcttgttccttgagtacgtggcactgtcccagagattcatcccagagcttatcaacttcctgctggggatactctatatagctacccccaacaaggcatctcaaggctctacattagttcacccctttagggcgctcggcaaaaactcggagttgctggttgtatcagcccgcgaagacgtcgccacctggcaacagtctagcctttcactacgctgggcctcaaggctgcgagcacctacaagtacggaggccaaccacatccgactgagttgcctggctgtagggttagccctgctgaaacgctgcgtgttaatgtacggatctctgccttcttttcacgccattatggggccactgcaagcattgttgaccgaccacctggcggattgtagtcacccacaagagctccaggagctctgccagtccacactgactgaaatggagtcccagaaacagctgtgtagacccctgacatgtgaaaaatctaagcctgtcccactgaaactgttcacacctcgcctcgtgaaggtgcttgagttcggccgaaaacagggatcatcgaaagaagagcaagaacgcaagcgccttatacataaacataagcgggaatttaaaggggccgtccgcgagatcagaaaagataatcagtttttagcccgtatgcagctctccgagattatggagagggacgccgagcggaaacggaaggtcaaacagttgttcaatagtctcgccacgcaagaaggcgagtggaaggctttgaagaggaagaagttcaagaaatag

SEQ ID NO: 126714 - DNA, 1728 bp, Artificial Sequence
  Description of Artificial Sequence: Synthetic coding sequence
atgaagagattcgccttggagcagcaacgccaccatgagaaaaagagtatttacaacttaaacgaagatgaagaactcactcactacggtcagagccttgctgatattgagaagcataatgatattgtggatagtgactcagatgctgaagacagaggcaccctgtctgctgagctaaccgctgcccacttcggcggcgggggcgggctactgcacaagaaaacccagcaagagggcgaagagcgagagaagccgaaaagtcgaaaggagttaattgaggagttaattgcaaagtctaaacaggaaaagcgcgaaagacaggctcagcgggaggatgcccttgagcttacagagaagttagatcaggattggaaagagattcaaaccctgctttcacataaaacgccaaagagcgaaaacagggacaagaaagaaaaacccaaacctgacgcctacgacatgatggttcgggagttgggcttcgagatgaaggcacagccctccaatcgtatgaagactgaggctgagctggcgaaggaagagcaggagcatctgcgcaagctcgaagcagagagacttcgtcgtatgttaggcaaggatgaagacgagaatgtgaagaaacctaagcatatgtcagctgacgatctaaacgatggcttcgtgctcgataaagatgaccgccggctcctgtcttacaaagatggcaaaatgaacgtggaagaggacgtgcaggaggagcagtcaaaggaagcatcagaccctgagtccaatgaggaggagggcgatagctcaggaggggaggacaccgaggagagtgacagccccgatagccatctggacctggagagcaacgtcgagtctgaggaggagaacgagaaacccgcaaaagagcagaggcaaacacctgggaaaggcctgatcagcggcaaagagcgcgctggcaaggccacaagagacgagctgccatataccttcgcggccccagaaagctatgaagaactgcggtcgctgttgttggggcggagcatggaggaacagttgttagtggtagaaagaatccagaagtgtaaccatccatccctggccgaaggaaacaaggctaagttggagaagcttttcggattcctgctggaatacgtaggggacctcgccaccgacgacccacctgatctgacggtcatagataagctggtcgtacacctgtatcatctctgtcagatgtttccagagagcgcctccgacgcgatcaaatttgtcctcagggatgcaatgcatgaaatggaagaaatgattgagactaaaggaagagccgccctcccgggattggacgtactgatttatctcaaaattacagggctactgttcccgactagtgacttctggcacccggttgtcaccccagccctcgtctgcctctcccagcttcttaccaagtgccctattttgtccctgcaagacgttgtaaaaggtctgttcgtgtgctgtctcttcttggagtacgtggccctttcacaacgatttattcctgaattgattaattttctgttgggcatcctatatattgcaacaccaaataaagcttcacaagggtcaactctcgtccacccctttagggctctcggaaagaactctgaactgctggtggtgtccgcacgggaagacgttgccacctggcagcagtcttccctgtccctgcggtggtggagtcgcatccctgatctgaggtag

SEQ ID NO: 126715 - DNA, 2304 bp, Artificial Sequence
  Description of Artificial Sequence: Synthetic coding sequence
atgggacggcgtagccgtgggaggcgcctgcaacagcagcagagacctgaggacgcggaagacggtgccgaaggcggcggaaagaggggggaggcaggctgggagggtgggtacccagagatcgtaaaggagaacaaactatttgaacattattatcaggagctgaagattgtccccgaaggcgagtgggggcagtttatggacgcccttcgcgagccactacctgcaacccttcgcattacgggatacaagagtcacgccaaagaaatccttcactgtctgaagaataagtatttcaaggagctcgaggacctggaggtggatgggcagaaggtcgaggtgccacagcctctctcttggtacccggaagagctggcctggcatacaaatctctcgcggaaaatcttgcgcaaatccccccacctcgagaagttccaccagttcctggtcagtgaaacggagtctggaaatatttcccggcaggaggccgtttccatgattcctcctcttttgctcaatgtaagaccacaccataagatcctagacatgtgcgccgctccagggagtaaaaccacgcaattaatcgaaatgttgcacgcagacatgaatgtcccatttcctgaaggtttcgtaatcgccaacgacgtggacaacaaaaggtgttacctcctggtccatcaagccaagcgcctcagttctccctgcatcatggtggtgaatcacgacgcctcctccattcccagacttcagattgatgtggatggccgcaaagagatcctgttctatgatcgcatcctgtgcgacgtcccatgtagcggcgatggcactatgcgtaaaaacatcgacgtgtggaagaagtggactacactgaacagcctgcagttacacgggcttcagctgaggattgccactcggggggcagagcagcttgcggaaggcggaagaatggtctattctacctgctctctcaatccaatcgaggacgaggccgtgattgcctccctgctagagaagtcagaaggtgcgctcgaactagctgacgtgagtaacgagctaccaggactcaaatggatgccaggcattacacaatggaaggtgatgaccaaagacggccagtggttcaccgattgggacgctgtgcctcactcccgccacacccagatacggccgacaatgttccctcctaaggatcccgaaaagctccaggctatgcacttggagcgttgcctgaggatcctgccacaccatcagaacaccggtggcttcttcgtcgctgttctggtgaagaagagctcaatgccctggaataagaggcaaccaaaactgcaaggtaaatccgcggagactcgcgagagtactcagctgtcgccagctgatctgaccgagggaaaacctacagatccctcaaagctggaatcaccctcctttactggaacgggcgataccgaaattgcacatgcaaccgaggacctagaaaacaacggttccaaaaaagacggcgtatgcggtccccccccttcaaaaaagatgaagctttttggctttaaagaagatccgttcgtctttatccccgaagatgaccccctttttccacccattgagaagttttatgccctcgacccatcattccctcggatgaacttgttgactagaaccactgaggggaaaaagagacaactgtatatggtgtcaaaagaattaaggaacgttctcctcaataatagcgagaaaatgaaggttatcaacacagggattaaggtctggtgtcgtaacaacagcggcgaagaatttgactgcgcttttagactggcccaggagggaatatatactttatacccgtttatcaactcacgtattatcaccgtgtcaatggaagacgtgaagatcttgctgacccaggagaaccctttctttagaaaattgagctcagagacttattcgcaggcaaaagatctggccaaagggagcattgttcttaagtacgagcctgactccgctaaccccgatgcgctgcaatgccccattgttctgtgtgggtggcgaggcaaggcttccatccggacctttgtgccaaaaaatgaacggcttcattatttgagaatgatgggcctcgaggtgcttggcgagaaaaagaaggaaggagttattctgactaatgaatcagccgccagtaccggccaacctgacaatgatgtcaccgaaggtcagcgcgccggcgagccaaatagcccagacgctgaagaggctaacagcccagacgtgaccgccggctgcgatccagccggagttcacccccccaggtag

SEQ ID NO: 126716 - DNA, 1596 bp, Artificial Sequence
  Description of Artificial Sequence: Synthetic coding sequence
atggtggttaaccacgatgcctcttctatccctagactgcagattgacgttgatggaagaaaggagatccttttttacgatagaatactctgtgatgtaccctgctccggcgatgggacgatgcgcaaaaatatcgatgtgtggaagaaatggaccaccctgaattccctgcagttgcacggattacagcttcgtatcgcgacaaggggggcggaacagcttgccgagggtgggcgcatggtgtatagcacctgctctcttaaccctatcgaagacgaggcagtgattgcgtcacttctcgagaaaagcgagggagccctggagctggctgacgttagcaacgagctgccaggcctcaagtggatgccgggaatcacacaatggaaagtaatgactaaagatggacaatggttcactgactgggacgcagtcccgcatagcagacacacgcagattcggcctacgatgtttcctcctaaagacccagagaaacttcaggctatgcacctcgagaggtgcctgcgcatactgccgcaccatcaaaacactgggggcttctttgtcgccgtgctggtaaagaaatctagcatgccatggaataaacgccagccaaaacttcagggtaagagcgctgaaaccagagaatcgacccagctctctcccgcagacctgacagagggcaagcccacagatccctccaaactggagtctccttcttttacgggcacgggagacacggaaatcgctcacgcaactgaggacttggaaaacaacggctctaaaaaagatggagtgtgcggcccccctccaagcaagaagatgaagctgtttggattcaaagaagacccatttgtgttcatcccggaggatgacccattatttccacccattgaaaagttctacgccctagatccttctttcccaaggatgaatctcctaacaagaaccacagaggggaagaagcgacaactctacatggtttctaaggaactcagaaacgtactccttaacaacagtgaaaaaatgaaggtgatcaatacagggattaaggtgtggtgtagaaacaatagcggcgaagagtttgactgcgccttcaggctggctcaggaagggatttacaccttgtatccgtttattaactcccgaatcattacagtgtcgatggaagacgtgaaaatcttgttaacccaggaaaatcctttcttcaggaagctttcaagcgagacttactcccaggcgaaagacctggcaaagggctcgattgtgctgaagtacgaacccgacagtgcaaatccagacgctcttcagtgtccaatcgttctctgtggttggcgtggaaaagcctcaattaggacctttgtcccaaagaacgaacgtctccactacctccgtatgatgggcctcgaggtgttaggcgaaaaaaaaaaggagggagtgattctaacaaacgagagtgccgcttccacaggccaacctgataacgatgtgaccgagggtcagcgagcgggcgaaccaaactcccctgatgcagaagaggccaactcaccagacgtcaccgctggttgcgaccccgctggcgtgcatcctcctagatag

SEQ ID NO: 126717 - DNA, 2199 bp, Artificial Sequence
  Description of Artificial Sequence: Synthetic coding sequence
atggggcgccgttcccgtggccgccggctccaacagcagcagaggcccgaggatgccgaggacggtgctgaaggaggggggaagagaggtgaggcaggctgggagggcggctacccagaaatcgtcaaagagaacaaacttttcgaacattattaccaggaattaaaaattgtgcctgaaggagaatggggacagttcatggatgctctccgtgagcctcttccagctaccctacgcatcacaggctataaacggtaccctgaggagctcgcctggcataccaatctttcccgcaagatcctcagaaaatctccacatctggagaagttccaccagtttcttgtctctgagactgagtcaggcaacatttctcgccaggaagccgtgagtatgatccctcctctactcctgaatgtacggccccatcacaagatccttgatatgtgtgccgcgccaggcagtaaaaccacccagttgattgaaatgctccacgcagatatgaatgtgccattcccggaggggtttgtgatcgcaaacgacgtggataataagcgctgctatctgctagtgcatcaggctaagcggctgtcctctccttgcataatggtggtgaatcacgacgctagcagcattccacggctgcaaatcgacgtcgacggaaggaaagagattctattttatgatcgcattttatgtgatgtaccatgttctggcgacggtacaatgaggaagaacattgacgtttggaaaaagtggaccaccctgaacagcctgcaactgcacggactacagctcaggattgccactcgcggggccgagcaacttgccgagggcgggcggatggtatattctacctgtagtctgaaccctatcgaggatgaagcagtgattgccagcctcctggaaaagtccgaaggcgcgcttgaactggccgatgtcagcaacgaactccctggcctgaaatggatgcccggaattacacagtggaaggttatgacaaaagatggtcaatggtttacagactgggacgcagtcccccactctcggcatacacaaatacgccctaccatgtttcctcctaaggaccccgagaagcttcaggcaatgcacctggaaaggtgtttgaggatcctgccccatcatcagaacactggcggcttcttcgtagcggtgcttgtgaaaaaatccagcatgccatggaacaaacgccagccaaagttgcagggcaagtctgccgaaacaagagagagcactcagcttagtccggccgatctcactgaaggtaaaccaactgacccctcaaagctggagtctccttcattcaccggcacgggagatactgagatcgcacacgcaacggaagacctggaaaataatggttccaagaaggatggtgtgtgtggacctccaccatccaagaagatgaaactgttcggattcaaagaggatccgttcgtcttcataccagaagacgatccactgttccccccaattgagaaattctatgcgctcgatccatcattcccccggatgaacctgttaacccggactactgaggggaaaaagaggcagctgtacatggtttctaaggagctcaggaacgtgctgcttaataactccgagaagatgaaggtaataaatactggcataaaagtttggtgccgcaataactcgggcgaagagtttgactgcgctttccggctcgctcaggagggaatatacaccttgtatccgtttatcaacagccgtattatcacggtctctatggaggacgtgaaaattctccttactcaggagaatccattttttcgaaaactgagcagtgaaacttacagtcaggccaaagatttggctaaaggaagtattgttctaaaatacgagccggattccgccaatccagatgccttacaatgtccgatcgtgttgtgcggatggcgtggcaaagcaagtattcgcactttcgtgcctaagaacgagcgcttgcattatctccggatgatggggcttgaagtcctgggcgagaagaagaaggaaggcgtgattctgacaaatgagagcgccgctagcacaggacaaccagataatgacgttactgagggccagagggccggagaacccaattccccagatgccgaggaagctaactcccctgacgtgaccgccggatgcgatccggccggagtccatccccctagatag

SEQ ID NO: 126718 - DNA, 1785 bp, Artificial Sequence
  Description of Artificial Sequence: Synthetic coding sequence
atggtcctgctgcatgtcttgtttgagcacgcggtaggttacgcactgctggcgctgaaagaggtagaagagatatccctcctgcaaccccaggtggaggaatccgttttaaatctcgggaagttccactcgattgtgcggcttgtcgctttctgccctttcgccagctctcaggtggctcttgaaaatgccaacgccgtctcagaaggcgtcgttcacgaggacctgaggcttctcctggaaacacaccttccctctaagaaaaagaaagtcctgctcggagtgggagacccaaaaatcggggcagcgatccaggaagaacttggttacaattgtcagactggcggggtgatcgccgaaattttacggggcgtgaggctccatttccataacctcgtgaagggcctaactgacctgagcgcttgtaaagcccagctggggctgggtcatagctatagccgcgcaaaagtaaagttcaatgtgaatagagtcgacaatatgataatacagtcaatttccctcttagaccaattagacaaggacataaatactttttccatgcgggttcgtgagtggtacggatatcattttccagaactggtgaaaatcattaatgacaacgcgacttactgtcggctggcgcagtttattgggaatcggcgtgagctgaacgaagacaagctagagaaactcgaagagctgacgatggacggggctaaggcaaaagctatcctggacgcctctaggtctagtatggggatggatatttccgctatcgacctgatcaacatcgagtccttcagctctcgcgtggtgagcctctctgagtatcgacaatcactccacacttatctccggagcaagatgagccaggtcgctccatcgttaagtgcgttaattggagaggccgtgggcgcccgcctgattgctcacgctggatccctgactaacctggcaaagtatcccgccagcactgtgcagatactgggcgcagagaaggcattgtttcgagctctcaaaactaggggcaacacccccaaatatggactcatcttccatagcacattcatcgggcgagctgcagctaagaataagggacggatcagccggtatttggcgaacaagtgctctattgcgtctcgtatcgattgtttttctgaagtgcccacaagcgtgtttggtgagaaactgagggagcaggtggaagagagactgtccttctacgaaaccggcgagattcccagaaagaacctggatgtcatgaaagaagcgatggttcaggccgaagaggccgctgctgagattacaagaaaattggagaagcaggagaaaaagaggctgaaaaaggagaagaagagactggcagcccttgcccttgcctcgagcgaaaactcgagttccacccctgaggaatgcgaagagatgagcgaaaagcctaagaaaaaaaagaagcagaagccccaagaggtgccacaagagaatggcatggaagacccaagcatctcattttccaaaccaaaaaaaaagaagtccttttctaaggaggagttaatgtcttctgaccttgaggagactgccgggtccacaagtatcccaaaacgtaagaaaagcacacccaaggaagaaacggtcaacgaccccgaggaggctggccaccgttcaggtagcaaaaaaaaacggaagttcagcaaagaggaacccgtgtcaagcggcccagaagaagcggtgggtaagagtagctcaaaaaaaaagaagaagttccacaaagcctcccaagaagactag

SEQ ID NO: 126719 - DNA, 678 bp, Artificial Sequence
  Description of Artificial Sequence: Synthetic coding sequence
atggacatatctgctatagatctgattaatatcgaaagtttttcttctcgggtggtgagcttgagcgaataccgacagtctttgcacacctatctgagatcgaagatgtcacaggtggctccctcactctcggctctgatcggagaggccgtaggcgcccggttgatcgcgcacgcaggatcactgaccaacctggccaaataccctgcgtccacggtgcagatcctgggggccgagaaagcattatttagagccctcaagacccggggaaacacgcccaagtatgggcttatctttcacagtacttttatcggtcgggcagccgctaagaacaagggacgcattagtcggtacctggccaacaaatgttccatcgccagccgcatagactgcttttcagaggtgccaacttccgtctttggggaaaagctacgtgaacaggtggaagaacgtctttcattctatgagacaggggaaattcctcgaaagaatctggatgtgatgaaggaggccatggtgcaggctgaggaagcagctgccgaaattacccgcaaattagagaagcaagagaagaagaggcttaagaaggaaaagaaacggctggcggctctcgccctggcttcatcggaaaatagttccagcacacctgaagaatgcgaggaaggggaccgctgctag

SEQ ID NO: 126720 - DNA, 660 bp, Artificial Sequence
  Description of Artificial Sequence: Synthetic coding sequence
tgactgatcaacattgaatcctttagctcaagagtcgtgagcctttcagaataccggcagtctttgcatacttatttgagatccaaaatgtctcaggtggcccctagtcttagcgcactgattggggaggccgtgggggcgaggcttatcgcacatgcaggttctttgacgaatcttgcaaagtatcctgcatctacggtgcagatcctcggcgccgaaaaagctttgtttcgcgcgttgaagacgaggggcaacaccccaaagtacggactaatttttcactcgacgtttatcggaagggccgccgctaaaaataaggggcgaatttctcggtacctggctaacaaatgttccatagcttcacgcattgactgttttagcgaggttcccacaagcgtcttcggcgagaaactccgcgagcaagtcgaagaacggctgagcttctacgagaccggggaaattcctcgaaagaacctggacgtgatgaaggaagccatggtgcaagctgaagaggctgccgctgagatcacgcgaaagctggaaaaacaggagaagaaacggctcaagaaagaaaaaaaacggttagcggccctcgcactggcatcctctgaaaatagctccagcacaccagaagagtgcgaggagggggatcggtgctag

SEQ ID NO: 126721 - DNA, 846 bp, Artificial Sequence
  Description of Artificial Sequence: Synthetic coding sequence
atggtccttctgcatgtgctctttgaacacgcagtgggctatgctctgctcgcattaaaggaggtcgaggaaatctcccttttacagccacaggtggaggagtccgtgcttaatttgggcaaattccactccatcgtgcggctggtggccttttgccctttcgcaagcagtcaagtcgcgctggagaatgcaaacgctgtctcggagggcgtcgtgcacgaggacttgagacttctactcgagacgcatcttcccagtaagaaaaagaaagtcctgttgggggtgggggatcccaagataggagccgcaatccaggaggagttggggtacaactgccagaccgggggggttatagccgaaattctgcgaggggttcggttacatttccacaatttggtgaaaggtctgaccgatctcagtgcttgtaaagcacagttgggtcttggacactcttactcaagagcaaaggtgaagttcaacgtgaacagagtggataatatgataatccagtcaatctcactcctggatcagctggataaggacattaacacctttagcatgcgagtgagacagtccaggtgtggcgagggcaaggcagttgcactgtggttcctgatgaagcagctaggccaaggcgtcaccgttgccctctgcagggagtggtatggctaccacttccccgagctcgtgaagatcatcaacgacaacgctacatactgccgtcttgctcagttcattggtaatcgaagagagttgaatgaggacaaactggagaagctggaagagcttactatggacggggctaaggctaaggccatcctcgatgcgtcaagaagcagcatgtag

SEQ ID NO: 126722 - DNA, 402 bp, Artificial Sequence
  Description of Artificial Sequence: Synthetic coding sequence
atgagaaaacacgtgctcgccgcatccttttcaatgctgtccctgctggtcattatgggcgacaccgacagcaaaaccgattcatcatttattatggacagtgaccctaggcgatgtatgcggcaccactatgttgactccatttcccaccccctctacaagtgcagctcgaagatggttctgctcgcccggtgcgaaggccactgctctcaagcttccaggagcgagcctttggtgtcctttagtaccgtgctgaagcagccgttccgatcatcttgccactgttgccgtcctcagaccagcaagctgaaagcactgaggttgagatgctcgggtggcatgagacttacggctacatatagatacatacttagctgccactgcgaagagtgcaactcctag

SEQ ID NO: 126723 - DNA, 7416 bp, Artificial Sequence
  Description of Artificial Sequence: Synthetic coding sequence
atgccagctctaagaccggccctgctctgggcactgctcgccctgtggctctgttgcgccgcccctgcccatgctcttcagtgtcgcgacggctacgagccatgcgtgaacgaagggatgtgtgtgacttatcacaacggcaccggatattgcaagtgtcccgagggctttctgggggaatattgccagcacagggatccctgcgagaagaatcggtgtcaaaacggaggcacttgcgttgcccaggctatgctcggcaaggccacttgccggtgcgccagcggttttaccggggaggattgccagtattccacaagccatccttgcttcgtcagccgaccatgcctgaacggcggcacctgccatatgctgagtcgcgacacatatgagtgcacctgccaggtgggcttcacaggaaaagagtgccagtggacagatgcctgcctgtcacacccatgtgcgaacggcagcacatgtacaacagttgcaaatcagttttcctgtaagtgcctcacaggattcacggggcagaaatgcgagactgatgtaaacgaatgtgacatccccggtcactgtcagcacggaggaacgtgtctcaatctaccgggatcctaccaatgccagtgtccacaaggcttcacaggacagtactgtgactctctgtacgttccgtgcgcaccttcaccctgcgtgaacggggggacctgccggcagaccggagactttacctttgagtgcaactgtttgcctgggtttgagggctcaacctgtgaaaggaatatcgacgactgcccaaatcatcggtgccaaaatggaggcgtatgtgtggacggtgtaaacacttacaactgcagatgccctccacagtggaccgggcaattctgtactgaggacgtggacgaatgtctccttcagcctaatgcatgccagaacggcggtacgtgtgccaacagaaatgggggctacgggtgcgtttgcgtgaacggctggtccggggatgactgtagcgagaacatagacgactgtgcttttgcatcttgcactcccgggtcaacatgtattgatcgagtagcatctttcagttgcatgtgcccggaaggaaaggccggtctcctttgccaccttgacgatgcctgtatctccaatccctgccataaaggagctctttgtgatacaaaccctcttaatgggcaatacatatgtacctgccctcagggctacaagggggcagattgtactgaagatgttgatgaatgtgcaatggccaacagtaacccatgtgagcacgcaggaaagtgtgtcaataccgacggggcgttccactgtgaatgcttgaaggggtacgccggacctcggtgcgaaatggatatcaatgaatgccatagtgatccatgtcagaatgatgctacttgtcttgacaagataggtggcttcacctgtctctgcatgccaggttttaaaggggtccactgtgagctggagatcaatgagtgtcagtctaacccctgtgttaataatgggcaatgtgtagacaaagttaatcggtttcagtgtttatgcccacctggatttactggtccagtatgccaaatcgatattgatgactgttccagcactccctgtctcaatggggctaagtgtatcgaccatcccaacggctacgaatgccagtgtgctactggctttactggagtgttgtgcgaagagaacattgataactgcgatcccgacccttgtcaccacgggcaatgccaggatgggatcgactcatacacctgcatatgcaatcctgggtatatgggtgccatttgctcggaccaaattgacgaatgctactcctccccttgcctgaacgacgggcgatgcattgacctggttaatggttatcagtgtaattgccagcccggcacctcaggggtcaactgtgagatcaacttcgatgactgtgcctccaatccgtgcatccacggaatctgcatggatggcatcaacagatattcgtgcgtgtgttctcccggtttcacaggtcagcgctgtaacatagacatagacgagtgcgcttccaatccctgcaggaaaggagccacatgcatcaacggcgtgaacgggttccgatgcatctgcccagagggcccccaccacccatcctgctactcccaggtgaatgaatgtttgtcgaatccttgtattcatggaaattgcacggggggcctctcagggtataagtgtttgtgcgacgccggctgggttggcatcaattgtgaggtggacaaaaacgagtgtttaagcaacccttgccaaaatggcgggacgtgcgataatttggtcaacggttatcgatgcacatgtaagaaagggtttaagggatacaattgccaggtgaacattgatgagtgtgcttccaatccctgtctgaaccagggtacatgttttgacgacatcagtggatacacttgtcactgtgttctcccatacaccggcaagaattgccaaacggtcttagcaccatgttcccctaacccctgtgaaaacgcagctgtgtgcaaagagtcgccgaattttgagtcctatacttgcctgtgcgctcccggctggcaagggcagcggtgcactatcgacatcgatgagtgcatctcaaaaccatgcatgaatcacggtctttgtcataatactcagggtagctatatgtgtgagtgtccacccggctttagcggcatggattgtgaggaggatattgatgattgtcttgctaatccttgtcagaacggcggctcttgtatggacggggtcaacacatttagctgcttgtgtctacctggcttcacgggagacaaatgtcagaccgacatgaacgaatgtctgtctgagccttgcaaaaacgggggcacctgcagcgactatgtgaatagctacacgtgtaaatgccaggccgggttcgacggtgtacactgtgaaaacaatataaatgagtgtactgagtcctcatgtttcaacgggggaacttgtgtggacggaattaattctttcagctgtctgtgccccgtgggcttcaccgggagtttctgtctgcacgaaatcaacgaatgttcctctcacccctgtctgaacgagggaacctgcgttgacggccttgggacatataggtgtagctgtcctctcggttataccggcaagaactgccaaactctcgtgaacctgtgttctagaagtccctgtaaaaataaaggaacatgtgtccagaaaaaagcggaaagtcagtgcctctgtccctctggctgggcaggagcctattgtgacgtgccaaacgtgtcttgcgatatcgccgcctcgagaaggggggtccttgttgaacatttgtgccaacattctggggtgtgtatcaacgccggaaacactcattattgtcaatgccctttaggctatacaggatcttactgcgaagagcaactcgatgaatgcgcatcaaacccttgtcagcatggcgcaacgtgctccgacttcattggtggatacaggtgcgagtgcgttcccggctaccagggcgtgaactgcgagtatgaggtcgatgagtgccagaatcaaccgtgtcaaaatggggggacgtgtatagatctcgtgaaccattttaagtgcagctgcccccctgggacacgaggcctcctgtgtgaagagaatattgatgattgtgcacgcggtccacactgcctgaacggtgggcagtgcatggaccgcatcggtggatacagctgtcgctgtctacccggctttgcaggggagcggtgcgagggtgacattaatgaatgtctctccaatccctgcagcagcgagggcagcttggattgcatccagttaaccaacgactatctgtgtgtgtgtcgatcagcttttactggccggcattgcgagacgtttgtggacgtgtgtcctcaaatgccgtgcctcaacggcggcacctgtgccgtcgcctctaacatgcccgatggatttatctgtagatgcccaccaggcttctcaggcgccagatgtcaatcatcatgtggacaggttaaatgtaggaagggcgagcagtgcgtacatacagcatcaggccctaggtgtttctgcccgagtcctagagactgcgagtccggctgcgcatctagtccttgtcagcacggtgggtcatgtcacccacaaaggcagcccccctattactcctgccaatgcgcccctcctttctctggcagtagatgtgaactgtatacagcccccccctccactccccccgccacatgtctgtctcaatactgcgctgacaaggcccgagacggcgtttgtgacgaagcgtgtaactcccatgcctgtcagtgggacggaggagactgcagtctgactatggaaaacccatgggctaattgttcttcccccttaccatgttgggattatattaataaccagtgcgacgagctgtgcaatactgttgaatgcctattcgacaatttcgaatgccagggtaactctaaaacgtgcaagtacgataagtactgtgcggaccactttaaagacaatcactgtgaccagggctgcaattccgaggaatgcgggtgggacggtctcgactgcgcggctgatcagccagaaaacctagcggagggaacattggtgatcgtagtgctgatgccccccgagcagcttttgcaggacgcccgctccttcttgcgtgcacttggcacattgttgcacactaatctacggattaaaagagacagtcagggtgagctcatggtatacccctactatggcgagaagtcggcagctatgaaaaagcaacgaatgaccagaagaagtttgccgggcgaacaggaacaggaggtggcgggctcaaaagtcttcttggaaatagacaatagacagtgcgtccaggacagcgaccattgcttcaagaacacggatgcagccgcagctctcttggccagccacgcgatccagggaacactcagctaccctctcgtgtctgttgtttctgaatccctgactcccgaacgtacccagttgctgtacctcctagctgttgccgtcgtgatcattctatttatcatccttctgggggtgattatggcgaaacgtaagagaaaacacggatccctgtggctgcccgagggattcactctgaggcgcgatgcttccaaccataaacgccgtgaacccgttggacaggacgccgtcggcttaaagaacctgtcggttcaggtgtctgaggcaaacctgattggcacaggaacgtctgagcactgggttgatgacgagggcccccagccaaagaaagtgaaagctgaggatgaagctctgctgtcagaggaagacgaccccatcgatcgcagaccatggacccagcaacacctggaagctgctgacatccgccggactccaagcttggcgttgacccccccccaagctgagcaggaggtggatgtattggacgtgaatgtccggggaccagacggctgcactcctctgatgctggcatccctcaggggaggatcttccgatctttcagacgaggatgaggacgcagaggacagcagcgctaacatcatcaccgacctcgtctatcaaggcgcatccttgcaagcccagactgacagaactggcgagatggccctacacctcgcggcccgatactcacgggccgatgctgccaaacggctgcttgatgcaggagcagatgcaaacgcacaggataacatggggcggtgtcctcttcatgccgccgtggcagctgatgctcaaggggtcttccagatccttattcgcaatcgggtcaccgatttggacgctaggatgaacgatggaacaacccctctgatccttgcggctcggctcgccgtcgaaggcatggtcgctgagcttatcaactgtcaggcagatgttaacgctgttgacgatcatggcaagagtgctctgcactgggctgcagcggtgaacaatgtggaagcaactctgttgctgttaaagaatggggctaacagagacatgcaggataacaaagaggagactcccctgtttctggcggcgcgagaaggttcgtacgaggccgccaaaatactactcgaccacttcgcaaatcgagatataaccgaccacatggacagacttcctagagacgtcgctcgcgaccgaatgcaccacgacatcgtacgactgttagacgagtacaatgtaactcctagccctccaggcacagtgctgaccagtgctctgtctcctgtgatctgcggacccaataggagttttctttctttgaaacacacaccaatgggaaagaaaagcaggaggccttccgcaaagtcaacgatgccaacatctctaccgaacttggccaaggaggccaaggacgccaaagggtcaaggcggaagaagagcttgagcgagaaggtgcagctcagcgagtccagtgtcacactctcccctgtcgatagcttagagtcgccccatacttacgtgtccgacacaacctcatcacctatgatcaccagccctgggatcctccaggcttccccgaaccccatgctcgcaactgctgcgcctccggccccagtccacgctcagcacgctctgagtttcagcaatctgcatgaaatgcaacccctggcccatggcgcaagcaccgtgctgcctagcgtgtcacagttattatctcaccatcacatcgttagtccaggctcaggcagtgctggttctctttcccgccttcaccctgtccctgtgcccgctgactggatgaatcggatggaagtgaatgagacacaatacaacgagatgttcggtatggtgctggccccagcagagggcactcaccccgggatagccccgcaatcccgcccccccgaagggaagcatatcacaacccccagagaaccactgccccccatcgtcacctttcagctaatacccaaaggatcaatcgcccagcctgccggagcgccacagccacaatccacctgcccccccgccgttgcgggtccattaccaactatgtaccagatcccagaaatggctcgtcttcctagtgtggccttcccgaccgctatgatgccccaacaggatggccaggttgcccagactattttgcccgcatatcacccgttcccagcctccgtgggaaagtatcctacaccacctagccagcactcatacgcatctagtaacgccgcagagcgaacccctagccacagtgggcatctacagggggagcacccctacctaacacccagtcccgagagcccagatcagtggtcttccagcagtccccacagtgcttccgattggtccgacgtcaccacaagtcctacccccggcggggctgggggggggcaacgcggaccaggtactcacatgtcagaaccgccccacaataacatgcaggtttatgcatag

SEQ ID NO: 126724 - DNA, 711 bp, Artificial Sequence
  Description of Artificial Sequence: Synthetic coding sequence
atgtgtgtgacttatcataatgggaccggttattgtaagtgtcccgaaggcttcctgggcgaatactgtcagcaccgggatccctgcgagaaaaaccggtgtcaaaacgggggtacatgcgtcgcccaggctatgctggggaaggcgacctgtcgatgcgcctccggttttacaggagaggattgtcagtatagtaccagccacccttgcttcgtgagccggccgtgcctgaacgggggtacctgccacatgttaagtagagatacatatgaatgcacttgtcaggtcggattcacaggcaaagagtgccaatggacggatgcttgcttgtcgcatccttgcgcaaacgggtccacttgtaccaccgtggccaatcagttttcctgcaagtgtctgactggcttcactggtcaaaaatgcgagacggatgtgaatgagtgtgacataccgggacactgccagcatggcggcacctgtctgaatctgcccggatcatatcagtgccagtgtccccagggatttaccggccaatactgcgactcactgtacgtgccttgcgctccatctccatgtgtgaatggtggcacttgcaggcagaccggcgacttcaccttcgagtgcaattgtcttcctgagaccgttcgtcgagggacggagttatgggaaagagacagacaggtgtggaatggtaaagagcatgatgaaaattag

SEQ ID NO: 126725 - DNA, 720 bp, Artificial Sequence
  Description of Artificial Sequence: Synthetic coding sequence
tgcagagacggctacgaaccatgcgttaacgagggtatgtgcgttacatatcacaacggtacagggtactgtaagtgccctgaaggattcttgggcgagtactgtcagcacagggacccttgtgaaaagaaccgctgccagaacgggggaacatgtgtggcacaagccatgttgggtaaggcaacttgcagatgtgccagcgggttcaccggcgaggattgtcaatactcgaccagtcacccctgtttcgtgagtcgcccctgcctgaacggtggaacgtgccatatgctcagtagggatacgtacgagtgcacctgtcaggtggggtttacgggtaaggaatgccaatggacggatgcatgcttatcccacccctgcgccaacggaagtacatgtacaacagtcgccaatcagttctcctgcaagtgcctaacggggtttacagggcagaaatgtgagacagacgttaatgaatgtgacattcctggacattgtcagcacggcggtacctgtttgaatttgccagggtcatatcagtgccaatgcccgcaggggttcaccggtcaatactgtgatagcctttacgtaccctgcgcacccagcccttgcgtcaacggtggaacgtgtcggcagaccggtgatttcaccttcgagtgcaattgccttccggcatgctggccccgcacaccggacctgagacttcttctcggtgagaagtag

SEQ ID NO: 126726 - DNA, 672 bp, Artificial Sequence
  Description of Artificial Sequence: Synthetic coding sequence
atgtggatctgtccaggcggagggggcggaggtgggggagggggcgacagagaggatgcacggccgcccctgtgctgtgggagatgttggaggtccggatgcgccgcaagaccccctagaatggtctctatcggactgcgcggagcagtgaggggcgctagagggtgccacctcggaagaccctttagtccaagcgtgctattatgtgttgggcggcccgggtctgccgctggggcagaaaggggacacagtcttggctcccaagagttcggtcatcgcagaggaccattgccctggtgtcctgcaaatagacggggatcgccaccatcggcaccccggggccctgggcctcttactcgactcttgggaagacgggaggctgggagtaagagccaaaaactattatttcggagcgctcgggtgcagggcgggggtcagttttgcccttccggcagcgcttttctgggcgttgaaagggaacctactgcagggttgggcggagcagaacgccgtaatgctcgattctggaggggggagagaggccagggtcggcaagccaagcgaccggcaccctcccagcctgcctccccgctgcctgggggaggcacttgggccggctgtgttgggctggtctggatgggcaccggcttttgtggcgcccccgaattttag

SEQ ID NO: 126727 - DNA, 2592 bp, Artificial Sequence
  Description of Artificial Sequence: Synthetic coding sequence
atgtgcgtcacatatcacaacggcacaggatactgcaaatgtcctgagggcttcttaggcgagtattgtcagcatcgcgacccttgcgagaagaatagatgccagaatggggggacatgcgtggctcaggccatgctgggcaaagccacttgccgctgtgcgagtggctttacaggagaagactgccagtattcgaccagccacccgtgcttcgtttctcgaccctgcctgaatggagggacctgtcatatgctgtccagggatacctacgagtgcacttgtcaggttggtttcactggaaaggaatgccagtggaccgatgcctgtctgagccacccatgtgcaaatgggtccacgtgtactacagtggccaatcagttttcttgtaagtgtcttacaggcttcacaggccagaagtgcgagactgacgttaacgagtgcgacataccaggccactgccagcatggcggaacatgcctgaatctccccggttcctaccagtgccagtgcccccagggctttaccggtcaatactgcgactcactctacgtaccgtgtgcgccgagtccgtgcgttaacggtggaacctgtagacagactggcgacttcacattcgagtgtaattgtttgcccggtttcgaaggcagcacttgtgagcgtaacatagacgactgccccaaccacagatgtcagaacggaggcgtctgtgtcgatggagtcaatacctacaactgccggtgtcctccccagtggactggccaattttgtacagaggatgtggatgaatgcctgctgcagccaaatgcctgtcaaaatgggggtacttgcgcgaacagaaacggaggatatggatgcgtctgcgttaatggttggtccggtgatgactgctccgaaaacatagacgattgcgcctttgcatcctgtacccccggtagtacctgcatagacagagtggcgtcattttcctgtatgtgcccagagggcaaggcaggtctgctctgtcacctggacgacgcatgcatcagcaacccatgccacaaaggggctctgtgtgatactaatccccttaacgggcagtacatttgtacttgtccccagggctataagggggcagactgcacagaagacgtcgatgagtgcgcgatggctaactcgaatccctgcgaacacgcgggcaaatgtgtcaataccgacggcgccttccattgcgagtgcctgaaaggctatgctgggcctcggtgcgaaatggacattaatgagtgccacagcgacccgtgccagaatgacgccacttgtttagacaaaattggtggctttacatgtctgtgtatgccaggattcaaaggggtacactgcgaattagagataaacgagtgccagtcaaatccctgcgtaaataacggacagtgcgtcgacaaagtgaaccgattccagtgcctctgtccccctggtttcacaggtccggtgtgccagatagatatcgatgattgcagttcaactccatgtctgaacggcgcaaaatgtattgatcaccctaatggttacgaatgccagtgtgccacaggcttcaccggagttctttgcgaagaaaacatcgataactgcgacccagatccatgtcaccacgggcagtgtcaggatgggattgactcatacacctgcatttgtaatcctggctacatgggtgctatctgcagtgaccagatagatgaatgttattccagcccctgtttgaacgatggtcgctgcatagacttagtgaacgggtaccagtgcaactgtcagccaggcacctcaggggtgaactgcgagatcaattttgatgactgcgcctcgaacccatgtattcatggcatttgcatggatggcattaatcgatactcctgcgtgtgttcccctggcttcaccggacagcggtgcaatatcgatattgacgaatgcgcctccaatccatgtcgtaaaggcgccacatgcattaacggtgttaatggtttccggtgtatatgtcctgaaggacctcaccacccctcatgttacagccaggttaacgagtgtctgtcaaatccttgcatccacggcaactgcaccggggggttgtcaggttataagtgcctctgcgatgccgggtgggttgggatcaattgtgaagtggacaaaaacgaatgcctgagcaacccctgtcaaaacgggggaacctgcgataatctggttaatggataccggtgtacttgtaaaaaaggatttaagggctataactgtcaggtgaatattgacgaatgcgcttccaacccatgcctgaaccaggggacgtgcttcgacgacatctccggatacacgtgccactgcgtgctgccttacacagggggcagctggaggtaccagcaaggcccagagggcatcctggacttagcgcttagcgtgccggaaagccagtgccctggactttgggggtgcaatgcccccccaagggctcatagcagcgtggtcctgcccgcttttaccgactggatcctttccttcgaagaaactctctggcctcctaagatgcaggttgtggactcccaccttccaacattgtacttttctatctag

SEQ ID NO: 126728 - DNA, 6966 bp, Artificial Sequence
  Description of Artificial Sequence: Synthetic coding sequence
atgggtccaggggctcgcgggagaagaagaagaagaagaccaatgtcaccacctcctcctccaccccccgtgagggctctgcctttgctgttgctcctcgccggccccggcgctgcggccccaccgtgccttgacgggtcgccgtgcgccaacggtgggagatgtacccagctaccgagcagagaagctgcatgcttatgcccgcctggctgggtgggagagaggtgccagctggaggacccctgtcacagcggcccctgcgctggtaggggtgtgtgccagagttcagtggtggccggcaccgctagattctcttgccgatgccctagaggctttagggggcccgattgttccttacccgacccgtgtctctcctcaccctgcgctcacggtgcccgctgttctgtgggccctgacggtagattcctgtgtagctgtccccctgggtatcaagggagatcatgccggtcagacgttgatgagtgccgcgtgggagaaccgtgccggcatgggggtacctgtctcaatacacccggcagtttcaggtgccagtgccctgctgggtatacaggacctctgtgcgagaatccagctgttccttgcgctccatcgccttgtcgaaatggagggacctgtcgccaaagtggagacttgacctatgattgtgcctgcttgcccggctttgaaggccagaattgtgaggtgaacgtagacgactgtcccggccacaggtgcctaaacggcgggacatgcgtggacggcgtgaacacatacaactgtcagtgccccccagagtggaccggtcagttctgcaccgaagatgttgatgaatgccagctgcagccaaatgcatgtcataatggagggacttgctttaatactcttggtggtcattcctgtgtctgcgtaaatggttggaccggagagagttgctctcagaacatcgatgattgtgccacagcagtctgctttcatggagcaacctgtcacgatagagtggcctccttttactgtgcgtgtcccatggggaagacgggtctactgtgccatcttgatgacgcctgtgtgtctaatccatgccacgaggatgccatatgcgatacaaatcctgtgaatgggcgcgccatttgtacctgtcctcccggttttacgggtggtgcatgtgatcaggatgtcgacgagtgtagcattggcgcaaatccctgcgagcacctcgggcgctgcgtgaacacccagggctcattcctttgccaatgcggtagagggtacaccggtccacggtgcgagacagatgtgaatgaatgcctttccgggccgtgccgaaaccaagctacatgcctggacagaatagggcagttcacctgtatctgcatggctggttttacaggaacctattgtgaggtggatattgatgaatgccaatctagcccatgtgtgaatgggggagtgtgtaaagaccgcgttaatggattctcctgcacctgcccctctggcttctctgggtctacctgccaactggacgtggacgagtgcgcatctactccatgcagaaacggagcaaaatgtgtggatcagcctgatgggtacgaatgccggtgcgccgagggcttcgagggaacgctgtgcgaccgcaacgtggacgattgctctccagacccctgccaccatggtagatgcgttgacggcattgctagcttctcatgcgcctgtgcccctggatatactggaactcggtgcgaatcccaagtggatgaatgtcggtcgcagccctgtagacacggtggaaagtgcttagacctagtcgacaaatatctttgccgctgtccaagtggtaccacgggcgtgaattgcgaggtgaacatagacgactgcgcctctaatccctgcactttcggcgtttgcagggacggtataaaccgctacgactgcgtgtgccagcctgggttcaccggacccctttgcaacgtggagatcaatgaatgtgcttcatcgccatgtggtgaaggaggcagctgtgtggacggcgagaacggttttcgttgtctgtgtccccctgggagtctgcctcccttgtgcctccccccaagccatccctgcgcccacgaaccttgtagtcacggcatttgctatgatgctcctggcgggtttcggtgcgtgtgtgagcctggatggagcggtcctagatgcagccagtctcttgcaagggatgcctgtgaatctcagccctgccgggctggagggacatgttcttccgacggaatgggcttccactgcacgtgcccaccaggagtccaaggccggcagtgcgaactcttaagtccatgcacccccaatccttgtgaacacgggggaagatgtgagagtgcccctgggcagctaccagtatgctcttgtcctcagggctggcaaggccccagatgtcagcaggatgtggatgagtgtgcgggccccgccccctgtgggcctcacggtatatgcactaacctggccgggtcattctcatgtacttgccacggtggctacacaggtcccagctgcgaccaggatataaatgattgtgaccccaatccttgtctaaacggagggtcatgccaggacggtgttgggtcattcagctgttcctgcctgcctggattcgcaggccccagatgcgccagagacgtggacgagtgtttgagcaatccatgtggcccagggacctgtacggaccacgtggctagctttacctgcacctgtcctcccggttatggcggattccactgcgagcaggacctgccagactgctcccctagctcatgctttaatggtgggacctgcgtggacggggtaaatagcttcagttgtctatgtagacctggatacaccggtgcccattgtcagcatgaggccgatccttgcctgtcaagaccgtgcctgcacggcggggtctgtagcgctgcccaccccggtttccggtgcacctgtctggagagttttactggtccacagtgccagacgttggtcgactggtgttctaggcagccttgtcagaacggggggaggtgcgtgcagacaggggcgtattgtctgtgcccccccggctggagcggaagactgtgtgacatccgctcactgccttgtagggaggccgcagcccagattggcgtgcggttggaacaattgtgtcaagccggcggacaatgcgtggatgaggattcttcccactattgtgtgtgccccgaaggcaggacagggtcccattgtgagcaggaggtagatccttgtctggctcagccatgtcaacacgggggcacgtgcagggggtatatgggcggttatatgtgtgagtgtcttcccggctacaacggagacaattgtgaggacgatgtggatgagtgtgcctcccagccatgtcagcatggaggcagttgtatcgacctggtggcccggtatctgtgtagctgcccacccgggaccctgggtgtgctttgcgaaatcaatgaagatgactgtggacccggcccccctctcgactccggcccaagatgtctccacaatggcacctgtgtcgaccttgtcggtgggtttcgctgcacatgcccacctggctatacaggacttcgttgtgaggctgacatcaatgaatgccggagcggggcttgccatgcagcccacaccagggactgccttcaggacccaggaggaggctttcgttgcctgtgtcacgcaggcttcagtggacccaggtgtcagaccgtactaagcccatgcgaatcacaaccctgccagcacggtggccagtgtagaccatccccaggtcccggaggcgggttgacattcacctgccattgtgcccagcctttttggggcccccgctgtgaacgcgtggctaggtcgtgcagggaactgcagtgtcctgttggcgtaccatgccagcaaactccccgcggcccaaggtgtgcctgtccccctgggttatctgggccgtcatgtagaagctttcccggatcgcctccaggtgcgtctaatgcctcctgcgccgcagccccatgcctccacgggggctcgtgcaggcctgcaccactggcccctttttttagatgcgcctgcgcccagggttggacaggacctaggtgcgaagcccccgccgccgcaccagaggtgtcagaagagccacgatgcccccgggcagcttgtcaggctaagcgtggggatcagagatgtgatcgcgagtgcaactctccaggctgcggttgggatgggggcgactgctccctctcggtcggggacccgtggcgacagtgtgaagccctccaatgctggcggctcttcaataactccagatgcgaccccgcttgctcttcccctgcttgcttgtatgacaatttcgattgccacgccggcggcagggaaagaacatgtaatcctgtctatgaaaagtattgtgccgaccactttgctgacgggagatgtgaccagggttgcaatacagaggagtgcggctgggacgggctggattgcgccagtgaggtgcctgccttacttgcccggggggtgcttgtcttgacagtgctcctgcctcccgaagagctgctcaggtcttcggccgattttctccagaggctgtccgccatactccgcacatcactaagattccggctggacgctcacggccaagctatggtgtttccctaccatagaccctcccccggcagcgagccacgcgcaagaagggagctggccccagaagtcataggcagtgtggtgatgctggaaattgataatagactctgtttgcagagccccgaaaatgaccactgtttccccgatgcacagagcgccgcagactacctcggtgcactgtccgctgtcgaaaggttagactttccatatccactgagagatgtcagaggagaacccttggagcccccggagccgtccgtacccctgctccctttgctggtggccggtgctgttctgctactcgtcatcctggtgctgggcgtgatggtggccagacggaaacgcgagcatagtactttgtggtttccagagggttttagtctgcataaggatgtggcctccggtcacaaaggacggagagaacctgtgggtcaagacgcgttaggcatgaagaatatggccaagggcgagagtctgatgggggaggtggctaccgattggatggatacagaatgccccgaagcaaaacgcttgaaggtggaagagcccgggatgggtgcggaggaagccgttgattgccggcagtggacgcagcaccacctggtagctgctgatattcgcgttgcccccgcgatggctctgacacccccccagggggacgcagacgccgatggcatggacgtgaatgtgcgcgggcccgatggcttcacacctctgatgctcgcaagcttctgcggaggcgctctggagcccatgcccaccgaagaagatgaggctgatgatacctccgctagtatcatatcagatctaatctgtcaaggagcccagctcggtgcccgaaccgaccgcaccggggagactgctttgcatttggccgcgaggtacgcaagggcagacgcagccaaaagattactagacgctggggctgatacaaacgcccaggaccacagcgggcggactccattgcatactgccgttactgccgatgcgcagggtgtatttcagattctcattagaaatcgttcaaccgatctcgacgcgaggatggcagatggctcgaccgcacttattttagccgcccgactggcagtggaaggcatggtggaagaacttatcgcttcccacgccgacgttaatgccgtcgacgagctgggtaagtctgctctacattgggccgccgccgtcaacaacgtggaggctaccttggctctcctgaagaatggcgccaacaaagacatgcaggacagcaaggaggagacacccctgttcctggctgccagggaggggtcctacgaggcagccaagctgctcttagaccactttgctaatcgagagatcacagaccacctggacaggcttcccagggatgtggctcaagagcgccttcaccaggatattgttcgactgctcgatcaaccctcaggacctcggtcaccccccggacctcatggtctggggcctctgctgtgtcctccgggagctttccttcctggcctaaaggctgcacagagtggatcaaaaaagagccggcgcccccctggaaaggccgggctcggcccgcagggtcctagaggtagaggcaagaaactgaccctggcatgtccgggtcctcttgccgatagctctgtgaccctctcacctgtggactcactcgattcccccagaccatttggtggacctccagccagcccggggggttttccactggagggtccttacgctgcggcgacagctaccgccgtcagcctggcccagctagggggccctgggagagctggcctgggccgccagccgccagggggctgcgtactctcattgggactgctcaaccctgtggctgtgcctctcgattgggcccggcttcccccccctgcacctcctgggccttcctttctccttcctttggctccggggcctcagctgttaaacccaggaacacccgtttcccctcaggagcgaccacccccataccttgccgtgcccggtcacggcgaagagtatccagctgctggagcacatagctctcccccaaaagccagatttctccgggtgccaagtgaacacccttatctgactccatcacccgagtcacccgaacattgggcaagtccatcacccccatcgctcagcgattggagcgaaagcaccccatcaccagcaacagctaccggcgccatggctacgactactggggccctgcccgctcagcccctgcccttatctgtccctagttccttggcccaggcccaaactcagctgggaccacagccagaagtaacccctaaacgccaagttcttgcatag

SEQ ID NO: 126729 - DNA, 3867 bp, Artificial Sequence
  Description of Artificial Sequence: Synthetic coding sequence
gcggccatgggccccggtgcccgagggaggcgacggcggaggcgcccaatgagccctccaccgccacccccacccgtgcgagctctgccccttctcctgctcctcgcggggccaggcgcagctgctcctccttgcctcgatggcagcccttgcgcaaacggagggagatgcactcaattgccaagtagagaggccgcatgcctgtgccctccagggtgggtgggcgagcgttgccagttagaggacccctgccactcaggaccctgcgcggggaggggagtgtgccaaagttccgtggttgccggaacggctcgtttctcgtgtcggtgcccgcgaggttttagagggccagactgttccttgccggacccgtgtctgtcttctccgtgtgcccatggagcgaggtgcagcgtcgggcccgatggtcgcttcttatgttcctgcccacctggctaccagggacgatcctgtcgcagtgatgtggatgagtgcagagtgggcgagccctgcaggcacgggggcacatgtttgaacacacccgggagcttcagatgccagtgccctgccgggtacaccggccctttatgcgaaaaccctgctgtgccctgcgccccctctccctgccgcaatgggggcacgtgccgccagagtggggacctcacatacgactgcgcctgcttaccagggtttgagggccaaaattgtgaagttaatgtggacgactgccccggccatagatgtctcaacggcggcacttgtgttgatggcgtgaatacttataattgccagtgtcctccagaatggacgggccagttctgcactgaagacgtggacgagtgccagttgcagcccaacgcttgtcataacggggggacatgctttaacaccctcggtgggcactcgtgcgtatgcgtgaatggctggacaggcgaatcatgctcccagaacattgacgattgcgccaccgccgtctgctttcacggtgctacttgtcacgaccgggttgcgtcattttactgcgcgtgccccatgggcaaaacaggtctgctgtgccacctggatgatgcatgcgtcagcaacccatgccatgaagacgctatttgcgacacgaatccggttaatgggcgcgctatttgcacatgcccccctggcttcaccggcggtgcatgtgaccaggacgtcgatgaatgttcgattggtgccaatccttgcgagcacttgggaagatgtgtcaacacccaagggtccttcttgtgtcagtgcggccgcggatacactggtccccgatgtgaaaccgacgtgaatgagtgcctatcagggccttgtcggaatcaagccacatgcctcgacaggatcggtcagtttacctgcatctgcatggccgggttcacagggacgtattgcgaggtggacatcgatgagtgtcagagctctccttgtgtcaacggcggcgtctgtaaggacagggtcaatggcttctcttgtacatgtccttcagggttttcagggtccacatgtcagctggatgtagacgaatgtgcatctacaccctgccggaacggcgccaagtgtgtggaccagccagatgggtatgaatgcagatgcgccgaaggttttgaagggacattgtgtgacagaaatgtggatgactgctcccctgatccctgccaccatggaaggtgcgtagacggcatcgcctctttcagctgtgcctgcgctcctggatataccggaaccagatgcgaatcccaggtagacgaatgccgttctcaaccatgccgccatgggggcaagtgcctcgacctcgtcgacaaatacctgtgtcgatgtcccagcggaaccacgggtgtgaattgcgaggtcaatattgacgactgtgctagtaatccctgcacttttggagtatgcagggacggcatcaatagatacgactgtgtctgccagcctggctttactgggccactctgcaacgttgagatcaacgagtgcgcatcttcaccctgtggcgagggtgggtcatgtgtggacggcgagaacggttttcggtgcttatgtccgcctggctcgctgccccctctgtgcttgccccctagtcatccgtgcgcgcatgagccttgttctcacggaatctgctacgacgctcctggaggctttcggtgcgtgtgtgagccaggctggtcaggaccccggtgttcacaaagtctcgcacgggatgcttgtgaaagccagccctgcagagccggtgggacatgtagtagcgatggaatgggttttcactgcacttgcccacccggcgtccagggacgccagtgtgagctgctgtcaccctgcactcctaacccatgtgaacatggaggccggtgcgagagtgccccaggccaactgcccgtgtgctcttgccctcagggctggcaggacccttgtctgaatggcggatcctgccaggatggggtgggctctttctcctgtagctgcctgcccggatttgcagggccacgatgcgctagggacgtcgatgagtgtctatctaatccctgcggccccgggacatgtactgaccacgtggcctcatttacctgtacctgcccaccaggatacggcggattccattgtgaacaggatctgccggactgctccccttcatcttgcttcaacggcggaacatgtgtggacggggttaacagttttagttgtctgtgccggcctggctacactggggctcactgtcaacacgaggctgacccgtgcctgagccgcccctgcctacacgggggtgtctgtagcgccgctcaccctgggttccggtgcacatgtttggaaagctttacagggccccaatgccagactctggttgattggtgttcccgccagccgtgccagaatggcggccggtgtgtccagaccggggcctactgcctctgtccccccggttggtccggccggctgtgcgacattagatctttgccttgtagggaagccgcggcacagattggtgtaagactagaacaactttgccaggcgggaggacagtgcgtggatgaggacagttcgcactactgcgtgtgtccagagggtaggactgggtcccattgcgaacaagaagtcgacccatgcctcgctcaaccttgtcagcatggtgggacctgccgcggctacatgggaggctatatgtgcgaatgccttccgggttacaacggcgacaattgcgaagatgacgtggatgagtgcgcatctcagccctgccagcatgggggaagctgcattgatctggtcgcgcgctacttgtgttcttgtccccctggcaccttgggggtcctctgcgagattaatgaagacgattgcggcccggggcccccattggacagcggcccacggtgtctgcataacggcacatgcgttgatcttgtgggcgggtttcgatgtacatgtccgcctggctacactggtctccggtgcgaggctgacatcaatgagtgtagatcaggagcatgtcacgctgcccatactagggattgcttgcaggatcctgggggcggcttccgctgtctttgtcacgctgggttctccgggccgagatgccagactgtcctctctccttgcgagagtcaaccctgccagcatggggggcagtgtagaccctcacctggacctgggggtggcttgaccttcacttgccattgcgcacagccattttggggccccaggtgcgaacgggtggcacgaagttgccgggagttgcaatgccccgtcggggtaccttgccagcagacgccccgtgggccaagatgtgcctgccccccaggtttgagcggccctagctgcagatcatttccggggagccccccgggcgccagtaatgcctcatag

SEQ ID NO: 126730 - DNA, 6012 bp, Artificial Sequence
  Description of Artificial Sequence: Synthetic coding sequence
atgcagcccccgtcactgttgttgctgctcttgctgctgttgttactctgcgtaagtgtcgtgagaccgaggggtctgttatgtgggtcattcccagagccctgcgccaatggcggtacctgcttaagcctgtcactcggccaggggacctgccagtgtgcccctggcttccttggtgagacctgccagttcccagatccgtgccagaacgctcagttatgccagaacggaggatcatgccaagcccttctgcctgctccgcttggtctgccctccagtcctagtccactgacaccttcctttctatgtacctgtctgccaggattcaccggggaacggtgccaggctaaattggaggatccctgtcccccaagcttttgcagtaaacgcgggagatgccatatccaggcctctggccgtcctcagtgttcgtgcatgccaggatggaccggcgagcaatgccagctgcgcgacttctgctctgcaaatccttgcgtgaacggtggagtttgcctggccacatatccgcagatccagtgccactgccccccggggttcgaagggcatgcctgcgaaagggacgtaaatgaatgttttcaagatcccggaccttgccccaagggaactagctgtcataacactcttggttccttccagtgtctctgtccagtggggcaagagggcccacgctgtgaactgcgggcagggccatgcccaccaagaggctgttctaacggtggcacgtgtcagttaatgcctgagaaggattcaacctttcacctgtgcctctgtccccccgggtttattggccctgattgcgaagtgaatcccgacaattgcgtctcacaccagtgccaaaatggaggcacatgtcaagatggcttggatacgtacacctgtctttgccccgagacatggactggatgggactgcagtgaagacgtggatgaatgtgagacgcagggcccacctcattgtcgtaacgggggaacgtgccaaaattccgctgggtcatttcactgtgtatgcgtgtccggctggggaggtacgtcatgtgaggaaaatctagatgactgtattgcagcgacctgtgctcccggttcaacatgtatcgacagagtgggtagtttttcctgtttgtgccccccaggtaggacgggtttactgtgtcaccttgaggatatgtgcctctcacagccctgtcacggggatgcacagtgctcaaccaaccctctcactggttccacgctgtgtctctgtcaacctggttacagtggcccaacatgccaccaagatttagacgaatgcctgatggcccagcagggaccaagcccctgtgagcacggcgggtcttgcctgaacacaccaggctccttcaattgcttatgtccacccggctacacagggtcacgatgtgaggccgatcataacgagtgcttaagtcagccttgccacccaggttctacatgcttggacctgctcgcaacattccattgcctctgcccccccggcctagagggtcagctctgcgaggtagagaccaatgaatgcgcctcggcaccttgtctgaatcacgcagattgtcatgatttactcaacgggtttcagtgtatctgtcttcctgggttctcaggcacacggtgcgaagaggatatagatgaatgccggagttccccctgcgcaaacggtgggcagtgccaagatcagccaggggcattccattgcaaatgtttgcctggcttcgaggggccgaggtgccaaaccgaggtcgatgagtgtctctccgatccatgtccagtaggcgcaagctgccttgatcttccaggtgcctttttttgtctgtgccccagcgggtttacgggccagctctgtgaggtgccattgtgcgcacctaatttatgccagccaaagcagatatgcaaagatcagaaagacaaggccaattgtttgtgtcctgacgggagccctggatgtgccccaccagaggacaactgtacatgccaccacggtcactgccaacggtcatcatgtgtgtgcgatgtagggtggacaggacccgaatgtgaagccgagctcggtggctgtattagcgcaccttgcgcgcacggggggacctgctacccccagcctagcggatacaattgcacatgtcctaccggctacaccgggcccacatgctcagaagagatgaccgcatgtcactctggaccttgccttaacggggggagctgtaacccctcccccggcgggtactattgcacttgtccaccctcccatacaggcccacagtgccaaacgtccacagactattgcgtaagtgccccctgttttaacgggggaacatgcgttaaccggcccggcacattttcatgtctgtgcgcaatggggttccagggtccacggtgcgaaggtaagttgagaccttcctgtgcggatagtccatgccgaaatcgcgccacctgccaggatagcccacagggcccgagatgcctctgccccacaggttatacaggcggtagctgtcagacacttatggatttatgtgctcagaaaccgtgtcctcggaactctcattgtctgcaaaccggaccttcctttcattgtctttgccttcagggctggaccggaccactgtgcaacttgccgctcagctcctgtcaaaaagcagccctgtctcagggcattgatgtgtcctctctttgtcacaacggcggattatgcgtcgattctggaccaagctatttttgccactgccctcccggatttcagggctcgctttgtcaagaccatgttaatccctgtgagtcccggccctgtcagaacggcgcgacatgcatggcccagccctctggttacctttgtcaatgtgccccaggttatgatggccagaactgtagcaaagagctcgatgcatgtcagtctcagccctgccacaaccacggcacctgcacccccaagccaggcggatttcactgcgcctgtccccccggcttcgtgggacttagatgtgagggagacgtcgacgaatgtcttgatcagccctgtcaccctaccggtactgcggcctgtcattccctcgcaaatgctttctactgtcaatgcctgcctggacacaccgggcaatggtgtgaagttgagatcgacccttgtcactcccagccctgttttcacggggggacctgtgaagctacagcgggctctcctttgggcttcatctgtcattgtccaaaagggtttgagggtcctacatgttcccatcgcgcgccgagttgcgggttccatcactgtcaccacggcgggctgtgccttcctagccctaagcccggcttccctccgagatgtgcatgccttagcgggtatggcggtccagactgtctcactccacccgctccgaagggctgcggcccaccaagtccttgtctatataatggctcctgcagcgaaactaccgggctcggcggtcccggctttcggtgttcatgccctcattcctccccaggtccacgctgccagaaacctggcgcgaagggctgtgaggggagaagcggcgacggggcctgcgacgcaggctgtagcggccctggtggcaactgggacggtggggattgctccctcggggttcctgatccttggaaggggtgccccagccactccagatgttggctgctgttccgggatggccaatgccacccccagtgcgacagcgaagagtgtctctttgatgggtacgattgtgaaacaccgcccgcttgcacccccgcctacgaccagtactgtcacgatcatttccacaacggccactgtgaaaaaggctgtaacaccgctgaatgcggatgggatgggggagattgccgccccgaagatggtgacccagaatggggcccaagcctggctctgctcgtggtactttccccaccggccctggatcagcagttgttcgccctcgctcgtgtgctctcactgacattgcgcgtcggtctgtgggtaaggaaagatcgggatgggcgggatatggtgtatccttaccctggagcgagagccgaggagaagctcggtggtactcgggatccaacctatcaggaacgggcggccccacagacacagccccttggaaaggagacggacagcctttcggccggatttgtcgtcgtgatgggcgtagatttaagccgctgcggtcccgatcatccagccagcaggtgcccttgggaccctgggctcttgcttagattcttagccgccatggcagctgttggcgctttagaaccactgctgccaggccccctgctggctgtgcaccctcacgctggaacggctccacccgccaatcagctgccctggcctgtgctttgctccccagtggctggagtaattcttctggccctcggtgctctgctggtgctgcaactgatccgccgcagacgccgtgaacacggggctctgtggctgccacctggcttcactcgcagaccgcgcacccagtcagcgccacacaggcgacgaccgcccctgggagaggatagtattgggctcaaggccctcaagccaaaggccgaagtggatgaggatggtgtagtgatgtgttccggcccagaggagggcgaggaagtcggccaggccgaggaaactgggccccctagcacttgccaactgtggtcactgagtggaggctgcggggccctgccccaggccgctatgttaacacctccacaggaatctgagatggaggctccggatctcgatactagggggccggacggagtgaccccactgatgtccgctgtgtgctgcggagaggttcagagcggcactttccagggcgcatggctgggctgtccggagccctgggagccactcctggacgggggggcctgtccgcaagcccatacagtgggaactggagagacgccacttcatctggctgcaaggttcagcagacccacggccgcccggagactgctggaagctggggccaatccgaatcagccagatagagccgggaggacccccctccatgccgccgttgctgctgacgcaagggaagtgtgtcagctgctgttgcggtccaggcagacagccgtggacgcccgaacagaagacggcactactcccttgatgttagccgcccgcctggcggtcgaggacttggtggaagagctcatcgccgcacaggcagatgtgggagctagggataagtgggggaagactgccttacactgggccgcagccgtaaacaatgcgcgcgctgcccgatctctgctgcaggccggcgccgataaagacgcacaggacaaccgtgagcagactcctctttttttagcagctcgtgaaggggcagtggaggtggcccagttgctcctgggtctcggcgcagcccgggagctgcgtgatcaagcaggcctggccccagcagacgtcgctcatcagaggaaccattgggatctgctcacgctgcttgagggggccggcccccctgaggctagacataaagccacgcccggaagggaggcagggccttttcccagagcacgaacagtcagtgtaagcgttccaccccacggaggtggcgctttgccccgttgtcggaccctgtcagccggggcgggacctcgtgggggaggcgcctgccttcaagctcggacttggtcagtcgatctggccgcgcgtgggggaggagcctactcgcactgtcgttccctctctggggtgggcgccggcggcggtccaaccccacgtggccgtcgattttcagccggcatgagaggccccagacccaatcccgccatcatgcggggtcgttatggtgtggcggcaggccgcgggggtcgcgtgtccaccgacgactggccatgtgactgggtcgcccttggcgcctgtgggtcggccagtaacattccaatccctcccccatgtttaacaccgagtcctgagcgcgggtcgccgcagttggactgtggcccacccgcccttcaggagatgcctattaaccaggggggggagggcaagaaatag

SEQ ID NO: 126731 - DNA, 3147 bp, Artificial Sequence
  Description of Artificial Sequence: Synthetic coding sequence
tgtgccccaggatatgacgggcaaaactgctccaaggagctcgatgcctgccaatctcagccttgtcataaccacggcacttgtacccctaagcctggcggattccactgcgcctgtcctccaggatttgttgggctgaggtgcgaaggggacgtggacgaatgccttgaccagccctgtcacccgacgggcactgcagcctgccactccctggcgaatgctttctattgccagtgcctcccgggccatactggccagtggtgcgaggtcgagatagacccttgtcattctcagccctgcttccatggtggtacctgcgaggcaacagcggggtcccctcttggcttcatctgccactgccctaaagggttcgaggggcctacctgctctcatcgagccccttcttgcggattccaccactgtcaccacggggggctttgtctgcctagtccaaaacctggatttcccccacggtgcgcttgtctaagcggctatgggggacccgactgtttgaccccaccagcccccaagggctgtgggccacccagtccttgtctttacaatggctcatgcagcgagaccactggtttgggggggcctgggtttcggtgctcctgtcctcatagttcgcccgggcctagatgtcagaaacctggagctaaaggctgcgaaggccgatcgggggacggtgcctgcgacgcaggttgcagtggccccgggggcaactgggacgggggggattgttcattgggagttcccgacccttggaaggggtgccccagccattccaggtgttggctgctcttcagagacggacaatgccacccacagtgcgatagcgaggaatgtcttttcgatggatacgattgtgagactccccccgcctgtactcctgcctatgaccagtactgccacgaccattttcataatggacactgtgagaagggatgtaataccgctgagtgcggatgggatggtggggattgccgacccgaagacggcgaccctgagtggggtccctcccttgcattgctcgtcgtgctgagtcctcccgctttggaccagcagttattcgcactcgctcgcgtcctgtctctaacgcttcgcgtgggcttgtgggtgcgtaaggatcgtgacggacgggacatggtctacccctatcccggcgctcgcgctgaagagaaactaggaggcacacgagaccccacatatcaggaaagagccgctccccaaacccagcctttgggaaaggagaccgattccctgagcgctggatttgtcgtggtgatgggagtggacttgtcacgatgcggcccggaccatcccgcatcccggtgtccatgggaccctggcctgctcctgaggttcctggcagctatggcagcagtcggagctctagaacctctacttcctggcccactcctggcggtgcatccccacgcggggacagctcccccagcaaatcaactcccatggcccgttctctgctcccccgtggctggcgtcatcctgctcgctctaggagcgctgttggtcctgcagctgatcagacggcgccgaagggagcacggcgccctgtggttaccgcccggcttcaccagaagacccaggactcagtccgcgcctcatcgccggagacctcctctgggggaagatagcatcggtctcaaggcactgaagcctaaagccgaggtggatgaggacggagtcgtgatgtgttccggccctgaggagggcgaagaagtcggacaggctgaagagacaggccctccctcaacttgccagctgtggtcgcttagcgggggttgtggcgccctgccccaggcagcaatgttaacgccaccacaggaatcagaaatggaggcgcccgatctagatacccgcggtcccgacggggtcacacccttaatgagcgcagtgtgttgcggcgaagttcagtcaggtaccttccagggagcctggctcggctgtcccgagccatgggagccactgctggatggcggtgcgtgccctcaggctcataccgtcggcactggagagaccccactgcacctggctgccagattttccaggcctaccgctgcacgacgactcctcgaggctggggccaaccctaaccagcccgatcgcgctggacggaccccactgcacgccgcggtggccgctgatgcgcgggaagtgtgccagctacttcttcgaagccgccagacagctgtagatgctaggaccgaagacggaaccactccgctgatgctggccgcccgcctggcagttgaggacctagttgaggagctcattgccgcacaggcagatgtgggcgcgagagacaaatggggcaagaccgctcttcattgggcagcagccgtgaataatgccagggcagcaagaagcctgctgcaagctggggccgacaaagacgcacaggataacagagagcagactcccctgtttttggctgcacgtgaaggagctgtagaagtggcccagctgcttctgggtctgggggctgccagagagctgagggatcaggcgggactcgcccctgccgacgtcgcacatcagcgtaatcattgggacctcctgaccctgctggagggggctgggcctcccgaggccaggcataaggcgactccaggccgggaggcgggaccatttcccagggctagaaccgtgtccgtgtctgtcccaccacatggggggggagcgctaccgcgttgtagaacgctgagcgccggtgccgggccacgcgggggtggcgcgtgccttcaggctcgaacctggagtgtggacctcgcggcccggggtgggggcgcctactctcattgcagatccctctccggggtgggggccgggggcggtccaactccccgggggagaaggtttagtgccgggatgaggggcccccggccaaacccggcaataatgcggggtagatacggagtcgccgctggaaggggcggacgggtcagcacagatgattggccctgcgactgggtcgctctgggcgcgtgtgggtctgcgtccaacatcccaatacctcctccatgcctaacaccctccccggaaaggggaagtccacagctggattgtggtccacctgcactgcaggaaatgccaattaatcaaggcggcgaagggaagaaatag

SEQ ID NO: 126732 - DNA, 6018 bp, Artificial Sequence
  Description of Artificial Sequence: Synthetic coding sequence
atgcagccaccctccctactgctgctccttcttttgttgctgttgctgttactgtgcgtgtccgttgtgcgtcctagaggactgttgtgtggctcattcccagagccttgcgctaatggtgggacttgcctaagcttatcgctcggccagggaacctgccagtgcgcccctgggtttctcggagaaacttgtcagtttccggacccctgccagaacgcacagctgtgccagaacggcggcagctgtcaggccctgcttcccgcgccacttggactgccatccagcccttctccactgactccctcatttctgtgcacatgcctccctgggttcacaggcgaacgatgtcaagcacagcttgaggacccatgcccaccttccttttgctctaaaagagggaggtgccacatccaggcttccgggcgtccccagtgtagttgtatgccgggctggaccggtgaacagtgccagctgagagatttttgctccgcaaatccttgcgtgaacggcggagtgtgtctagccacatacccccaaatccaatgtcattgcccaccagggtttgagggacatgcttgtgagcgagatgtgaacgaatgcttccaggatccggggccctgtcctaaggggacatcctgccataatacactggggtcatttcaatgcttgtgtccggtggggcaagagggcccccggtgcgagcttcgtgccggaccttgccccccccggggctgtagcaacgggggtacttgtcaactcatgcccgaaaaagatagcactttccacctgtgcttgtgtcctcctggatttatcgggcccgattgtgaagtgaatccagataattgtgtgtcccaccagtgccagaatggggggacgtgccaagatggcctggatacctacacatgcctttgccccgaaacttggaccggctgggactgttccgaagatgtagatgaatgtgaggcacaaggaccgccccattgtagaaacggggggacctgtcaaaacagtgccgggagctttcattgtgtgtgcgtcagtggttggggagggacttcctgcgaagaaaatctcgacgattgcatcgctgctacatgtgcaccaggatccacctgtatagatagagtgggctcgttctcctgtctttgtccaccgggcagaacagggctgttatgccatctggaggacatgtgcctgtctcagccctgtcatggtgacgcacaatgtagtacaaatcccctcactgggtcgactctgtgcttgtgccagccaggatatagtggccccacatgtcaccaggacctcgacgagtgcctgatggcacagcagggacctagcccctgcgagcacgggggaagttgcctgaatactcctggttcatttaactgcctgtgcccacccgggtacaccggaagcaggtgcgaagcagaccacaatgagtgcctttcacaaccctgccaccctggttctacttgccttgacctgctcgccacattccattgtctgtgccctcccgggctcgagggccagttatgcgaagtggagacaaacgaatgcgcctccgccccctgtctaaatcatgctgactgtcacgatctgctcaatggatttcaatgtatctgtttgccagggttctccggcacgcgttgtgaagaggatattgacgaatgccggagctccccatgtgcaaacggcggccagtgccaggaccagcccggagcgttccactgtaaatgccttccagggttcgagggaccacgatgccagactgaggtagacgagtgcctgtcagatccttgtcctgtgggagcgagttgcctcgacctacctggagctttcttttgcctgtgtcctagcgggttcactgggcagctttgtgaggtgccactctgcgcccccaatctttgccagccgaaacagatctgtaaagatcagaaggacaaagctaactgtctttgtcctgacggaagtcccgggtgtgcaccgccggaagacaattgcacatgccaccacggccattgccagcgcagctcgtgtgtgtgcgacgtcggatggaccgggccagaatgtgaggctgaactgggtggctgcatcagcgctccttgtgctcacgggggtacatgttatccacaaccgtccggctacaactgcacgtgcccaactggctacaccggccctacatgctcggaagagatgacggcctgtcattctgggccttgcctcaatgggggctcctgcaacccttcaccgggggggtactattgtacctgtcctcccagccacaccggcccacaatgccagaccagcactgactattgcgtctccgccccctgtttcaatggcggtacttgcgtgaaccgtcccggcaccttctcttgtctgtgtgccatgggttttcagggccctaggtgtgagggcaagttgaggccatcatgtgccgactcaccttgtagaaatagggccacctgtcaggactctccgcagggtccacgttgtctgtgtcctacggggtacacaggaggtagttgccagacactcatggacctctgcgctcagaagccctgcccacgcaactctcactgtcttcaaacagggccctcgtttcactgcctgtgcctgcagggttggactggacccctgtgcaacttgcctctgagctcgtgtcagaaggctgccctgtcccagggcattgacgtttcctctctctgccacaacggcgggctgtgcgtggattcaggcccctcctatttctgccactgcccacctggcttccaggggtcactctgtcaagatcatgtgaacccttgtgaatcacgcccttgccagaatggtgctacttgtatggcacaaccatccggctacctctgccaatgcgcaccgggatacgatggacagaattgctccaaggagcttgatgcctgccaaagccagccgtgccacaaccacggtacctgtacgccaaaacctgggggattccattgtgcctgccctcctggtttcgtagggctgcggtgtgaaggagatgtagacgagtgccttgaccagccatgccaccctacgggcactgccgcgtgtcactctctggcaaacgcattttactgccagtgtctcccgggccatacaggacagtggtgcgaagtggagatagacccttgccactcacaaccctgtttccacggagggacatgcgaagccacagctggaagccctctgggattcatttgccactgccccaagggctttgagggcccaacttgttcacatagggctccgagttgcgggtttcaccactgtcaccacggtggactttgtttaccaagtcccaaaccaggctttccacctcgctgtgcatgcctcagtggctacgggggccccgactgcctgacccctcctgctcccaaaggctgcggccctccgtcaccttgcctgtacaatggctcctgctcggaaacaaccggcttggggggtcctggattcaggtgctcctgcccccactcatcacctggccctaggtgccagaaacctggcgctaagggttgtgagggccgcagcggcgacggagcctgcgacgccggctgctcaggaccaggcggaaactgggacgggggggactgttcccttggcgttcccgacccctggaaaggctgcccctctcattccagatgctggctgctgttcagggacgggcagtgccacccacagtgtgactctgaagaatgcctgttcgatggatacgactgcgagactcctcctgcgtgtaccccagcatacgatcagtattgccacgatcattttcacaatggtcattgcgaaaagggttgcaataccgcggagtgcgggtgggatggcggggactgtaggccggaagatggtgaccctgaatggggtccatctctggctctactcgtggttctatctcctcctgcactagaccagcagctcttcgcactagccagagtgcttagtctcaccctaagggtcgggctctgggtcagaaaggatagagacgggcgggatatggtttatccatatcctggagcgcgggccgaagagaaactagggggcacgcgtgatcctacttatcaggaacgcgcagccccacagactcagcctcttgggaaagaaacagactctctgagcgccgggtttgttgtcgttatgggggttgacctatccagatgcggacccgaccatccagccagtcgatgcccctgggatcctgggctcctacttcggttcctggcggcaatggccgctgttggggccctcgagcccctgctccccggaccgttgctcgcagttcatccccacgccggtacggctccaccagccaaccagctgccatggccagtactctgttcaccagtggccggggtgatcctgctggctctcggcgcactgctggtgctgcaactgattcggcggagacgtcgggagcatggggcgctctggctgccgcctggcttcaccagaagaccgcgcacccagagtgccccccacaggcgccggcctccattgggtgaggattccatcggcttgaaagcactaaaacctaaagcagaggtcgacgaggacggcgtagtcatgtgtagtggacctgaagagggagaggaagtcggacaggcggaggagacgggaccccccagcacctgccaactatggagtttgagcggtgggtgtggcgctctgccacaggcagccatgttgactccaccccaggagagtgaaatggaggctcccgatctagatacaagggggccagacggcgtgacgcccctcatgtccgcagtctgctgcggcgaagtgcagagcggaacctttcaaggcgcgtggttgggatgcccagaaccgtgggagccattactggacgggggagcctgtccccaagcccatactgtcggcacaggagagacccccttgcacctggctgcaagattttcgagaccaacagccgcacgaaggctccttgaagctggcgcaaatcctaatcagcctgacagagccggtcggacgccccttcatgccgctgtcgctgccgacgccagggaagtgtgtcaactccttttgaggtcgaggcagacagccgtggacgcaaggactgaagatgggaccacacctttgatgcttgcagctagactggctgtggaggacctcgtcgaagaactaatcgccgcccaggctgatgttggcgctagagataagtggggcaaaaccgctctgcattgggctgccgctgtaaataacgctagggcggcccgatctctcctgcaggcaggcgcagacaaagacgcacaggacaatagagagcagacacccctgttcttggccgccagggaaggagctgtcgaggtagcccagttgttgcttggtctcggcgccgctcgagagctgagggatcaggctggtctagctccggctgacgtagctcatcagagaaatcactgggatcttttgactctgctggaaggagcggggccaccagaggcgagacacaaggcgacaccgggacgggaggcaggtccatttccaagagctcggactgtctccgtgagcgtgcctccccacggaggcggcgccttgccaagatgcaggacactgtctgctggagctggacctagaggaggaggcgcatgcttacaagcacgcacttggagcgtcgacctggccgcccgaggcgggggcgcttattcccattgtcggtcactttctggggtaggggctggcggtggacctaccccaagaggacgcagattctcagctggtatgcggggcccaagacctaacccagcgattatgagagggaggtacggagtggccgcgggaagaggaggccgggtgtccacagacgattggccctgcgattgggtcgccttgggcgcctgcggatctgctagcaacattcctattcctcctccatgcctgaccccatcaccagagcgtgggagccctcagctggattgcggcccaccggccttgcaggagatgcctatcaaccagggcggtgagggcaagaaatag

SEQ ID NO: 126733 - DNA, 6012 bp, Artificial Sequence
  Description of Artificial Sequence: Synthetic coding sequence
atgcagcctcctagtctcctgctgctgctgctgttactgctactcttatgcgtgtccgtggtgagaccgaggggactgctctgcggttccttcccagaaccatgcgctaatggcggcacatgcttgtcactctccctgggccagggaacttgccagtgcgccccaggatttctcggggaaacttgccagtttcccgacccatgccagaatgcccaactgtgccagaacggcggttcctgccaggccttgctgcctgcaccgcttgggctgccatccagccctagcccccttactccgtcttttctctgcacgtgtctgccaggattcactggggagagatgccaggcccaacttgaagacccatgccctccttccttttgttctaagcgagggcgatgtcacatccaagctagcggccgcccccagtgctcttgtatgcctgggtggacgggcgaacagtgccagctccgggatttctgctccgccaacccatgtgtcaacgggggagtgtgtctggccacctatccacagatccagtgtcattgcccgccgggatttgagggccacgcctgtgaacgcgacgtgaacgagtgctttcaagatcccggcccttgtcccaaagggaccagttgtcacaatactctgggaagttttcagtgtctgtgtcccgtcggacaggagggcccaaggtgcgagcttagggccgggccgtgcccccccaggggctgtagtaacgggggcacctgccagcttatgccagaaaaagattccacatttcatctgtgtttgtgtccacctgggttcatcggaccggattgcgaggtcaatccagataattgtgtgtcacatcaatgtcagaatggggggacttgtcaggacgggcttgatacatacacgtgcctctgcccagagacatggactggttgggattgttcagaagacgtggacgaatgcgagacacagggtccacctcattgtcggaacgggggaacatgccagaactcggcagggtccttccattgcgtctgcgtctctggttggggcggaacctcttgcgaagagaacttggacgactgtatcgctgccacctgtgcccccggctctacttgtatagacagagtgggctcattctcttgtctgtgcccccccggccgaacaggtcttctctgtcacttagaggatatgtgcctctcccagccttgtcatggtgatgcacaatgttcgacgaacccactgaccggtagcactctctgcttgtgccagccaggatattcgggacccacctgccatcaagacctcgacgagtgtctgatggcacagcaaggcccttcaccatgcgaacatggcggaagctgcttgaatactcccggctcatttaactgcctgtgcccaccaggctataccggctctcggtgtgaggccgaccataacgagtgcctgtcccagccatgtcatcctggctcgacttgcctggaccttctggccaccttccactgcttatgtcccccagggttggagggccagctctgcgaagttgagacaaatgagtgcgcctcagcgccctgcctaaaccatgctgattgccacgatctgttgaacggatttcagtgcatctgcctcccgggcttctcaggcactcggtgtgaagaagacatagatgagtgcagaagctcaccgtgcgccaatggggggcagtgtcaggatcagccgggagcttttcattgcaaatgtcttccagggtttgaaggcccgcgctgtcagaccgaagtcgacgaatgtctgagtgatccatgccctgttggagcatcctgcctagatcttcctggtgcatttttttgtttatgtcccagtggattcaccggacagctgtgtgaagtgccactgtgcgctccaaatctgtgtcagcccaagcagatatgcaaagaccagaaggacaaagcaaactgcctgtgtccagacgggagcccaggctgtgccccaccagaagataactgtacttgccaccacggccattgccaacggagtagttgtgtgtgcgatgtcgggtggacaggacccgagtgtgaagcggaactcggcgggtgcatcagtgctccttgcgctcacggcgggacctgttacccacagccatcgggctataactgtacatgccctaccgggtatactggccctacctgcagtgaggagatgactgcatgtcactcggggccatgccttaacggcggaagttgcaatccctctccaggtggctactactgtacatgccccccttctcacaccggcccccaatgtcagactagcaccgattattgcgtgagtgcaccctgtttcaacggaggtacctgcgtgaatcggcctggtaccttctcctgtttgtgtgctatgggctttcagggaccacgctgcgagggcaagttacgtccatcttgtgccgatagcccatgcagaaacagggctacctgccaagactcccctcagggaccaaggtgcctctgtcctacaggatacacaggtggaagctgccaaacgcttatggatctttgtgctcaaaaaccttgcccacggaacagccattgcctgcagaccggccccagtttccattgtctgtgtctgcaaggatggactggtcctttatgtaaccttcctctgtcttcttgtcagaaagccgccctatcacagggcatagatgtcagtagcctctgtcacaacggcggcctttgcgtggattccggcccgtcttatttctgccactgccctccaggctttcaggggtctctgtgtcaggatcatgtaaacccctgcgagtccagaccatgccaaaatggcgcaacctgtatggctcaaccatcgggctacctctgtcagtgcgcacccggctatgatgggcaaaactgctctaaggaacttgacgcctgccaatcccagccgtgccataatcatggaacttgtaccccgaaaccaggcgggtttcattgcgcttgcccgccaggctttgtcgggcttagatgcgaaggcgacgtggacgaatgcttggatcagccttgccatcccacgggtaccgccgcttgccattcgctcgccaacgccttttactgccagtgtctgcctgggcacacgggacagtggtgtgaagtagagatagacccatgccatagccagccctgcttccatggagggacttgtgaagcgacagcggggtccccactgggcttcatttgccactgtcctaaaggcttcgagggtcctacttgtagccaccgggcaccctcctgtggctttcatcactgtcaccacggcggcctgtgccttcccagtccaaagcccgggttccctccccggtgcgcatgcctatcaggttacggcgggcctgactgtttaacacctcctgcaccgaagggctgtggcccaccctctccttgtctgtataacggatcctgctctgaaaccaccggactcggcggaccaggcttccggtgctcatgtccgcattcttcccccgggcctcggtgccagaagcccggagcaaaaggctgtgaaggtaggtccggggacggcgcctgcgacgctgggtgcagcggaccgggagggaactgggacggaggtgattgttcgcttggtgtgcctgatccttggaaaggctgcccgtcacactctcgctgctggttacttttccgggatggacaatgtcaccctcagtgtgatagcgaagagtgtctgttcgacgggtatgattgcgagacccctccagcatgtactcccgcatacgaccaatattgtcacgatcattttcacaatggccattgtgaaaaaggctgtaataccgctgagtgcggatgggatggtggggactgtcgccctgaggacggagacccagagtggggcccatcgcttgctttgctggtggtattatctccacccgccctcgaccagcaattgtttgccttggcgagagtgctttccctgactttgagggttggcctgtgggtaagaaaggaccgagacggccgggatatggtctacccttaccccggcgcccgcgccgaagagaagctcggcggaaccagggatcctacctatcaggagcgggctgccccccaaactcagccactaggaaaggagaccgatagcctttcagccggctttgtcgtcgtgatgggtgtcgacctgtcacgttgtggaccagaccaccccgcctctagatgcccatgggatccaggactacttctacgtttcttagccgctatggctgcggtgggtgcactagaacctctcttgcctggcccactcctcgctgttcacccccacgcaggaacggctccgcccgccaatcaactgccttggccagtgctgtgctctcctgttgcaggtgtaatccttctcgcactgggagcactcctcgttctgcagctcattcgcagaagaagacgggaacatggcgccctgtggctacctcccggtttcactcgacggccacgaacgcaatcagcccctcacagaagaaggccaccactcggcgaagactcaattgggcttaaggctctcaagcctaaggctgaagtggatgaggatggcgtggtcatgtgttccggcccggaagagggcgaggaagtgggacaagccgaggagactggccctccatctacctgtcagttatggtccctgagcggtgggtgtggtgctctgccacaggccgccatgctaacacccccacaagaaagtgagatggaagcccctgacctggacacgagggggccagatggcgttacccctctgatgagcgcagtctgctgcggagaagtgcaatctggcacatttcagggggcttggctcgggtgtcctgagccctgggaacccctcctagacggcggggcctgtcctcaagcacatacagttgggaccggggagaccccgctgcatctagcggcccgcttcagccgccccactgctgccaggcggttactggaagctggggccaacccaaaccagcccgaccgcgccggacggacccccttgcacgctgcagtggctgcagacgcccgagaggtttgccaactgctgttacgttctagacagactgcagttgacgctagaaccgaagacgggactacgcctctcatgctggcagcccgcctggctgtggaagacctggttgaagagctaatcgccgcccaagccgacgtgggagctcgggacaagtggggtaagaccgccctgcattgggcagccgccgtcaataacgcaagagcagcacggtctctcctgcaagctggtgccgataaggacgcccaggacaaccgagagcagacccctttgttccttgccgcaagagagggggccgtcgaggtggcccaactcctgctgggattaggtgccgctcgggagcttagagaccaggccggcctagctcccgcagatgtcgctcaccaaaggaatcactgggatcttctgactctcttagagggtgctggacccccagaggcaaggcacaaggctactccagggcgcgaagcagggccgtttccccgtgcacgtactgtgtcagtttccgtgccgccacatggaggcggagccctccccagatgtaggaccctgtcagccggggcagggccccgcgggggaggagcttgtctccaggcaaggacttggagtgtggatctagcggcaagaggcgggggagcgtatagtcattgtcgatcactttctggggtcggtgccgggggaggtccaactccgcgcggacgccgtttctcagccggcatgagaggccctcgtccaaaccccgcgattatgagaggacgttatggcgtagccgcaggtaggggaggaagggtttcaacggatgattggccctgcgactgggtcgcactcggcgcctgcggatccgctagcaacatacctatacctccaccctgtctcaccccatcccccgagagaggttctccacagttggattgcggccctccggcattgcaggagatgcccatcaaccaagggggtgagggaaaaaaatag

SEQ ID NO: 126734 - DNA, 561 bp, Artificial Sequence
  Description of Artificial Sequence: Synthetic coding sequence
atgagcgccgtatgttgcggcgaagtccaatcaggtacctttcaaggggcttggttaggatgcccagagccatgggaacccctgctggacggcggcgcttgcccccaagcccatactgtcggaacgggagaaacacccctccacctggccgcaaggttttcgagaccaaccgcagcgcgcagactgcttgaagctggcgccaatccaaatcagccagaccgtgctggtagaacaccattgcacgcagcagttgctgcagatgcgagagaggtgtgtcaactactcttgcgctcccgccaaacagcagtagatgcaaggactgaggatggaactacaccactgatgctcgccgctcgtctcgctgtggaggatttggtggaggaattgatcgccgctcaagcagatgtgggcgccagagataagtggggcgcagacgcggctattcccggaggagcaggacggtccggaggatcttctccagcaactgcgggggctggtggttctccccgggcggcaggcccagggtgggctagcgcaggtggtaggcgcagccctacatag

SEQ ID NO: 126735 - DNA, 6009 bp, Artificial Sequence
  Description of Artificial Sequence: Synthetic coding sequence
atgcagccgccttccttgctgctgttgctgctgctgctgctattgtgtgttagcgttgtacgcccaaggggactgctttgtggatcctttcccgagccctgtgcaaacggcgggacctgcttgagcctgtcgctgggccagggaacctgtcagtgtgctccaggcttcttgggcgagacctgccagtttcccgacccctgtcagaacgcacagctgtgtcagaatggcggcagctgtcaggccctcctgccagctcctttgggtttgccgagcagccctagtccactgaccccttccttcctttgcacctgcttgcccggattcacaggcgaaaggtgccaggctcagctcgaggatccctgtcccccctctttttgtagtaaacgaggtcgttgccacatccaagcgtcaggtaggccacagtgtagttgtatgcctggctggactggggagcaatgtcagctgcgcgatttctgcagcgcaaacccatgcgtgaacgggggtgtctgcctggctacctatcctcaaattcagtgccactgcccacccggctttgaaggccatgcgtgcgaacgcgacgtaaacgagtgcttccaggatccaggaccttgccccaaggggacttcctgtcacaacacattgggctctttccagtgtctttgccccgtcggccaggaaggccctcgctgtgaactgcgtgctggtccatgccccccgcgaggctgtagcaatggcggaacgtgtcagttgatgccagaaaaagattcaacattccacctgtgcctgtgccctcccgggtttataggccccgattgcgaggtgaaccccgacaattgcgtcagtcatcaatgtcagaacggtggcacttgtcaggatggcctggacacctatacatgcctctgtccagagacctggacaggatgggactgctcggaagacgtcgacgagtgtgagacacaagggcctccacactgtcgaaacggtggaacctgccagaactctgcaggatcctttcactgcgtctgcgtgtcaggatggggaggaacttcctgcgaggagaaccttgatgattgcattgccgccacgtgtgcccctgggtctacttgtatcgatagggtgggttcttttagctgcctgtgcccgccagggcgcacggggctgctgtgccatctggaagatatgtgcctgtctcagccctgtcatggggatgcccagtgttccaccaatcctttgacaggatccacactttgtctatgccaacccggctacagcgggcccacttgccatcaggatctcgatgagtgccttatggcgcaacagggaccttcaccatgcgaacatggcggctcctgcctgaatactcccggttccttcaattgcttgtgcccgcccggatatacaggatcaagatgcgaagctgaccacaatgagtgcttgtcccagccatgtcaccctggctccacatgtctggacttactcgcaaccttccactgtctgtgccctcctgggttagaaggccaactgtgcgaggttgaaaccaatgaatgtgctagcgccccctgcttgaatcacgccgattgccatgatcttctgaacggattccagtgcatatgccttcccggcttttctggcacacgctgtgaagaggatatcgatgaatgtaggtcttcaccctgtgccaacggaggacagtgtcaggatcagcctggggctttccactgtaaatgcttgcccggatttgagggccctcggtgccaaacagaggtcgatgaatgcctctcagatccgtgccctgtgggagctagctgtctcgacttaccaggcgcatttttttgtctctgccccagcgggtttaccgggcagctttgtgaggtcccactgtgtgcccccaatctttgtcagccgaaacagatctgcaaagatcaaaaggacaaggccaattgcctgtgccctgacggatcacccggctgtgccccccccgaggacaattgcacatgccaccatgggcactgccaacgctctagctgtgtttgtgacgtaggctggaccggccccgagtgtgaagcagaattgggtgggtgcatctctgcgccatgcgcccatggtgggacttgctacccccagccttcagggtacaactgtacttgccctactggttataccggcccgacgtgtagtgaggaaatgaccgcttgtcactccggaccttgtcttaatggtggatcttgcaacccatctccaggcgggtattactgtacctgtcctccgtctcacaccggcccgcagtgtcagacctccacggactattgcgtgagcgcaccctgctttaatgggggcacatgcgtgaacaggcctggcacctttagctgtctgtgcgctatgggattccaagggccaaggtgtgaagggaaactacgaccaagctgtgccgactctccctgccggaacagggccacctgtcaggattccccacaaggccccaggtgcctgtgcccgacaggctacacagggggctcctgccagactcttatggacttatgtgctcagaagccctgtccaagaaactcccactgtctacagactgggccatctttccattgcctttgtctgcagggctggaccggcccgctgtgtaacctgccgctgtcatcgtgccaaaaggccgcactgagccaaggtattgatgtgtccagcctgtgtcacaatggaggtctctgcgttgattcaggcccgtcctacttctgccattgccccccgggttttcagggctccttgtgtcaggatcatgtgaacccttgcgagagcagaccctgccagaacggcgcaacctgtatggctcagccctcaggatacctgtgccagtgtgcccccgggtacgatggccaaaattgtagcaaggagctagacgcctgccagtctcagccctgccacaaccatggaacatgtacacctaagccggggggcttccattgcgcgtgcccacccgggttcgtcggcctcagatgcgagggcgacgttgatgaatgccttgaccagccttgtcatccaacgggcacggctgcttgccattctctagctaacgccttctattgccagtgcttaccgggccacacaggccagtggtgcgaagtggaaattgacccgtgtcactcccaaccttgtttccacggaggtacctgcgaggctaccgctgggagcccactcggcttcatctgtcactgcccgaagggctttgaagggccgacatgctcccatcgtgccccatcttgtggctttcaccactgtcatcatggaggcctttgcctccccagtcctaaacctggcttcccaccccgttgtgcgtgccttagcgggtatgggggacctgactgcctcacgccccccgctccgaaggggtgtggtcctccttccccttgcctgtacaacggatcttgctcagagacaactggactggggggtcccggttttaggtgctcttgccctcatagttcccccggccctaggtgtcagaaacccggggctaaaggttgtgaaggcaggtcaggtgacggcgcttgtgacgccggatgcagtggcccaggagggaactgggacgggggcgactgttccttaggggttccagacccttggaaaggttgtccaagccatagccgctgctggctcctttttagggacggccaatgccatccacaatgtgatagcgaagaatgtctcttcgatggatatgactgtgagactccaccggcgtgcacccctgcatatgaccagtattgccatgaccattttcacaatggacattgtgagaaggggtgcaataccgctgaatgtggatgggatgggggggattgccggcccgaagatggcgatccggaatggggaccaagtctggcccttttggttgtgttatcacctcccgcccttgatcagcagctctttgcactcgctcgtgtcctgtcccttacactccgcgtgggtctgtgggtcaggaaggaccgggacggtagagacatggtatatccatacccaggcgctcgtgctgaagaaaaactcgggggaacacgagaccccacctaccaggagcgtgccgcacctcagacacagccactgggaaaggaaacagacagcctgtccgcaggcttcgtggtggtcatgggtgtcgacctgagccgctgtggaccggatcatccagcatccagatgtccgtgggaccctggcctgctgttgcggtttttagccgccatggcggccgttggtgcgctcgaacccctcctgcctggaccccttctagctgtccacccacatgcaggcaccgccccgccagccaaccaattgccgtggccagttttgtgctcccccgtggcgggggtgattcttcttgcactgggagctctgctggtacttcaattgattcggagaaggcgaagagaacacggggcactttggctccccccggggtttacccggcgacctcgtacacaatcagcaccccaccggaggcggccgcccctgggagaagattccattgggctgaaggccctgaagccgaaagccgaggtcgatgaggatggcgtggttatgtgcagcggcccagaggaaggagaggaggtgggacaagcagaggagaccggccctcccagcacttgccagctttggtccctctcagggggttgtggagccttgccacaggccgctatgctaacacctcctcaagaaagcgaaatggaagcaccggatttggacaccaggggcccggatggagtcaccccactgatgagtgccgtgtgctgcggagaagtgcagtctgggacgttccaaggggcctggctgggctgtccagagccatgggagcccctactggatggaggggcctgcccacaagctcacactgtgggcactggcgagacccccctccacctggcagctaggttttcccgccctaccgcagccagacgcctcctggaggctggggcaaatcccaaccagccagacagggctggtagaaccccactgcacgcggctgttgccgctgatgcccgggaagtctgtcaattgctcctgagaagccgtcaaaccgcagtagacgccaggacggaggatggaaccacacctctgatgttagccgccaggctggcggtggaagaccttgtggaagagctcatagctgcccaagcagacgtgggcgctcgggataaatggggaaaaaccgccctccattgggccgcagccgtcaataatgcacgcgccgccaggtccctcctacaagctggtgccgacaaggacgctcaggataacagggaacaaacaccgctgttccttgcagctcgcgaaggtgctgtcgaggtcgcccagctccttctgggactgggagcagcacgcgaactcagagaccaggccgggctggcccccgcggatgtagcgcaccagcggaatcattgggacctgctgaccttgctcgaaggggccggccctccagaggcccgtcataaggcaaccccggggagagaggcaggccctttccccagggcacgaacggtgtccgtctctgtccctccccacggcggcggtgccctgccacggtgtagaacactgtcggcgggtgccggtccgagaggcggcggggcctgcctgcaggcccgcacctggagcgtggacttggcagcccgggggggtggcgcctattcccactgcagatccctgagtggtgtaggagcgggcggaggacctacaccacgggggaggagattttccgcaggcatgagagggcctcgcccaaacccagccattatgcgaggtaggtatggcgtggcagccgggagaggtggtcgggttagtacagatgattggccttgcgattgggtcgccctgggagcttgcggcagcgcgtcaaatatcccaatacccccaccatgcctgactccttctcctgagaggggcagtcctcagcttgactgcggccctcccgccttacaggaaatgccaattaaccaaggtggggaggggaagaagtag

SEQ ID NO: 126736 - DNA, 6012 bp, Artificial Sequence
  Description of Artificial Sequence: Synthetic coding sequence
atgcaacccccctctctgttactcctgctgctcctgctgctcctcctctgtgtgagtgtcgtacggcctagggggctgctgtgcggctctttccccgaaccatgtgcaaacggggggacgtgcctgagtctgagcctaggccaggggacatgccagtgtgcccccggattccttggagagacttgccagttccctgatccttgccagaatgcacagctttgtcagaacggaggctcttgccaggcattgctgcctgctcctctcggccttccgtctagcccgagcccacttaccccatcgtttctgtgcacgtgccttccaggatttaccggggagcgttgccaggcaaagcttgaggatccttgtcctccgtctttctgctccaagagaggtcggtgccatatccaggcatcaggcaggccacagtgctcatgcatgccagggtggaccggcgaacagtgccagttgcgggatttctgtagcgcgaatccctgcgtcaacggcggcgtctgtctcgctacgtacccccagattcaatgtcactgtcctcctgggttcgagggacacgcttgcgagcgcgatgtgaacgaatgctttcaagaccctggcccgtgccccaagggcacatcttgtcacaacacacttggttcttttcaatgtctgtgtcccgtcggccaggaagggcctagatgcgagctgcgcgccggtccatgtccgccgagaggttgtagtaacggcggcacctgccagctgatgcccgaaaaggactcaacttttcatttgtgtctttgcccgcccggattcattggacccgactgtgaggtgaatccagataattgtgtaagccaccagtgccagaacgggggtacttgccaagatgggctggacacttacacatgcctctgccctgagacttggacggggtgggattgctccgaggacgttgacgaatgtgaaacccaaggtccccctcactgtaggaatggcggaacttgtcaaaattcagcaggcagctttcattgcgtatgtgtgtctggttggggtggcacatcctgcgaagagaacctggacgactgcattgctgccacctgcgcacctgggtcaacttgtatcgaccgcgtggggagtttctcatgcctgtgtccccccgggcgcacaggacttctttgccacctggaagacatgtgcctatcccagccatgtcacggcgatgctcagtgcagcactaatccactgacaggcagcacactctgtctctgccaacctggatacagcgggccaacttgccaccaagatttggatgagtgtctaatggcccagcagggcccctctccttgcgagcatggagggtcatgtttgaacaccccagggtcgttcaactgtctatgcccccccggctacacgggatcccggtgcgaggccgatcacaacgaatgtctgtcccagccctgccaccccggatctacatgcttggatttgctggcaaccttccactgtctgtgcccacctggactcgaaggccagctgtgcgaagtggaaaccaacgagtgtgcaagtgctccttgtctcaatcacgctgactgtcatgacttattaaacggctttcagtgtatctgtctcccaggattttccggcacccgttgcgaggaggatatcgacgaatgtaggtcatccccttgtgctaatggcgggcagtgccaggatcaacccggcgctttccattgtaagtgtctgcctgggtttgaaggccctcggtgtcaaactgaggttgatgaatgtctgagcgacccatgtcctgttggcgcttcatgtctggacctcccaggggccttcttctgtctgtgtccttccggtttcactgggcagctgtgcgaagttcctttgtgcgcccccaatctctgccagcccaaacagatctgcaaggatcagaaggataaggcgaactgcctgtgccctgacggaagcccgggatgtgctccacctgaagacaattgcacttgccatcatggtcactgccagagatccagctgcgtttgtgatgtcgggtggactgggcccgaatgtgaggccgaactcggcggatgcattagcgcgccttgcgcccatggcggaacttgctacccgcaacctagtggatacaactgcacgtgccctactggatacactggcccaacctgctccgaggagatgaccgcctgtcactcaggcccctgtctgaacggcggaagctgtaacccctcacctggcggctactactgcacctgcccgccctcacacacaggcccccagtgtcagacatctactgactactgcgtctccgctccatgtttcaacggcggcacctgcgtgaaccgacctgggaccttttcatgtctctgcgcaatgggcttccagggtccgaggtgtgagggcaagttgagacccagctgtgcagattccccatgtagaaacagagcgacatgtcaagactccccacaggggcctagatgcctgtgcccaactgggtatacaggcggtagctgccagacgctgatggatctctgcgctcagaaaccatgcccaagaaattcacattgcttacagacggggccctctttccattgcctgtgcttgcaggggtggacaggaccactgtgcaatctcccgttgtcgtcctgtcaaaaggccgcactcagtcaggggatcgatgttagttccttatgccacaatggtgggctttgtgttgactctggaccatcctacttttgccactgtcctcccggcttccaaggatctctgtgccaggatcacgtcaacccatgtgagagcaggccttgtcagaatggagcaacttgcatggcccagccgtccgggtatctctgccaatgcgcccccggctatgatggccagaactgctccaaagaattggacgcatgccagagccagccttgccataatcatggaacttgtacccctaaacctggaggttttcactgcgcctgtcctcccggcttcgttggtctgcgctgcgagggcgatgtcgacgagtgcctggaccaaccctgtcatccgactgggaccgcagcctgccactctctggcaaacgccttctattgccaatgcttacctggacacaccgggcaatggtgcgaagtggaaattgatccgtgccactctcaaccatgctttcatgggggtacttgcgaggcgaccgctggctcccctttaggcttcatatgccactgccccaagggatttgagggaccaacttgtagccaccgtgctccatcctgtggattccaccactgccaccacggggggctgtgcttgccatcgcctaaacccggttttcccccccgctgcgcgtgcctgagtggctacggcgggcccgactgcttgacccctcctgcccctaaaggatgcggccccccatcaccttgtctctacaacggttcgtgctctgagactaccggattaggaggaccagggtttcggtgcagctgtccacactcatccccaggtcctcggtgtcaaaaacctggagccaagggctgcgaaggcagatcaggagacggcgcatgcgatgcaggctgcagcggcccaggtggtaactgggatggcggggattgctcgctgggggtaccagatccctggaaaggctgcccctcccattctaggtgctggctcctgttcagggatgggcagtgtcaccctcaatgcgactccgaggaatgcttatttgatgggtatgactgtgaaacaccccctgcctgcacccctgcatacgatcagtactgccacgatcacttccacaatggtcattgtgaaaaaggatgtaacacggccgaatgtgggtgggatggaggggactgcaggcccgaagatggggatccagagtggggcccttccctggctctcctagtcgttctgagcccccccgcccttgaccaacagctcttcgcactggccagggtactgtcacttacacttagggtgggtctgtgggtgcggaaggaccgcgacgggagagacatggtgtatccctacccgggcgcccgtgccgaagagaagctggggggcactcgggaccctacatatcaagaaagagcagctccccagacccagcctctgggcaaggaaactgatagtctttcagcaggcttcgtcgtggtgatgggtgtggatctgagcaggtgcggccctgatcatccagccagtcgttgcccctgggaccctggccttctactgcgcttccttgcggccatggcggcagtgggggccctagagccactactgccaggcccattgctcgcagtgcacccacacgcgggtaccgccccaccagcaaaccaattgccttggccggtcctgtgcagccccgtcgccggtgttatccttctcgcactgggagccctccttgttcttcagcttattcgtaggagacggagagagcacggggcgctatggctgccccccggattcactaggcgaccacgaacacagtctgcccctcataggcgtcgcccaccgttgggtgaagactcaattggtcttaaggccctgaagcctaaggccgaagtagacgaagatggagtggtgatgtgctctggcccagaggagggcgaggaggttgggcaggccgaggagaccggtcccccctccacctgtcaactgtggtcgttgagtggtggttgtggcgccctgccccaggccgctatgcttacgccgccacaggaatctgaaatggaagctcccgatctggacacccgtggtccggatggtgtcacccctcttatgtctgctgtctgttgcggcgaggtgcagtccggcacgttccagggggcatggctgggctgtcctgaaccatgggagcccttgctcgatggtggcgcatgccctcaggcacacacggtaggtacaggggagacacccctgcacctggccgccaggtttagcaggccaactgcagctcggagactcttagaggcaggcgctaacccaaaccagcccgacagagctggccgcacccccctgcatgctgccgtggcggccgatgctcgcgaggtctgtcagcttttgctcaggagccgtcaaacggcggtggatgctcggactgaggatgggacaacacccctgatgcttgccgctaggctggcagtggaggacctggtcgaggagctgatcgcggcacaggccgatgtcggtgcccgcgataagtggggaaagaccgctctgcactgggctgcggccgtcaacaacgctcgagccgctaggtccctgcttcaagccggggctgataaagacgcccaagacaatcgcgagcagactcccctattccttgcggctagagagggcgcagtggaagtcgcccaactcttgctggggctaggggccgcacgagaacttcgcgaccaggctgggctggctcctgccgacgtggcccaccagcgtaaccactgggatttactcacgctactggaaggcgcaggtccaccagaggcgagacacaaagcaacccccggaagggaggccggtccctttccgagagcccgcaccgtaagtgtgagtgtgccacctcatggcggaggggcacttccaagatgtcgcaccctgtccgccggagccggaccgagagggggcggtgcgtgtttgcaggcacggacctggtcagtggacctggcagctcgcgggggaggtgcgtattcacattgccgcagtcttagtggggtcggcgccgggggagggcccacccccagaggcaggcgcttcagtgccggcatgagaggaccacggccaaacccagcgattatgcgcgggagatacggcgtggcggcgggtcgtggcggacgagtctcaaccgacgactggccatgtgattgggttgcactgggcgcttgcggcagcgcatccaatatcccaatccccccaccatgtctgacacctagcccagaacgaggatcaccacagttggattgcggacccccggcactgcaggaaatgccaatcaaccaggggggggaggggaagaagtag

SEQ ID NO: 126737 - DNA, 561 bp, Artificial Sequence
  Description of Artificial Sequence: Synthetic coding sequence
atgtccgccgtctgctgcggcgaagtgcagagcgggacgtttcaaggggcctggctggggtgtcccgagccatgggaacctctgctagatggaggggcatgcccacaggcccatacagtcgggaccggcgaaaccccattacatctcgccgctcgattttcgcgacccaccgcggccaggcgtcttttagaggcaggagcgaatccgaatcagccagaccgggccggtagaacccctctgcatgcggccgtcgcagctgacgccagggaagtgtgccagctgctactccgatcaagacagaccgctgtggatgctagaacggaagacggcacaaccccattaatgttggcggctcggctggctgtcgaggacctcgtggaggagctgatcgcggctcaggccgatgtgggagccagggacaaatggggcgccgacgctgccatcccaggtggagcaggtagaagcggcggttcatcacccgctaccgccggagcgggaggctcacctcgagcggctggccctggatgggctagtgccggagggaggagatcacccacatag

SEQ ID NO: 126738 - DNA, 561 bp, Artificial Sequence
  Description of Artificial Sequence: Synthetic coding sequence
atgtcggcagtgtgctgcggggaagtgcagtcagggacatttcagggcgcctggctcggatgcccagagccctgggagccactgctggacggaggcgcttgccctcaggcccacacggtaggtacaggcgaaaccccactccacctggcagcccgattcagtcggcccacagcagctcgccgcttgctagaggctggtgccaacccgaaccagcctgacagagctgggaggacaccacttcatgcagctgtagccgctgacgctcgggaggtgtgccagttactgttacgcagtcgccagacagccgtggatgctcgaaccgaagacggtaccacacccttgatgctagccgctaggctggctgtagaggacttggtggaggaactgatcgcggcacaagcagacgtgggggctcgggataagtggggcgctgatgctgccattcctggcggggccggcagaagtggcgggagctctcccgcaaccgccggggccggcgggagtcctagagccgcaggccccggctgggctagcgccggagggcggcggagccccacatag

SEQ ID NO: 126739 - DNA, 561 bp, Artificial Sequence
  Description of Artificial Sequence: Synthetic coding sequence
atgtccgctgtgtgctgcggagaggtccaaagcgggacattccaaggtgcatggttaggatgcccagagccgtgggagcccctgctcgacggtggggcctgcccccaggcgcacactgtcgggacaggagagactccacttcaccttgccgctcggttctccagacccaccgcagccaggagactgttggaagctggcgcaaacccaaatcaaccggatcgagccgggcggacccctctgcatgccgccgttgctgccgatgcacgcgaggtgtgtcagctcttgctccgcagtcggcaaactgccgtggatgcccgcaccgaggacgggacaactccactaatgttagcagcacgactcgcagtggaagacttagttgaggagctcatagcagctcaagcagatgtgggagcccgggataagtggggtgcagacgcagccatcccagggggcgcaggacgctcaggcggtagctcgccagctactgcaggtgctggggggagtcccagagccgctggtcctggctgggcatctgccggagggcggcggagtcctacatag

SEQ ID NO: 126740 - DNA, 561 bp, Artificial Sequence
  Description of Artificial Sequence: Synthetic coding sequence
atgtccgctgtttgctgcggagaggtccaaagcggaacatttcagggggcgtggctaggctgtcccgagccatgggagccactgctggacggcggcgcttgccctcaggcacacacagttggtacaggcgagacccctctccacctggcggctcgcttcagccgacccactgctgccaggagactgttagaggccggggccaatcccaatcagcccgaccgggctggccgaaccccactgcacgcggctgtcgccgctgacgccagagaggtgtgtcagctgttgttacgctcccgacaaactgcagtggacgcccggactgaagacgggacaacgccactgatgttggcagcacgactcgccgtcgaagaccttgtcgaggaactgattgctgcgcaggccgacgtcggggctcgagacaaatggggcgctgatgccgccatccccggcggcgccgggaggtctggaggcagtagccccgctactgctggggcaggcggcagtcctagggcggccggcccagggtgggctagtgccgggggccgaagatcccctacctag

SEQ ID NO: 126741 - DNA, 561 bp, Artificial Sequence
  Description of Artificial Sequence: Synthetic coding sequence
atgtctgcagtgtgttgtggcgaggtgcagtccggaaccttccagggggcgtggctcggatgtccagagccgtgggagccactacttgacggtggtgcatgtcctcaggctcataccgtaggtactggagagaccccactgcaccttgcagcacggttctctaggccgaccgccgcaagaagactgctcgaagctggcgccaacccaaaccagccagaccgggccgggcggacacccctgcacgcagccgtagccgccgacgcccgggaagtgtgtcagcttctgctgcgtagcagacagaccgctgttgatgcccgaactgaggacggcacaacgcctctgatgctcgcagcccgcttggctgtcgaagatctggttgaagaactgatagccgcacaagccgatgtgggcgctagggataagtggggagctgacgcagctataccaggtggagcaggacggtccggcggctcatcccctgctaccgccggcgccggagggtcccccagagccgccggacccgggtgggcctcagcaggaggccgcagatcgccgacttag

SEQ ID NO: 126742 - DNA, 1491 bp, Artificial Sequence
  Description of Artificial Sequence: Synthetic coding sequence
atgggacgcggagtcagagtgctgttactgctgtcccttctgcactgtgctggagggtctgaaggtcgaaaaacctggcgtagacggggacagcagccaccgcctcctcccagaactgaagctgcccctgccgcaggacagcctgtagaaagttttccgctagacttcaccgccgttgaaggaaatatggactcatttatggcacaggttaaatcccttgcccagagtctttatccatgcagcgctcaacagctgaacgaggacctccgccttcatctgctgctcaacaccagcgtgacctgcaacgacggatctcccgctgggtactatctgaaagaaagccgaggtagccgtcgctggttactgtttctggagggcggatggtattgctttaaccgcgagaattgcgacagcagatatgatacaatgagacgccttatgtcctcccgtgactggccccggactcgaacaggaaccgggatactgagctcgcagcccgaggagaatccatattggtggaatgccaacatggtgtttatcccctactgctcctcagatgtttggtcaggcgcctcttctaagtcggaaaaaaacgagtatgccttcatgggcgccctcatcatccaggaagtggtgcgagaattgctcggcagagggcttagtggtgccaaagtgttactgctagcaggtagctcagcgggtggtactggagttctcctaaatgttgatcgggtggccgaacagctggaaaagctgggttaccccgccattcaagtgagagggctggccgactctggatggtttctcgataataagcagtatagacacaccgattgcgtggatacaattacttgtgctccaactgaggctattaggcggggaattcggtactggaacggggtggtgccagagcgatgtagaagacagttccaagaaggggaagagtggaactgcttcttcggatataaggtgtatcctacgttgcggtgtcccgtgttcgtcgtccaatggctgtttgatgaagcccagctcaccgtagataacgtgcatctgacggggcagcccgtgcaggagggacttcggttgtacattcagaatttgggtcgggagctgaggcacacgcttaaggatgtgcccgctagtttcgcgcctgcttgcctgtctcatgaaatcatcatccggtcccattggactgatgtccaggtgaaggggacatctctccccagagcacttcactgctgggacagatccctgcacgactctcacaaggccagcaagaccccactgaagggatgtccagtgcacttggtcgacagttgtccctggccccattgcaacccgtcctgtcctaccgtgagggatcagttcaccgggcaggagatgaacgttgcccagttcctgatgcatatgggcttcgatatgcagaccgtggcccagcctcaaggactggaacctagcgagctacttggcatgctctcgaacgggtcttag

SEQ ID NO: 126743 - DNA, 888 bp, Artificial Sequence
  Description of Artificial Sequence: Synthetic coding sequence
atgggccgaggcgttcgagtgctgctgctactgagtctgctgcattgtgctggaggatctgaaggcagaaagacatggcggaggcggggacagcagccaccccctcccccaagaaccgaagctgcacccgccgcagggcagccagtggagtcgtttcctttagatttcacagccgtggaagggaacatggattctttcatggctcaagtgaagtctcttgctcagtcactatatccctgtagcgcacagcaactgaacgaggatctgagactccacctgttgctgaatacctctgtgacatgtaatgatggtagccctgctgggtattacctcaaggagagccggggcagtcgtcgctggctcctctttctggagggaggatggtattgcttcaatagggagaattgtgactctagatacgacacaatgcggcgactcatgtcaagccgagactggccccggactcgaacaggcaccgggatcctgtccagtcagcctgaggagaacccctattggtggaacgccaacatggttttcatcccgtattgtagcagcgacgtctggtcgggcgcttctagcaagtccgagaagaatgaatacgcatttatgggggcattgatcattcaggaagtggtgagggagctgctgggccggggcctgtccggtgctaaggtgctcttgctagcgggttcctccgcaggggggacaggcgtgctcctgaacgtggatagggttgctgagcagctcgagaaattaggataccctgctatacaggtgcggggcttagcagactccgggtggttcctagataataagcaatatcgccacacagactgcgttgacaccataacctgcgctcccacggaggctatcagacgcgggatttag

SEQ ID NO: 126744 - DNA, 4080 bp, Artificial Sequence
  Description of Artificial Sequence: Synthetic coding sequence
atggccgaagccggactgcgtggctggctgctttgggcccttttactgaggctagcacagagcgagccctacaccaccattcaccagcccggctactgcgcattttacgatgagtgtgggaagaatccagagctgagcggctccctcatgacattgtctaacgtcagctgtctatcaaatacgcccgctaggaagattacgggggatcatcttattctgctgcaaaaaatatgtccgcgactgtacacaggacctaacacacaggcatgctgctctgcaaaacagttggtgtcccttgaagcttctctatctataactaaggccctgctaacccggtgtccggcctgctctgataactttgtgaacttgcattgtcataacacgtgttctcccaatcagagcctgttcatcaacgtcacacgcgttgcgcagctcggggcggggcaacttcctgctgtcgtggcttacgaggccttttatcagcacagcttcgccgagcagtcctacgattcttgttcgagggtgagggtgcctgccgctgctactctggcagttggcactatgtgcggagtatacggatcagcactttgcaatgcccaacgctggctgaactttcaaggagacacgggaaatggactggcacctctggatatcacattccacctgctggaaccagggcaggccgttggaagcggaattcagcccctcaacgaaggcgtagctcgctgcaatgagtcacagggggacgacgtcgccacttgtagctgccaggactgtgctgctagttgtcctgcaatagcccgaccacaggctctcgactccacgttctacctagggcagatgcctgggtcgctcgtgctgatcataatcctgtgctctgtgttcgctgtagtgactatacttctggtaggctttagagtagctcccgctcgagacaagtctaagatggtggatcccaagaaagggacctccctgtcggataagctgtctttttcgacccacacactgctcggccagttttttcaaggttggggaacatgggtcgcaagctggcccctaactattctggtactctcagtcatcccggtcgttgccctggccgccggtctggttttcactgaattaaccactgaccctgtggaactgtggtccgccccgaactcccaggcccgttctgagaaggccttccatgaccagcacttcgggccctttttcaggactaatcaggtgatcctcaccgcgccaaaccgcagctcctataggtacgactctttattgctgggaccaaagaatttctccggcatactagacctagatttgctgcttgagttgctggaactgcaggaacgattacggcacttgcaagtttggagccccgaggctcagcgtaatattagtctgcaggacatttgttacgctcctctgaacccggacaacacctcactgtacgactgttgcatcaatagcctgctccagtattttcagaacaaccgcactctgctcctcctcaccgcgaatcagactctgatggggcagacgagccaggttgactggaaggatcactttctgtactgcgccaatgctccattaacttttaaagatggtactgctttggccctctcgtgtatggctgattatggcgcgcctgtcttccccttcctggccattggagggtataagggcaaggattattctgaagccgaagcattgataatgaccttttcgctcaacaattaccccgcaggagatccacgcctggctcaggcgaaactctgggaggaggcattcttagaggaaatgcgggccttccagcgccggatggctggcatgttccaggtcacatttatggccgagcggtccctggaggatgagatcaatagaactacggctgaggacctaccaatctttgctacttcctatatcgtgatctttctgtatatctctttagcactggggagttacagctcttggtccagggtgatggttgatagtaaggccacgctggggctcggcggcgtggcggtggttctaggcgccgtgatggcagcaatggggtttttcagctacctgggtattagatcatcactagtgattctacaagtggtgcctttcttagtcctgagcgttggggcagataatattttcatttttgtcttagagtaccaacggcttccgcgcaggcctggcgaaccacgcgaggtccatattggacgcgcactgggcagagtggcacctagcatgctactgtgcagtctgtcagaagctatctgcttcttcctcggggctctgacccccatgcctgctgtacgaacattcgcccttacatctggtctggctgtgatccttgattttttgttgcagatgtctgcctttgttgcattgctgtctctggacagtaaaagacaggaggcgtctcgcctggatgtgtgttgttgcgttaagcctcaggaattgccaccacctggacagggagaaggcctccttctgggcttcttccagaaggcttatgctcccttcctacttcactggattaccaggggcgtggtactgctactgttcctggccctcttcggcgtctctctttattctatgtgtcatattagcgttggcctcgatcaggagctggctctgcctaaagacagttacttacttgactattttctattcctgaaccgctacttcgaggtcggcgcgcccgtgtatttcgttacgacacttggctacaacttttcaagcgaagccgggatgaacgccatctgcagttcagcagggtgtaataacttctcattcacccaaaagatccagtacgcgactgagttccctgagcagagttatctggctatcccagctagctcctgggtggacgattttatcgattggctgacgcccagctcatgctgtaggctctacatttctgggcctaataaggacaaattttgtccatcgaccgtgaatagcctgaactgtctcaaaaactgtatgagcataactatgggatccgtacggccatctgtcgaacagttccacaaatatttgccttggtttcttaacgatagacccaacatcaagtgcccgaagggtgggttggccgcctattccactagtgtgaacctgaccagcgatgggcaggttctggataccgtcgccatcctgtctccgcgactggagtattccggcaccataagcgcccattgtaatttatatcttcttgacagcacctcccgttttatggcctatcataaacctcttaaaaacagccaagattacactgaagccctgcgcgccgcccgtgaattagccgcaaatatcacggccgacttgcggaaagtgcctggtaccgaccctgcttttgaggtgtttccatacactatcaccaatgttttctatgaacagtacctaactattcttcctgagggcctgtttatgctgtcactgtgcctggtgcccactttcgctgtctcatgcttgctgcttggcctcgacctgcgttcagggctcctgaatctgttatctattgtgatgatcctggttgatactgtaggattcatggccctgtgggggatttcttataacgcagtttcgctgattaacctagtctcagctgtgggtatgtctgtggaattcgtctctcacatcactcggagttttgccatcagcactaagccaacgtggctcgagagggctaaagaggcgactatctctatgggttctgccgtttttgcaggtgtggccatgacaaacctgccaggcatcctagtgctgggacttgcaaaggcacagcttatccagatattcttctttcgcttgaatttgctgattaccctgcttggcctgctgcatggcttagtgttcctgcccgtcattctttcctacgtcggccccgacgtgaatccggccctggcgctggagcagaaacgggctgaagaagccgtggccgctgtgatggtggcttcatgtcccaaccacccctcccgcgtttccaccgccgacaacatatatgttaaccatagctttgagggcagcattaagggggccggcgccatctcaaatttcctgccaaataacgggagacagttctag

SEQ ID NO: 126745 - DNA, 3999 bp, Artificial Sequence
  Description of Artificial Sequence: Synthetic coding sequence
atggctgaggccgggctaagaggctggttactttgggctctattgctgaggctggcgcaatccgagccatacaccaccattcatcaacctggatactgcgctttttatgacgaatgcggaaaaaatcctgagttatctggtagcttaatgactctgtcaaatgtgagttgtctctctaacaccccagcccgcaaaataactggcgatcacctgatcctgctacagaagatctgtccccgtctatataccggcccaaacacccaggcctgttgctctgctaagcagctggtctctttagaggcctccctgtctataaccaaggccctgctcacccggtgtcccgcgtgttccgacaacttcgtcaatttgcattgccataacacttgttctcctaatcagtccctgttcatcaacgttactcgggtggctcagttgggcgctggtcaactcccagctgtcgtagcatacgaagccttttatcagcacagcttcgccgagcaatcttacgacagttgctccagagttagagttccggctgcagctaccttagccgtcggaacaatgtgtggcgtttacggctccgcgctctgcaatgctcagagatggctcaattttcagggtgatacaggcaacggtctggctcccctggatataacctttcatctgctggagcccggccaggctgtaggctcgggaatacagcctctcaatgaaggcgtggcacggtgtaacgaaagtcagggcgatgacgtagccacttgttcgtgtcaggattgtgctgcgtcatgtccggctatcgcccgcccccaggctcttgactcgactttctatctgggccagatgcccgggtccctcgtcctaattataatcctgtgcagtgtttttgccgtggtgacaatattgctcgttggatttcgagtcgctcctgcgagagacaagtcaaagatggtagacccgaaaaagggaaccagtcttagtgataaactaagcttcagtactcataccctgctcgggcagttttttcaggggtggggcacttgggtggctagctggccacttaccatccttgtgcttagcgtgattcccgtggtagctctggcagcaggactggtgttcacagaactgaccaccgatccggttgagctgtggtctgctccaaattcccaggcgaggtccgagaaggcgttccacgaccagcattttggccctttctttagaactaaccaggtcattctgaccgctcccaatcggtcaagttatcgctatgattctctgctcctggggcctaagaacttttccggaattttggatctcgacctcctccttgaactgctcgagctgcaggagcggctgcggcacttacaggtctggtcaccagaggcccaacgaaatatatccctgcaggatatttgctatgcaccactaaatccagataatacatcactgtacgactgctgtatcaattccctgctccaatattttcaaaataacagaaccctgctgcttctgaccgccaaccaaacccttatgggccagacttctcaagtggactggaaggaccattttctgtactgcgccaacgcccctctaacctttaaagatggcacagcattggccctgtcctgcatggccgattacggcgcacccgtatttccatttcttgccataggaggctacaaaggtaaggattactctgaggcggaggccctgataatgacttttagcctcaataattaccccgccggggatccacggctggcgcaggccaagctgtgggaggaggcatttcttgaagaaatgagagcctttcagcggcgcatggccggaatgtttcaggtgactttcatggcagagcgctccctggaagacgagatcaataggactaccgccgaggacctgccgatcttcgcaacctcatacatcgttatcttcctgtacataagcctggcccttggatcatattcctcttggtcgagggtcatggttgattctaaagccaccctggggctgggcggggtggcagtcgtgctcggcgctgtcatggccgccatgggctttttctcttatttaggaattcggagttcattggtgatcttacaggtggtcccatttctcgtgctgagtgtaggggctgacaacattttcatttttgtgcttgagtatcagaggctgccccgacgcccaggagaaccccgagaagttcacattgggcgggctttgggtcgggtagcaccctctatgctgttgtgctcgctctcagaggccatttgcttctttctcggggccttgactcccatgcctgctgtgaggacttttgctctcacgtccggtcttgccgtgatcctggattttctgctgcagatgtctgcctttgtggcccttcttagtttagatagcaagagacaagaggctagcagactggatgtgtgttgctgtgtgaagccgcaggagctcccgcctcccggccaaggcgaaggactgctactgggcttctttcagaaagcatatgccccttttctgctgcattggattactcgcggggttgtgttgctgctgtttcttgctctgttcggcgtctcattatatagcatgtgccacatttctgtgggtctcgaccaagaactggcccttcccaaagattcctacttacttgactacttcctgttcctcaaccggtactttgaagtaggggccccagtttacttcgtgacgacactaggatataacttctcctctgaggcaggaatgaacgccatatgttcaagtgccggatgcaacaatttcagctttacccaaaaaattcagtacgccacggaattcccagaacagtcttacctggccatccccgccagttcctgggtggatgactttattgattggctgacacccagcagctgttgtcgcttgtacatttccggacctaacaaagacaagttttgtccctctactgtaaattcgttgaattgcctgaaaaactgtatgtcgattaccatgggcagtgtgcgtccatccgtggagcagtttcataagtatctgccttggttccttaatgatcggcccaacatcaagtgtcctaaggggggccttgccgcctactccacatctgtaaatttgacaagcgacggacaagtgctggcttcacgcttcatggcctaccataaacctctgaaaaacagtcaggactataccgaggcactcagagcagctcgggagctcgccgctaacatcaccgccgatctgcggaaggtgcctgggactgatccagccttcgaagtatttccatatacaatcacaaatgtcttctatgaacaatatctgactatcttgccagaaggactgtttatgcttagcttgtgcctggtgccaacctttgccgttagctgcctactgctcggactggaccttcgttccgggctgttaaacctgctcagcattgtgatgatcctcgtcgatacggtggggttcatggccttgtggggcatctcctacaacgctgtcagccttattaatttggtcagtgctgtcggtatgtctgtggagttcgtttcccacatcaccagaagcttcgccattagcaccaagccaacctggctggaaagagcgaaggaagctactatcagcatgggctctgccgtgtttgccggagtcgcgatgacgaatttgcctggaatcctggtcctggggttggcaaaggcacagctgattcagatcttctttttcaggcttaatctcttaatcaccctgctcgggctgctgcatgggttagtttttctcccagtgatcctttcctacgtggggcctgacgtcaatcctgccctcgccttagagcaaaagcgcgcggaggaggctgtggcagcagtgatggtcgcctcctgcccaaaccaccctagtagagtttccaccgctgacaacatctatgtgaatcactcattcgaggggtccattaagggcgcaggggctatctcgaattttctgcccaataatggacgccaattctag

SEQ ID NO: 126746 - DNA, 3861 bp, Artificial Sequence
  Description of Artificial Sequence: Synthetic coding sequence
atggcagaagccggcctgcggggatggctcttatgggccctcctgctgcgcttagctcagagtgagccctataccaccattcatcaaccggggtactgtgcattttatgacgagtgtggcaaaaaccccgagctgtcgggctccctgatgaccctgtccaacgtcagttgcttatcaaatacacccgcccgtaagattacaggagatcatttgattttgttgcagaagatatgcccaagactttacaccgggcccaacacccaggcatgctgctctgccaaacaattggtgagtctggaggcgagcctctcgattacaaaagccttgctgactcggtgtccggcctgctccgacaactttgttaatctgcactgccataacacatgtagtcccaaccaaagcctcttcatcaatgtcacccgcgttgctcaactgggagcagggcagcttcctgcagtggtggcctatgaagcattttaccagcactccttcgccgagcaaagctacgactcctgcagcagagtgagggtacctgctgcggctacactggccgttgggacgatgtgcggcgtatacggaagcgcactgtgtaacgctcagagatggctgaattttcaaggagataccggtaacggcttggcgcctcttgacattacattccacctgctcgagcctggccaggccgtaggttccggcattcagccactgaacgaaggcgtcgcccgatgcaatgagagtcagggggacgacgtggctacttgctcatgtcaggattgcgctgcatcttgccccgcaatagcaaggccccaggcactcgacagtacattttatctgggccagatgcccgggtcactggtgctgataatcatcctgtgctctgttttcgccgtggttaccatactcctggtcgggtttcgagtcgcaccagcccgggataaaagcaaaatggtggatccaaagaaagggacctccctgtctgacaaattatcattttccacccacacactgctcgggcagtttttccaaggatggggcacttgggtcgctagctggccactcactatcctagtcttaagcgtcattccagtggtcgctttggccgctgggctggtgtttacagaactcacgaccgaccccgttgagctctggtctgccccaaacagccaggcccgctcagagaaagcttttcacgatcaacatttcggcccttttttcaggaccaatcaagtgatcctcaccgcgcctaacaggtcttcttacaggtatgacagtctcctgctgggtcctaagaatttcagtggtattctcgacctggatctcttactcgagcttttggaactgcaggagagattaagacacctgcaggtgtggagtccagaagcccagcgcaatatttctcttcaggacatttgttacgcgccgttgaatccggataatacatccctgtatgattgttgtattaactccctgttgcagtattttcagaacaatcgaacactcctcctcctcaccgctaaccagaccctgatgggccaaacatcgcaggtggactggaaggaccacttcctgtactgtgcaaacgcaccactcacattcaaggacggcacagctttagcgcttagttgcatggcggactatggagcgccagtgttcccatttctggccataggagggtacaaggggaaagattactcagaggccgaggcccttattatgaccttttcacttaacaactatccggcaggtgacccccgtttagcgcaagcaaaactatgggaagaagcctttttagaggaaatgcgtgcattccagcgaaggatggctggaatgttccaggtcacttttatggcagagcgcagcctagaggacgagatcaaccgaaccactgccgaggaccttccgattttcgctacaagctacatcgtcatttttctctacatttccctggccttgggatcatacagctcctggagtcgggtcatggtggactctaaagctacccttggactgggcggcgttgctgtggtgctaggtgcagtcatggccgccatggggtttttctcttacctgggcatccgaagttcactagtgattttacaggttgttccctttctggttctttctgtgggtgccgacaacatctttatcttcgtccttgagtaccaacgtctcccccgacggcctggtgagcctcgagaggtccatatcggcagggctctgggccgggttgcaccatctatgctattgtgcagccttagcgaagccatctgcttttttctgggagcgctgactcctatgcccgccgtcagaacattcgccttgacctcaggacttgccgtgatcctagactttctattgcagatgtcagcttttgtggctctgctgtctcttgattcaaagcgccaggaagcttcacgattagatgtgtgctgctgcgttaagcctcaggagttgcccccgcccgggcagggcgagggtctgctgttgggattcttccagaaagcctatgccccgtttctcctgcattggattacaaggggagtggtggtgggggcgcctgtttactttgtgacaacgctggggtataacttcagcagtgaagccggcatgaacgccatctgttccagcgctggttgtaacaatttttcctttactcaaaagatccagtatgctacggagtttcctgagcagagctacctcgcaatcccagccagctcctgggtggacgatttcattgactggctcacacctagctcttgttgtagactgtatattagcggtcctaacaaggataagttctgccccagcactgttaatagtctgaactgtctgaagaactgcatgtcaattacaatggggagtgtgaggccctccgtagaacagttccacaaatacttgccatggttcctgaacgataggccaaatattaagtgtccaaagggtggactggctgcttacagcacaagtgtgaatctcacctccgacggacaggtgctggcaagccgcttcatggcgtaccataaacccctgaagaactcacaggattatacagaagccttaagagctgcgcgggaactggccgcaaacatcactgcagatttacgtaaggtgcctgggactgaccctgcctttgaagttttcccctatacgatcaccaacgtgttttacgagcagtatcttaccattctgccagagggcctttttatgctctctctctgcctggtaccaacattcgcggtttcatgcctcctgctcggtctagatctcagatctgggctgctgaacctgctgtctatcgtcatgattctggtggacacagttggcttcatggccctgtggggtattagctataacgccgtcagcctgattaacctcgtcagtgccgttgggatgtcagtggaatttgtgtcacacatcactcgaagcttcgcgatctctaccaagcctacctggctggaacgtgcgaaggaggccactatctcaatgggaagcgcggttttcgccggcgtagctatgaccaatctacccgggatcctggtgctcggactggctaaagcacaactaattcagatattcttttttagactcaatctcttgatcactctcctcggccttctgcatggcctggtgtttctgcctgtgattctgagttacgttggccccgatgttaacccagccctggccctggagcagaagagagccgaggaagcagtggccgccgtgatggtggcttcctgccctaaccaccctagcagagtcagcaccgccgataatatctacgtcaaccacagctttgagggtagcatcaagggagctggcgccatctctaactttctgccaaataatggacgccagttctag

SEQ ID NO: 126747 - DNA, 783 bp, Artificial Sequence
  Description of Artificial Sequence: Synthetic coding sequence
atgcctcagaatgaatacatcgagctgcaccgcaagcggtatggttatcggctcgattaccatgagaagaaacgcaaaaaggaaagccgcgaagcccatgaaagatccaagaaggccaagaaaatgatcggtcttaaggcgaaactgtatcataaacaacgacatgccgaaaagatccagatgaagaaaactatcaagatgcatgagaaacgaaatactaaacagaagaatgatgaaaaaacaccccagggcgccgtcccagcttatctcttggacagagaaggtcagagccgcgctaaggtgttatcgaatatgatcaaacagaaacgaaaagaaaaggccggcaaatgggaagtaccgctacccaaagtgcgggcacagggagaaaccgaagtcttaaaggtcattaggactgggaagaggaagaagaaggcctggaagagaatggtgaccaaggtgtgttttgtgggagacggattcacgcggaaaccccctaaatacgagcgcttcatccgccctatgggcctgagattcaagaaagcgcatgttacacacccagaacttaaggctaccttttgcctgccgattctcggtgttaagaagaatccatcctcacccctgtacacaacactcggtgtgattaccaagggaacagtgatcgaagtcaatgtgtctgagctcggcctggtaacccagggcggcaaggtcatctggggaaagtacgcacaggtaactaacaatccagaaaatgacggatgtattaatgcagtgctgctcgtgtag

SEQ ID NO: 126748 - DNA, 1509 bp, Artificial Sequence
  Description of Artificial Sequence: Synthetic coding sequence
atgagctgtccagtgccagcctgctgcgccctgctcttagttctcggcctgtgccgggccagaccaaggaacgctctgttgctgttggccgacgacgggggtttcgagtctggcgcttataacaattcagccatagcaaccccgcatctggacgctctggccagaaggagtctgctattcaggaacgcttttacctctgtctcctcatgcagcccctctcgggctagtctgcttacaggtctgccccaacaccaaaatgggatgtatggcttgcaccaggatgtgcaccattttaactcctttgataaggtgcggtcccttcctctgcttctgtcccaggctggcgtgagaacaggcatcattggaaagaagcacgtcggcccggaaacggtttaccccttcgactttgcgtacacagaggagaatggttcagtcctgcaggtaggccgtaacatcactcgcatcaaactcctggtaaggaagttcttgcaaacgcaggatgatcgccccttctttctgtacgtggccttccatgatccacacaggtgtggtcactctcaacctcagtacgggaccttttgcgaaaaatttgggaacggagagtccggtatgggtaggatcccagactggacgccacaggcatatgatccactggatgtcctcgtgccatatttcgtgccaaacacccccgccgcccgcgctgacttggcagctcagtataccaccgtagggcgcatggatcagggtgtggggctggtccttcaagagctcagagacgcaggagttctgaatgacactctggttatttttacttcagataacgggatccccttcccttccggccgcacaaacctgtattggccaggtacggctgagccgctgcttgtatcttcccctgaacatccaaagcggtggggacaggtctcggaggcttatgtatctcttctcgacttaacaccgacaattcttgattggtttagtattccgtatcctagttacgccatcttcggcagcaaaacaatacacctgactggtaggtccttgttaccagcattagaagccgagcccttatgggcgacagtattcgggtcgcagtcccatcacgaagtgaccatgtcttatccgatgcgtagcgtacagcatcgccactttcgtttagtgcataatttgaactttaaaatgccattccccattgatcaagacttttacgtctccccaacattccaagatctgcttaacaggacaacagcaggacaacccactggatggtacaaggatttgcggcattattattaccgagcgcggtgggagctttacgaccgctccagagacccacatgagacacaaaacctggccaccgacccgcggttcgctcagcttctggagatgctccgggaccagctcgccaagtggcagtgggagactcacgatccctgggtatgcgctcccgatggcgtactggaagaaaagctgtctccccagtgccagcctctgcacaatgaactgtag

SEQ ID NO: 126749 - DNA, 900 bp, Artificial Sequence
  Description of Artificial Sequence: Synthetic coding sequence
atgggccggattccggactggacaccacaggcgtacgatcccctcgatgtgcttgtgccatacttcgtgccaaacacgcccgctgctagggctgacctggcagctcagtataccaccgtcggtagaatggaccagggggtgggcctggtgttgcaagaacttagagatgccggtgtactgaacgacaccctggtaatattcacctcagacaatggaataccttttcctagcggccgcactaacttgtattggcctggtaccgccgaacccctgttggtttcttcaccggagcaccccaaacgctgggggcaggtgtctgaagcttatgtatctctgttggacctgacacctacaatcctagattggttctccatcccttacccttcatacgcaatctttgggagtaaaacgatccacctgactgggcggagcttgctgcctgctttggaagccgagcccttatgggcaactgtctttggaagtcagagccaccatgaggtgactatgagttaccccatgcgaagtgtacagcacagacattttcggctggtgcacaacctaaatttcaagatgcctttccctatcgatcaggacttctacgtgtcacctacttttcaggatctgcttaatcgcacaaccgccgggcaaccgaccggttggtataaggatctacgccattattattatagggctcgatgggagctttacgaccggagtagggatccgcacgagacccagaacctagcaaccgacccacggttcgctcagctgctggaaatgctgcgtgaccagcttgcaaaatggcagtgggaaacgcatgatccctgggtctgcgcccccgacggagttctcgaggagaaactgtcccctcagtgccagcccctgcacaacgaactgtag

SEQ ID NO: 126750 - DNA, 618 bp, Artificial Sequence
  Description of Artificial Sequence: Synthetic coding sequence
atgagctgcccggtgcccgcctgctgtgccttactgctcgtgctgggcctttgtagagcgagaccccggaacgcgctcctcttgctggcagacagagcgctttcggtgtctcacttgactcagagaatgacggaagcgctcagagtggcacgcaccacaacggccccaagtccaccccggacgtggacgccctggccagctgccgccagcagttttgccatgccctccccacgctccgcagcagctctacctgccgcaccagcttcctccctggcttgtccctccatccgaatgggatgcacagggtgtacccggacttgtaccacttccacccccagtacacggtgcggagcctgtaggtgttgttccgctaagctcgtttgcgctcaggccagctcggggcgatccacatggggccggaggccgtgcacaagacttacgcttcgcactaggcgcagaatggctcctagttcccggtggggcgggacctccctggagttgtcatgtagctctggcaattcctgtcggctgcgcatgaccggcctgagtagttcgactagcccctccactacaccgaccctgtgggctttgcccgctccggtgaggaacctgttatag

SEQ ID NO: 126751 - DNA, 1191 bp, Artificial Sequence
  Description of Artificial Sequence: Synthetic coding sequence
atggcgtgtgcggggcttctcaccgtttgcctgcttcgtccccccgccccccagcctcaaccccaaactccacggcacccacagcttgcgcccgaccccggccccgctggccacaccctttttcaggacgtgtttagaagagcggacaagaatgacgatggaaaactgtcgttcgaggagtttcaaaattatttcgctgacggtgtgttgagcttgggggagttgcaggagctcttctctggaatcgacggccatctcaccgacaacttggagaccgaaaagttatgtgactatttttccgagcacctgggggtttacagacctgtcctggccgcactcgagagtctcaatcgggctgtgcttgccgccatggatgcaactaaattggagtacgagcgagcatccaaagtcgatcaattcgtcactcggtttctactcagagagaccgtctcccagctgcaggccctccagagctctctggaaggggccagcgatactctggaagcccaggcccacggatggcggtcagatgcggaaagtgtggaggctcagagccggctgtgtggaagccgccgggcaggccggcgcgcccttcgcagtgtgagcagatcctccacttggagccctggatcgtccgataccggccggtcaagcgaggcggaaatgcagtggcgcctgcaggtcaatcgtttacaggagcttattgatcagctcgagtgtaaagttcgggccgtgggtccagggccccacaagggagggccctcttggtatccccccgaaccaggaccatgttggcgcccagggccacacagcgtgcccagtcaggccccaaggttggagcccctgcgtgaggaagatttggctaagggccccgacctgcacatcctgatggcacagaggcaggtgcaagtggcggaggaagggttacaagactttcaccgggcgctacggtgttatgtggatttcacaggcgctcagtctcactgtttgcacgtgtctgcccagaagatgcttgacggcgcatccttcaccctttacgaattttggcaagatgaggctagctggcgccgtcaccagcagtcccccggttctaaggcgtttcagagaattctgattgaccaccttcgcgctcctgataccctgaccactgtctttttccccgcctcctggtggattatgaataacaactag

SEQ ID NO: 126752 - DNA, 1089 bp, Artificial Sequence
  Description of Artificial Sequence: Synthetic coding sequence
atggcctgcgctggtcttctgaccgtgtgtctgctcaggccacccgcccctcaacctcagccgcaaacacctcgccatccccagctcgctcccgaccccggtcccgccggtcataccctgttccaggacgtcttccggcgagcggacaaaaacgatgatgggaagctctcattcgaggagtttcaaaactactttgctgacggcgtgctcagtttaggcgaattgcaagagctgttctccggcatcgatgggcacctaactgacaacctagagaccgaaaagctatgcgattacttctctgagcacctaggagtttataggcctgtgctggccgccttggagagcctcaatagagctgtgctggccgccatggatgcgaccaagctggagtacgaacgggcctccaaagtggatcaatttgttacgcggtttctcttacgggaaacggtgtcccaactgcaggccttgcaaagtagtctggagggggcctccgatacactcgaagcacaggctcatggatggaggtccgacgctgaatccgtggaggcccaatccagactgtgcggctctcgtagagccggccgtagagctctgcgctccgtgagtaggtcttctacctggtcacctggttcttccgacacgggtcgaagcagcgaggcagagatgcagtggcggttacaagtgaaccggctccaggagctaattgatcagttggagtgtaaggccccgcggctggaacccctgagagaagaagatttggctaagggacccgacttacacatcttgatggcgcagcgacaggtgcaggtggctgaggaaggacttcaggattttcacagggcactgaggtgctatgtggactttacaggcgcccagtctcattgtttgcacgtctcggcccaaaagatgctggacggtgccagtttcaccctttatgaattttggcaggacgaggcctcatggaggcggcaccagcaaagccctggcagtaaggcattccagagaatcctgatagaccatctccgcgcccccgatactctgacgaccgttttcttccccgccagctggtggatcatgaacaacaactag

SEQ ID NO: 126753 - DNA, 870 bp, Artificial Sequence
  Description of Artificial Sequence: Synthetic coding sequence
atggcttgtgctggtttgttgaccgtctgtctattgagaccacctgccccacagccacagccccagacacccagacacccacagctggctcccgatcccggccccgcaggacacaccctgttccaggacgtgttccgcagagcagataagaatgacgatggcaagcttagctttgaagaatttcagaactattttgctgacggagttcttagcttaggtgaactccaagagttatttagcggcatcgatgggcacctgactgataacttggagactgagaagctctgcgattacttctcggaacatttgggagtctatagacccgttctggcagctttagagtccctgaatagagctgtcttggctgccatggatgccacaaaactcgaatacgagagggctagtaaggtagaccagttcgtcacacgcttcctgttgcgagagacagtgagccagctgcaggctctgcagtctagtttggagggagcttcggatacactggaagcacaggcacacgggtggagatcagatgcggaatcagtagaggcacaatccagattatgcggcagccgcagagccggacgccgggctttgcggtctgtgtctaggtcttccacctggagtcctggctcatcggacacagggaggtcaagcgaggctgagatgcagtggcggctacaggtgaaccggctacaagaacttatagatcagctcgaatgcaagcatattctgatggcacagcggcaggttcaggtggccgaggagggcctgcaggactttcatagggcccttagatgttatgtggactttactggtgcccagtcccattgtctgcatgtcagcgcgcagaaaatgctggacggcgcgtag

SEQ ID NO: 126754 - DNA, 423 bp, Artificial Sequence
  Description of Artificial Sequence: Synthetic coding sequence
atggcctctgtcgattttaaaacctatgtggaccaggcctgccgcgcagccgaggaatttgtcaacgtttactacactacgatggacaagcggagaaggctcctatcgaggctttacatgggtactgccactcttgtatggaatggtaacgctgtgtccggccaagagtccctttcggagttcttcgagatgctgcctagctctgagttccagatcagcgtcgttgactgccagcccgtgcacgacgaagctactccttctcagactaccgtgcttgtggtgatctgcggaagcgtcaagtttgaggggaataagcagcgcgacttcaatcagaacttcatactgacagcccaggcctccccctctaatactgtctggaagatcgcctccgattgctttagattccaggactgggctagctag

SEQ ID NO: 126755 - DNA, 984 bp, Artificial Sequence
  Description of Artificial Sequence: Synthetic coding sequence
atggccgtacctgctaagaagcggaagatgaatttttccgagagagaggtcgagatcatcgtggaggagctcgaattaaaaaagcacctgctcgtgaaccatttcaacgctggtgtccccctagctgctaagtctgctgcctggcacggcattctccgtagagttaacgcagtggccacctgcagacgggagctgcctgaggtgaaaaagaagtggtccgatctcaaaaccgaagtccgccgtaaagttgctcaagtgcgagctgcggtggagggaggggaggccccgggccctacagaggaggatggggccggaggccccggaacgggagggggctcgggcggagggggacctgccgtggcgcccgtcctactcacccccatgcagcagcgcatctgcaatctgcttggcgaggctactatcatctccctaccatctacaaccgagatccatccggttgctctgggtccatcggccacggccgccgcagcgacggtgaccctaacacagatcccaacagagacgacctaccacacactcgaggagggggtcgtggagtactgtaccgctgaggcaccaccaccactcccacccgaaacacccgtggatatgatggcccagcacgccgacactagcgtcaagcctcaggctctcaaaagcagaatcgcactgaactctgcaaagctcatacaggagcaacgagtgacgaacctgcacgttaaagagattgcacaacacttggaacaacagaacgacctactgcagatgatccgaagaagtcaggaagttcaggcatgtgcgcaagagaggcaagcacaagcaatggaaggtacccaggctgccctaagcgtattgatccaagttctacgccccatgatcaaggacttcaggcggtatctccagagtaataccgcaaatcctgcccctgcctcggaccctggacaagtggcccagaatggacagcccgacagcattattcagtag

SEQ ID NO: 126756 - DNA, 1485 bp, Artificial Sequence
  Description of Artificial Sequence: Synthetic coding sequence
atggaggtggtggaagcggcagcggctcagctcgagactctgaagttcaacggtaccgacttcggggtgggcgagggaccagctgccccatctcccggctctgccccggtgccggggacacagccacctctccagtcttttgaagggtctccagatgcgggtcaaactgtcgaagtgaaacccgcaggggaacagcccctgcagcctgtgctcaacgcagtcgcagctggaacgcctgcaccacagccacagccacccgcagagagtccagcctgtggtgactgtgtgactagccccggtgctgctgagcctgctcgtgcacccgactctctggagactagtgactccgattccgactctgacagtgagaccgacagcgattcatcgagtagctccagcagtagctcctcaagcagcagtagcagttcgtcttcatgtatctcactgccacctgtgttgtctgacggtgatgacgatctccagattgaaaaggagaacaagaatttccctctgaaaaccaaggacgagctcctgctaaacgagttgccgtcagtggaggagctgacaattatcctccctgaagatatcgagttgaagcccctgggtatggtgtcttctatcatcgaacagctcgtgattatcgagtctatgaccaatctgccccccgttaatgaggagacagttatttttaagagcgaccgccaggctgccggaaaaatattcgagatttttggtcccgtagctcaccccttctacgttctcaggtttaatagttctgaccatatcgagagtaaaggtattaaaattaaagaaacaatgtactttgcacccagtatgaaggattttactcagtacatttttactgagaaactcaagcaggataagggcagtgacgccagctggaagaatgatcaggagcctcctccagaagccctagattttagcgatgacgagaaggaaaaagaagcaaaacaaaggaaaaaatctcagattcaggggagaaagaagctaaagtccgaattcaacgaaccaggggaagatttcacagaggtccatcagaactggaatgcccactcctcggcttccgaacatgctaaaggctacagaaaccgggagtttaccagaggctttagtagagctcgttacccccgaagctgccacggtagaccacctcctcagcacttctataactctgaacatatggtgagtcaggagacctcaggttttccttctcaaagacagaacaacccaatcatgcctcaatatccctttcccctcccggttttcgacatgcataacttcccgctgcggccccctccaccacctccacctcctcctgtgaacatgggctgggccacgccaaacatggcagcccacccactactgaatcttccgtattcgctgccaccccccccaccgcccccaccacttccccccccccctagctccggagatagtaactcccacttcgggccctactactag

SEQ ID NO: 126757 - DNA, 1170 bp, Artificial Sequence
  Description of Artificial Sequence: Synthetic coding sequence
atggaggttgtggaggcggcggccgcacagttggaaaccctaaaattcaacgggacagactttggagtgggggagggccccgccgcaccctcaccagggagtgcacccgtccccggaactcagcccccacttcagagtttcgagggctctcccgatgccggacagacggtagaggtaaaacctgccggcgaacagcctcttcagcctgtacttaatgctgtagctgcaggaactcccgctccacagccgcagccccctgccgagtcacccgcctgcggagattgtgtaacttcccctggtgccgccgaacctgcccgagcacctgacagcctggagacttccgatagtgactccgacagcgacagcgagactgattcagattcaagctcgagctcaagctcctcttcctcatcatctagcagctcttcttcctcatgtatcagcctgccacctgtgctgagcgatggggacgacgacttacagattgaaaaagagaataagaattttcccctgaagaccaaggatgagctcctgcttaatgaactgccctccgtggaagagttgacaattatccttcctgaagacatagaacttaaacccctggggatggtgtcatccatcattgaacagctcgtgatcatcgaaagtatgacaaatctaccccccgtaaacgaggaaaccgtgatattcaagtctgatcggcaggccgcagggaaaatttttgagatctttgggcctgtggctcaccccttctacgtgctcagattcaattcgtctgatcatatcgaatctaaagggattaaaatcaaagaaacaatgtacttcgcaccttccatgaaagacttcacacagtacatatttactgagaaactcaagcaggacaaggggtctgacgcgtcctggaagaatgaccaggagccccccccagaggcactggatttttctgacgacgagaaagagaaagaagccaagcagcgcaagaagtctcagattcagggcagaaagaagctgaagagcgaattcaatgagcccggcacaggcatctcccatcggtactgcggactaggcagcaggccattgcaatctagcgagagtcacaagctgtttggctttcagatgcacatcaaggttaccttcacttgctactttagtctactgtccatgcagtag

SEQ ID NO: 126758 - DNA, 345 bp, Artificial Sequence
  Description of Artificial Sequence: Synthetic coding sequence
ctggcatcacggcttgggccagtctccacagctaacatgtcccgtccagtccggaaccgcaaggttgtggactactctcagtttcaggagagtgatgatgctgattttgaatccgaggacagcgaggacaaagatgttaagactaagaaggatgactcacacagcgccgaggactccgaggatgagaaagaagatcataaaaacgtgcgacaacagagacaggccgcctctaaagcggcctctaagcagcgtgagatgctcatggaggatgtgggcagcgaggaggagcaagaggaagaggatgaggccccatttcaggaacgaaaggacagcttctcacagtag

SEQ ID NO: 126759 - DNA, 732 bp, Artificial Sequence
  Description of Artificial Sequence: Synthetic coding sequence
atgtccagaccagtgcgaaaccgtaaggtggttgactactcccagttccaggagtcggatgatgccgatgaggattacggaagggattctggccccccaacaaaaaagatcagaagttctccccgggaggcgaaaaataagaggcgcagtggcaagaactctcaagaggacagcgaagattctgaggacaaagacgtcaagactaagaaagacgacagtcactccgcagaggactctgaagatgagaaggaggaccataagaacgtgaggcagcagcgtcaggcagcgtcaaaagctgctagtaagcagagagagatgctaatggaggacgtgggttctgaggaggaacaggaagaggaggatgaagccccgtttcaggagaaggattctggatctgatgaggattttctgatggaggacgacgatgattcagactacgggagttctaagaagaagaataaaaagatggtgaaaaaatcaaagccagaaaggaaggagaaaaagatgcctaagcctagactgaaagccaccgtaacacccagccccgtcaagggcaagggcaaagttggaaggcccacagcatccaaagcctccaaagaaaagaccccttcgcccaaggaggaagatgaagaacccgagtcgcctcccgagaaaaagacctctacttcccctccacctgaaaaatccggcgacgaggggtcggaagacgaggctccctccggggaggactag

SEQ ID NO: 126760 - DNA, 1122 bp, Artificial Sequence
  Description of Artificial Sequence: Synthetic coding sequence
atgtcaccatgcccaccacagcagtccagaaaccgtgtgatccagctgagcaccagtgagcttggcgagatggagctgacctggcaggagatcatgtccattaccgaactgcagggacttaacgctccttcagaaccatcatttgaaccccaagcaccagctccatatctgggtcccccaccccccacaacctactgtccctgctccatccatcccgatagtggattccccctccctcctcctccatatgagttgcctgcctcaactagccacgttcctgatcccccctattcctacggaaacatggcaatccctgtatcgaagcccctaagtctctctggcctgctgtccgaaccattgcaggacccactggctctgctcgacataggcctcccagctggcccaccaaagcctcaggaagatcctgaaagcgatagtggcctgtcactcaattattcagacgcggagagcctcgaactggagggaaccgaagccgggcgcagacgcagcgagtatgttgaaatgtaccctgttgagtacccatattcactgatgcctaactcgctcgcccattccaactatacattgcctgctgcagaaactcccctggccctcgagccctctagcggacctgtcagggcaaaacccactgcgcgcggggaagctgggagccgcgatgagcgcagggctctggccatgaagattccattccctactgacaaaattgtcaatctgcccgtggacgattttaacgaacttctggctaggtacccactcacggaatcccagttggcgctggtgcgcgatatccgcagacgtggaaagaacaaagtggccgcacaaaattgtcgtaagcgcaagctggagacaatcgtgcagcttgagcgcgaactggagagacttaccaatgaaagagaacgtctgctgcgcgctcggggagaggccgataggaccctagaagtaatgcggcagcagctgactgaactgtatcgagacatttttcagcacctgcgcgacgagagcggaaactcttatagtcccgaagaatacgccctgcaacaagcagccgacggcactatcttccttgtccctagaggtacaaagatggaggccactgattag

SEQ ID NO: 126761 - DNA, 1122 bp, Artificial Sequence
  Description of Artificial Sequence: Synthetic coding sequence
atgagcccatgccccccacagcagtctcggaatagggtgatacagttgtcaacatcagagcttggcgagatggaactgacatggcaggaaatcatgtctatcaccgagctgcagggcctgaatgccccttcagaacctagcttcgagccacaggcccccgcgccttatctgggcccgcctccaccaactacatattgtccatgttccattcatcccgactccggattccctctgccgcctccgccgtacgaactaccggcctccacaagccatgtgcccgaccccccttatagctatggaaatatggctataccagtgagcaaacctctgtctttaagcggcctgctgtctgagccactgcaggatcccctggctctgctcgacatcgggctaccagccggcccacctaaacctcaggaggacccagaatcagactccggtctgagtctgaattacagtgacgcagagtctttggaactcgagggaactgaggctggccgcaggcggtcagagtatgttgagatgtatccagtagagtatccttacagcctcatgccaaacagcctggcccactccaattatactctgcctgcggccgagactcccctcgctttagaacccagctccggccccgtgcgggcaaaacctacagctcggggagaggctggcagccgagacgaaaggagagctcttgccatgaaaattccatttccgactgacaagatcgtgaacctccccgtagacgacttcaatgagctgctagctcgttacccgctgaccgagtctcagttggcccttgtccgtgatattcgccggcgcgggaaaaacaaagttgccgcacagaattgtaggaagcgcaagctggagactatcgtccagctcgagagagagctggaaagactgaccaatgaaagagaacgccttttgagagcgcggggggaggccgaccggacgctggaggtcatgagacagcagcttactgagctttatagggatatcttccaacacctgagagacgagagcggaaattcatattcccctgaagagtacgccttgcagcaggccgccgatgggacaatctttttggttccaagaggcacaaaaatggaagccacagactag

SEQ ID NO: 126762 - DNA, 1122 bp, Artificial Sequence
  Description of Artificial Sequence: Synthetic coding sequence
atgagcccatgtccaccgcagcagtcgcgaaatagagtgatacagctgagcacatcagaactcggtgagatggagctgacctggcaggagatcatgagtatcactgagctgcagggcctcaatgccccttccgaacctagctttgagcctcaggcacctgcaccttatctggggccccccccgcccaccacctactgtccatgttcgatccatcccgattctggatttccactgcctcctccaccatatgagctacccgccagtactagccatgtgccagatcctccttattcttacggtaacatggccatacccgttagtaagcctctgagcctttcagggcttttgtctgagccgctccaggatccgctggcacttttagatatcggactccctgctgggcctccaaaaccccaggaggacccggagagtgattctggcctgagtctaaattatagtgacgcagagagtttagagttggagggcacagaagcaggaagacggcggtcagagtacgtcgaaatgtatcccgttgagtacccatacagtcttatgcctaacagtcttgcacacagcaactacaccctccccgccgcagaaacaccacttgctctcgaaccaagctctggtcccgttagagctaagcctactgcgcggggggaggccggatcaagggatgaacgacgagctcttgcaatgaagattcctttcccgacggataagatagtgaacttgcccgttgacgatttcaacgaactgctcgcccggtaccctctaaccgagagtcagctggcactggtgagggacatcaggaggaggggcaaaaacaaggtggctgcacagaattgtcgcaagcgcaagctcgagacaatcgtgcaactggaacgtgagctggaacgcctgaccaatgaacgtgaaagactcttgcgcgctaggggggaggccgaccggacactcgaggtgatgcgccagcagctgactgagctgtaccgggacatcttccaacatctgagggatgagagtgggaacagctactctcccgaggagtatgcattacagcaagctgcggacggtacaatctttctggtgccaagggggactaagatggaagccaccgattag

SEQ ID NO: 126763 - DNA, 1122 bp, Artificial Sequence
  Description of Artificial Sequence: Synthetic coding sequence
atgagtccctgccctccgcagcagtcccgcaatcgtgtgatacagttgagcacaagtgagctgggggagatggaactcacttggcaggagattatgagcataaccgagctgcaggggcttaatgctccttccgagccttcatttgaacctcaggccccagctccttatctgggtcctccacctcccacaacatactgcccatgctccatccatccggactccggattcccactgccgcctcctccctacgagttgccagcgagtacaagtcacgttccagacccaccttactcatacggcaatatggcaattccagtatcaaagcccctaagcttgtccggcttattgagcgagcccttgcaggacccactggcactgctcgatatcggactgccagcaggcccgccgaagccacaggaagatcccgagtccgactcaggattatcactcaactattcagatgctgagagcctggagcttgaaggtaccgaagccggtagaaggcgtagcgaatatgtcgaaatgtatccagtagagtacccgtacagcttgatgccaaattccttagcgcatagcaactacactctgcccgctgcggagacccccctggccctggagcctagcagtggcccagtgcgagcaaagcccactgccaggggagaagcaggctctagggacgagcggcgtgccctggccatgaaaattccttttcctaccgacaagatagtcaacctgcccgtggatgactttaatgagctactggctaggtaccctctgacggagtcacagctcgccctagtgcgcgatattcgcagacgagggaagaacaaagttgctgcgcaaaactgccgcaagcggaagctggaaacaatcgtgcagcttgagcgcgaacttgaaaggctaactaatgagagggaacgtctgttacgcgctagaggtgaggctgataggaccctggaagtaatgcgccagcagcttaccgaactttatcgcgacatcttccagcacctgcgcgatgagagtgggaacagttacagccctgaagagtacgctctccagcaagcagcagacgggaccattttcctggtgccccgcgggaccaagatggaggccaccgactag

SEQ ID NO: 126764 - DNA, 1032 bp, Artificial Sequence
  Description of Artificial Sequence: Synthetic coding sequence
atgtcaccctgcccaccgcagcagtcacggaatagagtcatccagctttccacatctgagttgggcgagatggaactgacgtggcaagaaatcatgtcaatcaccgagctgcagggtctaaacgccccatccgagccttcttttgaaccacaagcccctgcaccgtacctgggtccccccccgcctacaacttactgcccatgttccattcatccggattccggcttccccctgcccccacccccgtacgaactgcccgccagcacatctcacgtacctgatcctccttactcctacggtaacatggctattccagtgtcgaagccgctcagtctgtctggcctcctaagcgagccacttcaggatcccctagctctcctagacatcgggctgcccgcaggcccccccaaacctcaggaggatcctgagtcggactccgggctgagcctgaactatagtgacgccgagtcactggaactggagggcactgaagctggaagacgtagaagtgagtacgtggagatgtaccccgtggagtatccatatagcttgatgccaaacagcttggctcatagcaactataccttacctgccgccgagacaccactcgcactggagccaagctctggacccgtgcgggcaaaacctacagcccggggagaggccgggtcacgtgacgagcgcagggccctggctatgaagatcccatttcctacggacaagattgtaaacctccccgttgatgactttaacgaactgctagcgcgatacccactcactgagagtcagcttgccctagttcgggatatcagaaggcgtggcaaaaacaaggttgctgctcagaactgtaggaagcgtaagctggaaacaatagtacagcttgagcgtgagctcgaacgcctgaccaatgagagggaaagactgctgcgcgctcggggggaagcagataggacacttgaggtaatgcgacagcagctgaccgaactgtatcgggacattttccaacacctgagggacgaatctggaaactag

SEQ ID NO: 126765 - DNA, 2229 bp, Artificial Sequence
  Description of Artificial Sequence: Synthetic coding sequence
atgttgagcctgaagaagtacctcacggagggcctcttacaatttaccattctgctgtccctcattggcgtgagggtggacgtcgacacctatctgacatcccagctgccccccctgcgcgaaataatattggggccatccagcgcctacacccagacacagttccataacttacgtaatacactggacggatacggcatccatcccaaaagtattgacttggacaactatttcacagcccgtcggctgctgagccaggtccgcgcattagacaggttccaggtgccaactacagaggtgaacgcctggttagtgcatagagacccagagggctccgtgtcaggatcacagccaaacagcggcctcgctcttgaatcatcttcaggactgcaggatgtgaccggcccagataatggcgttcgagagtctgagacggagcaggggtttggcgaagacctggaggatctcggcgctgtggccccccccgtatcaggcgatctgaccaaagaagacatagatctgatcgacatcctgtggagacaagacatcgatctcggcgctggaagggaagtgtttgattactcccaccgccagaaggagcaagacgtggagaaagagctgagggatgggggggaacaggacacatgggcaggcgaaggagcagaagcactggctcgaaaccttctggtggacggggagaccggcgaatcttttccagcccagtttcctgccgatatcagctccataacagaggctgttccctctgagtccgagcccccagccctccagaataatctactttcccccctgttgaccggcactgagtcaccgttcgacctcgaacaacagtggcaggacctgatgagcataatggagatgcaagcaatggaagtgaacacctctgcctccgagattctttacagcgcgccgccaggggatcctctttcgaccaactattctttggcccctaacactccaattaatcagaacgtgtccctacaccaggccagcctgggaggctgttcacaggacttccttcttttctcacctgaggttgaaagccttccagtcgcgtccagtagtactttgttgccattggctccctccaattcaaccagccttaattctacctttgggagcacaaacctgactggcctgttctttcctccacagctaaacggtaccgccaacgacaccgccggccctgagctccctgacccgctgggagggctattagacgaagcaatgctcgacgagatcagcttgatggatttggcgatcgaagagggctttaatcccgtgcaggcttcgcagctggaagaagagttcgacagcgactccggcctgagcctagattcatcccatagtccttccagcctttccagttctgaggggagctcttcctcaagcagttcctcctcatcctcatcatcttctgctagttcgtccgctagcagctcattcagcgaagagggcgccgtgggctacagctcagacagcgaaaccctggacctggaagaagccgaaggggcggtgggctatcagccggaatactcaaagttctgtcggatgtcataccaagaccccgcacagttgtcctgtctgccttatctcgagcacgttgggcacaaccacacctataacatggcaccctccgctctcgactcggcggatcttccccctccatcagctttgaagaaaggctctaaggagaaacaagccgacttcctcgataagcaaatgtcaagagatgaacatcgggcccgagccatgaagataccatttacgaacgacaagattattaacctcccagtggaggaattcaacgaattactgagtaaatatcagttatcagaggcacagctcagtttgataagggatattagacggcggggcaagaacaaaatggcagcccagaactgtagaaagcgtaaactcgacaccatcctcaacctggaacgggatgtggaggacctgcagagagacaaagcccggcttctccgggaaaaagtggagtttctcagaagtctgaggcaaatgaagcagaaggttcagagtctctaccaggaggtctttggacgtcttcgcgacgagaatggtcgtccttactctccttcacagtatgccttgcagtacgctggcgacggttcagtgttattgatccctcgcaccatggccgaccagcaggcccgacgccaggaacgcaagcctaaggatagaaggaaatag

SEQ ID NO: 126766 - DNA, 2319 bp, Artificial Sequence
  Description of Artificial Sequence: Synthetic coding sequence
atgctgagcctgaagaagtatctaaccgagggattactgcagttcactatcttactgagcttaataggtgtgagggtggatgtggatacttatctcaccagtcagctgcctcccctgcgggagattatcctcgggccatctagcgcctacacccagacccagtttcacaatctccgcaacactctggacggttatgggatacacccaaaatccattgatctggataactactttaccgcccggcgacttctcagccaagtaagggctttggacagattccaggtccctactaccgaagtaaacgcttggctcgtgcatagagatccggaagggagtgtttccggctctcagcccaatagtggactggctctggagtccagtagtggtttgcaagacgttacaggcccagataacggcgtccgggagtctgagacggagcagggttttggtgaggatctcgaggacctgggggctgtagctcctcccgtgtcaggagacctaactaaagaggatattgatctgatcgacatcctgtggaggcaggatattgacctcggcgcagggagagaggtgtttgactatagccataggcaaaaagagcaggatgtcgaaaaggagctcagagacggaggggagcaggatacttgggctggggagggcgcagaagccctcgcacgcaacctgctggtcgacggcgagaccggcgagagttttcctgcccaggtgcctagtggcgaggaccagacggcccttagcctagaggaatgcctccggctactggaagccacctgcccttttggtgaaaatgcagagttcccggccgacatctctagtatcacagaggcagttcccagcgaaagcgagccaccggccctgcagaacaaccttctgagtcctctgcttactggtaccgagtccccgtttgaccttgaacagcagtggcaggacctcatgagcataatggagatgcaggcaatggaggtgaacaccagcgcctctgaaattctctacagtgctcctccaggagacccattgtccaccaactatagcctcgctccaaacacacccataaatcagaatgtgtccttgcatcaagcctccctgggtgggtgcagccaggatttcctgttattcagccccgaagtagaatccttaccagtggccagttccagcacactgttgccactggccccatctaattcaacttcactgaattcaactttcggaagtaccaacctcaccgggttattctttcctccacagctgaacgggaccgcaaatgacactgcaggccccgaactgccagatcccctcggtgggctgcttgatgaggctatgttggatgagatatcactgatggacttggccattgaggaaggttttaatccagtgcaggcatcccaattggaagaggaattcgacagcgacagcggattatcactcgattcaagccactctccctctagtctgagcagtagtgagggctctagtagttcctcaagttccagttcctcctcatctagcagtgctagtagctctgcgtctagtagttttagcgaggagggggcagttggatacagcagcgactctgagacactggaccttgaagaagctgaaggagccgtgggataccaacccgagtattctaagttctgccgtatgagttaccaggaccccgcccagctatcctgtttaccttatctggagcacgttggtcacaaccacacttacaatatggcgccgtcagccctggattcagccgacttacctccaccttctgctctgaagaagggttcaaaggaaaagcaggccgacttcctggacaaacagatgagtagggatgaacaccgagccagagcgatgaagattccctttaccaatgataagataatcaacttgccggtggaagagttcaacgagctcctgtcaaagtaccagctctctgaggcccagttgtcattaattcgcgacattcggagacggggcaagaataagatggccgctcagaactgtcggaagagaaagctcgataccatcttaaacctggagagggatgtggaagatttgcagcgggacaaggctcggttactgcgggagaaagtggagtttctgcgcagcttgaggcaaatgaagcagaaggttcaatccctgtaccaggaggtgttcggaaggctcagagatgagaatggcagaccttattctcctagtcaatacgcgttacaatacgcgggggatgggtccgtgctcctgataccacgaaccatggcggaccagcaggccagacgccaggagcggaagcctaaagacagaagaaaatag

SEQ ID NO: 126767 - DNA, 2376 bp, Artificial Sequence
  Description of Artificial Sequence: Synthetic coding sequence
tttgtgttctggaaaattttaaagaccaagaagcacaagcatagcgggcctagcgctatgttaagtctaaaaaaatatctgactgaggggttgctgcagttcacgatactactatcattgattggcgtacgggtggatgtggatacatatcttacctcccagctgccaccattgcgagagatcattctcgggccctccagtgcctatacccagacccaattccacaatcttagaaacactcttgatgggtacgggattcatcctaaatctatcgatctggacaactactttacagcccggaggttgctcagtcaggtacgcgctttagaccgcttccaggtcccaaccacagaggtcaatgcctggttggtgcatagggatccggagggctcagtttcggggagccagcctaactcagggttagctcttgagagctccagcgggctgcaggatgttactgggcctgacaatggggtgcgcgaatcggagactgagcaaggctttggtgaggatctcgaggatctgggcgctgtggccccccccgtctccggagatctgactaaagaagacatagatctcattgacatcctatggagacaggatattgatctgggtgcaggcagagaggtgttcgactattcccatcggcagaaggagcaggacgtagagaaagaactgagagacggaggtgagcaggacacgtgggctggcgagggggccgaggccctcgccagaaacttgttagtcgacggcgagaccggggaaagcttccccgcgcaggtcccctccggggaagaccagactgcgttgtcgttggaggaatgcttgagactactcgaggcgacttgtccgttcggcgaaaatgctgagttccctgccgatatctcgtctatcactgaggccgtcccatctgaaagtgagccaccagcgcttcaaaataatcttctctcacctcttcttaccggaaccgagtcgccttttgatctcgaacagcagtggcaagatttgatgtccattatggaaatgcaggctatggaggttaacacctcagctagcgagattctgtacagcgcccctccaggcgatcccctttcgaccaactactcattggccccgaatacaccaataaaccagaacgtgagcctgcatcaggcttccttgggcggctgcagccaagacttcctgctgttctccccagaagttgagagcttgccagtggcctcatcttccaccctcttgcctctggcaccatccaacagtaccagtctcaactccacttttgggtccacaaatctgacgggccttttttttccaccacagctcaacggaaccgcaaacgacactgcaggtcccgaactgcccgatcccctgggagggctacttgacgaggctatgctggatgagatttccctgatggaccttgctatcgaggaggggttcaaccccgtgcaggcaagtcagctggaagaggagttcgacagtgatagtggactctcgctcgattctagccactctccgtcgtccctgtcctccagtgaaggcagctccagtagcagttcgagctcatcttcatccagtagcagcgccagcagctctgctagttcttcgttttctgaggaaggtgctgtaggctactcaagtgactctgaaacattggatttggaagaagccgagggcgctgtcgggtatcagcccgagtattccaaattttgtcggatgagttatcaggatcctgctcagttgtcctgtctgccatacctagagcacgtgggtcataatcacacttataacatggcaccctctgccctggattctgccgacctgccccccccctctgccttgaagaaaggcagtaaagagaagcaagcagacttcttagataaacaaatgtcccgcgacgaacaccgcgcgagagcaatgaagatcccattcactaacgacaaaatcattaatctgcctgtcgaggaattcaacgaacttttgtccaagtatcagctcagtgaggcccagttgtcgttgatccgtgatattagaaggagaggcaagaataaaatggcagcacagaactgtcggaaacggaaactcgataccattctgaacctcgagagagatgtggaggatcttcaaagagacaaggccaggctgctgcgtgagaaggtcgaattcctgcggagcctgcgccaaatgaagcaaaaggtgcaatccctgtatcaggaggtgtttgggagactgcgcgatgagaacggccgaccttactccccaagccagtatgccctgcagtacgcaggcgacggctcagtccttctaatcccgagaacgatggccgatcaacaggctcgacgacaggagagaaagcctaaggacaggaggaaatag

SEQ ID NO: 126768 - DNA, 1851 bp, Artificial Sequence
  Description of Artificial Sequence: Synthetic coding sequence
atgacccgactggatcgctccagtcattctggcggcggacatgcaaaagggagccggcctctgaactcacttctggccggacatcgcgtggcgcaaccggcaagtgcaccaggctccagggcctccgtccaggatatcgacctaatcgatatattgtggcgacaggacatcgacttgggtgccggccgagaggtgttcgattattcccaccgacagaaagagcaagatgtggaaaaggagctccgcgatggaggagagcaagacacctgggcaggagaaggtgccgaggcgctggcacgcaatctgcttgtggatggagaaacaggggagtcttttcctgctcaattcccagccgatatctcttccatcactgaggccgtacccagcgagagtgaaccaccagccctgcagaacaatctgctaagtcccctactaacaggaactgagagcccctttgacttagaacaacaatggcaggatctcatgtccatcatggagatgcaagcaatggaagtgaacacgagcgcaagtgaaatcctgtacagcgctccccccggcgatccactgtctactaattactctctggcccctaatacacctataaaccagaatgtcagcctgcatcaggccagcctcggaggttgtagccaggatttccttctgttttccccagaggtggaatctctgcctgttgctagctcctccactctgttgcccctcgctcctagcaactctacatccctgaactcaacgtttggcagcacaaatttgacaggactattctttccgccccagctcaacggcaccgccaatgacacagccggcccagagttaccagatccactgggcgggttacttgacgaggcaatgcttgatgaaatttcgttaatggatttagccattgaagaggggtttaatcccgtgcaggcctcccaattggaagaagagttcgattcagatagcggactgagcctggactcgtcccactcaccatcaagcctcagttcttctgaaggctctagttccagctcttccagcagtagttcttcaagctcatccgccagcagctccgcctccagctcctttagtgaggagggcgccgtgggatactcttctgatagcgaaacgctggatcttgaggaggccgagggggccgttgggtaccagcccgagtactctaagttctgccgcatgtcctaccaggaccccgcacagctcagctgcctgccttacctggaacatgtgggacataaccacacctacaacatggcaccaagcgctctggactccgctgatcttccccccccctccgccctcaagaagggaagcaaagaaaagcaggcagattttttagataaacagatgtctcgtgacgagcacagggccagggcgatgaaaatcccatttaccaatgataaaatcatcaacttaccggtggaagagtttaatgaactcctgtctaaataccaattgtccgaagcccagctgtcactgattcgcgacattcgccgcagggggaaaaacaagatggccgctcagaactgccgtaaacgtaagctggacaccatcctgaacctggaaagggacgtggaagaccttcagcgggacaaagcaaggcttcttcgcgagaaggtggaatttctccgaagcctgcgacaaatgaagcaaaaagtacaatcactctatcaggaggtgttcgggcgcctcagagatgaaaacggccggccatatagcccgtcccaatacgctctccaatacgccggcgacgggtctgttctacttattccacggactatggcagatcagcaagccagaagacaagaaaggaaacctaaagaccggcggaagtag

SEQ ID NO: 126769 - DNA, 1818 bp, Artificial Sequence
  Description of Artificial Sequence: Synthetic coding sequence
atgatggacctggaactgcccccgcccggcctgcccagtcaacaggacatggacctgatcgacatcctctggcggcaagacattgatctcggtgtttcccgggaggtctttgatttcagtcagcggaggaaggagtacgagctggaaaaacagaaaaagctcgagaaagagagacaggagcagctgcagaaggagcaggagaaagctttcttcgctcagctgcagcttgacgaagagaccggggagtttctgcctatccaacctgcccaacacatccagagcgagaccagcggctctgccaattattcccaggtcgctcacatcccaaaaagcgacgctctgtattttgacgactgcatgcaactgctcgcccagactttcccattcgttgacgacaatgaagttagttctgccacgtttcagtcactagtgccggacattcccgggcacatcgagtcacctgttttcatcgccaccaatcaggctcaaagtcctgagacaagcgtggctcaagtcgccccagtggatctagatggaatgcaacaggacatcgagcaggtctgggaagagctcttgtcaatccctgaactacaatgcctgaacatcgagaatgacaagttagtggagactaccatggtgccctcccccgaggccaagttaactgaagttgacaactaccacttctattcctcaatcccaagcatggagaaagaggtcgggaactgtagccctcacttcctgaatgcttttgaagacagcttttcctccattctgtctaccgaagatccaaaccagctcacagtgaattccctcaactcagatgctaccgttaatacggacttcggggatgaattctattctgcttttatcgctgagccaagtatttcaaactctatgccttcgcccgcaactctttcccactcgttgtctgaactgctcaacggaccaatagacgttagcgacttgagcttgtgtaaggcgttcaatcagaaccacccagaatccactgctgaattcaacgatagcgatagtggcatctctctgaacacctctccttccgtagcctctcccgaacactccgtcgagtcctcatcctacggagatacactactcggactttcagattctgaggtcgaggagcttgacagcgcaccgggctccgtgaagcaaaacggacccaagactcccgtgcactctagtggcgacatggtacagcctctgagtccaagtcagggccagtccactcacgtccatgatgctcagtgtgaaaatactcctgagaaagagctgcccgtgagcccaggccataggaaaacgccttttactaaggacaagcattcaagccggttggaagcccatctgactcgggatgagcttagagcaaaagctttgcatatcccatttcccgtggagaagattatcaatctgccagtggtggatttcaacgaaatgatgagcaaggagcagtttaatgaggcccagctggccctgattagagacatccgcaggcgtggtaaaaataaagtggctgcccagaattgcagaaagcggaagctggagaacatagtggagctcgaacaagatctggaccacctgaaggatgaaaaagagaagcttctgaaggagaaaggggaaaacgacaagtcccttcacttgctgaaaaaacaactgtcaaccttatatctggaagtattttcgatgcttagggatgaagacggcaaaccctatagcccatccgagtactccctccagcaaaccagggatgggaacgtgtttttagtgcccaagagcaaaaaacctgacgtcaagaaaaattag

SEQ ID NO: 126770 - DNA, 1770 bp, Artificial Sequence
  Description of Artificial Sequence: Synthetic coding sequence
atggatcttatagacattctgtggcgtcaggatatagacctgggggtcagtcgtgaggtttttgactttagtcagcgaaggaaggaatacgagctggagaagcagaagaagttagaaaaggagagacaggaacagttgcagaaagagcaggaaaaggccttttttgcccagttacagctggacgaggaaactggtgagtttctgcctatccagcccgctcagcacatccagtcggaaaccagcgggtccgccaactattcacaggtggcccatataccaaaatctgacgctctgtattttgatgactgcatgcagctgctggcacagacttttccgttcgtggatgataacgaggttagctctgctactttccagtctctggtgcctgatatacccggccacatcgagtcccccgtttttatcgcaaccaaccaagcccagagccccgagacctccgtggcccaagtcgccccagtggacttggacggtatgcaacaagatatcgaacaagtctgggaagaactcctgagcattcccgagctgcagtgtctgaatatcgagaatgacaaattagtagagaccacaatggtgccctctccagaggctaagctgacagaagtagacaattaccacttctattctagcattccaagtatggaaaaggaggtgggaaactgctcaccgcattttctgaatgcttttgaggactccttcagttccattctcagtactgaggacccgaatcaattaacagttaacagtttgaatagcgacgccacagttaatacagattttggcgacgagttctacagcgcattcatcgctgagccctccatatctaacagcatgccttctcccgctacgctgtcacacagtctcagcgaactgttgaacggaccaattgatgtgagcgacctttccctttgcaaagcgttcaaccagaatcaccccgagtctacagctgagtttaacgactcggacagtgggatatccctcaacacctccccttcggtagcgagccctgaacatagtgttgaaagctcttcgtatggcgacaccctcctaggtctctccgattcagaagtcgaggagctggatagtgctccgggctcggtgaagcagaacggaccaaaaacccctgtgcatagcagcggagacatggtgcaaccacttagccctagccaaggacagtccactcatgtgcacgatgcccagtgcgagaacacccccgagaaagagctgcccgtctctcccggtcatcggaaaacccctttcaccaaggacaagcatagttctcggctcgaagcgcatttaacccgggatgagctgcgtgccaaggccctgcacattcctttccccgtggagaaaataatcaatctcccggtggtggatttcaacgagatgatgagcaaagagcagttcaacgaggcccagttggcactgatacgagatatcaggagaagaggcaagaataaggtggccgcgcagaactgcaggaaacgaaagctggagaatattgtggagctggaacaagacctggatcacctgaaggacgagaaggagaaacttctgaaggagaagggcgaaaatgataaatctctgcacctgctaaaaaagcaactctctacgctgtatctggaagtgttctccatgctccgagatgaagacgggaagccctatagccccagtgagtactctctccagcagacgagagacggtaatgttttcctagtgcctaaatcaaaaaaacctgatgtaaaaaagaactag

SEQ ID NO: 126771 - DNA, 705 bp, Artificial Sequence
  Description of Artificial Sequence: Synthetic coding sequence
atggacctgatcgacatcctgtggcgccaggacatcgatttgggggtctcgagggaggtgttcgatttctcacagcgccgcaaagaatacgagcttgaaaagcaaaaaaaactcgagaaggagagacaggagcaacttcagaaagaacaagaaaaggcattttttgcgcagctacaacttgacgaggagaccggggagttcctaccgatccagccagctcagcatatccagagcgaaaccagcgggtccgccaattattctcaagtggcccatattccgaagagcgatgccttgtattttgacgattgtatgcaactgctggcccaaacattcccattcgtggacgataatgaggtgtctagcgccaccttccagagtttggttcctgacataccaggccacattgagagcccagtgtttatagccaccaaccaggcgcagtctccagaaacgtccgttgctcaggtggccccagttgacctggatggaatgcagcaggacatcgaacaggtgtgggaggaactgttatctatcccggaactgcaatgcctgaacatcgaaaatgacaagctagtggagaccaccatggtgccatccccggaggctaaactgactgaggtcgataattaccatttctattcttctataccttccatggagaaggaggtcggaaactgtagcccacactttctcaatgcattttag

SEQ ID NO: 126772 - DNA, 843 bp, Artificial Sequence
  Description of Artificial Sequence: Synthetic coding sequence
atggatctcatcgacatcctctggcgccaggatatcgaccttggcgtgtcgcgagaagtattcgacttcagccaacggaggaaagagtacgagttagagaaacaaaaaaaattggagaaagaacgccaagaacagttacagaaggaacaagagaaagccttctttgcccagctccagttggatgaggaaacaggagaatttctgcctattcagccggctcaacacatccagagtgaaacctctgggtccgctaattattcccaggtggcacacattcccaagagcgacgcgttgtatttcgacgactgtatgcagcttcttgcccagacatttcccttcgtcgacgacaacgaggtaagtagcgctacatttcaatctctggttccggatatcccaggccatattgaaagtcccgtgttcatcgcaacgaatcaggcacagtcgcctgagactagcgtggcccaggtggcccctgttgacctggatgggatgcagcaggatattgaacaagtctgggaagagcttctctctattcctgaactgcagtgtcttaacatcgagaacgacaagctggttgaaactacgatggtccccagtcctgaagccaaactcaccgaagtggataactatcacttctatagcagtattccgtcaatggaaaaagaggtcggcaactgcagccctcatttcctgaacgccttcgaagactctttttcatctatactgagtaccgaggatcccaaccagttaacagttaattcactgaatagtgatgcgactgtgaacacagactttggagacgagttttattccgcttttatcgccgagccttctatttcctag

SEQ ID NO: 126773 - DNA, 1749 bp, Artificial Sequence
  Description of Artificial Sequence: Synthetic coding sequence
atggatttgattgatatcctctggcgtcaagatattgacctaggcgtgtcaagggaggtgtttgactttagccaacggcggaaggaatatgagttagaaaaacaaaaaaaattagagaaagagcgccaggagcagctgcaaaaagagcaggaaaaagccttcttcgcccagttgcagctggatgaagagaccggggaattcttgcccattcagcctgcccaacacatccaatcggagaccagcggaagcgccaactattctcaggtggctcatatccccaagtcggatgctttgtacttcgacgattgcatgcaactactagcccagacatttccattcgtggatgacaatgagtcgctggtgcccgacataccggggcatatcgaatcccccgtcttcatcgccactaaccaggcccagagccctgagacctctgtggcacaagtggccccagtcgacctggacgggatgcagcaagacatcgagcaggtttgggaagaactactttctatccccgagcttcagtgtctgaatatcgaaaacgacaagctggtcgaaactactatggttccctcacctgaggcgaaactgaccgaggtagacaactaccacttttactcctccatcccttctatggaaaaagaggtcggcaactgttcccctcatttcctcaacgcttttgaggattccttctcaagcattttgtctacagaggatccaaaccagctgaccgttaatagcctgaatagtgacgcgaccgtgaacacggatttcggcgacgaattttactcagcgttcatagccgaaccatccatatccaattccatgccgtcccctgcgactttgagtcactcactttcagagctgcttaatgggcccattgacgttagtgatctgtcgctgtgcaaagctttcaatcaaaaccatcctgaaagcacagcagaattcaacgattctgatagcggcatctcactgaatacaagcccgtcagtggccagccccgagcactctgtggagtcctcaagctacggggataccttgttaggtctgtcggactctgaagtggaagaactggattccgcacctggtagcgtcaagcaaaatggacccaaaacccctgtgcactctagcggcgatatggtacagccattgagcccttcccaaggccagtccacacacgttcacgacgcacagtgtgagaatacacccgaaaaagaactgccagttagccctggtcacagaaaaactccctttaccaaggataagcactcaagcaggttagaggcgcacctgacgagggacgaactgcgagccaaggcactccacatcccattccctgtggagaagattataaaccttcccgtggtagactttaacgagatgatgtctaaagagcagttcaacgaggcccaactcgccttaattagagacattcgacggagagggaagaataaagttgccgcccagaattgtcggaagcgaaaactcgaaaacatcgttgaacttgaacaggaccttgaccatctcaaggatgagaaggagaaactactgaaagagaagggagagaatgacaagtccctgcacctgcttaagaagcagttgtccaccctgtacctcgaagtgttcagcatgctgcgcgacgaagacggaaaaccttactccccttcagagtacagcctgcagcagacccgcgacggcaatgttttcctggtcccaaaatccaagaagcccgatgtgaaaaagaattag

SEQ ID NO: 126774 - DNA, 2085 bp, Artificial Sequence
  Description of Artificial Sequence: Synthetic coding sequence
atgaagcacctcaaacgatggtggtccgcaggtggtggactgcttcatttgacgcttctgttgtctctggccgggctgcgggtggatttagacctgtatttgcttttaccgcctcctaccttgctgcaggacgaactgcttttcctcggagggcccgcctcctcggcctacgccttgtcaccctttagtgcgtccggaggctggggtcgggccggacacctgcaccccaagggacgggagctggaccctgcggctcccccggaaggccaattgctcagggaagtgagggctctaggggtgccctttgtgccccggacaagcgttgatgcttggcttgttcattccgtcgcggctggctctgccgatgaagctcacggcctgttaggagccgccgctgcgtcgagtaccggcggcgcgggcgcgtcggtcgatgggggctcccaggctgttcagggaggcggaggcgacccaagagccgccaggtctggtccattagatgctggcgaggaggagaaagctcctgctgaacctaccgctcaagtgccagacgccgggggatgcgcctccgaagagaacggcgtgctccgcgagaagcatgaggccgtagaccactcctcgcagcacgaagaaaacgaggaaagggtaagcgctcagaaggagaatagcttgcaacagaatgacgacgatgagaataagatcgccgagaaacctgattgggaggcagagaaaaccaccgagagccgcaacgaaaggcacctgaatggtaccgatacgtcctttagccttgaggatctttttcagttgctttcttcccaaccagagaatagccttgaggggattagtttgggtgacatccctttgcctgggagcatctctgatgggatgaattcttctgcgcactaccacgtgaacttcagccaggctatatcacaagacgttaacctccatgaggcaattctgttgtgccctaacaatacatttagacgggaccccaccgcacgcacctcccagtcacaggaacctttcctgcagctcaactcccacaccactaaccccgagcaaactctacctggaacaaatctcacaggatttctgtctcctgtcgataatcacatgagaaatctgacaagccaagatcttctgtatgacctggacatcaacatcttcgatgagattaatctaatgtctttggccacagaagacaacttcgaccctatcgatgttagtcagctttttgatgagcccgatagcgactcgggtctctctcttgactcatcacacaacaacacatccgttatcaaaagcaactcctcacactcagtgtgcgacgaaggcgccatcggctattgtactgaccacgaatcgagttcccatcacgaccttgagggcgccgtgggaggttattaccctgagccatctaaactatgtcacctggatcagtcggatagtgatttccacggcgacctgacattccagcacgtattccacaatcacacgtaccaccttcagccgacagcgcctgaatctacatctgagccgttcccttggcccgggaaatcccagaagattcggtccaggtacttagaggacaccgataggaacttgtcacgcgacgagcagcgcgctaaggcactgcatatcccattctcggttgatgagattgtgggaatgcccgtggacagcttcaattccatgctaagtcgctattacctgacagatctgcaagtgagcctcatcagggacattcggcgccggggaaagaataaagtggccgcccagaattgccggaagagaaagctcgacattatactgaacctcgaagacgacgtatgcaatctgcaggcaaaaaaagaaacccttaagcgggagcaagcacagtgcaacaaagctattaacatcatgaagcagaagctgcacgatctgtatcacgatatctttagtagactgcgcgacgatcagggacggcccgtcaatccgaaccactacgccctgcaatgtacacatgatgggtcaatccttatcgttccaaaggaactggtggcaagcggacacaagaaggaaacccaaaagggtaagcgaaaatag

SEQ ID NO: 126775 - DNA, 1200 bp, Artificial Sequence
  Description of Artificial Sequence: Synthetic coding sequence
atgaattcctctgctcattatcatgtcaatttcagtcaagctatttcccaggatgtgaatctgcatgaggctattctgttgtgtcctaataacacattcagacgcgaccccaccgccaggactagccaatcccaggaaccatttctgcagctgaatagccacactacgaaccccgaacaaaccctccctggaacaaacctgacaggctttctctcaccggtggataatcatatgagaaacctgacaagccaggacctgctgtacgacttagatatcaatatctttgacgaaataaatctaatgtccctggccactgaagacaactttgaccccatagatgtaagccagttgttcgacgagcctgactccgatagcggtcttagcctggactctagtcacaacaatacctcggtcattaagtccaattcctcacactccgtttgtgacgaaggtgcgatcggttactgcacagaccatgagtcttcttctcaccacgacctggagggggccgtgggagggtactacccagagccgtctaaattatgtcatctggatcagtctgacagcgattttcatggagacttgacctttcaacacgttttccacaaccacacatatcacctgcagccaaccgcgccggagagcacgtcaaacctgtttcgcccagggaagagccagaaaatcagatcgaggtatcttgaagataccgatcggaatctcagccgagacgaacagagagccaaagctctgcatatacctttttctgtggacgaaatcgttggaatgccagtggactccttcaatagcatgctgtccaggtactacttgaccgacctccaggtgtccctgataagggacatccgccggagaggcaaaaacaaagttgccgcacagaattgtcgtaagaggaagctggatatcattctcaatctcgaggatgacgtgtgcaatctgcaggcaaaaaaggagaccctgaaaagagagcaggcccagtgcaataaggctattaacattatgaagcagaaattgcacgacctgtatcatgatatattctcccgcctgagggatgaccaggggcgtcccgtcaacccgaaccactatgccctgcagtgtactcacgacggctcgattctgatcgtgccaaaagagctggtggcaagcggccacaagaaggagactcagaaggggaagcgcaagtag

SEQ ID NO: 126776 - DNA, 1143 bp, Artificial Sequence
  Description of Artificial Sequence: Synthetic coding sequence
atgtatagtcccttatgcctgacccaagatgagttccacccattcattgaggccttgcttcctcacgtgcgcgctttcgcctatacctggttcaatttgcaggccagaaaaaggaagtacttcaaaaagcacgagaaaaggatgtctaaagaagaggagagagctgtcaaagacgagctgctctctgaaaagccggaagttaagcagaagtgggccagcagactgcttgccaaactgaggaaggacattaggccggaataccgagaggacttcgtgctcacggtcactggtaagaaacccccatgctgtgtcctttccaatcccgaccaaaaaggcaagatgcgcagaatagactgcctgcggcaggcagataaggtatggagactcgatctggtcatggtaattctgtttaaaggaattccactggagagcaccgatggagaaagattggtgaaaagtccacagtgttccaatcctggtttgtgcgtccaaccccaccatattggcgtgtcagtcaaagagctggatttatacctggcctacttcgtgcatgctgccggaatgccttcacctacaaccctgaagaagtccgaaaagtccggctttagttcaccatcgcctagtcagacaagcagtctaggcaccgccttcacacagcaccacagacccgttatcacaggaccccgagctagcccccatgctaccccgagcaccctgcacttcccgaccagccctattattcagcagcccggcccttatttcagccaccctgctatcaggtaccacccccaagaaaccctcaaagagtttgtgcaattagtctgtcccgacgccgggcagcaggccgggcaggtcggttttttaaaccctaacggcagctcccaggggaaagtccataatccattcttgccaactccaatgctgcccccccctccaccaccacctatggcacgccccgtcccacttcctgtcccagatactaagcctcctaccacctctacagagggtggagcggcaagcccaacctcccccacctattcaacaccaagcacatctcctgcaaatcggttcgtcagcgtgggaccaagagacccctccttcgtcaatattccgcagcagacccagtcatggtacttggggtag

SEQ ID NO: 126777 - DNA, 1464 bp, Artificial Sequence
  Description of Artificial Sequence: Synthetic coding sequence
atgtactcccctctctgcctgacgcaagatgagttccacccatttatcgaagcactgctcccccacgtcagagcttttgcctatacatggttcaatttacaagctcggaaaagaaaatatttcaaaaagcatgaaaagaggatgtccaaggaagaggaaagagccgtcaaagatgagcttctgtccgaaaaacccgaggtcaaacaaaagtgggccagcaggttgctggccaagttaaggaaagacattagacctgaataccgtgaggacttcgttctcacggtgacaggaaaaaagcccccttgttgtgttctgtcaaatcctgatcagaaagggaaaatgcggcgaatcgactgccttaggcaggccgacaaagtgtggaggctggatttagtaatggtcattctttttaaaggaatcccactcgagtccaccgacggcgagagacttgtgaaatctccccagtgtagtaatccgggactttgtgtgcaaccacaccacataggcgtgagcgtaaaggaattggatttatacctcgcctactttgtccacgcggccggtcacctaggatttcaggactccttcgtaaccagtggagtgttttccgtcaccgaactggtgagagtgagccagactcctattgccgcgggcaccggcccaaacttcagcctgagtgaccttgagagtagctcatactacagcatgagccctggagctatgcgacggagcttgccaagcacatcatctacctcatcaacgaagaggctgaagtccgtagaagacgagatggacagtcccggcgaagaacccttctacaccggtcaagggcgatcaccaggcagcgggagccagagcagcggctggcatgaagttgagcctggaatgccatctccaaccactctaaagaagtctgaaaagtcaggttttagctctccctccccttcacagacttcaagcctgggaaccgcctttacccaacaccacagacccgtgattacaggaccccgggctagccctcacgccactcccagcacacttcactttcccacctcaccaataattcaacaaccaggaccgtatttttcacatccagcaatccgttaccacccccaggaaaccctgaaggaattcgtgcaactggtatgtccagatgccgggcagcaggccgggcaagtggggtttcttaaccccaatggcagtagccaggggaaggtacataatccgttcttgcctacccccatgctgcccccccccccacccccacccatggcgcggcccgtaccattaccggtgcctgacactaaaccacccacgaccagcaccgaaggaggagccgccagcccaacatccccaacctattccactccctcaacctcgcccgctaataggtttgtgtctgtgggtccccgggacccctcctttgtcaacatcccacagcagactcaaagctggtaccttggatag

SEQ ID NO: 126778 - DNA, 1401 bp, Artificial Sequence
  Description of Artificial Sequence: Synthetic coding sequence
atgtacagcccgctctgtttaacccaggatgagttccatccgttcattgaagccctattgccacacgtccgcgccttcgcttacacatggtttaatctacaagccaggaaaagaaagtatttcaagaagcatgaaaaaaggatgtcgaaggaggaggagcgcgccgtgaaggatgagctcttaagtgaaaagcctgaggttaagcagaaatgggcatcccgattgctggcaaagctccggaaggacattagaccagagtatagggaagatttcgttctgacagtgaccggcaaaaaaccaccctgttgcgtgctgtccaatcccgatcagaagggaaagatgaggcgaatcgactgtttacggcaggctgacaaagtatggcgcctagacctggtcatggtgatcctgttcaaaggaatcccactggagtcaacagatggggaaagattggtgaaatccccgcagtgttccaatcccggcctgtgtgtgcaaccacatcatattggggtctctgtgaaagagctcgacctctatttggcatacttcgtccacgctgccgatagctcacagagcgaaagtccttcccagccgtccgacgcagatattaaagaccagcctgagaacgggcacctggggttccaggatagcttcgtcaccagcggtgtgtttagtgtaactgaattggtgagagtgtctcagactcctatcgccgctggaacaggccccaacttttcccttagtgatttggaatcttccagctactactccatgtctcctggggccatgcgcaggtcactgccttccacgtcgtctacgtcttccacaaaacggctcaagagcgtcgaagatgagatggacagcccaggtgaggaacctttctatactgggcagggtcgaagtcccggttcgggttctcagagctctggctggcacgaggtggagcccgctagccctcacgcaaccccaagcactctccattttcctacctcccctattatccagcagccaggtccatacttctcacacccggcaattcgctaccaccctcaggaaaccctcaaagaatttgttcaacttgtttgcccagacgcaggacagcaggcgggacaggtaggattcctgaatccaaatggttccagtcaaggaaaagttcataatcccttcctccctaccccaatgctcccgccaccacccccccctcctatggcgcgccccgttcccctgcccgtcccggacacaaaaccccctactacctctacggagggcggcgccgccagcccaacaagccctacttactccacacccagcaccagcccagccaacagatttgtctcggtgggcccaagagacccaagctttgttaacatccctcagcagactcagagctggtatctcggttag

SEQ ID NO: 126779 - DNA, 1665 bp, Artificial Sequence
  Description of Artificial Sequence: Synthetic coding sequence
atgcagatgtgtagacctgcatccagtagtgtgttatacgtgcccacacgatggcccggtgggtgtggggcgacttggcaaagctgtccctcccccccaccccgcagaacccgcataccgcaacgtccagccgtcatgtatagcccactgtgcttaacgcaggacgagtttcatccattcattgaggctctgctgcctcacgttagagcttttgcttacacatggttcaacctccaggccagaaagcggaagtatttcaagaaacatgaaaagaggatgtccaaagaagaggagagagctgtgaaggatgagctgttgagcgagaaacctgaggtgaaacagaagtgggcatcaagattactcgcaaaactcagaaaggacatcaggcccgagtacagagaggactttgtcttgacggtgactggcaaaaagcccccttgttgtgttctctctaaccctgatcagaaagggaaaatgcgccgcatcgactgtcttcgccaggccgataaagtgtggaggctcgatctggtcatggtgatcctcttcaaggggatccccctggagagtacggatggggagcgtttagtgaaaagccctcagtgcagcaatcctggcctgtgtgtccaaccccaccacatcggtgtctctgtgaaggagctggacttgtacctggcctactttgtgcacgccgccgatagctcccagagtgagtctcctagccagcctagtgatgcagacattaaggaccagccggaaaacggccatctgggcttccaggattccttcgtcacctccggcgtgttctcagtaactgagcttgtgcgcgtgtctcagacgccaatagctgctggtacaggtccaaactttagcctctccgacctggagtcctcctcatactactccatgagtcccggcgcaatgcgccgcagcctcccctctacctcgagtacttcctccactaaacgcttgaaatctgtggaggatgaaatggacagccccggagaagagcccttctataccggccagggaaggtctcccggatccggtagccaaagttccggatggcatgaagtggagcccggaatgccatcaccaaccacgctgaagaaaagcgagaagtcaggcttctctagccctagccctagccagacttcaagtctggggacagcattcactcaacaccataggccagtcataaccggtccacgcgcgtcccctcatgctactccctccaccttacattttccaaccagccctattatccagcagcccggtccctatttctcgcatccggctatcagataccacccacaggaaaccctgaaggagtttgtccagttagtttgccccgatgctggacagcaggcaggtcaagtagggtttcttaacccaaatggatcttcacaaggtaaggttcacaaccctttcttgccaactccgatgctgccacccccccctccgccacctatggcccgtccagttccccttccagtgccagatacaaaaccacccacaaccagtacagaaggtggcgccgcgagtccaacctcccctacatatagtacacccagcacctctccagccaataggttcgtgtccgtggggcctagggacccatcattcgtcaacatccctcaacagacacagtcatggtatctcggctag

SEQ ID NO: 126780 - DNA, 1599 bp, Artificial Sequence
  Description of Artificial Sequence: Synthetic coding sequence
atgaaactggccgactccgtcatggccgggaaggcgagtgacggctccatcaagtggcagctctgctacgatatatccgccaggacttggtggatggacgaattccacccttttatcgaggccctcttgcctcacgtgagggcgtttgcttatacgtggtttaacctccaggctcggaagcggaaatactttaaaaaacacgagaaaaggatgagcaaggaagaagagagggccgtgaaggacgaactcctatccgagaaacctgaagtcaagcagaaatgggcctcacgcctgttggcaaagctgagaaaagatatccggcccgaatatagggaggatttcgtcctgacagtcacgggcaaaaaaccaccttgctgcgtgctaagtaaccccgatcagaaaggcaagatgcggaggatcgactgcctgcgccaggctgataaggtgtggagattagatcttgtgatggtgattcttttcaaaggcattcctcttgagtcaacagacggcgagcgcctagtgaagtctcctcagtgcagcaaccctgggctttgcgttcagccacaccacattggcgtttccgtgaaggagctggacctgtatctagcgtactttgtgcacgcagcggatagctctcagagcgaatcaccgtcccagccatccgacgctgacatcaaagaccagccggagaatgggcacttgggctttcaagatagctttgttacttcgggagtgttctcagtgacagaactggttcgcgtatctcaaacacccatcgctgctggcacaggcccaaatttctccctcagtgacctggagtcatcctcttattactcgatgagtcctggagccatgcgcagatctctgccctcaacctcttcgactagttccacaaaacgcctcaagtcagtggaagatgagatggatagccccggcgaggagcccttttacacaggccagggcaggagtccaggatctggaagccagtcttctggttggcatgaggtcgagcccggtatgccgtcccccactactctgaagaagagtgaaaaatccggcttctcttctcctagccccagccaaaccagcagtttgggcacggcttttacacagcaccatagacctgtaattacaggtcccagggcgtcccctcacgcgactccatctactctgcactttcccacttcgcccatcatccaacagcccggcccgtattttagtcaccctgctatacggtaccaccctcaggaaacactaaaggaattcgtgcagctcgtgtgtccagatgccggccagcaggccggtcaagtcgggttcctcaacccaaatgggtcgtctcagggcaaggtccacaacccgttcctcccaacccctatgttgcctccgcctccacctccacccatggcgcgtcccgtgccactgcccgtgcctgataccaagccacctactacatccactgaggggggggcagcatcccctacaagcccaacttattccaccccgagtacaagtccagccaatcggttcgtgagcgttggcccacgtgacccttccttcgttaatatcccacaacaaactcaatcttggtatttgggatag

SEQ ID NO: 126781 - DNA, 1530 bp, Artificial Sequence
  Description of Artificial Sequence: Synthetic coding sequence
atgtactccccactgtgcctgacccaggacgaattccatcctttcatagaagctttgttgccgcatgtgagggccttcgcctacacctggtttaacctgcaggcacggaaaagaaagtatttcaagaagcacgagaagagaatgagcaaggaagaagaaagggctgtgaaggatgagctgctgtccgaaaaacctgaagtgaagcaaaaatgggcatcccggctgttggctaagttgcgcaaagatatcagaccagaatatcgagaagacttcgtgctcaccgtcaccggcaagaagccgccctgttgtgtgctgagtaaccccgaccagaagggcaagatgcgacgcattgattgcctgcgacaagctgacaaggtttggagactggatctcgtcatggtgatactgtttaaaggaatccctctcgagtcgactgacggggagagactcgtgaagagtcctcagtgttctaatccgggactgtgtgtccaacctcaccacattggcgtttcggtgaaagaattggatctctacctcgcctactttgtgcacgccgccgatagtagccaaagtgagtccccgagccaaccaagcgacgccgatataaaggaccaacctgagaatgggcaccttggctttcaagattcttttgtaactagtggcgtcttctcagttacagagctggtccgagtcagtcaaacacccatcgccgctgggaccggccctaatttttctttgagtgacctagagagttcatcgtactattccatgagccccggcgctatgagacgtagcctaccttcgacctccagcacctctagcaccaagcgtctaaaaagcgtggaggacgagatggactcaccgggcgaggaaccattttacaccgggcagggccgctccccaggcagcgggagccaatcaagcggatggcacgaggtggaaccaggcatgccgtctcccacgacccttaagaaatccgagaagagtggcttctcatctccttccccctctcagacctcctccctgggaaccgccttcacacagcaccatcgacctgttatcaccgggccgcgcgcctcccctcatgcaaccccatctacactacattttcccacctcacccattatccagcagccggggccgtacttttcccatcctgctatcagataccacccccaagagacacttaaagagttcgttcagctggtttgccctgacgccggccagcaagcgggtcaagtgggattcctcaacccaaacggctctagccaagggaaggtccataatccattcctgccaaccccaatgctgccacccccccccccgcccccgatggctaggccagtacctctcccggtccccgatacaaagcctccaactacctctacagagggaggcgccgcttccccaacttctcctacctattcaaccccttcaacgagcccagccaaccgcttcgttagtgtgggccccagggacccctcttttgtaaacatccctcagcagacacagtcatggtaccttggttag

SEQ ID NO: 126782 - DNA, 1506 bp, Artificial Sequence
  Description of Artificial Sequence: Synthetic coding sequence
atggatgagtttcatccttttatcgaagccctgctacctcatgtgagagcctttgcctacacgtggttcaatcttcaagccagaaagcgcaaatactttaaaaagcatgagaagcgaatgtcgaaggaggaggagagggcggttaaagacgaactgctttcagaaaaacccgaggtgaaacaaaaatgggcctcaagactgctggcgaagctaagaaaagacattcgcccagaatatagagaagatttcgtgctgacagtaacaggtaagaaaccaccttgctgtgtgttatcaaaccccgatcagaaaggaaagatgcggcgtattgactgtcttcgccaggctgacaaggtctggcggctagatcttgtgatggttatcctgttcaaagggattccactggagtcgaccgatggcgagcgactggtgaagagcccgcaatgctctaaccctggcctgtgcgtccaaccccatcatatcggcgtttctgtgaaggagctcgatctgtacctggcctacttcgtgcatgccgcagattctagccagagtgagagtcctagtcaacctagcgatgcagatattaaggaccagccagagaatggacatctcgggttccaggactccttcgttacctcaggggttttcagtgtaacagagctggtgcgcgtctcacagacacccatcgcagcaggcactggcccgaacttctcgctgtcggacctcgaatccagctcatactatagcatgtctccaggggcgatgcgaagatccctgcctagcacctcctcaacgtccagcaccaaaaggctcaaatcagtggaggacgagatggatagtccgggagaagagcccttctatacaggccagggaaggtccccgggaagcggcagtcaaagcagcggctggcatgaagtcgagcccgggatgccaagtcccactacactaaagaagtccgagaagagtggcttcagctcgcctagcccatcccagacgagcagcctggggactgcctttacgcaacatcaccggcccgttattaccgggcccagagcctccccacacgccaccccctcaacgctgcatttccccaccagcccgataattcaacagcctggaccatacttttctcacccggccatccgctaccatccccaggagacccttaaggaatttgtgcagctggtgtgccctgacgcgggccaacaagccgggcaggtcggttttttaaatccgaatggcagcagtcaagggaaggtgcacaacccattccttcccactccaatgctccctccacctccaccccctccaatggctagacctgtgcctttgccagtgcctgataccaaaccccccacaacctctactgaggggggagctgcatcccctaccagcccgacctactcaaccccatcaaccagccccgcaaatcgttttgtgtccgtgggacctcgcgaccctagcttcgtgaacatcccacagcagacccagtcatggtatttagggtag

SEQ ID NO: 126783 - DNA, 1497 bp, Artificial Sequence
  Description of Artificial Sequence: Synthetic coding sequence
atgtatagtcccctgtgtctaacgcaagacgagtttcacccctttatagaggcgctgctacctcacgttcgcgctttcgcctacacttggtttaatctgcaggcgcggaaaagaaagtatttcaagaaacacgagaaaaggatgtcaaaggaagaggagcgggcagtgaaagatgagttgctgagtgagaaacccgaggtgaaacagaagtgggcctcacgattgctggcaaaattgcgcaaagacatcaggcctgaataccgcgaagacttcgtactaacagtgacgggcaaaaaaccgccatgctgcgtactgtcaaatcctgaccagaaaggaaaaatgcggcgcatcgactgcttgcgacaggcagataaagtttggagactggacttggtcatggtcattttgttcaaaggcatccccctcgagagtacggacggcgagagattggtaaaaagcccccagtgttccaatcctggactctgcgtgcaaccgcatcatatcggagtctccgtcaaggagcttgacctgtatctcgcttactttgtgcacgctgctgatagcagccaaagcgagtccccctcccaaccctctgacgcggacatcaaagatcagccggagaacggacatcttggctttcaggacagcttcgtcaccagcggtgtcttctcagtgacagagctggtgcgagtgtcgcagaccccaatcgccgctggcaccggccctaattttagtctttccgacttagagtcctccagttattatagtatgtcgcccggcgccatgcgacggagtcttccctccacaagctctacatcatctacaaaacggctgaaaagcgtcgaagacgagatggacagccccggtgaagagcctttttataccggacagggaaggtctcccgggtccgggtctcagtcctctggatggcatgaggtggagccggggatgcctagccctactaccctgaaaaaaagtgagaagtccggctttagctctccatccccatcccagacatctagtctcggaactgcctttacgcagcatcatcgcccagtgattaccggaccaagggcctcacctcacgccacacctagcacactgcactttcctacgtctcccatcatccagcagccaggcccgtacttcagccatcctgccatcagataccacccacaggagacgctgaaagaatttgtgcagctggtgtgccccgatgccgggcaacaggccgggcaggtggggttccttaatcccaatggatcaagccagggaaaggttcataatccctttctcccaacacccatgttaccccccccaccaccgcctccaatggcgcgacccgtgcctctgcccgtgccagataccaagcccccaaccacttccaccgaggggggcgccgcaagtcctacgagtccaattttagtgcccggcataaaagtggcggcttcccaccatcccccggacagacctcctgacccattctcaaccttgtag

SEQ ID NO: 126784 - DNA, 603 bp, Artificial Sequence
  Description of Artificial Sequence: Synthetic coding sequence
atgatgtacagcccaatttgccttacgcaggatgagtttcatcctttcatcgaggcattgttgccccacgtcagggctatcgcctatacctggtttaacttgcaggccagaaaaagaaaatacttcaagaaacacgagaagcgtatgtctaaggacgaggagcgagcagtcaaggacgaactcttgagtgagaagcctgagatcaaacagaaatgggctagcaggctgctggcaaaactgcggaaggatatacgtcaggagtaccgggaagactttgtcctcacagtcaccggcaaaaagcacccatgctgtgtgttgtctaatcctgatcagaagggaaaaatacgtaggattgactgtctgaggcaggctgataaggtgtggcggttggatctggtcatggtcattctgttcaagggaatcccactggaatccaccgacggcgaacgacttatgaagagcccacactgcaccaatcccgccttgtgcgttcagccacaccacataaccgtttctgtgaaagagctagacctctttctggcctattacgtacaggaacagggcaaaaatttcttctccagtaacaagtgcataaaaatctag

SEQ ID NO: 126785 - DNA, 507 bp, Artificial Sequence
  Description of Artificial Sequence: Synthetic coding sequence
atgaatagcggcgttaatctacagcggtctttgtcatccccccccagttcaaagcggccaaagacgatcagcatcgatgaaaacatggagccttccccaacaggagacttctacccaagcccatccagcccggcagccgggtcacgcacctggcatgagagagatcaggacatgagtagtcccaccaccatgaaaaagccggaaaaaccattgtttagcagcgcatccccacaagactcatcacctagactgtctacattcccccagcaccaccaccctgggattcctggcgtggctcattcggtaatctctactcggactccaccacccccatctccactccctttccctacacaggccatactcccgcccgcaccgagctcctacttcagccatcctacgatcaggtaccccccacacttgaacccccaggacactctgaaaaactacgtaccctcttacgacccctctagcccccagacctcacaatcctggtaccttggctag

SEQ ID NO: 126786 - DNA, 1341 bp, Artificial Sequence
  Description of Artificial Sequence: Synthetic coding sequence
atggagcggattccggtgagtgtggacttttgggtggtctgctgtgctgtgctgaaatgcaaccccggtatcccgaaacggatgagtaccctgtgctttggatttagcgatgagtttcatccgttcatagaggcactcctcccacacgtccgcgcgatcgcatacacctggtttaacttgcaggcgcggaaaaggaagtactttaagaaacacgagaaacggatgtcgaaagacgaagaacgcgctgtcaaagacgagctgctctccgagaaaccggagatcaaacagaaatgggcatctcgtctgctggctaagctgaggaaggatattcggcaagagtatcgagaggatttcgtgctgactgttactgggaagaaacacccttgctgtgtgttgtcaaaccccgatcagaaaggtaagatccggcgaatcgactgcctaagacaggccgacaaggtatggcggctcgacctggtcatggttatactctttaaagggatcccactagaatccactgacggtgaacggctgatgaagtcaccacattgtacaaatccggccttatgcgtgcaaccacaccacataaccgttagcgtcaaagagctggacttgtttctggcttactatgtgcaagaacaagattcaggtcaatctggaagtccgtctcataatgacccggccaagaacccacccggctatttggaagacagttttgtcaaaagcggagtcttcaacgtttctgagttggtgcgtgtctcccgcactcccatcacccagggaaccggcgtgaacttcccgataggggagattcccagtcagccgtattaccatgacatgaattcaggtgtcaatctacagaggtcgctgtcttccccaccttcatctaaacgcccgaaaacgatctcaatcgacgagaacatggaacccagccctaccggggacttctatccgagccccagctccccagcagcaggctcaagaacatggcatgagcgagaccaggacatgagctcacccacaacgatgaaaaaacccgagaaacctttattctcctcagccagtccacaggactccagccccaggctgtccacattcccacagcatcaccacccaggaatccccggagtcgctcatagcgtgattagtactcgaactccaccccctccttctcccctgccgtttcccactcaggctattctgccacctgcgcctagtagctacttttctcatcccaccatccggtacccgccccacctgaacccccaagataccttaaagaactacgttccttcgtatgacccatccagtccacagacatcccagtcatggtacttgggatag

SEQ ID NO: 126787 - DNA, 1485 bp, Artificial Sequence
  Description of Artificial Sequence: Synthetic coding sequence
atgatgtattcgccgatttgcctgacgcaggacgagttccaccccttcattgaagctttactgccccacgttcgcgctattgcttatacatggtttaatctgcaggcaaggaagcggaagtattttaaaaagcacgagaagagaatgtccaaagatgaggagagagcggtaaaggacgaactgctgagtgaaaaacctgagattaagcaaaaatgggcctcccgccttcttgcgaaactgcggaaagacatcagacaggaatacagagaagatttcgtgctgacagtaactggaaaaaaacatccctgttgcgtccttagtaaccccgaccaaaaaggcaagattcgcaggatagattgcttacgccaggccgataaggtgtggagactcgacctcgtcatggttattttgtttaagggcatccccctcgagagtactgatggggaacgactcatgaaaagccctcactgtaccaaccctgcactgtgcgttcagccacatcatattaccgttagcgtcaaagagctggacttgttcctggcttactatgtccaggaacaagatagcgggcaatccggaagtccaagtcacaacgacccagccaagaaccctccaggttatttggaggatagttttgtcaaatccggggtgttcaatgttagcgaactggtccgcgtctcacgtactcctataacccaggggactggcgtcaactttccaatcggagagatcccgagtcaaccatactatcatgacatgaatagcggcgtgaatctccagagaagcctaagtagccctccttcctccaagcgccctaagaccattagtatcgacgagaacatggagcctagccctaccggggacttttatccgtctccaagttcaccagcagcaggatcacggacctggcacgagcgagatcaggacatgtcttcgccgacaaccatgaaaaagcctgaaaagcctctgttcagtagcgcatctccacaagatagctcccctaggctgagcacctttccgcagcaccatcatcctggcatccccggggttgcccactcagtcatatcaactcgcacccctccccccccctctcctctcccttttcctacacaggcaatccttccacccgctccttcttcctacttctctcaccccaccatcagataccctccacacctgaatccccaggatacacttaaaaactatgtgccaagctatgacccgtcatccccacaaacctcacagcccaacggatctggccaggtcgtcggcaaggtgcccggacattttacaccagttctagccccttcgccacacccctctgccgtaaggcccgtgaccttgtctatgactgacaccaagccgatcaccacaagcaccgaagcctatacagcttcgggcacgtctcaggctaaccggtatgtcggtcttagccccagagatccctccttcctgcatcagcagcagtcctggtatcttggatag

SEQ ID NO: 126788 - DNA, 1263 bp, Artificial Sequence
  Description of Artificial Sequence: Synthetic coding sequence
atgatgtactcccccatctgcctgactcaagacgagtttcacccctttattgaagcactgctccctcatgtcagggcaatcgcatatacatggttcaatctacaagccaggaaacgtaagtactttaagaagcatgaaaaacgcatgtccaaggacgaggagagagcagtcaaagacgaactcctctccgaaaagccagaaataaagcagaaatgggcaagtagacttctggcgaagctgcggaaagacatccgccaggagtaccgggaggatttcgtgcttactgttacaggaaaaaaacacccttgctgtgtgctatcgaacccagaccagaagggcaaaataaggagaatcgactgcctcagacaagccgataaggtttggagactggatctggttatggttattctgtttaaagggatccctctcgaaagcacggatggtgaacgcctaatgaagtccccacactgtacgaaccccgccctttgtgtccaaccccaccacatcacagtgtcagtaaaagaactcgatcttttcctagcttactatgtgcaggagcaggacagcggtcagtccggtagtcctagccacaacgatcctgcaaaaaatccccccgggtacctggaggattcttttgtgaagtccggcgtcttcaacgtgagtgagctcgttcgggtgtctcgcacccccattacacagggaactggtgtgaatttccccattggcgagatcccatcacagccttactaccacgatatgaatagcggtgtgaaccttcaacggtcattgtctagcccccctagctctaaaagacctaaaacgatttccattgacgagaacatggagccttcccccactggagatttttatccctctcccagtagtcccgccgcggggtccaggacctggcacgaacgagaccaagatatgtcctccccgactactatgaaaaagccggaaaaacccctgtttagttctgcaagcccccaagacagctctccacggctcagcacattcccccagcaccaccacccaggcatccctggcgtggcccatagtgtgattagcacccgcaccccaccaccccctagccccttacccttcccaacgcaggccatactgcctcctgccccttcctcctatttctcccatcccaccatccgctatccaccacatcttaatccacaggacaccttaaagaactatgtgccatcctatgatcccagttctcctcagacgtcacaaagctggtacctaggctag

SEQ ID NO: 126789 - DNA, 1686 bp, Artificial Sequence
  Description of Artificial Sequence: Synthetic coding sequence
atgatgtactccccaatctgtctaacacaggacgaattccaccctttcatcgaggccctgcttccgcacgtcagggccatcgcttatacctggtttaatttacaggctcggaagcgaaagtattttaaaaagcacgagaaacgcatgtctaaggatgaggagcgcgcggtgaaggatgagcttttgtctgaaaaaccagagatcaagcaaaagtgggctagcagactgttggccaaattgcggaaagacataagacaggagtatcgtgaagattttgtcctcactgtaaccggtaagaagcatccctgttgcgtcctctcaaaccctgaccagaagggcaaaattcgtcgcattgactgcctgaggcaggcagataaggtgtggagacttgatctggtgatggtaatattgttcaagggaatccccttagagagcaccgatggtgaaagactcatgaaaagtccccactgtacaaatccagccctgtgcgttcagccccaccacataaccgtgtccgtaaaggaactagacctgttcctcgcctactatgtgcaagaacaagacagcggccaatcggggtctccaagtcataacgatcctgctaaaaatccaccaggatatcttgaggactctttcgtcaagagcggcgtgtttaacgtctcagaactggtaagggtgtctaggacacctattactcagggaacaggggtgaacttccccattggggaaattccctcacagccatactaccacgatatgaatagtggagttaatctgcagagaagcctgagctcacccccatccagcaaaaggcctaagacaatttctattgacgagaatatggagcccagccctacgggcgacttctatccatcgcctagttcaccagcagcgggatcacgcacctggcacgagcgcgaccaagacatgtcaagtcctacaacaatgaaaaagccagaaaagccactatttagctcagcttcgcctcaggactcatcacctagactttctacctttccacagcaccatcaccccggtattcccggtgtcgcccattcagtgatcagtacaaggactccaccgcctccatctcccctcccctttccaacccaggccatactcccgcccgccccctcgtcatacttctctcatcccaccataagatatcctcctcacttaaaccctcaggacactctgaagaattatgtgccctcctatgatccaagttctccccagacttcgcaaccaaacggttccggacaagtcgtaggaaaagtacccggtcattttactccggtcctcgcgccttctccacacccctccgccgttaggccggtgactctgtctatgaccgacacaaagcctattaccactagtaccgaagcctacaccgcaagcggaacgtctcaggctaacagatatgtcggactcagcccaagagatccctctttcctacatcagcagcagttaagaatctgcgactggacaatgaatcagaacggccggcacttgtacccttctacatcggaggacactctgggcatcacctggcagtctcccgggacctgggcttctctggtgccattccaagtttccaaccggacccccatcctacccgcaaacgtgcagaattacggcctcaatatcattggggaacctttcctacaagccgagacatctaattag

SEQ ID NO: 126790 - DNA, 1464 bp, Artificial Sequence
  Description of Artificial Sequence: Synthetic coding sequence
atgatgtactcacccatttgtctaactcaggacgagtttcacccctttattgaggcgctcctccctcacgtgcgcgcaatcgcctatacgtggttcaatctgcaggcaagaaaacgtaagtatttcaagaaacatgaaaaacggatgtccaaggatgaggagagggctgtgaaggacgaactgctgagtgagaagccagagatcaagcagaaatgggcaagcagacttcttgctaaactcagaaaagacatacgccaggagtatagggaggactttgtgcttaccgttaccggaaaaaagcacccctgttgcgtgttgagcaaccctgatcagaaaggcaaaatccgtcgaattgattgtctgaggcaggcggacaaagtgtggcgattggacctggttatggtcattctgttcaagggtatcccactggaaagcactgatggagagcgtctaatgaagagccctcactgcaccaatccagccctttgcgtgcaaccccatcacatcacagtgtcagttaaggagttggacttattcctggcatactatgttcaagagcaagactcagggcaatctgggagtccctcccacaatgaccccgccaagaacccacccggctatctggaggactcctttgtgaagtcaggggtttttaatgtgagcgaactggtgcgggtgagcaggacacccattactcaggggaccggagtaaacttccccattggagagatcccatcacagccctactaccatgacatgaactccggagttaacctccagcgctccctgtctagccccccttcatcaaaaagaccaaagacaatatcaatagatgagaacatggaaccttcccctaccggagacttctatcctagtccttcatcacccgctgctggaagtcgtacgtggcacgagagggaccaggatatgagttccccgacaacgatgaaaaagcccgaaaaacctctgttttccagtgctagtccccaggactctagcccacggcttagcacattccctcaacatcaccatcccggcattcccggggtagctcattctgtgatttcaacgcggactccgccaccgcccagccctctgccgttcccgacccaggcaatcctgcctcccgcaccgtctagctactttagccatcccaccatccggtatcctccgcacctcaacccccaggacactctgaaaaactatgttccatcctatgacccctcgtccccgcagacctcccagctccggatatgcgattggacaatgaatcaaaacggtaggcatctgtatccatctacatcagaagatactctgggtatcacatggcagtcccccgggacgtgggcctccttggtgccgttccaggtttccaatcggacccctatattaccagcgaacgttcaaaactacgggctcaacatcatcggcgagccattcctgcaggctgaaacgtccaattag

SEQ ID NO: 126791 - DNA, 1713 bp, Artificial Sequence
  Description of Artificial Sequence: Synthetic coding sequence
atgatgtactcaccaatctgcctgacgcaggatgagttccacccattcatagaggccctgctgccacatgtgcgggccatcgcatatacatggttcaatctgcaggcccgaaagagaaaatattttaagaaacacgagaagagaatgagtaaagatgaagaacgagctgtcaaggacgagctgctcagcgaaaaaccagagatcaagcagaagtgggcttcacgcctgctggcgaagctgaggaaagacattcgccaagagtatagagaagattttgtccttacagttaccggcaagaaacacccttgctgcgtgctgtccaatcctgaccagaagggcaagatcaggcgcatcgactgcctgagacaggccgataaggtgtggaggttagacctggtgatggtgatactctttaaaggtatccccttggagtctacggacggagaaaggctgatgaaatccccccactgtacaaaccccgcactgtgcgtccaacctcatcacataaccgtcagcgtcaaggaacttgacctgttccttgcctactatgtccaggagcaggattctggccagagtggctccccttcacacaacgacccggccaaaaatcccccgggttatctagaggatagctttgttaagtccggggtgtttaacgtgtcagagctggtacgagtgtccagaacccccatcacgcaagggactggagtgaactttcccatcggggaaattccttcccaaccatattaccacgacatgaactccggggtgaacctgcagagatctctgagttctcccccatccagcaagcgccccaaaactatcagcattgatgaaaacatggagccatcacctaccggggacttttatccaagtccttcgtcacccgctgctggttctaggacctggcatgagcgcgaccaggatatgagcagccctaccactatgaaaaagccagaaaagcccctcttctctagcgcttctccacaggactccagtcccagactgtcaacattccctcagcaccaccaccctggtatcccaggcgtggcacacagcgtgatctccacacgcactcctccacccccttcaccgctcccctttccaactcaggcaatcctgccccctgcccccagtagctatttttcacacccaactatcaggtacccccctcacctcaacccacaagacacccttaagaattatgtcccgagttatgatccatcaagcccacaaaccagtcagccaaacggttctggacaggtggttggcaaggtgccagggcattttactccagtcctagcaccttctcctcatcctagcgcagttagacctgtgacgctcagtatgaccgatactaagccaattaccacctccacagaaggcgaggctgccagccccaccgccactacgtacacggcttccggtacctctcaggctaatagatacgttggcctctccccaagggatcccagtttccttcatcagcagcaactcagaatttgtgattggacaatgaaccaaaacggaagacacttatacccttctacatccgaggatacgctgggcattacgtggcagagcccagggacctgggcatctctggtccccttccaagtatcaaaccgaacccccatactccccgctaatgtacagaattatggccttaacattattggtgagccctttctgcaggccgaaactagcaattag

SEQ ID NO: 126792 - DNA, 930 bp, Artificial Sequence
  Description of Artificial Sequence: Synthetic coding sequence
atgaacagtggcgtgaacctccagagaagtctgtcttcacccccctcctctaagcgcccgaaaacaattagcattgacgagaacatggagccttcccccacgggcgacttttacccatcaccctccagtcccgctgccggttccaggacttggcacgaaagggaccaggacatgtcgtcaccgacaaccatgaagaagccagagaaacccctcttttcctccgccagtccgcaagattccagccctcggctcagtacatttccccaacaccatcatcctggcataccgggtgtggcacacagcgttatcagtacacgtacccctcctcccccaagcccactcccgttccctactcaggctattttacccccagccccaagtagctactttagccaccccacgatccgctatccaccccatctcaacccccaggacacactcaagaattatgtcccatcatacgacccttccagcccacagaccagccaacctaatggatcaggacaggtcgtgggtaaagtgcccggtcacttcacccccgtgctggctccgtccccacatccatctgcggtgaggcccgtcaccttgagcatgactgacactaagcctattacgacgtccaccgaggcatatacagcatcaggaacatcgcaggctaatcgatacgtaggattgtccccgcgagacccaagcttcttgcaccagcagcagttgaggatctgcgactggactatgaaccagaacggacggcacctttatcccagtacttctgaagacaccttagggatcacatggcagagccccgggacgtgggctagtctggtcccgttccaggtatcgaataggacccccatattgccagctaatgttcagaactatggcctgaatatcatcggtgagcccttccttcaggccgagacatctaattag

SEQ ID NO: 126793 - DNA, 1272 bp, Artificial Sequence
  Description of Artificial Sequence: Synthetic coding sequence
atgtattcctctccgttatgcctaacacaggacgaattccacccttttattgaagccttgctgccgcatgtgagggcctttgcgtatacttggtttaatctgcaggcccgtaaacggaagtacttcaaaaagcatgaaaaaagaatgagcaaggatgaggaaagagctgtgaaggacgagcttctgggtgaaaagccagaggtgaagcagaaatgggcttcccggctcctcgctaagctccggaaggacatccgtccagaatgtcgagaagactttgtgctgtctatcacagggaaaaaagctccgggatgtgtgctttctaatcctgaccagaaggggaagatgagaaggatcgactgcctgcgacaggctgacaaagtatggaggctagacctggtgatggtgatccttttcaagggcattccattagaatcaactgatggtgagaggttagtcaaagccgctcagtgtggacaccctgtactgtgcgtgcagccccatcatattggtgtggcggtaaaggagttggatctgtatttggcctacttcgtgagggagagggacgctgagcagtctgggtccccgcgcactgggatgggtagcgatcaggaggacagcaagcctattactttggacaccaccgactttcaggagtcatttgtaacctcgggcgtgtttagtgtaactgaactaatccaggtttcaagaactccggttgttactggcaccggcccaaacttttcgctcggcgagctgcagggacacctggcatacgatcttaaccccgccagcacaggcttacggaggacactgccctccacttcatcctccggctctaagcggcacaagtctggctccatggaagaggacgtggacacatctcctgggggagattactatacttcaccaagttcccccacgtcatctagcagaaactggaccgaggatatggaaggcgggatctctagccccgttaagaaaacagagatggacaagtcacccttcaactcacccagccctcaggatagcccccggctgtctagtttcactcagcaccaccgccctgtaatcgccgttcacagcggtatagctcgttctcctcacccaagcagcgcgttgcacttccccactacatctatcctgccccaaacagctagcacatacttcccgcacaccgccataagataccccccccatcttaatcctcaggaccctttaaaggatttagtgagtctggcgtgtgatccggcgtcccaacagcccggaccctag

SEQ ID NO: 126794 - DNA, 1287 bp, Artificial Sequence
  Description of Artificial Sequence: Synthetic coding sequence
atgtattcttcccccttgtgccttactcaggatgagttccatccttttatcgaagccttactcccacatgtgcgagcttttgcatacacgtggttcaacctgcaagcccgcaaaaggaaatacttcaaaaagcacgagaaaaggatgtctaaggacgaggagagggccgtgaaagacgagctcctgggggaaaagccagaggtcaagcaaaagtgggccagtcgattgcttgctaagctcaggaaagacatcagacccgagtgccgagaggatttcgtcttgtcaatcacaggcaagaaagctcccggttgtgtcttgagcaatccagaccagaaggggaagatgagaaggattgattgcttacgccaggccgacaaggtttggcggctggatctggttatggtaatcctgttcaaaggcattcccttggagagtacagatggagagaggctcgtgaaggccgcacagtgtggacacccagtgctctgcgtccaaccccatcacatcggggtagccgtcaaggaactggatctgtatctggcctatttcgtgcgggaaagagacgcggagcaatcaggatcacccaggaccgggatgggaagtgaccaggaggatagcaagccgataactctggatacaaccgactttcaggaaagttttgtaacatccggcgtgtttagtgtcacggagctaatacaggttagcagaacccctgtggtcacaggaacaggaccaaatttcagcctgggcgaactgcaggggcacctcgcttacgatcttaaccctgcgtccacaggcctccgacgaaccttgccgagcacatcttcctccggaagcaaaaggcataagagtggcagtatggaggaagatgtggatacatcccccggcggtgattactacacaagcccctcaagtccaacctcaagctctcggaactggactgaagacatggagggcggtatcagctcgccggtgaagaaaactgagatggataaatccccctttaacagccccagtccacaggattcacctcggttgtccagttttacacaacaccataggcccgtaatcgctgtgcattcaggtatcgctcggagccctcatccaagctctgctctccactttcctaccacaagcattctccctcagactgcgtccacatatttccctcatactgcgattcgatatccgccacacctgaatccacaggaccccctgaaagacctggttagcctggcctgcgaccccgcttcccagcagccaggaccctcatggtatctgggctag

SEQ ID NO: 126795 - DNA, 1527 bp, Artificial Sequence
  Description of Artificial Sequence: Synthetic coding sequence
atgtatagcagccccttgtgcctaactcaggacgaattccacccattcatcgaagcccttctgcctcatgtgagagcatttgcttatacatggttcaacttgcaggccaggaagcgaaagtactttaaaaaacacgagaagagaatgtctaaggacgaggagagggcggtaaaagacgagctgctgggcgagaagccggaggtgaagcagaaatgggctagcagactgctggcgaagctgaggaaagatataagacccgagtgtcgcgaagattttgtgctgtctatcacaggcaagaaagcaccgggctgtgtcctctcgaatccggatcagaaaggtaagatgaggcgtatcgactgccttaggcaggcagacaaggtgtggagacttgacctagtaatggttatactatttaaaggtattccgctagaatcaacagacggcgagcggctggtgaaggcagcccagtgcgggcatcccgtgttgtgtgtacagcctcatcacattggtgtagccgtgaaggaactggacttatatttggcctatttcgttcgcgagcgggacgcggagcaatctggatcaccaaggaccggcatggggtcagaccaggaggactctaagcccattactctcgatactactgactttcaagagtctttcgtcacaagcggggtattcagtgtaactgaattgattcaagttagccgtaccccggtggtgaccggaacagggcctaatttttcactcggtgagctccaaggtcatctcgcttatgaccttaaccccgcatcgacaggactgcgaaggactctgccctctacatcaagttctggctcaaagcgtcacaagtcaggctcaatggaagaggacgtagacacctctccaggcggggattattatactagcccctcctcacccactagtagcagtcgcaactggacagaggacatggaaggtggaatatcctcacccgtaaaaaaaactgagatggataaatcccctttcaacagtcccagcccccaggactcaccccggttgagctccttcacccaacatcaccgtcctgtgattgctgtccattcaggcattgcccggagccctcacccttcatccgctcttcacttccctacgacaagtatcttaccccagacggcctccacctattttcctcatactgccatccgctacccgccccacctaaacccacaagatccacttaaagatctcgtgtcactcgcttgtgatccagcatcgcaacagcctggacctctcaacgggtccggtcagctgaagatgccttcccattgcctgtcagcccagatgctagctcctccacctcctggactgccacggttggccctgccacccgccactaagcccgccactaccagtgagggaggcgccacatcaccaacgtcaccttcttattcccctcccgacaccagccctgcaaaccggagctttgtcggtctgggacctagagatccagccggcatatatcaggcacagtcatggggcgacggttag

SEQ ID NO: 126796 - DNA, 1221 bp, Artificial Sequence
  Description of Artificial Sequence: Synthetic coding sequence
atggatgagttccatcctttcattgaagcactactcccccacgtgcgcgcctttgcctatacttggtttaacctgcaggctagaaaaagaaaatatttcaagaaacacgagaaacgtatgagcaaggacgaagaaagagctgtcaaggacgaactgctgggtgagaagcctgaggttaagcagaagtgggctagccgcctgctagctaaactgcggaaagatataagacccgagtgtcgggaggacttcgtcttgtctatcacagggaaaaaagcccctggctgtgtgttgtccaacccagaccagaagggcaaaatgcgaagaatcgattgtctgagacaagctgataaagtgtggcggctggatctggttatggtcatcctgttcaaagggatcccactggagtcaacggacggagaacgcctagtaaaagccgcccagtgcggacaccctgttctgtgcgtgcagccccaccatattggggtcgctgtgaaagaactcgacctatacctggcctacttcgtgagggagcgcgatacaacagacttccaggagtccttcgtcaccagcggtgtgtttagcgtgaccgaactgatccaggtaagccggacgcctgttgttacaggcaccggccccaatttcagtctaggcgaattgcagggccatctggcttatgacctcaacccagcttctactgggctgcgcaggaccttgccgtcaacttccagcagcggatctaagagacataaatccggttcgatggaagaagatgtggatacatctcccggcggggattactatacttcacccagcagtccaacttcaagtagccgcaattggactgaagacatggaaggcggcatttcgtcccctgtgaagaaaacagaaatggataaatccccgtttaactcaccctcccctcaagactccccacgactgtcaagcttcactcagcatcacaggcctgttattgcagtgcactctggcatcgcccgatccccacaccctagcagtgcccttcactttccaacgacatctatcctgccacagacagcctcgacctatttccctcataccgcaataagatacccgcctcatctcaatccacaggatcctcttaaagatcttgtcagtcttgcctgtgatccagcatcccagcaaccaggccctcctaccctgcgccctaccaggcctctgcagacagtgccgctgtgggactag

SEQ ID NO: 126797 - DNA, 1293 bp, Artificial Sequence
  Description of Artificial Sequence: Synthetic coding sequence
atggacgagtttcacccttttatagaagcccttctaccccacgtgagagcttttgcgtacacctggtttaatttgcaggctcgcaagagaaagtactttaaaaaacatgaaaagaggatgtcaaaagacgaagagagagccgttaaagatgaactgctgggcgagaagcccgaagtcaagcagaaatgggcaagcagacttttggcgaagctcagaaaagacatcagaccagagtgccgggaggactttgtattatccataaccggcaagaaagctccaggctgtgtgctgagtaatcctgaccagaaggggaaaatgcggagaattgattgtctgcggcaggccgacaaggtctggagattagatctcgtaatggtgattctctttaagggcatccctctggaaagcactgacggggagcggcttgtcaaggcggcccaatgcggccaccccgttctgtgcgtgcagccccaccatatcggagtggctgtcaaggaattggatctttatctggcgtattttgtccgtgaaagggatgctgaacagtccggttccccccggaccggtatggggtctgaccaggaggattccaaacccattaccctggacactactgattttcaagaatctttcgtgacctcaggcgtcttttctgtcaccgagcttattcaagtatcccgaacccctgtggttacagggacaggacccaacttttcattgggtgaactccagggtcacttggcttacgacctcaacccggcctccacaggtttacgcagaactctgccaagcaccagttctagtgggagcaagcgacacaaatcgggcagcatggaagaagacgtggatacatctcccgggggcgattattacactagtcccagtagccccacctccagttctcgtaattggactgaggacatggagggaggtatttctagccccgtcaagaagacagaaatggacaagtctccttttaattccccatcaccccaagatagccctcgactgagctcattcactcagcatcaccgacccgtgattgccgtgcatagcggtatcgccaggtccccccaccccagcagtgctttgcatttcccaactacgtccatcctcccccagaccgctagcacttactttccccacactgcaatccggtaccccccccacctcaaccctcaggacccgcttaaggacctcgtatccctggcatgcgatcctgcctctcagcagcccgggccgccaaccctgcgcccaaccagacctctccagaccgtgcccttgtgggattag

SEQ ID NO: 126798 - DNA, 1500 bp, Artificial Sequence
  Description of Artificial Sequence: Synthetic coding sequence
atggacgaatttcaccccttcattgaagcactcctaccgcacgtaagggcctttgcctatacttggtttaacttgcaggcaagaaaacgaaaatatttcaaaaaacatgagaaaaggatgtctaaggacgaggagagagccgtgaaggatgagctccttggcgaaaaacccgaggtcaaacagaagtgggctagtagattgctagcaaagctgcgtaaggacatccgccccgagtgtcgtgaggattttgtattgtcgattactggcaagaaagctcccggatgcgttctttctaaccctgatcagaaaggtaagatgcgccgcattgattgcctccgccaggcggacaaagtgtggcgcctggacctagtgatggtgatcctcttcaaggggatccccctggagagcaccgacggagagagattggttaaagcggcccagtgcgggcatcctgtcctctgcgtgcagccccaccatataggtgtcgcagtcaaggaactggacttataccttgcctactttgttagggagcgagatgctgagcaaagcgggtctcccaggactggcatgggttcggaccaggaagacagcaaaccgattacactcgatacaacagacttccaggaaagctttgtgacctccggggtcttctccgtgacagaactaatccaagtctctcggacgccggtggtcaccggaaccggaccaaacttttcattgggcgagctccagggtcacttggcttatgaccttaatcctgcctccacaggacttcgcaggactttgccgtccacatcttcctcaggtagcaagagacacaagtcggggagcatggaggaagatgtggacaccagcccggggggggattactatacctctccttcttcgcccactagtagctcacgcaactggaccgaggacatggagggcggcattagcagtcctgttaagaagacagagatggacaagtctcccttcaattcgccctccccccaggacagtcctcggctgagctccttcacccagcatcaccgtccagtgattgccgtccactcgggcattgctagatctccccatccttcctctgctttgcacttcccaactacctccattctgcctcagacggcgagcacctactttccccacacagcgattcgctatccaccacacctgaacccccaggatcccctgaaagaccttgtgtcccttgcttgtgatcccgcctcccagcagccaggtcccctgaatgggtcaggccagctcaaaatgccgagtcattgcctatctgcccagatgctggcacctccgcctcccgggctcccaaggctggctcttcctcctgccacaaagcctgccaccacaagcgaaggcggagctacatccccaaccagcccctcctactctccgcccgacactagcccagctaatcgatccttcgttggactcggcccccgggacccagcaggtatttaccaggcacaatcctggtatctagggtag

SEQ ID NO: 126799 - DNA, 1500 bp, Artificial Sequence
  Description of Artificial Sequence: Synthetic coding sequence
atggatgagtttcatccattcatagaggcgttgctgccacacgtaagagccttcgcttatacctggtttaacctgcaggcccggaagcggaagtactttaagaaacacgagaagagaatgagcaaagacgaagagagggcagtgaaggacgagctgctgggcgagaaaccagaggtgaagcagaagtgggcatcccgcctgttggctaagctgcgtaaagatatccgcccggaatgtcgagaagactttgttctctctatcacaggaaagaaagctcccggctgcgtactttccaatccagatcagaaaggaaagatgcgtcgaatagattgcctgcgtcaggcagacaaagtgtggagattagatttggtcatggtcattttattcaagggaattccactcgagtcaaccgacggggagcgcttggtcaaggctgcccagtgtggccaccccgtgctctgcgtgcaacctcaccacatcggtgtcgcagtaaaggagctcgacctgtacttggcttactttgttcgcgagcgtgatgcggaacagtcggggtctccaaggaccggaatgggttctgatcaagaggattccaaacctattaccctagatactacagatttccaggagagcttcgtgacaagcggcgtgttcagcgtgactgaactgatccaggtaagcaggaccccagtggttaccggaacaggccctaatttctctttaggtgaattacaggggcacctggcttacgatctaaatccagcctccacgggccttcgccggacactgccaagcacttcatctagcggaagtaaacgacataaatccggcagtatggaggaggacgtggatacaagccccggaggcgattactacaccagcccgtcctcacccacctcttcttccagaaactggacagaagacatggaggggggcatcagttccccggtaaaaaagaccgaaatggataagtctcccttcaattcacctagcccacaggacagtccccgactgtcgtcctttactcagcaccaccggcccgtgattgccgtccactcaggaattgcccgctctccccatcctagctccgcgctgcattttcccaccacctccatacttcctcagaccgctagcacctacttcccacacaccgcgatcagatacccgccacatcttaatccacaggatcctcttaaggatctggtgagcctcgcctgtgacccagcttcccaacagcctggccccctgaatgggtccggccagctgaaaatgccaagccactgtctaagcgctcaaatgctagcacccccacctccaggactgcccagactggccctgcctcctgcgactaagcctgcgacaacatccgagggcggggctacttctcccacctccccatcctactccccacccgacacaagtcctgccaacagatccttcgtgggcctgggaccccgtgatccggctgggatataccaagctcagagttggtatctaggatag

SEQ ID NO: 126800 - DNA, 1212 bp, Artificial Sequence
  Description of Artificial Sequence: Synthetic coding sequence
atgggggcaaccgagccgggtggggacacgtcctcagatgagttccatccctttatcgaggcactccttccccacgtgcgcgcctttagctatacctggttcaatcttcaagctcgaaaacgtaagtactttaaaaagcatgagaagcggatgagcaaggacgaggagagggccgtgaaagacgagcttctcggcgagaagcccgaaatcaaacagaagtgggcatccaggcttcttgcgaaacttcggaaagacatacgcccagagttccgtgaagatttcgttctgactataaccggcaaaaaacctccttgttgcgtgctgtccaacccagatcagaaaggaaagataagacggatcgactgtctaaggcaggcagataaagtatggcgcttagatctggtaatggtgattctgttcaagggtatacccctggagagcacagatggggaaagactgtacaagtccccccagtgtagcaaccccggcctttgtgtgcagcctcaccacatcggcgtaacaattaaggaactggacctctatctcgcgtacttcgtgcatacacctgagtcgggacagtcagacagctccaaccagcagggggacgcggacatcaaaccgctgccaaacggccatctatcctttcaggactgttttgtaacaagtggggtgtggaatgtaaccgaactcgttagggttagccaaacccctgttgctacagcaagtgggcctaatttttccttggcggacctggagagcccatcatactataacatcaatcaggtgacactggggaggcgcagcatcacaagtcccccttccacaagcactactaaaagacccaaaagcattgacgattctgagatggaatcgccagttgatgatgttttttacccaggtactggaagaagtcctgcggcagggagttctcagtcaagcggctggcccaacgacgttgatgcaggcagccctagagctaccgccagcgcgctgcacttccctagtacctccataatccagcaaagtagcccatacttcacccatccgacgattaggtaccaccatcatcacggacaggactcccttaaggaattcgtgcagttcgtgtgctctgacgggagcggccaggctaccggacagcactctcagcgccaggctccgcccttacccactggcctgtcagcttctgatcctggaacagccacattctag

SEQ ID NO: 126801 - DNA, 1383 bp, Artificial Sequence
  Description of Artificial Sequence: Synthetic coding sequence
atgctccctgcatgtcgccttcaagacgaatttcacccgtttatcgaggccctcctgccccatgtgagagctttttcctacacttggttcaatttgcaggcccggaaacgtaagtatttcaagaaacacgagaaaaggatgtcaaaggacgaggaacgcgccgtcaaggacgaattactcggggagaaaccggaaatcaagcaaaaatgggcaagcaggctgttggccaaattgcgtaaagatatccgtcctgaatttcgcgaagacttcgtgcttaccattacagggaagaagcccccgtgctgcgtgctgtctaacccagaccaaaaaggcaagattcggagaatcgattgtctgagacaggccgataaggtgtggcgcttggatcttgtcatggtgattttatttaagggtatccctcttgaatccaccgacggtgagaggttgtacaagtcaccccagtgttctaatccaggcctgtgcgttcagcctcaccatattggcgtgactattaaagaattagacttatatttggcctatttcgttcatacgcctgaatcagggcagagtgactcctctaatcagcaaggggacgccgatataaagcccctaccgaacggccacctgtcattccaagattgctttgtgacctcaggggtgtggaatgttacggagctggtgagagtgtcccagactcctgtggccacagcaagtggtccaaattttagcctcgccgacctggaaagtcctagctactacaatatcaaccaagtgacacttggcagaaggtcaattaccagtccaccaagcacctcaacaaccaagaggccaaagtcaatcgatgattcagaaatggagtcgccagtcgacgatgtgttttaccccgggactgggagaagccccgcagccggttcttctcagagcagcggctggcctaacgacgtggacgccggctctcctagggccacagctagcgcattgcactttcctagtacgtccataattcagcagtcttccccttattttactcatcctacgattcgctatcaccatcaccatggtcaggattcgctgaaagaatttgtccaattcgtgtgttcagatggcagtggacaggccaccggtcaacccaacggtagtggacaaggcaaggtcccaggctcttttcttttacccccgcctccgcctgtggcgaggccagtgcctctgccaatgcctgacagtaaatcaacaagtacagcccccgatggcgcggcccttacgcctccatcaccttccttcgccaccaccggagccagctccgctaaccgattcgtgtccatcggcccccgcgacggcaactttctgaatatccctcagcagagccagtcatggtttctctag

SEQ ID NO: 126802 - DNA, 1326 bp, Artificial Sequence
  Description of Artificial Sequence: Synthetic coding sequence
atgtacagtccctactgccttacgcaagacgagttccatcccttcatcgaagcccttctcccccatgtcagggctttcagctacacatggttcaacctgcaggctaggaagagaaaatattttaagaaacacgaaaagagaatgagcaaggacgaggagcgagccgtcaaggacgaactgctcggcgagaagccagaaattaagcaaaaatgggcttctcgcctcctggcaaaacttcggaaggacattagaccagaattccgggaggactttgtgctgaccatcaccggtaaaaagccaccctgttgcgtcttatctaatcctgatcagaaaggtaaaatccgcagaattgactgcctccgccaggcagacaaggtctggagactggacctggtgatggtgattctgttcaagggaattcccctggagtctacagatggggaacggctgtataaaagcccccagtgcagtaatcccgggctatgtgtgcagccacaccatatcggagtaacgataaaagaactggatctctacttagcgtatttcgtgcatacccctgagagtgggcagtctgactcctctaatcagcagggagatgccgacattaagcccctgccaaatggtcacctgagctttcaagattgcttcgttacctcgggcgtgtggaacgtgacagagctggtgcgggttagccagacccctgttgccactgcctcggggcccaacttctccctcgccgacctggagtccccttcttactataatattaaccaggttacactgggtcggcgtagtatcacgtcacccccttccacgtctaccaccaaaaggccaaagtctattgacgattcagagatggagtctcccgtggacgatgtcttctatcctggcacaggcagatcgcccgccgcgggctcatcccaaagctccggctggcctaatgacgttgacgctggaccagcaagtctgaaaaagtcgggtaagctggacttctgcagcgccctgagctctcagggaagttcacccagaatggcctttacccatcacccattaccagtattggctggcgtgagacccggatctccacgcgccacagcatctgccctgcactttcctagcacttcaatcatccagcagtcatctccctactttactcaccccaccatacggtaccatcatcaccacggccaggacagtctgaaggaattcgtccagttcgtctgctccgacggatcaggacaggctaccggacagcattcccagcgccaggctccccctctgccaaccgggctgagtgcctctgatcctgggacagccacattttag

SEQ ID NO: 126803 - DNA, 1509 bp, Artificial Sequence
  Description of Artificial Sequence: Synthetic coding sequence
atgtattctccttattgtctaacccaggatgagtttcacccatttatcgaagccctcttgcctcacgtgcgcgctttttcgtacacctggttcaacctacaagcccggaagcgcaagtacttcaaaaaacatgagaaacgtatgtctaaagatgaggagcgggcggtgaaggatgaactcctcggagagaagcccgagattaagcagaagtgggctagtcggctcctggccaagttgaggaaggacatccgccccgagttcagagaagactttgtgttgacgattactggaaaaaagccaccatgttgcgtactgtcaaaccctgaccagaagggtaaaattagacgcattgattgcctgcggcaggccgacaaggtgtggcgcttggatctcgtgatggtgattcttttcaagggcatccctctggagtctacagatggggagagactatacaagtccccccagtgttcaaatccggggctctgtgtgcagcctcaccacataggcgtcacaatcaaggagctggatctgtacctggcttatttcgtgcacactcccgaatccgggcaatctgactccagtaatcaacagggggatgccgacatcaagccgctgcccaacggccacttgagctttcaggactgttttgtgacatctggagtgtggaatgtgacagagctcgtcagagtgagccaaacccccgtggccactgcatccggcccaaacttttctttggccgaccttgaaagtccgagttattataacatcaatcaggtcacactgggtaggaggtcaattactagtccgccaagcacctccactactaagcggcccaaaagtatcgacgattctgaaatggagagccctgtcgatgatgtgttctatcccggaactgggcggagcccagccgcaggttccagccagagttccggctggccaaacgatgtggatgcaggaccggcctcccttaagaaaagcgggaagctggacttttgctctgcattgtcctctcaggggtcctctccacgtatggctttcacccaccaccctctccctgtactcgctggcgtgcggccaggctcaccacgtgctactgcaagcgccctgcacttcccctccacatcaataattcagcagtcatcgccctatttcacccaccctaccatccgttatcaccaccatcacgggcaggactctttgaaagagttcgtgcagttcgtgtgctcagacggctctggccaggctaccggacagccaaatggctctgggcaggggaaagtaccagggagcttcctgctcccacctcctccgccagtggctaggccagtgcctctgccaatgccggacagtaagagtacctcaaccgcccctgatggcgctgccctgactccaccttcaccgtccttcgctactaccggcgctagcagtgccaacagattcgtgagtattggtccccgagatggtaacttcctcaacatcccccagcagtcccagagttggttcctgtag

SEQ ID NO: 126804 - DNA, 633 bp, Artificial Sequence
  Description of Artificial Sequence: Synthetic coding sequence
atgtccaaggacgaggaacgcgctgtaaaggatgagcttctgggcgagaagccagagatcaaacaaaaatgggctagccggctgctggctaagctaagaaaagacatcagaccggaattcagagaggacttcgttctgactatcactggtaagaaacccccgtgctgtgtgttaagcaacccagaccaaaagggcaagatccggagaatcgattgcttgcggcaggccgacaaggtctggcgcttggacttagtcatggtgatcctcttcaagggtatcccattagaatcaaccgacggggaaaggctttataaaagcccacagtgctcaaacccaggcctgtgcgtccaacctcatcacatcggagtgacaatcaaggaactggatttatacctggcctactttgttcacacccctgagagcggtcaatccgactcttctaaccagcagggtgacgccgacattaaacccctaccgaacggacacttatcattccaagactgcttcgtgacttcaggcgtgtggaatgtgacagaactggtctaccacagacttctgttacaacaacatcaaggccccactagcccctggaggacttggagagtgccagccaccacgaccagtaccagatag

SEQ ID NO: 126805 - DNA, 1071 bp, Artificial Sequence
  Description of Artificial Sequence: Synthetic coding sequence
atggcaggtgtagcctgtctcggaaaggccgcagacgcagatgaatggtgcgactcaggactgggttcccttggcccagacgccgcagcccccggcggccctggtctcggggccgagctcgggcctggcttgtcttgggcgcccctggtattcgggtatgtgactgaggacggcgatactgccctgcacctggctgtaatccaccagcatgaacctttcctcgactttctccttggtttcagtgccggcaccgagtacatggacctgcagaatgatctgggtcagaccgcactgcatttggcggcgatattaggggaaacctccacggtcgagaagttgtacgcggccggggctggcttgtgcgtggcagaacggcgcggacacacagccctgcaccttgcatgtagagtgggcgcccatgcgtgtgcccgggccctgctgcagccacgtcctaggcggccccgggaagctcctgacacctatctggctcagggcccagacaggacgcctgatacaaaccacacgccagtcgctctataccccgactctgacctggaaaaggaagaggaagaatccgaggaagactggaagctgcagctggaagccgaaaattatgagggccacacccctcttcacgttgccgtcatccacaaggatgtcgagatggttaggctgttgagagatgccggcgctgacctggacaaacccgagcctacctgcgggcggtcaccgctacatctcgcagtggaggcccaggccgccgatgtgcttgagcttctcctccgtgctggtgccaatccagcggctcgaatgtacggggggagaacaccactcgggagtgccatgctccgccctaatccaattcttgcccgattgcttcgcgcacatggggctcccgagcccgagggagaagatgaaaaatccgggccgtgcagtagctcctccgattctgacagtggtgacgaaggcgacgagtacgacgatatcgtcgtgcattcctcacgctcacagacccggctgccccctacgccggcttccaaaccacttcccgatgaccctagacctgtttag

SEQ ID NO: 126806 - DNA, 921 bp, Artificial Sequence
  Description of Artificial Sequence: Synthetic coding sequence
atgaatggagccaccgccgcctgggccccttgggttcgcacacagcgaccacccgaggacttaggctgggcccgctcgtgggctcgcggatgccggggcctcccgtcttccagtgccacgtcactgcgtatgggcacacggttctctgcaggaactgagtacatggaccttcagaacgatctaggccaaaccgcactacatctcgctgctatcttgggggaaacgtcgactgtggagaagttgtacgcagcaggggccggtctgtgcgtagctgagcgaaggggtcacacggcacttcacctagcctgccgcgtcggcgcacatgcctgcgctagggcactcctgcagcccagaccccggcgcccaagggaagcccccgatacatacctcgcgcaaggccccgatcgtacacccgatacaaaccataccccggtagctttgtatccggatagcgacctcgagaaggaagaggaggagtcagaagaagattggaagctgcagttggaggccgagaactacgagggccacactcctttgcatgtcgcagtgattcataaggacgttgagatggtgcggcttctgcgtgacgctggggccgacttagataaacccgaaccaacctgtggccgctcacctctgcacctcgctgtggaagcgcaggccgctgatgtgctagagctcctcctgcgagctggcgcaaatccagctgcgcggatgtacggtggacgcacgccactgggcagcgccatgttgcgccctaacccaattctggcccgtctcctgcgggcccacggagcccccgaacccgagggcgaagacgagaagagtggaccatgctcttcaagctccgatagcgacagcggcgacgagggtgtgagccaggaagagcggcaggggagtcccgctggcggctcggggtag

SEQ ID NO: 126807 - DNA, 1086 bp, Artificial Sequence
  Description of Artificial Sequence: Synthetic coding sequence
ctgcagaatagccgccagtccccagcgaccggcgggcgattgaggggtgccccagaagccgccggcgccatggcaggcgtagcttgtctcggaaaagccgccgatgctgacgagtggtgtgattccggactagggagtctaggccctgacgctgccgcgccagggggcccgggcttaggcgcagaacttgggcccgggctcagttgggctccgttggtctttgggtacgtaacagaggatggcgatacagcacttcatcttgccgtgattcatcagcacgagccgttccttgacttcctgcttggtttttccgcgggtacagagtatatggatcttcagaatgacctcggccagactgccctgcacctggctgccattctcggggagaccagcacagtggagaaattgtacgcagccggagccggtctgtgcgttgccgagagacgtgggcataccgctttgcacttagcctgccgggtaggagcacatgcatgtgccagagccctgctacagcccagaccacgaagaccgcgggaggcccctgatacctacttggcacaggggcctgatcggacccccgacaccaaccatacccccgtcgcactgtaccccgattctgatctcgagaaggaagaggaagagagcgaagaggactggaaactgcaacttgaggctgagaattacgagggtcacacccccctacacgtagcagtcatccataaggatgtggaaatggtgcggctgttgcgtgatgccggggccgacctggataagcctgaacccacgtgcggccgatctccactgcacctggctgtagaggctcaggctgccgatgtcctggagctattgctgcgggcaggggctaatcctgctgcccgaatgtatggtggtaggacaccgctcggctcagccatgctgcgaccaaatccgattctcgcacggctactccgggctcacggtgcacctgagcctgagggggaggatgagaaaagcgggccgtgtagtagttccagcgattctgactccggcgacgagggcgtgagccaagaggagagacagggcagccccgctggcgggtccgggtag

SEQ ID NO: 126808 - DNA, 1791 bp, Artificial Sequence
  Description of Artificial Sequence: Synthetic coding sequence
atgatagttgacaagttgctggatgactccagaggtggcgaaggacttagggatgctgccggtggatgtgggctgatgacttccccactgaatctgagttacttctatggagcttcacctcccgcagctgccccgggcgcctgtgacgcctcctgcagcgttctgggccctagtgcccccggtagccctgggtctgatagctctgatttctcttctgctagcagcgtttcctcctgtggcgcagtcgagtccagaagcagggggggcgcacgcgcggagcgccagcccgtggaacctcacatgggcgttgggcggcagcaaaggggtcccttccagggagttcgggtcaaaaatagtgtgaaggagctcctgcttcacataaggagccacaagcagaaagcttcaggccaggctgtagacgacttcaagacccaaggcgtgaacattgagcaattcagagagctgaaaaatactgtctcttatagtgggaagagaaagggccccgattctctgtctgacgggccagcgtgcaagagacccgcactccttcattcgcagttccttaccccaccccagactcctacacctggcgagagtatggaggatgtacacctcaatgaaccgaagcaggagtcctcagccgacttgttacagaatatcatcaacattaagaacgagtgttcacctgtctcgctcaacacagtgcagacatctagttccgttcagcagcaaaacgatgctcatctgcacagctttagtatgatgccgtcttcagcttgtgaagcaatggtcggacatgagatggcatcagactcctctaatacaagcctccctttctcgaatatgggtaatccgatgaatacaactcagctggggaagtccttgtttcagtggcaggtggagcaagaagaatcgaagcttgccaatatcagccaggaccaatttctctctaaggatgcggatggtgacacatttctgcatattgccgtagctcagggtcgccgtgctctctcttacgtgctggcccgcaagatgaacgctttacatatgttggacataaaggaacataacgggcagtcagcctttcaggtcgcagtggctgccaaccaacaccttatagtccaagatcttgtcaacatcggggcacaggtcaatacgactgattgttggggccggacaccattacacgtgtgtgcagagaaaggccattcgcaagtcctgcaggccattcagaagggggccgtgggcagtaaccagtttgtcgacctggaggccaccaattacgatggattaacacccctgcactgtgccgttatcgcacacaacgctgttgtacatgagctgcagcgcaatcagcagccccattctcccgaggtgcaggagctcctcctgaaaaataaatctctagtcgatactatcaagtgtctcatccagatgggcgcagcagtggaggctaaagataggaaatctggcaggaccgccttgcacttggcagctgaggaagctaacctggagctaataaggctttttctcgagctcccttcttgtctctcttttgtgaacgccaaagcctataatgggaacacggctttacacgtcgccgcatccctgcaatatcggctaactcaacttgatgcagtgagactgctgatgagaaagggcgcagatccttcgaccagaaacttggagaatgagcagcctgttcatctcgtacccgacggccctgttggagagcagatccggcggatcctgaaaggtaagagcattcagcagagagcgcctccctactag

SEQ ID NO: 126809 - DNA, 2157 bp, Artificial Sequence
  Description of Artificial Sequence: Synthetic coding sequence
atgatcgtggataaattactcgatgacagtcgcgggggagaagggctgcgtgatgccgccgggggatgcgggctgatgacttctccccttaacctgtcttacttctatggcgcctccccccctgccgcagccccaggagcttgtgacgcgtcctgctccgtcctcggaccctcagctcccggctcccctggctctgatagctctgacttttcctccgcatcctctgtcagtagttgcggtgcagtggagagcagatccagggggggggccagagccgaacgccaacctgtggagccccatatgggggtgggcaggcagcagcgaggcccatttcagggagtgcgagtcaaaaatagcgttaaggaactgcttctacacatacgcagtcataagcaaaaagccagtggacaagctgttgacgacttcaaaacacagggcgtaaacattgagcagttcagagaactgaagaatacagtgagttatagcggcaaaaggaagggacctgactctctctctgatggccctgcttgcaagagaccagccttgttacacagtcaattcctgacccccccacagacacctacccccggcgagagtatggaggatgttcacttaaatgagcccaaacaagagagctccgctgatctgttgcaaaacatcatcaatatcaagaatgaatgtagtccagtgagcctgaacaccgtgcaggtgagctggctgaatcctgtggtggttccacagtctagccctgcggaacagtgtcaggacttccacggaggacaagtgttttctcctccacagaagtgccagcctttccaggtgaggggatcacaacaaatgatcgatcaagcctcattatatcagtattcacctcagaaccagcatgtggagcagcagccccactatacccataagccgaccttggagtattcaccgttccccatccctcctcagagccctgcctacgaaccaaatttgtttgacggccccgagagccagttctgtccaaatcagtccctggtttctctactgggagatcagcgcgagtcagagaatattgcaaacccaatgcaaacgtcttcttctgtccagcaacagaatgatgctcacctccattccttcagtatgatgcccagtagcgcatgtgaagccatggtgggccacgagatggcaagcgattccagcaacacctccctaccgtttagcaatatggggaatccaatgaacacgacgcagctggggaaatctctgttccaatggcaggtagagcaggaggagtctaagctcgccaatatctctcaggaccaatttctgtccaaggacgccgatggagatactttcctccacattgccgtggcccaaggaagaagagccttaagctatgtgttggccagaaaaatgaacgccttacatatgctggacataaaagagcacaatgggcagtctgcatttcaggtggccgttgctgccaaccaacacttgattgtgcaggatctcgtgaatattggcgcacaggtgaataccactgactgctggggaagaactcccctacacgtttgcgccgagaaaggacacagccaagttctgcaagctatccagaagggagcggtaggatctaaccaatttgtggatcttgaggctacaaattacgacggacttacccctttacattgcgccgtgattgctcacaatgccgtagtgcacgagctgcagcgcaatcaacagccccattcacctgaggtacaggaactgcttttaaaaaataagagcctcgttgacaccataaagtgcctcatccagatgggggccgccgtagaagccaaggacagaaagagcggaaggaccgctttgcaccttgctgccgaggaggcaaatttagagctcatcaggctttttctcgaacttccttcctgtctgagtttcgtcaatgccaaggcttataatggcaataccgccttgcacgtcgctgcatcactccagtatcgcctgacacaacttgacgcagtcaggctcctcatgcggaagggcgctgaccctagcacgcgaaaccttgaaaatgagcagcccgttcaccttgtgcccgatgggccagttggagagcagatcaggaggattctgaagggaaaatctatccagcagagagcgcctccatattag

SEQ ID NO: 126810 - DNA, 1857 bp, Artificial Sequence
  Description of Artificial Sequence: Synthetic coding sequence
atgggtgttggccgacagcagagagggccttttcagggggtgcgcgtgaaaaactccgtgaaggagttgctcctccacatacgaagtcacaaacagaaagcctccgggcaggccgttgacgattttaagacacagggagtgaacatcgaacagttcagagagttgaaaaatacagtgtcctacagcggtaaacgcaagggacctgactccctgtccgatggacctgcgtgtaaaagacccgctctgttgcactcccagtttctcacccctccccagacacctacacctggggagtctatggaagatgtccatcttaacgaacctaaacaggaaagtagtgccgacttactccaaaatataatcaacatcaagaatgagtgcagcccagtgagcctcaatactgtccaggtgtcgtggttgaatccagttgttgtgcctcaatctagccccgccgagcagtgccaggattttcatggcggccaggtgttctcaccaccccagaaatgtcagccattccaagtgcgggggagccaacagatgatcgaccaagcctcgctataccagtacagtcctcagaaccagcacgtggagcagcagccacattatactcacaaaccaaccctggagtattcacccttcccaatccctccccagtctcctgcgtacgagcccaatctgtttgatgggcctgaatcacagttctgtcccaatcaatccctggtttccctcctgggggatcagcgcgagtcagaaaatatcgccaatccgatgcagacaagctcatccgtccagcagcaaaatgatgcccacctgcacagtttctctatgatgccgagtagtgcgtgcgaggccatggtcggacacgaaatggcttcggacagctcgaacacttccctgccatttagcaacatgggaaacccaatgaacaccacccaattgggaaagagtctctttcagtggcaagtggagcaggaggaaagcaagctggcaaacattagccaggatcagttcctcagcaaagacgccgacggcgacacattcctccacatcgcggtggcgcaaggaagacgagctttaagctacgtcctggctcgcaagatgaacgcgctccacatgctggacatcaaggagcataacgggcagtcagcctttcaagtcgcggtcgccgcaaatcagcaccttatcgtgcaggacttggtcaacatcggcgcccaagtgaacacgactgattgttggggtagaacccccctgcacgtgtgtgccgaaaagggacattctcaggtcctgcaggcaatacagaagggggccgtcggctccaatcagttcgtagacctggaagccaccaattatgatggcttaacacctctgcactgtgcggtgattgctcacaacgccgtggtgcatgagctacaaaggaatcaacagcctcacagccctgaagtgcaggagctgctgctaaaaaacaaatcactcgttgacactataaaatgtctgatccagatgggggcagccgtcgaagctaaggaccgcaaatcaggacggactgccttgcacctggcggccgaggaggccaacctggagttaatcagactgtttctggagctccccagctgcctcagtttcgtgaatgctaaggcctataacggaaataccgcccttcatgtggctgccagtctgcagtataggctcacacaattagacgccgttcggctcctcatgaggaagggcgcggacccttctactagaaacctcgagaacgagcaaccagttcatctggttcctgatggacccgtgggagagcagattcgacggatcctcaaaggcaagagcatccagcagagagctcctccatactag

SEQ ID NO: 126811 - DNA, 333 bp, Artificial Sequence
  Description of Artificial Sequence: Synthetic coding sequence
atgatcgtcgataagctgctcgatgatagcagaggcggagaaggtctcagggacgcagccggagggtgcggtctgatgacctctccactgaatctgagctacttctacggggcaagcccgcccgcagccgcccccggtgcctgtgatgctagctgttccgtcttaggaccaagcgctccaggatcaccaggaagtgatagttctgattttagttctgctagcagtgtctcttcatgcggggctgtcgaatcccggagccgtggcggggcccgggccgagcgacagcccgttgaaccacacatgggcgttggacgtcagcagcggggcccttag

SEQ ID NO: 126812 - DNA, 1806 bp, Artificial Sequence
  Description of Artificial Sequence: Synthetic coding sequence
atgggggtgggtcgccagcaacgaggcccatttcaaggagttagagtgaaaaactctgtgaaagaattacttctgcacattcgcagccataagcagaaggcctctggacaggccgttgatgacttcaagacacagggggtgaacatcgaacagtttcgggagttgaaaaacactgtgagctacagtgggaaaaggaaaggtcctgattcgctgtctgatggcccagcgtgcaaacgacctgccttactgcattcccagttcttgaccccaccacagacaccaactcccggtgagagcatggaggatgtgcacctcaatgaacctaaacaagaaagtagtgccgacctccttcagaacatcataaatattaaaaatgagtgcagccctgtcagtctcaacaccgtgcaggtctcctggctgaatcctgttgttgttccgcagtcaagcccagcagaacagtgccaagattttcatggagggcaggtcttcagccccccacagaaatgtcaaccgttccaggtccgtggttctcaacagatgattgaccaggcttccctgtaccaatattcgccccaaaaccagcatgtggagcagcagccccactatacacataaacctactctggagtacagcccgtttcccatacctcctcagtctcctgcctacgagcccaatctctttgacggcccagagtcccagttctgccccaaccagtcgctcgtatccctgctgggggaccaacgggagtccgaaaatattgccaacccaatgcaaacctccagtagcgtacagcagcagaatgacgctcatttgcattcattctcaatgatgccaagtagcgcatgcgaagcaatggtcgggcacgagatggcctctgactcatctaatacaagcctccccttctctaacatgggaaacccgatgaacacaactcaacttgggaaaagtctgttccagtggcaggtcgagcaggaagagtctaaactcgccaacatcagccaggatcagtttttaagcaaagatgcagacggcgataccttcttgcatatcgctgtagcccagggacggagggccttgagttatgtgttagcaagaaagatgaacgcactccacatgttggatatcaaagaacataacggtcagagcgctttccaagtcgccgtggcagcaaaccaacatctgatcgtgcaagacctagttaatataggggctcaagtgaatacaaccgactgctgggggcgaacacccctgcacgtatgcgcagagaagggacacagtcaggtcctgcaggctattcagaaaggtgcggttggcagcaatcagttcgtagacctggaggcaacgaattacgatgggctgactcccctccactgcgcagtaatcgcccacaatgcagtcgtgcacgagctgcagagaaaccaacagccccattcccccgaagttcaggagttacttctgaagaacaaatcactcgtggataccatcaaatgtctgatacagatgggagcagccgtggaggctaaggaccggaagagtgggaggaccgccttgcacctggccgcggaggaagctaatctggagctcattagactcttcctcgagctcccgtcttgtttgtcatttgtgaatgcaaaggcctacaacggaaacaccgcactgcacgtggcagcaagtttgcaataccgcctgactcagttagacgcagtgagactgcttatgagaaaaggtgcagacccttcaaccaggaatctcgaaaacgagcagccggtgcatttggtgccagacgggcctgtgggagagcaatag

SEQ ID NO: 126813 - DNA, 393 bp, Artificial Sequence
  Description of Artificial Sequence: Synthetic coding sequence
atgggcgtaggccgtcagcagcgcggcccatttcagggagtgagggttaaaaattccgtcaaggagctcctgttgcacatccgttcacacaagcagaaggcttccggccaagctgtcgacgacttcaaaacccaaggggtgaacattgagcagtttcgggagttaaagaataccgtgtcctattcaggaaagaggaagggaccggattccctgagtgacggcccagcctgcaagagacccgcccttcttcatagtcaattcctgacaccaccccagacacccacccctggcgagagcatggaagatgtgcacctgaatgaaccaaaacaggagagttctgctgatttacttcagaatatcatcaacatcaagaatgaatgttcacctgtgtag

SEQ ID NO: 126814 - DNA, 1101 bp, Artificial Sequence
  Description of Artificial Sequence: Synthetic coding sequence
atgtctaacccaagcccacaggtgcccgaagaagaagcatctacctccgtgtgccggcctaaatccagtatggcttctaccagtaggcgtcagaggcgcgaaaggaggttccgacgataccttagtgcaggtcgacttgttcgtgcacaagcgcttttgcagagacaccccggactggacgtcgacgctggccagcccccccctctgcaccgcgcttgcgcccggcatgacgcacctgctctgtgtctcctgctacgattgggcgccgatcccgcgcaccaagatcggcacggggataccgcactgcacgccgctgctagacagggacccgacgcttatacagacttctttctgccacttctttcccggtgtccctccgcaatggggattaagaacaaggacggtgagacgccagggcagattttgggctgggggcccccgtgggactcagccgaggaggaagaagaagatgatgcttccaaggagagagaatggcgccaaaaattacagggggatgcctcccacgagacacaggagccagaaagtttctcggcctggtcggatcggctagcaagagagcatgctcagaaatgtcaacaacaacaaagagaggccgaggggtctaggcgccctccaagggcggagggaagttctcagagctggcggcagcaggaggaggaacagcggctgttccgcgagcgcgctcgtgcgaaagaagaggagctcagggagtcccgggcacgccgagcccaggaagctctaggggaccgcgagccgaaacccacacgcgccggcccgcgcgaggagcacccccggggtgcaggtcggggctccctctggcggtttggcgatgttccctggccatgccccgggggaggtgacccagaagcaatggccgccgccttagtggctagaggaccacctctcgaagagcagggtgccctcaggcgctacctacgcgttcaacaagttcggtggcacccagatagattcttgcaacgctttagatctcaaatcgaaacttgggagctcggccgcgtcatgggtgctgttaccgccctgtctcaggctctcaacaggcatgccgaggctttaaaatag

SEQ ID NO: 126815 - DNA, 1077 bp, Artificial Sequence
  Description of Artificial Sequence: Synthetic coding sequence
atggctagcacctcccggaggcagcggcgagaacggcgatttcgaagataccttagcgccggccgcttggttcgtgctcaggcccttctacagcggcatcctggcctggatgtggatgccggccagccaccacccctgcacagggcgtgtgccaggcacgatgcccctgccctttgcctgcttttgcgcctcggggccgatcctgcccatcaggatcgacatggagatactgcacttcatgccgctgcaagacagggtcctgacgcgtacacggatttttttttgcccctgctctccagatgcccgagtgctatgggaatcaagaataaggatggcgaaacgcctggacagattctcggatggggaccaccatgggactctgcagaggaagaggaagaggatgacgcctctaaagaaagagagtggagacagaaacttcagggagaattggaagacgagtggcaggaggttatgggccgcttcgaaggagacgcctctcacgagacccaggagcctgagtctttctctgcatggtccgaccgtcttgctcgggagcatgcacagaagtgccagcagcaacagagggaagccgaggggagccgcagacctccgcgtgcagagggaagctcacagtcatggcgccagcaggaggaggagcagcggctgttcagagagcgagccagggctaaggaagaagaactacgagagagcagagccaggcgcgcccaagaggccctgggagatagagaacctaagccgacccgtgcaggaccacgcgaggaacaccccaggggggccggccgaggaagcctatggagatttggtgatgtcccatggccatgccctgggggcggcgaccccgaggcaatggctgcagccttggtggcgagggggccccctctcgaagaacaaggtgccctgcgcaggtatctgcgagtccagcaggtgcgctggcaccctgaccgctttctccagagatttcgcagccagatcgaaacttgggagctaggacgcgttatgggtgccgtcactgccctgagccaggctcttaacaggcacgccgaggctctaaaatag

SEQ ID NO: 126816 - DNA, 1146 bp, Artificial Sequence
  Description of Artificial Sequence: Synthetic coding sequence
atgtctaaccctagtccccaggtgcctgaggaagaggcctcgacctcggtgtgccgccccaagtccagcatggcatccacgtccaggagacagaggagagagcgcagatttagaagatacctctctgcaggtaggctggttcgcgcgcaggccttgctgcaaagacaccctgggctagacgtcgacgccgggcagccccccccacttcacagggcctgcgctcggcacgacgctccagcactctgtcttttgttgcgactgggggccgacccggcccaccaagataggcatggggataccgcgctacacgcagctgctcggcagggacctgacgcctacaccgacttttttctcccactcctttctaggtgccctagcgccatggggatcaagaacaaggatggagagaccccaggccagatcctggggtggggcccaccatgggattcagctgaggaagaagaggaggatgatgcatcgaaagaacgggaatggcggcagaagttacagggtgaattggaggatgaatggcaggaagtaatgggacgattcgagggagatgcttctcatgagacgcaagagccagagagcttttcagcatggagtgaccgactggcacgagaacacgctcaaaagtgtcagcagcagcagagggaggccgaggggtcgcgcaggccacctagagcagaaggttcctcgcagtcttggagacagcaggaggaggaacagcgtctgtttcgggaacgcgccagagctaaggaagaggaactgagagaatcacgagcacgcagggcgcaggaggccttgggcgacagggaacctaaacctactagggcaggcccaagagaggagcatcctcgaggagccggacgaggatcactgtggcgattcggggatgtcccctggccttgccccggtggcggcgatcctgaggcgatggcggcagcccttgttgcacgggggccaccgttagaggagcaaggagctctgaggcggtatcttagggtacaacaagttaggtggcaccctgatcgctttcttcaacgcttccgatcccagatcgagacatgggagttgggtcgcgtaatgggtgccgtgaccgcattatcacaagctctgaaccgtcatgctgaggcactgaagtag

SEQ ID NO: 126817 - DNA, 1101 bp, Artificial Sequence
  Description of Artificial Sequence: Synthetic coding sequence
atgtccaacccgtcaccccaggttccagaagaggaggcatcaacatctgtgtgccgccccaagtcatctatggcctcaacctcaagaaggcaaaggcgtgagcggagatttcggcgctaccttagcgccggacgcctggtgcgggcccaagcattactccagcgccaccccggactcgatgttgacgcaggccagcctccccctctccacagggcttgcgctcggcacgatgccccggcactgtgtcttttacttcgcctgggcgctgacccggcccatcaggaccggcacggagacactgcacttcacgccgcagcacgacagggtccggacgcatacactgatttcttcctgcctttactgagcagatgtccttctgcaatgggaatcaaaaataaagacggcgagacaccggggcaaattttgggatggggtcccccatgggactctgctgaggaggaggaggaggacgacgcttctaaagagcgcgagtggcgacaaaaattgcaaggggacgcttctcatgaaactcaggagccagagagctttagcgcttggagtgacaggctggcacgtgagcatgctcaaaagtgccagcagcagcagcgtgaggctgaggggagctgccggccacctagagctgagggctcgagtcagtcttggaggcaacaggaggaggagcagcgcttatttcgagaacgggcccgggccaaagaggaagaacttagagagtctagagcccggagggcccaggaggccctcggcgatcgggaaccaaagcctacaagggccgggccccgcgaagaacaccctaggggtgccggccgggggtcactgtggcgttttggtgacgtgccttggccctgcccagggggcggtgacccagaagctatggcagcagcactggtggcacgcggccccccactggaggagcagggcgcactgcgcaggtacctcagagtccagcaagtgcggtggcaccccgatagattcctacagcggtttagatcccagatagagacctgggaacttgggcgcgtgatgggggcagtcacggccttgagtcaggccctcaaccgacatgccgaagctctcaaatag

SEQ ID NO: 126818 - DNA, 1077 bp, Artificial Sequence
  Description of Artificial Sequence: Synthetic coding sequence
atggcgtccacttcccgcaggcaaaggagggaacggcgattccggaggtacctgagtgccggcaggctggtgagagcacaggccctattacagcgccatcccgggttggacgtcgacgctggtcagccacctccactacaccgggcttgcgcaaggcacgacgcacctgcactgtgtctgctgctgagattaggggccgatcccgctcatcaggaccgccatggggataccgccctgcatgcagccgcccgccaaggccccgacgcatataccgacttctttttgcccctgctgtcacggtgtccaagtgccatgggaatcaaaaataaagacggcgaaacaccagggcaaatactcgggtggggtccaccctgggacagtgccgaggaggaggaagaagacgacgccagtaaggagcgcgagtggcgccagaagttgcagggcgaactggaggacgagtggcaggaggtaatgggacggtttgaaggggacgcttcacacgaaacacaggagcccgagtcctttagcgcttggtcagacaggcttgcgcgcgagcacgctcagaagtgccagcagcagcagcgggaagccgagggcagctgtcgtcctcctcgggctgaagggagtagccagtcttggaggcaacaggaggaggagcaaagattatttcgcgagagagcccgcgcaaaggaggaagagcttagggaaagcagggcccggagggctcaggaggctctgggcgatagagaacccaaacctacgcgagctggtcctagagaagagcatccccgcggcgcaggtaggggaagcctatggaggtttggagacgttccatggccctgcccaggtggaggcgaccctgaagctatggctgctgccttagtggcacgtggcccacctctggaggagcaaggcgccctcagaaggtatctacgggtgcagcaagtgagatggcaccccgaccggttcttgcagcgcttcagatctcagattgaaacttgggagctaggtagggtcatgggagcagttaccgccctttcccaggccctgaataggcatgctgaagccctaaaatag

SEQ ID NO: 126819 - DNA, 1146 bp, Artificial Sequence
  Description of Artificial Sequence: Synthetic coding sequence
atgagcaaccccagtccccaggtgccagaggaggaggcttctacatcagtgtgtaggcctaagagttcgatggcttcgacgtccagacgccagaggagagagcgacggtttcgcagatatttatctgcaggccggttggtgagggctcaggccttgctacagcgtcacccaggtctggacgttgacgctggccagcccccccctctgcaccgggcatgtgctcgccacgacgcgccagccctgtgtctgctactgcgactgggcgcggaccccgcacaccaggacagacacggggacaccgccctgcacgcagccgcacgacagggcccagatgcctataccgatttctttctccctctcctgtcccggtgcccctccgcgatgggaatcaagaacaaagacggagaaacccccggccaaatacttggatgggggcctccatgggactctgctgaggaagaggaggaagacgatgcctctaaagagagggagtggcgccagaagctccagggtgagctggaggatgagtggcaggaagttatgggacgattcgaaggggatgcatcacacgaaacccaggaacctgaaagcttctccgcatggagcgacagactcgccagggagcacgcacagaagtgtcaacaacaacagcgtgaagcggaagggtcttgtcgaccacctcgggcggaaggaagtagccagagttggcgtcagcaggaagaggaacagaggttgtttcgggagcgcgcccgggccaaagaagaggaattgcgcgagagcagagctagaagggcccaggaggcgctcggcgacagggagccgaagcccacgagagccgggcccagggaggagcatcctcgcggtgctgggagagggtcgctctggcgatttggagatgtgccatggccctgtccgggtggaggcgatcctgaagcgatggctgctgcattagtggcacggggtcccccgctcgaagaacaaggcgcattgcgccggtatctgagggtgcagcaggttcgttggcacccagatcgttttcttcaacgattccgtagccagattgagacctgggaactgggccgagtgatgggagcggtgacagccctgagccaggcgttgaaccgccacgctgaggctctcaaatag

SEQ ID NO: 126820 - DNA, 1101 bp, Artificial Sequence
  Description of Artificial Sequence: Synthetic coding sequence
atgagcaatccgtcccctcaggtcccagaggaggaggcatctacaagcgtgtgcaggccgaagagttccatggcctcgacctcacgcaggcagcgccgcgagaggcggttcagaaggtacctctctgcagggcgattggtcagagcccaggccctcttgcagcgccaccccggcctggatgtagacgccggccagcctccccctctccatcgggcatgtgcaagacatgacgccccagctttatgcctactcctcagattaggagccgatccggcacatcaagacagacatggtgacaccgccctccatgcagctgcccgacagggacccgatgcgtacactgactttttcctccccttgctcagtaggtgcccatccgccatgggcattaagaacaaggacggagaaacacctggccagatcctgggatgggggcctccttgggatagcgcagaggaggaagaagaggacgatgcatctaaggagcgggagtggaggcaaaagctccaaggcgacgccagccatgagacacaggagcccgagtctttttccgcgtggagcgatcgtctagcccgcgagcatgcccagaagtgccagcagcagcaacgggaagcggagggaagttgcagaccccccagagctgagggctctagccagtcatggagacagcaggaagaggaacagcgattgtttcgtgaaagggccagggccaaagaagaagaactgcgcgaaagtagagctaggcgcgctcaagaggccctgggcgaccgagaacctaaaccgacaagggcggggccaagagaggaacacccacgtggagccggcaggggcagcctatggcggttcggagacgtgccatggccctgcccagggggcggggatccggaggccatggcagctgcccttgttgccaggggtcctcctttagaggaacagggcgctctgagacgctaccttcgggttcagcaggttagatggcatccagaccggtttctccaaagatttagatcccagatagagacctgggagttaggtagggtcatgggcgcagtgacagcgctgagtcaggccctgaatcgccacgccgaagcccttaagtag

SEQ ID NO: 126821 - DNA, 1146 bp, Artificial Sequence
  Description of Artificial Sequence: Synthetic coding sequence
atgtctaaccccagcccacaggtaccggaggaggaagcctcgacctccgtgtgccgacccaaaagcagcatggcatcaacaagccgacgccagcgtagagaacgcagattccggagatacttaagcgcaggaaggctggtgcgcgcccaagcattgttgcagcgtcacccgggtctagatgttgacgccggacagcctcctccgctgcaccgggcctgcgccagacatgacgcccccgcgctgtgcttattactgcgcctaggtgccgaccctgcacatcaggacagacatggcgataccgcccttcatgcagcggcccgacaagggcctgacgcatacacggattttttcctaccgctattgagccgctgcccaagcgctatgggaatcaagaacaaggatggggagaccccgggccagatactgggctggggtcccccctgggatagtgctgaggaggaggaagaggacgacgcttccaaggaaagggaatggcggcaaaagctgcaaggcgaactcgaagacgagtggcaggaggtaatggggaggttcgaaggcgatgcctcacacgagactcaagagcctgagtccttttccgcttggagtgatcggcttgccagagaacatgctcagaaatgccaacaacaacagcgcgaagccgagggatcttgtaggccccctcgggccgagggctcctcacagtcatggcgtcagcaggaggaggagcagagactgttccgagagcgcgccagggccaaagaggaggaactgagggaatcccgggcaaggcgcgcacaggaagctctcggcgaccgggagccaaaacctacgagagccggtcctcgtgaagagcatcctcgaggcgctgggcgcggctcactctggaggtttggagacgtgccttggccctgcccaggcggaggggacccagaggccatggctgccgcattagtcgctaggggtcccccactagaggaacagggcgctctgcggcgttatctccgagtccagcaggttcgctggcaccccgaccgctttctgcagcgatttcgctctcagatagaaacttgggagcttggtagagttatgggagccgtaaccgcactctcgcaggcactgaatagacacgccgaggcactgaagtag

SEQ ID NO: 126822 - DNA, 1101 bp, Artificial Sequence
  Description of Artificial Sequence: Synthetic coding sequence
atgtctaaccctagtccacaggtacccgaagaggaggccagcacctcggtgtgtaggcctaagtcctccatggcatccacgagccggcggcagagacgggaacggagattccggaggtatctcagtgccgggagactggttcgggcgcaagcccttctgcagagacatcccggtctcgatgtagatgccggtcagccccctccgctccatcgcgcttgcgcacgccatgacgccccagccctgtgcctgctgctgcgcctcggtgctgacccagcacatcaggacagacacggagataccgcccttcacgccgccgcccgccagggtccagatgcctacacagactttttcttgccattgttaagccgctgccctagcgctatgggaattaaaaacaaagatggcgaaactcccggccagatcctcggatggggacctccatgggatagcgccgaggaagaggaagaggacgacgctagcaaagagcgcgaatggcggcagaagctgcagggtgacgccagccatgagacacaggagccagaatcctttagtgcttggagtgacaggttggctagggagcacgcacagaagtgtcagcagcaacagagggaggccgaggggtcttgccgccctccacgtgccgaaggaagctctcaatcttggaggcagcaggaagaggagcagaggctgttccgggaacgagctcgcgctaaagaggaggaactgcgggagagccgggcccgccgagcgcaagaggccctcggcgacagggaacccaaacccaccagggctggcccccgcgaagagcaccctcgaggggccgggagagggagtttgtggcgatttggagacgtcccatggccctgtcccggtgggggggacccggaggcaatggctgccgctttggtggctagagggcctcctctggaggaacaaggggctctaagaagatatctgagggtgcagcaggtcaggtggcaccctgaccgcttcctgcaaagatttcgaagtcaaattgagacctgggaattggggagggtgatgggagccgtaacagccttatctcaggcactcaatagacacgctgaggcactgaaatag

SEQ ID NO: 126823 - DNA, 1101 bp, Artificial Sequence
  Description of Artificial Sequence: Synthetic coding sequence
atgtcaaatcctagtccacaggtgcctgaagaagaagcgagcaccagcgtgtgtagacctaagagctcaatggctagcaccagccgccggcagaggcgggaacgacgctttcggcggtacctaagcgcaggacgcctggtgcgtgcccaggccttgttgcagcggcatcccgggcttgacgtcgatgcggggcaaccacctccacttcatcgtgcttgcgccagacatgatgctccggcactgtgtctgctcctgagattaggcgctgatcctgcgcaccaggacagacacggagacacagcactgcatgctgccgcacgacagggtcccgacgcctataccgacttcttccttccactgctgtcccgctgtccctccgctatgggaatcaagaataaggacggggagacacctgggcagatacttggctggggcccaccctgggatagcgccgaagaggaagaagaagacgacgcatctaaagaacgcgaatggcggcaaaaactgcagggagacgcctctcatgaaacacaggaacctgagagtttctctgcttggagcgacagactagctagggaacatgcacaaaaatgccagcaacaacaacgagaagccgaaggaagctgtcggccccctcgagcagagggcagcagccagagttggaggcagcaggaggaggagcagcggctctttagggagagggctcgggcaaaggaggaggagttacgcgagagccgtgcgcgaagggctcaggaggccttaggggatcgagagccaaaaccaacgcgcgccgggcccagagaggagcacccacgcggggccggtagggggtccttatggcgcttcggtgacgtgccctggccatgccccggcggtggcgaccctgaggcgatggccgccgccctcgtggcccgcgggcccccattggaagagcagggcgcgctgaggcgctacctaagggtgcagcaagtgagatggcacccagaccggtttttacagagattccgaagtcagatagaaacctgggagctgggcagggtgatgggcgcagtgactgcactgagccaggcccttaaccggcatgccgaagccctgaaatag

SEQ ID NO: 126824 - DNA, 1146 bp, Artificial Sequence
  Description of Artificial Sequence: Synthetic coding sequence
atgtctaatccaagtccacaggtgccggaagaggaggcaagtacatcggtgtgtcgacccaaaagttccatggctagcaccagtaggcggcagcggcgcgagcggagatttaggcggtacttgtccgctgggcggctggtccgggcacaggccctgctgcagcgccatccaggtctagacgttgacgccgggcaacctccaccactccatcgcgcatgtgcccggcatgacgctccggccctttgtcttttgctcaggttaggggcggatcctgcacaccaggacaggcatggagacacagccctgcatgcagccgcccggcagggacccgacgcctatactgacttcttcctacctctcttgagtcgctgcccttcagctatgggaattaagaacaaggatggagagactcctggccagattctgggctggggaccaccatgggattccgccgaggaggaagaggaggacgacgcctcaaaggagagagagtggcgtcagaaactccaaggcgagcttgaggacgaatggcaggaggtgatgggtagattcgagggggacgcaagccacgagactcaagaacccgaatctttcagcgcctggagcgacaggcttgccagggaacacgcacagaaatgtcagcaacaacagagggaggccgagggtagctgccgaccgccgcgggcggaagggagctcccagagttggcgccagcaagaggaggagcagcgtctgttcagggaacgagcacgggctaaggaagaagagctgcgggaaagtagagcaagaagagctcaagaggctctgggagatcgggaacccaagcccactcgtgccgggcctagggaggaacaccccagaggcgccggaagaggcagcttgtggcgcttcggtgacgttccttggccgtgtcctggaggcggagacccggaagccatggctgcagctctcgtggctcgcgggccacccttagaggagcagggagccctgagacgatatctgagagtacagcaggtccgctggcatcccgaccgatttctgcagaggttcaggagtcagatcgagacttgggaactagggcgggtgatgggtgcagtaacagccctgtctcaagctctgaatcgccatgcggaagccctcaaatag

SEQ ID NO: 126825 - DNA, 1077 bp, Artificial Sequence
  Description of Artificial Sequence: Synthetic coding sequence
atggcttctacgagtagaagacagcggcgggaacggagattcaggagatacctatccgccgggcgcttagtcagggctcaggcgctgttacagcgccacccgggtttagatgtcgacgcgggccagcctcctcccttgcaccgggcatgtgcacggcacgatgctccagcgctgtgcctgctattgcgcctgggtgcagaccccgcgcatcaggataggcatggagacactgccttgcatgcagcagccagacaaggccccgacgcttacacagactttttcctccccctgctctctagatgccccagcgctatgggcataaaaaacaaagacggcgagactcctgggcagatcctaggatggggtccaccctgggacagcgccgaggaggaggaggaagatgatgcttctaaggaacgcgagtggcgccagaagttgcagggagaactcgaggatgaatggcaggaggtgatgggacgctttgagggagacgccagccacgaaacacaggagcctgaatctttttccgcatggtcagacagacttgcaagagagcacgcacagaagtgtcagcagcagcagcgagaggctgagggatcctgcagacctccacgggccgaaggcagtagtcagagttggcgccagcaggaagaagagcagaggctcttccgggaaagagcaagagccaaggaggaagaattacgagagagcagggcgaggcgggcacaggaagcgttgggcgacagggaaccaaagcctacccgggcgggacccagggaggagcatcccaggggcgccggccgcggcagtctgtggcgtttcggagacgttccatggccatgtcccggggggggcgaccctgaggctatggctgccgccttggtagcccgcggacctccgctcgaggagcagggtgcccttagaaggtacctgcgagtacagcaagtgcggtggcacccagacaggtttcttcagcggttccgctcccagatcgaaacgtgggaactcgggagagttatgggtgcagtcaccgcgttatctcaggccctgaacagacatgccgaggccctgaagtag

SEQ ID NO: 126826 - DNA, 1101 bp, Artificial Sequence
  Description of Artificial Sequence: Synthetic coding sequence
atgtctaatcctagccctcaggttccggaagaagaagcctcaacttccgtttgccggccaaaatcttctatggcttctactagtaggcggcagcgcagggagaggaggttcaggcggtatctgtctgccgggagacttgtgagagcccaagctcttctgcagaggcatccgggcctggatgtcgacgcaggacagcctcccccattgcacagagcctgcgcacgccacgatgcccctgctctctgtcttctgctccggctcggagcagacccggctcaccaagatcggcacggtgataccgcactgcacgcagcagcaagacagggaccggatgcctacacagatttcttcctccccctattgagtcgctgtcctagcgccatgggtattaagaataaggatggcgagaccccgggccagatcctggggtggggacccccttgggactcagccgaggaggaggaagaggacgacgccagcaaagagagagagtggagacagaagctacaaggcgacgcgagtcatgagactcaggagcccgagtcattttctgcctggagcgacagactcgcgcgagagcatgcccagaagtgccagcaacaacaaagagaggccgaaggctcatgtaggcctccccgcgccgagggaagcagtcagagttggcgccaacaagaggaggaacagagactgttccgagaacgcgcacgagccaaagaagaggagctgcgggagtcccgggcccgcagggcccaggaagccctgggcgatagagagccaaagccaactcgggcggggccccgcgaggagcatccgcgaggggcaggaagaggcagcctatggcggtttggtgacgtgccgtggccttgccccggggggggcgaccctgaggccatggccgctgcattagtggctcgtggacccccgcttgaggaacagggcgcacttcgcaggtatttaagggtgcaacaggtgaggtggcacccagacagatttctgcagagatttaggagtcagattgagacttgggaactcgggcgggtgatgggtgctgtcacggcgctatctcaggcgctcaaccgacatgcagaggcactgaaatag

SEQ ID NO: 126827 - DNA, 1077 bp, Artificial Sequence
  Description of Artificial Sequence: Synthetic coding sequence
atggcaagcacatctcgccgccagaggcgtgaaaggcgattccgccggtatctgagcgccgggcgcctcgtccgcgcccaggctctccttcagcgccacccggggctggacgtggacgcagggcagccgcctccattgcatcgtgcctgcgcgcgccatgacgcccccgcactgtgtctgttgctcagactgggggctgatccagctcatcaagatcgccatggagacacagctctgcacgcagctgcaagacagggacctgacgcttacacagacttttttctgccactgctgagtagatgtccgagcgccatgggcatcaagaacaaggacggggagactcctggacaaattcttggatggggaccgccgtgggattcagcggaggaagaggaagaggacgacgcatctaaggaacgggagtggcgtcaaaaactgcagggggagctggaagatgagtggcaggaagtgatgggacgctttgaaggggatgcttctcacgaaactcaggagcccgagtcatttagcgcgtggtccgatcgtctcgctcgcgagcacgcccaaaaatgtcagcagcaacaacgtgaggccgagggctcctgtagacccccgagggctgaaggttcctctcaatcttggcgtcagcaagaagaggaacaaaggctttttagagagagggcccgggcaaaagaagaagagctccgcgaaagtagggcacgaagagcccaggaggccctcggcgaccgcgaacccaagcccacccgggctggccccagggaggagcatcctcgcggcgcaggaaggggctcactgtggcggtttggcgatgtcccctggccttgtcccggcggtggcgatccagaggcaatggctgctgcactggtggcccggggacccccgctcgaagagcaaggcgctctacgccggtacctgcgagtccagcaggttaggtggcatcctgacaggtttcttcagcggtttaggagccagatcgaaacttgggagttgggaagagtcatgggagctgtgacagcgctttcacaggccctgaatcggcacgccgaagctcttaagtag

SEQ ID NO: 126828 - DNA, 1146 bp, Artificial Sequence
  Description of Artificial Sequence: Synthetic coding sequence
atgagcaacccaagcccccaggtgcctgaggaggaggcatccacgagcgtctgtagacctaagagctcaatggcttccacttcaaggcgccaaagacgtgagagacggttccgccgctacctgtcagcagggcggctggtgagggctcaggctcttctgcaacggcacccggggttggatgttgatgcaggccaaccaccgccattacaccgagcgtgcgccaggcatgatgctcccgctttatgtttactcctgagactcggagccgatccggcacatcaggacaggcacggagataccgctctgcacgctgcagctagacagggcccggatgcttacaccgatttttttcttcctctgctgagcaggtgtccctcagctatgggcattaagaacaaggacggagaaactcccggccagatactcgggtggggaccaccctgggactcggcagaagaggaggaggaggatgatgcgagtaaagagcgcgagtggcgccagaaactgcaaggggaactggaggacgagtggcaggaagttatgggtaggtttgaaggtgatgcaagtcacgagacgcaggaacccgagtcattttccgcttggagcgatcgtctggctcgcgagcacgcacagaagtgccagcagcagcagagagaagctgagggaagctgtcggcccccccgagctgaaggatcatcccagtcctggagacaacaggaggaagaacagcgcttgtttcgggaacgagcccgggccaaggaagaagaactgcgggagtcccgtgcaaggcgggcacaggaagctctcggggatcgcgagcccaagccaacccgcgcagggccgcgggaagagcatccgcgaggtgcaggcagaggctcattatggcgcttcggagacgtgccctggccttgcccaggaggcggcgaccctgaggcaatggctgcggctctggtggcccgaggtcctcctctggaggagcagggagccctccgcagatacttgcgggtccagcaggtgcgttggcacccagaccggtttctgcaacggttccgaagccagatcgagacatgggaactaggtcgagtgatgggtgcggtgactgctctgtcccaagccttaaaccgccacgcagaagctcttaagtag

SEQ ID NO: 126829 - DNA, 1077 bp, Artificial Sequence
  Description of Artificial Sequence: Synthetic coding sequence
atggcaagcacctcgagacgtcagaggcgagagagacgtttccggcggtatctaagtgccggcagacttgtgcgcgcccaggccctgctccagcgccatcctggtttagacgttgacgccggccaacctccgcctttgcacagggcatgcgctcgccacgacgctcctgccctgtgcttgctgttgaggctgggggcggatcccgcccatcaggatcgacatggcgataccgccctccatgctgctgcacgccagggtccagatgcctacaccgatttcttccttccactactaagccggtgccctagtgccatggggattaagaacaaggatggggagacccctggccagatcctgggatggggaccgccctgggattccgcagaagaggaagaggaggacgatgccagcaaggagagagagtggagacagaagctccagggcgaactggaagatgaatggcaggaggtcatgggccgctttgagggagacgcctctcatgagacccaggagcccgaaagctttagtgcatggagcgataggctcgctcgcgaacacgcccagaaatgccagcagcaacaacgggaggctgaaggctcgtgccgcccgcctagagccgagggctcctcacaatcctggagacagcaagaagaggagcagcgcttgttccgtgaacgcgcccgggctaaggaggaagaacttcgtgaaagccgcgctaggcgagcccaggaggccctcggggacagagagccaaagcccacccgtgcagggcctagggaggagcatccaagaggtgctggaagagggtcactttggcggttcggcgatgtgccatggccgtgtcctgggggaggggatcctgaagcaatggctgccgcgctggtggccagggggcctccactggaggagcaaggagcattgaggagatacttgcgggtgcagcaagtccgctggcatcccgatcgttttctacagagattccggtcccaaatcgagacatgggagctcgggcgggtgatgggcgctgttactgctttgagccaagccctcaatcggcatgccgaggctttgaaatag

SEQ ID NO: 126830 - DNA, 1146 bp, Artificial Sequence
  Description of Artificial Sequence: Synthetic coding sequence
atgtccaacccgtccccgcaggtgcctgaggaggaggcaagcacctccgtatgtcggccaaagtcctctatggcctcaacttctagaagacagaggagagagagacgcttcaggcggtatctgtctgccggaagactcgtgcgcgcacaggcattgctgcagcgacaccctgggctggacgtggatgcaggccagccaccccccttgcaccgagcttgcgcacggcatgatgcccccgctctgtgtttacttttgcgcctcggagccgaccccgcccaccaggaccgacacggtgatacagcacttcatgcagctgcgaggcagggccccgatgcgtatactgatttcttccttcctcttctgagccgctgcccctctgccatggggattaagaacaaggatggcgagacgccaggccagatcctgggatggggacccccttgggactctgccgaagaagaggaggaagatgatgcctcaaaggagcgagaatggcggcagaagctccagggggagctggaagatgagtggcaggaggtgatgggcagatttgagggcgatgctagccatgagactcaggagcccgagtcttttagcgcctggtctgaccggttggccagggaacatgcccaaaaatgccagcagcaacagcgagaggccgaaggatcttgtcgcccgccacgggcggaaggctcctcacaatcttggcggcagcaggaggaagaacaaagactctttcgtgagagggccagagccaaggaggaagagctgagagagtcacgggcccgccgagcccaggaagcactgggggaccgtgagccaaagccaactagagctgggccgcgcgaagagcaccccagaggtgctggccgaggaagtctgtggagattcggcgatgttccctggccctgccctgggggtggcgaccccgaggcaatggccgccgctctcgtggcgcggggaccccccctggaagaacaaggcgcccttagacgttatctgagagttcagcaggtccgctggcaccctgacaggtttttgcagaggtttaggtcacaaatagaaacatgggagttagggcgggtcatgggtgccgtcaccgccctgagccaggcactcaaccgccatgccgaggcgctgaagtag

SEQ ID NO: 126831 - DNA, 1101 bp, Artificial Sequence
  Description of Artificial Sequence: Synthetic coding sequence
atgagcaacccgtctccacaagtgcctgaggaagaagcaagcacatcagtatgtcgtcctaaatcatccatggccagcacttccaggagacagagacgcgaaaggcgctttcggaggtatctcagtgctgggagacttgtgagggctcaggccttgttacagcgccacccagggcttgacgtagacgccggacaacctcccccgctgcaccgcgcttgtgctcgacacgatgcccccgctttgtgcctattgcttcggctgggtgccgatccagcccaccaggatcgccatggcgacacagctctacatgcggctgcgcgccagggaccagacgcatacacagactttttcctcccgcttctgtctcgctgcccctctgccatgggaattaagaacaaggatggtgagactcctggccagatacttggctgggggccaccttgggattcagcagaagaggaagaggaagacgacgccagcaaagagcgtgagtggcgccagaagctgcagggcgacgcaagtcatgagacgcaggagccagagtccttcagtgcttggtctgacagactggctagagaacacgcgcagaagtgccagcagcaacagcgcgaggccgaaggaagctgccgcccccctcgcgccgaaggctcgagtcagtcgtggcgtcagcaggaggaagaacagcgtctgttcagggagagggcgagagccaaagaggaagagctcagggaaagccgcgcacggcgcgcccaggaggcactcggagatagggagcccaaaccaacacgtgcaggacctcgcgaagagcatcccaggggcgctgggaggggcagcctttggagatttggcgatgttccctggccttgccccggaggcggcgatcccgaggccatggcagccgctctggtcgccagagggccccccctcgaggaacagggagcactgagacggtacctgcgggtccagcaagtgcgctggcatccagatcgcttcttgcagcgttttagatcgcagatcgagacttgggaactgggaagggtgatgggcgcagttactgccctctcacaagccttgaacaggcacgccgaggcactgaaatag

SEQ ID NO: 126832 - DNA, 1077 bp, Artificial Sequence
  Description of Artificial Sequence: Synthetic coding sequence
atggcttcaacctcacgccggcaacggcgggagcgtcgtttccgtcgatacctatcagcgggtcggcttgtccgggcccaggctcttttgcagcggcacccgggcctggacgtcgacgctggccagccccctccccttcatagagcatgtgcacgccatgatgcccccgccctgtgcctgctgttaagactgggagcagacccagcacaccaggaccggcacggggataccgcccttcacgctgccgcccggcaagggccagacgcctacactgacttttttttacccctcctgtctcggtgcccctcggctatgggaattaagaacaaggatggcgagaccccgggccagattctgggctggggtcccccatgggactccgccgaagaagaggaagaagacgacgcatccaaggagagagagtggcggcagaagcttcaaggagaactcgaagacgaatggcaagaggtgatgggcagattcgaaggcgacgcatcccacgaaacccaggagcctgagtcgtttagtgcgtggagcgacagactggcccgagaacacgcccagaaatgtcaacagcagcagcgggaggcagagggttcctgtagaccaccacgagctgaggggagcagccaatcctggcggcaacaagaagaagagcagagactcttcagagaacgagcccgggcgaaagaggaggagttgagggaaagtcgcgctcgaagggcccaggaagctctgggagatagggaacctaagccaacccgagctggacctagggaagagcatcccagaggggcaggtaggggatccctgtggagatttggcgatgtcccttggccttgcccaggaggaggcgatcccgaagccatggcagcagctctcgtagcccgaggacctccattggaggaacagggagcactgcggagatatttgagagtccagcaagtgcgatggcatcccgataggttcctgcagcgctttaggtcccagattgagacttgggaactggggagagttatgggtgctgtgacggccctcagccaggcactgaatcggcacgcagaggccctcaagtag

SEQ ID NO: 126833 - DNA, 1146 bp, Artificial Sequence
  Description of Artificial Sequence: Synthetic coding sequence
atgagcaatccatctcctcaagtccctgaggaggaagcaagcacctccgtgtgccgacctaaatccagcatggcgtcgacttccaggagacagaggagagagcgtcgattcaggaggtacctgtccgccggcagactggtgcgggcacaggccctcctgcagcgacatcccggcctggatgtcgatgcaggccagcctcctcctctacaccgagcatgtgcacggcatgacgcacctgccctgtgcctgctactgcgactgggagctgatccggcgcaccaggatcgccacggggatacggctcttcatgccgcagctcgtcaggggccagatgcatacactgacttcttcttgcccctcctgagccgatgtccatccgctatgggcataaagaacaaagacggagagacccctggacagattctgggatggggtcctccttgggactctgcggaggaggaggaggaagacgatgcctcaaaggagcgcgagtggcggcagaaacttcagggggagttggaggacgaatggcaggaagtcatgggacgcttcgagggggacgcttcacacgagacacaggagcccgagtctttttcagcttggtctgaccgcctggccagggagcacgcacaaaagtgccaacagcagcaacgtgaggccgaagggagctgtaggcccccccgggctgaagggagttcacagagctggagacagcaggaagaggagcagcgtttgttccgagaacgtgcacgcgcaaaggaagaagagctcagggagtcacgggcaagaagagcacaggaggcactgggtgatcgcgagccaaaacctacaagggccggccctcgggaagaacacccgcgtggcgctggtagaggcagtctgtggagatttggcgacgtgccttggccatgtccaggaggtggggacccagaagctatggctgccgccctggtggcaagagggccacccctggaggagcaaggcgctctgagaagatatctacgggttcagcaggtcaggtggcatcccgataggtttctgcagcgtttccgatcccaaattgagacttgggagttgggccgggttatgggcgccgttactgcactatcccaggcccttaaccgccatgccgaagccctgaagtag

SEQ ID NO: 126834 - DNA, 1077 bp, Artificial Sequence
  Description of Artificial Sequence: Synthetic coding sequence
atggctagcacttcccgtagacaacggcgcgaacgccggttcagaagataccttagcgccggaaggcttgtgcgtgcccaggcacttctgcagcggcatccaggcttagatgtggatgcggggcagccaccacctctccatcgcgcatgtgccagacacgacgccccagccctttgcctcctgctgcgcttaggcgccgacccagcacaccaggaccgccacggcgacacagcactgcacgcagctgctagacagggcccagatgcttatactgatttcttcctgcctctgctttccaggtgcccgtccgcaatgggtatcaaaaacaaagatggcgagacacctggacagattctgggctggggacctccctgggacagcgccgaggaggaagaagaagatgacgcctccaaggaaagggaatggaggcaaaaactgcagggagaattggaagacgagtggcaggaggtgatgggaaggttcgagggcgacgcgtctcatgaaacccaggagccagaatcgtttagcgcatggtccgaccggctggcccgtgaacacgctcagaagtgccagcagcaacagcgtgaggctgagggatcatgcaggccacctcgcgcagaaggatcatcacagtcttggcgccaacaggaagaagagcagagattatttagagagagggccagagctaaagaagaggagcttagggaatccagagcccggagggcccaagaagcacttggcgacagagagcccaagcctaccagggccgggccacgcgaggaacaccctcggggcgccggacgaggcagcctgtggcgctttggtgacgtgccttggccgtgtcctgggggcggggacccagaagcgatggccgccgcccttgtggctaggggaccaccactggaagaacaaggtgcccttagacgttatttgagagtgcagcaggtgcggtggcatcctgataggttcctgcagagatttagatcccaaatagaaacctgggaacttggaagagtcatgggagcagttactgctcttagccaggccctgaatcggcacgctgaggctctgaaatag

SEQ ID NO: 126835 - DNA, 699 bp, Artificial Sequence
  Description of Artificial Sequence: Synthetic coding sequence
atggcgtctacttctcggcgccagaggcgggagcgccgttttagacgatacctttcagccggaagactggtacgagctcaagctcttcttcagcggcaccccggactggatgtcgacgctgggcaaccacctccgttgcatcgcgcatgcgcccggcatgacgctccagctctgtgcttgctcctcaggctgggtgccgaccctgcccatcaggatcgccatggggataccgccctgcacgcggctgcaaggcagggtcctgacgcctacactgattttttcttacctctgctctccagatgtcccagcgctatgggtataaagaacaaggacggcgagactcccggacagatattgggctggggtcctccttgggattccgccgaggaggaagaggaggacgatgccagtaaagaacgagaatggagacagaaattgcagggtgagctagaggatgagtggcaggaagtgatggggaggtttgagggcgacgcaagccatgagactcaggaacccgagtccttttccgcctggtcggatcggctggcccgggagcatgcccagaaatgtcagcagcaacagcgggaggctgaaggcagcagacggcctccacgcgccgaaggaagttcgcagtcctggcgacagcaggaagaagagcagaggctcttccgggagagagccagagctaaggaggaatag

SEQ ID NO: 126836 - DNA, 699 bp, Artificial Sequence
  Description of Artificial Sequence: Synthetic coding sequence
atggcttctacatcacgcagacaaagaagggagcgcaggttcaggcgctacctgtcagcaggccgacttgtccgcgcccaggctctgctgcagagacaccccggcctggatgtggacgccggacagccgccacccttacaccgcgcttgtgctcggcacgacgcaccagcgctgtgtctgctgctgcgattgggcgctgatcccgcacatcaagacaggcatggcgataccgccctgcatgctgccgcacgccaggggcctgacgcctataccgatttcttcctgccgctgttgtctagatgtcccagcgctatgggtataaagaacaaggatggggagacaccggggcaaatcttaggttggggacccccctgggattcagcggaggaagaagaagaagacgatgcctcaaaggaacgggagtggagacaaaaactccagggtgagctggaggatgagtggcaggaagtgatgggccggtttgaaggtgacgcatctcacgaaactcaggagcccgagtccttttccgcctggagtgatagactggcacgagaacacgctcagaagtgtcagcagcaacagagggaggcagagggatcatgtagaccacctcgggcagagggctcttcccagtcctggagacagcaagaggaggaacaacgacttttcagagagcgagcccgcgccaaagaggaatag

SEQ ID NO: 126837 - DNA, 699 bp, Artificial Sequence
  Description of Artificial Sequence: Synthetic coding sequence
atggcgagcacctccaggcgccagagaagggaacgtagattccgccgctacctttccgcagggcgcctcgtcagagcacaagccctgctgcaacggcacccagggctggacgtcgacgctggccagccaccacctcttcatagagcatgcgctaggcacgacgcccctgccctgtgtctgctgctgagactgggcgctgatcctgcccatcaggatcggcatggcgataccgcgctgcacgctgctgctcggcagggacccgatgcatatactgacttcttccttcctctgctgagccggtgcccgagcgcaatggggatcaagaataaagacggggagactccaggccaaatcctcggatgggggccgccatgggattctgcagaagaggaagaggaggatgatgccagtaaggaacgcgagtggaggcaaaagctgcagggggagcttgaagacgaatggcaggaagtgatgggcagatttgaaggcgatgcaagccatgagactcaggaacctgagtcattctcggcctggtccgacaggctcgcaagagaacacgcccagaagtgccagcagcaacagagggaggccgaaggttcttgccggccacctagggctgagggcagttcccagtcctggcggcagcaggaggaggagcagagacttttcagggagcgagccagagcaaaggaggagtag

SEQ ID NO: 126838 - DNA, 699 bp, Artificial Sequence
  Description of Artificial Sequence: Synthetic coding sequence
atggcatctacgtcgcgacgacagaggagagagcgtcggtttcgtcgttacctctcagccggacgcctcgtccgcgctcaggctctcctgcaacgtcatccgggcctggatgtggacgcggggcagcctcctcctcttcacagagcatgcgcccggcatgatgcccctgctttgtgtctgcttttgaggttgggtgcggatcccgcccatcaggaccgccatggggacacagctcttcacgcggccgccagacagggcccagatgcctatactgatttctttctacccttgctgtctagatgcccatcggcaatgggcattaaaaataaggatggcgagacgcccggccaaatcctagggtggggaccaccttgggacagcgctgaagaggaagaagaggacgatgccagtaaggaacgagaatggcgacagaagctgcaaggcgaactcgaagatgagtggcaggaagtgatgggtcgattcgagggcgatgcctcacacgaaactcaggaacccgaatcattttccgcttggtctgaccgcttagccagggagcatgcccagaaatgccaacagcagcagagggaagccgaaggttcttgtcgaccaccgcgggctgagggatcttcccaatcctggcgccagcaggaggaagaacaaaggctcttcagggaaagagctcgggccaaggaggagtag

SEQ ID NO: 126839 - DNA, 699 bp, Artificial Sequence
  Description of Artificial Sequence: Synthetic coding sequence
atggctagcacatcgagaaggcagaggcgggaacggcggtttagaaggtacctgagcgccgggaggctagttagggcccaagccctgttacagcggcaccccggcttggacgtggacgcaggtcagccgcctcccttgcatcgagcttgcgcacggcatgacgcgcccgccctgtgcctactgctgcggctaggggcagatccagcacaccaagaccgacacggcgataccgcactgcatgctgccgccaggcagggccccgatgcatacaccgacttcttcctgcccctgctaagccggtgcccttcagccatgggcatcaagaacaaggacggagagacacccggccagatcctgggctggggaccgccatgggatagcgccgaggaggaggaagaagatgacgctagcaaggagcgcgaatggcgccagaagcttcaaggggagttagaggacgaatggcaggaggtgatgggcaggttcgagggagacgcttctcacgagacccaagaacctgagtctttttccgcttggtccgatcggttggctcgggaacatgcacagaaatgccagcagcagcagcgtgaggccgaaggaagctgcagaccaccccgtgcggaaggctcttctcagagctggagacagcaggaggaggagcaaagactgtttcgggagcgcgctcgtgccaaggaggagtag

SEQ ID NO: 126840 - DNA, 699 bp, Artificial Sequence
  Description of Artificial Sequence: Synthetic coding sequence
atggcgtcaacctctagacgccaacggagagagcgccggtttcgtcgttatctgagcgcaggccgacttgtgcgagcacaggcgctgctgcaacggcaccctgggctggatgtggatgcaggccagcccccgcctttgcaccgcgcctgtgcacgtcacgacgcgcccgctctgtgcctgttgcttagactcggggcagatccagctcaccaagatcggcacggcgacacagcgcttcatgccgcagcgcgacaagggcccgatgcatatacagacttctttctccccctcctcagcaggtgccccagtgctatgggcattaaaaacaaagacggtgagacgcctggacagatcctcgggtggggacccccttgggacagtgcagaagaggaggaagaggatgacgcaagcaaagaaagagagtggcggcagaagttgcaaggtgagctggaagatgagtggcaggaagtgatgggcagattcgagggagacgcctcgcacgagacccaggaaccggagtcattctccgcctggtctgacaggctggccagagaacatgcccaaaaatgccagcagcagcaacgtgaagcggaagggtcttgcagaccccctcgggctgagggatcctcacagtcatggaggcagcaagaagaggagcagcggttattcagagagagagctagggccaaggaagagtag

SEQ ID NO: 126841 - DNA, 699 bp, Artificial Sequence
  Description of Artificial Sequence: Synthetic coding sequence
atggcatcaactagcaggcgacaaaggcgagagcggcggttccgcagatacctcagcgcgggcagactcgtgcgggcccaagccttactgcagcgacatcccggcctcgacgtggacgcgggccaaccccccccacttcatcgggcttgcgctcgtcacgatgcccctgccttatgtttgctactcagattgggcgccgaccccgcccaccaggatcgccacggggacaccgcactgcatgccgccgcaaggcagggcccagacgcctacactgatttttttctgcccctactatcgcgatgcccgtctgccatggggatcaagaataaggacggggagaccccgggacagatccttggctgggggccaccatgggatagcgccgaggaggaggaggaggacgatgcatctaaggaacgagagtggcggcagaagcttcaaggagaactcgaggacgagtggcaggaggtgatgggccggttcgagggcgatgcctcccacgaaacccaggaacccgagtcattttctgcttggtctgacaggctggctagagaacacgcccaaaagtgtcagcagcagcagcgcgaggcggagggcagctgcaggccaccgagagcagaggggtctagccagagctggcgccaacaggaagaagagcaaagactattccgggaaagggcaagggccaaggaggagtag

SEQ ID NO: 126842 - DNA, 3900 bp, Artificial Sequence
  Description of Artificial Sequence: Synthetic coding sequence
atggattctcttgaccacatgttgacagacccattagaactgggcccttgtggagacgggcatggcaccaggattatggaagattgtctactcggcggtactagagtgtccctccccgaagacctgcttgaagaccctgagatctttttcgacgttgtgtcgctctctacctggcaggaggtgcttagcgacagccaaagagagcatctgcaacagttcctcccacaattccctgaggactcagctgaacagcagaatgaactgatcttggccctgttctccggcgaaaacttccgtttcgggaatcccctgcatattgctcagaaactgttcagggatggtcactttaacccggaggtagtgaaatatcggcagctgtgctttaagagccagtacaaaagatacttgaatagccaacaacagtactttcacaggcttctcaaacagatcctggcttcgagatcagatctgctggagatggcccggcggtctggcccggcccttcccttccggcagaagcgcccctcaccatcaagaactccagaggaaagggaatggagaacgcaacagcggtacctcaaggtgctgcgtgaagtgaaggaggaatgtggagacaccgccctctcgtccgacgaggaggatctgtcctcttggctaccttcctctccggcccggtctccctccccggcagtcccgctgagagtcgtgccaacacttagcaccaccgacatgaaaacagcagataaagttgagctgggtgatagcgatctcaaaataatgctgaagaagcaccatgaaaagcggaaacatcagcctgaccacccagacctgctgacaggggacctaaccttgaacgacattatgacccgcgtgaatgctggtcgtaaagggagtctggcagccctgtatgatctggctgtcctgaagaagaaggtaaaagaaaaggaggagaaaaaaaaaaaaaaaattaagaccatcaaaagcgaggccgaagacctcgcggagcccctctcctccaccgaaggagtggcgcccctgtcccaggcaccctcccctctggcgattcccgccattaaagaggaaccactggaggaccttaaaccttgtctcggaataaatgagatctctagtagcttcttttcactcctactcgagatcctgttactggaaagccaagcatctctgcctatgctcgaagaacgcgtattagactggcagagctcccccgccagctctttgaactcatggttcagtgccgcacctaactgggcagagctggtgctgcctgctctacaatacctggcaggagagtcccgtgctgtgcccagctcctttagtccttttgtcgagttcaaggagaaaacccagcagtggaaactgctcggccaatcccaggataacgaaaaggagctggccgctctgttccaactgtggctcgagacgaaggaccaggcgttttgcaagcaggaaaacgaggacagctctgatgcaaccaccccggtccctcgcgtccggacagactacgttgttaggccttctacgggcgaggagaagagagtgtttcaggaacaggagcgctatagatattcacagccccataaggccttcactttcaggatgcacggctttgagagtgtagtgggccccgttaaaggggtttttgataaagaaacctccttgaacaaagcccgtgagcactcactgcttcgctctgatcggcccgcctacgttactattctctctctggtacgtgacgctgccgcacgtttgccgaatggagaggggaccagagccgaaatttgtgagcttctcaaggatagccaattcctggccccggacgtcacctccacacaagtgaatacggttgtgtccggggccctagaccgacttcattatgagaaagacccctgtgttaagtatgacattggaagaaagttatggatctatctccatcgcgaccgctctgaggaggagtttgagaggattcatcaggctcaggcggcagcggcgaaagcccgtaaagcacttcaacagaagccaaaaccaccttctaaggtaaaaagttccagcaaggagtcctccattaaagttttgtccagcggtccttcagagcagagccagatgagtctttccgactcttcgatgccacccacgcctgttacccccgtaacaccaacgacacccgcattacccgcaatcccaatatccccccccccggtgtccgccgtgaacaaaagtggcccaagcacggtatctgaaccagccaaatcttcttccggagtgctgttggttagttcccctaccatgccgcacctcggtactatgttgtccccagcctcaagccagactgcacccagtagccaagcagcggcgagggttgtgtcccattcaggatccgctggcctcagccaggttagagttgttgctcagcctagccttcccgctgttccccagcagagcgggggacccgctcagacactgccgcaaatgcccgccggaccacaaataagggtccctgccaccgccacgcagacaaaagtggtgcctcaaaccgttatggctacagtacctgtgaaggctcaaactaccgcggccacagttcagcggcccggacccggacagacaggattaaccgtcacgtcgcttcccgcaaccgccagtcccgtctccaagccggcaacctcaagcccagggacctcagcaccctctgcatccacggccgccgtaatccagaacgtgacaggacaaaacatcatcaagcaggtggctattaccgggcagctgggggttaagccacagactggcaactccatccccctcactgcgacgaacttccgcatccagggcaaagacgtgctaagactgccaccctcttcgataacaactgacgcaaaaggtcagaccgtgctgcgaatcactcctgacatgatggcaaccctagcaaagagtcaggtgacgaccgttaagctgacgcaggaccttttcggaacgggaggcaataccacaggcaagggcatatctgccaccttacatgtaaccagcaaccccgtgcatgccgccgactcccctgccaaagcatcgagtgcttctgcgccctccagtaccccaactgggaccaccgtcgtcaaagtcacacccgaccttaagcccaccgaagccagttcctctgcgtttcgcttgatgcctgcgttgggggtgtcagtggcagatcagaaaggtaagagcactgtggcctcctcagaagctaaacctgccgctacaattagaatcgtccaggggttgggcgtcatgcctcccaaggctggccagacaattacagttgcaacccatgcgaagcagggtgctagtgtggcttccggttcaggaacggtgcatactagcgccgtctcactgccaagcatgaacgcggcggtaagcaaaaccgtagcagtcgcctcgggggcggcaagcacaccaattagcatatccacgggggccccaacagtgcgccaggtgcctgtgtccaccacagtagtgtctacaagccaggcagggaaacttccaactcgtattaccgtccccctttctgtcattagccagcccatgaaggggaagagcgttgtgactgcccctatcatcaaaggaaacctcggcgccaacttgtcaggcctgggtagaaacatcattctaacaacaatgccggccggtactaaattaatcgcgggcaacaagcccgtgagttttctgaccgcacagcagctccaacagctgcaacaacagggtcaagccacccaggtgaggattcaaacagtgcccgcttctcatctgcagcagggcaccgcctcaggatcttcgaaagccgtgtccacggttgtagtgaccactgcccctagtcctaagcaggcaccggaacaacagtag

SEQ ID NO: 126843 - DNA, 3900 bp, Artificial Sequence
  Description of Artificial Sequence: Synthetic coding sequence
atggacagcctcgatcacatgcttacagatcccctggaactcggaccttgtggagacggccacggtaccaggatcatggaagactgtcttctgggggggacgagggtttccctccctgaggacttgctcgaagaccccgaaatcttcttcgatgttgtcagtctgagcacatggcaggaggttttaagcgattcacagagggagcacctgcaacagttcttaccccagtttcccgaagattcagccgagcagcaaaacgaacttatcttggctcttttctctggcgagaattttcgcttcggtaatccactgcacattgctcagaaactgttcagggatggccactttaatcctgaggtcgttaagtatcgtcaattgtgctttaagtcccagtataagcggtacttaaactcccagcaacagtacttccatcgattgctgaagcagatcttagcttccaggtcagacctcttggagatggccaggagaagtggcccagccctgccgttccggcagaagcgtcctagcccttctagaacgcccgaagaaagggagtggcgcacccaacagagataccttaaggtactaagagaagtgaaagaggagtgtggcgatacagctctctctagcgatgaggaggatctgtcttcatggttgcctagtagccccgcacgcagcccaagccctgcagtgcccctgagggttgtccccacactcagcactacggacatgaagactgcagataaggtggagctgggtgactcagatctgaagattatgctcaagaagcaccacgagaagagaaagcaccaacccgaccaccctgacctgctgacgggcgacctgacccttaatgacataatgacccgagttaatgctggccgcaaagggagcctggcagcgctctatgatcttgcggtgttgaaaaagaaggtgaaggagaaagaggagaagaagaaaaagaagatcaaaacaattaagagcgaggccgaggacctagccgagcccctgagctctaccgagggtgtggccccattgtcacaggctccgtctccactcgcgattccagctataaaggaggagccacttgaagaccttaagccttgcctgggcatcaatgaaatttcctcatcattcttcagcctgttgctagaaatcctgctgttagagtcacaggctagtctgccaatgctggaggaacgcgtactggattggcagagttcgccggcgtcatccctaaactcttggttttccgctgcgcctaactgggctgaactcgtcctgcccgctttacagtatttggccggggaaagcagagctgtaccatcatcattctccccattcgtcgagttcaaggaaaagacacaacagtggaagttgctcggacagtcccaggacaatgagaaagagctggctgcactattccaactctggctcgaaacaaaggatcaggcattttgcaagcaagagaacgaggactcatctgacgcaacaactccagtaccccgggtgaggacagactatgttgtgcgtccatccaccggcgaggaaaagcgtgtgtttcaggagcaggagagataccgctactctcagcctcacaaagcctttacgttcagaatgcacggcttcgagagcgttgtagggcccgtgaaaggagtgttcgataaggagacatcattaaataaggccagagaacactccttactacggagcgataggcctgcctatgtcacaattctcagcctggtccgggacgcagccgcccgcttaccaaacggggagggaacgcgggccgaaatatgcgagttgttgaaggattctcagtttctcgctcctgacgtcaccagcacacaggttaacacagttgttagtggagctttggaccgcctgcattatgagaaggatccatgcgttaaatacgacatcggccgaaaactttggatatacctgcaccgtgataggtcagaggaggagtttgagcgaattcaccaagcgcaggccgcagctgccaaggctcggaaagctctgcaacaaaaacccaagcctccatccaaggtgaagagctcatcaaaagagtcttccattaaagtactgagcagcggtccctctgaacagtcccagatgtcactcagcgattcctcaatgcccccaacccccgttacaccagtgactcccaccacacctgcactgcctgctatccctatctctccacctcctgttagtgccgtaaacaaaagcggacctagtacagtgagtgagcctgccaagtctagcagtggcgtgctgctcgtgagctcaccaaccatgcctcacctcggaactatgctgtctcccgcttcctctcagacagctccttctagccaggcggctgccagggtggtgagtcacagtggatctgcgggactgtcccaggtgagggtagtcgcgcaaccctctctgcccgctgtcccccagcagtccggaggccctgctcagacactaccacagatgcccgccggcccccagatcagagtgcccgctacggccacacagacaaaagtcgtcccacagactgtcatggctacggttcccgtcaaagcacagactactgccgcgactgtgcagcgacccggtcctggccagaccggactgacagtcacatctcttccggcaactgcgagtcctgtgtctaagccggccacatcatccccgggaacttcggctccatctgctagtactgctgccgtcatacagaatgtgaccgggcaaaacatcatcaagcaggtggccatcaccgggcagctcggtgtgaagccccagacagggaatagcatccccttgactgcgacaaactttagaatccagggaaaggatgtgttacgtctcccaccaagctccatcaccaccgatgccaaaggccagacagtcctgcgtatcacgcccgacatgatggccaccctggcgaaaagccaagtgacaacagtgaaacttactcaggacttgtttggcaccggtggaaacacaacagggaaagggattagcgccacactgcacgtgacttccaacccggtccatgctgccgactcacccgcaaaggctagcagtgcatccgcccccagcagtacacccaccggtaccaccgtcgtcaaggtcaccccagatctgaagcctaccgaagcgtcatcaagtgcctttcgtttgatgcctgccttgggagtgagcgtggcagaccagaagggaaaatctaccgtggcaagcagcgaggccaaacctgctgccactatcaggatagtccagggcctcggggtgatgccccctaaggctgggcagaccattactgtcgcaacacacgccaagcagggggctagtgttgcttctggtagcggaactgtacatacgagtgcggtgtctctcccctcaatgaacgccgctgtctcgaaaaccgttgccgttgccagcggggcagctagtaccccaatatctatctctacgggggccccaactgtgcgccaggtccctgtaagtactactgtcgtttctaccagtcaagccggtaagctgcctacacggataaccgtcccattgtccgtcatctcccagccgatgaaggggaaatccgtggtgacagctcccatcataaagggcaacctcggcgctaatctgtccggattagggcgcaacatcatcttaacaactatgccagctggaacaaagcttatcgccggaaataagcctgtcagcttcctcacggcacaacagctgcagcagctgcagcagcagggccaggccacccaggtgcggatccagacggtccctgcctcgcacctccagcaggggactgccagcggttcatcaaaagcagtgtctacagtggttgttactaccgcaccaagcccaaagcaagcccccgagcagcagtag

SEQ ID NO: 126844 - DNA, 3900 bp, Artificial Sequence
  Description of Artificial Sequence: Synthetic coding sequence
atggattcattggaccacatgctgacagatccactagagctgggaccctgtggggatggacacggcaccaggataatggaagattgcctccttggtgggacccgcgtgtcactgcccgaggatttattagaagatcctgagatctttttcgacgtcgtgagcttgtcaacgtggcaggaggtcttgagcgatagccagcgagagcatctgcagcagttccttcctcagttccccgaggactcagcagaacaacagaatgagctgatcttagcactgttttcgggggaaaacttccggtttggcaatcccttgcacatagcccagaagctctttcgcgatggccattttaatccagaggtggtgaagtacagacagctctgtttcaagagccagtacaagcggtacttaaactctcagcagcagtacttccacagattgctgaagcagatcctggcttcaagatccgacctccttgagatggctcgtaggtcagggcccgccctaccatttcgccagaagcgcccatcaccctcccgcacacccgaggagagagagtggcggacacaacagcggtacctcaaggtgttaagggaggtaaaagaggagtgcggcgacaccgccctctccagcgacgaggaggatctgagttcttggcttcccagctccccagcccgcagcccatcaccggccgtgcctctccgggtcgtacctacactatcaacaaccgatatgaaaacggctgataaagtggagttaggggacagcgatttgaaaattatgctgaagaagcaccatgagaaacggaaacaccaacccgaccatcctgacctgctcaccggagacctgactctgaacgacatcatgacacgcgtaaacgcaggccgcaagggatccctggccgcgttgtatgacttggccgtgctgaagaaaaaggttaaagagaaagaagagaaaaagaagaaaaaaataaagaccattaagtctgaggctgaagacctcgccgaaccactctcaagcactgagggcgtggctcctctgtcccaggccccatctccccttgccattccagccattaaggaggaacctctcgaggacttgaagccatgtctggggatcaacgaaatatctagcagttttttctcactcctgctagaaattctattgctggagtcccaagcatccctgcccatgttggaggaacgggtccttgactggcaaagcagcccagcctctagtcttaactcttggttcagcgccgctccgaactgggctgagcttgtactgccagcattgcagtatctagcaggcgaaagcagagcggtgccttcctcatttagcccattcgttgaatttaaggaaaaaacccaacagtggaagttactgggtcagtctcaggacaatgaaaaagagctggccgccctgttccaactgtggctggagacaaaggaccaggctttctgcaaacaggaaaacgaggatagttccgacgctaccacacccgtgcccagagtccggacagattacgtggtccggccctccaccggcgaggagaagcgggtgttccaggagcaggagaggtatcgctacagtcagcctcacaaggcttttacctttaggatgcatggattcgagagcgtagtcggccctgtgaaaggcgtgttcgacaaggaaacgtccttgaacaaggctcgtgagcactcactgctgcgctctgacagaccagcttatgtaaccatactgagccttgttagggatgccgccgcccgtctgcctaacggagagggaactagagcagaaatctgtgaattgctcaaagacagccaattcctggccccagacgtcacgtctacacaggtgaatacggtcgtcagtggagcattggatcgactgcattatgagaaagacccctgcgtaaaatatgacatcgggaggaagctctggatttatttgcaccgggatcggtctgaagaggaatttgaaaggatacatcaagcgcaggctgcagctgccaaagctagaaaggccctgcagcagaaacctaagcctccatcaaaggtcaagagctccagtaaggaaagcagtatcaaggtcctgagctctggaccctctgagcagtcacagatgtctcttagcgattccagcatgccaccaacgccggttactccagtgactcctacgactcctgcattgccggccatcccaatatccccaccgcccgtgagcgcagtgaacaaaagcgggccaagcactgtgagcgaaccagctaagtcgtcatctggggtgctgctggtatcatcacccaccatgccgcaccttgggactatgctgagccctgccagtagccaaaccgcaccatcttcccaagcggcagccagagttgtgtcccactccggcagcgcaggactgtcacaggtgagagttgtagctcagccctctctcccagcggttccccaacagtctggtggcccagcccagactcttcctcagatgcctgcagggccacaaatcagagtcccagccaccgcaacacagaccaaggtggtcccccaaaccgtcatggccaccgtcccagtgaaagcgcagactaccgccgcgaccgttcagaggcctggacccgggcagactggcctcaccgttacatctctccctgctaccgcttctccagtctccaagccggccacgtctagccctggaacctccgcaccctctgcctccacggccgctgtgatccagaacgttacaggacagaatattattaagcaggtcgccataacaggacagctcggcgttaagccacagacagggaactctatcccactcaccgcgaccaatttccgaattcagggcaaggatgtgctcagactgccaccatctagcatcactacagatgccaaaggtcagactgtcctgcgtataactcccgatatgatggctactctggccaaaagccaggtgactactgttaagctcacccaggacctgtttgggaccggcggaaacacaaccggaaagggcatttcagccacactgcatgttacatccaatcctgtccatgccgccgattcaccagcaaaagcgtcatcagcttccgctccgtcatccactcccaccggcactacagtcgtgaaggtgacaccagacttgaagcctaccgaagcctccagctcggcatttcgcctgatgcctgcgttaggggtttccgttgcggaccagaagggtaaatctaccgtggcttctagtgaagctaagcctgccgcaaccatacgtattgttcagggcctgggagttatgccgccaaaggccggccagacaattactgtggccacccatgcgaagcagggggcgagtgtagcgagtggatccggcactgtgcatacaagtgccgttagcctcccaagcatgaatgccgccgtgtctaagaccgtcgctgtggctagtggagcggcatccactcccataagtatcagcacaggcgccccaacagtcagacaggtcccggtgtcaacgactgtggtgtccacatcccaggcgggcaagttgccaacccgcattaccgtaccactgagcgtgatttcccagccaatgaaaggaaaatctgtcgtgacagccccaattataaaggggaacctgggagctaatttgagtgggttgggcaggaacatcattttgaccacaatgccagcaggaactaagttaatcgcaggaaataaacctgtctcttttctcaccgctcagcagctccaacagctgcagcaacaaggtcaagccacccaggtgagaattcagacggtacccgcaagccacctccagcagggcacagcctcaggatcttcaaaagctgtcagtaccgtggttgttacaacagccccaagcccaaagcaagcgcccgagcagcagtag

SEQ ID NO: 126845 - DNA, 3975 bp, Artificial Sequence
  Description of Artificial Sequence: Synthetic coding sequence
atgcacgtcttcgtccagagtacctgcggagaagagaccatggactctcttgaccatatgcttactgatcccctcgaattggggccttgtggagatgggcatgggacccgcatcatggaggactgcctgctcggggggactagggtgagtctaccagaggatctcctggaggatccggaaatcttctttgacgtggtctctctctcgacctggcaggaggttctttcagatagccagcgggaacacctgcagcagtttctgcctcagtttcccgaagacagcgcggagcagcagaacgagctcatcctggcactgttcagcggcgaaaacttcaggttcggcaatccgctccatatcgcacaaaaattgttccgcgacggtcatttcaatcccgaggtagtgaaataccgacagctgtgcttcaagtcccagtataagagatatctgaattctcagcagcaatattttcaccggcttttaaagcaaattttggcaagccgctccgatctgctcgagatggccaggcggtccggtcccgccctgccctttcgccagaaaagaccatcccccagccgcactccggaggaacgggagtggagaactcagcagagataccttaaggtcctccgggaggttaaagaagagtgcggcgacacagctctgtcaagcgacgaggaggccactcttgatctgcaggagcagttcagctttgaggaccttagctcatggctgccgtcttccccagcaagaagtccaagcccagctgtcccactgcgggtggtccccaccttgtcaacaacagatatgaagacagcagacaaagtggaattgggagatagcgacctaaagatcatgttgaagaaacatcatgaaaagagaaaacatcagcctgatcaccccgacttgctaaccggagaccttacactgaatgatattatgacccgggtgaacgccggcaggaaggggtcattagccgcactttatgacctggctgtactgaaaaagaaagtgaaagaaaaggaagagaaaaaaaagaaaaaaataaaaactattaagagcgaagccgaggacctggcagagcccctatcctccacagagggagtggcccctctctcccaggcaccctcccctctagccatccccgctataaaagaggaaccgctggaagatctgaagccctgcctgggcatcaacgaaatttccagttctttttttagcctcttattggaaattctgctgctggagagccaggctagcttgcctatgctggaagaacgagttctggactggcagtcttcccctgcatcaagtcttaacagttggtttagtgctgcacccaactgggcggagctcgttctgcctgccctgcaatacctcgcaggggagagccgtgccgtgcccagcagcttttctccgttcgtggagtttaaggaaaagacccagcagtggaagctcttgggacagtcccaggacaatgaaaaggaactcgcggctctattccagctgtggttggaaacgaaggaccaagctttttgcaagcaggagaatgaagactcttccgatgcgacgacaccagtgccaagggttagaaccgattacgtcgtgcgcccctccaccggtgaggaaaaaagagtgttccaggaacaagaaagataccggtattcccaaccacacaaagccttcacgttcagaatgcatgggtttgaatcagtggtgggaccagtgaagggcgtgttcgataaggaaacctctctcaataaagcccgggagcactccctgctgcgctctgatagacccgcctacgtgaccatcctatctctcgttagagacgcagctgcccgactcccaaacggcgaaggcactagagcggagatatgcgagctgctgaaggatagtcagtttctcgcgccagatgtgacttcgacccaagtcaacacagttgtctctggagccctggaccggctacactatgagaaggatccatgcgtgaagtatgacatcgggcggaaattgtggatctacctgcatagggatcgttccgaggaggagtttgaacgcatccaccaagctcaggcagccgcggctaaggccagaaaagctttacagcagaaacccaaaccaccttccaaagtgaagtcctcctctaaagaatcctctattaaggtactgtcctctggtccaagcgagcagtcacagatgtcactaagtgacagctcgatgccacctactccggtaacacccgtgacccctacaacccccgccctgcctgccattcccattagccctccacccgtgtctgcggtcaacaagtctggtccgagcacagtcagtgaacccgcaaagagctccagtggagttctcctggtgagtagtcctaccatgcctcatctgggtacgatgcttagcccggcctcctcccagactgccccgagttcccaagcagcggccagagtggtgagccactccgggtctgccgggctctctcaagtgcgagttgtcgcacaacccagcctcccggctgtcccacagcagagcggggggccagcccagaccctcccacaaatgcccgcgggcccacaaatcagagtgcctgctactgctacgcagacaaaagtcgtaccacaaacagtcatggctaccgttccagtgaaggcacaaactactgctgctacagtccagcgccctggcccaggccagactggattaacagtgacttcacttccagcaacagcttcaccagtgtcaaaaccggccacatcctctccgggaacttcggcgccttccgcctcaaccgccgcagttattcagaatgtgaccggccagaatatcattaagcaggttgccattaccggccagcttggagttaagccccaaacaggaaatagcatccctttgacggcaacaaactttcgcattcagggtaaagatgtgctgcgactgccaccttcttcgatcaccaccgatgccaaggggcaaacagttctcaggatcacgcccgacatgatggctacgctggcgaagagtcaggtgaccacggtgaagctcacccaggacttgttcggtactggagggaatacgaccgggaaaggaatttccgccaccctgcacgtaacttccaacccagttcacgccgccgactcccctgcgaaagccagttcagctagcgccccgagctcgacaccaaccgggacaacagtcgttaaggtgacgccggatctgaaacctaccgaagcctctagctccgccttccgtcttatgcccgctctgggggtgtccgtcgcagaccagaagggaaaatccactgttgcctcttcggaggctaagcctgccgctacaatcagaattgttcagggcttgggggtaatgcccccaaaagccggccagaccattactgtggccacccacgccaaacagggcgcatcagtagccagcgggtccggcacagttcacacaagtgccgtaagccttcctagcatgaatgcagccgtgtctaagacagtggccgtggcttctggcgcagcttctacacccatctccatcagcaccggcgcaccaactgtccggcaggtaccagtgagtaccactgtggtctctacgtcacaggctgggaagctccccactcgcatcaccgtgcccctatcagtgatcagtcaaccaatgaagggaaaatctgttgtgactgcccccattattaagggtaatctcggggctaatcttagtggcctgggtagaaacatcatcctgacaacaatgcccgctgggactaaactaatcgctggtaacaaaccggtgtctttcctgaccgcccagcaacttcagcagctccagcagcaaggtcaggccacacaggtgagaatacagacagtgccggccagccatctgcagcagggcacagcgtcaggtagttcaaaagcagtgtctaccgtggtagtgacaaccgccccttcccccaagcaggcccctgagcagcagtag

SEQ ID NO: 126846 - DNA, 1389 bp, Artificial Sequence
  Description of Artificial Sequence: Synthetic coding sequence
atgcaactgcggaagatgcaaaccgtcaagaaggagcaggccagtctggacgcctcttccaacgtggacaaaatgatggtcctgaacagcgcccttacagaagtgagtgaggactcaaccacaggcgaggagttactcctctccgaaggttcagttggaaaaaataagagttctgcatgccggcggaagagggagttcatacccgacgaaaagaaagacgccatgtactgggagaaaaggcgcaagaataatgaagctgctaaacgtagtcgcgagaagagacgcctaaacgaccttgtgctggagaacaagctgatagctctgggggaggaaaacgccacactgaaggccgagctgctgtcactgaagctgaaatttggtctcataagtagcactgcctacgcccaggagatccaaaaactgagtaactccaccgcagtctattttcaggactatcagacgtccaagagcaacgtcagtagtttcgtagatgagcacgagccatcaatggtatcttccagctgcatttccgtaatcaaacactctccacagagcagcctgtccgacgtgtctgaagtgtcttcggttgagcacacccaggaaagctccgtgcagggctcctgtagaagccccgagaataagttccagattatcaaacaagaacctatggagctcgagtcttacacaagggaaccaagagatgatcgcggatcttacaccgcatcaatatatcagaattatatgggtaacagctttagcgggtattcacattcacctcctctgctgcaggtaaatcgcagctcttccaattcaccaaggacatctgaaactgacgacggcgtagtcggtaagtcttcagacggcgaggatgagcagcaggtgccaaaaggtcctattcacagccctgtggaactaaaacacgtgcacgctacagtagttaaagtccccgaggtcaactctagcgccctgcctcacaaattacgaataaaggccaaggccatgcagattaaagttgaggcgttcgacaatgagtttgaggccacacagaagttgagtagccccatcgatatgacgtctaagcgtcactttgagctggagaagcatagcgcaccttccatggtgcacagttcccttacaccattctctgttcaggttacaaacatccaggattggtcactgaaatctgaacactggcatcagaaggagctaagtgggaagacgcagaattcttttaagacaggggttgtagaaatgaaggactcagggtataaagtttccgatccggagaatctttatctgaagcaggggatagctaatttgtcagcagaggtggtcagcctgaaaagattgatcgccacgcagccaatctctgcttccgacagcgggtag

SEQ ID NO: 126847 - DNA, 1389 bp, Artificial Sequence
  Description of Artificial Sequence: Synthetic coding sequence
atgcaactgcgaaaaatgcagactgtgaaaaaggagcaggcctccctcgatgcctcctctaacgttgacaagatgatggtgttgaactccgcactgaccgaggtttccgaagatagcacaaccggagaggagcttctgttgtcagaaggctccgttggcaaaaataagagctccgcttgtagaagaaagcgcgagttcatcccagatgaaaagaaggatgctatgtactgggagaagcgtcgcaagaataatgaggctgctaagcgctctagagagaaaaggagacttaacgatctagtgctcgaaaacaaactcattgccctgggcgaggaaaatgcgaccttgaaggcagagttgcttagtttgaaattgaaatttggcctcatttctagcactgcctacgcacaggagatccagaagctatctaactccacagctgtgtattttcaggactatcagacatccaaatctaacgtcagtagctttgtggatgaacatgagcctagcatggtatcctcctcttgcatctcagtcattaagcacagcccccagtccagcctttccgacgtgtctgaggtctcctcagtggagcacactcaggaatctagcgtgcagggctcatgtagatcacctgaaaacaagttccaaatcattaagcaggaaccaatggaattggaaagttacacgagagaacctcgggatgacagagggagttatacagcctctatatatcaaaactacatgggcaactctttttccggctattcccactcgcccccacttctacaggttaacagaagttcaagtaacagcccacgtacctctgagactgacgatggggtcgtcggtaagagcagcgacggtgaagatgagcagcaagtgcctaaaggaccgatccactccccagtcgagctgaaacacgttcacgcaactgttgtaaaagtccccgaagtgaactccagcgcacttccccacaagctccgtataaaggctaaagctatgcagataaaggttgaagccttcgacaacgaatttgaagctactcagaagctgtcctcccctatcgacatgacatctaagcgacactttgagttagaaaagcatagcgcacctagcatggttcacagttctctgaccccctttagtgttcaagttactaacatacaggattggagcctaaagtcagaacactggcatcagaaagagctgagcggtaagacgcagaatagttttaagactggggttgttgagatgaaagacagcgggtataaggtcagtgaccctgaaaatctgtacttaaaacaagggatcgctaacctgagcgcagaagtggtctccctgaaacgactcatcgcaactcagccaatatctgcctctgatagtggttag

SEQ ID NO: 126848 - DNA, 1488 bp, Artificial Sequence
  Description of Artificial Sequence: Synthetic coding sequence
atggctgaacctacttcagactttgaaacccctatcgggtggcatgcttcaccagaactaactcccacactgggccctctgtctgacacagccccaccgcgagacagttggatgttctgggcgatgttgccacccccacctccgccactgacgtcttccctgccggcggctggctcaaagccttcgtctgagtcacagcctcctatggaagctcagtccctgcctggcgcccctcctccctttgatgctcagatccttccgggcgctcagccaccattcgatgctcaatctcctttagactcccagcctcagccttcaggccagccttggaacttccatgcatccacttcttggtactggagacagagctccgatcgattcccgcggcaccagaagtcattcaatcccgctgtgaagaacagctattaccctcggaagtatgacgcgaagttcacagacttcagtcttccaccatctagaaagcaaaagaaaaaaaaacggaaagagccagtatttcatttcttttgtgacacttgtgatagggggttcaagaatcaggaaaagtatgacaagcatatgtccgagcacactaagtgtcctgagctggattgcagcttcactgcacacgagaagattgtgcagttccattggaggaacatgcatgccccagggatgaaaaaaatcaaacttgatacgccagaagagattgcccgctggcgggaagagagaaggaaaaattaccctaccttggcgaatattgaaagaaagaagaaattgaagctagagaaggagaagcgtggcgccgtgctgactacgacccagtatggcaagatgaaagggatgagtagacacagtcaaatggcaaagatcagatcgccaggcaaaaatcacaaatggaaaaacgataacagcaggcagcgagctgtgaccggtagtggatcgcacctctgcgacctcaaattagaagggccgccggaggctaatgccgatccattaggcgtactgataaactctgattcagaatcggacaaagaggagaagccccagcactctgtcataccaaaagaagttactcctgctttgtgctctttgatgtcctcctacggcagtttatctggcagcgaatccgagccggaagaaacgcccatcaagactgaggccgatgtattggcagaaaatcaggtccttgatagcagcgcccctaagtctcctagccaggacgtgaaggctacagtgcggaacttttccgaagccaagagcgagaatcgcaaaaaatctttcgaaaaaaccaaccctaagcggaagaaggactaccacaactaccagactctcttcgaacctcgcacgcaccacccttacctccttgagatgctactcgctcctgatattcgccatgaaaggaacgtcatcctgcagtgtgtgcgttatattattaaaaaagatttctttgggctggatacgaatagcgccaaatcaaaggacgtatag

SEQ ID NO: 126849 - DNA, 648 bp, Artificial Sequence
  Description of Artificial Sequence: Synthetic coding sequence
atggaaacgcaggcagagcagcaggagcttgagacactccctacaaccaagatggcacagaccaatcccacccctggctccctggggccctggaaaattaccatttacgaccaggagaactttcagggaaaaagaatggaatttacttcttcctgcccaaacgtttcggaacgttcatttgacaacgtgcgctctctgaaggtagaatcaggcgcctggattgggtacgagcacactagtttttgcggccagcaattcatcctcgagcgcggtgaatacccgcggtgggacgcctggagcggcagcaatgcctaccacatcgaacggctgatgagtttccggccgatttgctctgccaaccacaaggagagcaagatgacaattttcgaaaaagaaaacttcatcgggagacaatgggaaatatccgatgattacccttctttacaggctatgggctggttcaataacgaagtgggcagcatgaagattcagtcgggggcctgggtctgctaccagtaccccggttatcgtgggtatcaatacattctggagtgcgaccaccacggcggagactacaaacattggcgagagtggggtagccatgctcaaacctcacagattcaaagcatccggagaatacagcagtag

SEQ ID NO: 126850 - DNA, 2940 bp, Artificial Sequence
  Description of Artificial Sequence: Synthetic coding sequence
atgaccctgcatgcgactcgcggcgccgccttgctctcctgggtcaactcactccacgttgccgaccctgtggaagctgtcttacagctgcaggactgctcaatttttattaaaattattgatcggatccatgggacggaggagggccaacagatactgaagcaacccgtgtctgaacgtctggactttgtctgtagctttctccagaaaaatcggaaacacccgagtagccctgaatgcctggtgtctgcccagaaagtgctcgaagggtcagagcttgaattggcaaagatgactatgctgttactctatcactccacaatgagctccaaaagcccgcgcgattgggagcagtttgagtacaaaatacaggccgaattggccgtgatcttaaaattcgtgctggatcacgaggatggtcttaatttgaatgaagatctggagaactttttacaaaaagcccccgtaccctcaacatgttcctccacttttcctgaagaactgtctccaccttctcatcaggccaaacgtgaaattcgattcttggaattacagaaggtggcttcatctagttcgggcaataactttctatccggctcccctgcatctcccatgggcgacatacttcagaccccccagttccagatgagacggttgaagaagcagctcgccgatgaaaggtccaatagggatgagctcgaactcgaactggctgagaaccggaaattattaacagaaaaagacgcgcagattgccatgatgcagcagaggatcgacaggcttgccttactgaatgagaagcaggctgcgagcccgcttgagccaaaagagctggaagaactccgagataagaatgaatcactcaccatgagactgcacgagactttaaagcagtgccaggacttgaagactgaaaagtcccagatggatcgcaaaatcaaccagttgagcgaggaaaatggtgatctgagcttcaaactgcgtgaatttgctagccatctccagcagctccaggatgctctgaacgagctaacagaggagcatagcaaggctactcaggaatggctggagaaacaggctcagctcgagaaggaactgtcagctgctctacaggacaagaagtgtttagaagaaaagaatgagattctgcagggcaagctgagccagctggaggaacacctttcacagttacaagataatccacctcaggaaaaaggagaggtgctgggagacgttttacaggttgaagaattgtctaagaagcttgctgactccgatcaggcctctaaggtccagcagcagaaattgaaggcggtgcaagctcaaggcggcgagtctcagcaggaggcccaacgcctgcaagcacagctgaatgagctgcaggctcagctttctcagaaggagcaagctgccgagcattacaaactgcagatggagaaagccaagactcactatgacgcaaagaaacagcagaaccaggagctacaggagcagctgcgaagcctcgagcagctgcaaaaagagaacaaagagctgcgagccgaagccgagagacttgggcatgagttacagcaggccgggttgaagacaaaggaagcggagcagacttgcagacatcttactgctcaggttcgctcactggaggctcaggtggctcatgcagaccagcagctcagggacttgggaaagttccaagtggctacagatgccctgaagtctagagaaccgcaggctaagccccaactggatcttagcattgattctctggacctatcatgtgaggaaggtacaccgttgtcaattaccagtaagctgcctcgcacacagcccgacgggacttcagtgcccggtgagccggccagtccgatttcacagaggttgccccctaaggttgaatctttagagtcactgtatttcacccctataccagctaggtctcaggcgccgttggagtcttctctggattctcttggtgatgtgttcttagacagtggaaggaagacccgttctgcgagaaggcggacaacccagatcatcaacattaccatgacaaaaaagctcgatgtcgaagagcctgattccgccaatagcagcttttactccacacgctccgccccagcttcacaagcgtcactgagagctacctctagcacacagtcactggctaggctgggttctcctgattacgggaacagcgctctactatccctacccggctaccggccaactacgcggagctccgcaagaaggagccaggccggggtgagctccggtgcaccccccggtcgaaattcattctacatgggtacctgccaggatgagcctgaacagctggacgattggaaccggatcgctgagttgcagcagaggaacagggtgtgccccccacaccttaagacatgttacccactggagagtagaccaagcctgagtcttggaactatcaccgacgaagaaatgaaaaccggggatcctcaggagacattgcgccgcgcctccatgcagccaattcaaatcgccgaagggactgggatcaccacgcgacaacagcggaagagggtgagcctagaaccgcatcagggccccggaactccagagtcgaagaaagccacctcatgctttcctcgccctatgaccccacgcgatcgccacgaaggtaggaaacaaagcaccaccgaggcacagaagaaggccgccccagctagcaccaaacaggccgatcgccggcaaagcatggccttctccatcttaaacactccaaaaaaactcggcaatagcttattaaggcgaggcgcctcaaaaaaagcacttagtaaggccagtccaaacactcggtcaggcactcgccgcagtccacggattgcgacaacaacagcgtcagcagccactgccgccgccattggcgctacacccagagccaaaggcaaggccaagcactag

SEQ ID NO: 126851 - DNA, 6306 bp, Artificial Sequence
  Description of Artificial Sequence: Synthetic coding sequence
atgacactccatgcaacgcgaggcgccgcgttattatcatgggtaaatagtctccacgtggccgatccagtggaagctgtgctccagcttcaggattgttccatcttcatcaagattatcgatcggattcacggcacagaggaaggccagcagatcctcaaacagccagtcagcgaacgccttgatttcgtgtgttcctttctgcaaaaaaacagaaaacatcctagctcgccagagtgtctggtatccgcacaaaaggttctggaggggagcgaacttgaactggccaaaatgacaatgctcctcctgtaccattcaaccatgagtagtaagtctccccgcgattgggagcagttcgaatacaaaatccaagctgagctggctgtgatactgaagttcgtgttagatcacgaagatggtctaaatttgaatgaggatcttgagaattttttgcagaaagcccctgtgccttctacgtgtagcagcaccttccctgaagagcttagtcccccaagtcaccaggctaagagagagattcgtttcctcgaactgcagaaggtggcatcatcctcatccggaaacaattttctcagcggcagccctgcctcaccgatgggagacatacttcaaacccctcagttccagatgaggcggctgaagaagcagctagccgacgagaggtctaatcgggacgagttagagctcgaactagccgaaaaccggaagctgttgactgaaaaggatgcccaaattgctatgatgcaacagagaattgaccgactggcgctactaaatgaaaagcaggcagccagccctttagagcccaaggagttggaggaactacgagataagaacgagtccttgaccatgaggctgcacgagactctgaagcagtgccaagacttgaaaacagaaaagtcccagatggaccgcaagataaaccagctgtcagaggaaaatggggacttgtcatttaaactgagagagttcgctagccatctgcaacagcttcaagacgccttgaatgaactgacagaagaacattctaaggcaacacaggagtggctcgagaagcaggcccagctggagaaggagctttccgccgctctccaggataagaagtgcctggaggaaaaaaacgagatcctgcagggcaagctgtcccaattggaggaacatctgagtcagctgcaggataatccgccccaggaaaaaggggaggtgctaggggatgtcctccaattggagactctgaaacaggaagctgccacgttggctgccaataacacacaactacaggcccgcgtggagatgctggagaccgagcgcggccagcaagaagccaaacttcttgccgaacgtggacacttcgaggaggaaaaacagcaattgagttccttgatcaccgacctccagagctcaataagcaatctgtcccaggctaaagaagaactggagcaggcctcccaagctcacggcgcccggcttacagcccaggtcgctagcctgacttccgaactgacaacgcttaacgctaccatccaacaacaagaccaggagcttgccggcctcaagcagcaggcgaaggaaaagcaggcacaactagctcaaactctccaacagcaggagcaggcctcccaaggtctccgtcaccaggttgagcagctgtcaagctctttgaagcagaaggagcagcaactgaaggaggtggccgaaaagcaggaggccactaggcaagaccacgctcagcagctggcaaccgcggcagaggagcgcgaggccagcttgcgagaacgggacgcagcattgaagcagttggaagctttggagaaggagaaggctgctaagctggagattctccagcaacagctgcaagtggcaaacgaagctcgcgactccgcgcagacatcggtcacccaagctcagcgcgaaaaggcagagctcagtaggaaagttgaggagctacaggcttgcgttgaaacggcccggcaggagcagcatgaggcccaggcccaggttgcggagctggagctccagctgagatcagaacagcagaaagcaacagaaaaggagagggtagcccaagaaaaagaccagttacaggaacagctgcaagcccttaaggaaagtctcaaagtcacaaaggggagcttagaggaggagaaaaggagagcagctgacgctctcgaggaacagcagagatgcatctcagagttgaaagccgaaactcgctcgttggtggagcagcataaacgcgaacggaaagagcttgaagaagaaagggcgggcagaaaagggttggaagcacgcttacagcagttgggtgaggcgcatcaggcagagacagaagtgcttcggagggagcttgctgaggccatggccgcgcagcatactgccgagtccgagtgcgaacaactggtcaaagaggtggcagcctggcgagaacggtatgaggacagtcaacaagaggaggcgcagtacggcgccatgtttcaggagcaactgatgacactcaaggaggagtgtgagaaagcgcggcaggagctgcaggaagccaaggagaaagtcgccgggatcgagagccatagtgaacttcagatatcaaggcagcagaacgagctggccgagttacatgcaaatctcgcacgggccctgcagcaagttcaggaaaaagaggtgagggcccagaagttggctgacgatctttccaccctgcaggagaaaatggccgccactagcaaagaggtggcaagactggaaaccctcgtcaggaaagccggcgagcagcaggagacggcctcacgcgagctcgttaaggagcctgccagagctggcgatcgccagcccgaatggcttgaggagcagcaggggcgacagttctgttcgacacaagcagccttgcaggcaatggaacgtgaggctgagcagatgggaaacgagttggagaggcttcgcgctgcactgatggaatctcaaggccagcagcaggaggaacgcggccagcaggaacgggaggtggctcgcctaacccaggaacgcggtagagcccaagcggatctggcgcttgaaaaggctgcacgtgctgagctggaaatgagactccagaatgctcttaatgaacaacgggtggaattcgccacgctgcaggaagccctggcgcacgcattgactgagaaggagggtaaggaccaggagctcgccaaacttcgcggccttgaagccgcacagattaaggaacttgaggagctccgccagactgtgaaacagctgaaggagcaattagctaagaaagaaaaggagcatgccagtggcagcggggcccagagtgaggctgcaggtagaaccgagcccacgggccctaaattagaagccctccgggctgaagtgagtaagctcgagcagcagtgtcaaaaacagcaggaacaggctgattcattggaacgtagcctggaggccgaacgggccagtcgcgcagagcgtgactccgctctcgagactctgcaggggcaattggaggaaaaggcacaggagctcggacattcccaatccgccctggcttccgctcagcgagaactggccgcattccgaacaaaagttcaggatcatagcaaggccgaagacgagtggaaggctcaagtggcccgcggtagacaagaggctgagagaaagaattcactcataagtagccttgaagaagaagtgtcaatcctaaaccggcaggtgctggagaaggagggggagagtaaggaacttaaacgtttggtaatggctgagagcgaaaagagccagaaactggaagagcgcctcagactcctccaggccgagacggctagcaattctgccagagccgccgagcgcagcagcgccctgagggaggaagtacagtcacttcgtgaggaggcagaaaagcaacgggtggcgtccgagaatctgcgacaggagctgacatcccaggctgagagagctgaggagctaggccaggagcttaaagcttggcaagaaaagtttttccagaaagagcaagcactgagtactcttcagctcgaacatacatcaacgcaggcacttgtgtccgagctgttgcctgccaagcacctttgccagcagctacaggccgaacaagccgcggcagaaaaacgccacagagaggaactggagcaatctaaacaggcagccggcgggttgcgcgcggagcttctccgggcccagcgggaattgggtgaactgatccctctccggcaaaaggtggcagagcaagaacgtactgctcaacaactgcgtgccgagaaggccagctacgcagagcagctgtcaatgctgaagaaagctcacggtcttctcgcagaagagaatcggggtctaggagaacgggctaatctagggagacagtttcttgaggttgagcttgaccaggccagggagaaatacgtgcaggagctggccgccgtccgcgcggacgctgaaactcgccttgcggaggtgcagcgcgaagcacaaagcaccgccagggagttggaggtgatgactgcaaaatatgagggagctaaggtgaaggtgctagaggaaagacaaagatttcaggaggagcgacagaagctcacggcccaggttgaggagctttcaaaaaagctggcggacagtgaccaggctagcaaggtccagcagcaaaaacttaaggccgtccaggcccagggtggagagagccagcaggaggctcaacgactacaagcccaactgaacgaacttcaagcccagcttagtcagaaggagcaggcagccgaacactacaaacttcagatggagaaggcaaagacacactacgacgcgaaaaagcaacagaaccaggagctccaggagcaactaaggtccctggagcagctgcagaaggagaataaggaactccgcgctgaggctgaaaggctggggcacgaacttcaacaggcagggctgaagactaaggaagccgagcaaacatgccgccaccttactgcccaggtgaggtcgctggaagctcaggtggctcatgccgatcagcaactacgggacctgggcaagttccaagtggccaccgacgccctgaagagtagagagccacaggctaagccgcagctagatctctctattgactcactggacctctcgtgtgaggaggggacccctctgtccatcacaagcaagttgcctcgaactcaaccagatgggaccagcgtgcctggggagcctgctagccccatcagtcaaaggttgccacctaaggtcgagagccttgaatctctatacttcacaccgatccccgcccgttcccaggctccactggaatcttctctagatagcctcggcgacgtgttcctggacagcggacgtaagacccggtctgctaggcgaagaacaactcaaatcatcaacataacgatgacaaagaagctggatgtggaggagcccgatagcgctaattccagcttttacagtacaagaagtgccccggcatcccaggcttctttacgcgccacctcgagcacacaaagccttgcacgccttggctcgccagattatggcaactctgctctcctcagtctgcccgggtaccgcccaacaacccgttcctcagctagaaggagtcaggcgggagtctcttccggcgctcctcctggcagaaactccttttacatgggcacatgtcaagatgagccagaacagttagacgattggaacaggatcgccgagcttcaacagaggaatagggtctgccccccacaccttaaaacgtgttatcctcttgagtcaaggccgagcctcagtctggggaccatcacagacgaagagatgaagactggggacccccaagagaccttgcggcgggctagtatgcagcctattcagatcgctgaaggaacaggtataacaacccggcaacagcgcaaacgggtatccctggaaccacaccagggccccggcactccagagtctaagaaggcaacatcttgcttccctcggccaatgactccacgagatcgtcacgaggggagaaagcagagcacgactgaagcccaaaagaaggccgccccggcttctactaagcaggccgataggcggcagtccatggcgtttagtattctaaatacccccaagaagctgggtaatagcctgcttcggaggggagccagcaagaaggcccttagcaaggcatcgccaaatactcgctcagggacccgccgcagcccacgaatcgcaacgacaaccgcgtcggcagccaccgcagcagcgatcggagcaaccccccgcgcaaaaggcaaggccaagcattag

SEQ ID NO: 126852 - DNA, 4995 bp, Artificial Sequence
  Description of Artificial Sequence: Synthetic coding sequence
atgttggagacggagcgggggcaacaagaggcgaagctcctcgccgaaagagggcattttgaagaggaaaaacagcaactctcttctctgattactgatctgcagagcagtatatctaatttatcgcaggccaaggaagaactggagcaggcatctcaggcccatggggcaaggctgactgcccaggtcgcctctctgacttctgaactcacaacattaaacgcaaccattcagcagcaggatcaggaactggcgggcctgaagcagcaagctaaggagaaacaagcgcaactcgcccaaacactacaacagcaagaacaggcctctcaggggctacgacaccaggtagaacagctgagtagctctttaaagcaaaaggaacagcagctaaaggaagttgccgagaagcaggaagcgacaagacaggatcacgctcagcagctcgctacagccgccgaagagcgggaagcctctttgcgcgagcgcgatgccgcgctgaagcagcttgaggcattggagaaggagaaggcggctaaactggagattctgcagcagcaactgcaggtagccaatgaggccagggactccgcccagacctccgtcacccaagcccagagggagaaggcggaattatctcgtaaagtcgaagaactgcaggcctgtgtggaaacagcccgtcaggaacagcacgaggcacaggcgcaggtcgcagagttggaattgcagctgaggtctgaacagcagaaggccaccgagaaagaaagagttgcccaggaaaaagatcaactccaagagcagctccaggctctcaaggaaagcttaaaggtgaccaaagggagcctagaggaagagaagcggagggccgccgatgcactcgaggaacagcagcggtgtatttccgaattgaaggcggaaactaggagcctagtggagcagcataaacgggaaagaaaagaactggaagaggaacgtgcagggcggaagggcttagaggcacgactgcagcagcttggagaagcccatcaagctgagactgaggtgctgaggagagagcttgccgaggctatggctgcccaacacactgccgaatcggaatgtgagcaactcgtgaaagaggtcgccgcatggcgcgaacgttatgaggattcacagcaagaggaagcgcagtacggggccatgtttcaggagcaactgatgaccctgaaggaagagtgcgagaaagctagacaggaacttcaggaggccaaagagaaggtcgccgggatcgagagtcactccgaactccagattagcaggcagcagaatgagctggcagaactacacgccaatctcgcccgcgctttgcagcaggtccaggagaaggaagttcgcgcccagaaactcgccgatgacctgagtacgctccaagagaagatggcggcaacctccaaagaggttgccaggcttgaaactttagttaggaaagccggagaacagcaggagacggccagtcgtgagctcgtgaaggaacctgccagggccggagaccggcaaccagaatggctagaagagcagcagggccgtcagttctgcagcactcaagctgccctccaggccatggaacgcgaggccgaacagatgggcaatgagctcgagcgcctcagagctgccctaatggagtcccagggtcagcagcaagaggagaggggccaacaggaacgggaggtagcccggttgacacaagaacgcggtcgagcacaggccgatctggccctagagaaagcggctcgggccgagctggaaatgagactgcagaatgccttgaatgagcagcgggtggagtttgcaaccttacaggaggccctggcgcacgctctgactgaaaaagagggtaaggaccaagagctcgcgaagctgcgcggactcgaagctgcccaaattaaggagctagaggagttgagacagacagttaagcagctgaaagagcaactagccaaaaaggagaaagagcacgcctcgggttcaggcgctcaatcagaagctgcaggacgaacagagcctacaggccccaaattggaggccttgagggctgaggtatcaaaacttgagcagcagtgtcagaagcagcaagagcaagctgacagcctggagcggagcctggaagcggagcgagccagcagggcagagcgtgatagcgcgcttgaaacacttcaggggcagctggaggaaaaagcccaggagctggggcactctcagtcagccctggcgtctgctcagcgggaactcgcagctttcaggacaaaagttcaagatcacagtaaagcggaggacgagtggaaagcccaggttgcgcggggacgccaagaggcagaacgtaagaacagtctgatatctagcctggaagaggaggtctccatacttaacaggcaggtcctagaaaaagagggggaatctaaggaattgaaaagactggtcatggcagagtcggaaaaatcccagaagttagaggagcgactgaggctattacaggccgaaactgcttcaaactctgcgcgcgccgccgagagaagttctgctcttagagaagaagtacagtccctccgcgaagaggcggaaaaacaacgtgtggctagtgaaaatctgaggcaggagctaacatctcaggccgagcgcgcagaagagctgggtcaggagctcaaggcatggcaggagaaattttttcaaaaggaacaggcactgagcactttgcagcttgagcatacctctacacaggctctagttagcgagctgctgcccgcgaagcatctgtgtcagcaacttcaggccgaacaagccgcagctgaaaagagacaccgcgaagaactcgaacagtctaaacaagccgcggggggactgagggccgaattgctgagagcccagagagagttaggggagttgattccattgaggcagaaagtggccgagcaggaacgaacagcccagcagctgcgagctgagaaggcctcctacgccgagcagctgtcaatgctgaaaaaggcacatggacttctcgcagaggaaaaccgaggcttgggtgagcgagccaacctaggaaggcagtttctggaggtagagctggaccaggccagggaaaagtatgtgcaggagttagctgctgtgcgcgcagacgccgaaacccgactggccgaagtacagagagaagctcaaagtacagctcgggaactggaagtaatgaccgcaaaatatgagggcgccaaggttaaggtcttagaagaaaggcagcgtttccaggaggagcgtcaaaagctcaccgcccaagtcgaggaactgtccaaaaaattggcggattccgaccaggccagtaaggtgcagcagcagaagttgaaggcggtacaggcgcagggcggtgagtcgcaacaggaagctcaaaggcttcaggcccagctaaatgagcttcaggcccagctgagccagaaggaacaggccgcagaacattataagctgcagatggagaaagcgaaaacgcattacgacgctaaaaagcagcagaatcaggaactccaggaacaattacggtctctggagcagttacaaaaggagaacaaagaactacgcgccgaagctgaacggttaggccatgaacttcagcaggccgggctgaaaacgaaagaggctgaacagacctgccgtcatttgaccgcccaggtgaggtctttggaagctcaagtggcccatgcagaccagcagctaagagatctcggcaagtttcaggtggccacggatgctctcaagtcacgggaacctcaggcaaagccacagttggacctgtccatcgactcactcgacctgagctgcgaggaggggacgcccctgagcattacaagcaaattaccccgaactcaacctgatggaacctctgtgccaggcgaaccggcgtccccgatttcgcaacggctaccacccaaagtcgagtctttggagtctctctatttcacacctatccccgcacgttcgcaagctcccctcgaaagcagcctcgactcccttggcgacgtattcctggacagcggcagaaaaacgagaagtgcaaggcggcgcactacacaaattatcaatattactatgacgaagaaactcgatgtggaggaacctgattctgccaatagttcattctattctactcgttccgcacctgccagtcaagcttcactcagggccacgagtagtacccaaagcctggctcggttaggaagtcccgactacgggaattcagccctgctttccttaccaggctacaggcccactacgcgttctagcgcaaggcggtcccaggcgggggtctcttctggagccccgcctggacggaatagtttctacatggggacatgccaagatgagccagaacagttagacgattggaaccggatagcagagctccagcagaggaaccgggtttgtcctccgcacctcaaaacatgttatcccctcgagtcacgcccgtctctttccctggggacaataaccgatgaagaaatgaaaacaggcgatcctcaggagacactcaggcgggcatcaatgcagcctatccagatcgctgagggcacaggcatcacaactaggcaacagcgaaaacgggtctccttagaacctcaccagggcccaggtacccccgaatccaagaaggccacgagctgtttccctaggcccatgacccctagagatcggcacgagggacggaaacagagtaccacagaagcccagaagaaagcagcccccgcgagcacaaagcaggccgatagaagacagtctatggcctttagcattctgaatacgcctaagaagctgggcaattccctgctccgacgcggggcttccaaaaaggccttatccaaggcctcaccaaacacccggagcggtacccgacggagtcctaggattgctacgactacagcctctgccgcaacagctgccgctatcggcgcaacgcctagagcaaaagggaaggccaagcattag

SEQ ID NO: 126853 - DNA, 228 bp, Artificial Sequence
  Description of Artificial Sequence: Synthetic coding sequence
atgactttacacgctactcggggcgcggcactgctgagctgggtcaattcactgcatgtggccgatcccgtggaggccgtcctgcagctgcaggactgtagtattttcatcaaaattatcgacagaattcatggcacagaagagggccagcagattttaaaacagcccgtctcagagcgcctagacttcgtctgtagtttcctccagaaaaatcgtaagcacccttag

SEQ ID NO: 126854 - DNA, 276 bp, Artificial Sequence
  Description of Artificial Sequence: Synthetic coding sequence
atgaccttgcacgccactagaggggccgctttactatcatgggtcaacagcttacacgtggccgatcctgtggaagcggtgcttcaacttcaagattgctctatctttattaaaatcatcgataggattcacgggaccgaagagggccagcagatcctcaagcagcccgtcagcgagagactggatttcgtgtgtagtttcttgcaaaaaaaccgtaagcaccctagtagcccggagtgcctggtcagtgcacaaaaggttctggaaggaagctag

SEQ ID NO: 126855 - DNA, 6348 bp, Artificial Sequence
  Description of Artificial Sequence: Synthetic coding sequence
atgacactacacgccactagaggagccgctttattatcatgggtgaactctctgcacgtggcagaccctgtcgaggcagtactacagctccaggactgctcaattttcatcaaaataattgaccggatacatggaaccgaagagggccagcaaattctgaagcagcccgtgtcagagcgcctggactttgtgtgctctttcctgcagaaaaatcgaaagcacccctcgagtcctgaatgtctcgtctccgctcagaaggttttggagggcagcgaactcgagctcgctaagatgaccatgcttcttctgtaccatagtaccatgtccagcaaatcaccacgggactgggaacagtttgagtacaaaatccaggccgaattggctgtgattttaaagttcgtgcttgatcatgaggatggactaaacctgaacgaggacctcgagaacttcttgcagaaggcaccagtcccgtctacttgttcctccacattccctgaagaattgagtccaccttctcaccaggctaaacgcgaaatccgatttctggagctccagaaggtagcttcatcctcatccggaaacaatttcctctctggttccccagcgagtccaatgggagacattctgcaaactccgcagttccagatgagaaggcttaagaaacagctcgcagatgagcgctccaatcgagatgagctggagctcgagttggctgaaaatcgcaaattgctcacagagaaggatgcccagatcgcgatgatgcagcaaaggatagatcgacttgctctgctcaatgagaagcaggcggcatcacctctggaacctaaggagttggaggagctgagggacaagaacgagtctctgaccatgcgcttacatgaaactctgaagcagtgtcaggacctcaagaccgagaagtctcagatggaccgaaaaatcaatcaactctctgaggagaatggcgacctgagcttcaaactgcgggagttcgcatctcatctgcagcagttgcaggatgctcttaacgaattgactgaggagcatagcaaggcgacacaggagtggctggaaaaacaagcccagctggaaaaggagctgagtgctgctctccaggacaaaaagtgccttgaagaaaaaaacgaaattctgcagggcaaactgagtcagctggaggaacacctgtcacagctgcaggacaaccccccccaagaaaaaggtgaggtgttgggagatgttttgcaactggagacccttaaacaggaagccgcaacactcgctgctaacaacacacaactccaggcacgcgtggaaatgctggaaacagaaagggggcagcaagaagctaaattgctcgccgagcgtggccacttcgaagaagagaagcaacagctgagcagcctcatcactgaccttcagagcagcatatctaacctgtctcaagctaaggaggagctcgaacaagccagtcaggctcacggagccaggctaaccgcccaagtggcttccctaacctccgagctgaccaccctcaatgccactatccagcagcaggatcaggaactggcaggtctgaagcaacaggccaaggaaaaacaggctcagctggcccaaacactgcagcagcaggagcaggcaagccagggccttcgccatcaggtggagcagcttagctcttcactgaagcagaaagagcaacagctgaaagaagtggcagagaagcaggaggctacacggcaggatcatgcccagcaactggctactgccgcagaagagagagaggcctccctcagagaaagagacgccgctctgaagcagttagaggccctggaaaaagagaaagctgccaaactggagattctgcagcaacagctgcaggttgctaacgaagcccgtgattcagcacagacctcagtgactcaggcgcaaagggagaaagccgaactaagcaggaaggtggaggaattgcaagcatgcgtggagacagctagacaggaacagcatgaagcacaagcgcaagtagcggagttggagctgcaattaaggtccgaacaacaaaaggctaccgaaaaagagcgagtggcccaagagaaggatcaactgcaggagcagcttcaggcgctgaaggaatctctgaaagtgaccaaggggagtctggaggaggaaaagcgtcgcgccgccgacgcactcgaggaacagcagagatgcatttctgagctgaaagccgaaactaggtccttggtcgagcaacacaagagagagagaaaggaactcgaggaggaacgcgcagggagaaagggcctggaggcccgtctgcagcagcttggagaagcccatcaagctgagactgaggttcttcgtcgagagctggccgaggctatggccgctcagcatacagccgagtccgaatgtgaacagctcgtcaaggaagtggcagcttggcgggaaagatacgaagactctcagcaggaagaagcccagtatggcgcaatgttccaggagcagttaatgactctgaaggaagagtgcgaaaaagcacggcaggagctgcaagaagccaaggagaaggtcgctggcatcgagagtcattctgagttgcagatctcacggcagcaaaatgaactggctgagcttcacgccaatctcgctcgggcactccagcaggtccaggagaaagaagtcagggctcagaaacttgcggatgacctctctacgctgcaggaaaaaatggccgcgacgtccaaagaagtggcaagactggagactctggttcggaaggctggtgagcaacaggagacagcttctagggaactcgtaaaggagccagcgcgggcgggggatagacagccagagtggcttgaggaacagcaaggaaggcagttttgttcaacccaggccgccctccaggccatggagcgggaggccgaacagatgggcaatgaactggagaggttgcgcgccgccctgatggaatctcaaggccaacagcaggaagagcgcggccaacaagagcgcgaagtggcgcggctgacacaggaaagaggaagagcccaagccgacttggcgttagagaaggcagcgagagccgagttggaaatgaggctgcaaaatgctctgaacgagcagcgagtggaatttgccacattgcaggaagcattggcccatgcgctgaccgaaaaagaaggcaaggaccaagagcttgcaaaactgcgcggcttggaggctgctcagattaaggaactcgaggaactgcgacagactgtaaaacagttaaaggagcaattggccaagaaggaaaaagaacatgcatcaggctcgggggcacagagcgaggcagctgggcgaaccgagcccaccggccccaaattggaagcactgcgggcggaggtgagcaaacttgagcagcagtgtcagaaacagcaggagcaggcagattcactagagcgatcgctggaagctgagagagcatcccgcgccgagagggactctgcacttgaaactttgcagggacaactcgaagaaaaagctcaagaactgggccacagccagtccgctttagcctccgcccagagggagctcgcagctttccgtaccaaggtgcaggaccacagcaaagccgaggatgaatggaaagcccaggtggctcgggggagacaggaagccgagcgtaaaaactctcttatctcctctcttgaagaggaggtaagtattctgaaccgtcaggtgcttgaaaaggagggagagtctaaggagctgaagaggctcgtaatggccgaaagtgagaaatctcagaaactcgaggagaggcttcgcctcctgcaggctgagaccgcctccaactcagcacgcgccgccgaaagatcatctgctcttcgcgaggaggtacaaagcctgcgagaggaggctgagaaacagcgagtcgccagtgagaatctgcgacaggagctgacatcacaggcagagcgggccgaggagctgggacaggagcttaaggcgtggcaggaaaaattctttcaaaaagagcaagccctaagtacactccagcttgagcacacttcaacacaggccctagtttcggagctgcttccggccaagcatctgtgtcaacagcttcaggctgagcaggcggccgccgagaagcggcacagggaagaactcgaacagtccaaacaggccgctgggggccttagggctgaattactgagggcccagcgcgaactgggggagctcatcccgcttcgtcagaaagttgcagagcaagagagaacagcacagcaacttagagcagagaaagccagctatgcagagcaactgagcatgttgaaaaaggcccatgggctcttagctgaagaaaatcgaggacttggtgagagagcgaacctggggcgccaattcctggaagtcgaactggaccaggcaagggagaaatacgtgcaggagctcgcagctgtgcgagcagatgccgagactcgtctggccgaggtacagcgcgaggctcaatcgacggctagggagttggaggtgatgaccgcaaaatatgagggcgcaaaagtgaaagttttagaagagcggcagcgcttccaggaagaacgtcagaaactgacagctcaggtcgaacaactggaagtttttcagagggagcagaccaaacaggtagaagagctttcgaagaaactggccgacagcgatcaggcatcgaaggtccagcaacagaaactaaaggcagttcaggctcaagggggcgaatctcagcaggaggctcagcgactccaggcccagttgaatgaattgcaggcccaactgtctcaaaaagaacaggctgccgaacactacaagctacagatggaaaaggcaaagactcactacgacgctaagaagcagcagaaccaagagctgcaggaacaactgagatccctcgaacagctgcagaaagaaaacaaggaacttcgagccgaggccgagcgcctgggtcacgagctacagcaggctggcctcaaaacaaaggaagccgaacaaacgtgtagacacctgacagcacaggtgagatcactggaagcccaggttgctcacgccgaccagcagctcagggatcttggaaagttccaggtagctaccgatgcccttaaatcaagagaaccccaggcgaagccacagttggatttgagcatagactcactggacctttcttgtgaagagggcacaccactgtctattacaagcaaactcccacgcactcagccagatggtacgtcggtgcccggggagcccgcctccccaatcagtcaacgccttccccccaaggtcgaaagtctggagagcctgtactttacgcccatcccagctagatcgcaggccccactcgaatcttcactggactcactcggcgacgtgttcctcgattctggccgcaaaaccagatcagcccggaggagaacaactcagatcataaacattaccatgacgaagaagcttgatgtggaagagcccgatagcgctaattcgagcttctattccactaggtcagcccccgccagccaagccagccttcgggccacctctagcacccagtcactggccaggctcggcagccctgattatggtaacagcgcactgctttcactgccagggtataggcccacaacccgaagcagcgctagacgttcccaggccggcgtgtcatcgggggcacccccgggccgcaacagtttttatatggggacttgccaagatgagccagaacagttggacgattggaatcgaatcgccgagctacagcagagaaatcgggtctgtccaccgcatctcaagacctgctaccccctcgaaagcagaccgtctctaagcctcggcacgattaccgacgaagagatgaagacaggagatccccaggaaactctcagaagagcctccatgcaacctatccagatcgccgaggggacaggtattacaactaggcagcagcggaaacgggtgagcttggagccacaccagggccccggtacaccggagagtaagaaagcaaccagttgcttcccccggcctatgacccctcgtgaccggcatgaaggccgcaaacagagcacgaccgaggcccaaaagaaggccgccccagcaagcacaaagcaagctgatcgcaggcagtctatggccttctcgatattgaacactcccaagaagctggggaattccctgctacgccgtggcgcgagcaagaaagcgctaagcaaggcttcgcctaacacacggtccggtactcgacgcagtcctcggatcgccacgactaccgcctctgctgcaacagctgcagctattggagcaacaccacgcgctaagggcaaagcaaagcattag

SEQ ID NO: 126856 - DNA, 330 bp, Artificial Sequence
  Description of Artificial Sequence: Synthetic coding sequence
atgaccctgcacgcaaccagaggagccgccctcctgtcctgggtaaattccctccacgtggctgatccagtagaagccgtcctccagcttcaggattgctctatttttatcaagatcatcgaccgcatccatggaacggaagaggggcagcaaatacttaagcagcccgtgtcagagcggctggattttgtatgcagtttcctgcagaagaaccgaaaacatccttcttccccagaatgtctcgtgtcagcccagaaagttctcgagggaagcgagctggaactggccaagatgacaatgttactgctgtatcatagcaccatgagttag

SEQ ID NO: 126857 - DNA, 186 bp, Artificial Sequence
  Description of Artificial Sequence: Synthetic coding sequence
atgacattacatgccacgcggggtgccgcattactgtcctgggtgaattcccttcacgtggctgatccagtcgaagccgttctgcaattgcaggattgttctatctttataaaaatcattgacaggatccacgggacggaggagggacagcaaatcctgaagcaaccagtgtccgagaggctatag

SEQ ID NO: 126858 - DNA, 180 bp, Artificial Sequence
  Description of Artificial Sequence: Synthetic coding sequence
atgaccctgcacgcaacacggggagcagcactcctatcatgggtcaacagcctgcacgtggctgatccagttgaggcagttctccaactccaggactgctccatatttatcaagattatcgatcgcattcacgggacggaagaagggcagcagattctgaagcagcctgtatccgagtag

SEQ ID NO: 126859 - DNA, 441 bp, Artificial Sequence
  Description of Artificial Sequence: Synthetic coding sequence
atgacactgcacgctacacgtggagccgccctgttatcttgggtgaattcactgcacgtggccgaccccgttgaagccgttctgcagctgcaagactgctccatttttataaagatcatcgatagaattcacgggactgaggagggtcagcagatcctaaagcaacccgtttccgagagactagactttgtgtgcagcttcctccagaagaatcgcaagcaccccagttcccccgaatgtctggtgtctgctcagaaggttcttgagggttcagaactggagctcgcaaaaatgaccatgctcttgctgtaccacagtactatgtcctctaagagtccgcgagattgggagcagtttgagtataaaatccaggctgagttagccgtgatcctcaaattcgtgctggatcacgaggacggactcaatctcaacgaagactag

SEQ ID NO: 126860 - DNA, 3267 bp, Artificial Sequence
  Description of Artificial Sequence: Synthetic coding sequence
atgcgactccagaatgcgctgaatgaacaacgcgtggagtttgccactctgcaggaagctctggctcacgcgctcactgagaaggaggggaaggatcaggagctggccaagttgaggggcctcgaggccgctcagatcaaggaactcgaggaattaagacagacagtcaagcagctcaaggagcagctggctaagaaggaaaaggagcacgcctctggctcaggggctcaatcagaagctgccggccggactgagcctacagggcctaagctagaggcattacgcgccgaagtctcaaagctggagcaacagtgccaaaaacagcaggagcaagcggactcactcgagcgcagcctcgaggctgagcgcgccagccgtgctgaacgcgatagcgccctggagaccctgcagggccagctggaggagaaagcccaggaactcggacactcacagtctgccttagcctccgcccaaagagaactagctgcatttaggacgaaggttcaggaccattcgaaagcagaagacgagtggaaagcacaagtagctcgcgggagacaggaagcggagagaaagaacagcctgataagttccctggaggaggaggtttcgatcctgaatagacaggtgttggagaaggagggtgagtctaaagaactcaagcgacttgttatggcggagtctgagaaatcccaaaaactcgaagaacgcctgaggctgctgcaagccgagactgcttctaactctgcgagagccgccgagcgcagcagtgctctcagggaggaagtccagagcctgcgtgaagaagctgagaaacagagagtagcctctgagaacctgcgtcaggaattgactagccaggcagaaagagccgaggaactagggcaagaacttaaggcatggcaagagaaattcttccagaaggaacaagccctgtctactcttcaacttgaacatacatccacccaggcactcgtatcggaattgctgccagccaaacatctgtgccaacagttacaggctgaacaagcagcagccgagaagcggcatagagaagagctcgaacagagcaagcaggccgctggaggcttgcgggccgaactactcagggctcagcgtgagctcggcgaacttatcccactgagacagaaggtggccgagcaggagagaaccgcccagcagctgcgcgcggagaaggcatcttatgccgagcagctcagcatgctcaaaaaagcccacggcctgcttgccgaggagaaccgcgggctgggagagagggccaaccttggaagacaatttctcgaggtggaacttgaccaggccagagagaagtatgtccaagagctggcggcagtgcgggctgatgccgagactagactggcggaggtccaaagagaagcccaatctacggcgagggagctggaagtgatgaccgcaaagtatgagggagccaaagtgaaggtccttgaggagagacagcgctttcaggaggaacgtcagaagctaactgcccaagtggaagaactaagtaagaaattagcagacagcgatcaggccagcaaagtacagcagcagaagctcaaagcagtgcaggctcagggtggggagtcacaacaagaggcccagaggctgcaagcccagctcaatgagctgcaagcacagctgagccagaaggagcaggccgcagagcactacaagcttcaaatggagaaggcgaagacgcattacgacgctaaaaagcagcagaaccaggaactccaggagcagctcagatccctcgagcagctacagaaggagaacaaggagctcagagccgaggccgaacgacttggacatgagctgcagcaggcagggttgaagactaaggaggctgaacagacatgcaggcacctcaccgcccaggtgcggtctctggaggctcaggtggcacacgcagaccagcagttgcgcgacctaggcaaattccaggtcgcaaccgacgccctaaaaagccgggaaccccaggcgaaacctcagttggatctcagtattgatagcctcgatctctcatgcgaggaagggactcctctctctatcacgcggcacaaagccctgatgactattatcccagacctgtcccctaataacccattgagcaagctccctcggacccagccagacggcacaagtgtacccggtgagcccgctagtcccatttcccagcgattgccccccaaagtggagagcctggagagcctgtactttacgcctattcctgcccggagtcaggccccactcgaatctagtttagactcactcggcgacgtctttctggattcaggcaggaagactcgcagcgcacggcgaaggaccactcagattatcaatattaccatgaccaaaaagctagatgtggaggagccggatagcgccaatagcagtttctattcgacccgaagcgcaccagcgagccaagcctccctccgcgcgaccagtagtacacagagccttgccagactcggatctcccgactatgggaactccgcacttctgtcgttgcccgggtaccgcccaactacaaggtctagtgctaggagaagccaggctggcgtctcctccggtgcgcctcccgggaggaattcattttatatgggaacctgtcaggatgagcctgagcagctggatgactggaacagaatcgcggagttgcagcaacggaatcgagtgtgccccccccacctaaagacttgctacccattggaatctcgaccatcactgtcactcgggactatcaccgacgaggagatgaagacaggagatccccaggaaactttacgcagagcaagcatgcagcctatccagatagccgaaggcacaggcattaccactaggcagcaacgcaaaagggtgtcactcgaaccacatcaggggccaggaacgcccgaatctaaaaaagctacgtcatgcttcccccggccgatgacccctagggatagacacgagggtcgaaagcagtctaccacagaagctcagaagaaggccgcaccagcatctactaagcaggccgatcggaggcagtccatggcattcagcatcctaaatacgccaaaaaaacttggaaatagccttctccgccgcggtgcctcaaagaaggctttatcaaaggccagtcctaacaccaggtccgggactagacgaagtccacgaatagcgactaccacagcttccgccgctacggctgccgccattggagctactcccagagctaagggaaaggcaaaacactag

SEQ ID NO: 126861 - DNA, 2076 bp, Artificial Sequence
  Description of Artificial Sequence: Synthetic coding sequence
atgaccctgcacgcaacccgcggggctgcactgctctcctgggtaaatagtctccacgtggccgaccccgtggaggccgtgctgcaactccaggactgttccatcttcatcaagatcatcgataggatccacggaaccgaagaaggccagcaaatcttgaagcagccagtgagtgaacgactggattttgtttgctcattcttacagaagaatagaaagcaccctagctcccccgagtgcctggtttcagcacagaaagttcttgaggggagtgagttagaacttgccaaaatgaccatgttgctcctgtatcactctactatgtccagcaagtccccgcgagattgggagcagttcgaatataaaatccaggcagagctcgccgtgatactgaagttcgttttggaccacgaggatgggctcaatttaaatgaagatctggagaatttccttcagaaagcaccggtacctagcacctgttcctcgacttttcctgaagaactaagcccccccagccaccaagccaaacgcgaaatacgtttcctggagcttcagaaagtagcctcctccagcagtggcaacaattttctttctggttctccggcatccccaatgggtgatatactccagacgcctcagttccaaatgcggagactgaagaagcaacttgccgatgagcgctcaaatcgcgacgagctcgagttggaactcgctgaaaatagaaagctattgacagagaaagacgcgcagatcgccatgatgcaacagcggatcgaccgcttagccctgttgaacgaaaagcaagcagctagcccacttgagcctaaagagttggaggagctccgagataagaacgagtctctgactatgcggttgcatgaaaccctcaagcaatgtcaggacctaaagaccgaaaagtcgcagatggatcggaaaattaaccagctatctgaagagaacggtgacttatccttcaagctgagagagttcgcgtcccacctacagcaactccaggacgctctgaatgagctgactgaagagcactctaaggcaacgcaggagtggctcgagaagcaggcgcagctggagaaagaattatctgcagctctgcaggacaagaaatgcctcgaagagaagaacgagattcttcagggtaagctgtctcagctggaggagcatctgtcccagctccaggacaatccgccacaagagaaaggcgaagtactgggcgatgttttacagctggaaactttaaagcaggaggcagcgacactggccgcgaataacactcagttgcaagctcgggtggaaatgctagagactgagagggggcagcaggaagctaaactgcttgccgagaggggccactttgaagaggaaaagcaacaactgtcgagcttaattactgatctgcagtcctcaattagtaacctttcacaagccaaagaagaattagaacaggccagccaggcacacggagcacggctcacagcgcaggtggcgagtctgacaagcgaactcactactcttaatgcgacaatacagcaacaagatcaggaactcgccggcctgaaacaacaagcaaaggagaagcaggctcagctcgcccaaacactccagcagcaagagcaagcatcccaaggattaagacaccaggtggagcagctgtcctcatcccttaaacaaaaggagcaacagcttaaagaagtagccgagaagcaggaggcaaccagacaagatcacgcgcagcagttggcgactgcagccgaagagagagaggcatcattgcgcgagagagacgccgccttaaagcaactggaagctttggagaaagagaaggccgccaagttggaaatcctgcagcagcaactgcaggtggccaatgaggccagggacagcgctcaaacaagcgtcacccaggcacagcgagaaaaagccgagttgagcagaaaggtggaagagttgcaagcttgtgtagagaccgctaggcaggaacaacatgaggctcaggcgcaggtggctgagcttgaattgcagctccggagcgagcagcaaaaagccacagaaaaggagtag

SEQ ID NO: 126862 - DNA, 480 bp, Artificial Sequence
  Description of Artificial Sequence: Synthetic coding sequence
atgactctgcatgccacccgaggcgcagcactcctgtcatgggtaaactctcttcacgtggcagaccccgtggaggccgttcttcagctgcaggattgcagcatcttcatcaagattattgacaggatacacggcaccgaagagggccaacagattctcaaacagcctgtaagtgagcgcttggatttcgtatgcagttttctccagaagaatcggaagcatcccagctctcccgaatgtcttgtgtcagcccagaaagtgctggaggggagcgagttggagttagctaaaatgaccatgctcctgttgtatcattccacaatgtcgagcaagagtcccagagactgggaacagttcgaatataaaattcaggctgagctcgccgttatactgaaatttgtactcgaccacgaagatggcctgaacttgaacgaggacctcgagaactttctgcaaaaggcccctgttccatcaacatag

SEQ ID NO: 126863 - DNA, 219 bp, Artificial Sequence
  Description of Artificial Sequence: Synthetic coding sequence
atgacactgcacgctaccaggggcgccgccctactatcatgggtaaacagcctgcatgtggctgacccagttgaggcagtgctgcaactgcaggattgttctatcttcataaagatcattgacagaattcatggcaccgaggaagggcaacagattctcaaacagcccgttagcgagagactggactttgtgtgttcatttctgcagaagaatagatag

SEQ ID NO: 126864 - DNA, 252 bp, Artificial Sequence
  Description of Artificial Sequence: Synthetic coding sequence
atgacgctgcatgcgacccggggagcggccctcttgtcatgggtgaacagcctccacgtggccgatcccgtggaggccgtgcttcaactgcaggattgctctatatttattaaaatcatcgaccgtatccacggtacagaggaaggccagcaaattctaaaacagcctgtgtcagagcggctggacttcgtatgtagttttctgcagaagaatcggaaacacccgtcgtcccctgaatgtctggtttcttag

SEQ ID NO: 126865 - DNA, 2559 bp, Artificial Sequence
  Description of Artificial Sequence: Synthetic coding sequence
atgaccctgcacgccacgagaggagcagctctgctgagttgggtgaactctctccacgtcgcagaccccgtggaggcggtgttgcagctccaggactgcagcatttttatcaagataatcgacagaatccatggcacagaggagggtcaacagatcctcaagcaaccagtgagcgaaagactggactttgtgtgttccttcctgcaaaaaaacagaaaacatccatcatcccccgaatgtttggtaagcgcccagaaagtcctggaaggctccgagctcgagctggcaaaaatgaccatgctcctgctctaccatagtactatgagttctaagagcccccgggactgggagcagttcgagtataagattcaggccgaactggctgttatcctgaagtttgtgctcgaccacgaagacggcctgaacttgaacgaagacctcgagaattttctccagaaagcccctgttccatctacgtgctccagcacattcccggaagagctgagtccacctagccaccaggctaaaagagagatccgatttctggagctgcagaaggtcgcctcttccagctcaggtaataactttctgtctgggtctccggcctcgcctatgggagacatactgcagactcctcagtttcagatgaggcgactaaagaagcagttagccgacgagagaagcaatcgcgatgagctggagctggagctcgcggagaaccggaaactactcaccgaaaaggatgctcaaattgcgatgatgcaacaaaggatagaccggctggccttgctgaatgagaagcaggcagcgagtccactggagcctaaagagctggaagagctccgagacaaaaatgagagcctaacaatgcggttacatgagacactaaaacagtgtcaggacctaaaaactgagaaatctcaaatggatcggaagattaatcagctgtccgaggaaaatggcgacctttctttcaagctcagggaattcgccagccatctgcaacaattgcaagatgcactaaatgaactgaccgaggaacactcaaaagcaacccaggaatggcttgaaaaacaggcccagctcgagaaagagttatccgccgctctccaagataaaaaatgcttagaggagaagaacgaaatactccaagggaagctatcccaattggaggaacacctatcacagcttcaggacaacccaccccaggaaaagggagaggtcctgggcgacgttttacagctcgaaaccctgaaacaggaggcggccacactggccgccaataacacgcagttacaagcaagagtcgagatgctcgagacagagcggggccaacaggaggcaaagctccttgcagaaaggggtcactttgaggaagaaaagcagcaactaagctccttgattaccgaccttcagtccagcatctcaaacttaagccaggctaaggaagagctggaacaggcctcacaggcccacggcgctcggctcaccgcacaggtggccagtctgacatcagagctaaccactcttaacgctacaatacagcaacaggaccaagagctggctggactgaaacaacaggctaaggaaaagcaggcccagctcgcccagacactgcaacaacaggaacaggcttcgcagggtttacggcaccaggttgaacagctgagctcatcactcaagcagaaagagcagcagctcaaggaagtcgcggagaagcaagaagctacgcgccaagatcatgctcagcagttagctacagcagccgaggagagggaagcttctttgcgggagcgcgatgctgctctaaagcaactggaagccctggagaaagagaaagccgctaagcttgaaatccttcaacagcagttgcaggtggccaacgaggccagagatagtgcccagacatcagtcacccaggcccagcgagagaaagccgaactttcccgaaaggtggaggagctgcaggcttgcgtagaaacagcgcgccaggagcagcacgaggcacaagctcaggttgctgaattggaattgcagctgcgcagtgagcaacaaaaggccacagaaaaggagcgagtggctcaggaaaaagaccaactccaggagcagctccaagcactaaaggaaagtctgaaagttaccaaaggaagcctagaggaagagaagagacgtgctgcggatgcattagaagaacaacagaggtgtatcagcgaactgaaagccgagactcggtccctcgtcgagcagcacaagcgtgagcgtaaagagctggaagaggaaagggcaggtcgcaaaggactggaggcccgtctacagcagttgggcgaggcacatcaagccgaaaccgaggtgttacgccgcgaattggctgaggctatggctgctcagcacacagccgaatcggagtgtgagcagttggttaaggaggtggcggcatggcgtgagaggtacgaggacagccagcaggaggaagcccagtatggcgctatgtttcaagaacagctgatgacgctgaaagaggagtgtgaaaaggctcgccaagaacttcaagaagcctag

SEQ ID NO: 126866 - DNA, 525 bp, Artificial Sequence
  Description of Artificial Sequence: Synthetic coding sequence
atgaccctacatgctaccagaggcgcggctctgttaagctgggtgaattccctgcacgttgctgacccagtggaagccgtcttgcaactgcaagactgcagcatttttattaagatcatcgaccggattcatgggacggaagaggggcagcaaattctgaagcaacccgtgtccgagaggttagattttgtttgtagcttcctgcagaagaacaggaaacatccttcaagccccgagtgtctggtgagcgcccagaaggtgctggagggctcagagctcgaacttgcaaagatgacaatgctgcttttgtatcatagcaccatgagtagtaagtcccctcgagactgggaacagtttgaatacaagatacaagccgaactggccgtgattttaaagtttgtgctggatcacgaggatggactgaatcttaatgaggaccttgaaaacttcttgcagaaggcgcctgttccctccacctgcagctctacattccctgaagagctgagtccgccctcccaccagtag

SEQ ID NO: 126867 - DNA, 606 bp, Artificial Sequence
  Description of Artificial Sequence: Synthetic coding sequence
atgacactgcatgccaccagaggggccgcgctcctgtcctgggttaatagtctccacgtggccgatcccgtagaggccgtccttcagcttcaggactgcagtatcttcattaaaatcattgaccggattcacggtacggaggagggacaacaaatccttaagcagccggtctctgagcgactggatttcgtgtgcagctttctccaaaaaaaccgcaaacaccccagctccccagaatgtctcgtctcagcccagaaggtgctcgaaggaagtgagttggaactggccaaaatgactatgctgctgctgtaccatagtaccatgtccagcaagagccctcgtgactgggaacagttcgagtataagattcaggcagaactggcagtgatcttaaagtttgtgctagaccacgaggacggcctgaacttgaacgaagacttagaaaatttcctccagaaggcccccgttcccagtacttgttcttctaccttcccagaagagctcagcccacccagccaccaagccaagcgagagattcgatttttggaactccaaaaggtggcctcatcctccagcgggaataatttcttgtcaggcagtccatag

SEQ ID NO: 126868 - DNA, 480 bp, Artificial Sequence
  Description of Artificial Sequence: Synthetic coding sequence
atgaccctgcacgccacgagaggggctgccttgctgagctgggttaactctcttcacgtggccgacccagtcgaagccgtgttgcaactccaggattgctccattttcatcaagatcattgataggatccatggaacggaagaggggcaacagatcctgaagcagccagtctctgagcgactggacttcgtgtgttcctttctgcagaagaaccgaaaacacccatcatcccccgaatgtcttgtgagcgcccagaaggtgttggagggaagtgagctcgaactggcaaaaatgaccatgctgctgctctatcactccacgatgtcatcgaagtcgcctcgcgattgggagcaatttgaatataagatccaggccgaactggcagtcatcctgaagtttgttcttgatcacgaggacggcttgaacttaaacgaggacctggaaaattttctgcaaaaggcgccagtgccctcaacctag

SEQ ID NO: 126869 - DNA, 663 bp, Artificial Sequence
  Description of Artificial Sequence: Synthetic coding sequence
atgacactccacgctactcgcggggcagcacttttatcctgggttaacagcctccacgtagccgacccagtggaggccgttcttcagctgcaggactgttctatttttatcaaaatcatcgatcgcatccatggaaccgaagagggccagcagattctgaagcaacccgtgtctgagcgattggatttcgtgtgctctttcctccaaaaaaatcgcaagcaccccagtagtcccgagtgtttggttagtgctcagaaggtactggaagggagtgaactggaattagccaagatgacgatgttgttgctgtatcattcaaccatgtcctccaagagcccaagggattgggagcagtttgaatacaagatccaggctgagctggccgtcatcttgaaatttgtgctagatcacgaggatggactgaatctcaatgaagatctcgaaaactttttgcagaaagcacctgtgccctccacttgtagtagcaccttccccgaggagctgtccccacccagtcaccaggctaaacgcgagattagatttctggagctgcagaaggtagcaagcagcagttccggaaataatttcctgagtggctcacccgccagccccatgggagatattttacagacaccacaattccagatgagacgcttgaaatag

SEQ ID NO: 126870 - DNA, 171 bp, Artificial Sequence
  Description of Artificial Sequence: Synthetic coding sequence
atgacactgcatgcaacaagaggggctgcgttactgtcatgggtgaactctttgcatgtcgcagatccagtggaagccgttctgcagttacaggactgttccatcttcattaagatcatcgaccgcatacacgggactgaggaaggacagcagatacttaagcaaccctag

SEQ ID NO: 126871 - DNA, 1053 bp, Artificial Sequence
  Description of Artificial Sequence: Synthetic coding sequence
atgttttgctgcctcggctatgaatggcttagcggcggctgtaaaacatggcactccgcctgggtgatcaatacactcgcagaccacagacaccgagggactgacttcggcggcagcccttggttgctgatcattacagtttttctgaggtcttataagtttgccatatcactgtgtacaagctatctgtgcgtgagcttcctgaagacaattttcccttctcagaacggacatgacggatctaccgatgtgcaacagagagctagaagatccaaccggagacgccaggaaggaattaagatcgtgttagaggacatcttcacactgtggcgacaggttgaaactaaagtgagagctaaaatccgaaagatgaaagtgacaactaaagtgaaccggcacgataaaattaatggcaagagaaagactgcaaaggagcacctgagaaagctctccatgaaagagcgcgaacacggagaaaaagagagacaggtgtccgaggctgaagaaaatggcaaattggatatgaaagaaattcacacatacatggaaatgttccagagggcacaggctttaaggcggagggccgaagattactatcgatgcaagattaccccctccgcccgtaaacccttatgtaacagagtgcggatggcggcggtggagcacagacactcgtctgggcttccgtactggccatacctgactgctgagaccttgaagaatcgaatgggccatcaacctccgccacccacccagcagcacagcatcatcgataacagcctgagcctcaaaactccatctgaatgccttctaacccccctgcctccttccgccctgccctcggccgacgacaacctcaagactcccgccgagtgtttactgtaccctctacctccttcagcagatgataatcttaagaccccccccgaatgcctgcttactccactccctccatccgccccccctagcgtcgatgacaatctaaaaactcctccagaatgcgtatgcagcctgccattccacccccaacgcatgataataagtaggaactag

SEQ ID NO: 126872 - DNA, 1053 bp, Artificial Sequence
  Description of Artificial Sequence: Synthetic coding sequence
atgttttgctgtcttggatatgaatggttatccggtggctgcaagacatggcactctgcctgggtgatcaatacactcgcagaccacagacaccgtggcacagacttcggagggagtccgtggcttctgatcatcacagtctttctgcgatcctacaaatttgccatctcactgtgcacatcatatctttgtgtaagctttttgaagaccatattcccctcacagaatgggcacgatgggtcgaccgacgtgcagcagagagcaaggcggagcaataggcggcggcaggagggcattaagatcgtgctggaagatatctttaccctgtggaggcaggtggagaccaaagtgcgagccaagatccgcaagatgaaggttactactaaagtaaataggcatgataagatcaatggaaagagaaaaaccgctaaagaacatctccggaagctctcaatgaaggagcgtgaacacggagaaaaggagcggcaggtgagcgaggccgaggagaacggcaagctggacatgaaggagatccatacatacatggagatgtttcagagagcccaagcccttcgacgacgagccgaggattattatcgctgcaagatcactccatcagctcggaaacccctatgcaacagagtcaggatggccgctgttgaacatcggcactcgtccggcttgccctattggccttaccttaccgccgaaaccctcaagaaccggatgggtcaccagccaccgccacctactcaacagcacagcatcattgataattctctctcactcaaaaccccctcagaatgcctcctgactcctttgccacctagtgctttaccgtcagcagatgataacttgaaaactccagccgagtgtttgctctatcccctgccacccagcgccgacgacaatctgaagacgcctcctgagtgtctgctcacacccctcccacctagtgccccaccgtccgtagacgataatctgaaaactccaccggagtgcgtgtgttctcttccatttcacccccagaggatgatcatctccagaaactag

SEQ ID NO: 126873 - DNA, 1431 bp, Artificial Sequence
  Description of Artificial Sequence: Synthetic coding sequence
atggcaagcccattctcaggggcccttcagcttacggatttggacgactttattgggcccagtcaggagtgcataaagccagtaaaagttgaaaagcgggccggaagtggggtagccaaaatacggatcgaagatgatggcagttactttcaaatcaatcaggacggcggcacgcggcgacttgagaaagcgaaagtgtcgctgaatgactgcctcgcatgcagtggctgcataaccagcgccgaaaccgttctgataactcagcaatcacatgaggagcttaaaaaggtcctggacgcaaataagatggccgcaccgtctcaacaacgcctggtagtggtcagtgtgtcgccccaaagcagagcctcacttgccgcccgcttccaacttaatccaactgacaccgcaagaaaacttaccagcttctttaagaagattggcgttcatttcgtgttcgatacagcgtttagcaggcacttttcgctcttggagagccaacgggagtttgtgcgccggttcagagggcaagccgactgtcgccaagcgctccctctcctggcatcggcttgtcccggatggatctgctacgccgagaagactcacggctcgtttatcttgccacacatctcaactgcacgcagcccgcagcaggtgatgggatcacttgtgaaagactttttcgctcagcaacaacatctcacccccgacaagatataccacgtcaccgtcatgccttgctatgataagaagctggaggccagccgcccagacttctttaatcaggagcaccaaacgcgggatgtcgactgtgtgctgactaccggtgaggtgttccggctgctggaagaggaaggggtctccctgcccgacctcgagcctgccccacttgatagcctgtgtagtggcgccagtgctgaggagcctaccagtcatagaggcggcggcagtggcggctatttagagcatgtgttcaggcacgcagcccgagagctgtttggcatacacgtagctgaagtgacatacaagccactgcggaataaggacttccaggaggtgactctggagaaagaaggtcaggtgctcctgcatttcgcgatggcttatggctttcgaaacatccaaaacctggtccaaagattgaagagaggccgatgtccttaccactacgtagaggtcatggcatgtccaagtggctgcctgaatgggggcggacaattacaagccccggaccgcccaagccgggagttgttgcaacatgtggagcgtctgtatggtatggtacgtgctgaggctcctgaagatgcccctggtgtccaggagctgtacacacactggctgcagggcacagattctgaatgcgctggccggttactccatacacagtaccacgccgtagaaaaggccagcactggactaggaataaggtggtag

SEQ ID NO: 126874 - DNA, 567 bp, Artificial Sequence
  Description of Artificial Sequence: Synthetic coding sequence
atggcttcgcctttcagtggcgcccttcagctgactgaccttgatgactttatcgggcccagccaggagtgcattaagcccgtcaaggtagagaaaagggctggttccggagtggcgaagatacggatagaggatgacggaagttattttcagatcaaccaggatggaggaacacggcgtctggaaaaagccaaagtgagtctcaatgactgcttggcctgctctggctgtattacgtcggccgagaccgtgctcatcacgcagcagtcgcatgaggagctgaagaaggtccttgacgctaacaaggggtgcaccagctctagtacacctccctcacaggggactagcgcctcttggagggcctccgaatctctgtgtggcgattcagaggatagaccaactgccgataggaggtgcccttgttggcccttacccgcacaagcggggagcgccatgcctcgacgtcttacagccgcatcctcaagccctacctcagctccccccgggccccgcagccgatcttgggccccgtggtccagaacctcttcacccagttcaagcacatag

SEQ ID NO: 126875 - DNA, 1125 bp, Artificial Sequence
  Description of Artificial Sequence: Synthetic coding sequence
atggcagcgccctctcaacagcgccttgtcgttgtcagcgtgtcgccgcaatcccgcgcgtcactggccgctcgctttcagttgaatccaacagatacagctagaaagcttacatcatttttcaagaaaatcggtgtccatttcgtgttcgataccgcattcagtcgacatttttccttgctcgagagccagcgcgagttcgtcagaagattccgcggccaggcagactgccggcaagcgctgcctctgcttgcgtccgcctgccccgggtggatttgctacgctgagaaaactcacgggagctttatccttccacatatcagcactgccagatctccccagcaggttatgggtagcctagtcaaggattttttcgctcagcagcaacacctgacaccggacaagatatatcacgtgacagtaatgccctgttacgacaaaaaactggaggcctctcgcccggacttttttaatcaagaacaccagacacgggacgtggactgcgtccttacaacaggagaggtctttcgactgctggaagaagaaggagtgtctttgcccgaccttgagccagctcccttagactcactctgttctggggcaagcgctgaagagccaacctctcatcgtggagggggatccggtggatacctggagcacgtgtttaggcacgctgcaagggagttatttggcattcacgtggctgaagtgacatacaagcccttgcggaacaaagactttcaggaggtgaccttggaaaaggagggccaggtcctcctgcatttcgcaatggcctatggcttccgaaacattcagaacctggtccaacgccttaaaaggggcagatgcccataccactatgtggaagtcatggcttgcccgagcggctgcttaaacggcggcgggcaactacaagcacctgacagacccagccgagaactactgcagcacgtcgaacggttatacgggatggttcgcgcagaggcccccgaggacgccccgggagtgcaggaattgtacacacactggttgcagggaaccgacagtgaatgcgccggccggttgctccatacccagtaccatgcagtcgagaaggcatccaccggactgggcatacggtggtag

SEQ ID NO: 126876 - DNA, 4284 bp, Artificial Sequence
  Description of Artificial Sequence: Synthetic coding sequence
atgctccttcccagcgacgtagccagactcgttctgggctatctccagcaggagaacctcatctccacttgtcagaccttcattctggaatcaagtgatctgaaagaatacgcagaacactgtaccgacgagggctttatcccagcgtgcctcctttctttatttggaaagaacttaacaactattcttaacgaatacgttgctatgaaaactaaggagacttctaacaacgtacctgcaatcatgtcctccctctggaagaagctcgatcacacattgtcgcagattcggtctatgcagagcagcccccgctttgccggctcccagcgcgcccgtacccgtaccgggattgccgagatcaagcgccagcggaaacttgcatctcagactgccccagcgtccgccgagctactcaccctgccctatctgagtggtcagttcactaccccaccaagcactgggactcaagttacaaggcccagcgggcaaatcagtgatcccagtcgcagctatttcgtggtggttaaccactcacagtctcaggataccgttacaacaggtgaggccctcaacgtgatccctggcgcacaggaaaagaaggcgcacgcctcattaatgagccccgggcgaagaaagagcgagtcacagaggaagagcacaactttgtctggaccgcactcgaccatcaggaatttccaggaccctaacgcgttcgctgtggagaaacagatggtgatcgagaacgcgagagaaaaaattttgtccaacaaatccctgcaggaaaagctcgccgagaatatcaacaaatttctgactagtgacaataacatcgcccaggtgcctaagcaaaccgacaataatccgaccgaacccgaaaccagcatagacgaatttctcgggctgccatcggagatccatatgtccgaggaggctatccaagacatcctagaacagaccgagtccgacccggcattccaggccctgttcgacctctttgattatggcaagacgaagaacaacaagaacatttcccagagtatatcgagccagccaatggagagtaacccgagcatcgttttggccgacgaaacaaatcttgcggtaaaaggcagtttcgagaccgaagaaagtgacgggcagtcaggccagcctgcattctgcacatcataccagaatgatgaccccctcaatgccttaaagaattcaaataaccacgacgtcctacgacaggaagatcaagagaacttctctcagatctctacttctatccagaaaaaggctttcaagacggcggttccaacggagcagaaatgtgatatcgatatcacttttgagtccgtaccaaacctgaatgacttcaaccagagagggaactccaacgcagaatgtaatcctcactgtgctgagctgtacacgaaccagatgtcaacggagacagagatggccatcggtatagaaaagaactctctatccagcaatgtgccctccgagagtcaacttcagcccgaccagccggatatccctataacctcattcgtatctttgggctgtgaggctaataatgagaatttaattctgagcggcaagtcttctcagctgctgagtcaagataccagcctgaccgggaagccttctaagaagtcccagttttgcgaaaatagtaatgataccgtgaagctcaagatcaactttcatggttctaagtcttcggattcgtcagaagtacataaaagcaaaatcgagattaacgtgctggaacccgtgatgagtcagttgtccaactgtcaggataatagttgcctccagtcagagatcttgcctgtgagcgtcgaaagctcccacttgaatgtatctggtcaggtcgagattcacctaggcgatagcctatcctccacaaaacaaccatctaacgatagcgccagtgtcgagctgaaccacaccgagaacgaggcacaggccagtaaaagcgagaattcccaggaacccagttcctccgtcaaagaggagaacactatattcctctcactgggcgggaatgcaaattgtgaaaaagtggcgctcactccacctgagggcactccagttgagaacagtcacagcttgccccccgaaagcgtttgtagctctgtcggcgactcccaccccgagtcacaaaacaccgacgacaaacccagtagtaataacagcgctgagattgacgcatccaacatcgtgagcctgaaggtcattatctcagatgaccctttcgttagttctgataccgaacttacatccgccgtgtcttcgattaacggcgagaacctccctacaattatactgtcctccccaaccaaatcgcccactaaaaacgccgagctagttaaatgcctgtcgtccgaagagacagtcggagctgtggtctacgcggaggtgggcgactcagcttcaatggagcagagcctgctcacattcaaatctgaggatagtgcagtgaacaatacccagaatgaggatgggatcgctttctcggctaatgtaaccccctgtgtctccaaggatggtgggtatatccagctgatgcctgccaccagcacagccttcggcaatagcaacaacatattgatcgccacttgcgtgacggatcctacagccctcgggacatccgtgagtcagtccaacgtagtggttctgcctggcaattccgctcccatgactgctcagccactgccacctcaactgcagacaccgccccggtctaactcggtctttgccgttaatcaggccgtctcgccaaacttttcccagggatcagccatcatcatcgcctctcctgtgcaaccagttctgcaggggatggtcggtatgatcccggtgagcgttgtgggacaaaacgggaacaacttctctacgcctccccggcaagtacttcacatgcccctgacagctcctgtctgcaacagatccatcccccagtttcctgttccacccaaatctcagaaagcccaggggctgaggaataaaccttgtatcggaaaacaggtaaataatctggttgatagcagtggtcacagtgttggctgtcatgcccaaaaaactgaggtgtccgataaatccatcgcgacagatctgggcaaaaaaagcgaggagaccacggttccatttcctgaagagagcatcgtgcctgccgcaaagccatgccacaggcgagtcctatgtttcgactccactacagcaccggtggcgaacactcaggggccaaaccataaaatggtgtctcaaaataaagagcggaatgccgtgtcgtttccgaatctggatagcccaaatgtgtcatcaaccttgaaacccccaagtaacaatgcgatcaagagagagaaagaaaagcctccactccctaaaattctgagcaaatctgagagcgccattagcagacataccacgatacgggaaacccagtccgaaaagaaagtcagtccaaccgaaattgtgctggagtcgtttcacaaggccacagctaataaggaaaatgagctttgctccgacgtggagaggcagaaaaaccccgaaaatagtaagctgagcatcgggcagcagaacggaggactgcggtcagaaaagtccatagcctccctccaggagatgacgaaaaaacagggtaccagcagcaacaataaaaatgtgctgagcgtggggaccgccgtgaaagatctcaagcaagagcagactaaaagtgcatcttccctgattacgacagagatgcttcaggacatacaaagacacagttcagtttcccgcctggccgattcttcggatcttcctgttcccagaacgcctggttccggcgctggagaaaaacataaagaggaacctattgacatcataaaggcacccagtagtaggagattctcagaggactcatctactagcaaagtcatggtgccaccagtgacccctgaccttcccgcttgcagtcctgcctctgaaaccggatctgaaaattccgtgaacatggcggctcacaccctaatgatcctgagccgcgcagccatctcccgaacgacatccgccacgccacttaaagataacacacagcagtttcgggcttcctcgaggtccacaacaaagaagcgcaagattgaggaacttgacgagcgagaacgtaactccagacctagctccaaaaacttaaccaattccagcatcccaatgaaaaaaaaaaaaattaaaaaaaaaaagttgccttctagcttcccagctggcatggatgtggataaattccttttgagtctgcactacgacgagtag

SEQ ID NO: 126877 - DNA, 7284 bp, Artificial Sequence
  Description of Artificial Sequence: Synthetic coding sequence
atgcccctaaaaacccggacggccctttcagacgatcctgactccagcacttctacactgggtaacatgctggagctacctggcacatcctcgtcttctaccagccaagaattaccattctgccaaccaaagaagaaaagtacccccctaaagtacgaagtaggcgatttgatttgggccaagtttaagcggcggccctggtggccatgcagaatttgctctgaccccctgataaacacccattctaagatgaaagtaagcaaccgcagaccctacagacagtattatgttgaagctttcggcgatcccagtgaacgggcttgggtggctggcaaagctatcgtaatgttcgaagggaggcaccagttcgaagagctccccgtgctgagaaggcgtggcaagcagaaagaaaaaggatatcggcataaagttcctcagaaaatactaagtaagtgggaagcgagtgtcggccttgctgagcagtacgacgtccccaaaggtagcaagaatcgtaaatgtatccccggcagtataaaacttgactcagaagaagacatgccttttgaagactgtaccaacgatccagagtccgagcacgatctgctgttaaatgggtgtttgaagagcctggcattcgactctgagcactcagctgatgagaaagagaagccctgcgcaaagagcagagccaggaaatcatccgacaatcctaaaagaacatccgtgaagaaagggcacatccagtttgaggctcataaagacgagcggagagggaaaatccccgagaatcttggcttaaattttatttcaggtgacatttctgatacccaagcctccaacgaattatctaggatagcaaactcgcttacggggagtaataccgcccctggcagcttcttatttagtagttgtggaaagaacacggccaagaaagagttcgagacctcaaacggagacagcctcttgggtcttcctgagggagccctgatctccaaatgtagccgggaaaaaaacaagccccagcgctcgctagtgtgcggtagtaaagtcaagctctgttacattggtgctggcgatgaagaaaagagaagcgatagcatcagcatttgtacaacttccgatgacggcagttcagatcttgatcccatcgagcactctagtgaatcggataacagcgtcctcgaaatccccgacgccttcgaccgcaccgaaaatatgctatcaatgcaaaagaacgagaaaataaagtactctcggtttgccgcaactaatacccgtgtgaaagccaagcagaagcctttaatttctaatagccatacagatcatctcatgggctgcacaaagagcgctgaacccggcactgagacttctcaagttaatctttctgacctgaaggcaagcaccttggtccataagccccagtccgatttcaccaatgacgccctcagcccaaagttcaacctcagctcctccatatctagcgagaacagcctgatcaaggggggagctgctaatcaggctttgctgcattccaaatctaagcaacctaaatttaggagcattaagtgcaaacataaagagaacccagtgatggcagaacctcccgtcattaatgaggagtgtagtctcaaatgctgttcaagcgatactaaaggcagccctctagctagcatcagcaagtcgggaaaggtggacggcttgaagctacttaacaatatgcatgaaaagactagagactccagtgatatcgagaccgcggtggttaaacacgtcctgtctgagcttaaggaactgagctaccggagcctgggtgaggatgttagcgactccgggacatctaagcctagtaagcctctgctgtttagctccgcttcttcccagaatcacataccaatcgagcccgattacaaattcagcactctgcttatgatgctcaaggacatgcacgattcaaaaacaaaggaacagagattgatgacagcacagaacctggtatcctaccgcagcccaggacgaggcgactgctccacaaatagcccagtgggcgtgtctaaagtcttagtaagcggcggtagtactcataactctgagaagaagggggatggtacacagaatagtgccaatccatctcctagtgggggagactccgctctgtctggggagctatctgccagcctgcccggacttctgagtgacaaacgggacctgcccgctagcgggaaaagccggtctgactgcgtgaccagaaggaattgcgggagatccaagccaagtagcaaactaagggatgcattcagtgctcagatggttaaaaatacagtaaatagaaaggccctcaagacagagcgcaaaagaaagttgaaccaactgcccagcgttaccttggatgctgtgttgcaaggcgatcgagagcgggggggtagcctgaggggcggtgctgaggatcccagcaaggaggatcctctgcaaataatgggccatcttacctcagaggatggggaccattttagcgatgtgcattttgattctaaagtaaagcagtccgacccaggcaagataagcgagaagggtctgtccttcgagaatgggaaaggaccagagttggacagcgtgatgaactctgaaaatgacgagctgaatggcgtaaatcaagtagtcccgaagaaacggtggcaaagactgaaccagcgcagaactaagcctcgcaaacggatgaacaggtttaaggagaaggagaacagcgagtgtgccttccgcgttttactgccaagcgaccccgtccaggaaggtagggacgaattccccgagcaccgcacaccctccgctagcattctagaggaaccactgaccgagcagaaccacgcagattgcctggatagcgccggaccgagacttaacgtctgtgacaagtcttctgcgtcgattggagacatggagaaggaaccagggattccctccctcactccccaggctgaactgcctgagcccgctgtgaggtctgaaaaaaaaagactgcgaaagccctccaaatggctactcgaatacacagaagaatacgaccagatctttgctccaaagaaaaaacaaaaaaaggtacaggagcaagtgcacaaggtctcgtccagatgcgaggaagagtctttactcgcccgaggtcgctcctctgctcaaaacaagcaggtcgatgagaattcactgattagcacaaaagaagagccacccgttctcgagagggaagctccatttctggagggtcctttagcacaatccgagcttgggggggggcacgcagagttgccccagctgacactctccgtccctgtggcaccagaggtgtctccccgcccagctttagagtccgaggagctacttgtcaagactccaggtaattacgagtctaaacgccaacggaagccaaccaagaagcttctggaatccaacgacttagacccaggtttcatgcccaagaagggagatttagggctgagcaagaaatgctacgaagcagggcatctggagaacggcattaccgaatcttgcgctacatcttactccaaggatttcggaggtggtacaactaagatcttcgacaaaccaaggaagcggaaacggcaaaggcacgcagccgcaaagatgcagtgtaagaaagtcaagaacgacgacagttccaaggaaatccccggatcagagggagagctgatgccacaccgtactgccacctcaccaaaggaaaccgttgaggagggagttgaacacgatccaggtatgccagccagtaaaaagatgcagggagagagaggcgggggagccgccctgaaggagaatgtctgtcagaattgtgagaagttaggcgagttgctactgtgtgaagcgcagtgctgcggcgccttccacctggagtgcctgggcctgactgagatgcctcgcggcaagttcatctgcaacgagtgcaggacaggcattcacacttgttttgtgtgtaaacagtccggcgaggacgtaaaacggtgcctcctgccgctctgtggtaagttctaccatgaagagtgtgtgcagaagtatccccctacagtaatgcagaacaaaggtttccggtgcagcttgcatatttgcattacgtgtcacgctgccaatcctgccaacgtgagtgcttccaaaggcagactgatgagatgtgtccgatgtccagttgcctaccacgccaatgatttctgtctagctgcaggatcgaaaattctggcctccaatagcataatctgccctaaccatttcactccgcggcgaggctgtcgcaatcacgagcatgtcaatgtctcttggtgtttcgtctgtagcgagggtggatccctcttatgttgcgattcttgcccagctgcctttcaccgtgagtgccttaacatcgacatcccagagggaaactggtactgtaacgattgtaaagccgggaagaaaccacactaccgcgagatcgtatgggtaaaggtaggaagatatcggtggtggcctgctgagatctgccaccctcgtgctgtaccttcaaacattgataagatgcgccatgatgtgggcgagtttcctgtacttttcttcggctctaacgactacctttggacccaccaggcaagggttttcccatatatggagggggatgtgtcatccaaggacaagatgggtaagggtgtggacggcacttataagaaagccctgcaggaggcagcggcccggtttgaagagctcaaagctcagaaggagctcagacagttgcaggaagatcgtaagaacgataaaaagcctcctccctataagcatatcaaagttaacagacccatcggtcgcgtgcagatctttacagcagatctcagcgaaattcctaggtgcaactgtaaagccactgatgaaaacccctgtggtattgactcagaatgcatcaaccgcatgctcctctacgagtgccacccgactgtgtgtccagcgggcggcaggtgccagaatcagtgttttagcaagcgacaatatcccgaggtggagattttccgaactcttcagagggggtggggtttgagaacaaagacggatatcaaaaagggcgaattcgttaacgagtatgttggcgagcttatagacgaggaggagtgcagagcccgtattcggtatgcacaggagcatgatattacaaacttttacatgttgacgctggacaaagatcggatcattgacgccggcccaaaaggcaactacgcaaggtttatgaaccactgctgccagcctaactgcgaaacccagaagtggagtgttaacggagatactagagtgggtctgtttgccctgtcagacatcaaggcggggacagagctgacctttaactacaacctggaatgcctgggaaacggaaaaaccgtctgtaagtgtggagccccaaattgtagtggcttcctaggcgtgcgtcctaagaaccaacccattgccacagaggagaaatcaaagaaattcaagaaaaaacagcaaggcaagagacggacccagggcgaaatcaccaaggagcgggaagacgagtgcttctcttgtggagacgccggacagctggtctcctgcaagaaaccaggatgccctaaggtgtatcacgcagactgtctgaacctgacaaaaagacccgctgggaaatgggaatgcccatggcaccagtgtgatatatgcggcaaagaagcagcttctttctgcgagatgtgtccctcttcattctgcaaacagcacagggaaggaatgctcttcatttccaagctggatggccgtctgagctgtacggagcatgacccatgtggtccgaatccgctagaacctggtgaaatacgagaatacgttcccccccctgtccctctgcctccaggaccgagtactcacctggcggaacagagcactggcatggcggctcaagcaccgaaaatgtctgataagcctccagccgacaccaaccaaatgctgtcactcagtaagaaggcccttgctggcacttgtcaacgtcccctgctgccagagagacccctggagagaactgatagcaggcctcagcccttagacaaggtccgagacctcgcgggaagcggaacaaagtctcagtctctggtgtcaagccagcggcccctcgataggcctcccgccgttgctggccctcgcccccagctctccgacaaaccgagccccgttacgtcccctagctcttctccatccgtgcggtctcaaccactggaaagacctctgggcaccgccgatcctcgactggataaatccattggtgccgctagtcccaggccccagtcccttgagaagaccagtgtacccacaggcttacggctccctccacccgaccggctgctgattacttcgtcgccaaagcctcagaccagtgatcgacccaccgacaaaccccacgccagcttgtcgcaacggctgccacccccagaaaaggttttgagcgccgtcgtacaaactctggtcgcaaaagaaaaggcgctgcggcccgtcgaccagaacactcagtcaaaaaatcgcgcagcacttgtgatggatttaatcgatctgactcccagacaaaaggaaagggctgcatcaccacatcaagtgacaccccaggccgacgaaaagatgccagtgctggagagtagctcctggcctgctagcaagggactaggccatatgccccgcgctgtggaaaaggggtgcgtatcggaccctctccagactagcggcaaggccgctgcccctagcgaggacccatggcaggccgtcaaatcactgacccaggcccgtctgttgtcccagccacctgctaaagccttcctgtatgaacccaccacacaggctagtggacgggccagcgcgggagctgaacaaaccccagggcccttgtcgcagagcccaggattggtgaaacaggctaaacagatggttggaggccaacaactccctgcactggcagccaagagcggtcagtccttcaggagtcttggtaaagcccctgcaagcctccctacagaggagaagaagctggtcacaaccgaacaatcaccctgggccctgggcaaggcatccagtagggcaggcttgtggcctatcgtggctggacaaaccttggcacaatcttgttggagcgccgggagcactcaaaccctggcacagacatgttggtccctaggtaggggtcaggaccctaagccagaacaaaacactctccctgcactcaatcaggctcccagctctcacaaatgtgctgagagcgagcaaaagtag

SEQ ID NO: 126878 - DNA, 7284 bp, Artificial Sequence
  Description of Artificial Sequence: Synthetic coding sequence
atgcctctgaagacgcggaccgccctgagtgatgatccggattcaagtacatctacgctcggtaacatgttggagcttccgggaacgtcttcttcctctacctcacaggagctgccattttgtcaaccgaaaaagaaatctacacctcttaaatatgaggttggcgatcttatctgggccaaatttaaacggaggccatggtggccctgccgaatatgcagcgatccactgatcaacactcactctaagatgaaggtttcgaaccgaaggccatacaggcagtattacgttgaggccttcggggatccatccgaaagggcttgggtcgccggtaaggccatcgtgatgttcgaggggaggcaccagttcgaagagcttccagtgctaaggaggcgggggaaacaaaaggagaaaggttatagacacaaagtcccccagaagattctgtcaaagtgggaagcttccgtggggctcgccgagcagtacgacgtgccaaaggggagtaaaaataggaagtgcatacctgggagcatcaagttagattccgaagaagacatgcctttcgaggattgcactaatgatccagagtctgagcacgacttgctgctgaatgggtgcttgaagtcactagctttcgattcagaacattcggcagacgaaaaggagaagccctgtgctaagtctagggcccgcaaaagcagtgataacccaaaaaggacctccgtgaagaagggccacatacagttcgaagcgcataaagacgaacggagaggtaagatccccgaaaaccttgggctgaactttatttcaggagatatctcagatactcaggccagtaatgagctctcccgtattgctaacagtttgactggcagcaacacagctcccggttcctttctttttagctcctgcggcaaaaacacagcaaaaaaagaattcgagacatctaatggcgactccctgttgggactacccgaaggggctctgatttctaaatgctccagagaaaagaataagccacagcgcagtttggtgtgcggtagcaaggtcaaactatgctatatcggtgcaggggatgaagagaagagatccgacagtatatccatctgcacaacttccgacgacggctccagtgacctggatcctatcgagcactcctcggagagcgacaattccgtgctcgaaattcccgatgcattcgatcgcaccgagaatatgctttccatgcagaagaatgagaagataaagtattcaaggttcgcagcgactaatactcgcgttaaggctaaacaaaaaccactaatctctaactctcacacagatcacttaatgggttgtacaaagagtgcggagcctggaacagaaaccagccaagttaacctctctgacctcaaggcctcgactctggttcacaagccgcagagcgattttaccaatgacgccctctccccaaaatttaacctctcttcttctatttcaagcgagaacagcttgatcaaaggaggggccgccaatcaggccctgctccattctaagagcaagcaaccaaaatttaggtcaataaaatgtaagcacaaagaaaaccccgtgatggccgaacctccagtgattaacgaagaatgctcactcaaatgctgcagctcagataccaaaggatcgccattggcctctatttctaagtcggggaaggtggacgggctgaagctcctgaataacatgcatgaaaaaaccagggatagttctgacatagagacagcagtcgtcaaacacgtattgagcgagctgaaggaactgtcctacaggtccttaggcgaggatgtcagtgattccggcacttctaaacccagcaagcccctcctgttcagtagcgcgtcatcccaaaatcacatccctattgaaccagactacaaattctccacgctgttaatgatgctgaaagacatgcacgacagcaaaaccaaagagcaacgcctgatgacggcacagaacttggtatcctatagatcaccagggagaggggactgctctaccaactcccctgttggcgtgtctaaggttctggtgtctggagggtccacacacaatagtgagaagaagggggacgggacacagaacagcgctaatcctagccctagcggaggagactcagccctgtcaggagagctgtctgctagcctgcctggtctcttgtccgataaaagagatctccctgcgagcggtaagagtaggagcgattgcgtgacccgacgtaattgcgggcgttcgaagccttcttccaagctcagggacgctttcagcgcccagatggtgaaaaatactgtaaataggaaggccttgaagacggagagaaagagaaagctcaatcaactgccctcagtaacgttggatgcggtgctacagggtgaccgggagcgcggggggtcattgagagggggagccgaggaccctagcaaagaagacccgctccagataatgggccatctcacctccgaggatggcgaccacttctcagatgtacacttcgacagtaaagtgaagcagtcagatcctggcaaaataagcgaaaaaggcctcagctttgagaatgggaaagggccagagctcgactctgtaatgaactccgagaacgatgagctaaatggagtgaatcaggtcgttcccaagaaaagatggcagaggctgaatcagcgaagaactaaacccaggaagaggatgaacagatttaaagagaaggagaacagcgagtgtgcctttagagtgctgcttccttctgatcctgttcaggagggaagagatgagtttccagagcacaggacccctagcgcaagcatcctggaggagcctcttacagagcagaaccatgccgattgcttagactccgcaggcccgcgcctgaatgtgtgtgacaagtcctctgccagtatcggggacatggagaaagaacccgggattccaagcctcacgccgcaggccgagctccctgaacccgccgtgcgaagcgaaaaaaagcgcctacggaagccctcgaagtggctgctggaatacactgaagagtacgatcagatatttgcaccgaaaaagaagcagaagaaggtgcaggagcaagtgcacaaagtctcctcacgatgcgaggaagagtctcttttggctcggggccggtctagtgctcagaataaacaggtggatgaaaattcactcataagtactaaggaagaaccacccgttttggagagggaggccccattcttggagggtccactggcccagtcagaactcggtggtggtcacgcagagctgccacagctcactttgtccgtgccggttgccccagaggtgtctccacgcccagcactggaatctgaggaactgctcgttaaaactccaggcaattatgagtctaagaggcagcgcaagcctaccaagaagttactggaaagcaacgatttggaccctggatttatgccgaaaaaaggagatctggggctttcaaagaagtgttatgaggcgggccacctggagaacggcattacggagagctgtgccacaagttactcaaaagacttcggtggcggaactactaaaattttcgacaagccgcgcaaaagaaagcgccagagacatgccgcggctaagatgcaatgcaagaaggtcaagaatgacgattctagtaaggaaatcccgggatcagagggtgaacttatgccccatcgcactgccaccagtcctaaggagaccgtggaggaaggagtcgaacatgacccaggcatgcccgccagtaagaaaatgcagggcgaacgcggcgggggcgccgcgctgaaggaaaatgtgtgccagaactgcgaaaagcttggggaactgctgctctgtgaagcccagtgctgtggagctttccatctggagtgcctgggactcactgagatgccaaggggcaagtttatatgcaacgagtgccgtactggcattcacacctgtttcgtttgtaaacaatccggtgaagacgtgaagcgctgtctgctccccttgtgtgggaagttttaccacgaggagtgtgtccaaaaatacccccctaccgttatgcagaacaaggggtttcgatgctcgctacatatctgtataacttgtcatgccgctaatccggctaacgttagcgcctccaagggacgtctgatgcgatgtgttaggtgccctgtcgcctatcacgctaacgacttctgtctagccgcagggtctaaaatccttgcctccaacagcattatctgcccaaatcattttacccctaggaggggatgccggaaccacgaacatgtcaacgtgtcatggtgttttgtgtgttcagaggggggatcattactatgctgcgactcttgcccagccgcgttccatagggaatgtctcaacatcgacatacccgaagggaactggtactgtaacgattgcaaggccggcaaaaagcctcattatcgagagatcgtttgggtgaaggtagggcggtacaggtggtggccagccgaaatctgtcacccgcgtgccgtcccgtccaacatcgacaagatgcgccatgatgtcggggaatttccagtcttattttttggcagtaatgattacttatggacacaccaggctagagtgtttccctatatggaaggcgatgtttcatcaaaggataaaatgggcaagggcgttgacggcacctacaagaaggctctgcaagaggccgccgcaaggtttgaggaactgaaggctcagaaggaactgcggcagctacaagaagatcggaagaacgacaagaagcccccaccatataaacacatcaaagttaatagaccgatcgggcgcgtgcagattttcacagcagacctgtccgagatcccccgttgtaactgtaaagctacagatgagaacccatgcggcatcgatagcgaatgtattaacagaatgctcctgtacgagtgtcatccgacagtgtgtcccgcagggggcagatgccaaaatcagtgtttcagtaagaggcagtaccccgaggtggaaattttccggacacttcagcggggctggggtttacgtacaaaaactgacatcaagaaaggagaattcgttaacgagtatgtgggagaactcattgacgaggaggagtgccgtgctaggatccgttacgctcaagagcatgatataaccaatttctatatgctgacactcgataaggataggatcatcgatgcaggacccaaaggcaattacgcccggtttatgaatcattgctgtcagcccaattgcgagacccaaaagtggtccgtaaatggcgatacacgtgtggggctcttcgctctctccgacatcaaggcaggcaccgagctgacttttaattataatctggagtgtttgggcaatgggaaaacggtatgtaaatgtggcgcccctaattgtagtggattcctgggggttaggcccaaaaatcagcccatcgctacagaggagaaaagcaagaagttcaaaaaaaaacagcaggggaaacgcaggactcagggcgaaataaccaaagaacgtgaagacgagtgcttttcctgcggcgatgctggacagctcgtcagctgcaagaagcctggctgcccaaaggtttatcatgccgattgcctgaatctcaccaagagaccggccggcaagtgggaatgcccgtggcatcagtgcgacatttgcggcaaggaagcagcgagtttttgcgagatgtgtccttcctccttttgcaagcagcatcgagagggaatgctgtttataagcaagcttgatggaaggctcagctgcacagagcatgacccctgcgggcctaaccctctcgaacccggagagatcagagagtacgttccaccaccggtccctctacctcccggaccgtccacccatcttgctgaacagtcgacaggaatggcagctcaggcgcccaagatgtccgacaaacctccggccgacaccaaccagatgctgagccttagtaagaaagccctggcgggtacatgtcagagacccctgctgccagagagaccccttgaacggaccgacagccgcccccagccacttgataaagtacgcgacttagccggctccggaaccaagtcacagtccctggtgagcagtcagcgcccgctggaccgcccaccagccgtggcaggaccgcggccccagttatccgacaagccatcacctgttacctcaccctcatcctcaccaagtgtgcgctcacagccgctcgaaaggccactcgggactgccgacccacgtctcgacaaaagtattggcgccgcctcaccaaggcctcagagcttggagaaaaccagcgtgcctactggcctgcgtctcccccctccagatcggctattaatcactagctcacctaaaccccaaacctcggatagaccaacagataagcctcatgcctccctgagccagaggctgccacctcccgagaaggttctcagtgccgtggtacagaccctggtcgccaaggaaaaagccctgcgccccgtggatcaaaatacacagtccaagaaccgcgccgcactggtaatggacctaatcgacttgacccccaggcagaaagagcgggccgcatcccctcaccaagtgacgccgcaagcggacgagaaaatgccagtactggaaagttctagctggcctgcaagcaaagggttaggtcatatgcctagagctgtggaaaagggatgcgtgtccgatccgctccagaccagcggcaaagccgcagccccctccgaggacccatggcaggccgtgaagtctctaactcaggcacggctcctgagccaacctcctgccaaggccttcttatacgagcccacgacccaggctagcggcagagctagtgctggagcggagcaaactccaggacccctctcccagtctcccggtctggtgaagcaggccaagcagatggtcggcggacaacagcttcccgctttagccgccaagtcagggcagtcatttcgctccctgggaaaggcccctgcaagtttgcctacagaggaaaagaaactggtgacgaccgaacaaagcccatgggccctcggaaaggcgagtagtagggctggcctgtggcctattgtggcaggccagaccctggcgcagtcttgttggagtgctggttctacgcagaccttggcccaaacctgctggtctttgggccggggacaggaccccaaaccggagcagaatacgctgccggctctgaaccaggctcccagctcacataaatgtgctgagtcggaacaaaagtag

SEQ ID NO: 126879 - DNA, 1692 bp, Artificial Sequence
  Description of Artificial Sequence: Synthetic coding sequence
atgcccctaaaaaccaggaccgcactcagcgatgatcctgacagctctacaagtacactggggaatatgctggaactgcccggcacatcttcctcatcaacaagccaagaactgcctttttgtcagcccaagaaaaaatctacccccctgaagtatgaggtcggcgatctgatttgggctaaattcaagcgtcggccatggtggccgtgtcgcatttgctcagatccactgattaatacccactccaaaatgaaagtttccaatcggcggccttatcggcaatattatgtggaagctttcggcgacccttcagagcgggcatgggtagcggggaaagctatagtgatgtttgagggcagacatcagttcgaggagctccccgtactccggcgtagagggaagcagaaggaaaaaggatacaggcacaaggtgccccagaaaattcttagcaagtgggaggctagtgttggcctggccgaacagtatgatgtccccaagggatctaaaaaccgaaaatgcatccccgggtctattaaactcgatagcgaggaggacatgccattcgaagattgtacaaatgatcccgagtctgagcacgatttgctgctcaatggctgtttgaagtctttagcatttgactctgagcacagtgcagacgaaaaggaaaagccttgcgccaaatccagagctcgcaaatctagcgataatcctaaacggactagcgtgaagaagggccatatccagttcgaggcacataaggacgaacgcaggggaaagatccccgagaacctgggactgaattttatttccggcgatatatcggacacgcaagcgtcaaacgagctctcccgaatagccaatagtcttacaggttctaacaccgctcccggatccttcttgttcagttcgtgcggcaaaaatactgcgaaaaaagagttcgaaacctctaatggagattccctcttagggctcccagagggtgcgcttatttccaagtgctcacgggaaaagaataaaccacagcggtctctggtgtgcggctcaaaggtgaaactctgctatataggcgccggagacgaagagaaacgctctgacagcattagcatttgcactacctcagatgatgggagttccgatctggaccctattgagcacagcagcgaatcagacaacagcgtgttggagatccctgatgctttcgaccggaccgagaatatgcttagtatgcaaaagaatgaaaaaatcaaatactccaggtttgcagccactaatactcgtgttaaggccaagcagaagccactcatctcgaacagccatacagaccatttgatgggttgcacaaaatccgccgagcctggcactgaaaccagccaggtcaacctgagcgatctgaaagcaagcacactggtgcacaagcctcaatcggattttactaacgacgcactctctcccaagttcaatctgagcagttcgatatcatccgagaactccctcataaaggggggcgcggctaaccaagcccttcttcacagcaagtctaagcagccaaagtttaggtctatcaaatgtaagcacaaagaaaaccctgtaatggctgagcccccggtgatcaatgaggaatgctccctgaagtgctgtagcagcgacaccaagggctcaccgctggctagtatctctaaaacaccaccctag

SEQ ID NO: 126880 - DNA, 7782 bp, Artificial Sequence
  Description of Artificial Sequence: Synthetic coding sequence
atggaccagacatgtgaattgcctcgccgtaattgcctgctgcctttcagcaaccctgttaatctggatgcacccgaagataaggatagcccatttggcaacggccagtcaaatttctcagaacctctcaacggttgtaccatgcaactgtccaccgtatcaggaacaagtcaaaacgcttatggccaggactccccttcatgctacatccccctgcggagactgcaggacctggcatctatgatcaatgtcgagtacctcaatgggtccgctgacggcagtgagtcttttcaggatcccgaaaagagtgatagccgcgcccagaccccaattgtctgtacttctctgagcccaggcggtccgaccgcccttgcgatgaagcaagagccatcatgtaacaattcacccgagctgcaagttaaagtcaccaagaccattaaaaacggcttccttcactttgagaactttacgtgcgtggacgatgccgacgtggacagcgaaatggaccccgaacagccagtgaccgaagatgaatccattgaggaaatcttcgaagaaacacagaccaatgctacatgcaactatgagaccaagtctgagaatggagtcaaagtggctatggggagtgagcaggactccacacctgagtccagacacggggcagttaaatcgccgtttttaccactggctccacagaccgaaactcagaagaataagcagcgcaacgaagtggatggttccaatgaaaaggccgccctactgcccgccccattctctctcggcgacacaaacatcacgattgaagagcagttaaattccataaatctaagttttcaggatgacccagactcatccacttcgaccctgggcaatatgttggaattgcccgggacatctagctcatccactagccaggaacttcccttcgttcctcaaaaaattctctccaaatgggaggcgtctgtaggcctcgccgagcagtacgacgtcccaaaggggtccaagaaccggaagtgcattcctggctccattaagctggactccgaggaagacatgcccttcgaagactgtacaaacgatccagaaagtgagcacgatctgctcctgaatggatgcctaaaaagtctagcatttgattccgagcattccgcggatgaaaaagagaaaccttgcgccaaatcgagggctcggaagagttccgacaatcctaagaggacttcggtgaagaaaggccatattcagtttgaggcgcacaaggatgaaaggagaggaaagattccggaaaacttaggcctaaacttcattagtggcgacatctccgatacccaggccagcaacgagttatcacgcattgctaactcactcaccggcagcaacactgctccagggtctttcctgttttccagttgtggaaagaatacggctaagaaggagttcgagacctcgaacggtgacagtctgctcggccttcccgagggagccctgatctcaaagtgctctcgagagaagaacaagccccaacgttctctggtgtgtggctccaaggttaagctgtgttacatcggggccggcgatgaagagaagaggtcggattcaatatccatatgcactactagcgatgacgggtccagtgatctcgaccctatcgagcacagcagcgagtccgataattccgtcctcgagatacccgatgcgttcgaccgcactgaaaatatgctgagtatgcagaaaaatgagaaaatcaaatattctagatttgcggctactaatacccgagtgaaggctaaacaaaaaccgctgataagcaatagtcacactgaccatttgatgggatgcactaagtctgccgaaccgggaaccgaaacatcgcaggttaacctgagtgatctcaaagcttcaaccttggtgcacaagccacagagcgatttcacaaacgatgctctgagccctaaatttaacctgtccagcagcatcagctccgagaattcactgattaaaggtggggcagccaaccaggcgctgctccactccaagtctaagcaaccaaaatttcgatctatcaaatgcaaacataaggagaatccagttatggccgagccacctgtgattaatgaggagtgttcacttaaatgctgctcatccgacacgaagggttctcccctggcatccatatcaaagtctggcaaggttgacgggcttaagctgcttaacaacatgcacgaaaaaaccagagacagttccgatattgagaccgctgttgtgaagcacgtgcttagcgaacttaaggagttgtcctataggagcctcggagaggatgtcagcgattcaggaacaagcaaaccttccaaacccctcctgttctccagtgcatcttctcagaatcacattcccatcgaaccagattacaagttctccacactcctgatgatgctgaaagacatgcatgactctaaaaccaaggagcagcggttgatgacggcccaaaatttggtaagctaccgtagccctggcagaggagactgctctaccaactctccggtcggagtgtcaaaagtgctggttagcggtggaagcacgcataattcggagaagaagggcgacgggactcaaaactccgctaaccctagtccttcaggtggagattcggccctgagtggcgagctgtcggcctctctacccggcctgttgtccgacaagagagatctccctgcctcagggaaatcccggtccgactgtgttacccgacggaattgcggaaggtctaagccatccagcaagcttagagatgcctttagcgcacagatggtcaagaacaccgtcaacaggaaggccttaaagacagagaggaaaaggaagctgaatcagctcccctccgtgaccctcgatgctgttctacaaggggaccgagagcgaggtggcagcctgcgcggcggtgctgaagatccctcaaaagaggatcctttgcagataatgggacatcttacctccgaggacggtgaccacttcagcgacgtgcacttcgactccaaggtcaagcagtctgatccaggcaagatttccgaaaaaggcctgtccttcgagaatggcaaagggcctgagctggactccgtgatgaacagcgagaacgacgagctgaacggagttaaccaggtcgttcctaagaaaaggtggcaacgactgaaccagcggcgtacgaaaccccggaagagaatgaaccggtttaaggaaaaagagaattcagagtgcgcatttcgtgtgctgctcccttctgaccctgtgcaggaaggtcgagacgagtttcccgagcatcggacgccttcagcctccatactggaggaacctcttacagagcagaaccacgcggattgcctcgactccgccgggcccagattaaacgtgtgtgataaatcctccgcaagtatcggagatatggagaaggaacctggcataccgagcctcaccccgcaggccgaactccccgagcctgcagtgcgaagcgagaaaaagaggctgaggaagccaagcaagtggttgctggagtacaccgaggaatatgaccagattttcgcgccgaagaaaaagcaaaagaaggtgcaggaacaggtgcataaggtatccagcaggtgcgaggaagagtctctgttagcgagaggacgaagcagcgcgcagaataaacaggttgatgaaaactcccttatctctacgaaggaggagcctccagtcctggaacgcgaagctccttttcttgaggggccactcgcccagtctgagctgggcggcgggcatgccgaactgcctcagctaaccctgagtgtgcccgttgcacccgaggtgtccccacgtccagccctcgaatctgaggagctactggtgaaaacacctggcaactacgaatccaagcgacagaggaagccaacgaagaaactgctagagagcaatgatctcgatcccggatttatgcccaagaaaggcgacctaggtttgagcaaaaagtgctacgaggccggccacctagaaaacggtattactgagtcttgcgccacaagttattcaaaagattttggaggaggcactacaaaaattttcgataagccacggaagagaaaacggcagagacatgccgccgcgaaaatgcagtgcaagaaggtgaagaatgatgatagttccaaggaaataccgggcagcgaaggcgaactgatgccacacaggactgcgacttctccaaaagagacagtggaggaaggtgtggagcacgatccaggaatgccagccagtaagaagatgcaaggagagagaggaggaggtgcagccttgaaggaaaatgtgtgccagaattgcgaaaaattaggcgagctgctgctgtgtgaagctcaatgctgtggcgctttccatctcgagtgcttgggcctgactgagatgcctagaggtaagtttatatgtaatgagtgccgcacaggaatacacacttgctttgtttgcaagcaatccggggaggatgtcaagagatgcctgctgcctctctgtggaaagttctatcacgaggagtgcgtccagaagtacccaccaaccgtgatgcaaaataaaggatttagatgcagcctgcacatatgcattacctgccacgctgccaatccagcgaacgtctccgcctcaaagggccggttaatgaggtgtgtccgttgccctgttgcctaccacgccaatgacttctgcctggccgccggttctaaaatactggcttcaaattccattatctgtcccaatcactttacaccccgcagaggctgccggaatcacgagcacgtcaacgtgtcatggtgtttcgtgtgcagcgagggaggctcgctgctgtgttgtgacagttgtccagcagccttccacagagagtgcctgaacatcgacatccccgaaggaaactggtactgtaatgactgtaaagcgggaaagaagccacattatcgggagatagtgtgggtgaaagtcggacggtaccgttggtggccagctgaaatctgtcaccccagggcagtgccgtccaacatagacaagatgcggcatgacgtgggagaattccctgttctcttttttggcagcaacgactacctttggacccatcaggctcgcgtgttcccctacatggagggggacgtgtctagcaaagataagatgggaaagggagtcgacggaacctataagaaagcccttcaagaggccgccgcgagattcgaggagttaaaggcacagaaagagctgaggcagctccaggaagatcggaaaaacgataagaaaccccctccatataagcacattaaggtgaacagacccatcggccgagtgcagatatttaccgccgatttgagcgaaattcccaggtgtaattgtaaggctaccgatgagaatccctgcggcatcgatagtgagtgtataaatagaatgctgttgtacgagtgtcatcctactgtgtgccccgctggcggccgatgtcagaaccagtgtttttccaaaaggcagtatcctgaagtagagatcttccggacactccagcgaggttggggcctacgcactaagacggacatcaaaaaaggtgaattcgtaaatgagtacgttggggaactgattgatgaagaagaatgtagagctaggattagatatgcacaagaacatgacataactaatttttacatgctgacacttgacaaggatagaatcattgatgccggcccgaagggcaactacgcacgctttatgaaccactgctgtcagccaaattgtgaaacacagaagtggtcagtcaacggcgatactagggtggggttatttgccctgtccgacattaaggccggcacagagcttacctttaattacaatctagagtgcctcggcaacgggaagacagtatgcaagtgcggcgctccaaattgcagcggcttcctgggagtacgccccaagaaccagcccattgccactgaggagaaatccaagaaatttaaaaaaaagcagcagggtaagcggaggacacagggcgaaattacaaaagaacgcgaggatgaatgcttttcatgcggtgacgcggggcaattagtgtcgtgcaaaaagcctgggtgcccgaaggtttatcacgctgactgtctgaacctaaccaaaaggcctgccggcaaatgggaatgcccctggcatcagtgtgatatctgtggaaaggaagcagcctccttctgtgagatgtgtccgagctccttttgcaagcagcaccgggaggggatgctttttattagcaaactggatgggcggctgagctgcaccgaacacgacccatgtggccccaatcccttagagcctggcgagattagagaatacgtcccgcctcccgttcccttgcctcccgggccatctacccatctggcagaacaatccacagggatggcggcacaggcccctaagatgtccgataagccgccggctgatacgaaccagatgctcagcttgtcaaagaaggccctggccggcacatgccagcggcccttgctgccagagcggcccctcgaaagaaccgattcaagaccccaaccactagataaggtgagggatctagccggctcaggcacaaagagccagtccttagtgtcatctcaacggcctcttgatagaccaccggcagtagctggaccccggccacagctgagtgacaaaccctcacccgttacctctccatcttcttctccttccgttcggagtcagcccttagagcgaccattggggaccgccgacccccgattggacaaatccattggagctgcatcccccaggccacagtcgctcgagaaaaccagtgtcccaaccggcctgagactacctccgccagaccggttgctcattacctcttccccaaagcctcagactagcgacaggcctaccgataaacctcacgcatcactgtcacagagactgccaccacccgagaaagtgctttcagcagtggtgcagacgctcgttgccaaggaaaaagcactcagaccagtggaccaaaatacccagagcaaaaaccgcgctgccctggtgatggatctgattgatctcacaccaaggcaaaaggagcgtgccgctagcccccaccaagttactccccaggccgatgagaaaatgccagttctggagtcctcttcctggccagctagcaagggtctgggccacatgccgagggcagttgagaagggatgtgtgtccgacccccttcagacctctgggaaggcggcagctcctagtgaggacccctggcaagccgtcaagtctttgacccaggcccgccttctctctcagcctcctgccaaggccttcttgtacgaacctactacacaggctagtgggcgcgcaagcgcaggcgccgagcagaccccaggacccctgagccagtccccggggttggtcaaacaagctaaacaaatggtgggcggacagcagcttcctgcactggcggccaagtccggccaatccttcaggagccttggcaaggcccctgccagcttgcccaccgaagagaaaaagctggtgacgactgagcagtctccctgggccctcggtaaagccagttcccgagcaggactgtggcctatagtggccgggcagacccttgcccagagctgctggagcgctggatcaactcagacactcgcccagacctgttggtcgttggggcggggtcaggatcccaagccagaacagaacactcttccagccctgaaccaggcaccctccagtcataaatgtgccgagtcagaacagaaatag

SEQ ID NO: 126881 - DNA, 8091 bp, Artificial Sequence
  Description of Artificial Sequence: Synthetic coding sequence
atggaccaaacttgtgagcttcctaggcgtaactgcttgctcccgttctctaatcccgttaatctggacgcccccgaggataaggactcgcccttcgggaatggccaatcaaacttctccgagcctctgaacggctgtactatgcagcttagtaccgtgtcagggacttcccagaatgcctacggacaggattcaccgtcctgttacattccattacggcgattacaagatctcgcatccatgatcaacgtggaatatctcaacgggagtgcagacggatccgaaagcttccaggaccctgagaagtctgattccagagctcagactccaatcgtatgtacttctttgagccctggcggacctaccgctctcgcgatgaaacaggagccgtcctgcaataatagtcccgagttgcaggtcaaggtcaccaagactataaaaaacggattcctgcactttgaaaacttcacatgtgtcgatgacgcagatgtggacagtgaaatggacccagagcaaccggtcacagaggacgagagcattgaagagatctttgaagagacccagacaaatgccacgtgtaattatgaaaccaagtctgagaatggagttaaggtggcaatgggctctgagcaagatagcacaccggagagtaggcacggcgcagttaagtccccattcctcccgttggctcctcagacagaaacacagaagaataaacagagaaatgaagtggacgggtcaaacgaaaaggcagcccttctgccagccccatttagccttggagacactaacataaccattgaggaacagctgaactctatcaatctgtcatttcaagatgaccccgacagctccacatccacattaggaaacatgctcgaactcccaggcactagctcctcctccaccagccaggagctgcctttttgccagcccaaaaagaagtcaacccccctgaagtatgaggtgggggatcttatctgggctaaattcaaacgtcgaccttggtggccatgccgaatttgtagcgatcccttgattaacacacactcaaagatgaaggtgagcaaccgcagaccttacagacaatactacgtggaggccttcggtgatccctctgagagggcctgggtggcggggaaagccattgttatgttcgagggtaggcaccagttcgaggaactgcctgttctgagacgtaggggcaaacaaaaggagaagggttatcgacataaggttccccagaagattctaagtaagtgggaagctagcgtcggtctcgctgagcagtacgatgtgcccaaggggtctaagaatcgaaagtgtatccctggatcgattaaactggatagcgaagaggatatgcccttcgaggattgcactaacgatcccgagagtgaacatgatttactgctgaacggctgcctaaaaagcctcgcatttgattccgagcactccgctgacgagaaagagaaaccatgcgcgaagtctcgcgcccggaagtccagtgacaatccaaagaggaccagtgtgaaaaaggggcatatccagttcgaggcccataaggatgagcgtagaggcaagattccagaaaatctcggactgaacttcatctccggggatatctctgacacacaggctagcaatgaactgtctaggatcgccaacagtcttactggaagcaacacagcacccggcagctttctgtttagctcatgtggtaaaaataccgctaagaaggaatttgaaacaagtaatggagatagtttgctcggcctcccagagggcgcgctaatcagtaaatgctcccgagagaagaataaacctcagagaagtctggtgtgtggctccaaggtaaagctgtgctacattggcgccggcgacgaggagaagcgctctgacagcatctcaatctgtacaaccagcgacgacggatcatcagacttggatcctattgaacattcttctgagagcgacaattcagtgctggagatccccgatgcctttgaccgaactgaaaatatgttaagtatgcagaagaacgagaagatcaagtacagccggttcgctgccaccaataccagggtgaaggccaaacagaagccactcatatcaaacagccacacagaccacctgatggggtgtactaagagcgccgagccaggaacagaaacttcacaggtgaatcttagtgacctgaaagcgagtactttagtgcataagccacagagtgactttacaaacgacgccctatctcctaaatttaacttaagctctagcatcagctcagaaaattcgcttatcaagggtggggctgccaatcaagccctgctgcactcaaaatccaagcagccaaaatttaggtccatcaaatgtaaacacaaagagaatcccgtgatggctgaaccgccagtgatcaatgaggagtgttccctgaagtgctgctcttcagacactaaagggtccccgttggcctccatttccaaaagtgggaaggtagatgggctgaagctgttgaataatatgcatgagaagacccgtgacagcagtgacatcgagacggctgtagtcaagcacgtgctgagtgagctgaaggaattgtcttacagaagtctgggcgaagatgtgtcagacagcggaacatcgaagccctccaagccgctgttgttctctagtgcctcgagtcagaaccacatacctattgagcccgactacaagttttcaactcttttgatgatgcttaaggacatgcacgattctaagacaaaggagcagcggctgatgacagcacagaacttggtgagctataggtctccaggcaggggcgactgcagtacaaactccccggtgggagtgtccaaagtgctggtgagcggtggctctacccataatagcgagaaaaagggtgacgggactcagaactcggccaatccttcaccaagcggtggggattcggctctttccggggaactgagcgcatctctccccggcctgctaagcgataagcgcgacctccccgccagtgggaaaagcagatcagactgtgttaccagacgcaactgtggaagatccaaaccctcaagcaagctgcgcgatgcttttagcgcccagatggttaagaacactgtcaacaggaaggcgctgaagaccgaacgcaagaggaagctgaatcaactcccctcagtgacacttgacgccgtgctccagggcgacagagagcgaggcgggtctctgcgcgggggggccgaagatccttcaaaggaagaccccctgcagattatgggacacctgacctcggaagatggcgaccattttagtgacgtgcattttgatagcaaggtgaagcagtctgacccggggaagatcagcgaaaaggggctctctttcgaaaatggaaagggtcccgaacttgatagtgtcatgaacagcgagaacgatgagctgaacggtgtgaaccaggtggttccaaaaaagcgctggcagcggctcaatcagcgccgaactaagccccgaaaaagaatgaacagatttaaggaaaaggagaactctgaatgcgctttcagagtactcctgccttcagacccggtccaggagggacgagatgagttcccggagcataggaccccatccgcgagtatcctcgaagagccccttactgaacagaaccatgctgactgcttagacagtgctgggccccgtcttaacgtctgcgataaaagctctgcttcaataggtgacatggagaaagagcccggtatcccgtccctgacaccccaagctgaactgcccgaacctgcggtgaggtccgagaagaagcgccttcggaagcctagcaagtggcttcttgagtacacagaagaatacgatcagattttcgctcctaaaaagaaacaaaaaaaagtccaggaacaggtgcacaaagtttccagccggtgcgaagaggagagcctgctcgcacgtggacggtccagcgcacagaacaaacaggtggacgagaattccctgataagtactaaggaagagcctcccgtgctggaacgagaggctcctttccttgaaggacctcttgctcagtcagaacttggcggaggccacgctgagctgccccagcttacccttagtgtgccagtggcacccgaggtgagcccaaggcctgccctcgaatccgaagagctactggtaaagactcccggtaactacgaatcaaagaggcagcgtaagcccactaaaaagttgctggagtccaatgacttagacccaggattcatgcccaaaaagggagacctgggattgtctaagaaatgctacgaggctggccatcttgagaatggcattacagaatcctgtgcaacatcatatagcaaagactttgggggagggacgacaaaaatctttgataagcctcggaagaggaagcgtcagcgccacgccgcggctaagatgcaatgcaaaaaagtgaagaatgatgacagttctaaagaaatccccggatctgaaggcgaattgatgcctcatcggaccgccacctcgccaaaggagacagtggaggagggggtcgaacatgaccctggtatgcccgcctcaaagaaaatgcagggcgaacgcggcggaggagctgctctgaaggagaacgtctgccagaactgtgagaagctaggggaattactcctttgcgaggcccagtgttgtggcgcgtttcacttggaatgcttgggtctgaccgagatgccacggggcaaatttatctgtaacgagtgccgcacggggatacacacctgctttgtttgcaagcagtctggcgaagacgtgaagaggtgcctgctgcctctgtgtggtaagttttaccacgaagagtgtgtgcagaaatacccccccactgtcatgcagaacaaaggcttccgctgctcactgcacatatgcatcacgtgtcatgctgccaaccccgctaatgtgtcagccagtaaaggtcgactgatgaggtgcgttcggtgccccgtagcctaccatgccaatgacttctgccttgctgcaggctctaaaatcttggcaagtaattcgattatctgtcctaaccacttcactcctaggcgcggatgcagaaaccacgagcatgttaacgtctcatggtgctttgtgtgttcggaaggtggctctctcctgtgttgcgattcctgtcctgcagcgttccatcgagagtgcctcaacatcgacatcccggagggtaactggtattgcaacgattgcaaagcaggtaaaaagccacattaccgggaaatagtttgggtgaaggttggtagatatagatggtggcccgcagaaatctgtcatccacgcgccgttccctcaaatattgacaaaatgcgccacgacgtgggcgagttcccagtgctgttctttggtagcaacgactatttgtggactcatcaggcccgggtcttcccttacatggagggagatgtgtcaagcaaggacaaaatgggcaagggagtcgacggtacgtacaagaaggctcttcaggaggcagctgcacgtttcgaggagctaaaagcacagaaggagctgcggcaattacaggaggacagaaaaaatgacaaaaaaccgccgccttataagcacattaaagtgaaccgcccgatcggacgcgtgcagattttcacagccgatctgtcagagatccccaggtgcaattgtaaggccacggacgaaaatccctgcggcatcgatagcgaatgtatcaatagaatgctcctgtacgaatgccaccccacagtgtgccctgcaggcgggcgctgtcagaatcaatgcttctctaagaggcagtatccagaagtggagatcttccgtaccctgcaacggggttgggggttgcgaaccaaaacggatattaagaagggtgagtttgtgaacgaatacgtcggagagcttatagacgaagaagaatgccgggcaagaattagatatgctcaggagcacgatattactaatttttacatgctgacgctagacaaggatcgcatcatcgatgcagggccaaaaggcaactacgcacgcttcatgaatcactgttgtcaaccgaattgcgaaacacagaagtggagtgtcaacggcgatacacgggtaggactctttgctctgtctgatattaaagcagggactgaattaacctttaattacaacctggaatgcctcgggaacggaaaaaccgtgtgcaaatgcggggcacccaactgcagtgggttcctcggcgtaagacccaaaaaccagcccattgcgaccgaggagaagagcaaaaagtttaagaagaaacagcaggggaagaggaggacccagggagaaattacgaaggagcgagaagacgaatgtttttcttgcggggacgccgggcagttggtgtcttgtaaaaaacctgggtgtcctaaagtgtaccacgcagattgtttgaatctcaccaaacgccctgccggaaaatgggaatgtccatggcatcagtgcgacatctgcggtaaggaggcggctagtttctgcgagatgtgcccatcatctttttgtaaacagcaccgggaggggatgctgttcatttcaaagcttgatggaaggctctcctgtacagaacatgatccctgtgggccaaacccgctggagcctggggagatccgggagtacgttccccctcctgtccccctgcctccaggacccagtacgcatctcgctgagcagtcaacaggtatggccgcccaagcgcccaagatgtcagacaagcccccagctgacaccaatcaaatgctgagccttagcaaaaaggccctagcaggaacttgtcagcgcccactgcttccagagaggccgcttgagagaactgactcccgaccacagccactggacaaagtgagggatcttgcaggcagcggtacaaagtcccaatcccttgtgtcctcccagcggcctctggataggccacccgcagtggcggggcctagaccccaactctccgacaagcctagtcctgtgacgagtccatctagttcacctagcgtcagatcacaacctttagaacgaccccttggcacagccgatcctagactagacaagtccattggcgctgcttcaccacgtccccagagtctggagaagacctctgtgccgactgggctcagactacctccgccggatcgcctcttgattacgtcttcacccaagccacagacatctgacaggccaaccgataagcctcatgcctctctcagccagcggttgcctccaccagagaaggtactgtctgctgtagtccagacactggtggctaaggaaaaggccttacggccagttgatcagaacactcagtcaaagaacagagcggcccttgtgatggacctgatcgatctgacaccacgccaaaaagaaagggccgcctccccccaccaggtgacgccccaggccgacgaaaagatgcctgtgctagagagtagctcctggccggcatccaaaggactaggacatatgcctagggctgtcgagaaaggttgcgtgtccgacccgcttcagacttctgggaaagccgcagccccgagcgaggacccctggcaagccgtcaagtctctgacccaagcccggcttctatcacaaccccccgcgaaagccttcctctacgaaccgactacgcaagcaagtgggcgggcgagcgcaggagccgagcaaacacctggccccctttcacagtcaccagggctagtcaagcaggctaagcagatggtcggaggtcagcagctgccggccctcgccgctaagtccggtcagtcgtttaggagtctgggaaaagccccagcctccctgccaactgaggagaagaagctggtcaccacagaacagtccccttgggctctggggaaggcctccagtcgggctggtctttggcctattgtcgcaggtcagaccctggctcagtcttgttggtcggcgggctccacgcagactcttgctcagacctgttggagcctgggaaggggacaagaccccaagcctgagcagaatactctccctgcattgaatcaggctcccagttctcacaaatgtgcagaatctgaacaaaaatag

SEQ ID NO: 126882 - DNA, 468 bp, Artificial Sequence
  Description of Artificial Sequence: Synthetic coding sequence
atgcccctcaaaacccggactgctctgagcgatgatcctgattctagcacttccaccctaggtaatatgctggagcttcccggcacctccagcagttctacgtcccaggagctgccattttgccaaccgaaaaagaagagcacgcctttaaaatacgaggttggagacctgatatgggctaagttcaagaggcggccctggtggccttgccgaatctgttctgatcctcttatcaatacccacagtaagatgaaggtcagtaaccgccgaccttacagacaatattatgttgaagccttcggagatccctctgaaagggcatgggtggcgggaaaagcaattgtaatgttcgaggggcgtcaccagttcgaagagctacctgtgcttcgaagacgcgggaagcagaaggagaaaggctatcgccataaagtaccacagaagattttaagtaagtgggaagcctcatag

SEQ ID NO: 126883 - DNA, 375 bp, Artificial Sequence
  Description of Artificial Sequence: Synthetic coding sequence
atgccactcaagacacgaacagctttgtccgatgatccggatagttccacatccactctcggtaacatgctcgaactgccggggacatctagcagttccacctctcaggaacttcctttctgccagcccaagaaaaaaagtactcccctcaagtatgaagtgggcgacctgatttgggctaagttcaagcggcggccttggtggccttgtcgaatttgctcggacccgctgattaatacacacagcaagatgaaggtgtctaatagacgaccttaccgccagtattacgtcgaagcattcggggatcccagcgaaagagcatgggtggctggcaaggctatcgtcatgttcgagggtagacatcagttcgaatag

SEQ ID NO: 126884 - DNA, 4200 bp, Artificial Sequence
  Description of Artificial Sequence: Synthetic coding sequence
atgtccggtctgggggactcttccagtgacccagctaaccctgattctcataagcggaaggggtccccttgtgatactctggcttcctcaactgagaagcgccgcagagagcaggaaaataagtacttagaagagcttgctgagctgctgtcggcaaacatctccgacatcgatagcctgtcagtgaaaccagataagtgcaagatacttaaaaagacagtggaccaaatccaactcatgaaaaggatggagcaggagaagtccaccactgacgatgatgttcagaaatcagacatctccagctccagccagggagttatcgagaaggagtcactgggtcctttgcttttggaagcgctcgacggcttcttcttcgtcgtgaattgcgaaggacgaatcgtattcgtgagcgagaatgttaccagctaccttgggtataatcaggaagaactgatgaacacctccgtgtattccatcctgcacgtaggggatcatgccgaatttgttaagaacctcctgcccaaaagcctggtgaatggggttccatggccccaggaggccactcgacggaacagccacaccttcaattgtcggatgcttatccatccccccgatgagcccggaacggagaaccaggaggcctgccaaagatatgaagtcatgcagtgctttaccgtttctcagcccaagagcattcaggaggatggcgaggactttcaatcttgcctgatctgtatcgcccgcagactacctagaccaccagccattactggcgtcgagagcttcatgacaaaacaggatacaacgggaaaaatcatatccatcgacacatcttcgctcagggccgccggtagaaccggttgggaggatctagtgcgcaaatgtatttatgcgtttttccaaccccaggggagagaaccgagctacgccaggcagctgttccaggaagttatgacgagaggaacagcctctagcccttcttacaggttcattttgaacgacggcactatgctttctgcacacacaaagtgcaagttatgctatcctcagtcgcccgacatgcaaccatttatcatgggaatccatatcattgatcgagaacatagcgggctatctccacaagacgacactaacagcggcatgtctatcccaagggtgaatcctagcgtgaacccatccatttcccctgcacacggagtcgcaagaagttctacactcccacccagcaattctaatatggtcagcacccgcattaatagacaacagagtagtgatctccacagtagctcacactctaatagctccaattcccagggcagttttggctgcagccctgggagccagatcgtggccaacgtagccctgaatcaaggacaggcgagtagccagtccagcaaccccagcttgaacctcaataactctccaatggaaggaacaggcatctctctcgcgcagttcatgagcccacgccggcaggtgacctcaggcttagcaacacgcccaagaatgcccaacaattcctttcccccaaatatctcgacattgagttctccagtcggtatgacaagtagtgcctgcaacaacaacaatcgaagctactctaacattcccgtaacgtcactgcaggggatgaacgagggaccaaacaactctgtcggctttagcgctagtagtcctgttctgcggcagatgtcctcgcaaaatagcccgtcaagactcaacatacagccggcaaaggctgaatcaaaagacaacaaggagattgcttcaatactcaatgagatgatccagagtgataacagttcttcagacggcaaaccactcgacagcggcctgctgcacaataacgacaggttgtccgatggagacagcaagtattcacagacaagccacaagctggtgcagctcctcaccaccacagcagaacagcagctcagacatgcggatattgacacatcatgcaaggacgtactctcctgcaccggaacctctaactccgctagtgccaacagctctggggggtcatgcccctcaagccatagtagcctgaccgaacggcataagattctccaccggttactccaggagggatccccatctgatataaccactctgagcgtggagcccgacaagaaggatagcgccagcacctcagtttccgtcacgggacaggtgcaagggaattcgagcataaaacttgaattagacgcatcaaaaaagaaagaatcaaaggaccaccagctcctgcgctacctgttggacaaggatgaaaaagatctcaggagcaccccgaatctgtcattggacgatgtcaaagtgaaagtcgaaaagaaagagcagatggatccctgtaacacaaaccctacgcccatgacaaagcctaccccggaggaaattaaactggaagcccaaagccagtttaccgctgacctggatcagtttgatcagcttttgcctacactagagaaggcggcacagctccccggcctgtgtgaaactgatagaatggacggcgccgtgacaagtgtcaccattaaatctgagatcctgcctgccagtctgcagagtgccactgccaggccaaccagtagattaaacagactgccagaattagagctcgaagctatcgataatcagttcggccaacctgggacaggcgaccagatcccttggacgaacaacacagtgactgcaataaatcagtcaaagtctgaggatcaatgcatctctagtcagctggacgaactattatgcccgcctaccaccgtggaggggcggaacgatgaaaaagccttgctggaacaactcgttagctttcttagcggcaaagatgagaccgagctggccgagttggatagggcgctcggtatcgacaaacttgttcaaggcggaggattagatgtactgtccgagagatttcctcctcagcaggcaactccacctcttataatggaagagcgcccgaacctgtacagccaaccttactccagtccatctcccactgctaacttgccatcaccttttcaggggatggtgcgacagaaaccttcccttggaactatgccagtgcaggtaacaccgcctcggggagcctttagccctggcatggggatgcagccgagacagacacttaatcggccccctgctgcgcctaatcagttacggctgcaacttcagcaaaggttacaggggcagcagcagctcattcaccagaacaggcaagctattctgaaccagttcgcggccaccgcccccgtgggaatcaatatgagatccgggatgcagcagcaaattaccccccagccacccctaaacgcccaaatgctcgcacaacgccaacgagagctctacagtcagcagcatagacaaaggcaactcatccagcagcagagggccatgctcatgcggcagcaaagcttcggtaataacttgcccccatcttcgggcctaccggtccaaatgggaaatccacgtctcccacagggagcaccgcagcagtttccctatccccccaactacgggaccaatcccggcaccccccccgcaagcacatctccatttagtcagctcgccgctaaccccgaggcgtctcttgccaatcgcaattctatggtgtcacgcggcatgactggtaatatcggtggacagtttggcacgggaatcaacccacagatgcagcagaacgtgttccagtaccccggtgcgggcatggtgccccagggcgaagcaaatttcgcccctagtttgtccccagggtccagcatggtccctatgccgattcctccgccgcaatcttcccttttacagcaaacacctccagcttctgggtaccagagcccagatatgaaggcatggcagcagggagccatcggcaacaataatgtgttctcccaggccgtgcagaatcagcccacgccagcccagcctggagtgtataacaacatgagcatcaccgtgagtatggcaggtggaaatacaaacgtgcagaacatgaatcccatgatggctcagatgcagatgtctagccttcaaatgcctggcatgaatactgtttgtcctgaacagattaatgatcccgcactgcggcacacaggactgtactgcaatcagctgagcagcactgacctgcttaaaacggaggcagatggtacacaagataagaaaacggaggagttctttagcgtcgttactaccgattag

SEQ ID NO: 126885 - DNA, 4326 bp, Artificial Sequence
  Description of Artificial Sequence: Synthetic coding sequence
atgtcgggattaggtgatagctcgtccgatccagcaaacccggactctcacaagcgtaagggatcgccctgcgacacccttgccagcagcactgagaaacgtagacgggaacaagagaacaaatacttggaggagctggcagagttgcttagcgctaacatttccgacatagattccctaagcgtgaagcctgacaagtgcaagattcttaaaaagaccgtggaccagatccagctgatgaagaggatggagcaggagaagagtacgactgacgacgatgttcagaagtccgacatctcatcctccagtcagggcgtgatcgagaaagagtctctgggaccactgctgcttgaagctctcgacggcttcttcttcgttgtgaattgtgagggcaggatcgtgttcgtatccgaaaacgtgacgagttatctcggatataaccaggaggaactgatgaacactagtgtgtacagtatcctacacgtcggagaccacgctgaattcgtaaagaatctcctgccaaaaagtctggtaaacggagtcccatggccacaggaagccactagacgaaatagccacacattcaattgtagaatgctcatccatcccccagacgagccaggtaccgaaaatcaggaggcatgtcaacgctatgaggtgatgcagtgtttcaccgtttcacaacctaagtctattcaggaggacggtgaggacttccaaagctgtctgatttgcatagctcgacgactcccccggccccctgcgatcaccggtgtggagtcctttatgacaaagcaagacactacaggaaaaattatatcaatagacacttcgagcttgagggccgctggaaggaccgggtgggaggatctggtccggaaatgtatatacgctttttttcagcctcaagggcgggagccttcctatgcaagacagctgttccaggaggtgatgactcggggtacagcctcttcgccttcgtataggttcatcctgaatgacggcacaatgctcagcgcccataccaagtgcaagctgtgctatccgcagtcgccagacatgcagccatttataatgggaatacatattattgaccgtgaacactccggcctatctccccaagacgacacaaatagcgggatgtcaatccctcgcgtgaacccctctgttaatccatcaatcagtcccgcccatggagtggctagatcctcaaccctaccacctagcaatagtaatatggtatcgactcgcattaacaggcaacagagcagcgaccttcattcttccagtcactccaacagttctaactcgcagggctccttcgggtgtagtcccgggtcacagatcgttgcaaatgttgccttgaaccaggggcaagcctcctcacagagttctaacccaagtctaaatctaaataactctcctatggagggaacaggcatcagcctggcccagttcatgagtccacggcggcaagtaacgagcggccttgctaccagaccgcgaatgcctaacaacagcttcccacctaatatttctacactgagcagccctgttggtatgacttcatctgcatgcaacaataataatagaagttacagcaatatcccggtgacctctctccaaggtatgaatgaaggccccaacaactccgtaggattcagtgcttcctccccagtcctgaggcagatgagcagtcagaactctccaagcaggctgaacatccaacctgccaaagcagaatcaaaagataacaaggagatcgccagtatcctgaatgaaatgatccagtctgataactctagtagtgacggcaagcctctggattcgggcttattgcataataacgaccgcctctctgatggagacagcaagtattcccagactagtcacaagctcgtacagctgttgactaccacggccgagcaacaactaaggcatgctgacattgacacatcatgtaaggatgtactttcttgcactggcacgtcaaattctgcctcagccaattcttctggagggtcctgcccgagcagccatagttcacttacagagagacataagattctgcatcggttactccaagaaggatctccatcagatatcaccactctgagtgttgagccagataagaaagatagcgcgagcacatcagtgtcggtcaccggtcaggtccaagggaacagctccatcaagttggaattggacgcaagcaagaagaaggaatcaaaagatcaccaacttctaagatatctactggacaaagacgagaaggacctgaggagtaccccgaacctgagcctcgacgacgtcaaggtgaaggtggagaaaaaagaacagatggatccatgcaataccaaccccacccccatgactaagcccacaccagaagagatcaaacttgaggcccagtctcagttcactgccgacttagaccaatttgatcagctgctgccaacacttgagaaggctgcacaattacctgggctgtgtgaaacggaccggatggatggtgcagtaacgtctgttactataaaaagcgagatcttacccgcttcccttcagagcgcaacggccagaccaacgtcccggttaaacagactaccagagctcgaactggaggctattgacaatcagttcggccagccaggcaccggggatcagattccatggactaataatactgttacggcgataaatcagtcgaaatcagaggaccagtgcatctcgtcccagctggacgagctgttatgtccccccaccaccgttgaaggcaggaacgacgagaaagcattgctcgaacaactggtcagcttcttgagcggtaaagacgaaaccgagttggcggagcttgatagggcactggggatcgataaactggtccaagggggaggtctcgacgtactcagtgagcgttttcccccgcaacaagccacaccgcccctcatcatggaggagcggcccaatctgtacagccagccttactcctctccttctccgaccgccaacctgccatctcccttccaagggatggttcggcagaagccctccctcgggaccatgcctgtccaggttactccacccagaggggccttctcccctggaatggggatgcagccaaggcagacactgaataggccacctgcagcccccaaccaactccgcctgcagctgcagcaacgtctgcagggacagcagcagctgatccatcagaaccgccaggccatccttaatcagtttgccgcaacggcccctgtgggaattaacatgcgaagcggaatgcagcagcaaataaccccacagcccccactcaacgctcagatgctggctcaacgccaacgggaactctatagccaacagcatcgccaacgccagctgatccagcagcagcgggcaatgttaatgcgtcagcagagctttggtaacaacttacctccatctagcggactccccgtgcagatggggaatcctagactgccacagggagctccccagcagtttccttacccacctaattatgggaccaaccctgggacaccacccgcaagtacctctcctttcagtcagctggccgcgaaccctgaggcctccttagctaaccgtaattctatggtgtctcggggaatgactgggaacattgggggccagttcggaacaggaatcaacccacaaatgcagcagaacgtctttcagtacccgggagcaggcatggttcctcagggcgaggccaactttgccccctcactttctccagggtcctcgatggttccaatgcctattcccccaccacagagctccctgctgcaacagaccccccctgcctctgggtatcagtctcccgacatgaaggcatggcaacaaggggctattggtaataacaacgtttttagtcaagctgtccagaatcaaccaacccctgctcaaccaggcgtgtacaataatatgagtataacagttagtatggccggtggaaataccaatgttcagaatatgaatcccatgatggctcagatgcaaatgagctccctccaaatgcccggcatgaacacagtgtgcccggaacagattaacgacccagcattgcgccacaccgggttatactgtaatcagctcagttctacggacctgttaaagactgaagccgacggcacccaacaggttcaacaagtccaggttttcgccgacgtgcaatgcactgttaatcttgtcggcggagacccctacctaaatcaacccggcccactggggactcagaagccaactagcggaccccagaccccacaggcacaacagaagagtcttctgcagcaactgctcacagaatag

SEQ ID NO: 126886 - DNA, 4323 bp, Artificial Sequence
  Description of Artificial Sequence: Synthetic coding sequence
atgtctggcctgggtgatagctctagcgatccagctaatcccgacagccacaaacgtaaaggatccccttgcgacacccttgcaagcagcaccgaaaagcgaagaagggaacaggagaacaaatacttggaggagcttgccgagctcctcagtgcaaacatctctgacattgatagcttgtcagtgaagccagacaagtgcaaaatcttgaagaagaccgtcgaccagatccagctgatgaaacgcatggaacaggagaaatccacaactgacgacgatgtgcagaagtctgatatctccagctccagtcagggcgtcattgagaaggagtccctgggcccgctcctgttggaagctctggacggcttcttttttgtagtgaactgtgagggtcgaattgtgtttgtttctgagaacgtgaccagttatctggggtataaccaagaagagctgatgaatacatcagtctacagcattctgcacgtgggtgaccacgctgagtttgtgaaaaatctgctgcccaagagcctcgtgaacggcgtcccttggccacaggaagccaccagacgcaacagtcacactttcaactgtcggatgctgattcatcctccagatgagccaggaacggaaaatcaggaggcttgccagaggtatgaggtaatgcaatgcttcacggttagtcaacctaaaagtatccaagaggacggagaagatttccagtcatgtctgatttgcattgctaggaggctacccaggcctcccgcaatcaccggagttgagagttttatgaccaagcaggacactaccggcaagattatctccatcgatacatcttcgctgagagccgctggaaggacgggttgggaagacctggtgcgcaagtgcatttatgcttttttccaaccgcaaggacgagagccaagctacgcccgccagctgtttcaggaagtgatgactcggggaactgcttcatctccttcgtatcggttcattttaaacgatggaactatgctcagtgcgcacactaagtgcaagctatgttatccccagtcccctgatatgcagccctttatcatgggcatccacatcatcgaccgagagcacagcggattatcaccgcaggacgacaccaactccgggatgagtattccaagagtcaatccatccgtaaaccccagtatttcccctgcacacggtgttgcccgttcatcaacactgccgccctcaaactccaacatggtcagcaccaggatcaatcgccagcagagctctgatctgcacagttccagtcactcaaattcttcaaacagccagggcagcttcgggtgctcacccggtagccaaattgtcgccaacgtggctttaaatcaggggcaggccagcagccagagctccaatccaagcctcaacctgaataatagcccgatggagggtaccggaatcagcctcgctcaattcatgagcccacgacgccaagtgacctcagggctggcaactcggcctaggatgcccaacaactcatttcccccgaacatctcaaccctgtcctctcctgtgggaatgacctcttccgcctgtaacaataacaaccggagttactctaatattcccgtaactagcttgcagggcatgaatgaaggaccgaataatagcgtaggctttagtgcatcctctccagtacttagacagatgtcttcccagaacagcccctctcgtttgaatattcaaccagccaaggcagagtctaaagataataaagaaatcgcctcgatcttaaatgaaatgatacagtccgacaactcgtcgtctgacggcaaaccactggactcaggccttcttcataataacgacagattgagtgacggagactccaagtattctcagacctcccataagctggttcagctgttgaccacaacagctgagcagcagcttcggcatgcagatattgataccagctgcaaggacgttttatcctgtaccggaacgtctaactctgcctctgcaaacagctctggcggctcttgcccctccagccattcatctctgaccgaacgccacaagattcttcaccgtctgttgcaggaagggagcccgtcggacatcaccaccctaagtgtagagcccgacaagaaagactctgcaagtacctcggtgtctgtgactggccaagtccaggggaactcaagcatcaaactggaactggatgcctccaagaagaaagagtctaaagaccaccagttattgagatatttattagataaggacgagaaagatctaagatccactccaaatctgtccctggacgatgtaaaggtaaaagtggagaagaaggaacagatggatccctgtaacaccaacccaacccccatgacaaagccaacacccgaggagattaagctcgaagcacagtcacagttcaccgccgatctggatcagtttgatcaactgcttcccacactggagaaggcagcccaactgcccggcttgtgcgagaccgaccggatggatggcgccgtgacaagcgtaacaattaaatctgaaatcttgccggcgagtctccagtctgcaacagcccggccaacaagcagactgaaccgacttcctgaattagagctggaagcaattgataaccaatttggacagcccggcacaggcgaccagatcccctggacgaataatacagtaacagctataaatcagtcaaagtccgaagaccagtgcatctccagccagctggatgagctcctgtgcccacctactacagtggaaggccgcaatgatgaaaaggcacttctggagcagctggtcagctttttatccgggaaggacgagacggagctcgccgagctggatcgtgccctgggtatagataagctcgttcaaggaggtggattagacgttctgagcgagcgttttcccccccagcaggcaactccccccctaatcatggaagagcgcccaaatctctacagccagccttatagtagtcccagccccacagctaacctgcccagcccatttcaaggaatggtccgccagaagccgtctctcggaacaatgcctgttcaggtgactccacctaggggagctttctcacccggcatgggaatgcaaccccgacagaccctcaaccgccccccagccgcacccaaccagctgcggttgcagctacaacagcgactccagggccagcagcagttaatccatcagaacaggcaggcaatcctcaatcaatttgccgccacagctcctgtcggtatcaacatgcgatcgggcatgcagcagcagatcaccccccagccacctcttaatgctcaaatgcttgctcagagacagagagagctgtactcacagcagcaccggcaacgccagctgattcagcaacagcgggctatgctcatgaggcagcagagctttggcaataatttgcccccatccagcggcctcccagtccaaatgggaaaccctaggctgcctcagggggcccctcagcaattcccctatccccctaattatggtactaatcctggcacaccaccagcatctaccagtcctttttctcagcttgcggcaaacccggaggcctcgcttgccaatcgtaactcaatggtgagcagaggaatgactgggaacatcggcggccagttcggcactggcattaaccctcagatgcagcagaacgtattccagtaccctggcgcgggcatggtgccgcagggagaagccaacttcgcaccctcgcttagtcccggcagtagcatggtccctatgccaataccccccccccagtcaagcctcctgcaacagacccctcctgccagcgggtatcagagccctgatatgaaggcctggcagcagggtgctatcggtaacaataatgtcttttcacaggctgtacagaatcagccaactcccgcgcagccaggcgtttataacaacatgtcaattacagtttctatggcgggagggaatacaaacgttcagaatatgaacccaatgatggcacaaatgcagatgtcttccctgcagatgccggggatgaacaccgtttgcccggaacaaataaatgacccggccctgcgtcatacggggttgtattgtaatcagctgtcctctaccgatctgttaaagacggaagctgatggcacccaggtccagcaagtgcaagtcttcgccgatgttcagtgcactgtcaatttggtcggcggcgatccctatctcaaccagcctggaccgctgggtacccaaaaaccaacgagcggcccacagacccctcaggcccagcaaaaaagtctgctgcagcagctgctgaccgagtag

SEQ ID NO: 126887 - DNA, 4200 bp, Artificial Sequence
  Description of Artificial Sequence: Synthetic coding sequence
atgtcaggccttggagatagttcctccgatccggcaaaccccgactctcataaacggaagggctctccttgtgacaccctcgcatcatcaaccgaaaagcgaaggcgagagcaagaaaacaaatacctggaggaactcgcagagttgcttagtgcaaacatctcagatatcgacagcctgtccgtaaagccagacaagtgcaagatcctgaagaagactgtcgaccagattcagcttatgaagcggatggaacaggagaagtcaaccacagatgatgacgtccaaaagtctgacataagctccagttctcagggagtgattgagaaagagagcctaggccccctgttattagaggctctcgatggatttttctttgtcgtaaactgcgagggacgcattgtttttgtaagcgagaatgtgaccagctacttaggatataatcaggaggaactcatgaatacgagcgtatacagcatacttcatgtgggagatcacgcagaatttgttaagaatctgctgcctaaatcactcgtcaatggcgtgccgtggccccaagaagcaaccagacggaactctcacactttcaactgtagaatgctgatccatcctcctgatgaacctggcactgaaaatcaggaagcatgtcaaaggtatgaggtcatgcaatgctttacggtgtcacagccaaaaagtatacaggaggacggagaggactttcaatcttgcctcatttgcatcgcacggagactccctagaccgcctgccattacaggcgttgaatcctttatgacgaagcaggacaccactggcaagatcatctccattgacacgtctagtttgcgggccgcaggcaggaccggatgggaggacctggtaaggaagtgtatatacgcattcttccagccccaagggcgagagcctagctacgcccgccagctatttcaggaggtgatgacgagaggaactgcctcttccccgtcttacaggttcatcctgaacgacggaactatgctcagcgcccatactaaatgcaagctgtgctacccccagtcaccagatatgcagcccttcatcatgggaattcacatcattgatcgcgaacactcgggcttgtcaccccaggacgatactaatagcggaatgtccattccacgcgtgaatccctctgtgaaccctagcattagtcccgctcatggcgttgctagatcatcgaccctgcctccatccaattctaacatggtctccacgaggattaatcggcaacagagctccgacctccactcaagcagtcactctaattcctcgaattcccagggctcattcggttgttctccagggtctcagatagtggcaaacgtcgccctgaaccaaggtcaggcttcctctcagtcaagcaacccctccctgaatctgaacaattcccccatggagggtacaggaatatctttggcccagttcatgagccctaggcgacaggtgacttccggtctcgccacccgccccagaatgcccaataactcattcccccccaacatcagcacgcttagctctccagtgggcatgacgtccagcgcctgtaacaacaataatagatcatattcaaatattcctgtgacttcccttcaaggcatgaacgagggccccaacaattccgtcggattttcagcgtcgtcacccgtgctgaggcagatgtcgtcacagaactccccctctagactgaacatccagcctgcaaaggccgagagcaaagataacaaggaaatcgcatctattctgaacgagatgattcagtccgataactcctcgtcagacgggaagcctctcgacagtggcctactgcataacaacgatcggctgtccgatggggactctaagtactcccagactagccataagcttgtgcagctgcttacgaccaccgctgaacagcagctgaggcacgctgacatcgatacttcatgcaaagatgtcctcagctgcactgggactagcaatagcgcatccgcaaattccagtggcgggagttgtccttcaagccatagcagtctcacggagagacataaaatcctgcatagactgctccaggaaggaagtccatccgacatcaccacgctatcggtggaaccagacaagaaggactcagccagcacaagtgtcagcgtaacaggccaggtccaagggaactcctcaatcaagctagagcttgatgcttcaaagaagaaagaatccaaggatcatcagttgcttagatatttgctggacaaagatgaaaaagatctgagatccaccccaaacttgtcattggacgacgtgaaggtcaaagttgagaaaaaggagcaaatggacccttgcaacactaatcccacccctatgacaaagcccactcccgaagaaattaagcttgaggcccagagtcaatttaccgcggacttggatcagttcgaccaacttctgcccactttggagaaagctgcccagttgcctggcctgtgtgaaaccgataggatggacggtgccgtgacttcagtgaccattaagtcagaaattcttcctgctagtctgcagtctgcaactgcccgtcctacaagtaggctaaatcgcctgcctgaactggaattggaggcaattgataatcagttcggccaacccggaacgggagaccagataccttggacaaacaacaccgttacagctatcaaccaatcaaagagcgaggatcaatgcatcagctcccagcttgacgagttgctgtgccctcctaccacggtggagggcaggaatgacgagaaagctcttctcgagcaactcgtgtccttcctgtccggcaaggacgagaccgagttggccgaacttgaccgggccttgggaatagacaaactggtgcagggcggagggctcgatgtgctatctgagagattcccaccccagcaggcaacaccacccttgatcatggaagagaggcccaatttatacagccagccatatagctctccctcacccaccgcgaacctgccatcgccgtttcaaggcatggtcaggcagaaaccatcactgggtaccatgccggttcaggttacgcctcccaggggggctttttcaccggggatgggtatgcagcctcggcaaactttgaatcggccaccggcagctcctaaccagctgaggctacagttgcaacagagactacaagggcagcagcagctcatccaccagaatcgtcaggcgattctgaaccagtttgccgccacagccccggtgggaatcaacatgagatcaggcatgcagcagcagatcaccccccagcctccattaaacgcccaaatgctcgcccaaaggcagcgagaattatattctcagcaacaccggcagaggcagctgattcagcagcaaagagccatgctaatgcgtcagcagtctttcggtaacaaccttcccccttcgagcgggctccccgttcagatgggtaaccctcgcctgccgcagggagcccctcagcagtttccttatccgcctaattacggaacaaaccctggtacccctccagcatccacatctccgttcagccagctggccgctaatccggaggcctcattggcgaatcgaaatagtatggtgtccagggggatgacaggtaacattgggggtcagttcgggacaggaataaacccacagatgcaacaaaatgtgtttcaataccccggagccggaatggtgccgcagggagaagccaattttgccccttcactctccccgggcagctccatggtgccaatgccaattccaccaccacagtcttccctgttacagcagacacctccagccagtggctatcagtctcctgacatgaaggcctggcagcagggagcaatcgggaataataatgtcttcagtcaggcagtgcagaaccagccaacgcctgcacagcccggagtgtacaataatatgagcattaccgtgagcatggccggtggaaacacgaacgtccagaacatgaatcctatgatggcccagatgcagatgtcttcgctgcaaatgcccggtatgaatacagtgtgccccgagcaaattaacgaccccgcattgaggcatacaggtctctactgcaaccaactttcctccacagatctccttaaaactgaagctgacggaactcaagacaaaaaaacagaggaattcttttcagtggtgaccacagattag

SEQ ID NO: 126888 - DNA, 4326 bp, Artificial Sequence
  Description of Artificial Sequence: Synthetic coding sequence
atgagcggtcttggggactcttccagcgatcctgctaaccccgactcccacaagaggaagggctccccttgcgataccctggcatcttcgaccgaaaagcgacgtagggagcaggaaaataagtaccttgaagagctggccgagcttctgagcgccaacatctccgatattgattctctcagcgttaaacccgacaagtgtaaaattcttaaaaaaactgtcgaccaaattcagcttatgaaacgcatggaacaggagaagagcaccacagacgatgacgtccagaagtctgacatttcctcctcgtctcagggtgttatcgagaaagaatctctgggccctctgctattggaggcactggacggctttttttttgtggttaactgtgaggggcgcatcgtgtttgtctccgaaaatgtaactagctaccttggctacaaccaggaagagttaatgaacacctcggtgtacagcatattacacgtcggcgaccacgcagagtttgtcaagaatctgttgccaaagtccctggtgaatggcgtgccttggccacaggaagcgactcggagaaattcccacacttttaattgtagaatgctcatacatccgccagacgaacctggcaccgagaaccaggaagcctgccaaagatacgaggtgatgcagtgctttactgtgtcacagcccaagagcattcaggaagacggagaggattttcaatcctgtctcatttgcatcgctcggcggctccctcgaccaccagccataactggggttgagtctttcatgactaagcaagataccacgggaaaaataatcagtatcgatacgagcagtcttcgagccgccggaagaaccggctgggaggatttagtaaggaagtgcatctacgcctttttccagccccagggtagggaacccagctatgccagacagctcttccaagaggttatgacaagggggactgcttcgagtccaagctacaggtttatcctgaacgatggcacgatgctctcagcccacactaagtgcaagctttgttatcctcagtcccctgacatgcagccatttattatggggatacacatcattgatcgggagcattccggcctgtctccacaagatgacacgaattccggcatgagcattcctcgagtgaacccttcagttaacccctctatttctccagcccatggcgtggccaggagttcaaccctgcccccgagtaacagcaatatggtgtccactcgaatcaaccgccaacagagtagtgatttgcatagttcctctcactccaattcgtccaactcacaagggtcctttggttgttcccccgggtctcaaattgtggcgaacgtggcactgaaccagggacaagcctcaagccaaagttccaatccctccctcaatctgaacaactcccctatggaaggcaccgggatttcgttagcccagtttatgagcccacgcagacaggtgacgtccggactcgcaactcgaccgcggatgcctaacaattctttcccccccaacatctccactctgagctccccggtgggaatgaccagttccgcatgcaataacaacaaccggtcatacagcaacattccagtcactagcctacagggcatgaacgaaggccccaataacagcgtggggtttagtgcctcttcgcctgtgctccggcagatgagctctcagaatagcccgagccggttaaatatacagcccgccaaggcggaaagcaaggacaacaaagaaatagcttccatactgaacgagatgattcagagtgacaactccagttcggatggcaaacctttggactccggtttactccacaataatgaccgcctgtctgacggagatagcaagtattcccagacatcccataagctagtccagctcttgacaactacagcggaacagcagctcaggcatgccgatattgacactagttgcaaggatgtactcagctgcacgggcacgagcaatagtgccagcgctaattccagcggcggctcgtgcccttctagccatagtagcctaacagaaagacataaaattcttcacagactgctgcaagaaggctctccaagcgacatcaccacactgtccgtggagcccgacaaaaaggatagtgccagcacgtcggtgtcggtcaccggccaggtgcagggaaattcatccattaaactggaactcgacgcgtccaaaaaaaaggagtccaaggaccatcagttgctgcgctatctgcttgacaaggacgagaaagacctccggagtacgcctaatctctcccttgacgatgttaaggtgaaggttgaaaagaaggagcaaatggatccctgtaacaccaatcccactcctatgactaaacctacaccagaagagattaaactcgaggcgcaatctcagttcacagcagatttggatcagttcgatcaactgttacccactctggaaaaggccgctcagctccccggactatgcgagacagacaggatggacggagcagtcacgtcggtaacaattaagtctgaaatcttgccggcatctctacagtctgcaaccgctcgccccaccagcaggctgaatcggctcccagaactggagctagaggcaattgataaccaatttgggcagccaggaaccggagaccaaattccatggacgaataatacagtaacggcaataaaccaatccaagtccgaggaccagtgtataagctcccagctggacgagctgctgtgccctcccacgaccgtggagggtcgaaacgacgaaaaggcactgctagagcagctggtatcattcctttcaggtaaggacgagacagaactggcggagctggaccgggcactcggcattgacaagctcgtgcaggggggcgggttggatgtgctctctgagcgctttcccccccagcaagcaacaccccccctcatcatggaagaaagaccaaacttgtactctcagccgtacagctcaccctctcctacagcaaatctcccttcaccttttcagggaatggtgcgacaaaaaccctcactcggtaccatgcctgtgcaggttaccccacctcgtggagctttttccccgggaatgggcatgcagccccggcaaacattgaatagaccgcctgctgcccccaaccaactcagactgcaacttcaacagcgcttgcaaggccagcagcagctcatccatcagaatcgtcaggccattctgaaccaattcgcagcaacggcccccgtcgggataaatatgagaagtgggatgcaacaacagattacaccccagcccccgttgaatgcacagatgttggcacagaggcagagggagctctatagccagcagcacaggcagcgccagttaattcaacagcagagggcaatgcttatgcggcagcagtcatttggcaataatctgccacctagttcgggcctccccgtgcagatgggcaatccacgccttccacaaggggctccgcagcagttcccctaccccccaaattatggaacgaacccaggcaccccccctgccagtacaagccctttctcacaactggccgctaatcccgaggcatctcttgccaaccgaaacagcatggtctcaaggggcatgacaggcaacattggtgggcagttcgggaccggtatcaatccgcaaatgcagcagaatgtgtttcaataccctggcgccggcatggtgccacagggagaggcaaactttgccccatccctgtctcctggctctagcatggtgcctatgccaattccaccccctcagtcaagtcttctccagcaaactccccctgcttccggctaccaatccccagacatgaaggcctggcagcagggagccatcggaaacaataacgttttcagtcaggccgtgcagaaccagcccacacccgcccagcctggcgtttacaacaatatgtctattactgtatctatggctggcggtaacacaaatgtgcagaatatgaaccccatgatggctcagatgcagatgtcatccctgcagatgcccggaatgaataccgtttgtccagaacagattaatgacccggctctgagacatacaggactctactgcaatcaactgtcctccactgatttgttgaaaaccgaagccgacggcactcagcaggttcagcaggtgcaagtctttgctgatgtgcagtgcacggtgaatttggtggggggagacccatatctgaatcaacctggaccgcttggtacccaaaagccaacttcaggccctcagacccctcaagctcaacagaagagcctgcttcagcagttacttaccgagtag

SEQ ID NO: 126889 - DNA, 4200 bp, Artificial Sequence
  Description of Artificial Sequence: Synthetic coding sequence
atgtctggccttggagacagcagctccgaccctgctaaccctgactcccataagcgcaagggaagtccatgtgatacccttgcttcctccaccgaaaaaaggaggcgggagcaggaaaataagtatctggaggaattagccgagcttttgtcagccaatatcagcgatatcgactcgctatctgtgaaaccagacaagtgcaaaatcctcaaaaagacggttgaccagatccaactaatgaagagaatggagcaggaaaaaagcactaccgacgacgacgtgcagaaaagtgacataagttccagttcgcaaggtgttatagagaaggagagcctcggtccccttttactcgaagccctggatggctttttcttcgtcgtaaattgtgagggccggatcgtgttcgtgtctgagaatgttaccagttacttagggtacaatcaggaggagctgatgaataccagtgtttacagcatcttgcatgttggggaccacgccgagtttgtgaaaaacctgctgcccaaatctcttgttaatggcgtgccctggccacaggaggccacccgcagaaattcacatacattcaattgtcgcatgctgattcatcctccagatgaacctggcaccgagaatcaggaagcttgccagcggtacgaggtgatgcaatgcttcaccgtgagccaacccaaaagtatacaggaggacggagaagattttcagtcgtgcctgatctgtatcgctcgacgcctgcccagacctcccgccattactggcgtggagagcttcatgacaaaacaggatactacgggaaagatcatcagtattgatacaagttccctgcgtgccgccggacggacaggatgggaggatctggttcgcaagtgtatctacgccttcttccaaccccaaggtagggaaccaagctatgcaagacaattgttccaagaagtgatgacaagaggaacggcgtcctccccatcctatagattcatcctcaatgacggaacaatgctgtcagctcataccaagtgcaaactctgctatcctcagagcccagatatgcaaccctttattatggggatccacatcatcgatagggagcatagcggactgagtccccaggacgacactaactcagggatgagcatcccgagagtgaatccaagcgtaaatccttcgatctccccagcccatggcgtggcgcgatcaagcacccttccacccagtaacagcaacatggtcagcacccgaatcaaccgccagcaaagctcagacttgcattcctccagtcattctaattcaagtaattctcagggctctttcggatgtagtcccggctcacagatcgtggctaacgtagctctgaaccagggccaggcatcatcccagtctagcaatcccagtctgaacctaaacaatagccccatggagggcactggtatctccttggcccagttcatgtcccctaggagacaggtaacttcgggcttggcaactaggccgagaatgcccaataacagctttcctccaaacatttcaaccctttcgagtcctgtaggtatgacatcttcagcatgtaacaataacaaccgatcctactcgaatatccctgtaaccagtctgcaagggatgaacgagggacccaataattctgtgggtttctctgctagttcccctgtgcttaggcaaatgtctagccagaactccccctcccgcctgaatatccagccagcaaaagcagagtccaaagacaacaaagaaatcgcaagtatactgaacgagatgatccagtccgacaattccagttctgatgggaaacccctggatagcggtctgttgcacaacaacgacaggctcagtgacggggactccaagtacagtcagacatctcacaaattggtccagttgttaactacgacagctgagcagcagcttaggcacgcagatatagatacaagttgcaaagacgtgctgagttgtaccggcacaagcaacagcgcctcagccaacagtagtggagggtcatgcccgagctctcactcttccctgactgagaggcataaaattttacataggctgctgcaagagggatcgccaagtgatattaccaccctgtccgtcgagccggacaagaaagattcagcttctacgtcagtaagcgttacaggccaggtacaggggaattcaagcattaaactcgaactcgatgcaagcaaaaaaaaggaaagcaaggatcaccagctcttgaggtacttactggataaggatgagaaagatttgcgctctacacctaatctgagcttagacgatgtgaaggtcaaagtcgaaaagaaggagcagatggacccatgtaatacaaatccaactccgatgaccaaaccaacccccgaagaaataaaacttgaagcccagtctcagttcactgcggacctggaccagttcgaccaactgctccctaccctcgagaaagctgctcagctgccgggcctttgtgagaccgatcggatggacggggcagtcacgagcgtaacaatcaagtctgagattcttcccgcctctcttcagtcagcaacagccaggcccacttcccgattgaataggttaccggagctagagctggaggcaattgataatcagttcgggcagccgggaactggtgaccaaatcccctggaccaataataccgtgactgccatcaaccagagcaaatctgaagaccagtgcatttctagccagctcgacgagcttctctgtccccctactaccgtggagggacggaatgatgaaaaggccctcctggaacaacttgtgagctttctgtcaggcaaggatgagactgaattggccgagctcgatagagcactaggcatagacaagcttgttcagggcggaggtctggatgtgctgtccgaaagattcccgccacagcaggctacgcccccactgataatggaagaacggccaaatctgtacagtcagccctattccagtcctagtcccactgctaatcttccaagcccattccaggggatggtccgacagaagccatctttaggaacaatgcctgttcaggtgacacccccacgcggggccttttccccaggcatgggcatgcaaccacgccagacgttgaatcggccgcctgccgcccccaaccagctccgcctccagctccagcagaggctgcaggggcagcagcaactgattcatcagaaccggcaggctatactgaaccagttcgccgccacagcgcccgtaggaatcaacatgcgttccggcatgcaacagcagatcacaccccagcctcctctaaacgctcaaatgctcgctcagcgtcaaagagagctatattcccaacagcacagacagcgccaactgatacagcaacagcgggcaatgctgatgcggcagcagtcatttgggaacaatctgcccccctcatctgggctcccagtgcagatgggaaacccccgcctcccccagggtgcaccccagcagttcccatacccaccaaattatggcacaaatcctgggaccccacctgcgtcaacatctccctttagccagctggcagccaatccggaggcttctctggccaaccgtaacagcatggtgtcaagaggaatgacgggaaatatcggagggcagtttggaacagggataaacccacaaatgcaacagaacgtgtttcagtatccaggtgctggcatggttccccagggggaagcgaactttgcaccatccttgagccccggctcaagcatggtcccaatgcctatccctcccccacagtcttcactgctccagcaaaccccacccgcaagcggctatcagtctccagatatgaaggcttggcaacagggggctatcggcaacaacaatgtgttttcccaggccgtgcagaatcagccgacacctgcacagcccggtgtgtacaataacatgtctatcactgttagtatggccggaggtaacacgaatgttcagaatatgaaccctatgatggcccaaatgcagatgagcagcttgcaaatgcctggaatgaacacagtctgcccagaacagattaatgacccagccttgcgacatacaggcctgtactgcaatcagctgtcctcgacagacctgctcaagacagaagcagatggcacacaggataagaagaccgaggaattctttagcgtcgtgaccaccgattag

SEQ ID NO: 126890 - DNA, 1659 bp, Artificial Sequence
  Description of Artificial Sequence: Synthetic coding sequence
atgcagctgaccgcagaaaatagtccggtgacccctgtgggcgcgcagaagaccgctttgcgcatctctcagtcacgcatgatcggcaatagcgcatcacggccaaccatgcctagcggcgaatgggcgcctcagtcttcggcagtgcgcgtgacatgtgcagccaccacgtctgctatgaacagacccgtccaggggggcatgatcagaaatcctgccgccagtatccccatgcgccctagcagccagcctggtcagcgccagacactccagtcccaggtcatgaacatcggtccatccgaactagaaatgaatatggggggacctcagtactctcagcagcaggccccacctaatcagacagccccatggccggaatctatcctccccattgatcaggcctctttcgctagccagaaccggcaaccctttggtagctctccagacgacttactgtgtccgcaccctgccgccgaatccccgagtgatgaaggcgctttgctcgaccagctttatctggctctcagaaacttcgacggcttggaagaaatcgaccgggccctgggaattcctgaattggtgtctcagtcacaggcggtggatcccgaacagttctcctctcaggacagtaacatcatgctcgagcaaaaggcaccagtatttccccaacagtacgcttcacaagcccagatggcacaaggctcatacagcccaatgcaggaccccaattttcacacgatgggacagcggcccagctacgccaccctaagaatgcagcctagacctggcctgcgacctacaggcctggtacagaatcagcccaatcagctgcgcctgcaactccagcaccgactgcaagcgcaacagaatcggcaacctctcatgaaccagatttcaaatgtaagtaatgtgaacctgacacttagaccgggcgtgcctacccaagcccccattaatgctcaaatgctggcccagcggcagagagaaattcttaatcagcatctgagacaacgccaaatgcatcaacaacagcaagtgcagcagcgcacactaatgatgagaggtcaggggctgaacatgaccccatctatggtggccccctccggcatgcccgcaaccatgagcaatccaaggattccccaagcgaatgcacagcaatttccttttccccctaattatggtatctcccaacagccggaccccggatttaccggtgctaccaccccccagtccccactaatgagtccacggatggcccatacccagagcccaatgatgcagcagagtcaggccaacccagcctaccaagctcctagtgatatcaatggttgggcccagggcaacatggggggaaactccatgttcagccaacagagcccaccgcattttggacagcaggcaaatacctccatgtatagcaataatatgaatatcaatgtgagcatggccaccaatacaggcgggatgtcgtccatgaatcagatgactggacagatatcgatgacctccgtgacatcagttccaacatcaggactaagctcgatgggcccagagcaggttaatgaccccgctctgagaggcggcaacctgtttcctaaccagctgccaggcatggacatgatcaaacaggaaggggataccacacgcaaatattgctag

SEQ ID NO: 126891 - DNA, 4395 bp, Artificial Sequence
  Description of Artificial Sequence: Synthetic coding sequence
atgagtggtatgggcgagaatacgagtgatccgtcaagggctgagacacgcaagagaaaggaatgtccagatcagcttggtccatctccaaagagaaatacagaaaagcgaaatcgcgaacaggagaacaaatacatcgaggagctcgcagagctcattttcgccaatttcaacgacatcgacaatttcaatttcaaaccagacaagtgcgcaattcttaaagagactgtgaagcagatccggcagatcaaagagcaggagaaagccgctgccgctaacatcgacgaggttcagaagtcagatgtgagcagcacgggccagggagtaatcgacaaggacgccctgggaccaatgatgctcgaagccctggatgggttcttcttcgtcgtgaacttggagggcaatgttgtctttgtctccgagaatgtgacacaatacctgcgatataatcaggaggaactcatgaataagtctgtgtactcaatcttgcacgtgggggaccatacggagttcgtgaagaatctgttaccaaagtctattgtgaacggggggtcctggtcaggcgagccaccaaggcggaacagccacacattcaactgtagaatgcttgtcaagcctctgcctgatagtgaagaggagggccacgataaccaggaagcccaccaaaaatatgaaacaatgcagtgctttgcagtttcccaacctaaaagtatcaaggaagagggtgaggaccttcaatcctgtctgatttgtgtggctcgacgagtgccaatgaaggagaggcctgtgcttccttcttccgaatctttcaccacccgccaggatctgcaggggaaaatcacatcactggatacatccacgatgagggccgccatgaaaccaggctgggaagacctagtgcgaaggtgcatacagaagtttcacgctcagcatgagggagaatcagtgtcatatgcgaagcgccatcaccacgaggtgctgagacagggactcgcattttcgcagatatatcggttcagcctaagcgacggcaccttggtggccgctcaaaccaagagcaagctcattcggtcacagaccacgaacgagcctcagttggtaatttctctccatatgctgcaccgggagcagaacgtgtgcgtcatgaaccccgatcttacaggtcagactatgggaaagccccttaatcctatatccagcaatagcccggctcaccaggctctctgctcaggtaacccagggcaggacatgacactgagctccaatatcaattttccaattaacggcccaaaagaacagatgggcatgcccatggggaggttcggcggaagcggaggaatgaatcatgtcagcggaatgcaggccactaccccccagggctcaaattatgctttaaagatgaacagtccctcccagtctagccctggaatgaatccaggacaacccacctctatgttatccccaaggcaccggatgtcgcctggagtcgctgggtccccacggattcctccctcccagttcagtccggccggaagcctccacagtccggtaggggtgtgttcaagcaccggaaacagtcacagctacactaacagcagcctgaatgccctgcaggccctgtccgagggtcatggcgtttccctgggatcaagcctggcctcaccagatctcaaaatgggaaatctgcagaatagcccagttaatatgaatccccctccattgtctaagatgggatctctggattcaaaagattgcttcggcctctatggtgagccatcagaaggtacgaccggacaagccgagagttcatgtcaccctggcgagcagaaagaaacaaacgatcctaacctgcctcccgcagtgagttcggaacgtgcagacggccaatcaaggctgcacgactccaaggggcagacaaaactgttgcaactcctgacaaccaagagcgaccaaatggagccttcacctctcgcttctagcttgagcgatacaaacaaagattcaactgggagtctaccaggatccggttccacccacggcacctctctcaaggaaaaacacaagattctccacaggctgctgcaggatagctcctcgcctgtggacctggccaagctgacagccgaggctacgggaaaggacctgagtcaggagtcttcgagcacagcacccgggtctgaggttacaataaagcaggaaccagtgagccctaaaaagaaagaaaacgctctgctccgctacctcttggacaaggacgatacgaaggacatcggcctgccagagattactccaaaacttgaaagactcgacagcaaaaccgaccctgccagtaatactaagctcattgctatgaagacagaaaaggaagaaatgagcttcgagcctggcgaccagccaggttccgaactggacaacctggaagagatactggacgacctacaaaactcacaactgcctcagttgttccccgacactcgccccggcgctcctgccggatcagtcgataagcaggccatcatcaacgaccttatgcagttaactgccgagaacagtccggtgactccagtaggggcccagaaaactgcactgcggataagccagagtaccttcaataaccccagacctggtcaactcggccggctgcttccgaaccagaacctacccctggatataactcttcagagtcccaccggcgcgggaccattccctccaatcaggaacagctccccctacagcgtcattccccagcccgggatgatgggtaaccagggcatgattgggaatcaaggcaatctgggaaactcctcaacaggcatgattggaaacagcgcgtccagacccacaatgccaagtggagaatgggccccgcagagtagcgccgtaagggtgacatgcgccgcaactacttccgccatgaacaggcccgttcagggggggatgattcggaatccggccgcgtctattcctatgcgtccctccagtcaacccggacagcgacagactctgcagtcccaggtgatgaacattggcccatcggagctagaaatgaatatgggagggccccagtactcacaacaacaggctccccccaatcagaccgccccctggcccgaaagcatcctccctatcgatcaggcgtcctttgctagccagaacagacagcctttcggctcctctccagatgacctcttgtgtccccatccagctgcggagagcccgagcgacgagggagcgctattggaccagttgtatttggccttgaggaattttgacggcctcgaggagattgaccgggctctgggcattcctgagttagtgtcccagtctcaggctgtcgacccagagcagtttagctcccaagattccaatattatgctagaacagaaggctcccgtctttcctcagcagtatgcctcacaggcccagatggcacaaggatcctacagtcctatgcaggatccaaacttccacacaatgggccaaaggccctcctatgccacattacgcatgcagcctcgacccgggttgcgaccgaccggactggttcagaaccagcccaaccaacttcgactgcagctacagcaccggttacaggcccagcagaacaggcagcctctgatgaaccagatctctaacgtgagcaatgtgaacttgacactgcggcccggagtaccaactcaggctcccattaatgctcagatgctggcgcagaggcagcgggagatcttgaatcagcacctccgtcagcggcagatgcatcagcagcaacaggtgcagcagcggaccttgatgatgcgtggccagggtctcaacatgaccccatccatggtagcgccctccggcatgcctgctaccatgtctaatccccgcattccacaggccaatgcccaacagttcccttttcctccaaactacggcatcagtcaacagcctgacccaggctttacgggggctacgaccccacagtcccccctcatgtcgccccgcatggcacatacccagagccccatgatgcaacaaagccaggcaaaccccgcgtaccaggccccatccgatattaacggctgggcccaggggaatatgggaggcaattctatgttcagccagcagagtccgccgcactttgggcagcaagcgaatacgagcatgtattccaataacatgaacatcaacgtctccatggccactaacaccgggggaatgtcatctatgaaccagatgactggacagatcagtatgacctccgtaacctccgtccccacttcgggcctgtccagcatgggacctgaacaggtgaatgatcccgcacttcggggaggcaatctgtttcccaatcagttgccaggaatggatatgataaagcaggaaggagataccactaggaagtattgctag

SEQ ID NO: 126892 - DNA, 51 bp, Artificial Sequence
  Description of Artificial Sequence: Synthetic coding sequence
atgtccggcatgggagagaacacgtctgatccttcacgtgctgagacatag

SEQ ID NO: 126893 - DNA, 27 bp, Artificial Sequence
  Description of Artificial Sequence: Synthetic coding sequence
atgagtggcatgggagaaaatacatag

SEQ ID NO: 126894 - DNA, 4263 bp, Artificial Sequence
  Description of Artificial Sequence: Synthetic coding sequence
atgtccggcctgggcgaaaacctggaccctctcgcctccgacagcaggaagcgaaagcttccatgtgataccccgggccagggactgacctgctccggcgagaaacgacggagagagcaggaatctaagtatatcgaggaactagcggagctgatatcagctaatttgagtgatattgacaatttcaatgtcaaaccagacaagtgcgccattcttaaagaaaccgtgcgacaaatccggcaaatcaaggaacagggaaagacaatctcgaacgacgacgacgtccagaaagcagacgtgtcttccaccggtcagggagtgattgataaagactctctgggtcctctgcttctccaggcactcgacggttttcttttcgtggtgaaccgggatggaaacattgtgttcgtgagcgagaatgtaacacaatatctgcaatacaagcaagaggacttggtgaatacctctgtatataacatactgcacgaagaggaccgaaaggattttttgaaaaacctacccaaaagcaccgtgaatggcgtctcatggaccaacgagacccagagacagaaatcgcatacatttaattgcagaatgttaatgaagacccctcatgatattctggaggacatcaacgccagcccagagatgcgccagcggtatgagacaatgcaatgcttcgcactatcacagcccagggccatgatggaagagggtgaggacctacagagttgcatgatctgcgtcgcacggagaatcacaactggagagagaacctttccgagtaaccccgaatcatttatcactcggcatgatctgagcggaaaggtagttaatatcgacacaaactctctgcgctcatccatgcgccctggatttgaggacattattcgaaggtgcatccagcgtttcttctctctgaatgacgggcagtcatggtcacaaaaaaggcactaccaggaggcgtacctaaatggtcacgcagagacccccgtgtacaggttttcgttggcggatggcaccatcgtgaccgctcagacaaagtctaaactgttccgaaacccagttaccaacgaccgccacggcttcgtgtccactcattttctacagagagagcagaatgggtatcgtccgaacccaaatcctgtcggtcaaggcatcagaccccctatggcaggatgtaattcatcagtagggggaatgtccatgtcccccaatcaggggcttcagatgccatctagcagagcttatggcctcgctgacccaagcactacaggacagatgtccggggcgagatatgggggaagctcaaatatcgcaagtctcacccccgggcccggcatgcaaagtcctagttcctatcagaacaacaactacgggctcaatatgagctcaccaccgcacggctcgccagggctggcgcccaaccagcagaatatcatgataagccctaggaatagaggatccccgaaaatcgcctctcaccagttcagtcctgtggctggagtgcactccccgatggcttcctccggcaacactgggaaccacagcttttcctcctcttcactgtctgctttgcaggcgatctccgagggagtgggcacctctttgctctcgacactttcgagcccagggccgaagcttgacaacagccccaatatgaacataacacagcccagtaaggtgagcaatcaggatagcaagtcgcctctcgggttctactgcgatcagaacccagttgaaagttctatgtgccagtccaacagtagagatcaccttagtgataaagagtcaaaagagagttctgttgagggcgctgagaatcaacgtggcccactggagtctaaaggccacaagaagctgctgcagctcctgacctgtagttcagatgatagagggcactcgtctctcaccaatagtcctttagactcatcgtgtaaagagagtagtgtctcggtgacgtctcccagtggcgtttcatcctcgactagcgggggggtttcctccacaagcaatatgcatggatctctgctgcaggagaaacatcgaatcctgcataaactgctgcagaatgggaactctcctgccgaggtggctaaaataacggcggaggccacaggaaaagacacatcatctatcacgtcatgtggggatgggaacgtcgtgaagcaagagcagctttcaccaaagaaaaaagaaaacaatgccctgctgaggtatctcctggatcgcgatgatccatcagatgctctctcaaaggaactacaaccacaggtggaaggggttgataacaagatgagccagtgcaccagttccactattccttccagcagtcaggagaaggaccccaaaatcaagacagaaacctctgaagagggatctggcgacctggacaaccttgacgcaattttgggcgatttgacctcatcagacttctataataacagtatttcgtcaaacggtagccacctgggaaccaaacagcaggtgttccagggtaccaatagtttagggctgaagtcaagtcagtcggtacagtctattagacccccatataacagagccgtgtcacttgactccccagtgtccgtgggatcttctccacctgtgaaaaacatctcagccttccctatgctgcccaaacagccaatgctgggagggaatcctagaatgatggattcacaggagaactatggctcctccatgggcggacctaacagaaatgtgactgttacgcagactcctagctcaggcgattggggactgccgaactcaaaagctggaagaatggaacctatgaacagcaactccatgggaaggcccggaggcgactacaacaccagcctgccgagacctgcactgggaggctctattccaacactccccctacgttccaactccattcctggggcgaggccagtcctacaacagcaacagcagatgttgcagatgcggcctggtgagatacctatgggaatgggtgctaatccttatgggcaggctgctgcctcaaatcaactgggtagctggccggacggtatgttgagtatggaacaagtgagccatgggacacagaatcgcccactgctcagaaattcactggacgatttggtcggccctccatctaacctggaaggccagagcgacgagcgggctttactggatcagctgcacacactcctctctaatactgatgctactggccttgaggaaattgacagagccctagggatacctgaactggttaaccagggacaggcactcgaacctaaacaggacgcgtttcagggtcaggaagccgccgtcatgatggaccagaaggcgggcctgtatggccagacttatccagcgcagggaccacctatgcaaggtggctttcacctccagggccagtctccgagttttaactcgatgatgaaccagatgaatcaacagggcaacttccccttgcaaggtatgcaccccagggcaaacattatgcggccccgcaccaatactcccaagcaactgagaatgcagctgcagcagcgtctgcaaggccagcagttcctcaaccagagccggcaggctctggaattgaaaatggagaacccaactgccgggggtgccgctgtgatgcgccccatgatgcagccccagcaggggtttctgaacgcacagatggtggctcagcggtcgcgggagctgttaagtcaccatttccgacagcaaagagtagccatgatgatgcaacagcagcagcagcaacaacagcagcaacagcagcagcagcagcagcagcagcagcagcaacaacaacaacagcagcagcagcagacccaggcctttagtccccccccaaacgtcactgcgtccccgtctatggacgggttgctggctggacccacaatgccacaggcgccaccacagcaatttccctaccagcccaactacggtatgggccaacagcctgatcccgcctttggcagagtaagcagtccgccgaatgccatgatgagttcccgcatgggacccagtcagaacccgatgatgcagcacccacaggccgcatctatttatcagtccagcgaaatgaagggatggcccagcggcaatctggctcggaactcctccttcagccagcagcagttcgctcatcagggaaatcccgccgtctactccatggtgcatatgaacgggagctcaggacacatggggcagatgaatatgaatccaatgccgatgtcgggaatgccaatggggccagatcagaaatactgctag

SEQ ID NO: 126895 - DNA, 4053 bp, Artificial Sequence
  Description of Artificial Sequence: Synthetic coding sequence
atgagcggcctgggcgaaaatcttgacccactggcctccgactcccggaagcgcaagctcccatgtgacactcctggccaaggattgacatgcagtggagagaagcgaagaagggagcaggagtccaagtacattgaggaacttgctgagcttatctccgccaacctgtctgacatcgacaactttaatgtgaagccagacaagtgtgccattttgaaagagaccgtgcggcagatcagacagatcaaggaacaagggaagacgatttctaacgatgatgacgtccagaaggccgacgtctccagcactggtcagggcgttattgacaaggattccctcggcccactcctcctgcaggccctggatggcttcctcttcgttgtgaaccgagatgggaatattgtctttgtttctgaaaacgtgacgcagtaccttcaatataagcaagaagatttggtgaacacatcggtctataacatcttgcacgaagaggacaggaaagattttctcaagaacctgccgaaaagtacagtgaacggtgttagttggacaaatgaaacacagcgccagaagtcacatacctttaactgtcgtatgctgatgaagactccgcacgacatcttggaggacatcaacgcctccccagagatgaggcagcggtatgaaacaatgcagtgcttcgccctttctcaacccagagctatgatggaggaaggagaagatctgcagtcatgcatgatttgtgtggctaggcgcatcacaacaggtgagagaacattcccttccaacccagagagtttcatcactaggcatgaccttagcggtaaggtcgtgaacatcgataccaacagtctgcggtctagcatgcggcctggctttgaggatattattcgacgctgcatccagcggttcttctcgcttaacgacggtcaatcttggagtcaaaagaggcattaccaagaggtcacaagcgatggaatcttcagccccacagcatacctgaatggccacgcagaaacgcccgtgtaccgctttagcttggccgatgggactatcgtgacagcacagaccaagtccaaacttttccgcaatcctgtaacaaacgacagacatggctttgtgtcaacgcatttcttgcagcgggagcagaacggatatcggccaaatcctaaccctgtgggacaagggatacgtccacccatggccggctgtaactcctctgtggggggaatgtccatgtccccaaaccagggcctacagatgcccagttcgcgcgcatacggcctggccgacccgtccacaactgggcagatgtcaggggctcggtacggtggctcttctaacatcgcaagcctgacaccaggacccgggatgcagagtccctcctcataccagaataataattacggactgaacatgtcgagccctccccacggcagcccaggactggccccaaaccagcagaatataatgatttctccccgaaaccggggcagccccaaaatcgccagccatcagttcagccctgtcgccggcgtgcatagccccatggcgtcatctggaaacacaggaaatcacagtttttcttcttcttccctctctgctctccaagctatttccgagggggtgggcacctcactgctcagtaccctgtctagtccggggcccaaactggacaatagtccaaatatgaacatcacgcagccatcaaaggttagcaaccaagattcaaaaagtcctttgggcttttactgcgatcaaaatcctgtcgagtcatccatgtgccaaagcaattcccgggatcacttatccgacaaagaatcaaaggagtccagcgtggaaggggccgaaaaccaacgcggccctctggaaagcaaagggcataaaaagttgctccaactactgacctgtagctctgacgaccgcggccactcctctctcactaattccccgctggacagctcatgcaaggaaagcagtgtgtctgtcacctccccttccggcgtgagctcttcaaccagtgggggggtgtcaagcacctccaatatgcacggaagcctattacaagaaaagcaccgtatactgcacaaactgctacagaatggtaacagccccgctgaggtcgctaaaattacagcggaggctactggaaaggatacatcctctattacttcctgtggagatggcaatgtcgtcaagcaggaacaactatcgccgaagaagaaggaaaacaacgcgctccttaggtacttactggatcgcgacgaccccagcgatgcactttctaaagaactgcagccacaagttgagggggttgacaataagatgtctcaatgcacaagcagcaccataccaagctcctcacaagaaaaggaccccaagatcaagactgaaacatctgaggaagggtcaggggatctcgataacttggatgctatcttgggcgatttgacctctagcgatttttacaataatagtattagctcaaacggatcacacctcggcactaagcagcaggtttttcaaggtacaaactcactcggcgattgggggctgcctaactctaaggccggaaggatggagcctatgaacagtaactctatgggtaggcccggtggagattataatacttcattgccccgccccgccctcggcggtagtatcccgacactgcccctccggagtaattcaatccccggggcgaggcccgtactgcaacaacaacaacaaatgttgcagatgaggcccggcgaaattccgatgggaatgggagcaaatccatatggacaggcagccgcctctaaccaactcggctcttggccagacggaatgctgagcatggaacaggtctcccatggcacgcagaatcgaccgctgctccgtaactcattagatgatctggtgggaccacctagcaatttagaaggacagagtgacgaaagggctctgctcgaccagttgcacacccttctgagcaatacggacgcgactggcctcgaagagattgatcgggccttgggtatcccagagttggttaaccaagggcaggctctggaacccaaacaggacgccttccaaggccaggaggccgccgtgatgatggaccagaaagccgggctttacggccaaacatatcccgcacaggggccgccaatgcaggggggcttccacctgcagggacagtcccccagcttcaattctatgatgaaccagatgaaccaacagggcaacttcccactgcaaggcatgcatccaagggccaacatcatgcgacctagaacaaacacaccgaaacagctgagaatgcagctgcagcaaagactgcaggggcagcagtttctgaatcagtcacgacaagctctagaactgaagatggagaacccaaccgcaggcggggccgccgtcatgagaccaatgatgcaacctcaacaggggttccttaatgcccagatggtggcccaacggagccgggagctgctttcacatcattttaggcagcaacgggtcgcaatgatgatgcagcagcagcaacagcagcagcagcagcaacagcagcagcagcagcagcaacaacagcaacaacaacagcaacagcagcaacaacagacccaagctttttctccaccccctaatgtgacagccagccctagtatggatggattacttgctggcccaacgatgcctcaggcacccccgcaacaattcccttatcagcctaattatgggatgggccaacagcccgatcctgcctttggcagggtaagtagcccgcctaatgcaatgatgtcctcgagaatgggccccagccagaaccctatgatgcaacatccacaggccgcctccatttaccagtcatcagaaatgaaaggctggcctagtggcaacctggcacgcaactcctccttttcccagcagcaatttgctcatcagggtaatcccgccgtttacagcatggtgcatatgaatggttcttctggacatatgggtcaaatgaatatgaaccctatgcccatgtctgggatgccaatgggccccgatcagaagtattgctag

SEQ ID NO: 126896 - DNA, 4248 bp, Artificial Sequence
  Description of Artificial Sequence: Synthetic coding sequence
atgtcaggcttaggagaaaacttagaccccctggcatctgattccaggaaaagaaagctcccatgcgacacaccgggccagggtttgacctgcagcggcgagaagagacgtagggaacaggaaagcaagtatatcgaagagctggcggagctgatttctgcaaacttgtctgatatagacaatttcaatgtgaagccagacaagtgtgccatccttaaggagaccgtgaggcagatccgtcagattaaagagcagggtaagacaattagcaatgatgatgatgtacagaaagcagacgtaagcagcaccggccaaggcgtgatagataaggacagtctgggacctctccttttgcaggccctcgatggtttcttgttcgtggttaaccgtgacgggaacatagtattcgtgtccgaaaatgtgacacagtacctgcagtataaacaggaggatctagttaatacgtccgtgtacaacattttgcacgaggaagataggaaagattttcttaagaacctccctaaatctaccgtgaacggcgtctcctggacaaatgagacacaacggcagaaatcccatacattcaactgccgtatgcttatgaaaacacctcacgatattctggaagacattaacgcctctccggagatgcgtcagagatatgaaacaatgcagtgcttcgccctgagccagccacgcgccatgatggaagaaggggaggacctacagtcctgtatgatctgcgtggccagacggattactacaggcgagcggacctttcctagtaatccagaaagttttataacccgacatgatctgtccggaaaagttgtgaacatcgacactaactccctgaggagttccatgagacccggcttcgaggatattatcagaagatgcattcagcggttcttttctctgaacgacggccagagctggagccagaagcgccactatcaagaagtgacgtccgacggtatattttctcctactgcttatctgaacgggcacgccgagacaccagtgtacaggtttagcctggctgatggaacaattgtgactgcacagacaaagagtaaactgttccggaaccctgtcacgaatgacaggcacggattcgtttccacccactttctccaacgcgaacagaatggctatcggcccaacccaaaccccgtcggacagggcatccgaccgcccatggctggttgcaactcatcagtgggcggaatgtccatgtcacccaaccagggcctacagatgcctagctcacgagcgtacggactcgccgaccccagcacaactggacaaatgtccggagccaggtatggcggatcaagtaacatagcctcacttacaccagggccaggtatgcagtccccaagcagttaccagaacaacaattatgggctaaatatgagctctccaccccacgggtcccccgggctggctccaaaccagcagaacataatgataagtcctcgcaacagaggatcaccaaaaatagcgagccatcagttctccccggtcgctggggtgcacagcccaatggcaagcagcgggaatacgggaaaccattcctttagctcttcttccctgagtgctttacaggcaattagcgaaggggtagggacgtcattgctgagcaccctttcaagtccagggccaaaactagataactctcccaacatgaatatcacccagccttccaaagtgagtaatcaagacagcaagtcgccccttggtttttattgtgaccagaaccctgtggaatctagcatgtgccaatccaactctagagaccatctgtccgataaagagtcaaaagagtcatctgttgagggcgcagagaaccagaggggtcccctggagagcaagggccataagaaactacttcagctgctcacgtgttctagtgacgatcgcggtcattcctcccttaccaattcacccttagatagctcatgcaaagaaagtagcgtatccgtcacttccccaagtggagtctcatcctcaacatccgggggcgtgtcctccacctcaaatatgcatggatccctgctgcaggaaaaacaccgcatcctgcacaagctgcttcaaaacggaaacagccccgcggaagtggccaaaattaccgccgaagctacgggcaaggatacgtcgtcaatcacatcttgtggtgacggtaacgtggtgaagcaggagcagctctccccaaaaaagaaagaaaacaatgcattgctgagatacttgcttgacagagatgacccctctgacgcgttgagcaaagaattgcaacctcaggtcgagggagtcgacaataagatgtcccagtgtacaagcagcactatcccttcatcgtcccaggagaaagatcccaagataaagacagagacttcagaggagggttcaggtgacctggataatttagatgcaatactaggagatctaacctctagtgacttctataacaacagcatcagctctaatggctcacaccttggtaccaagcagcaggtgtttcagggcaccaatagcctcgggcttaagagcagtcaaagcgttcagtcaatacggccaccctataatcgcgccgtgagcctcgattcgccagtgagcgtgggctcttctccaccagtgaaaaatatctccgcctttcccatgcttccgaaacaacctatgttggggggtaacccacgcatgatggactcgcaggagaattatggctcgagcatgggcgactggggtctgccaaacagtaaagcaggacggatggagccgatgaattccaacagtatgggccgtcccggcggagactacaatacctcgctgccccggccagctcttgggggatctatccctactttgccgctcagatctaactcaattcctggggcacgacccgtgttgcagcagcagcaacagatgcttcagatgcgcccgggcgagatccccatggggatgggagctaacccctacggacaagctgccgctagtaatcaactagggtcttggcccgatgggatgctcagcatggagcaggtgtcccacggtacgcagaatagacctctcctccggaacagcctggacgacttggttggaccgccatccaatctggaaggccagagcgatgaaagggcactgctggaccagcttcacactctcctatcaaacacagatgccacgggtctggaggagatcgatagggccctggggatccctgaactggtgaatcaggggcaggctctggagccaaagcaagacgcctttcagggacaggaggccgctgttatgatggaccaaaaggccggtctctacgggcaaacctacccagctcaaggacctcccatgcagggcgggttccatctccagggtcaatccccaagcttcaattctatgatgaatcaaatgaatcaacaaggaaactttcccctccaaggaatgcacccacgagcaaacataatgagaccacgcaccaacactccaaaacagctcagaatgcagctgcagcaacgcttgcagggacagcagttcctgaaccaatctcgccaggcactcgagttgaagatggaaaacccaaccgctggtggcgctgccgtgatgaggcctatgatgcagccgcagcagggcttcctgaatgcccagatggtggctcagcggagtagggaattattatcccaccacttccggcagcaacgcgtagcaatgatgatgcaacaacagcaacagcaacaacagcagcagcagcagcagcaacaacagcagcagcagcaacagcagcagcagcagcagcaacagcagacacaggccttctcaccccctcccaacgtgaccgcaagcccgagcatggacgggttgttggccggcccgacgatgccacaggctccgccccaacaatttccataccagccaaactatggcatgggccagcagccagatcctgcctttggacgggtgagttcgccacccaacgcaatgatgtccagccggatgggcccctcccagaaccccatgatgcagcaccctcaggctgccagtatttaccagtcatcagagatgaagggctggccatcagggaacctggcacgcaatagcagtttctctcagcagcagtttgcacaccagggcaatcccgccgtctattccatggttcatatgaacggaagtagcgggcatatggggcagatgaacatgaaccctatgcctatgtctgggatgccaatgggaccagaccagaagtactgttag

SEQ ID NO: 126897 - DNA, 4275 bp, Artificial Sequence
  Description of Artificial Sequence: Synthetic coding sequence
atgtcaggcttgggcgagaatctggacccgctggcaagcgattctaggaagcgcaagcttccttgtgacaccccaggccagggcttgacttgcagcggtgagaagaggaggagagagcaggagtcaaagtatatcgaggaactcgccgagctcatcagcgctaatctgtcggacatcgacaactttaacgtgaaacccgacaaatgtgcaatccttaaggagacagtaagacagattcgacagattaaggaacaaggtaaaaccatttctaatgatgacgacgtgcaaaaagcggatgtttccagcacagggcagggcgtgatcgacaaggacagcctgggcccattactgctgcaggccctggacggcttccttttcgtggttaaccgggacggcaacattgtcttcgtcagcgagaacgtgacccagtacctgcagtataagcaagaggacctcgtcaacactagcgtgtacaatatcctccacgaggaagatcggaaggacttcctcaaaaatctgccaaaatccactgtgaatggagtgagctggacaaacgaaacgcaaagacagaagtcacacacgtttaactgccgaatgttgatgaagaccccccacgacatcttggaggacattaatgcgtcccctgaaatgagacaacggtacgaaaccatgcagtgttttgcactctcacagccacgcgcaatgatggaggaaggggaggacctacaatcttgtatgatctgcgtggcaagacgaatcacaactggggagaggactttcccctccaacccggagtcctttatcacacgccatgacttgagtggaaaggtggtgaatatcgacacgaattcattacgcagctctatgcggccaggcttcgaagacattatccgacgttgtatccagcggttcttcagtctgaatgacgggcagtcctggagccaaaagaggcactaccaggaggcatacctcaatggccatgcagaaacacccgtatatcggttttccctggcagacggtacaatcgtcacagctcagactaaaagcaagctctttagaaaccccgtgaccaatgacaggcatggttttgtttctacacacttcctgcagagggagcagaatgggtacagacccaaccccaaccccgtcgggcaaggcataaggcccccaatggcaggctgcaactcctcagtcggtgggatgtcgatgtccccaaaccagggcctgcagatgccctcctctcgggcatatggcctggcagatccttcaactacgggacaaatgtcgggcgcccggtatggaggctcgagtaacattgcatctctgacacctggtcccggtatgcagagcccgtccagctaccaaaataataactatggtctgaacatgagctccccccctcacggcagcccaggtctggcgcccaatcagcaaaacataatgattagcccacggaacagggggtcaccaaagattgcctcacaccagtttagcccagtggccggggtgcatagccctatggcatcatccggcaacacaggaaaccacagcttctcttctagttcactgtccgctctccaggccatcagcgaaggagttgggacttccctgcttagtaccctctcgagtccaggcccgaaattagacaattctccaaatatgaacatcacccagccctccaaagtgtctaatcaggatagcaagtccccactggggttttattgcgaccagaatccagtggaatcaagtatgtgccaaagcaacagccgggatcatctgagtgataaggaatccaaagaaagttcggtggagggagctgaaaatcagcgaggccctctggaaagcaaaggccataaaaaactgctccagctccttacctgttcctctgacgacaggggccatagcagtctcaccaatagtcctttggactcatcctgcaaggagagctcagtttcagttacttccccctccggagtatcctcaagtacatccggaggggtgtcctctacaagtaatatgcacggctcactccttcaagagaagcatagaatccttcataagcttcttcagaacggaaatagcccagccgaggtggctaagattaccgcagaagccactgggaaagacaccagcagtattacatcttgcggtgacggaaacgtggtgaagcaggaacagctttcccctaagaagaaggagaataacgccctcctccgctacttacttgacagggacgacccaagcgacgcactctcgaaggaactgcaaccgcaagtcgaaggcgtggataacaagatgtcgcagtgtacatcctccaccataccttcatcaagtcaagagaaggatcccaagatcaagacggagacttcagaggaagggtcgggcgacctggacaaccttgatgccatcctgggtgatttaacctcttccgatttttacaacaatagcatctcttccaacggaagtcacctcggcacaaagcagcaggtgttccagggcaccaacagcctgggactgaagtctagtcagtcagtccagtcaataaggcccccttacaatcgtgccgtgtctctggactcaccggtctctgtcgggtcttcccctcctgtgaagaatatttccgcattccccatgctgcctaagcagccaatgctgggaggaaaccctcgtatgatggactcccaggagaactacggttcttccatgggaggtccaaaccgtaatgttacagtgacacagaccccaagctctggcgattggggccttcccaactctaaagcaggccgcatggaacctatgaacagcaattcaatgggccggcctggcggcgattacaatactagcctaccacgaccggcccttggagggagcatacctaccctgccactgcgcagcaattccatacctggagcgcggcctgtcttacagcagcagcagcagatgttgcagatgcgtccaggggagattccgatgggcatgggcgcgaatccatacggacaggcagccgcctccaatcagctagggtcttggccggacggcatgttgtctatggaacaggtgtcacacggcacacaaaaccgacctttgctgagaaacagtttggacgatttggttggccccccctcgaatctggaggggcaatccgatgagcgagctctgttggatcaactccatacccttctcagcaatacagacgcaactgggttagaggagattgacagagcgctcggcatccccgagctggtgaaccaaggacaggccttagaaccaaaacaagacgcattccagggccaagaggcagccgtgatgatggatcagaaggccgggctgtacggccagacttaccctgctcaaggccctccaatgcagggcgggtttcatctgcaaggacaatccccttcctttaattctatgatgaaccagatgaaccagcaaggaaacttccccttgcagggcatgcacccgcgcgcaaatataatgaggccccgcacaaatacacccaagcagttgcgcatgcaattacagcaacgtctgcagggacagcagtttctgaaccagagtcggcaggcgctggaattaaagatggaaaacccgaccgccggaggcgctgctgtcatgcgccctatgatgcaacctcaggtctcctcccagcagggattcctgaacgcccagatggttgcccagcgatcccgggaattactgagtcaccattttaggcagcagagagtggcgatgatgatgcagcagcagcagcagcagcagcaacagcagcagcagcaacagcagcaacaacaacagcagcaacagcagcagcaacagcagcagcagacgcaggcattttctcctcctccgaatgttaccgctagcccgtctatggacgggctactggctggcccaaccatgcctcaagcccctccccagcagtttccataccagccaaactatggcatgggacagcagcccgatccagccttcggccgtgtctcctccccgcccaacgctatgatgtcttctagaatggggccgagccaaaatcccatgatgcagcacccacaggccgcgtctatttatcagtcatctgagatgaaaggttggccctcaggtaatctggcccggaactcgtcattttcccaacagcagtttgcccaccagggcaaccccgcagtgtattccatggtgcacatgaacggcagctccgggcatatggggcagatgaatatgaaccccatgcccatgagtggtatgcccatgggacctgatcagaaatactgctag

SEQ ID NO: 126898 - DNA, 4263 bp, Artificial Sequence
  Description of Artificial Sequence: Synthetic coding sequence
atgtcaggtctgggtgagaacctggaccctctggctagcgactccagaaagcgaaaactgccttgcgacactcctggccagggtctgacctgcagcggcgaaaaaagaagaagagagcaggagtctaaatacatcgaggagctggccgagctgatcagcgccaaccttagcgatatcgataatttcaatgtgaagcccgacaagtgtgcaatattgaaagagacagtacgccagatcagacagattaaagagcagggcaaaaccatctccaatgacgatgacgtgcagaaggccgatgtgtcaagcaccggtcaaggggtgatcgacaaagacagcttggggcctctgttgctgcaggcacttgacgggttcctgtttgtggtgaacagggatggaaatattgtctttgtcagcgagaacgtcacccaatatttacaatataagcaggaggatttagtcaacacatccgtgtacaacattttgcatgaggaagataggaaggattttctgaaaaatctgccgaagagcaccgtgaatggggtgagctggacaaatgaaacacagcgacagaaatcgcataccttcaattgcaggatgctcatgaaaactccacacgacatcttggaagatattaatgccagccccgaaatgagacaacgctatgaaaccatgcagtgtttcgcactgagtcaacctagggcaatgatggaagagggtgaggatcttcagagctgcatgatttgcgtggcgagaaggatcacgacaggcgagaggacctttccttccaatcccgagagctttatcacccgacacgacctgtcagggaaagttgtcaatattgatactaactctcttaggtcctctatgcgcccaggctttgaggatatcattaggcgttgtattcaacggtttttctcgcttaacgacggccagtcatggtcacagaagcgccattaccaagaagcttaccttaacggacacgcggaaacacccgtctaccggttttctctggctgatggcaccattgtgacagcacaaacaaagtcaaagctcttcaggaatcccgtgaccaacgacagacatggattcgtgagtacacacttcctgcagcgtgaacagaacggatatagacccaatcccaatcctgtggggcagggaataaggcctccaatggctggatgtaactctagcgtgggtggcatgagcatgtcccccaatcagggcttgcagatgccatcctctagggcctatgggctggctgatccttctaccaccggtcaaatgtcaggcgccagatatggaggatcaagcaacattgccagcctgactcctggccccggcatgcagtccccctccagttaccagaacaacaattacggactgaatatgagctccccaccccacggctctcccggcctggcccccaatcagcagaatatcatgatttcccccagaaatcggggcagccccaaaatcgcctcacatcagttctccccggtggctggggtgcacagtcccatggccagcagcgggaatacaggaaaccacagctttagtagttcctcccttagcgccctgcaggctattagtgagggcgtcggaacctcacttctttccactctcagttcccccggccccaagctggataactcgcccaacatgaatatcacacagcccagtaaggtgtccaatcaagacagcaagtcccccctcggcttctactgtgaccaaaaccctgtggaatcatctatgtgccagagtaactctcgagaccatctgtccgataaggaatctaaagaaagttctgtggaaggggctgagaatcaacgaggaccattggaatctaaagggcataagaagcttcttcagctgctgacatgctcatccgacgaccgcggccattccagcttgaccaattctccgctggacagtagctgcaaggaatcctcagtaagtgtgacaagcccgagcggagttagttcctctacatctggcggtgtttccagcacctctaatatgcatgggtccttattacaagagaaacaccgaatactgcataagctcctgcagaatggcaactctcctgcagaggtcgccaagataactgctgaggctacaggtaaggacacatcgagcatcacgagctgtggcgacggtaacgttgtcaagcaggagcaactgtcaccaaagaagaaagaaaacaatgcattactgagatacctgttggaccgggatgatccctctgatgcgctcagcaaggaactccaaccacaggtcgagggcgtggacaacaagatgtcacagtgtacctcttctaccataccgtcctccagtcaggaaaaggatcccaagatcaagactgaaaccagcgaagaaggttcaggcgacctcgacaacctcgacgcgattctgggggaccttacctcttccgacttctacaataacagcatatcaagcaacggctcccacctcgggactaagcaacaggtgtttcaggggactaattctctcggccttaaatcttcacagtccgtgcagagtatcaggcccccttacaatcgagccgtgagtctggatagccctgtgtccgtgggcagctccccgccagtcaagaatatctccgcatttcctatgcttccaaaacagcccatgctgggcgggaaccccagaatgatggactcacaagaaaattacggctcttctatgggaggtcccaataggaatgtgaccgttactcaaacaccctccagtggggattgggggctccctaattccaaagccggtagaatggagcccatgaacagtaattccatgggacggccaggaggtgactacaatacttcattacctcgcccggctctgggcggttcaattcctacactgccccttagatcgaattcaatccccggggcccgcccagttttacaacagcagcagcagatgcttcagatgaggcccggagaaattccaatgggaatgggggcgaatccttatggccaggccgcagcttctaatcagctgggatcctggccagatgggatgctgagtatggaacaggtgtctcacggcacacagaataggccattgctgcggaactcactggatgatctggtggggccacctagtaatttggaggggcagtcggacgagcgcgctctattagaccagctgcacactttactgtccaatactgacgccacgggtctggaggaaattgacagagccctggggatacccgagctggtgaatcaaggacaggcactggaaccaaaacaggatgcctttcaaggtcaggaggctgcagtcatgatggatcagaaggccggtctctacggacagacatacccagcccaaggaccgccaatgcaaggaggttttcacttacaggggcagtcccctagctttaatagtatgatgaatcagatgaatcagcagggcaacttcccactgcagggtatgcaccctagagccaatattatgcgccctcgcactaacaccccaaagcaactgcgcatgcagctgcagcagcggttgcaaggccagcaattcctcaatcagtccaggcaagctctcgaactaaagatggagaaccctactgccggtggagccgcggtgatgcgaccgatgatgcaacctcagcagggcttcctgaacgctcaaatggtagcccagaggagcagagaactgctgtcccatcactttcgacaacagagagtagctatgatgatgcagcagcagcagcagcagcaacagcagcagcagcagcaacagcagcagcagcagcaacagcagcagcagcagcagcagcagcagcagacgcaagctttctccccacctccaaacgtgaccgcctctcccagtatggatggcctgctcgccggccccaccatgccccaggcacctccccagcagttcccctatcaacctaactacggtatgggccaacagcctgaccccgcatttggcagagtgtccagtccacctaacgctatgatgtcctcaaggatgggcccctctcagaatcctatgatgcaacacccgcaggccgccagcatttatcaatcctccgaaatgaaaggctggccgagtggcaacctggctaggaattcaagtttctcacagcagcaatttgcccaccaggggaatccagccgtttactctatggtgcacatgaacggatcttcagggcatatgggacagatgaatatgaatcctatgcctatgtcaggcatgcctatgggacccgaccagaaatactgttag

SEQ ID NO: 126899 - DNA, 774 bp, Artificial Sequence
  Description of Artificial Sequence: Synthetic coding sequence
atgatggaggaaggagaagacctgcagtcatgtatgatttgcgtcgcacgccgaattacaacaggtgagaggacttttcccagtaatcccgagtcatttatcacacgtcatgacctgtccggtaaagtggtgaatattgacacaaattcactccgcagttcaatgagaccagggtttgaggacataattcgacggtgcattcagcgatttttcagtctgaacgatggccagtcctggtcacaaaaacggcattaccaggaggcctacctgaatggtcatgcagagactcccgtttaccgattctctctggctgacggtacaatcgtgactgcacagaccaaaagcaagttgtttaggaacccggtgacaaacgaccgacatggattcgtgagtactcacttcctgcaacgagagcagaatggatatcggccaaaccctaaccccgtcggccaagggatccggccgcccatggcaggatgcaacagtagtgttggtggaatgtcaatgagccccaaccaaggccttcagatgcctagttcccgcgcttacggactagcggaccctagcactaccgggcaaatgagtggcgcccggtatggaggatcgtccaatatcgcttccctcactcccggcccaggcatgcagagcccatcttcctaccaaaacaacaactacggcctaaacatgagtagtcccccccatggttcacccggtctagctccgaaccagcagaatatcatgattttgctagtgatcgtgggtgtgcagcgctag

SEQ ID NO: 126900 - DNA, 864 bp, Artificial Sequence
  Description of Artificial Sequence: Synthetic coding sequence
atgaacacgtttcaggaccagtctggaagctcttccaacagagagccgctgctgcgatgtagtgacgctcggcgtgacctggagctcgccatagggggtgttttgcgggccgaacagcaaattaaggataatttaagagaagttaaagctcagattcacagttgtatatctagacacctcgagtgtttgagaagtcgcgaagtttggctgtacgagcaagtggacttaatataccagttaaaagaagaaactcttcaacaacaggcacagcagttatactctctgctaggccagttcaattgtctaactcaccagctggagtgcacccagaataaagacctggccaaccaggtgtctgtctgtctggagaggctgggctcactgacccttaagcctgaggatagcacagtgttgctctttgaggccgatacaatcacactacgccagaccataacgacctttggaagccttaagacaatacagattcccgagcacctaatggctcacgcctcctccgcgaacatcggaccatttctggaaaaaagggggtgcatctcaatgccagagcagaaatcagcatctggcatagtggccgtaccatttagcgagtggctgctcggaagcaagccggcctcaggttaccaggctccctacattccatctactgacccgcaggattggctgacgcagaagcagacactggagaactctcagcaggaggtgttgctgaactcccctctacaggaagagcacaactttccccccgaccactatggattacctgctgtctgtgacctcttcgcgtgtatgcagctgaaagtggacaaagagaagtggttatataggacaccccttcaggtttag

SEQ ID NO: 126901 - DNA, 1845 bp, Artificial Sequence
  Description of Artificial Sequence: Synthetic coding sequence
atgaacaccttccaagaccaatccggatcgtcgtcaaatagggagcctttactgaggtgtagcgacgcccggcgggatttggagctggcgatcggaggagtactgagggccgaacagcagattaaagataaccttagggaggttaaagcccaaattcatagttgcattagtcgtcatctggaatgcctgcggtctcgcgaagtctggctgtatgaacaagttgacctcatttaccagctaaaagaagagacactgcagcagcaggctcagcagctctattcattgctgggccaattcaattgtctgacccaccagctcgagtgtactcaaaataaggacctcgcaaatcaggtgtccgtgtgcctcgaacggttaggctccctaaccctgaaaccggaagacagcaccgtattactgttcgaagcagacaccatcactctcaggcagaccatcacgacattcgggagcctgaaaacgattcagatacctgaacatttgatggcccatgccagcagtgccaatatcggaccgtttctcgagaaaagggggtgcatatctatgcctgagcaaaagtccgctagcgggattgtcgcagtgccctttagcgagtggctgcttggatctaaaccagcctccggttaccaggcaccgtacataccctcaactgacccccaagattggcttacacagaagcagactctcgagaactctcagacaagttcccgtgcttgtaattttttcaacaacgtgggtggaaatctgaagggcctggagaactggttactgaagtcggaaaagagctcataccagaaatgtaactctcatagcaccacgtctagtttctctattgaaatggaaaaagtgggcgatcaggagcttcctgatcaagacgagatggatctgagtgactggctcgtcactccccaagagtcacataaactccgaaagcctgagaatgggagtagggaaacgagcgagaaatttaagctgctgttccagagttacaatgtgaacgactggctcgtgaagaccgactcttgcacgaactgccagggcaaccagcccaagggcgtagaaatagagaacttggggaacctcaaatgtctaaacgatcatctggaagccaagaaacccctgtctacccccagtatggtcacggaagattggctcgttcagaatcatcaagacccctgcaaggtggaggaagtctgcagggctaatgaaccctgcactagctttgcagaatgcgtgtgtgatgagaactgtgaaaaggaagcgctctacaagtggcttctgaagaaagaaggcaaagataagaacggtatgcctgtggaacccaaacctgagcccgaaaaacataaagattccctgaatatgtggctttgccctcggaaggaagtaatcgaacagactaaagccccaaaggccatgacaccaagccgcatcgctgattcatttcaagtaataaagaatagccccttatcagaatggctgatacgtcccccatataaagaaggctcgcccaaggaggtgcctggtaccgaagaccgagcaggtaagcagaaatttaaaagccctatgaacacttcttggtgctcgttcaacacggccgactgggtactccccggtaagaaaatgggcaacctctctcaactgtctagcggcgaagacaaatggctgctcagaaagaaggctcaggaagtcctgctgaacagccccctccaggaggagcacaactttccccccgaccattatggtctgccggcagtgtgcgacctctttgcttgcatgcagttgaaggtagacaaagagaagtggttatacaggaccccactgcagatgtag

SEQ ID NO: 126902 - DNA, 1728 bp, Artificial Sequence
  Description of Artificial Sequence: Synthetic coding sequence
atgaatacttttcaagatcagtctggatcttccagcaacagagaacccctgcttcgctgctctgacgcccgacgggacctggaactagcaatcggaggcgtgctgagagcagaacaacagattaaagataatttgcgggaggtaaaagcccagatccatagctgtatcagcaggcatctcgaatgccttaggtcccgggaagtctggttatacgaacaggtagacctgatataccagctcaaagaggagacgctgcagcaacaggcacaacagctatacagtctccttggtcagttcaactgcttgacacaccagctcgagtgcacacagaacaaggatctggcgaaccaggtcagcgtctgcttggagaggctgggctctctaactctcaagcctgaagactccaccgtcctcctattcgaagcagataccatcactctgcgccaaaccattactaccttcggatcactgaaaacaatccagattccagagcacttgatggctcacgcatctagtgccaacatcggcccattcctcgaaaaacgcggctgcatttctatgcctgagcagaagagtgccagtggaattgtcgccgtccccttttcggagtggctcttggggagtaagcccgcatcaggatatcaggcaccttatatcccatccaccgacccccaggattggctgactcagaaacagaccctggagaacagccagacatccagtcgtgcttgcaacttcttcaacaatgttggcggaaatctcaagggcctggaaaattggctgctgaaatcggaaaagagctcctaccagaagtgtaatagccattctactacctccagtttctcgatcgagatggaaaaggtaggcgatcaggagcttccagatcaagatgaaatggatttgagtgattggctggtaacaccccaggagtcacacaagcttaggaagcccgaaaacgggtcgagggagacttctgaaaagttcaaactcctgttccagtcgtacaatgtgaacgactggttggttaagacagactcctgtacgaattgtcagggtaaccaacctaagggagtggaaatagagaatctgggcaatctaaaatgcctgaatgaccatctagaggctaaaaagcccctctctaccccaagtatggtgaccgaggattggttagttcagaatcaccaggacccatgtaaggtggaagaggtctgtagggcaaatgagccatgtacctccttcgctgaatgtgtatgtgatgaaaattgcgagaaggaggccttatacaagtggctgctgaagaaagagggcaaagacaagaacggcatgccagtggagccaaagcctgagcctgagaaacacaaggatagcctgaatatgtggctgtgcccgagaaaggaggtcatagaacaaacaaaggcacctaaagccatgacgccctcccgaatcgctgactcattccaggtcatcaagaactccccgttgagcgagtggctaattcgacctccctataaagaaggcagcccaaaagaggtaccagggacggaggatagggccggaaaacagaaatactacctgatccacctgtataggaggaacatcacctcaccgcagaccatcatggcatctttacagtttgtgatatctctgcccgtatgctcattaaaactgattaaacgctctggatacatcgaactgctctatcgctgtgaaggtatggacaagtcctag

SEQ ID NO: 126903 - DNA, 1845 bp, Artificial Sequence
  Description of Artificial Sequence: Synthetic coding sequence
atgaacaccttccaggaccaatctgggagtagtagtaatagggagcccttattacgctgcagtgacgcaaggcgggatcttgagttggccatcgggggcgtgctaagggcggagcaacaaatcaaggacaacctccgagaggtcaaagcacagattcacagctgtatctcgcgccacttggaatgtctgcggtctagagaagtctggttgtacgaacaggttgacctgatttatcaactcaaggaggagacactgcagcagcaagcacagcagctatactccctccttgggcagttcaattgtctaacacaccagctggagtgcacccaaaataaggacttggcaaaccaagtgagcgtttgtttggaacgcctgggatcactgaccttgaaacctgaggatagcactgtgctgctgttcgaggcagataccatcacacttagacaaactatcactaccttcggcagtttaaagacaattcagattccagagcacttgatggcccatgcctctagtgccaatatcggcccatttttagaaaaaaggggctgtatcagcatgccggagcaaaaatctgccagcggcattgtagctgtccccttttccgaatggcttctcggctctaagcccgcaagcggctaccaagccccttatattccttcaaccgatccacaggactggctgacacagaagcagacccttgagaatagtcaaacctcttcgagggcgtgtaacttttttaacaatgttgggggtaacttgaagggcttagaaaactggctcctcaaatcggaaaagagcagctaccaaaaatgcaactcacattctactacaagttcttttagcatcgaaatggagaaggtaggggatcaggaactccccgatcaggatgaaatggacctatcagattggctagttaccccacaggagagccacaaactaaggaagcctgagaacggctcaagggagaccagcgagaaattcaaattgctgttccaaagctacaatgttaacgactggttggttaagaccgactcctgtaccaactgccaagggaaccaacctaaaggtgttgagatcgaaaacttgggtaacttgaaatgtctaaacgatcacctggaggctaagaaacccctctctactcctagcatggtgactgaggactggctcgtgcagaatcatcaggatccatgcaaagtagaggaggtgtgcagagcaaatgaaccttgcacatcattcgctgagtgtgtgtgtgacgaaaactgtgagaaggaggcactgtacaagtggctgcttaaaaaggaagggaaggacaagaatggaatgccagtggagcccaaaccggaaccagagaagcataaagatagcctcaatatgtggctgtgtccccgaaaggaagtcattgagcagaccaaggccccgaaggccatgactccgagcaggattgctgacagttttcaggtgattaagaattcgcctctaagcgagtggctcattagacccccctataaagaaggttcaccaaaagaggtccctggcaccgaggatagagccggtaagcagaaattcaagtctcccatgaatactagttggtgttccttcaatactgcggattgggtgttgccaggaaaaaaaatggggaatttgtcccagctctctagtggcgaggacaagtggctcctccggaagaaggcgcaggaagtgctgttgaacagtcccctgcaggaagaacataacttcccgcccgatcattacgggctcccagctgtctgcgacctattcgcgtgtatgcaactgaaggtagataaggagaaatggctttataggaccccactccagatgtag

SEQ ID NO: 126904 - DNA, 1347 bp, Artificial Sequence
  Description of Artificial Sequence: Synthetic coding sequence
atggcacatgcctcttcggcgaatattggtccgttcctcgagaaacggggttgcatctctatgcccgagcagaaatccgcatccgggattgtggcagtaccgttcagtgagtggctgctgggatctaagcccgcaagtggctaccaggccccatacatcccgtccaccgacccgcaggactggctgacccagaaacagaccttggaaaacagccaaaccagcagccgagcatgcaacttctttaataatgttggtgggaatctgaagggcctcgaaaattggctgcttaagagtgaaaaaagctcgtaccagaagtgtaacagtcacagcactacctcttctttctcaattgagatggagaaagtaggagatcaggaattaccagaccaggacgaaatggatctcagtgattggctagtgacccctcaagaatcacataaactgcggaaacccgaaaatgggtcacgggagacttctgagaaattcaagctgctgtttcaatcctacaacgttaacgactggctggtgaagaccgactcctgtactaattgtcagggtaatcagccaaagggtgtagaaattgaaaacttgggcaacctgaaatgcctgaatgaccacctcgaagctaagaaaccactttcaacgccctccatggtcactgaagactggctggtgcagaatcatcaagacccctgcaaagtggaggaggtgtgccgagcgaacgagccatgtacttcatttgctgaatgcgtctgcgatgagaattgtgagaaggaagccctgtacaaatggctgctcaagaaggaaggcaaagataagaacggcatgcctgtggagccgaaacctgagccagagaaacacaaagactccctgaacatgtggctgtgtcctcgtaaagaggtcatcgaacagacgaaggctccaaaagcgatgacccccagccggatcgctgatagcttccaggtcatcaaaaattcgcccctgtcagagtggctgatacggccgccgtataaggaagggagcccaaaagaagtccctggcaccgaggatcgcgccgggaagcaaaaatttaaatcaccaatgaacacgtcatggtgtagcttcaataccgccgactgggtgctgccaggtaagaagatgggaaatctctcccagttgtcttccggggaggacaaatggctgctcaggaaaaaggcgcaggaggtgctgctgaatagtcccctccaggaggagcacaatttcccccccgaccactatggcttgccagctgtatgcgatctgttcgcatgtatgcagttaaaggtggacaaagagaagtggttgtacaggacccctctacagatgtag

SEQ ID NO: 126905 - DNA, 1545 bp, Artificial Sequence
  Description of Artificial Sequence: Synthetic coding sequence
atgaacaggtggactctattcatttccttgaagcgccgccactttaattctaggttaagcagctccactcggttaggatccctgaccctgaagccagaggattcaaccgtcctcctgtttgaagccgacaccatcactctccgacagacaataaccaccttcgggtccctcaagactatccaaattccagaacacctgatggctcacgcctcaagcgcaaacattggaccctttctggagaaaagaggatgtatctctatgcccgagcagaagtccgccagcggaattgtagctgttccattctccgaatggttgttggggagtaaacctgcgtcaggataccaggcaccctatatccccagtactgacccacaagattggctgacccagaaacaaactctggagaacagccagactagtagccgggcttgcaactttttcaacaacgtgggtggtaacctgaagggactcgaaaattggcttctgaaaagtgagaaatcatcatatcagaaatgcaatagtcactccaccacctcctcattcagtattgagatggagaaggtaggagaccaagagctccccgaccaggacgagatggacctctctgattggctggtgacacctcaagaatctcataagctcaggaaacccgaaaatggctctagagagacatcggaaaaatttaagctgctgttccagtcttataatgttaatgattggttagtgaagactgactcctgtaccaactgtcagggcaatcagcctaaaggcgtggaaatagaaaacctcggtaatctgaagtgtttaaatgatcacttagaagcgaagaagcctttgtcgacaccatctatggtcactgaagactggctggtgcagaaccaccaggatccgtgcaaagtggaagaagtttgccgagcaaatgagccatgtacgtcttttgctgagtgtgtatgcgatgaaaactgtgaaaaggaagctctttacaagtggctcctgaaaaaagagggcaaggataagaacgggatgcccgtcgagccaaaaccagagcctgagaagcacaaagatagcctcaacatgtggctctgccctcgcaaagaggtcatcgaacagactaaagccccaaaggcaatgacaccttcgaggattgctgactcattccaagtgataaaaaactctccattaagtgaatggctaattcgacctccctataaagaagggtctcctaaggaggttccaggcaccgaagacagagcggggaaacagaagttcaagtctcctatgaacaccagctggtgctcatttaatactgccgattgggttctgccgggaaaaaaaatggggaacctgtcccagctatcctccggggaagacaagtggcttctgcgtaagaaggctcaggaagtattattgaattcccccctccaagaggaacacaacttcccgcctgatcattacggactgcctgccgtctgtgatttatttgcctgtatgcagctgaaagtagacaaggaaaaatggctgtaccggacgcccctgcaaatgtag

SEQ ID NO: 126906 - DNA, 795 bp, Artificial Sequence
  Description of Artificial Sequence: Synthetic coding sequence
taatgtacccctgcttgggctgccgagttggatagcgtctccaaacaaaaaaagaatccaaagcccacatttaagaaaaagactgaggagcggacctgtgaggtgaaaaaagtcagtcgactgggctctctgaccctgaaacctgaggactctacggtactacttttcgaagcggatacaataacgctcaggcagaccataaccactttcggttctctgaagactatccagattccagaacatttaatggctcatgccagcagcgcaaacatcgggcccttcctggaaaaacgaggctgtatcagcatgccggagcagaagtcggcttctggcatcgttgctgtgcctttctcagagtggctgttaggtagcaagccagcatccgggtaccaggctccttacatccccagcactgatccccaggattggctgactcagaaacaaaccctagaaaactctcagacatctagtagggcctgtaatttttttaataacgtgggcggtaatctgaagggactggagaattggctactgaagtctgagaagagcagctaccagaaatgtaattctcattccacaacaagcagtttttccatcgaaatggagaaggtgggggatcaggaactcccagatcaagatgagatggatctgagcgattggctggtgaccccccaggagagccataagctgcgaaagcctgaaaacgggtcccgagaaacgtcggaaaagtttaaacttctgttccagagttacaatgtgaacgactggcttgtaaaaaccgacagctgcacatag

SEQ ID NO: 126907 - DNA, 1893 bp, Artificial Sequence
  Description of Artificial Sequence: Synthetic coding sequence
atgggagcacagctgacgacattcgcattggctggagccgtccgaagaatgaatacatttcaagaccagtctggatcgtcctcaaacagagaaccgttgctgagatgctccgatgccagacgtgacctggaactggccatcggcggcgttctgcgggcagagcagcaaattaaggacaacctccgagaggtgaaggcccagatccacagttgcatttctaggcacctcgaatgtctgcgcagtcgggaggtgtggctttacgaacaggtagatctgatctaccagctcaaagaggaaaccctgcaacagcaagcacagcagctgtactccctcttggggcagttcaactgcttgacccaccagctcgaatgtacacagaataaagaccttgctaatcaggtgtctgtttgtctggagagactcggatccctcactctgaagcccgaggacagtaccgttctgctgttcgaggccgatacgatcactctgcgtcaaactatcacaactttcggttcccttaagactattcagatccccgagcacctcatggcgcatgctagttcagccaacatcgggccatttttggaaaaacgaggatgcatcagcatgccagagcagaagtctgcgagcggtatcgtggcagttcctttctctgagtggctacttggctcaaaacccgccagtggttaccaggcgccctacatcccgagcacagatcctcaggattggctgacacagaagcagaccttggaaaactcccagacatcgtctagagcttgcaactttttcaataatgtgggagggaacttgaaaggcttagaaaattggctgctgaagtcggagaagtcatcctaccagaagtgcaactcccacagcacaacatcaagcttttcaattgagatggaaaaggtgggcgatcaggagttgcccgaccaggacgagatggaccttagtgattggctggtgacccctcaagaatcacacaagttacgcaagcctgagaacggttccagggagacatctgaaaagttcaagctgctgtttcagagctataatgtcaacgactggctcgttaaaacagatagctgtactaattgccagggcaaccagcccaaaggcgtcgaaatagaaaacctgggaaacctgaaatgtcttaatgaccacttggaggctaaaaagcctctttctactccttccatggtgacagaggattggctggttcaaaatcatcaggacccctgcaaggtggaagaggtgtgcagagctaacgagccttgcacctcattcgcagagtgcgtgtgcgatgagaactgtgagaaagaggcactgtataaatggttattgaaaaaggagggaaaagataagaatggtatgccagttgagcctaaacctgaacccgaaaagcataaagactcactgaacatgtggctttgcccgcggaaggaggttattgaacaaactaaagctccaaaggccatgactccttcaaggatcgctgactcttttcaagtgattaagaattcacccctctccgagtggctcattcgacctccctataaggaaggctcccctaaagaagtgcctggcaccgaggatcgagccggaaaacaaaaattcaaatcaccaatgaacacgtcctggtgctcattcaacacagctgattgggtgcttcctggcaagaaaatggggaatctctcgcagctgtccagcggagaagataagtggttgctaaggaaaaaagcccaagaagtgttactaaattcacccctccaggaagaacataacttccccccagatcactatggcctgcccgcggtctgtgacctgtttgcgtgtatgcagcttaaggtagataaggagaagtggttatatcgcacaccgctgcagatgtag

SEQ ID NO: 126908 - DNA, 1845 bp, Artificial Sequence
  Description of Artificial Sequence: Synthetic coding sequence
atgaatactttccaggatcagtcaggatcctcttctaatagggaacccctgctgcggtgttcagacgcccgcagagatctagagctagccataggcggtgtgctgagggcagaacagcagatcaaagacaacctgcgggaggtgaaagcccaaatccattcctgcatctccagacatctcgagtgcttgaggtctcgagaagtgtggttgtacgaacaggtggatctaatttaccagctgaaagaagaaacactacagcagcaggctcagcagttgtactccctcctggggcagttcaactgtttaacccaccaattggaatgcacccagaacaaggacctggcaaaccaggtgtctgtctgtctggaacgtctggggtcgttaaccctgaagccggaggacagtactgttttgctgtttgaggccgacacaataactctcaggcagactattaccaccttcggaagccttaaaaccatccagatacctgagcatctcatggcgcatgcttcaagcgccaatatcggccccttcctggaaaaacgaggctgtatctccatgccagagcagaagtccgcctccggtattgtggctgtgcccttctcagagtggctcctgggtagtaagccagctagtggttaccaagcgccatatattccttcgacagatccacaggattggctgacccagaagcagaccctcgagaactctcaaacatcaagccgggcctgcaacttctttaacaatgttggggggaatttgaagggactggagaactggctgctgaagagcgagaagtctagctatcaaaagtgtaattcacactctactacctcgagtttttctattgaaatggagaaagtgggggaccaggagctgcccgaccaggacgaaatggacctgagtgactggttggtcacacctcaggagagccacaaattgcggaagccggaaaacggatcacgcgaaacctccgaaaaatttaagcttctgtttcagagttataacgtcaacgactggcttgtaaagaccgatagctgtacaaactgccagggcaatcaacccaagggggtggagatagagaacctcgggaacctcaagtgcttaaacgaccacctcgaagcaaaaaagcctttgtccacacccagcatggtgactgaagactggctggtgcagaatcatcaagacccctgcaaagtggaagaggtgtgtcgagcgaatgagccatgcaccagttttgcagagtgcgtgtgtgacgaaaattgcgaaaaggaggcactgtataagtggctgctgaaaaaggagggcaaagacaagaacggaatgcccgtggagccaaaacctgaacccgagaagcacaaagatagtctgaatatgtggctctgccctaggaaggaagttattgagcaaaccaaagccccaaaggctatgacccctagccgcatcgccgacagcttccaggtgattaagaacagcccactgagtgaatggctgatcaggcctccatacaaggagggctcacccaaggaagtacctggaaccgaggacagagccggtaaacagaagttcaaaagccccatgaacaccagctggtgctcctttaacaccgcggactgggtgctccccggcaaaaaaatgggtaatctttctcaactgtcctctggagaggacaagtggctgttaagaaaaaaagcccaggaggtcctgctcaactctcctctgcaggaagagcacaatttcccaccagaccactacggattacccgccgtgtgcgacctctttgcttgtatgcagctgaaagtcgacaaagaaaaatggctctatcgtacacctctacagatgtag

SEQ ID NO: 126909 - DNA, 1953 bp, Artificial Sequence
  Description of Artificial Sequence: Synthetic coding sequence
atgggcgcccaactgaccactttcgctctggccggagccgtccggcggatgaacaccttccaggatcaatcaggatcatcgtccaaccgggaacctctgctgcgctgctccgacgcacgtcgcgacctggaactcgctattggcggtgtgttaagagccgagcagcagattaaagataacctgagggaggtgaaggcccaaatccactcgtgcatctccaggcatctggaatgcctgcgaagccgcgaagtgtggctgtacgaacaggtggacctgatttaccagctgaaggaagagacccttcagcaacaggctcagcagctgtacagccttctcggacagtttaactgtttgacacaccaactggaatgcacccagaataaagatctcgcaaaccaggtctcagtgtgccttgagcggttaggttccctgacattgaaaccagaagacagtacggttctcttgttcgaggctgacaccatcacactaagacagaccattaccaccttcggctctctgaagaccattcagatccctgagcacctgatggcccacgcttcttccgccaatatcggtccttttcttgagaaacgtggatgtatatcaatgcccgagcaaaagagcgctagcgggattgtcgccgtgccattctcggagtggcttctcgggagtaagcccgctagtgggtaccaggctccctatatcccctccactgacccccaggactggctgacacaaaaacagacccttgaaaatagccagacatctagtcgggcctgtaattttttcaataatgtcgggggcaacctgaagggactcgaaaactggcttcttaaatcagagaaaagctcataccagaaatgtaatagccactcaactacttctagcttctcgattgaaatggagaaagttggggatcaggaactacctgatcaagatgagatggatctctctgattggttggtgactcctcaggaatcgcacaagctcaggaaaccagagaatggctctcgcgaaacttctgaaaaattcaaactgctcttccagagctacaacgtgaatgactggctagtgaagaccgacagttgtacaaactgccagggcaatcagcctaagggagtggaaatcgagaacctcggtaatctgaagtgtttgaacgatcatctggaagccaagaaacctctcagcaccccctccatggtgactgaagactggctcgtgcagaaccaccaggacccttgcaaggtggaagaagtctgtagagccaatgagccatgcacaagtttcgccgaatgcgtctgcgacgagaactgcgagaaggaagctctgtacaagtggctcttgaaaaaagaagggaaagacaaaaacggcatgcctgtggagcccaagcccgagccggagaagcataaggattccttgaatatgtggctatgtccacgcaaggaagttattgagcagaccaaggcacctaaggcaatgacccctagtcggatcgccgattctttccaggtcatcaagaatagcccactttccgagtggttaatcagacccccttacaaagaagggtctccaaaggaagtgcctggcaccgaggaccgcgcaggtaagcagaaattcaaatcccccatgaatacgagttggtgtagctttaacaccgcagactgggtgttgccgggaaagaaaatgggcaacttgtcacagctgtctagcggggaggacaagtggctgctccggaaaaaggcccaagaggtgctcctgaattcccctctccaggaggagcacaacttccctccagaccattacgggcttcccgcggtgtgtgacctctttgcatgcatgcagctgaaagtggacaaagaaaagtggctgtaccggaccccacttcaagcgtattttaaaatgaatttccaggacgttaccgtgggcaacttccaaataccttgcggattctag

SEQ ID NO: 126910 - DNA, 6192 bp, Artificial Sequence
  Description of Artificial Sequence: Synthetic coding sequence
atggtgctggatgacctcccgaacttagaggacatctatacatctttgtgttcaagtactatggaagactcagagatggattttgactctggtctcgaagatgatgacacaaagtccgactccatattggaggactccactatcttcgtggccttcaaaggcaacattgacgataaggatttcaaatggaaattagacgccatcctgaagaacgttccgaacctacttcacatggagtccagtaagctaaaggtccagaaggtggagccatggaactctgtacgggtaacctttaatattccccgcgaggccgccgagcggctacgcattctagctcagagcaataaccagcagctgcgtgaccttgggatactttccgtccagattgagggagagggcgccattaacctggcattggcacagaacagaagtcaggacgtgcgtatgaacgggcccatgggggcaggtaactctgtgagaatggaagctggctttccaatggccagcgggccaggcatcatacggatgaacaaccccgcaaccgtaatgattccccctggcggcaacgtaagttcaagtatgatggcacccggtccgaacccagaactccagcctagaacaccgcggcccgcgtcccaatccgatgcgatggacccactgctgtcgggactgcatatacagcaacagtcacacccatcaggaagtttagctcctccccaccatcccatgcaacctgtctcggttaatcgccagatgaaccccgctaattttccccagctccaacagcagcaacagcagcagcaacaacagcagcagcagcagcagcaacagcaacagcagcagcagcagcagcaactgcaggctcggcctccccagcagcatcagcagcagcagcctcaaggcattcgaccacagtttacagctcctacgcaggtgcccgtgccccctggctggaatcagctgccgtccggggctcttcaaccgccgcccgcacaggggtctttggggacgatgactgccaaccaggggtggaagaaagccccgctgccggggcctatgcagcagcagctccaggctcggccttcactggctacagtacagacaccgagccacccaccacccccctatccttttggctcccagcaggcctcccaggcgcatactaacttccctcagatgagtaaccccggtcaatttaccgccccccagatgaagtctttacagggtggcccatccagagtgcccactcccctgcagcaaccacacctcaccaataagtcccccgcgagttccccatcaagcttccaacaaggctcacccgcctccagtccgactgtgaaccagacacagcagcaaatgggcccgcggccacctcagaataacccccttccccagggcttccagcaaccagtgagcagcccgggcagaaacccaatggtgcagcaaggaaatgtgccacctaatttcatggtgatgcagcagcagccccccaatcagggcccccaatctctccacccaggtttaggcggcatgccaaaacgactgccgccgggcttttctgccggtcaggccaatcctaacttcatgcagggccaggtgccaagcactaccgctaccactcccggcaactccggggcaccacagcttcaggcaaaccagaatgttcaacatgcagggggacagggggcggggccgcctcagaatcagatgcaggttagccacggaccccccaacatgatgcaaccttcgctgatggggatccacggaaatatgaataaccaacaggccgggacctccggagtgcctcaggtaaatctttccaacatgcagggtcagccgcagcaagggcctccatcacagctcatgggcatgcaccagcagatcgtgccaagccaggggcaaatggtgcaacagcaggggaccctcaacccccagaatcccatgattctgagtagggcacaactcatgccacagggacagatgatggtgaaccctccctcacagaatctgggccctagcccccagcggatgacacctccaaaacagatgttgtctcagcagggaccccagatgatggcgccgcacaatcagatgatggggccccaaggccaggtgctgctccagcagaatccaatgattgaacagattatgacgaaccagatgcagggcaataagcagcagtttaatacacagaatcagagcaatgttatgcccgggccagcacagatcatgcgtggacctacacccaatatgcagggcaatatggttcagttcactggccagatgagcggacagatgctgcctcagcaggggcccgtaaacaattcaccgagtcaggtcatgggcatccaagggcaggtgctccgtcccccaggcccttctcctcacatggcccaacagcacggcgatcccgcaacgacagccaacaacgacgtgagcctgtcccaaatgatgccagacgtatctatacagcaaacaaacatggtcccaccgcacgtgcaggccatgcaaggtaattccgcctcaggaaatcatttcagcggtcacggcatgagtttcaacgcaccattcagcggagcacctaatgggaaccagatgtcctgcgggcaaaaccccgggttccccgtgaacaaggatgtgacattaacatctcctttactcgtcaatcttctgcagagcgacatttccgccggccatttcggagtcaacaacaagcagaataatacaaatgccaacaaaccaaaaaaaaaaaagcctcccaggaaaaaaaaaaatagccagcaggaccttaacacacctgatacaagaccagcaggccttgaggaagctgaccagcctcctctccccggtgagcagggcatcaacctcgataattctggcccaaaactgcccgaattctctaatcgtcctcctggataccctagtcaacccgtggaacagagacccctgcaacaaatgcctccccagctgatgcagcatgttgcaccaccacctcagcctcctcagcagcagccacaacctcaactgccacagcagcagcagccaccccctccctctcaaccccagagtcagcagcagcaacagcaacagcaacagatgatgatgatgctgatgatgcagcaagaccctaaatcagtgcgtctgcctgttagtcagaacgtccaccctccccgaggcccactgaacccggattcccagaggatgcctatgcagcagtctgggtccgtcccggttatggttagtttgcagggccctgcctccgtgcctccatcccccgataaacagcgaatgcccatgcccgtcaacactcccctgggtagcaacagcagaaaaatggtctaccaagaatcaccgcagaatccctcctcctcacccttagccgaaatggcgtcccttcccgaagccagtggatctgaggctccctccgtgccaggcggccctaataatatgccctcgcacgtagtcctgccccaaaatcagttgatgatgaccgggcccaaacccggtccgtcaccgctgtctgctacccagggagccacaccccagcagcctcctgtgaatagcctgccgagctcacatggccatcactttcctaatgtggcagctccaactcaaacaagtagacctaagactccaaatcgggcttcccctcgcccgtattatccacaaacgcctaacaacagacccccctcaactgaaccaagcgagatctccctgagtcccgagcgtctgaacgcatccatagcagggctatttccaccccagataaacataccattgccaccacggcctaaccttaatcgagggttcgaccagcagggtttgaacccaacgaccctgaaggcgattgggcaagcgccgagcaacttaaccatgaatccatccaattttgcaaccccacagacacacaaactggacagtgttgttgtcaatagtggaaagcagtccaatagtggtgcaactaagagagcctctcctagtaatagccggagaagcagcccaggcagctcaagaaagacaacacccagtccgggaaggcagaattcaaaggcgccaaaattgacacttgccagccaaaccaatgccgcccttctgcaaaatgtcgaactgccacgaaatgttctggttagtccaacacccctggccaatccacccgtgccaggatcctttccaaacaatagtggcctcaatccacagaactcgaccgtgagtgttgctgcagtaggcggggtcgtggaggacaataaggagtcactcaatgtaccacaagatagcgactgtcaaaacagccagagccggaaggaacaggtcaacatcgaactgaaggctgtcccagcacaggaagtgaaaatggtcgttcccgaggatcagagcaagaaagatggtcagccgtctgaccccaacaagctccccagcgtcgaagaaaacaagaatcttgtatcgccagccatgcgcgaggcccctacctcactgagccagctgctggacaatagtggtgcccctaacgtgacaattaagccccctggtctcactgatcttgaggtgactcctccagtggtgtccggagaagatctcaagaaagcaagcgtgatccccaccttgcaggatttaagtagcagtaaggagcctagcaattcactgaatctgccacattctaatgagctatgcagctctctggtacacccagagctatcggaggtatcttccaacgtcgccccctcaatacctcctgttatgtcccgtccagtgtccagctcaagcatctcaacacctctgccaccgaatcagatcaccgtgttcgtgacgtctaaccctataactacgtctgcgaacacctctgcagccctgcccactcacctgcagtcagcgctgatgagcacggtagtcaccatgccgaacgcgggatccaaggtgatggttagtgaggggcaaagtgcagcccaatccaacgccaggcctcagtttataacccccgtgtttataaactcctctagcatcatccaggtgatgaaggggtcccagccatcgactatccccgctgcgcccttgactactaatagcgggctaatgcccccttcggtggctgtggtcggaccacttcacatcccccagaacattaagttctcctctgcccctgtccccccaaacgcactgagttcatctccagcccctaatatccagactggcagaccactggtgctttccagcagggcgaccccagttcaacttccgtctccgccgtgtacatcctcaccagtagtgccatcccatccccctgtgcagcaggtgaaggaactgaatccagatgaagcctcacctcaagtgaacaccagtgccgatcaaaacactctgccttcttcgcagagcacaacgatggtgagtcctctgttaaccaatagccctggaagctccggcaaccgccgcagtccagtgagtagttcgaaggggaagggcaaagtcgacaaaatcggccagattctcctgaccaaggcctgcaagaaggtgacagggtcactggaaaaaggagaagagcaatacggagcggacggtgagacagaaggtcagggattggacacaactgcccccggtctgatgggaacagagcagctgtcaacagagctggacagcaagactcctacccctcccgctcctaccttattaaagatgaccagcagtcctgttggcccggggactgctagcgcgggcccatccctgcccggcggcgctctgcctacatccgtgcgctcaatcgtgacaacccttgtgcctagtgaactcatcagtgccgtgcctaccactaaaagcaaccatgggggtattgcctccgagtctctggctggaggcttggttgaagagaaggtgggaagtcacccagagctccttccttccattgcaccaagccaaaatctggtaagcaaggaaactagcaccacagctctgcaggccagtgtcgctcgacctgagctggaagtgaatgccgccatcgtgtcgggacagagcagcgagcccaaggagatcgtggagaagtccaagattccggggcggaggaactcccggaccgaggaacccacagtagcgagcgaatctgtcgagaacgggcaccgcaaacggtccagccgtccagccagcgcaagctcaagcacaaaagatattacatctgccgtgcagagcaaacggcgaaagtccaaatag

SEQ ID NO: 126911 - DNA, 6192 bp, Artificial Sequence
  Description of Artificial Sequence: Synthetic coding sequence
atggttttagacgatctgcctaacttggaggacatatacacctccctgtgctccagtaccatggaagatagcgaaatggatttcgacagcggccttgaagatgacgatactaagagtgacagcattcttgaggacagtactatcttcgtggctttcaaagggaatatcgatgacaaggactttaagtggaaactggacgccatcctgaagaatgtgccgaacctccttcatatggagtctagcaagctcaaggtgcagaaggttgagccatggaattcagttcgcgtgacttttaatatccctagagaagcagctgaacgccttcggatactcgctcaatccaacaatcagcaactcagggatctgggcatcttgtccgtccagattgagggggaaggggccatcaaccttgccttagcacaaaatcgcagccaggacgttagaatgaacgggcctatgggcgcaggtaattccgtgcgaatggaagccggctttccaatggcttctgggccagggataatccgaatgaacaaccccgctaccgtcatgattccacctggggggaatgtaagctcttcgatgatggcccccgggcccaatcctgagctccaacctcgaacccctcgacctgcatctcagtccgacgcaatggatccactgctttctgggctgcatatccagcagcagtcgcacccctcagggtcactggctcctccccatcaccctatgcaacctgtgtcagtaaaccggcagatgaaccccgcaaatttcccccagctgcagcaacagcagcagcagcaacagcagcagcagcagcaacaacagcagcagcaacagcagcaacaacagcagcagcttcaggcccgccctccacagcagcatcagcagcagcagccacagggtatccgcccccaattcaccgcaccgacccaggtgcccgttcctcccggatggaatcagctccctagcggtgcccttcaaccacctcccgcacagggcagcctgggaactatgactgcaaatcagggatggaaaaaggccccactccccggccctatgcagcaacaactgcaagcccggccttctttagccacggtgcagacaccaagtcatccccctccaccctacccttttggttcccaacaagcctcacaggcacacactaactttccacagatgtcgaaccccgggcagtttacagccccgcagatgaagtctctgcaggggggcccctctagagtcccaactcccttgcagcagcctcatctcacaaacaagtctcccgcctctagcccctcgtctttccaacaggggtctccggcaagcagcccaaccgtgaatcagacccagcagcagatgggaccccgtccaccacagaacaatccacttccacagggatttcagcagcctgtgtcttctcccgggcgcaatcccatggtacagcaggggaatgtacctcctaatttcatggtcatgcagcagcagccacccaatcaggggcctcagtcgcttcacccaggccttggcgggatgccaaagaggttgccccctggattctctgccgggcaggccaacccaaacttcatgcagggccaggtgccctctacaacagccactactccaggaaactcaggtgcacctcagctccaggcgaaccagaacgtgcagcacgctgggggacagggggccggtccgccacagaaccagatgcaggtgtcgcatgggccacctaacatgatgcagcccagcctgatggggatccatggaaatatgaataaccagcaggcaggaacaagcggagttcctcaagtgaatctgtctaacatgcagggccagccccaacaaggtcccccgtcccagctcatgggcatgcaccaacagattgtgccttcccagggccaaatggtacaacagcaaggtactttgaacccacaaaaccccatgatcctgtctagagcccagctgatgccacaaggccaaatgatggtgaatccaccgtcgcaaaatctaggcccatctcctcagcgcatgacacctcccaagcagatgctgtctcagcagggcccacagatgatggcaccgcacaatcaaatgatgggaccccagggacaagtgctgcttcagcagaatcccatgatcgagcagataatgaccaatcagatgcagggcaataaacagcaatttaacactcagaaccagagcaacgttatgcccgggccagcccaaatcatgcggggccctacaccaaacatgcagggcaacatggtccagttcacggggcagatgagcggccagatgttgccacagcagggaccagtgaacaacagtccaagtcaagtcatgggaattcaaggccaggtgctgagaccgccaggaccatcaccgcacatggcccagcagcacggtgatcctgccacgaccgcaaacaatgacgttagtttatcacagatgatgccagatgtgagcatacagcagacaaatatggtaccacctcacgttcaggccatgcaggggaactctgctagcggcaatcacttttctgggcatggtatgagctttaatgctccgttttcaggggcaccaaacgggaaccagatgagttgcggtcagaatcccggcttcccagtgaataaagacgtgaccctgacttctcccctcctggtgaacttactgcaaagcgatatctcagcgggacacttcggcgtcaataataaacagaataatacaaacgccaacaagcccaagaagaaaaagccgcctcgtaaaaaaaaaaactctcagcaggacctgaacaccccggataccagacctgcgggactggaggaggcagatcagcctcccttgccaggggaacaggggattaacctagacaactctgggcccaagctgccagagttcagcaatcggcctcccggatatccctcccagcctgtggagcaaagaccattacaacaaatgcctccgcaactgatgcagcacgtggctcctcctccacagcctccacagcagcaaccgcagcctcaactccctcagcagcagcagccccccccgccttcccagccgcagtcccagcagcagcaacaacagcagcaacagatgatgatgatgctcatgatgcagcaagaccccaaatccgtgaggttgcctgtcagtcagaatgttcatcccccccggggacctcttaaccccgatagtcaaagaatgcctatgcagcaaagtggctcggttcccgtaatggtgagcctccaaggaccagcttcagttccaccgtccccagataagcagcggatgcctatgccagtcaatacccccctgggatccaattcaaggaaaatggtttatcaggaatcgccacagaacccatcatcctctcctcttgctgagatggcatcattgcccgaagccagcggcagcgaggcaccgtctgtcccgggaggaccaaacaatatgccgagccacgtggtgcttccccagaatcagctcatgatgaccggccccaagccagggccttctcccctgtccgctacacagggagcaaccccacagcagcctccggtgaactctctcccctcttcccatgggcaccactttcccaatgtagccgccccgacacagaccagtcgtccaaagacgccaaatagagcgagccctcggccttattatccacagacccctaacaaccgcccaccaagtaccgaaccctcagaaatctcgttgtctcctgaacgattaaatgcttcaatcgccggcctgtttcccccccagattaatattccccttccaccaagacctaatcttaatcgagggttcgaccagcaggggctgaatccaactaccctcaaagccattggacaggcccccagcaatctcaccatgaatccttcaaacttcgcaacaccacagacacataaactcgattctgtggtggtcaacagtgggaagcaatcaaattcaggggccacaaaaagggctagcccgagcaacagcaggagatctagtccagggtcctctaggaaaactacaccctctcccggccgccagaatagcaaagcaccaaagctgacactcgctagtcagacaaatgctgccctgcttcagaatgtagagttaccacggaacgtgctggtgtctccaaccccccttgcaaatccacccgtgccaggatcattcccaaataattctggcctgaatccacagaatagcactgtatcagtggccgctgtggggggtgttgttgaggacaataaggaatccttaaacgtgccgcaggatagtgactgtcagaactcacagagcaggaaagagcaggtgaatatagagctcaaggcggtcccagcacaagaagttaagatggtcgtgcctgaggatcagtctaagaaagacggacagccctccgatccaaacaaattgccaagcgtcgaggagaacaaaaacctcgtgtcccccgccatgcgcgaggctccgaccagcctgagccagctgttggataattcaggggccccaaacgtcaccattaagccaccaggtctgaccgacctggaagtcactccacccgtggtttcgggggaggaccttaaaaaagcttcagtaatcccgacccttcaagatcttagttcttctaaggaaccctccaactcactgaacttgccccacagcaacgaactgtgcagcagccttgttcatcccgaactgtctgaagtctctagtaatgtcgccccctcaatcccaccagtgatgagcaggcctgtgtccagtagttctatctctacacctctgccacctaatcaaatcactgtttttgttacctctaaccctatcacgactagcgccaacacttctgctgcactccctactcatctgcaatcggctctgatgtccacagtggtgacaatgcccaacgccggtagtaaagtcatggtgtctgagggacagagtgcagctcaaagtaacgcgcgcccccagttcatcacccctgtattcattaactccagttctatcatccaggtcatgaaggggagtcagccttcaaccatcccagccgccccactgaccacaaactctgggttaatgcctcccagtgtggccgtagtgggaccactccatattccccagaatattaaattcagctccgcgcccgttccacctaatgcgctgagctctagccctgccccaaatatacagacaggtaggccccttgtgctctcttctcgagcgacccctgtgcagttaccttcaccaccttgtacttcttctccggtggtcccatcgcatcccccagtacagcaggtaaaagaattgaacccagacgaagccagccctcaggttaacacaagtgctgaccaaaacaccttaccaagcagccagagcacaacgatggtgagccccctgctgacgaatagtcctggctcctccggcaatcgaagatcccctgtgtcctcctctaaggggaagggcaaggtcgacaaaattgggcagattctgcttacaaaagcgtgcaaaaaggtcacagggtccctcgagaagggcgaagaacaatacggcgctgatggcgagaccgagggccagggccttgatactacggctcccggactcatgggtactgaacagctgagtacagagctggactctaagacacccactccccccgcgcctactctgttgaaaatgacaagctccccagtgggccctggtaccgcctctgctggtccctcactgcctggcggcgccttgcctacgtcagtgcgaagcatcgtaaccacactagtgccttctgagctcatttccgccgtgccaactaccaaaagtaaccatggtgggattgcatctgaatctctcgctggagggctagtggaggaaaaggtgggcagccatcccgagttgttgccctccatagcccctagtcagaacctcgtcagcaaggaaacttccactacggccttgcaggctagcgtagcccgaccggagctggaggtgaacgcagcaattgtaagcgggcagtcctccgagcccaaagagattgtggagaagagtaagattcctgggcgccgcaattcgcgaacagaagagcccactgtcgcctccgaaagcgtagagaatggccaccgcaagaggagttctcggcccgcctcagcctcctccagcacaaaggatattaccagcgctgtccagagcaagcgaagaaaaagtaagtag

SEQ ID NO: 126912 - DNA, 1086 bp, Artificial Sequence
  Description of Artificial Sequence: Synthetic coding sequence
atggtactcgatgatctgccgaatttggaggacatctacacatctctctgttcctctacaatggaggattcggagatggacttcgacagtgggttggaagatgatgacacaaagtcagactctatccttgaggactcaacaatatttgtggcatttaagggcaacattgacgataaagatttcaagtggaagctggacgctatcctcaagaatgtaccaaacctgctgcacatggagagctcaaaactgaaggtgcagaaggtcgagccatggaatagcgttcgggtgacattcaacatccctagggaggccgccgaacggcttaggatcctcgcgcagagtaataaccagcagctgcgggatctcgggatactctctgtgcagatcgaaggtgaaggggctataaacctcgcactggctcaaaatcgctcccaggatgtccggatgaacggtccgatgggcgccggtaatagcgtgagaatggaggccgggttcccgatggccagcggccctgacgcaatggatcccctcctgtccggtctccacatccaacagcagagccacccctctggatccctcgccccaccgcatcatcctatgcagcctgtaagcgtgaataggcaaatgaatcccgccaatttcccacagttgcaacaacaacagcagcagcagcagcagcaacagcagcaacaacagcagcaacaacagcagcagcagcagcagcaactgcaggctaggccgccccagcagcatcagcagcagcaaccgcagggaataaggccacaatttacggccccaacccaggtgcccgtaccccctggttggaaccagcttccatctggagcgctacaacctcccccggcacagggcagcttggggaccatgacggccaaccagggctggaaaaaggccccactccccggccccatgcagcagcagctgcaggctaggcctagcctcgctacagtccagacgcctagtcatcctcctcctccttacccattcggttcccagcaggcctcccaggcccacacgaacttcccccagatgtccaatccgggtcagttcactgctccccagatgtag

SEQ ID NO: 126913 - DNA, 549 bp, Artificial Sequence
  Description of Artificial Sequence: Synthetic coding sequence
atggccgaggaacaggtcaatagaagcgccggcctcgcccctgactgtgaggcgtccgcaactgccgaaaccactgttagctctgtgggtacatgtgaggcagccggcaaatcccctgagcccaaagactatgattccacatgcgtgttctgcagaatcgctggccggcaagatcccggcacagagctactgcattgcgaaaacgaggatctaatttgttttaaggacatcaaacccgctgccactcatcactatctcgtggtgccaaagaaacatatcgggaactgccggacgctgcgcaaagaccaagtcgagttggtggagaacatggtgaccgtagggaagacaatattggagcgcaataatttcacagactttacgaacgtccggatgggcttccacatgccacccttctgctccatttcccacttacacttacacgtactcgcccccgtggaccagctgggattccttagcaagctggtctacagggtgaattcctattggtttattacagcagaccatctcatcgagaagttgagaacctag

SEQ ID NO: 126914 - DNA, 552 bp, Artificial Sequence
  Description of Artificial Sequence: Synthetic coding sequence
atgggagccgcacatagtgtgtgggaagtggatcacctatataccttctttgtgcagtggtcaccggatgtttacggcaaagacgcaaaagagcaggggtttgtggtggtggagaaagaggagcttaatatgatagataatttttttagcgagccgaccaccaaatcgtgggaaataatcacggtggaggaagccaaaaggcgcaagtcaacctgtagctattatgaggacgaggatgaggaggtgcttcccgtgctccgtccccattctgccttgctcgagaacatgcacattgaacagctcgcacggcgcctacccgcccgtgtacagggctatccctggcgtctggcctactccacgctggaacatgggacatccctgaagacgttataccggaagagcgcatccctggacagtccggtgctcctggttatcaaggatatggacaatcagattttcggtgcctatgctacccacccatttaagtttagtgatcattactacggaaccggagagacttttctgtatacgttttcgccacactttaaatag

SEQ ID NO: 126915 - DNA, 2829 bp, Artificial Sequence
  Description of Artificial Sequence: Synthetic coding sequence
atggatacaaaagaagaaaagaaagaaagaaaacaaagctattttgccagactgaaaaaaaagaagcaagctaagcagaacgctgagacagcatcggccgtggcaacgcgcacgcacaccggaaaggaggataacaataccgtcgtgctcgaaccagacaaatgtaacatcgcggtagaagaagagtacatgaccgacgaaaaaaagaaacggaagtcaaatcagttaaaggagatccgtcggactgaactaaaacggtattatagcatcgatgacaatcagaacaagactcacgataaaaaagaaaagaagatggtggtgcagaagccacatggcacgatggagtacacagctgggaatcaagatacactcaacagcattgccttgaaattcaatatcactccaaataaactggtggagctgaataagctgtttacgcacaccattgttccagggcaggttctgtttgttcccgatgcgaactctccgtcttctacccttaggctatccagctcgtcacccggagctacagtcagcccctcttcctcagatgccgaatacgacaagttgccagacgcagatttggcaaggaaagcactgaagccaattgaacgagttctctcatccacgagtgaggaggacgagccaggcgtggtgaagtttctgaagatgaactgcaggtactttacagacgggaaaggggtggtcgggggagtgatgatagtgacaccaaacaatataatgtttgacccacacaagtcagacccacttgttattgaaaacggatgcgaggaatacggcctgatatgcccaatggaggaggtcgtgtcaatagctctgtataatgatatctcccacatgaagatcaaggatgccttgccctccgacctgccgcaggacctatgtcctctctataggcctggcgagtgggaggaccttgcctctgagaaggacattaacccgttttccaaattcaagtccatcaacaaggaaaagcgacagcagaacggggaaaagattatgacatccgattccagaccaatcgttcctctggaaaagtctacaggccatacacccactaagcccagcgggagcagcgtgagcgaaaaactcaagaaactggatagcagcagggaaaccagccacggatccccaacagtaacaaaactgagcaaggagccttccgatacttcgtccgcttttgagtccaccgctaaagagaatttcctgggcgaggacgacgatttcgtcgatcttgaggagctatcttctcaaactggggggggaatgcataagaaagataccttgaaagagtgtttgtcacttgatccagaagagcgcaagaaagccgaatctcagatcaacaatagtgcagtcgaaatgcaggtacagagtgccttagcttttcttgggaccgagaatgatgttgagctcaaaggagcccttgatttagagacctgcgagaagcaggacattatgccagaagtcgacaagcagagcggcagtccagaatccagagtagaaaacacactcaatatccacgaggacctcgataaggtcaagttgatcgaatactacctgacaaagaacaaggagggtccacaagtaagcgagaacctgcaaaagacagagctgtcagacggtaagagcatcgagcccggaggcattgatatcacactctcttcctcgctgagccaggctggtgacccaataacggagggtaacaaggaaccagacaagacttgggtgaagaagggcgaacccctcccagtgaaattgaacagttccacagaagctaatgtgattaaagaagctctagactctagcctggagtcgactctggacaactcttgccagggcgctcagatggacaacaaaagtgaagtgcagttgtggctcctgaagagaatacaagtgccaattgaagatattctacctagtaaagaggaaaaatcaaaaacaccccccatgtttctctgtattaaggtaggcaagcccatgcggaaatcattcgccactcacaccgctgcaatggtccaacaatacggcaagcggcggaagcagcccgagtactggttcgcagtcccaagggaaagagtggatcacttatacacgttttttgttcagtggagtccagacgtatatggcaaagatgcaaaggagcagggattcgtcgtggttgagaaagaggaactgaacatgattgacaactttttttctgagccgaccaccaagtcctgggagatcatcacagtcgaagaggcaaagcgacgcaagtcaacatgttcctattatgaggacgaagacgaggaggttctccccgtgctgcggcctcactctgctctgctggaaaatatgcatatcgaacagctggctagacggctgcctgcgcgggtgcaaggttatccctggaggttagcttacagcaccttagaacatggcacttccttgaagacgctttaccgtaagtcagctagcttagatagccctgttctgctggtcattaaggacatggataaccaaattttcggtgcctatgcaactcacccctttaagttctctgatcattactacggaaccggcgaaactttcctgtacacattctctccacatttcaaagtgtttaagtggtctggcgaaaatagctattttattaatggggatatctccagcctggaactgggaggtggcggcggacgctttggcctgtggctcgacgctgatttgtatcatggacgctccaactcgtgcagtacattcaacaatgatattctttctaaaaaggaagactttatcgttcaagatctagaggtatgggcatttgattag

SEQ ID NO: 126916 - DNA, 2829 bp, Artificial Sequence
  Description of Artificial Sequence: Synthetic coding sequence
atggacactaaggaggaaaagaaagagaggaaacagtcctacttcgcgaggctgaaaaagaaaaagcaggctaagcagaacgcagaaacagctagtgcagtggctaccagaacccataccggtaaagaggataacaacacggtggtgctggagccagacaagtgcaacatcgcagttgaggaagaatatatgaccgatgagaagaaaaaaaggaagagtaaccaactgaaggagattcgcagaacagagcttaagagatattactcaattgatgacaatcaaaacaaaactcacgacaagaaagagaaaaaaatggttgtgcaaaagccccacggaacaatggaatacaccgctggaaatcaagacactttgaactccatcgccctgaaattcaacattacacctaataaattagtggagttaaataaattattcacccacacaattgttccaggacaggtcctgtttgtgcccgacgctaactccccctctagtaccctgcgactgtcctcttcttctccaggggcaactgtgagcccatcatccagtgacgctgaatacgacaagctccctgatgcggacctggcgcgcaaagctctaaagccaatcgaacgtgtgctatcatcaacttcagaggaggatgagcctggagtagtcaaattcctgaagatgaactgtcgatacttcactgatggtaagggcgtggtgggcggggtgatgatcgtgactcccaacaacattatgtttgacccccacaagtccgacccgctggtgattgaaaatggctgtgaggagtatgggttgatatgccccatggaggaagtggtgagcatagctctatataacgatatctcccacatgaagataaaggacgccttgccgtcagacctgccccaagacctatgtccgctctaccgaccgggagagtgggaggacctggcctcagagaaggatataaacccatttagcaagtttaagagtattaacaaggaaaagcgccagcagaatggcgagaagattatgactagtgattctcggccaatagtgcctctggaaaagtccacaggccatacacctacaaagccctccggctcctccgtcagtgagaaactgaagaaactagactcgagtagagaaacctcccacgggagcccgaccgtgacaaagctttcaaaagagcccagcgatacatcttcggccttcgagtcaacagcaaaagagaatttccttggagaagacgacgacttcgtggacttagaggagctgagctcacagacgggcggtggaatgcacaaaaaagacacactgaaggagtgtctgtccctggatccagaagagaggaagaaagctgagtcacaaatcaataattccgccgttgagatgcaggtccagtcggcacttgcatttttggggaccgagaacgatgtggagctgaaaggcgcactcgacctagaaacatgcgaaaagcaagatatcatgcccgaagtggacaaacagtcaggcagcccagaaagccgagttgaaaatactctgaacattcatgaggacctcgacaaagtcaaacttatcgagtactacctcacgaagaacaaagagggaccacaggtctccgaaaatctgcaaaaaactgagctgtctgatgggaaaagtattgaaccagggggtatcgacattactttatcaagtagcttgtcccaggccggggaccctataacagagggaaacaaggagcctgataagacctgggtcaagaagggggaacctctacccgtgaagttgaactcctcaactgaggcaaacgtcataaaagaagcattggactcctcccttgagtcaactcttgataactcatgccagggagcgcagatggacaacaaatccgaggtccagttatggttgcttaagcgcatccaggtcccgattgaggacatactcccctccaaagaagagaagtcgaagacgccgcccatgtttctctgcatcaaagttgggaaacctatgcgaaaatcattcgcaacccacacagctgccatggtgcagcagtacggcaagcgccgtaaacagcctgagtattggttcgcagtgccccgggagagggttgatcacctgtatactttcttcgtgcaatggagtcctgacgtgtatgggaaagacgccaaggagcagggttttgtggtcgtggagaaggaggaattgaatatgatcgataactttttctcagaaccaaccactaagagttgggagatcattaccgtcgaggaggcaaagcgccggaaaagcacctgcagctattacgaggatgaggacgaagaggtgctcccagttctcaggcctcactccgcactcttagagaacatgcatatcgaacagctcgctcgcaggctccccgccagagtgcaaggctacccatggcggctggcttattccacactcgaacacggaacatccctcaagactttgtatcgcaagtcagcaagcctggactcccctgtactgctggtaataaaggatatggataatcagatctttggagcctatgccactcatcccttcaagttttccgaccactactatggaaccggagaaacatttctgtataccttcagcccgcactttaaagtctttaagtggtctggcgaaaatagctactttattaacggagatatatcatcattggagctgggcgggggaggggggcgcttcggcctgtggcttgatgccgacctgtaccacggccgaagtaacagttgctcaactttcaacaatgacatcctctcaaagaaggaagacttcatcgtgcaggatctcgaagtgtgggcgttcgattag

SEQ ID NO: 126917 - DNA, 1323 bp, Artificial Sequence
  Description of Artificial Sequence: Synthetic coding sequence
gacgctgatctcgctcggaaggctctgaaaccaattgaacgggtgttgagttcgacctcggaggaggacgagcccggtgtggtgaagtttttgaaaatgaattgccggtacttcacagacgggaagggtgtcgtgggaggcgtgatgattgtgaccccgaacaatatcatgttcgatccccacaagtccgatcctttggttatagagaatggctgtgaagaatacggacttatatgtcctatggaggaagtcgtctcgattgccctgtataatgatatttcgcacatgaaaatcaaagacgccctgccttcacccggtgagtgggaggaccttgcctctgagaaggacattaatcccttctctaagtttaagtccatcaataaggaaaaaagacaacagaatggcgaaaagatcatgacgtccgactcaaggccgatcgtccccctcgagaaaagtacaggccatactcctaccaagccctccggttcaagcgtgtccgagaaactcaagaagttagactcctctagggagacgtcccacggatcaccaacagtgacaaagctgtccaaggagccatctgacaccagctcagcctttgaatccaccgccaaggagaatttcttaggcgaggatgacgattttgtggacctggaggaattgagttctcaaacaggtggcggcatgcataagaaggacacgctcaaggagtgtctgagtttagacccagaagaacgcaaaaaggccgagtctcagatcaataacagcgcagtggaaatgcaggtccaatctgccctggccttcctgggaacggagaatgatgttgaactaaagggagctctggatcttgagacatgcgaaaagcaggacattatgccggaagtggacaagcaatctggttccccagagtccagggtggagaacaccttgaatatacacgaggaccttgacaaagtgaagcttatcgaatactatctgacaaagaacaaggaaggccctcaagtgagcgaaaacctccaaaaaacagaattatctgatggaaagtccattgaaccggggggtattgatattaccctctcttcatcactcagccaggccggcgaccctatcactgaaggcaataaggaaccagacaaaacgtgggtaaaaaaaggggaaccactacccgtgaagctcaattcctcgactgaggcaaatgttatcaaggaagccctagattcatcattagagagtacactggataatagctgtcagggtgctcagatggacaataaatctgaagtgcagctgtggttactcaagagaatccaggttccgattgagtag

SEQ ID NO: 126918 - DNA, 576 bp, Artificial Sequence
  Description of Artificial Sequence: Synthetic coding sequence
atggacacgaaagaagaaaaaaaggaaagaaagcagtcatactttgcgcgacttaagaaaaagaagcaagcgaagcagaacgccgaaaccgcgtctgcagtcgcaaccagaacccatacaggaaaagaggataataacacggtcgttctggagccagataagtgtaacatcgctgtcgaagaggagtatatgacggatgagaagaaaaagcggaagagtaaccagctgaaggagattcgcagaactgagctcaaaagatattattccattgacgacaatcagaataagactcacgataaaaaggagaagaaaatggttgtccagaaacctcacgggacgatggagtacacagccggcaatcaggatactctaaattccattgctctcaaattcaacataacaccaaacaagctcgtggagttgaataagttgttcacacacactatcgtgccgggacaagtgctgttcgtccctgacgcaaatagtccgtcctctaccctgcgcctgtcaagcagcagtccaggggctactgtgagtcccagtagcagcgacgctgaatatgataagctgccctag

SEQ ID NO: 126919 - DNA, 354 bp, Artificial Sequence
  Description of Artificial Sequence: Synthetic coding sequence
atggacaccaaagaagagaagaaagagcgaaaacagagctacttcgcccgcctgaagaagaaaaaacaggccaagcagaacgcagagactgctagcgcggtcgccacacggacgcacacaggcaaagaagataacaacactgtggtccttgaacctgacaagtgtaatattgccgtggaggaggaatacatgacagacgagaaaaaaaagagaaaatctaaccaacttaaggagatcaggcgaacagagttaaagagatattactctatcgacgataaccagaataagacacatgataaaaaggagaaaaagatggtcgtccagaaaccacacggaaccatggaatatacctag

SEQ ID NO: 126920 - DNA, 273 bp, Artificial Sequence
  Description of Artificial Sequence: Synthetic coding sequence
atggacactaaggaagagaagaaggagagaaagcagagttatttcgcccgattgaaaaagaaaaaacaagctaagcagaatgccgagacagcctccgctgtggctactaggacacacaccggtaaggaggacaacaacacagtggtgcttgagcccgataaatgtaatatcgcagtggaagaggaatacatgactgatgagaagaagaagagaaagtctaaccagctcaaagaaatcagaaggactgaattgaaacgatattattcgatctag

SEQ ID NO: 126921 - DNA, 273 bp, Artificial Sequence
  Description of Artificial Sequence: Synthetic coding sequence
atggacacaaaggaagaaaagaaggagcggaaacaaagctattttgctagacttaagaagaaaaaacaggcaaaacagaacgcagaaaccgctagtgcggtggccactcgtacacacacaggaaaagaagacaacaacaccgttgtgctagagccagataagtgtaatatagccgtcgaggaagaatatatgacggacgaaaaaaaaaagaggaaaagcaatcagttgaaggagatccgacggactgagctaaaaagatactatagcatttag

SEQ ID NO: 126922 - DNA, 552 bp, Artificial Sequence
  Description of Artificial Sequence: Synthetic coding sequence
atgggggccgctcattccgtttgggaggtggatcatctatatacgttctttgtacagtggtctccagatgtgtacggtaaggatgccaaggaacagggattcgtagtcgtcgagaaggaagaacttaacatgattgataacttctttagtgaacccacgacaaaatcatgggaaattattaccgttgaggaagccaagagaagaaagtctacatgcagttattacgaggacgaagatgaggaggtgctacccgtgctgcggcctcactcggcattgttggagaatatgcacattgaacagctagcacgaagactgcccgccagggtgcagggctatccttggagattagcctactccaccctagagcacggtacatcccttaaaaccctctatcggaagtccgctagtctggatagccccgtcttactggtgatcaaagatatggataatcaaatctttggcgcatatgccacacatccatttaagttctccgatcactactatgggaccggtgagaccttcctatatacatttagcccccatttcaaatag

SEQ ID NO: 126923 - DNA, 714 bp, Artificial Sequence
  Description of Artificial Sequence: Synthetic coding sequence
taagagaagacttgttctagtctggaaagagagcctcacttcagtttgctcactatgagggggcaaaggctacccctggatattcagatattctactgcgccagaccagacgaagagcctttcgtcaagattatcaccgtcgaagaagcgaaaaggcgaaagtctacctgttcctattacgaagatgaggatgaagaggtgctgccagtacttcgcccgcactctgccctgctagagaacatgcatattgagcagctggcaagaagactgccagcacgagtgcaaggctacccgtggaggttggcttattcaaccctcgaacacggcacttctctaaaaacactttataggaaaagtgcctccttagatagtcccgtcctgctggtgataaaggacatggataatcagatctttggggcgtacgccactcatccttttaagttttctgaccattattacggtacgggcgagaccttcctgtatactttctcaccccacttcaaagtgtttaagtggtccggggagaactcttacttcattaacggagacatctcctctctcgagcttggcgggggaggcgggaggttcggcctgtggctcgacgcagacctgtatcatgggcggtcgaattcttgttcaaccttcaacaatgacatcctgagcaagaaagaggattttatagtccaggatcttgaggtctgggcattcgattag

SEQ ID NO: 126924 - DNA, 534 bp, Artificial Sequence
  Description of Artificial Sequence: Synthetic coding sequence
taagagaagacttgctctagcttggagagggaaccccattttagcttactcacgatgcgcgggcagcgtctcccactcgacattcaaattttttattgcgcaagacccgatgaggagcctttcgtgaaaattatcactgtggaggaagccaaacgacgcaaatccacttgttcttactatgaagacgaagacgaagaagtcctgccagttctgaggcctcacagcgcattgcttgagaacatgcatattgaacagttggcccgacggctccccgcccgcgtgcagggatacccctggcggcttgcatattccacactggaacatggaacaagcctaaaaacactttatcggaaaagcgcctctctagactcccccgtactcctggtgatcaaagatatggataatcagatcttcggcgcatatgccactcacccatttaaattttcagaccactactacgggactggtgagacattcttatacactttctcgccacacttcaaggggactatatggtttatggccagatgttag

SEQ ID NO: 126925 - DNA, 573 bp, Artificial Sequence
  Description of Artificial Sequence: Synthetic coding sequence
taggaaaagacatgctcatctttagagagggaaccccacttcagcctgctgaccatgagaggccagcggctgcccctcgatatacagatcttttactgcgctcgacccgatgaagagccatttgtgaagatcatcacggtcgaggaagccaagaggagaaaatctacatgcagctactatgaggacgaagatgaagaagtgttacccgtcttgagaccacactccgccctgctggaaaacatgcacattgaacagctggcccggcgactgccagccagagtgcagggctacccgtggagactggcctattctactttggagcacggaacctcactcaagaccctgtaccgcaaaagtgcctctctcgattcgcctgtcctgcttgtgataaaggatatggataatcagatctttggcgcttatgcaactcaccccttcaagttctcagaccactactatggtacaggtgaaaccttcctgtatacgttttcaccccacttcaagtggtcaggcgagaatagttatttcatcaacggcgatatctcgagcctggagctgggggggggcggttag

SEQ ID NO: 126926 - DNA, 273 bp, Artificial Sequence
  Description of Artificial Sequence: Synthetic coding sequence
atggatacaaaggaggagaaaaaagaacggaagcaatcctatttcgctaggctcaagaaaaagaaacaggccaagcaaaatgccgaaacggcgtccgccgtagcaacaagaacacacacaggtaaggaggataataatacagtggtgctcgaacctgataagtgtaatattgcggttgaagaggagtatatgaccgacgaaaagaaaaagcgaaagtcaaatcaactcaaagaaatacgtcgcaccgagctaaagcggtactattccatttag

SEQ ID NO: 126927 - DNA, 7566 bp, Artificial Sequence
  Description of Artificial Sequence: Synthetic coding sequence
atgagtgggtcaacccaacccgtggcccagacttggagagcgactgagccgagatacccacctcactccctgagttatccggtgcaaatcgcgcgtacccacactgacgtaggacttttggagtatcagcatcattccagggattatgcatctcacctgtcccctggctcaataatccaaccccagcgcagacgaccatccctactttccgagttccagcctggaaacgagcggtcacaggaactgcacttgaggccggagtcacattcatatctacccgaacttgggaaatcagagatggagtttattgagagcaagcggccacgcctagagctgctacccgaccccctcctccgcccatctccgcttctggccactgggcagccggcaggaagcgaagatctcaccaaagaccgctcattgactggaaagctggagcctgtgagccctccctcgcctcctcacacggatccagagctggagctcgtgccccccagactttccaaagaggagctcatccagaacatggatagggtggaccgggaaataactatggtcgagcagcagataagtaaattaaagaaaaagcagcagcaacttgaggaggaagccgccaaacctcctgagccagagaaacccgtctccccccctcctatagaaagcaaacacaggagcctggtgcagatcatctacgacgagaacagaaaaaaggccgaggctgcccacagaattcttgagggcctcggaccacaggtcgagcttcccctgtataatcagccctccgacacccgacagtaccacgagaacatcaaaattaaccaggccatgcgaaagaagttgatcctatatttcaagcgaaggaatcacgcccgtaagcagtgggagcaaaaattctgtcaacgatatgatcagctcatggaggcgtgggagaaaaaggtggagcgaatcgaaaacaacccccgacgaagagccaaggagtctaaagtgcgcgagtactacgagaagcagtttccggagattcgcaaacagagagaactccaggagcgcatgcaatcgcgagtggggcagaggggatcggggttgtctatgtcagcagctaggagtgagcacgaggttagcgaaatcatagacggcctgtctgaacaggaaaatcttgagaaacaaatgcgccagctcgccgtaattccccctatgctgtacgacgcagaccagcagaggataaagttcattaacatgaatggattaatggctgatcctatgaaggtttacaaggacagacaggtgatgaatatgtggtccgaacaggagaaagagacgtttcgggagaagttcatgcagcatcccaagaatttcgggctgatcgccagctttttagaaagaaagaccgtagccgagtgtgttctctattactacctaaccaaaaagaacgaaaactacaaatctctggtaaggaggagttacaggcggcggggtaagtctcagcagcagcagcaacagcaacagcagcagcaacagcagcaacagcagcaacctatgcccaggagtagtcaggaggagaaggacgaaaaagaaaaagaaaaggaagccgagaaggaagaagagaagcccgaggtggagaacgacaaggaggacctgctgaaagagaagacagatgatacctcaggagaagataatgatgagaaagaggcagttgcctcgaaaggacggaaaacagccaattcacaaggtaggaggaaaggccgaattacacgcagcatggccaacgaggctaactccgaggaagcgattaccccccagcagtcagccgaactggcctcgatggagctgaacgagtcatcgcgatggacggaagaagagatggaaactgctaagaaggggctcctggagcacgggaggaactggagcgctatagcacggatggttggctcaaaaactgtgagccagtgtaagaacttctattttaactataaaaaaagacagaatttggatgagattctacaacagcacaagctgaagatggagaaggaaagaaacgcacgaaggaaaaagaagaaggctcccgcagccgcctctgaggaggcggcgttcccacccgttgtggaggatgaagaaatggaggcttctggcgttagtgggaatgaggaggaaatggtggaagaggctgaggcgctccatgccagtggcaacgaagtcccacggggtgagtgcagcgggccagccacagtgaacaattcaagcgataccgaatcaattcctagtcctcataccgaggccgctaaagataccgggcagaatggccctaagccgccagctaccctgggtgcggatggaccgccacccggacctcccactccacccccagaagatattccggcccctaccgaaccgacacccgccagtgaagcgaccggcgcgcccacaccgcctccggctcctccctctccttccgcccccccccccgttgtgccaaaggaagaaaaagaggaggagaccgctgctgcaccaccggtggaagaaggggaagagcaaaaacctccagcagcagaagagctggcggttgacaccgggaaggccgaggaaccggtgaagagcgaatgcactgaagaggccgaagagggacccgcaaaggggaaggatgctgaggccgctgaggccactgccgaaggagccctcaaggcagaaaaaaaagaaggaggttccggccgcgctaccactgcgaaaagctcaggcgctccacaggacagcgatagcagcgctacatgtagtgccgatgaggtggatgaagcagaaggtggtgataaaaatcgccttcttagtcctcgaccctcacttctgaccccaactggggacccacgggcgaacgcaagcccccaaaaacccctggacctcaaacagctgaagcagcgtgccgccgcaatcccacccatcgtaacaaaagtccatgagccgccgcgggaggatgcagcacccactaaacctgctcccccagcaccgcccccaccacagaacctccagcccgagtccgatgccccccagcaacctggcagctccccacgaggtaagtctcgatcaccggccccacccgcagacaaagaggctgagaagcccgtgttctttccagccttcgctgcagaggcccagaaattgcctggcgacccgccttgttggacttccggcctcccctttcctgtccccccacgcgaggtgataaaggctagtcctcacgcccctgatccttcagcatttagctacgctccacctggtcaccccctgccactgggcttgcacgacacagcccggccggtcctgccaagacccccaaccatctccaacccaccgcccctcatcagctctgccaagcatccctcggtcctggaaaggcagataggtgctatcagccagggcatgagtgttcaactgcatgtgccttactctgaacacgccaaggcgccagtggggcctgtaactatggggctacctctccccatggacccgaaaaaactcgcgccattcagcggcgtgaaacaagagcagttgagtccgagaggacaggctggcccccctgagagtctgggcgtgccaacggctcaggaggcttccgttctgcgtgggacagcgttgggctctgtgccgggaggctccatcactaaagggatccccagcactagggtgccatcagattcagcaattacataccgcgggtctattacccacggcaccccggccgatgtcctgtacaaaggtactatcacccgaattatcggcgaggacagccctagtcgcttggaccgcggccgggaagatagccttccgaaaggtcatgttatttatgagggcaaaaagggtcatgtgttgtcctacgagggagggatgtcagtaacccagtgttcaaaagaagatggcaggtcatcaagtggtcccccacatgagaccgcagctccaaaacgtacctatgatatgatggagggtagggtcggcagggcaatttcgagcgcgtccattgaaggtctgatgggccgagccatccctccagagcgacactcgcctcatcacctgaaagagcaacatcatatcagagggtcaattacgcaagggattccacgctcttatgtcgaggcccaggaggactacttgcgccgggaggcaaagctgctgaagcgtgaaggaacgccccctcctcctcccccttccagggacctgactgaagcttacaagacacaggccctggggcccctgaagctgaaaccagctcacgaaggactcgtcgccactgttaaagaggctggtagatccatccacgagatcccccgagaagagctccgccatacaccagaactcccccttgcaccccgacctctgaaagagggttccattacccagggaacgccgctgaaatatgacacaggtgccagcactaccggatctaaaaagcacgatgttagatcgctgatcggatcccctggacgtacatttcctcccgtgcaccctctagatgtgatggctgacgcccgggcactggaacgggcttgttatgaagagagtttaaagtccagacccgggacggcttcctcctctggtggatccatcgcgcgcggggccccagtaatcgtgccagaactaggtaaacccagacagagccctctcacttacgaggaccacggcgcacctttcgctggtcatctccccagaggctccccagttaccacacgggagccaacgcctcggctgcaggagggatcgttgagctccagcaaggcctcacaagaccggaaattgaccagcacccccagggaaatcgcaaagagtccccactcgacagttccggaacatcacccgcatcccatcagcccctatgagcatctattaagaggtgtatcgggggtggacctttatagaagccacatcccattggcgtttgatcccacttccatcccacgcgggataccgctggacgcagcagcagcttactatcttccgagacacctggctccaaatccgacatacccccatctctatcctccatacctgatccgaggctaccccgatactgccgcactggagaatcggcaaacaattatcaacgattatatcacctcgcagcagatgcaccacaatgcggccacggcgatggcccaaagggccgatatgctgcggggcctatctcctcgggaatcttccctggccctcaattacgccgctggtcccagaggcatcatagacctgtctcaggtgccacatctgcccgtcctcgtgccacccacccccgggacacccgccaccgctatggaccggctggcttacttaccgactgcgccccagccattcagttcaaggcactcctcttcacccttgagccccggcggaccaacacacctgaccaagccaaccacaacaagctctagcgaaagggaacgcgacagagaccgcgagagggatcgcgatagggaacgggagaaatccatactgacgagcactacaacagttgagcacgccccaatatggcgtccgggcactgagcagagcagcggaagctctggcggcgggggcggctcttcgagccgccctgctagtcattctcacgcacatcagcacagccctatctctccacgcacacaggatgcacttcagcaaagaccttccgtgctgcataacaccggaatgaagggaattattaccgccgtggagcctagcacacccacagttctccgaagtaccagcacttcatccccagtgagacctgcagccacattcccgcccgccacgcactgcccgctgggaggaaccctcgacggggtgtacccgactctgatggagcctgtgctgctgcccaaggaggccccgagggtggcccgcccagagagacctcgggccgatacaggccacgcctttctcgccaaaccccctgcacgttctgggttggaacccgctagctccccttccaaggggtctgagcctcgccccctggtacctccagtgagcggtcatgctacaattgcacggacccccgcgaagaacctggcccctcatcacgcctctcccgacccacctgcccctcctgctagcgccagtgaccctcatagagaaaagacccagagtaaaccattttccattcaggaactcgaattgcgaagcttggggtatcacggcagctcgtatagtcctgagggtgtcgagcccgtgagccccgtgagctctccctcgctgactcacgacaagggacttccaaaacaccttgaggagctcgacaaaagtcacctggagggggagctacggcccaagcagccggggccagtgaaactggggggagaggctgcacaccttccacaccttcggcctctcccagaatcacagccatcttcatcccctctgctgcagactgccccaggcgtgaaggggcatcaacgggtcgtaaccctggcccagcacattagtgaagtcatcactcaagactacactcgtcatcatccacagcagttgtcagcccccttgcccgcaccgctttatagttttcccggtgcttcatgccctgtgctggatctgaggaggccccccagtgatctatacctgccccctccggaccatggcgcccctgctaggggctcaccccattctgaaggtgggaagagatctcccgagcccaataaaaccagcgtgctgggcggaggcgaagatggcatcgagccagtttccccccctgaaggcatgactgaaccaggacactcgcggtcagccgtgtaccctctgctgtacagagacggtgagcagactgaaccctcccgcatgggcagcaagtcacctggaaacacttctcagccaccagcattcttcagtaagttgacagagtcaaactctgcaatggtaaaaagcaagaagcaggagattaataagaagttgaatacccacaacaggaatgagcctgagtacaacatcagtcaacctggcaccgagatcttcaatatgccggccatcaccgggactgggcttatgacataccgttcacaggccgtgcaagagcatgcctcaaccaacatggggctggaggcaataattcgcaaagcgttgatgggcaagtatgatcaatgggaggagagcccaccccttagcgccaatgcgttcaatcccctcaacgcgagcgcttcccttccggccgcaatgcccatcacggccgctgatggcagatcagaccataccctgacctcacctggaggcggcggaaaagcgaaagtgagcgggaggcccagttccaggaaagctaaatcccctgcacctgggctcgcctccggcgaccgaccacccagcgtgtcgagcgtgcactcagagggtgactgtaacagacgcacccccctaacaaacagagtatgggaagacagaccttccagtgccggctcgacgcctttcccctataatcccctgattatgcgcctgcaggcaggagttatggcgagccccccccctccgggacttccagctggttctggaccactggccggcccccaccacgcctgggacgaggagcctaaacctcttctatgtagccagtacgagacactcagcgatagcgaatag

SEQ ID NO: 126928 - DNA, 7380 bp, Artificial Sequence
  Description of Artificial Sequence: Synthetic coding sequence
atgagcggctccacacagcctgtggctcagacttggagggctacggaacccagataccctccccactccctttcatatcctgtgcagatcgctcggacccataccgatgtgggtctgctcgagtaccagcaccacagcagggactatgcaagccacttgagcccaggctctatcatacagccccagaggaggcgtccctccctcctgagtgaattccagcccgggaatgagcggtctcaggaattgcatctgaggccagaatcccacagctatcttccggaactcgggaaatccgagatggagtttattgagtccaagaggccccgtttagagctgctgccagaccctttgcttcgccccagtccccttctggccaccggccaacctgccgggagtgaagacttaacaaaagataggtcattaacaggcaagctggagcctgtgtcacctcccagccctccccacaccgatcccgagctggagctggtaccacctcggttgtccaaagaggaactaatccagaacatggatcgcgtggatcgggaaataacaatggttgagcaacaaatttccaagctgaagaagaaacaacagcagctggaggaggaagccgcgaagccacctgaacccgagaagccggtaagcccacccccaattgaaagtaaacatcgctccctggtgcagatcatttacgacgagaaccggaaaaaagcggaagccgctcataggatccttgaaggattaggcccccaggtcgagctcccactttataaccagcccagcgacacccgccaatatcacgagaatatcaagattaatcaggccatgcggaaaaagctcatcctgtactttaaaaggaggaatcatgcacgaaagcagtgggaacagaagttctgtcagcgctatgatcagctgatggaagcgtgggagaaaaaggtggaaaggatcgaaaataacccaaggagaagagccaaagaatcaaaggttagggaatactatgaaaaacagttcccagagattcggaaacagcgtgagctgcaggagagaatgcaatctcgggtggggcaacgcgggtctggtttgtctatgtctgctgccaggtctgaacacgaggtatcggagattatcgatgggttgtccgagcaggaaaacttagagaaacagatgcggcagctagctgtgattccaccaatgttatacgatgccgatcaacaacggatcaaattcattaacatgaacgggttaatggcagacccgatgaaagtgtacaaagatcgacaggtgatgaatatgtggtctgaacaggagaaagagacatttcgcgagaagtttatgcagcatccgaagaatttcggccttatagcaagctttctggagaggaagacagtggccgagtgcgtgttgtactattacttaacaaagaaaaacgagaactacaaaagcctggtacgcagatcctatcggcgccgcggaaaaagccagcaacaacagcagcagcagcagcagcagcagcagcagcagcagcagcagcctatgccacgctcctcacaagaggagaaggatgaaaaggaaaaggagaaggaggcagagaaagaagaggagaagccggaagttgagaacgataaagaggatttacttaaggaaaaaaccgatgatacgagcggtgaagataacgacgagaaagaggctgtcgcaagcaagggtaggaaaactgctaacagccagggccggagaaaagggcggattacacgttctatggcgaacgaagctaatagtgaggaagctatcacaccccagcaaagcgccgaactggcaagtatggaacttaacgaatcctcccggtggacagaggaagagatggaaactgccaaaaagggcctgctggaacacggtaggaattggtccgccatcgcccgcatggtgggcagcaaaactgtcagccaatgcaagaatttttattttaactataaaaaaaggcaaaatttagatgagatcttgcagcaacacaagttaaagatggaaaaggagcgtaatgctcggaggaagaagaaaaaggcacctgcggcagcttcggaggaagctgccttcccccccgttgtggaagatgaggaaatggaggcatccggcgtgtctggaaatgaggaggaaatggtagaggaggccgaggccacagtgaacaacagcagcgacacagaaagcattccctcaccacacaccgaagcggctaaggatacaggacagaacggacccaagcctcccgctaccttaggggccgacgggcctccgccagggccacctacgcctccacctgaagacattcctgcccctaccgagccaactcctgcgtcagaagcaaccggtgctccaacgccaccgccagctcccccctcaccttccgctccaccacctgtcgtgccaaaggaggagaaggaagaagaaacggcagctgcccctcctgtggaagagggcgaagagcaaaaaccgcctgcggccgaagaattggcagtagacaccggaaaggccgaagagcctgtgaagagtgagtgcactgaggaagctgaagagggaccagctaaaggtaaggatgcagaggccgctgaggctacggctgaaggtgctctgaaggcggagaagaaggaaggaggctcaggacgagcgaccactgcaaaatcgtcaggcgctccgcaggactcagactcatccgctacttgttccgcagacgaagtggatgaagcagagggcggcgataagaaccgactgctgagccccagaccctccctcttgacccctactggagatccccgggcaaacgcttcacctcagaaacctctggatttgaagcagttaaagcagcgcgccgctgcaatcccgcccatccaagtgaccaaagtccatgaacccccaagagaagatgctgctcctactaaacccgccccacctgcgcccccccccccgcaaaacttacaacccgagtccgacgccccccagcaaccaggcagttccccccgtggcaagagccgctctcctgcacccccagcagacaaagaagcagaaaagccagtcttcttccccgccttcgctgcagaagcccagaaacttccaggcgaccctccttgctggaccagcggcctcccttttcccgttccaccccgggaggtcattaaagcctcaccccacgctcccgaccctagcgcatttagttacgccccacccggccacccactgcctctaggtctccacgatacggcccgtccagtgctgccccgcccacctactatatccaaccctcctcctctgatatcatcagccaaacacccatccgtcctggagcgccaaatcggagccatatctcagggaatgtccgtgcagcttcacgtcccttactccgagcatgccaaggcccccgtggggcctgtcaccatgggcctgcctctccccatggacccaaagaaactggctcctttttcaggagttaagcaggaacaactgagtcctagaggccaagctggcccccctgaaagtttaggtgttcctactgctcaggaagcatccgtgcttagaggcaccgctttgggctcagtcccaggcggctccattacaaaagggatcccgtcaacacgcgtaccatcagattccgcgatcacttataggggcagtatcactcatgggacacctgctgatgttttgtacaaaggaaccatcacgcggataattggtgaagatagtccttctcggctggacagagggagggaagactcgctccccaaagggcacgtcatttacgaaggcaaaaaagggcatgtacttagttatgagggggggatgagcgtaacccagtgcagcaaagaagatgggcgcagctctagtgggcctccccacgaaactgccgcacccaaacggacctacgacatgatggagggccgcgtcggtcgcgccatttccagtgcatccatcgaagggctgatgggtcgggcaataccaccagagagacacagcccccaccatctgaaggagcagcaccatatcagaggaagtattacacagggaattcctcgatcctacgtcgaggcacaggaggattatttgaggcgtgaggccaagttattaaagagggagggcacccccccgcccccacctcctagtagagacttgacagaggcatacaagacacaggccctcgggccgttgaaattaaagccagcccatgagggcctggtcgcaacagttaaagaggccggaagatcaatacacgagatcccaagggaggagctaaggcacacccctgaattacccttggcccccaggccactgaaggagggctccattacacaggggactccgctcaagtacgatacaggcgcctcaaccaccgggtctaaaaaacacgacgtgcgtagcctaataggaagcccaggtcgcactttccctccggtccacccactagatgtaatggccgacgctcgggcgctcgagcgggcctgttatgaggagtctctgaagtcccgcccaggcacagcttcctccagcggagggtctattgcacgcggggcccctgtgatcgtccctgagctgggcaagcctcgccagagccccctgacctacgaagatcatggagcaccctttgcaggacaccttccacgcgggagtccagtgaccactcgggagccaactcctcggcttcaagaaggatccctttctagctcaaaggccagtcaggatcgcaaactgacctcaactcctcgggaaattgcgaagtccccccattcaactgtcccagagcatcatcctcacccaatctcgccttatgaacacctcctgaggggcgtcagtggcgttgacctgtataggtctcatatccctctagcattcgatcctacctccattcccagaggcatcccgctcgacgcagccgcagcttattatctgccgaggcacctcgcaccaaaccctacgtacccacacctgtaccctccatatcttatccgggggtatcctgacactgcggctttggagaaccggcaaactatcataaacgattacattacaagtcaacagatgcatcacaacgctgccacagccatggcccagagagcggatatgttgcgaggcctcagtcctagagagtctagtctagccctaaattacgcagccgggccccgcggtattatcgatttatctcaggtccctcacctgcctgtcctggtgccaccaacccccgggacacctgccacggcaatggataggctggcatacctgccaaccgccccccaacctttctcatcccggcactctagtagtccactgtctccaggcggccctactcacttgactaaacctaccacaacaagctcgagcgagagggagagggaccgcgatcgggagcgcgacagagacagagagcgggagaagtccattctgacttccacaactaccgtggagcacgccccgatatggagaccagggacggagcagtcgtcgggaagcagcggaggcgggggcggctcctcttcccgccctgcctcccatagccatgcccaccagcacagccccatttccccccgcacacaggatgcgcttcagcagagaccttcggtcctccacaatactggcatgaaagggattatcacagctgtggaaccgtccacgcccacagtgctgcggtctaccagtacatcatctcccgtccgccctgccgccactttcccgcccgcaacacattgccctctgggggggaccctggatggcgtatatccaactctaatggaaccagtcctgttgccaaaggaggcccctagagtagcccgtcccgagcggccccgggccgataccggtcacgcatttctggccaagccgccagcccgcagcggattggaacctgcctcaagtcctagtaagggatcagaacctcgcccgcttgtgccaccagtgagcggccacgctaccattgctagaacgccagccaaaaatctggcacctcatcacgctagtccagacccccctgctcctccagcctcagcctccgaccctcacagggagaaaactcagagcaagccttttagcatccaggagctcgagcttagatctttgggctatcacgggagcagctactcccccgagggcgtggaaccagtgtctccagtctcttccccaagcctgacgcacgacaagggcctgcccaaacatcttgaggaacttgataaaagccacctcgaaggggaactcaggcctaagcaacccggccccgtcaagctcgggggggaagctgcccaccttcctcatttaaggccgctgccagagtcgcagccctcttcctcacccttactgcaaaccgctcccggagtgaagggtcatcagcgagtggtgacattggcccagcacatttccgaagtcattactcaggattacacccggcatcacccacagcagctctcagcacctttgcccgcaccactctatagctttcctggtgcctcttgccctgtactggatttaagaagaccaccgagcgacttgtatttaccaccgccagaccacggggccccagcaagaggaagcccccactcagagggcggtaagagatctccagagccaaataagacgtccgttctggggggcggtgaagacggcatcgagcctgtctccccacccgagggcatgaccgaacccggacactctcggagtgccgtatatcctctgttgtatcgcgacggcgagcaaaccgagccaagccggatgggtagcaagtcaccaggcaataccagtcagcctcctgctttcttctcaaagctgaccgaatctaactccgccatggtgaagagtaagaaacaagagataaacaaaaagctgaatacccataaccgtaatgagccagaatacaacatcagtcagcccggaaccgagatattcaacatgcccgcaattacgggcacaggccttatgacttacaggagccaagccgtgcaagaacacgcaagcacaaatatggggctcgaggccattatcagaaaggctctgatggggggcggaggaaaagccaaagtgagtgggaggccaagctctcggaaggcaaaaagcccagcacccggtctggcctccggggaccggccaccatccgtgtcctccgtgcacagtgaaggcgactgcaacaggagaaccccccttacaaaccgagtgtgggaagacagaccatcgtccgctggttccacccccttcccgtataatccacttataatgaggctccaagccggagtcatggcctcgcctccacctcccggcttgcctgccggatcaggcccccttgccgggcctcaccatgcgtgggatgaggagccaaaaccactgttgtgctcccaatatgagacactgtccgacagtgaatag

SEQ ID NO: 126929 - DNA, 6228 bp, Artificial Sequence
  Description of Artificial Sequence: Synthetic coding sequence
atgtggtctgagcaggaaaaggagacttttcgggagaagttcatgcagcaccctaagaattttgggctgatcgcctcttttctggagaggaagactgttgcagagtgtgtgctctactactacttgacgaaaaagaacgagaattataagagtctagtgaggcggtcttacaggcgtcgaggcaaatcccagcagcagcaacagcagcaacagcagcaacaacagcagcagcagcagcagcccatgcctcgatcatcccaggaggagaaggacgagaaggaaaaggagaaagaggctgaaaaagaggaggagaagcctgaagtggaaaacgacaaagaggacctgttaaaggaaaaaacagacgataccagtggcgaggacaatgacgagaaggaggccgtggcatccaagggtcgaaaaacagctaacagtcagggacgcaggaaaggccggattacacgctctatggcaaatgaggcaaattctgaggaagccatcaccccccaacagtcagctgagctagcctctatggaactcaacgagagcagccgttggaccgaggaagagatggaaacggccaagaaaggcctcttggaacacggaagaaactggtccgccatcgcacggatggttgggagtaagactgtgtctcagtgtaaaaatttttacttcaattataagaagagacagaatttagatgaaatcttgcagcagcataagttaaagatggaaaaggaaagaaacgccaggagaaaaaagaagaaggctcccgctgcagcaagcgaagaagcggccttcccacctgttgtggaggacgaagagatggaagcttcaggtgtgagtggcaatgaggaggaaatggtggaggaggctgaagctactgtcaataattcctcagacaccgaaagcatcccctcccctcacaccgaagccgcaaaggacactgggcaaaatggtcccaagcccccggctacactcggtgcagatggaccaccccccgggcctccgactccacctcccgaagacataccagctcccaccgaacccactccagcttctgaggcgacgggcgcaccaacacccccgccagcccccccttctccatccgctccccctccagtagtccctaaggaggagaaggaagaggaaactgctgcagcccctccagtggaagaaggagaggagcagaaaccaccagccgccgaggagcttgctgtggacacaggcaaagcggaagagcccgtgaagtccgaatgcactgaggaagccgaggagggtcctgccaaaggcaaggatgcagaggcggcagaggccacagctgagggtgcgttaaaggccgagaagaaggaaggggggtctggcagggcaaccacagcgaagtcgtcaggagcccctcaggattctgacagttccgcgacgtgttcggctgacgaagtggacgaagccgagggcggagataagaaccgcctcctctctcctcgtccatctctgctcaccccgaccggcgacccccgggcgaatgcaagccctcagaaacccctcgatctgaaacaattgaaacaacgtgccgccgctattccaccaatccaggtcactaaggttcacgagcccccccgtgaggatgccgctcctaccaaaccggctcctcccgcgccccctcctccccaaaaccttcagccagagagtgacgctccccagcagccagggagtagcccccgtggcaaatcccgttcacctgcccctcccgcagacaaggaagcagagaagcctgttttcttccccgcctttgccgctgaagcacagaaattgcccggagatccaccttgttggaccagtggcctgccatttcctgtgccaccaagagaagtgatcaaggccagtccccatgcgccagatccgtcagcctttagttatgccccaccgggacaccccctgcccctcgggttacacgacacagccagacctgtgctccctcgtcccccaacaatcagcaaccctcccccactgataagcagcgctaagcatcctagcgtattggagaggcagataggcgctattagccagggcatgagcgtgcagctccacgtcccctactcagagcacgcaaaagccccagtcggaccagtcacaatgggactgccactcccgatggacccgaaaaaactggcgcccttttccggtgtcaagcaggagcagctaagcccacgcggccaggctgggcctcctgagagtctaggggtgccaactgcccaggaggcttctgtgcttcgcggtacggctttagggtcggtgcctggaggatccatcactaaggggattccctctacgagggttccttcggatagcgccatcacttatagaggttcaattacacacggcacccctgcggatgtgttgtacaaaggtactattaccagaatcatcggtgaagatagtccaagtcgcctggatagaggtcgtgaagactctctgccgaaagggcacgtgatctatgagggcaaaaaaggacacgtcctgagctacgaaggggggatgagcgtgacccagtgcagcaaggaggatggacgttcaagttctggacctccccacgagacagctgccccaaagaggacatacgacatgatggaaggcagggtgggccgcgccatcagcagtgctagtatagaaggcctaatgggcagagccatcccccccgaaaggcatagtcctcatcacctgaaggagcagcaccatattaggggctccattactcaggggattccccgtagctatgtggaagcgcaggaggattacttacgacgggaagccaagctactgaagcgagagggtactcccccaccaccccctccaagtcgggatcttactgaagcctacaaaacacaggctttaggtcctctgaagttaaaacctgctcacgagggtctggtggcaacggtgaaggaggcagggcggtcgatccacgagatcccgagggaggagttacggcatacacccgagttgcctctggccccaaggccacttaaggaagggtctatcacacagggaactccccttaagtacgacacaggggctagtactacagggagtaaaaaacacgacgtcagatccctcataggctctcccggcagaacatttccaccagtgcacccattggatgtgatggcagacgccagagctctggagcgcgcatgttatgaggagtcattgaaatccaggcctggtaccgcttcctcaagtggtggtagtatcgcacgtggtgcgcctgtgatcgtgccagagctgggtaagcccagacagtcccctcttacatatgaggatcatggcgctccctttgcaggacaccttccacgaggatcacccgtgacaacccgcgaaccgactccacgtctgcaggagggctcactgtcctcctccaaagcctcacaggaccggaaactgacatcaacccctcgggaaattgcgaagtcaccacattccaccgtgcctgagcaccatccccatccaatctctccatatgagcatctgctaagaggtgtttctggagtggatctgtaccgtagccatataccactcgcctttgaccccacaagtattccccggggtatccctctggacgccgcggctgcttactacttgcccagacacctggcgccgaaccctacctacccccacctatatcctccctatctgattcgcggctaccccgacacagccgccctagaaaatagacagactattatcaatgattacatcacaagtcagcaaatgcatcacaatgctgcgaccgccatggcccagcgggccgatatgctgcgcggactctccccacgagagtcaagccttgcactcaattatgcagctgggccgagagggattattgacttgtctcaagtcccgcatttgcccgtcctcgtgccaccaactcccgggacccctgctaccgctatggatcggctggcttatttgccgacggcccctcaaccattcagctctcgtcacagctctagtccactgtcccctggtggtccaacgcacctgaccaagcctaccacgacaagctcttccgaacgcgaaagggaccgcgacagagagagggatcgcgatagggaacgcgaaaaatccatactcacaagtaccacaacggttgaacacgccccaatctggcggcctggtaccgagcagtcttcgggttcttctggcgggggtggtggcagctcatctaggcccgcctcccattcccacgcccatcagcacagtcccatatccccaagaactcaagatgccctccaacagcgaccctcagttcttcacaataccgggatgaagggtattatcactgctgtcgaaccttcaactccaaccgtgctcagaagcacaagcaccagctcgcccgttcggcccgccgccacttttccacccgctacccactgcccactagggggtaccctagatggagtgtatcccactctcatggagcccgtcctgcttcctaaggaagcccccagggttgcgaggcctgagcgtccacgtgccgacacaggtcatgcatttttggctaagccacccgctagatctggcctggaaccagcctcatctccttcaaagggctccgagccacggccgctggtcccaccagtatccggccacgctacaattgcacggacaccggccaaaaatctcgcccctcaccacgcgagcccagacccacccgctccccccgcttccgcatcggacccccatagagaaaaaacccagagtaaaccatttagcattcaggagctagagctgcgcagtctgggctaccacggctcaagttactcccccgagggcgtggaaccagtttctccggtgtcgagtccttcgctcacccatgacaagggattacctaagcacctcgaggagcttgacaagtcacacctcgagggcgagcttcgcccaaagcagcccggcccggttaaactcggcggggaagccgcacatttacctcacctgaggcctctacccgaatcgcagccgagcagctctccactcctccagaccgcccccggggtgaaaggccaccagagagtcgttacgcttgctcaacacatttccgaagtgataacccaggattatactagacaccaccctcagcagctgagtgccccattacctgctcctctttatagctttcccggtgcctcatgtcctgtgctagatctgcgccgccctccctccgacctgtacttgcctccccctgaccacggggcgccagcacggggtagccctcactccgaagggggcaagaggagccctgaacctaataagacatcggtgctgggtgggggcgaggacgggatcgagcccgtgtcgccacccgagggtatgaccgaacccggacattcccggagtgccgtttacccactcttatacagagacggggaacagaccgagccaagccgcatggggtcaaaaagcccaggaaatacttctcagccacccgcatttttctctaaactgactgagtcgaactccgcaatggtgaagtccaagaagcaggagataaacaagaagctgaatacacacaatcgtaacgaaccagagtataatatctctcagcccggaaccgaaatttttaacatgccggccatcactggcaccggcctgatgacgtaccggagtcaggctgtccaggaacacgctagcactaatatgggtttggaggcaatcatccgcaaagctctcatgggaaagtacgatcagtgggaggagagtccccctctgtccgctaacgcattcaatccgctgaacgcatccgccagcctgcccgctgccatgcctattaccgcagccgatggccggtcagatcacaccctgacgtcacctggaggaggtggcaaggccaaagtcagcgggagaccatcatcccggaaggcaaaatcgccagcccccggtctggcctctggcgacagacctccttcagtttcctcagtgcatagcgaaggcgactgcaaccgccggacaccccttaccaaccgggtgtgggaagatcgcccaagttcagccggatccacccccttcccatataacccacttataatgagactacaggccggtgtgatggcctctccaccaccaccgggtctgcctgcggggagtgggcctctggctgggccccatcacgcttgggacgaggaacctaagccgctcttgtgctcacagtacgagacgctgtctgatagcgagtag

SEQ ID NO: 126930 - DNA, 7377 bp, Artificial Sequence
  Description of Artificial Sequence: Synthetic coding sequence
atgtcggggagcactcaacccgtggcccagacctggcgggcaaccgagccccggtatccaccacacagcctgtcatatcccgtgcaaatcgctaggacacatactgatgtgggactgctggaatatcagcaccactcccgcgattatgcttcgcatctttccccgggcagtattattcagccacagcggcggcggccttcattgctcagcgaattccagcctggcaacgagcgctcacaagagctacatctgaggcccgaaagccatagttacctaccagagttgggcaagagcgaaatggaattcattgagagcaagaggccccgtctcgagctactgcctgatcccctgcttcgtccctctccactgctggcaacgggccagcctgccggtagtgaagatctaactaaggaccggtcactgacaggaaaattggagcctgtgtcacccccctccccaccacatactgacccagagctggaacttgtacctcctcggctgagtaaagaagagttaattcagaacatggaccgggtggatagagagataaccatggttgagcagcagatcagcaaactcaaaaaaaaacagcagcagttggaagaagaggctgcgaagcccccagagcccgagaagcctgtttcgccccccccgattgagtccaagcatcgctccctagttcaaatcatttatgatgaaaatagaaaaaaagccgaagctgcccatcggatactggagggtctgggtccgcaagttgagttaccactgtacaaccagccgagtgataccagacagtaccatgagaatattaagatcaaccaagctatgcggaagaaacttatcttatactttaaacggcggaaccacgctaggaaacagtgggagcagaagttctgtcaaaggtatgatcagctcatggaggcatgggaaaagaaggtggaacgaatagagaacaatcccaggagaagagcgaaggaatctaaggtaagggagtactacgaaaaacaatttccagaaatcagaaagcagcgggaactgcaagaacgaatgcaaagggttggtcagcggggtagcggtctgagcatgtccgctgccagatcggagcacgaagtatctgaaattatcgatggactcagcgaacaggagaacctagagaaacagatgcgccagctggcagtgattccacctatgttgtacgacgccgatcagcagagaatcaaatttattaacatgaacggtctcatggcagacccaatgaaggtctacaaggacagacaagtgatgaacatgtggagtgaacaggagaaggaaacctttagggaaaagtttatgcaacatcctaagaattttggacttatcgctagttttctagagagaaagaccgttgcggaatgcgtgctgtactactatctaacaaagaaaaacgaaaactacaagagcctggtgaggagaagctacaggcgccggggtaaatcccagcagcagcagcagcagcagcagcaacagcagcagcaacagcaacagcaacctatgccccggtcgagccaagaggaaaaagatgaaaaggagaaggaaaaagaagccgagaaggaggaagaaaaacctgaggtcgagaacgataaggaggatctgttgaaagagaaaacagacgataccagtggcgaggacaacgacgagaaagaagccgtggcttccaagggtcgtaaaacagccaatagccaaggccggcgcaaaggccgtatcactcgctccatggccaacgaagccaatagcgaagaagctataacaccgcagcaaagcgccgaactggccagtatggagttaaacgaatcctcaagatggacagaagaagaaatggagacagctaaaaaaggcttgcttgagcatggacgtaactggagcgccatcgcgcgaatggtcggctccaagaccgtttctcaatgcaagaacttctacttcaattataagaaaaggcagaatctggacgaaatcttacagcagcacaagctgaagatggaaaaagagcgaaacgcgagacgaaagaagaagaaggctcccgccgcagccagcgaggaagccgccttccccccagtcgtagaggatgaagaaatggaagccagcggggtgagtggaaatgaggaagaaatggtcgaggaggctgaggcaaccgtaaacaacagcagcgatacagagtctattccttccccacacactgaggccgcaaaagataccgggcaaaatgggcccaaaccaccggccaccctcggcgctgatggtcctcccccggggccgcccacacccccacctgaggacattcctgcaccgacagagccaacgccagcttctgaggccacgggggcccctacaccaccgccagctcccccaagtccttccgcaccgccccccgtggtgcccaaagaggagaaagaggaagaaaccgccgcagcccctccggtggaagaaggcgaggagcagaaaccaccggctgctgaggagctagccgtggacaccggcaaagcagaagagcctgttaaatccgagtgcaccgaagaagccgaggaaggtccagctaaggggaaagatgccgaagctgcggaggccacagcagagggagccctgaaggctgagaaaaaggaaggtggatccgggcgcgccacaaccgctaaatcatctggggccccccaagattccgatagttcagctacctgcagcgccgatgaagtggatgaagctgaaggcggcgataaaaatagattactgtctcctcgtccttctctcctcacacctacaggagacccccgggccaatgcaagcccccaaaagcctctcgacctgaaacagcttaagcagcgggccgccgccatcccaccaatccaggtcactaaggtgcatgagccacctagagaagacgccgcccctaccaaacccgcaccaccagcgcctccccctccccagaacctgcagccagagtccgatgcaccccagcagcctggcagctcacctcggggcaaatctaggtccccagccccgcctgcagataaggaggctgagaaacctgttttcttccccgcgttcgccgcagaagctcagaagctgcccggcgatccaccttgttggacctcgggcctgccgttccccgtgccccctcgggaagtaatcaaagcttcacctcatgcgcccgatccctcagctttcagctatgctcctcccggccaccccctgccactgggactccatgacactgcacgacccgtcctacctcggccccccacaatcagcaatcctccccccctgatttctagcgcaaaacatccatccgtgttggagagacaaattggcgccatatctcagggcatgtcagtgcagttacatgtgccatacagcgagcacgcgaaggccccagtgggtccagtcaccatggggctgcccctgcctatggacccgaagaaactggctcccttttctggtgtgaaacaagagcaactctcgccaaggggccaagcaggaccaccggagtctttgggtgtccctacagctcaggaagcatcagtcctgcggggaactgccctgggtagtgttccaggagggtcaataactaaggggattccaagtactagagtgccctcggactctgcgatcacatacagagggtctattacacatggaacgccagcagacgtgttgtacaaaggaacaattaccagaatcataggagaagattcccctagtcgcctggatcgcggacgcgaagattcactgccaaaaggacatgtgatttatgaaggcaagaagggtcacgttctgtcgtatgagggagggatgagcgtaacgcagtgctctaaagaagacggaaggagtagctctggacccccgcacgaaactgcagctccaaagaggacctacgacatgatggaaggtcgagtgggccgggctatttcatcggcgagtattgaagggttgatggggagggccatcccacccgagcgccactcaccgcaccacttgaaagagcaacaccatattaggggatcaattacccagggcattcctcgatcatacgtagaagcacaagaagactacctgcgaagagaggcaaaactcctaaaacgggagggcaccccacccccacccccaccttcccgggacttaaccgaagcgtataagactcaggctctagggcctcttaaacttaagcctgcccatgagggcctggtcgctacagtgaaagaggccgggcgcagtatccacgagattccaagggaggagctaaggcatactcccgagttaccacttgcaccccgtccactgaaggaaggctcaatcactcagggcactcccctgaaatatgatactggggcctctaccaccggaagtaagaaacatgatgtgagatccctcattggcagccctggccgaacctttcctcctgtgcacccgcttgatgtgatggccgacgccagggctctggagcgcgcctgctacgaggagtccctcaagtcacgccctggcaccgcctctagctccggagggagtatcgctaggggcgccccagtgatcgtcccagaactagggaaaccaagacagtcgcccctcacttacgaggaccacggggcacccttcgccggacatttaccccgtggatccccagttaccacaagagaaccgaccccgcgactccaggaaggatctctcagcagctcgaaagcatctcaggatcgaaagctcaccagcactccacgggaaatcgctaagtctcctcattccaccgtccctgaacaccacccacaccccattagtccttatgagcatctgttgaggggtgtcagtggagtggacctctaccggtcacatataccattagcgttcgatcccaccagtatcccccgcggcatcccactagacgccgccgcagcctactaccttccacggcaccttgcccctaaccccacttacccccatctttaccctccttatctgattcgcggctaccccgataccgctgcactcgagaatcggcagaccatcattaacgactacattacaagtcagcagatgcatcataatgcagctacagctatggcccagagggccgatatgttgcgcgggcttagtcctcgagaatctagcctggccctgaattatgctgcaggccctagggggattatcgacctttcgcaggtgccccatctgcctgtgctggtccctcccactccgggcactcccgccaccgcaatggacagactggcctatctgcctactgcccctcaaccgttttcctctagacactcgtctagccccttgtcacctggaggacccacccacttgactaagcccactacgacctcatcttccgaaagagaacgcgaccgggaccgggaacgcgacagggatagggaaagagaaaagtccatcctgacctcaaccaccacagttgagcatgctccaatctggagaccggggacagagcagtcaagcggttccagcggagggggtgggggctcgtcatcgcggccagccagccacagccatgctcatcagcacagccccatctcaccaaggactcaggatgccttgcaacagagacccagtgtgctacataacacaggaatgaagggcataatcacagccgtagaaccctctacacctactgtcctgcgctccacatccacctcctctccagtgcggcctgcagcaacctttcctcccgccacacactgcccactgggtgggaccctggacggcgtataccccacactgatggaaccagtccttctgcccaaagaggccccccgcgtggcccggcccgaaagacctagagcggacactggccacgcctttttggctaaaccaccggcgcggagtggtctggagccagcctcgagccccagcaaaggaagtgagcctcgccctctggtgccccctgtgtctggacatgcaacgatcgcaaggacacctgccaagaatttggctccacaccatgcgtcgcccgatcctccagccccgccagctagcgcgtccgacccccacagagaaaaaacgcagtctaaaccattttccatccaggagctcgagttgcggtctctgggctatcacggtagctcttatagccccgaaggtgtcgagccagtttctcccgtgtcatctcccagtctgacccacgataaaggactccctaaacatttggaagagctcgataagagccatctggagggcgagctgcggccgaagcagcctgggcccgtgaaactgggaggagaggcggctcacctgccccacttgcgcccgctaccggaaagccagccctccagctcgcccctgctgcagactgccccaggggttaaggggcatcagcgggtcgtaaccctagcccagcacatttcagaggtgataacgcaggattacaccagacatcacccccaacagctttctgcaccactgcccgctcctctgtattctttccctggcgcctcctgcccggttcttgacctgagacgacctcctagcgatctctacctaccaccacccgatcatggagccccagctcgagggtccccgcactctgaaggcggcaagagatcacctgaaccgaacaaaaccagcgtgttaggaggaggagaagatggcatcgaaccagtatctccccccgagggaatgacagagccaggccattcgcggtccgctgtatacccactcctttatagggacggcgagcagactgagcctagtcggatgggtagcaagtctccaggtaacacaagccagccccccgcgttttttagcaagctaacagaaagtaatagcgccatggttaaaagtaagaagcaggagattaataagaaactgaacacacataataggaacgaaccggagtataacatctctcagcccggtaccgaaatctttaacatgcctgctattacaggaacaggactgatgacctatcgcagtcaagccgtccaagagcacgcatccaccaatatgggactcgaagcaataatacgcaaggcattgatggggggcggaggcaaggctaaggtgtcaggacgtccctctagccgcaaggctaagtcccccgctccaggcttggccagcggggaccgccctccctctgtgagttctgtccactctgaaggggactgtaatcgcagaactccacttactaaccgcgtgtgggaggaccggcctagttccgctggcagcacacccttcccgtataaccctctgattatgcggttgcaagcgggcgtgatggcatctcctccgcctcccggtctccctgccggaagcgggcctctggcgggccctcaccacgcttgggatgaggagccgaagcctcttctctgttctcagtacgagacactgtcagattccgagtag

SEQ ID NO: 126931 - DNA, 7545 bp, Artificial Sequence
  Description of Artificial Sequence: Synthetic coding sequence
atgtcgggtagcacacagcccgtggctcagacttggcgggcaacggaaccccggtaccctccacattctctgtcctatcccgtgcagattgcccgtacgcacactgacgtgggcctgcttgagtaccagcaccattcccgcgactacgcgtctcatctgtcaccaggatctataattcagccgcaaaggcgacggccttcactgctgagcgaattccaaccaggtaacgagagatcacaagagctgcacctgcggccagagtcgcactcctacctgcccgaattaggtaagagcgagatggaatttatagagtcgaaacgcccccgcttggagctgcttcccgacccactccttcggccctctcccctcttggccacgggacagccagctggctccgaggatctgacaaaggatcgttcactgacaggtaaactagagccagttagccctccatccccgccccacactgatccagagctagagttagtgcccccccggctgtccaaagaggagttgattcaaaacatggacagagtcgatcgcgaaattactatggtggagcaacaaatcagcaagttgaagaaaaagcaacagcagctcgaggaagaggccgcgaaaccaccagaaccagagaaaccggtcagcccccctcccattgaatcaaagcacagatcactggtgcagatcatctatgatgagaatcgcaagaaagccgaagccgctcacaggattctggaagggttgggcccacaggttgagctgcccctgtataaccagcccagtgacaccaggcaatatcatgaaaacattaagatcaaccaggccatgcgtaagaaacttatcctgtattttaagcgacgcaatcacgcccgcaagcagtgggagcagaaattttgccagaggtatgatcaactgatggaggcctgggagaagaaggtcgaacgaattgaaaataatcccaggcgcagagccaaggagtctaaggtgagagaatattacgagaagcaattcccagaaataaggaagcagcgcgagttgcaggaacgtatgcagtcacgagtgggtcagagaggttctggtctgtctatgtccgccgcaagatccgaacatgaagtcagtgagattattgacgggctgagcgagcaggaaaacttggaaaaacagatgaggcaactggcagtcattccaccgatgctgtatgatgccgaccagcagcgtatcaagtttattaatatgaacgggctgatggctgacccaatgaaggtctacaaggataggcaagttatgaatatgtggtcagagcaggaaaaggaaaccttcagggagaagttcatgcagcaccccaagaactttggcctgattgctagctttctggaacggaagacggttgccgaatgcgtattatactattatctgacgaaaaagaacgagaactacaagtcactcgtccgtcgctcataccgacgccgcggcaagtctcaacagcagcaacaacagcagcagcagcaacagcaacagcagcagcaacagcccatgccgcggagttcccaggaggaaaaggatgagaaggagaaagagaaagaggctgagaaagaagaggaaaaacccgaagtagagaatgacaaagaggatttactgaaagagaaaacagacgatactagcggggaggataatgatgagaaggaagcggtggcgtccaagggtcgcaaaaccgccaactcccagggcagaagaaaagggcggatcacccggtctatggcaaatgaggccaacagtgaagaggcaattactccccagcagagtgcagagctcgccagcatggagttgaatgaatcatctaggtggacagaagaagaaatggagacggctaagaaaggactactggagcacggtcgaaactggtcagccatcgcacggatggttggctcgaagacagttagccagtgcaagaacttttattttaactacaaaaaacggcagaatctggatgaaatcctgcagcagcacaagctgaaaatggagaaggagcggaatgctcgacgaaagaagaagaaggctcctgccgctgccagcgaggaggctgcgttcccccctgttgtcgaagacgaagagatggaggcctcaggagtaagtggaaacgaagaggagatggtggaggaggcagaagcactgcacgccagcggcaacgaggtccccagaggcgagtgctcaggccccgcaacagtcaacaatagcagcgacacagagagcatacccagcccccacaccgaggcggccaaagataccggtcaaaacggaccgaagcctccagccactctgggcgccgacggccctcctcccggtccacccactcccccgcctgaagacatacctgcccccactgaaccaaccccagcatccgaagccacgggagcccccacacctccgccagctccaccgagcccgagcgcacctcccccagtcgttccgaaagaagagaaggaagaggaaactgcagcagctcctcctgtcgaagagggcgaagagcagaagcctcccgctgctgaagagctggccgtggacacaggaaaggctgaagagcctgtcaaaagcgagtgcacagaggaagcagaggagggccctgcgaaaggtaaagacgccgaggctgccgaagccactgccgagggagccctgaaagcagagaaaaaagaaggaggctctgggagagctactaccgcaaagtcgtcaggggccccccaagactcagacagctcagcgacttgctctgccgacgaggtggacgaggccgagggaggggacaaaaataggcttctgtccccacgcccatcccttttaaccccaactggcgacccaagggcaaacgcaagcccccaaaaacctttggaccttaagcaactgaaacagcgcgcagccgctattccccccattcaggtgacaaaggtgcatgaacctccgcgcgaggatgctgcaccaactaaaccagccccacccgcgccacctcccccccagaacctccaaccagagagcgatgcaccacagcagcccggctcttctcctcgggggaagtcaagaagtccagcgcctccagccgacaaggaagcgtttgccgctgaggcgcagaaactgccaggggaccctccttgttggacctcaggtttgccctttcctgttcctccacgggaggtgatcaaagcgtccccgcacgcacccgacccctccgcgttttcctacgcacccccaggacatcctctgcccctgggccttcacgacacagccaggcccgtgctcccccgccccccaaccattagcaacccgcctcccctgatctcatctgctaaacatccttcagtccttgaacggcagattggggccatctcccaagggatgtctgtccagttgcatgtgccatacagtgagcacgccaaggctccggtgggccctgtgacaatgggcctgccactgcccatggatccaaaaaagttagcgccctttagtggagttaaacaggagcaactgtcaccccgcggccaggcaggaccaccggagtctttgggagtccccactgctcaggaggcaagcgtcctccggggaactgctcttgggagcgtaccgggtgggagcattacaaagggcatccctagcaccagggttccaagcgacagcgccattacctatcgggggagcatcacacatgggacacctgcggatgtgctgtacaaaggaaccattacacggattatcggcgaagacagtccttcaagattggaccgtgggcgagaagatagcctccctaaaggccatgtgatctatgaaggcaagaagggccatgtgctctcatacgaaggaggaatgtccgtgacgcagtgctccaaggaagatggcagaagctcgtctggccctccccatgaaaccgctgctcctaagaggacttatgacatgatggagggtcgggtgggaagagcgatcagttctgctagtattgaggggttaatgggtcgcgcaattccccctgaaagacattctcctcaccatctgaaggaacagcaccatatcagaggatcaattacacagggcatccccaggagctacgtggaagcacaggaggactatctgcggagggaagccaagctgctgaagagagaagggaccccaccccctccccctcctagtagggatctgactgaggcatataaaactcaggcactgggccccttgaagctgaagcccgcccacgagggactggtggccacagtgaaggaggcagggcgctccattcacgagatcccccgcgaggaattacgccacactcctgagctgcctctggcccccagacccttaaaggaggggtctataacacaggggacccctctgaaatacgatactggggcctctaccaccggatccaagaagcacgatgttcggtctctcattggtagtcctggcaggaccttccccccagttcaccctctggatgtcatggctgacgctcgcgctctcgagcgggcctgttatgaggagtcactcaaatcccggcccggcaccgctagctcatctggtggaagcattgcccgaggcgcacctgttattgtgccagagctcggaaaaccaagacagtcgcctctgacgtacgaagaccacggcgctccttttgccggtcatctgcccagaggtagccccgtgacgactcgggaacccacaccgcggcttcaagagggctccctcagctccagcaaggcaagccaggacagaaagctcacgtccactcctagggaaatcgcaaagtctccccacagcacagtccccgagcatcacccacaccctatctccccatacgaacacctcctgaggggagttagcggggtggatctgtatagaagtcacatacccctggctttcgatccaaccagcatacctcgcggaattcctctggatgcggctgcagcgtattacttacccaggcatttagcacctaatcccacctacccgcacctgtacccgccctacctcatccgggggtatccagacactgccgccctggagaaccgtcagactatcatcaatgactacatcacaagccagcagatgcaccataatgccgctacagcgatggcacaaagggccgacatgctccgtgggcttagcccccgcgagtccagtctagccctgaattacgcagctggtccacggggaatcatcgacctgtcacaggtccctcacctccctgtcttggttcccccgacccctgggacaccagcgacggccatggatcgtcttgcttatctgcctacagcaccgcagccctttagttcacggcactcttcctctcccctatctcccggggggcctacacatctgacaaagcccacaaccacaagtagttcggaacgcgagcgcgaccgggatcgggagcgcgatagagacagggaacgcgaaaagagcattctcacctccactacaaccgtggaacatgcccccatatggaggccagggactgaacagagttctgggagctccggaggcggcgggggctcatccagcaggcccgcctcccactcgcatgcccatcagcactcccctatttccccacgcacccaagatgctctccaacagcggccttccgtactccataacacagggatgaaaggcatcataaccgcggtggagccttcaacacccactgtcttacggagcacatcgacatcttcccctgtccgccccgctgcgaccttcccaccagcgacacattgtcctcttggggggacactggacggcgtgtaccctaccctcatggagcccgtgctcttgcctaaagaagcaccccgcgtcgctaggcccgagcggcctcgggcagatactggccatgcctttctagccaagccccctgccagatccgggctggaaccggcaagtagcccttcaaaaggatcagagcccagaccgctggtgccacctgtatcagggcacgcaacaatcgcacggaccccggccaaaaatcttgcaccgcatcatgctagtcctgaccctcctgcgcccccagccagcgcaagtgaccctcacagagagaaaacgcaatctaaacccttcagcattcaggagctagagcttaggtcactcgggtaccacggcagctcttattctcccgaaggcgtcgagcccgtgagccctgtgagctctcctagcctcacacacgacaaaggcttacccaaacacctcgaggaattagacaaaagtcacctggagggagagctgagacctaaacagccgggccccgtgaaactgggcggtgaggcagcccacctaccccacctacgccccttacctgagagtcagccgtcctctagtccactgttacaaactgctcccggggtcaagggtcatcagcgagtggtgactttggcccaacatatttccgaggttatcacccaagactacaccaggcatcacccccagcagttatctgcccctctacctgcaccactttacagttttccaggagcttcttgtcccgttcttgacctgcggagaccaccctctgacttgtacttaccgcctccagaccacggagcccctgcaagagggagcccacatagtgagggtgggaaaaggtcccctgagcctaataagacgtctgttctgggcggtggggaagatgggattgagcccgtctcgcctcctgaaggcatgacagagcccggccattctcgatcagctgtatatcccctactgtatcgggacggagagcagacagaaccatccaggatgggatctaaatcaccgggcaatacaagccagcctccagcctttttcagcaaactgactgagtccaactcagctatggtgaaatccaaaaagcaggaaattaacaagaagttaaacactcataaccggaacgagcccgaatataatatcagccagccaggcactgaaattttcaatatgccagccataactggcaccggcctaatgacctaccgaagtcaggccgtacaggagcatgccagcacaaacatggggcttgaagccattatacgaaaagccctgatgggcaagtacgatcaatgggaggagagtccaccactaagcgcaaacgccttcaacccccttaatgcatccgcgtcattacccgctgccatgcctatcactgctgccgacggccgttcagaccacaccttaacaagcccaggcgggggcggcaaagcaaaagtttccggccgcccctcctcacgtaaggctaaaagtccggcccccggcttggccagcggagatagaccgccgagtgtgtctagcgtgcattcagagggagactgtaataggcgaacccctcttaccaatagggtatgggaagatcggccgtcatctgccgggtctacaccctttccatacaatccattgatcatgaggttgcaggctggcgtgatggcatccccgcccccacctggccttcctgcggggtccggtcccctggccggtccccaccatgcttgggatgaagagcctaagccccttctgtgctcccagtatgagaccctttctgactcagagtag

SEQ ID NO: 126932 - DNA, 7515 bp, Artificial Sequence
  Description of Artificial Sequence: Synthetic coding sequence
atgtccggcagcactcagcccgttgcacagacatggcgcgccaccgagcctagatatcctccacattcactatcataccccgtgcagattgctcggacccacactgacgtgggcctgttagaatatcaacatcacagccgggattacgccagtcatttaagccctggctcaatcatccaacctcagagaaggagacccagtcttctatccgagttccagccaggcaacgagcgttcacaggaactgcatttgcgccctgaatcccacagttacctcccggaactgggcaagtccgagatggagttcatagagagcaagcggccccggctggaactgttgccagacccccttttacggccttctcccctgttggccactggtcagcccgccggcagcgaggatctcacgaaggaccggtccctgaccggcaagctagaacctgttagtccacctagcccaccccatacagaccctgaactggagttggttccgccccgcttatcgaaggaggagctcatacagaacatggacagagtcgacagggaaatcacgatggtggagcagcagatcagcaagctgaaaaaaaagcagcagcaacttgaggaggaagctgcaaagcctcctgagccagagaaaccagtgtcaccccctccgattgagagtaaacatcggtctttggtgcaaataatttacgatgagaaccggaagaaggctgaagcagcccatcgtattttagagggactgggccctcaagttgagctgccgctgtataatcagccatccgatactcgtcagtatcacgagaacatcaagataaatcaagctatgcggaaaaagctcatactgtactttaagagaaggaaccacgcaagaaagcagtgggagcagaagttctgtcagcgatatgatcagctcatggaagcctgggaaaagaaggtcgagcgaatcgaaaacaatcctcgtagaagggccaaagagtccaaagtccgcgaatactatgaaaagcaattccccgaaattcgaaagcagcgcgagctccaggagaggatgcagcgcgtggggcagcgcggctcaggcctttctatgtctgctgcccgcagcgaacacgaagtgtccgaaataatcgacggtctttctgagcaggaaaacttggaaaagcagatgcgccagcttgctgttatcccaccaatgctgtatgatgcagaccagcagaggatcaagtttatcaacatgaacgggcttatggcagatccgatgaaagtttacaaagatcggcaggtgatgaatatgtggagcgagcaagagaaggagacattccgagaaaagttcatgcagcaccctaagaacttcggtctgatcgcctcttttttggagagaaagacagttgccgagtgtgtgctgtactactatttgaccaagaagaacgagaactacaagtcccttgtgaggcggagctatcgcagacgtgggaagtcccagcagcagcagcagcagcagcagcagcagcagcagcagcagcaacaacagccaatgcctaggtcctcccaggaggaaaaagatgagaaagaaaaagaaaaagaagcggaaaaagaggaggagaagcctgaggtcgagaatgataaggaagacctcttgaaggaaaagaccgatgataccagtggtgaggacaacgatgaaaaagaagctgttgcttccaaaggccgaaagactgctaattcacagggacgccgaaagggaagaatcactcgatcgatggctaacgaagctaactcagaggaagcaattacacctcagcagagcgcagagcttgcatcaatggaattgaatgagagtagcagatggacggaagaggaaatggagactgccaagaagggactcctggaacacgggaggaattggagcgcaatagctagaatggtaggcagcaagacggtttcacagtgtaagaacttctattttaattataagaagcgtcagaacttggacgagatcctccagcagcataaacttaagatggagaaagagaggaacgctcgtcgtaaaaagaaaaaagcccctgctgctgcttcagaggaggcagcattcccgccagtcgtcgaggacgaggagatggaggctagcggcgtatctggcaacgaagaggagatggtagaggaagcagaagccaccgtcaacaattcttcagataccgaaagtatcccttcaccacatactgaggctgcaaaggatactggccagaacggacccaagcctccagcaacactgggggctgacggacccccccctggcccaccgactccaccacctgaagacatccccgcccccacagaacccaccccggcctcagaagcgaccggggcaccaacacctcctccagctcctccgagcccttccgctccaccacctgtagtgcccaaagaggagaaggaggaggaaactgctgctgcccctccggtagaggagggcgaggaacaaaaaccacccgccgctgaggagctggctgtagataccggtaaagctgaggagccagtgaagtctgagtgtaccgaggaagcagaggagggtccagcaaaagggaaagacgccgaggcggcggaagccactgcagaaggagcattaaaggcagaaaagaaggaggggggaagcgggagagcaacaaccgccaaaagttctggcgctccccaagattccgactcatccgccacatgctcagctgatgaagtggacgaagctgaaggcggagacaagaataggctccttagtccaaggccaagcctcctaacccctactggggacccgcgagcaaatgcctctccgcaaaaacctctggacctgaaacagttaaagcaaagggctgctgcaattccacccattcaggtgaccaaggttcacgagcccccccgtgaggatgcagcaccaaccaagccagccccccctgctccaccacctccacaaaatctgcagcctgagtcagacgcccctcaacagcctgggtcatccccaagaggaaaatctaggagtcccgccccacctgccgataaggaggctgagaaaccggtattcttccctgcttttgccgccgaagcccagaagttacctggcgatcccccttgttggacgagcggtctgccgtttccagttcctcctcgggaggtcattaaagcttcaccccatgcaccagaccccagcgcgttttcctatgcacctcctggacaccccctgcccctgggactccatgatactgcacgacctgttcttcctaggcctcccaccatctctaacccacctcctctaatcagttctgctaagcaccctagtgtgctggaaagacagatcggcgccatctcccaaggcatgtctgtacaactccacgtcccttacagtgaacacgcaaaggccccagttgggccagtaaccatgggcctgccgctgccaatggatcccaaaaagttggcacccttttccggggtaaagcaagagcagctgagcccgaggggccaggctgggcctccggaatcgttgggcgtgccaaccgctcaggaggcctctgtcctcagaggaactgccctcgggtctgtccctggagggagtattaccaaagggataccatcgacacgcgtaccgagcgactctgcaatcacctaccgaggttccattacacacgggacacctgccgatgtcctgtataaaggcacaatcacgaggattattggcgaagactctccgagcagactcgaccggggcagggaagattctctgcctaagggccacgtgatctacgaaggcaaaaaaggccacgtcttaagttacgagggcggcatgtccgtgacccagtgttcgaaggaggatggacgaagttcttcaggccctcctcacgagacggctgctccgaagcgcacctacgatatgatggagggccgggtgggacgtgccatctcaagtgcgtctattgaaggcctgatgggccgggcgatcccccctgagcgacattcacctcaccatctaaaggaacagcatcacatccggggatccattacccaggggatcccgcgatcatacgtggaggcccaggaggattatttgcggcgggaggctaagctgcttaagagggagggcaccccacctcccccaccaccctctagagacttgactgaggcttacaagacacaggcactgggccctttgaagttgaagcccgcccacgagggactggttgctaccgtcaaggaggcaggccggagcatacatgagattcctcgagaagagctgagacacacacctgagcttccccttgccccgcggccattgaaggaaggatccataacgcaaggaactcctctgaaatatgataccggcgcaagcaccactgggtccaaaaagcacgacgtgaggagcctaatagggtcccccgggcggacttttcctcctgtgcaccctctcgatgtaatggccgacgctcgcgccctggagcgagcctgctatgaggagtccttgaagtctagaccaggcactgcatccagctctgggggctcgatcgccagaggcgccccagtgatcgttcctgagttaggcaagcccagacagagcccactaacttacgaagaccatggggcgccttttgcaggccacttacctcgaggatctcccgttaccacaagagagccaacgcctcgcctgcaagagggaagtctgtctagctccaaagctagccaggaccgcaagcttacatctaccccacgcgagatcgcaaaaagcccccattccaccgttccagagcaccacccgcatcctatatccccttatgagcacctcctgagaggtgtgtcaggagttgatctgtacagatcacacattccattagccttcgatccaacctctatccctagagggattccgcttgacgcagccgcagcatactatctgcctaggcacctggccccaaacccaacctaccctcatctgtacccaccgtatctgatccggggttatccagacacagcagcccttgagaaccgccaaaccatcattaacgattacattactagccagcagatgcaccacaatgccgcgactgctatggctcagcgggccgatatgttaagaggcctctcccccagggagtcctctctggcgttgaattacgcggcaggccctagaggcattattgatctgtcccaagtgcctcatctcccagtactggttcctcccacacctggtactccagcgacagcgatggaccgcctcgcttatctgcccaccgctccgcagcctttctcctccaggcactctagttcccccttgagccctggcgggccaacacatttgacaaagccaacgaccacctcttcgagcgagcgcgaaagagatcgtgacagagagcgagatcgagacagagaaagagagaaaagtatattgacctctacgactacggtcgagcatgctcctatctggcgccccggcaccgaacagtcatccggctcaagcggcggaggcggaggatcctcttctagacctgcctcccattcccatgctcatcagcatagtccgatctccccacgcacccaggatgctctgcaacaaaggccatccgtacttcataacactggtatgaagggtataatcaccgctgtggagccaagcacacccactgtcctaaggtccacctcgacatcatcccctgtgcgtcctgcagctacatttccgcctgcgacccactgtcctttagggggcaccctcgacggagtctacccaactctaatggagccagtattactgcccaaagaagcccctagggtggctcgccccgagaggcccagggccgacactggacacgcctttttggcgaagccaccggcccggtccggcctggaacctgcttccagcccaagtaagggatcagaacccaggcctctggttcccccagtgagcggccacgccacaatcgcccgcacaccagccaaaaacctcgcacctcatcacgcctccccagacccgcccgcaccccctgcatctgccagcgatccacacagagagaaaacccagagcaaaccgtttagtattcaggagctggagcttcgatcactgggctatcatgggagctcttactcaccggaaggagtggaacctgtctcccctgtctcttcacccagcctgactcacgataagggcctccctaaacatctggaggagttggataagtcacaccttgagggcgagctgaggcccaagcagcccggacctgtgaagctgggtggagaggcagcccatcttccacacctcagacccctgcctgagtctcaacctagcagtagccccctattacagaccgcccctggggtaaaggggcatcagcgcgtagtgacactggcgcagcatatatccgaggtaatcactcaggactataccagacaccatcctcagcagctgagtgcacccctgccggcacccctttactcattcccaggagcttcttgtccagtgctggacttgagaaggcccccttcggacctataccttcccccccccgatcatggagccccggcaagggggtcaccacacagcgagggcggcaaacgctctccagagccgaataagacgagtgtactgggaggcggcgaggacggcattgaaccggtatcaccacctgagggcatgaccgagcctggccattcaaggagtgccgtttaccctctcctttacagagatggcgagcagaccgagccctctagaatgggtagtaaaagtccaggcaataccagccagccccccgcattcttttccaaactaacggagtctaattctgctatggtgaaatctaaaaaacaggagatcaacaagaaactgaatactcacaacagaaatgagcccgagtataatatctcccagccaggcactgagatttttaatatgcccgccattactgggaccggcctcatgacttatcgcagccaagcagttcaagagcacgcatctacaaacatgggcctggaagctatcataaggaaggcccttatgggcaaatacgaccagtgggaggagagccctcccttgagcgctaatgccttcaacccacttaacgcaagcgcctctttgccagcagccatgcctatcaccgcagcagatggacggagcgatcataccctgacttctcccgggggtggggggaaggccaaggtgagtggccgaccatcctcaaggaaggcaaaatcccctgcccctgggcttgctagcggcgataggccgccaagtgtgtcttcagtgcactccgagggggattgcaacagacgcacaccactgactaatcgcgtctgggaagatcgtcccagttccgcgggttcaactccttttccttataacccacttatcatgagacttcaggcaggtgttatggcgagccctccaccccccggcctgcctgccggttccgggcctctggccggcccccatcacgcctgggacgaagagcctaagccactgctctgctctcaatacgagacactgtcagacagtgagtag

SEQ ID NO: 126933 - DNA, 7542 bp, Artificial Sequence
  Description of Artificial Sequence: Synthetic coding sequence
atgagcggctctacccagcctgtggcccagacttggagggccactgagccccggtaccctccccacagcctcagttaccccgtccagatcgcacgtactcacactgacgtgggccttcttgagtaccagcaccactcaagagactacgccagtcatctgagcccggggagtattatacagccgcaacgcaggcgaccatctttgttaagtgaatttcagccaggaaatgagcgtagccaggagttacatctcagaccggaatcacattcgtatctccctgagctaggcaaatccgaaatggagttcatagaatctaagaggcccaggctggagctattgcctgacccacttttgaggccgagcccattactagccaccgggcagccagctgggagtgaggatcttacaaaagacaggtccctcaccggcaaattggagcccgtctcaccacccagcccaccccatactgacccagagctagagcttgtgccgcccagattgagcaaggaagagctcatccagaatatggatagggtggatagagagattacaatggtggaacaacagatctcaaaactgaaaaagaaacaacagcagcttgaggaagaggcagccaaacctcccgaaccggagaaacctgtgagccctcctcctatcgaaagcaaacaccgatctctggtacagattatctacgacgaaaatcgcaagaaggcagaggctgcacatcgaatattagaggggctggggccccaggtagagttgcctctgtacaatcagccctctgacaccagacagtaccatgagaacattaaaatcaatcaagccatgcgaaagaaactgattctctactttaaacgacgaaatcacgcccggaagcagtgggaacagaaattctgccagagatacgatcaactcatggaggcctgggagaagaaggtggagagaatcgaaaacaacccgaggcggcgggcaaaggaatctaaagttcgcgagtattacgagaagcagtttcccgagattaggaaacagcgcgagctccaggagagaatgcagagccgagtgggccagagaggcagcggcctcagtatgtctgctgcaaggtccgagcatgaggtaagcgagatcatcgatgggctgtctgagcaggagaatctggaaaagcagatgaggcagctggctgtaatccctccaatgctctacgatgctgaccaacaacgcatcaaattcattaacatgaatggcctgatggcagacccaatgaaggtgtacaaggacagacaggtgatgaatatgtggtcagaacaggaaaaagagactttcagggagaaattcatgcagcatccgaaaaattttgggttgatcgcaagctttctcgaacggaagacagtagccgaatgcgtgctctattattacctcaccaaaaaaaacgagaattacaaatctctggttcggagaagctataggcgtcgaggaaaatcacagcagcaacaacaacagcagcagcagcagcagcagcagcaacagcagcaacccatgccacgaagctcccaagaagagaaagatgagaaggaaaaggaaaaggaagccgagaaggaggaggaaaagcctgaagtcgaaaatgacaaagaggatttattgaaggaaaaaacagacgacacctctggcgaagacaacgatgagaaagaggccgtcgcttctaaaggccgcaagacggccaattcacagggacgtaggaagggacgcatcaccaggtcaatggccaatgaggctaactccgaggaagccatcacccctcagcagtccgcggaactggcatctatggaactcaacgaatcgtcaaggtggaccgaggaggagatggagaccgccaaaaaaggcctgttggaacacgggaggaactggagtgctattgcaaggatggtgggatcgaaaactgtgagtcaatgtaagaatttttacttcaactacaaaaagcggcagaatctagacgagatattgcagcagcacaagcttaaaatggagaaagagcgaaatgcgagaagaaagaagaaaaaagctccggctgcagctagtgaagaagctgcgttccctccggtggtcgaagacgaggaaatggaggccagcggagtgtcagggaacgaggaagaaatggtggaagaagccgaggctctgcacgccagtggtaacgaagtccctagaggggagtgctctggccctgccacggttaacaattcctccgatacagaatctattccctccccccataccgaagcagccaaagatacaggccagaatgggcccaaaccacccgcaaccttgggagccgacggccctcctcccgggccacccacccccccaaggaggacctctcggccaaccgagccgacccccgcttcagaggctaccggcgcccctactccacctccagcccctccctcccccagtgctcccccacccgtcgtccccaaagaagaaaaggaagaggaaaccgcggccgccccacccgtcgaggaaggagaggagcagaagccaccggcagcggaagagctggctgtcgacacgggtaaggcagaagagcctgtgaagtcagaatgtactgaagaagcagaagagggccctgccaaaggaaaagacgccgaagcagcagaggccaccgcagagggggccctcaaggccgagaaaaaggaaggaggttcgggcagagcaactacggctaaaagttcaggcgctcctcaggattcggattcctcggcaacatgtagcgctgacgaggttgacgaggccgaaggcggagacaaaaacagactcctctctccccgccccagtctgctcacaccaactggggaccctcgcgccaacgctagccctcagaagcccctggacctgaagcaactgaaacagagagctgctgcaattcctcctatccaggttactaaggtccacgaacccccacgagaagatgcagcccccaccaagccagccccgcccgcgccacctccccctcaaaatctgcagccagaatcggacgccccgcagcagcccggctccagtccccgagggaaaagccgctcaccagctccacctgccgacaaggaggcatttgcagccgaggcccaaaagctgccaggtgacccgccatgctggaccagcggcctaccgtttccagttccgcctcgagaagtcattaaagctagtcctcatgccccagatcccagcgctttctcctatgccccacccggacaccctctccccttggggctccatgataccgcccggcccgtgctacctcgcccccccaccattagtaatcccccacccctcatctcttccgcgaagcatccttctgtcttggagcgtcaaataggcgccatctcacaggggatgagcgtgcagctgcatgttccttactcggaacacgctaaggcgcctgtgggcccggtgacaatgggactgcccttgcctatggatcctaaaaaactagctcctttttccggcgtaaaacaggagcaactttctccgcgcggacaggccgggcctcccgaaagcttgggggtccccacagcccaggaggcgagcgtcctgcgcgggactgccctgggcagcgtgccgggcggctcaatcaccaaggggatcccttccactcgtgtgccctctgacagcgccatcacttaccgcggctcgattacacacgggactcccgccgacgtgctttataagggcaccattacaagaattatcggtgaagacagtccctctaggttggaccgcggacgggaggatagcctgccaaaaggccacgtcatctatgaaggcaaaaaaggccatgtgttgagctatgaaggaggcatgagcgtgactcaatgctccaaagaggatggccgctcatcctcaggcccaccccacgaaaccgctgctccaaagaggacatacgacatgatggaaggtcgggtgggccgcgccatcagctctgcctctatagagggattgatgggcagggccataccaccggagcgtcatagtcctcatcatctgaaagaacagcaccatatccgcggctcaattacccagggcataccgcggtcatatgtcgaggcacaagaagactacctgaggcgagaggccaagctgctgaaaagggagggtaccccgcccccgcccccacccagtcgggatctgactgaggcctataagacgcaggccctgggcccactgaaactaaaacctgcccacgagggcttggtggccactgtgaaagaggccggaagatctatccatgagattcctcgggaagagctccgtcacacccccgagttgccactcgcccccaggcctctgaaggaggggtccatcacccagggcacccctctcaagtacgacacaggagcgtccactaccgggtctaaaaagcacgacgtacgtagccttatcgggtcccctggacggacctttccaccggtgcatcctctggacgtcatggcagacgcgcgcgcattagagagagcctgctatgaggaaagcctgaagagtagaccaggaactgctagctcttccggcggctctattgcccgcggagcccccgtgatagtccccgagcttggcaaaccccgccaatccccactgacatatgaagatcacggggcgccctttgccgggcatctccccagaggctccccggtgaccactcgcgagccaactcccagactgcaagaagggtcactcagcagctccaaggcgtctcaagatcgcaaactcacctctactccccgcgaaatcgctaaatcaccgcactccaccgtcccggagcaccacccacatccgatctccccctacgaacacctactgcgtggggtttccggagtcgatctgtatcgctcgcatattccacttgccttcgacccaactagtatcccacggggcataccactggacgcggctgcagcatactaccttccccgacacttagctcccaaccccacttatccccacttgtaccctccatacctcatacgtggttatccggacaccgccgctctcgaaaacaggcagactataatcaacgactatattactagtcagcagatgcatcacaacgcagcaacagctatggcgcaacgtgctgatatgctgagaggactatccccacgcgagtctagtctagccctcaattacgcagccgggccaagggggataattgatttatcccaggtgccacatctgcctgtcctggtgccacctactcccggtacccctgctactgccatggatagacttgcttatctaccgactgccccccagcctttctctagcagacatagttcgagtcctctgagtcctggtggtcccacccacctgacaaaacccactaccacctcttccagtgagagggaacgcgaccgggatcgggaaagagacagggatcgggaacgggaaaagtccatattaactagcacaactacggtagagcacgcgcccatctggcgacccggaacagagcagtcaagtgggtcctccggcggaggcgggggttccagcagccgtccagcaagccactctcatgcacatcaacactcaccaatttccccaagaactcaggacgcgttgcagcagcgaccaagcgtattgcacaataccggcatgaaaggcattatcaccgctgtcgagccttccacccccactgttctacgctccacctcaacatcatcacctgttcgccccgccgctaccttccccccagctacccactgtcccctgggaggtaccttagatggcgtctatcctactctcatggaacccgtcctcctccctaaggaggctcctcgggtcgctaggcctgagagacctagagccgacacaggccatgcctttctcgccaagcctcccgcgagatcaggcctcgagccagcttcatcaccatcaaaggggagcgaacctagacctcttgtgccgcctgtctctggccatgccaccattgcaagaacccctgccaaaaatttggcgccacaccatgcctccccggacccaccggccccgccagcttccgctagcgacccacaccgggaaaagacccaaagtaagcccttcagcatccaggagctggaacttcgcagcctcggttaccacggcagctcttacagccctgagggtgtagaacccgtcagcccagtttccagtccttccctaacacacgacaaaggcctgccaaaacatctggaagaactcgacaagtcccatctggaaggggagttacggcctaaacagcctgggccggttaaactcggcggtgaggccgctcacttacctcaccttagaccactccctgaatcacagcctagtagtagccccctcctccagacagcccccggagtgaagggccaccagcgcgtggtgactctggctcaacacatttctgaagtgattactcaggattacacacggcatcatcctcagcagctgtccgctcccctccccgcccctctttatagctttcctggagcttcctgccctgtcctggatctccggcgacccccatctgatctgtatctgccccccccggaccacggtgctccagccaggggctcaccacattcagagggcggaaagagaagccccgagcccaacaaaacatcggttttggggggaggcgaggatggaatcgaacctgttagtccccctgaaggtatgaccgaaccaggccacagccgatctgccgtctatccgctcctatacagagacggagagcagactgaaccctcacgtatgggctccaaatcccccggtaacacctctcagccaccagctttcttctctaagctcacggaatccaatagcgctatggtcaaaagtaaaaaacaagagataaacaagaagctgaatacacataaccgcaatgaacccgagtacaatatctcccagccgggcactgaaatcttcaacatgccagctattaccggtacggggctgatgacatacaggagccaagcagtccaagagcacgcctcgacaaacatgggcctggaggccattatccgcaaggctctgatgggcaaatatgatcagtgggaggaaagcccccccttaagtgccaacgctttcaaccctcttaatgcttctgcatctcttccggccgccatgcctataacagctgccgacgggcggagtgaccacaccctcacatctcctggaggcggaggaaaagcaaaagtgtctgggagaccctcgagcagaaaagccaaaagtcccgcacccggccttgcctccggggatcggccaccttctgtgtcatctgtgcactcggagggcgattgtaaccgtagaacccctctgaccaatagggtctgggaagacaggccatccagcgcggggtcaacacctttcccttataatccactgatcatgcgtctccaagcgggggttatggcgagtcccccaccacctggccttcctgcaggctctggaccactggcaggaccccatcacgcctgggacgaggagcctaagccgctgctctgttctcagtatgaaaccctctcagactcggagtag

SEQ ID NO: 126934 - DNA, 1821 bp, Artificial Sequence
  Description of Artificial Sequence: Synthetic coding sequence
cttcagagcggggctacacactgccctctgggagggacccttgacggggtgtatcctactctcatggagccagtgctccttccaaaagaggccccacgtgttgcgcgaccggagcggcctcgggccgacacaggtcatgcttttctggcaaaaccccctgctaggagcggcctcgagccagcctcttccccatccaagggctctgagcccagacctttggtgccgccagtgtctggccatgctaccattgctcgcactcccgcaaaaaatttagcccctcaccatgcttcccctgacccgcccgcaccccccgcttcggcatctgatccccatagggagaagacgcaatcaaagcccttttcaatacaagagctggaacttaggtccctgggttatcatggaagttcatattccccggaaggagtagagccagtgtccccggtgagctcccctagtttaacgcacgacaagggactacctaaacatctagaggaattggataaaagccacttggaaggcgagctgcgtccgaagcagcccgggcctgtgaagcttggcggggaggctgcacatctgccacatctgaggccattgcctgagtctcagcccagcagctctccgctgcttcaaacagcacctggggtaaaaggtcatcagcgcgtggtcacattggctcaacatatctccgaggtgataacccaggactatactcgccatcacccacagcaactgagtgcacccctccctgcgccgctgtacagctttcctggagcaagctgccctgtgctcgacctccggcgccctcctagcgacctgtatttaccccctcctgatcatggggcacccgctcgggggtccccacattcggaagggggcaagcgatctcctgaacccaacaaaacttctgttcttggaggcggcgaggacggcattgaacccgtatccccgcccgagggtatgactgaacccgggcatagccggtctgctgtataccccctgctgtaccgcgatggcgagcagacagagccctccagaatgggcagcaagagcccaggtaacacttcccaacccccggctttcttctcgaaactaaccgagtccaacagcgctatggtgaaatctaaaaagcaggagattaacaagaagttgaatacacacaatcgaaatgagcctgagtacaatatttctcagcccggtacagaaatttttaatatgcctgcaatcaccgggaccggactgatgacgtatcgcagtcaagctgttcaggagcatgcctccactaacatgggtctggaagccatcataagaaaggctttgatgggcaaatacgaccagtgggaagagtctcctccgctctctgctaacgcctttaaccctctgaacgcctccgcttcattgccggccgccatgcccattactgctgccgacggccgcagcgatcacactctcacctcacccggcggaggcggtaaagccaaagttagtggccggccctctagccggaaggccaaaagccccgccccagggttggcgagcggtgaccgccccccttctgtcagttctgtgcactccgaaggcgattgtaaccggcgaacccctctgacaaatcgggtgtgggaagatcggccgtcaagcgccggctccacgccatttccttacaatccactaatcatgagactgcaggccggagtgatggcctcccccccacctccgggcttacccgcaggcagcggcccccttgcaggtccccaccacgcctgggacgaagagcccaaaccgctgctgtgttcacagtatgaaacactcagcgattctgaatag

SEQ ID NO: 126935 - DNA, 726 bp, Artificial Sequence
  Description of Artificial Sequence: Synthetic coding sequence
atgttctactcaggattactgaccgagggaggccggaaagagacagacatgcgtgaggccgcctcgctgagacagcagcgcaggatgaagcaggcggtccaattcatacataaggacagcgcagacctcctgcctctggatggtcttaagaagctggggagttccaaagacatgcagccccataacattctccaacgaagattaatggagactaatctctctaaactccggagcggtcctcgagtaccatgggcttcaaagaccaacaaactgaaccaggctaaatcagaaggcctcaaaaagtcagaagaagacgacatgattctagtgtcatgccagtgcgccggcaaagacgtaaaggcccttgtcgacaccggctgtctgtataacctgatcagcctcgcttgtgttgacaggttgggcctgaaggagcacgttaagagtcataagcatgagggggagaagttgtcgctccccagacacctgaaggtggttggacagatagaacatctggtgatcacactgggatccctaaggctggattgtccggcagctgtagtcgatgacaacgaaaagaatctaagtctgggcctccagacgctgaggtcccttaagtgcataatcaacttggataaacatagactcatcatgggtaaaaccgacaaggaggaaatcccatttgtggagaccgtgagccttaatgaagacaacacttcagaggcctag

SEQ ID NO: 126936 - DNA, 774 bp, Artificial Sequence
  Description of Artificial Sequence: Synthetic coding sequence
atgtctacctcacagcctggagcttgcccctgccaaggtgccgcctctcgcccggccatcttgtatgccctgctatcttcaagtcttaaagccgttccacgcccgcggtctagatgtctgtgtcgacagcatagacctgtccagctgtgtgccccacaccggacctgtcgagaagccctagatgttttggccaaaactgtcgcattcctccgaaacctgccttccttctggcagctccccccccaggaccagcggcggcttctgcagggatgctggggccctctgtttttgctgggtctggcccaggacgcggtgacattcgaagtggcagaagcccctgtaccttcgatcctgaaaaaaatcttactcgaagagccgtcttcgtctggggggtcaggtcagctgccggaccggccccagccatctctggctgctgtgcagtggctgcagtgttgtctagaatccttttggtctctcgagttgagtcccaaagagtacgcctgccttaaagggaccattctctttaatccagatgttcccggattacaggcggcctcacacattggccacctgcagcaagaagctcactgggtgctgtgcgaagtgcttgagccctggtgcccggcagcgcagggcaggctgactagggtgctcttaaccgcaagcacgctgaaatcaatcccaaccagtttgctgggcgatctgtttttcaggccaatcataggagatgtcgacatagctggcctcctgggggacatgctgttgcttagatag

SEQ ID NO: 126937 - DNA, 1845 bp, Artificial Sequence
  Description of Artificial Sequence: Synthetic coding sequence
atgaccactctagactcaaataataataccggaggggtgatcacatacatcggtagctccgggtcatctccgtcacgtacatcacccgagagcctgtattcagataactccaatggttcctttcagtccctgacccaggggtgtcccacttattttcctccttcacccaccggcagcctcacgcaggacccggccaggtcgttcggctcaattccgcctagcttgtcagatgatgggagccccagcagcagttccagtagctccagctcatcttctagcttttataatggttcacctccaggctcccttcaggtggctatggaagactcttcaagagtgtctccgtccaagtccacatctaatatcactaaattgaacgggatggttctgctctgtaaggtatgcggcgacgttgcgtcaggatttcactacggcgtgcacgcttgcgagggatgtaaagggttcttcaggcgatctatccagcagaacatccagtacaagcgctgtcttaaaaacgagaactgttccatagtgcggatcaacagaaatagatgccagcagtgcaggttcaagaaatgcctgagtgtagggatgtcacgggatgccgtgcgtttcggccggatacctaagcgggagaagcagcggatgctggccgaaatgcaatcagcaatgaatctggcaaataaccagctgtcatctcagtgcccactggaaacaagtcctacacagcaccccactccaggacctatgggtccatcgcctcccccagcccccgtaccttcccctctggtcggattttctcaatttccacagcagttaactccgcctaggtcacctagcccggaaccaactgtggaggatgtgattagtcaagtagctagggctcaccgcgagatctttacctacgctcacgataaattgggctcatcacctggtaatttcaacgcaaaccatgcctcaggttccccccctgccaccacaccccacaggtgggagaatcaaggttgccctcctgcgcctaatgataacaatacactggccgcccagagacacaatgaagcactaaacggtctgagacaagccccttcttcatatccccccacgtggccacctggccctgcacatcatagctgccaccagtcaaactccaacggccatagattatgccctacccacgtttacgccgcccccgagggcaaagcccctgccaattctcccagacaaggcaattccaagaacgtgctgctggcttgtccaatgaatatgtacccgcacggtcggagtggtagaaccgttcaagaaatatgggaggacttctctatgagcttcacgcctgccgttagagaagtcgtggaatttgcgaaacatattcccggtttcagagatctcagccagcacgatcaagtgaccctccttaaggccggcacgttcgaggtgctcatggtcagattcgcctctctgttcaatgtaaaggaccagaccgtgatgttcctgagcaggacaacttatagtctgcaggaactgggagccatgggaatgggcgatctgctttctgctatgtttgacttctctgagaagctgaattccctggccctcaccgaagaggagctaggtctgtttacagcagtagtcctagtgagcgcggatagatctggaatggagaactccgcatcagtggaacagctgcaagaaacccttctgcgcgcactgagggccctggttctcaagaatcgccccttggagacaagtagattcacaaaattattgctgaagcttcctgatctgcggacattgaacaacatgcatagcgagaaactcctctccttccgcgttgacgcccagtag

SEQ ID NO: 126938 - DNA, 1383 bp, Artificial Sequence
  Description of Artificial Sequence: Synthetic coding sequence
atgagctcccccactacttccagtctcgataccccactgccaggaaatgggcctccacagcctggagcaccctctagtagccccaccgtcaaggaagaaggcccagagccctggccgggcggccctgatccagacgtccctggtacagacgaagctagcagtgcgtgctctacagattgggtgatccccgatcccgaagaagaacccgagagaaaaaggaagaaaggtcctgccccaaagatgctcggtcacgagctttgccgggtctgcggtgataaagcatctggcttccactataacgtgttgtcctgcgagggctgcaagggcttctttcggaggagcgtagtgaggggcggcgcacgtcgctatgcttgtaggggtggtggcacctgccagatggatgcatttatgagaaggaaatgccagcagtgcagactccggaagtgcaaggaggcaggcatgcgtgaacagtgtgtgctgtctgaagagcagatacggaagaagaagatcagaaagcagcaacaggaatcacagagtcagtcccagagccccgtggggccccagggtagtagttccagcgccagtggcccaggtgcgtcccccggaggcagcgaagccgggagccaaggatctggagagggggagggagtgcagctgaccgcagcacaggagctgatgatccagcaactggtcgcagcccaactgcagtgtaataaaaggagctttagcgatcaacccaaggtgactccttggccactcggagccgacccacagtcaagagatgccaggcaacagcggttcgcgcattttactgaacttgctatcatttctgtccaggaaatcgtcgacttcgctaagcaagtgccgggatttctccagctaggcagagaagaccagattgccctgctgaaggcttccaccatcgaaataatgcttttggaaacggcaagacggtacaaccacgagacagaatgcataacctttctcaaggattttacatactctaaggatgactttcaccgggctgggctgcaggtagagttcatcaaccctattttcgagtttagcagggctatgagacgcttgggtctggacgacgccgagtacgctctgctgattgccattaatatcttctcggccgataggcccaatgtgcaagagcctggaagggttgaagccctccaacagccttacgtggaggctctcctatcatatacccggatcaagagaccacaggatcagctgagattccctaggatgttgatgaaactggttagcttgaggactttgagcagtgtgcatagtgagcaggtcttcgcccttcggttacaggacaagaagctgcccccactgctcagcgaaatttgggacgtgcacgagtag

SEQ ID NO: 126939 - DNA, 1377 bp, Artificial Sequence
  Description of Artificial Sequence: Synthetic coding sequence
atgagctcgccgacaacctctagtctggacacgccgcttcctggaaatggaccaccccagccgggcgccccctctagtagtcctaccgttaaagaagaagggccagagccctggcctggcgggcccgatccagacgtcccgggtaccgacgaggcgtccagcgcctgtagcactgactgggtcatcccggaccccgaagaggaacctgagcggaagcgaaagaagggacctgctccaaagatgctgggacatgagctttgccgagtctgtggggacaaggcttccggattccattacaacgtgctatcttgcgaaggttgcaaagggttcttccgcaggagcgtggtgagagggggcgctcgacgctatgcatgccggggcggaggcacatgccagatggatgccttcatgagaagaaaatgccaacaatgccgtctgcggaaatgcaaggaggccggaatgcgggaacagtgtgtcctctccgaggaacagatccggaagaaaaagatacggaagcaacagcaagagtctcagagtcagagccagtcccccgtcggacctcaggggagttctagtagcgccagtggccccggagcctcacccggcggttctgaggcaggcagccagggatccggggaaggagaaggagtacagctgacagccgcccaggagctcatgatacagcagctggttgccgcccaactccagtgtaacaagaggagcttttcagatcagccaaaagtgaccccttggccactgggagctgaccctcagagccgggatgcccgtcagcagagattcgcccatttcaccgaactcgctatcatttccgtgcaagaaatagtggacttcgccaagcaagtccccggctttctgcagttgggcagagaggaccagattgccctcctgaaggcgagcaccatcgaaatcatgcttctggagaccgcccgtcggtataatcatgagacggagtgcataacctttttgaaggattttacatactcgaaagacgattttcatagagctggcctccaggtcgagtttatcaaccctatttttgaattttctagagctatgagacgcctcggcctcgacgatgccgagtatgcactcttaatcgccattaacattttcagcgcagacagacctaacggcgctggcccccgcgggggtgtggcggctgcactgcgaggcggcgctgctgtgctgcacgcccaccaagaagctgcggatcagcttaggttcccgcgtatgttgatgaaattggtcagccttcgaaccttaagctctgtacactccgaacaggtatttgcgctgcgattacaggacaagaagttaccaccactgttgagcgaaatatgggacgtccatgagtag

SEQ ID NO: 126940 - DNA, 1092 bp, Artificial Sequence
  Description of Artificial Sequence: Synthetic coding sequence
atgtccagtcctaccacctcctccttggacacaccactacctgggaacggtccaccccagccaggcgctccgagtagtagccctaccgtgaaggaggaagggcctgagccatggccaggcgggcccgatcctgacgtacctggtaccgatgaagctagcagtgcatgttcaaccgattggggtgttctatccgaagagcaaatccgaaaaaaaaagattaggaaacaacagcaggagagccagtctcagtcacaaagtcccgtaggcccgcaagggtcctcttcttctgcttccgggcctggggcaagcccgggcggctcggaagccggatcacagggctccggcgaaggagagggagtccaattaacagccgcccaagaactgatgatccagcaattggtggctgcacagctgcagtgcaacaagagaagcttctccgaccagccaaaggtgacaccctggcccctaggtgctgacccgcaaagtcgggacgcacgccagcaacggtttgcacactttactgaattagccataatctctgtgcaggaaatcgtggattttgcaaagcaggtgccgggatttttgcagctcggtcgggaggaccagattgcccttttaaaagcatcgacgatcgaaatcatgctcctggaaacggcaagacgatacaatcatgagacagagtgcattacctttctgaaggacttcacctacagtaaagacgattttcaccgggctggtctgcaagtggaatttataaacccaattttcgaattttctcgggccatgaggaggctcggcctggatgacgccgaatatgctctcctcatagccatcaacatttttagcgcagaccggccgaatgtccaggagcccggtagagttgaggcgctgcagcagccctacgtggaggccctcctgtcatacacccggatcaaacgaccacaggaccagctcaggtttcccagaatgttaatgaagctggtgtccctccggacactttcatctgtgcactctgagcaagtctttgcgctcaggttgcaggacaagaaactcccgcccctgctgagtgagatatgggatgtacacgagtag

SEQ ID NO: 126941 - DNA, 576 bp, Artificial Sequence
  Description of Artificial Sequence: Synthetic coding sequence
atgatacaacagctcgtggcagcccagctgcagtgcaacaagcgaagcttttcagatcaacctaaagtcaccttgggcagggaagatcagatcgcactgcttaaggccagcaccatcgagatcatgctgctggaaaccgccagaagatacaaccacgagactgaatgtattaccttccttaaggattttacctatagcaaagacgatttccacagagccggccttcaggtcgagtttattaaccccatctttgaatttagtagggccatgcgtagactgggtctcgacgacgctgagtatgcgttgctcatcgccatcaacatcttctcggccgatcggcctaacgtccaggagccagggcgggtggaagctctccagcagccctacgtggaggcactgctcagctacaccaggatcaagcgcccccaggatcagttgaggttcccccgaatgctgatgaagcttgtgtctttaagaactctgtcaagtgttcactccgagcaagtgtttgcactgcgcctgcaagacaaaaagctgcccccacttctgagcgaaatctgggacgtgcacgagtag

SEQ ID NO: 126942 - DNA, 1422 bp, Artificial Sequence
  Description of Artificial Sequence: Synthetic coding sequence
atgaccgtgacacggacgcaccactttaaggagggcagccttagagcaccagccatccccctccactcagccgctgcggaactcgcttcgaaccaccctagagggcctgaagcgaatttggaggtcaggccaaaggaaagctggaaccacgcagacttcgtgcactgcgaggataccgaatctgtgcccggtaaacctagcgtgaacgccgatgaggaagttggagggccgcaaatatgtagggtgtgtggcgataaagctacagggtatcatttcaatgtaatgacctgcgaaggatgtaagggctttttccggagagctatgaagcggaacgctcgcttgagatgccccttcagaaaaggcgcttgcgagattactcgcaagacaaggcgtcagtgtcaggcctgtcggctcagaaagtgcctggagagtggaatgaaaaaagagatgataatgtccgatgaggccgtggaagaacgcagggcacttattaaacgcaaaaagtcagaaagaaccggaacgcaacccctgggtgtgcagggtctgactgaggaacagaggatgatgatccgagagttaatggacgcccagatgaagacctttgatactacctttagtcactttaaaaattttcggctgcccggagttctgtcatccggctgcgaactccccgaatcacttcaggccccatctcgcgaagaagcagctaaatggagtcaggtgcggaaagacttgtgttctcttaaagtgtccctgcagctgcgaggagaggatggaagcgtttggaactacaaaccacccgccgattccggcgggaaggagattttttctctcctgccacacatggccgacatgagtacttatatgttcaagggcataatcagtttcgccaaggtgatcagctactttcgcgatctccctattgaagaccaaatatccctactcaagggggccgcctttgaactgtgccagctgaggttcaatactgttttcaatgcagaaaccgggacatgggagtgcggccggctgtcttactgtctcgaagatacagctggcggattccagcaactcctcctggagccaatgctgaaattccattacatgctgaagaaactgcagcttcacgaggaggagtatgtcctcatgcaagccataagtctatttagccctgatagaccaggcgtccttcagcaccgagttgttgatcagttgcaggagcaatttgccattactctgaagagctatattgaatgtaaccggccgcagcccgcccacaggtttttgttcttaaaaataatggcaatgctcaccgagcttagatcaataaatgctcagcatacccagagactactcaggatacaggacatccacccctttgctaccccgctgatgcaagaactgtttgggattaccgggtcttag

SEQ ID NO: 126943 - DNA, 1305 bp, Artificial Sequence
  Description of Artificial Sequence: Synthetic coding sequence
ctggaggtgcgtcccaaagaatcctggaaccatgctgacttcgttcattgcgaggacacagagtctgttcctggcaaaccttcagtgaacgctgacgaagaggtgggtggccctcagatctgcagagtgtgcggcgacaaggctacaggatatcatttcaacgttatgacctgcgaagggtgcaagggtttttttcggcgagccatgaagcgcaacgcaagactccggtgtcccttccgcaaaggtgcctgtgaaatcacccgaaagacccggcgccagtgccaggcttgccggcttcggaagtgtctcgagtccgggatgaagaaagagatgattatgtcggacgaggctgtcgaggaacggagggcacttattaaaaggaagaaatctgagcggacaggaacccaaccactcggcgtgcagggcctaaccgaggaacagaggatgatgatcagagagctgatggacgcccagatgaagactttcgatacaaccttctcacattttaaaaacttcaggcttccgggtgtactgtcaagcggctgcgagctgcctgaatccttgcaggccccctctcgggaggaagctgcaaaatggagccaggtgcgtaaagacctatgctcattgaaggtgtcgctgcaactacggggtgaggacggatctgtttggaactacaaaccgcccgcggactcgggcggcaaggagatttttagtctgctacctcacatggccgacatgagcacttacatgttcaaaggaattattagctttgcaaaagttatcagttacttccgcgatttgcccattgaggatcagatctcactgttaaaaggggccgcttttgagctatgtcagcttcgtttcaatacagtcttcaatgctgagaccggcacatgggaatgtggtcgcctgagctattgcctagaagacacggccgggggttttcaacagctgttgctcgagccaatgctcaaatttcactacatgctgaagaaattacagctgcacgaagaagagtacgtcttgatgcaggccatatcactgttctcccctgaccggccaggggtgctccagcatcgagttgtggaccagctgcaggagcagttcgctattacattgaagtcttatatcgagtgtaaccggccgcaaccagcccaccggttcctgttcctgaagattatggccatgctgacagagctccggagcatcaatgcgcaacacacccagagactgctgaggatccaagatatccaccccttcgccactcccctgatgcaggaactgttcgggattaccggctcctag

SEQ ID NO: 126944 - DNA, 1194 bp, Artificial Sequence
  Description of Artificial Sequence: Synthetic coding sequence
ttggaggtgcgtcccaaagaaagctggaaccacgccgacttcgtacactgcgaagacacggaaagcgtgcctggaaaaccttcagtgaacgcggacgaggaagtgggtggcccacagatctgccgggtgtgcggtgacaaggccactgggtaccacttcaatgttatgacttgcgagggatgcaaaggatttttccggagggctatgaaaaggaacgctcggttgcggtgtccattcaggaagggagcatgcgaaatcacacggaaaactagaagacagtgtcaggcctgcaggctgcgtaagtgtttggagagtgggatgaagaaagaaatgataatgagtgacgaagccgtcgaggagcggcgcgccctcattaaacgaaagaagtcagagcggaccggcacccagccactaggagtccagggcctcactgaggagcagagaatgatgatccgcgagttgatggacgcccagatgaagacttttgacactacatttagtcactttaaaaatttcagggtgtctctacagctccgaggagaagacggttcagtttggaactataaaccacctgcagacagcggaggaaaggaaatcttctcccttctaccccacatggctgacatgtcaacatatatgttcaaggggataatctcattcgctaaggtaatttcatactttagagatctccctattgaggatcaaataagtctcctgaagggggctgcatttgagctgtgccaattgagattcaataccgtgtttaacgctgagactggaacatgggagtgcggtcgtctgagttattgtctggaggatacagcaggagggtttcagcaactgctgctcgaaccaatgctgaagtttcattatatgctcaagaagttgcaattgcacgaggaagaatacgtgctgatgcaggctatttcactctttagccccgatagacccggggtactacagcatcgggtggtggaccagctgcaagagcagttcgcgatcacacttaagtcctatattgagtgcaatcgaccccaacccgcccatcgatttctttttctgaagattatggccatgctcacagaactccgtagtattaacgcccaacatacgcagcgcctgttgcgcattcaagacatccatccttttgctacccctctgatgcaggagctgttcggaatcactggcagctag

SEQ ID NO: 126945 - DNA, 1848 bp, Artificial Sequence
  Description of Artificial Sequence: Synthetic coding sequence
atgacctctccgtcaccaaggatccagatcatcagtactgacagcgctgtcgcctcaccccaacgcatccaagggtctgaacccgccagtgggcccttaagcgtgttcacgagtttaaacaaggagaaaatcgtcactgaccagcaaacgggtcagaaaatccaaattgtaacggcggtggatgcaagcgggagtcccaaacaacagttcattcttactagtccagatggagctggcacaggaaaagtaatcctggcaagccctgaaacgagttcggctaagcagctgatttttaccactagtgataacttagttcctggacgaattcagattgttacagacagtgcctctgtggagcgcctgctcggtaaaacggacgttcagcggccccaggtagttgagtactgtgtggtttgtggcgacaaggcgtctggtaggcattacggggcggtgtcttgtgaaggttgcaaggggtttttcaaacgaagcgttaggaagaacctgacgtattcctgccgcagcaatcaggattgcatcattaacaagcatcacaggaaccgatgtcagttttgccggcttaagaaatgcttggaaatggggatgaagatggagtccgtgcagagcgaacggaagccattcgacgtccagagggagaaaccaagtaactgtgcagcttccaccgaaaagatatatattcgaaaggacttgaggagccctctgatcgctacgcctaccttcgtggcggataaagatggcgctcgacaaacgggcctcctggatccagggatgctggttaacatacagcaaccgcttatccgcgaggacggaaccgtgctgttagcgaccgattctaaggctgaaacaagtcaaggggctttaggaacactggcaaacgtggtgacttccctggctaacttgtccgaatctctgaacaacggcgacacctctgagatccagccggaggaccagtcagcctctgagatcactcgggccttcgacactttggcaaaggctctgaatacaactgactcatcatccagtccctcactggccgacggaattgacacgtcagggggcggcagtattcatgttatcagccgggaccagagcacacccataatcgaggtcgaagggcctctgttgtccgacacgcacgtgacttttaagctgacgatgccatcacccatgcccgagtatttaaacgttcattatatttgcgagtctgcgtcgagactactctttctgtccatgcattgggccagatccatccccgctttccaggctctgggtcaggactgcaacacttcccttgtgcgagcctgctggaacgagcttttcaccttaggtcttgcacagtgcgcacaagttatgtccctgtcgacaatccttgccgccatcgtgaaccaccttcagaacagcatccaagaggataaattgtctggtgaccgtattaagcaggtgatggaacacatctggaagctgcaggagttctgcaattctatggctaagctcgatattgatggctatgagtatgcctacctcaaggccattgtgctcttcagtccggaccatcccggcctgactagcaccagccagatcgagaaattccaggaaaaagctcagatggagttacaagattacgttcagaagacgtactcagaggacacatacagattagcgcgcatccttgtgaggctccctgccttgcgattaatgtcctcaaatattaccgaggagctgttcttcacgggattgattggaaacgtgtctattgacagtattatcccctatatactcaagatggaaacggctgaatataacggtcagattaccggggcttcactctag

SEQ ID NO: 126946 - DNA, 1791 bp, Artificial Sequence
  Description of Artificial Sequence: Synthetic coding sequence
atgacgagcccttcccccaggatacagatcatatctaccgatagtgctgtagcttcgccccaacggatccagattgtcacggatcagcagactggccagaaaattcagattgtgactgcagtggacgctagcgggagccctaaacaacaatttatcctcaccagcccagatggcgctggtaccggcaaggtgatcctggcaagccccgagacctcgtccgctaagcaactgatattcactacttcagacaatctggtgcccggccggatccaaatcgtgaccgattctgcctcagtagaacggctgctgggaaaaactgacgtgcagcggccccaggttgttgaatactgtgttgtgtgcggggacaaggcttccggcaggcattatggagccgtgagttgcgagggctgtaagggctttttcaagcgctccgtgcggaagaacctaacgtactcctgtcgatctaaccaggactgcataattaataagcatcacaggaaccggtgtcagttctgcaggcttaaaaagtgcctggagatgggaatgaagatggaatctgtgcagtccgagcgcaagcccttcgacgtgcagcgcgaaaagcccagtaactgtgctgcttctaccgaaaagatatatatcaggaaggatctcaggagtcccctgatcgccactcccaccttcgtagctgacaaagatggagccaggcaaaccgggcttcttgatccaggcatgctggtgaatattcaacagcctctgattagagaggatggaaccgtcttactggcaaccgactccaaggcagagacgagtcaaggagccttgggaacactcgctaatgtggttacctcgctggctaatctttcagagagtctaaacaacggggatactagtgagatccagcccgaggaccaaagtgcctcagagattacccgtgcctttgacactttggccaaagccctaaacactacggacagcagttcttccccctctttggccgatgggatagatacttcaggaggtggcagcattcatgttatttcccgcgatcagtcaacaccgatcatcgaggtggagggtcccctgctgtccgacacacatgttacctttaaattgacgatgcctagccccatgcctgagtatttaaacgtgcactacatctgcgagtctgctagtcggctgctgttcctcagcatgcattgggctcggtctattcccgctttccaggcccttggccaggactgcaacacaagtctggtccgcgcttgctggaacgagctattcacattaggcttggctcagtgcgctcaggttatgagtctgagcacaatcttagccgctatcgtgaaccacttacaaaactcaattcaggaggacaagctgagtggggatcggattaagcaggtgatggaacatatctggaaattacaggaattctgcaactccatggctaagctggatatcgacggatacgagtatgcttacctaaaggctatcgtgctcttttcacccgatcacccagggctgacgtcaaccagccagatcgagaaattccaggagaaggcgcagatggaacttcaagactacgtacagaagacttattctgaggacacctacagattggctcgcatactggttcgtttgcctgccctacggttgatgagcagcaacatcacagaagaattattctttacggggctgattgggaacgtgagcatcgattccatcataccatatattctaaagatggaaacagctgagtataacgggcagatcacaggcgcctcgctctag

SEQ ID NO: 126947 - DNA, 1791 bp, Artificial Sequence
  Description of Artificial Sequence: Synthetic coding sequence
atgacgagtccctctcctcgaattcagattatctctaccgacagcgccgtcgcctctcctcagaggatccagattgtgacagatcagcagaccggtcagaaaattcagattgtgacagccgttgatgcgtcaggctcgcctaagcaacagttcattctgacaagcccagatggggctgggacgggaaaagtcatcctggctagcccagagacttcctcagcaaagcagcttatttttaccacttctgataacctggtgcccgggcgaatacaaattgtgaccgatagcgcttccgtagagcgcttgttagggaaaaccgacgtacagagacctcaagtcgttgagtactgtgtggtctgcggggacaaggccagtggccgccactacggagccgtgagctgtgaggggtgtaaggggttctttaagcgttcagtgcgcaagaatctgacatactcctgccggtcgaatcaagattgtattattaataagcatcaccggaaccgttgccagttctgccgacttaaaaagtgcttggaaatgggcatgaaaatggaatctgtgcagtccgaaagaaaaccattcgacgtgcaacgcgaaaaaccgagtaattgcgcggcaagcacagagaagatatatatacggaaagacctgcgtagcccactgatcgccactcctacattcgtcgctgataaagacggtgccagacagaccggcttgctcgatccggggatgcttgtcaatatccagcagcccctgatccgcgaagatggaactgtgctgctggctaccgacagcaaggccgagacgagccaaggggcccttggcaccttagccaatgtagtcaccagcctggctaacctgtctgaaagccttaataacggggatacctccgagattcagcctgaggatcaatctgcatccgagatcactagagccttcgatactctcgcgaaagcgctcaacaccacagattcaagctcatctccttccctcgctgacggcattgacacctctggtggcggtagtattcatgtgataagtcgggaccagagcaccccaatcattgaggtagagggacccctactgtccgatacacatgttacctttaaactgacaatgcctagccccatgcccgagtatctgaacgtgcattatatctgcgaatctgcctctagactgctgttcctctctatgcattgggctcgatctataccagcatttcaggctctcggccaggattgcaatacttccctagtgcgggcctgctggaatgaactcttcacccttggactggctcagtgcgctcaggtgatgtccctctccacaatcttggccgccattgtgaaccatctccaaaacagtatacaggaggataaactgtctggagatcgcataaagcaggtgatggaacatatctggaagctgcaggagttttgtaacagcatggcaaagctggatattgatggttacgaatacgcctatcttaaagccatcgtgctgttctcccccgaccatcctggcttaaccagcacctcccagattgaaaagtttcaagagaaagctcaaatggagcttcaggactacgtgcagaagacgtattccgaggatacctacagacttgccagaatcctcgttcgactcccggcacttcgattgatgagttcgaacataacagaagaactgttctttactggtctgattggaaatgtttcaattgatagcataatcccgtacattctcaaaatggagacagcagagtacaatggacagataactggggcatctctttag

SEQ ID NO: 126948 - DNA, 1791 bp, Artificial Sequence
  Description of Artificial Sequence: Synthetic coding sequence
atgacctctccctcccctagaatccagataatcagcacggacagtgcggtagcatcacctcaaagaattcaaatcgtgaccgaccagcagaccgggcaaaagatccaaatcgtgaccgctgtggacgccagtgggagtccgaaacagcaatttattctgaccagtcccgatggggccggaactggtaaggtgattcttgcttccccagagaccagctccgccaagcagttaatatttacaacgtccgacaacctggtgccaggcagaatccagattgtgactgactcagcctctgtcgagaggctcctcggcaagactgatgtgcaacgcccccaggttgtcgagtattgtgtggtctgtggcgataaagcgtccggtaggcactatggcgccgtgagttgtgaaggctgcaagggctttttcaaacggtccgtccgcaagaatttaacatacagctgtcgctctaatcaagactgcattatcaataagcaccacaggaaccgctgccagttttgccgcttaaaaaagtgtctggagatgggcatgaaaatggaaagcgtacagtcggagcgcaaaccgttcgatgtgcagagagaaaagcctagcaattgtgctgcctcaacggaaaaaatatatatcagaaaggaccttaggagtccccttatcgcaactccaaccttcgtggccgacaaggacggggcccgtcagaccggcctgttggaccctggaatgctggttaatattcagcaacccctgatccgggaagatggtactgtgctcctcgccacggatagcaaggccgaaactagccagggcgcacttgggactctggcgaatgtggttacctcgttggcaaacctgagcgagagcctgaataacggagacacgagcgagattcagcctgaggaccagtccgcctctgagatcacacgagcttttgacaccctcgccaaggctctcaatactactgactcaagctctagcccctccctcgccgatggcattgacacttctggcggggggagtatccacgtgatttctagagaccaaagtacaccaatcattgaagtcgagggcccactcctgtccgacacccacgtgacgtttaagctgaccatgccctctccaatgccagaatacctgaatgttcactatatttgcgagtctgcctctaggctcctattcctctctatgcactgggcaagatctattcctgcgtttcaagctttggggcaggactgcaacacttctctggtccgggcttgttggaatgaactttttaccctgggccttgcccagtgtgcccaggtgatgagcctgtcaactatcttggctgccatcgtgaaccacctacagaacagcatccaggaggacaaactgtctggcgacaggatcaagcaagttatggagcacatttggaaacttcaggagttctgcaacagtatggcaaagttggatatcgacggatatgagtacgcttacctgaaggccattgtgctatttagtccagatcatcccggattgacatctacatcgcaaatcgaaaagtttcaagaaaaggcccagatggagctacaggactatgttcaaaaaacatactccgaggacacctacagactggcacggatattggtgcggttacccgccctgagactgatgtcgtccaacatcactgaagaacttttcttcacgggactaataggcaatgtcagcattgacagtattatcccctatatcctcaaaatggaaaccgcggagtacaatggacagattaccggagcgtcactgtag

SEQ ID NO: 126949 - DNA, 111 bp, Artificial Sequence
  Description of Artificial Sequence: Synthetic coding sequence
atgacatctccctcacctaggattcagatcatcagcaccgatagcgctgtagcctccccgcagaggattcagggctctgagcccgcttcgggcccactgagtgtattctag

SEQ ID NO: 126950 - DNA, 618 bp, Artificial Sequence
  Description of Artificial Sequence: Synthetic coding sequence
atgactagcccctcaccacgtatccagattatcagcacagactctgctgtagcttctccacagagaatccaggggtcagagcctgctagcgggccactgtccgtctttacctccctgaacaaggaaaagatcgtgaccgatcagcaaacggggcagaaaatccagatagttactgccgtggacgcctccggatcccccaaacagcagtttatccttaccagcccagatggtgcagggacgggcaaagtgattctggcaagccccgaaacatccagcgcgaaacagctgatctttaccacctccgacaaccttgttccaggtagaatccagatcgtcactgactcggcctctgtggaacggcttctgggaaagacggacgtgcaaaggccacaggttgtggagtactgcgtcgtatgcggcgacaaggcgtccggccggcactacggtgccgtttcttgcgaaggatgcaagggattcttcaagaggagcgtccggaagaacctcacatatagctgcaggtctaaccaggactgtatcatcaataaacatcatcggaatcgctgtcagttctgcagattaaagaaatgcctggagatggggatgaaaatggagtgttag

SEQ ID NO: 126951 - DNA, 1269 bp, Artificial Sequence
  Description of Artificial Sequence: Synthetic coding sequence
atgtttcgggcaggggccgagggcgctgagaaggaaccctcccctcggccggagtgtcgcgccgatcctggtcccggactgggtttcccccttgggtctggtttgccttggccatcgctgctagaaagcccgggcggaagaattctggatattccgtgcaaggtgtgtggggacaggtcgtccggaaagcattatggcgtgtatgcatgtgatggctgttccggattcttcaaacgctctattagaagaaacagaacatacgtatgcaagtccggcaaccagggcggatgtcctgtggacaaaacccatcgcaatcaatgccgcgcatgcaggctcaagaagtgcctggaagtgaatatgaacaaggacgccgtgcagcacgaaagagggccaagaacaagcaccattcggaaacaggtggcactgtacttccggggccacaaggaagaaaatggtgctgctgcccactttccttccgccgccctccctgcacccgcattcttcactgccgtcacgcagttagagccccatgggctggaactggccgctgtctctacaacaccagagaggcaaaccttggtttctttggcccagccgacccccaagtatcctcacgaggtgaacggaacccctatgtacctctacgaagtcgccacggagagtgtgtgcgagtctgctgccaggctgttattcatgtccattaaatgggccaagagcgtgccagctttttctaccctgtctctgcaagaccagctaatgctcctggaagacgcttggcgcgagcttttcgtgctggggattgcacagtgggcaatcccggtggatgctaacaccctgttggcagtgagcggcatgaatggtgataacacggactctcagaagcttaataaaataatctccgaaatacaggccttacaggaagttgttgccaggttccgtcagctgaggcttgacgccacagaattcgcatgcctcaaatgtatagtgaccttcaaggcagtccccactcacagtggcagtgaactgcgcagcttccgaaatgcggctgcaatcgcagcactgcaggacgaggctcaacttaccctaaattcatacatccacaccaggtaccctacacagccttgccgcttcgggaaattactgctcttgctgcctgccttgcggagcatttccccatctacaattgaggaggtgttttttaaaaagacaatcggcaacgtgcccatcacgagactgttgtccgatatgtacaagtcgagcgacatctag

SEQ ID NO: 126952 - DNA, 1158 bp, Artificial Sequence
  Description of Artificial Sequence: Synthetic coding sequence
atgtctaagcctgcaggctctacctcgaggattctggacatcccatgtaaggtctgcggggaccgctcatccgggaagcactatggagtgtatgcctgcgatggctgcagtgggttcttcaagcgctcaatcaggagaaaccgcacctacgtgtgtaaatccggtaaccaaggagggtgcccggtggataaaacacatcgcaaccagtgtagggcatgcagacttaaaaaatgccttgaggtgaacatgaacaaagatgcagtgcaacatgagcggggcccacgaacctctaccatccgtaagcaagtcgctctttacttccggggccacaaagaggaaaacggcgccgctgcacatttcccttccgccgccctgcctgcccccgcgttctttacagcggtaacacaattggaacctcatggactggaacttgcagctgtgagcactaccccagagcgccagaccctggtgtctctggcccaacccacccctaagtacccacacgaggtgaatgggacccctatgtacctgtacgaggtggccaccgagagcgtctgcgagtcggcggctagactcctttttatgtccataaagtgggctaagtcagttccagcattctccactctgagcttgcaggaccagttgatgttgttggaagacgcctggcgagaactgtttgttctaggcattgcccaatgggctattccagtggacgccaacactctcctggcagtcagcgggatgaacggagataacacagattcacagaaactgaataagatcatcagcgaaatccaggccttgcaggaagttgtggcgagatttagacagttgagactggatgcaactgagttcgcctgtttaaaatgcattgtgacgtttaaggcagtgcctacgcacagtgggtcagagctgaggtcctttcgaaatgctgcagccatcgccgccctgcaggatgaggcccagctgacactgaattcttacatccacaccaggtatcccactcaaccctgccgattcggtaagttattgctactcctaccagccctaaggagtattagccctagcaccatcgaggaagtcttttttaagaagaccattggcaatgttcctattacacgcttgctgtctgacatgtacaaaagttctgatatatag

SEQ ID NO: 126953 - DNA, 141 bp, Artificial Sequence
  Description of Artificial Sequence: Synthetic coding sequence
atgaataaagatgctgttcagcacgagcgaggccctaggacaagtactattcgtaaacaagttgcgctgtactttagaggacacaaggaggagaatggcgccgctgctcactttccaagtgctgctctgcccgccccatag

SEQ ID NO: 126954 - DNA, 1272 bp, Artificial Sequence
  Description of Artificial Sequence: Synthetic coding sequence
atggccatggtggtgagttcttggcgggacccccaagatgacgttgcaggtggtaaccctggcgggccaaatcctgctgcacaggcagctagagggggcggcggcggcgccggcgaacagcaacaacaggcaggcagtggggccccacacacacctcagacacccggacagcctggggcccccgctacgcctggtactgctggagacaaggggcagggcccgcctggtagtggccagagccaacagcacatcgaatgcgtagtgtgcggagacaaaagctctggaaaacattacggtcagttcacttgtgaggggtgcaagagctttttcaaacgctcagttcgacgaaacctcacgtatacttgccgcgctaacagaaattgcccaatcgatcagcaccacagaaaccagtgtcaatactgtaggctgaagaagtgcctgaaggtaggtatgcgcagggaagcagtgcagcgcggtcgtatgcctcctacacaaccaaacccgggtcagtacgcgctgacaaatggcgatccattgaatggccattgttacctgagcggatatatcagcctcctgctgagggcggaaccttatcccaccagccggtacggatcacagtgcatgcagccgaataacattatgggtatcgagaatatctgtgagctcgccgcacgtctcctcttctcagcagttgaatgggccagaaacattccttttttcccagatctccaaattacagatcaagtatcactactccgactaacttggtcggagctgtttgtgcttaacgccgctcaatgcagcatgccccttcatgttgctcccctattggccgctgccggccttcatgccagccccatgagtgccgaccgcgttgtggcattcatggatcacattagaattttccaggagcaggtggaaaagctcaaagctctgcacgtcgacagcgccgagtattcttgtttgaaggccattgtgctgttcacctctgatgcctgtggtctctctgatgccgcgcacattgaatctttgcaggagaagtcccagtgtgcacttgaggaatacgtccggtcacagtacccgaaccagccaagtcgcttcgggaagctgctgctcaggctgccatcactgcggactgtgagctctagtgtcatcgagcagttattttttgtgaggttagttggcaaaacgccaattgaaaccctgatcagggacatgctactgagtggaagctcatttaattggccctacatgtcaatccagtgttcttag

SEQ ID NO: 126955 - DNA, 1245 bp, Artificial Sequence
  Description of Artificial Sequence: Synthetic coding sequence
atggcaatggtggtgtctacctggcgggacccccaggatgaggtcccagggtcgcaggggagtcaagccagccaggcccccccagtcccgggtccgccacctggagcacctcacaccccgcagacccccggccaaggaggcccagcctctacgcctgcgcagaccgcagccggcggtcaagggggacccgggggccctggcagcgacaaacagcagcagcagcaacacatagaatgtgtggtttgcggggacaaaagtagcggtaagcattacggacagtttacatgcgaaggttgtaaatcctttttcaagcgtagtgtccggaggaatctgtcgtacacgtgtagagcaaacagaaattgccccatcgaccaacaccaccgcaaccagtgccaatactgcagactcaagaagtgtcttaaagttggtatgcgaagagaagcagtgcagagaggccgcatgccaccgacccaaccaacccatggccagttcgcactgaccaatggcgatcccctgaattgtcattcatacctgagtggatatatctccctgctgctgcgcgctgagccctaccctacttcacgctttggctcccagtgcatgcagcctaacaacatcatggggattgagaatatatgcgaactggccgctcgcatgctgttcagtgcagtggaatgggcccggaacatccccttctttcctgatctgcaaattactgaccaggtagcactgttgcgactgacatggagtgaactgtttgtgctgaatgcagcacagtgctcaatgccgctgcacgttgctcctctactggcagctgcaggactgcacgcatcgccaatgtcagccgatagggtggtggcttttatggaccatattagaattttccaggaacaagtggaaaagctcaaagcgctccacgtggactcagctgagtactcttgcctcaaggccattgttctttttacctctgacgcgtgtgggctgagcgacgtggcgcatgtggagtcccttcaggaaaagtctcagtgtgccctcgaggagtacgtgcgaagtcagtacccaaaccagccaactcggtttgggaagctgctgctgagactgccctctctgcgcacggtctcgtcatccgtcattgaacagctctttttcgtcagactagtgggcaagacaccaatagaaactttaattagggatatgttgttatcgggatcttctttcaactggccatacatggctatccagtag

SEQ ID NO: 126956 - DNA, 786 bp, Artificial Sequence
  Description of Artificial Sequence: Synthetic coding sequence
atgccaccaacacagccaacacatggacaattcgcccttaccaatggcgatcctctcaactgccacagttacttgtcaggttatatttcactcctcctcagagccgagccgtatccaacaagccggttcggtagccagtgtatgcaacccaacaacatcatgggcatcgaaaacatctgcgagctggccgcgcgcatgctgttctcagctgttgagtgggcaagaaatattccattcttccctgacctgcagatcaccgatcaggtcgcactccttaggctcacctggtctgagctgttcgttctgaatgctgcccaatgctccatgccattacatgtagcgcctttactggccgccgcaggactgcatgcgtcacctatgtctgctgaccgggtcgtggcattcatggatcacattcgaatattccaggagcaggtggagaagcttaaggctcttcacgttgattctgctgagtacagctgcctgaaggctatcgtcttgtttactagcgacgcctgcggcctgagtgatgttgcgcacgttgagtcattacaagagaaatcacagtgtgcgctcgaagaatacgtacgctcgcagtatcccaaccagcctactagatttggaaagctcctgttacggctgcccagcctcagaaccgtgagtagctcggtgattgagcagttattttttgttaggttggtaggcaagacaccaatagagacactcatacgcgacatgcttctgtccggctcatcatttaattggccctatatggctattcagtag

SEQ ID NO: 126957 - DNA, 846 bp, Artificial Sequence
  Description of Artificial Sequence: Synthetic coding sequence
atgcaagctgtctgggacctggagcagggcaaatatggcttcgccgtacagagggggaggatgccacccacacagccaacacacgggcagtttgctctgaccaacggtgacccactgaactgccattcctacctaagcgggtatatctccctcctgctaagggccgagccatatcctacctcccgcttcggaagtcaatgcatgcagccaaataacatcatgggaattgagaacatttgcgagctggctgcacgcatgttgtttagtgccgtggagtgggcccgtaacatacccttttttcccgacttgcagatcacagatcaggtggcactactccgtctgacctggagcgaattgttcgtcctgaacgcggcccagtgttccatgcccctccatgtggccccactgcttgcagccgctggccttcatgcctccccaatgtcagcagaccgggtggtagcgtttatggaccacattaggatattccaagaacaggttgaaaaattaaaggctctgcacgtggactcggctgaatacagctgtttaaaggccatcgtgttgtttacctccgatgcttgtggcctctcagatgtggcccatgtcgaatcactacaagagaaatcccagtgcgctcttgaggaatacgtgcggagccagtaccctaaccagcccacacgcttcggcaagctgctcctgaggctgccctccctccgcaccgtatcgagctccgtgatcgagcagttgttcttcgtacggctagttgggaagactcctattgaaaccctcatccgggatatgcttctatctggcagcagctttaactggccctatatggccatacaatag

SEQ ID NO: 126958 - DNA, 786 bp, Artificial Sequence
  Description of Artificial Sequence: Synthetic coding sequence
atgcctccaacgcagccaacgcacggccagttcgccctgaccaacggtgatcccctgaattgtcactcctacctatctgggtatatcagcctgctgctgcgggcagagccctacccaacgtcgcggtttggatcccagtgcatgcagccgaacaacataatgggtatcgaaaacatctgtgaactagcagccagaatgctctttagcgccgtggagtgggcccgaaatatcccttttttccccgatctgcagattacagatcaggttgcgctgcttaggttgacctggtccgagctgttcgttctgaacgcagcccagtgttcgatgcccctccacgtcgcccccttgttggccgcggcaggactgcatgcgtcacctatgtccgcagacagggtcgtggcctttatggaccacattcgcatcttccaggagcaagtggagaaactaaaggcactacatgtggacagcgcggaatattcttgtctcaaggcaatcgtcctgttcacctcagacgcatgcgggctgtctgacgtcgcgcacgtggagagcctgcaagagaagagtcagtgtgctctggaggaatatgtcaggtcgcagtaccccaaccagcctaccaggttcgggaagctgctgttgaggctgcccagcctgagaactgtaagctcctcggtgattgagcaactatttttcgtgaggctggtaggaaagaccccaatcgagaccctgatccgggatatgctgctgagcgggagcagcttcaattggccttatatggcgatccagtag

SEQ ID NO: 126959 - DNA, 1215 bp, Artificial Sequence
  Description of Artificial Sequence: Synthetic coding sequence
atggcaatggtcaccgggggctggggaggccctggaggggataccaacggggtagacaaagccggcggataccccagagcggcggaggatgactctgccagtccacccggcgccgcttctgatgctgagcccggcgacgaggagcgaccgggtctccaagtggactgcgtggtctgcggcgataagagctctggtaagcattatggtgtcttcacctgcgagggatgcaagagcttttttaagaggagcatacgacgcaatttgagctatacctgtagaagcaaccgagattgccagatcgatcaacaccaccggaatcagtgtcagtactgccgccttaaaaagtgttttagagtgggcatgaggaaggaagccgtccagcgcggccgcatcccacatagccttcctggtgcggtggccgcttctagcgggagcccgcccgggagcgctttagccgccgtggcctctggcggtgatttatttcctggacagccggtgagtgaactgatcgcccagctgctgcgtgccgagccctatcctgccgccgcaggacgtttcggggcaggtgggggagccgctggagctgtccttgggattgacaacgtgtgtgaactcgctgccagactcctgttttcaactgtggagtgggctcggcacgcccctttcttccccgagctccctgtggccgaccaagtggccctgcttcgtctctcctggtctgagcttttcgtgctaaatgccgcccaggcagccttacctcttcatacggctcctctgcttgccgcagccgggctgcacgccgctcctatggcggctgagcgagccgtggcctttatggatcaggtcagagcctttcaggaacaggtggataagcttggaaggctgcaggtcgattcagcagagtacgggtgccttaaagctatcgcactgttcaccccagatgcctgtgggttgtcagacccagcccatgtggaatcccttcaggaaaaagcccaggtcgctctgactgagtatgtccgtgcccagtatccgtcccagcctcagcgattcggacgcctgctacttagacttcccgctctgagggcagtgcctgcctccctgataagccagttgtttttcatgcgcctagtgggaaaaacccctattgagaccctgatacgcgatatgttgctgagcggtagcaccttcaactggccttatggcagcggacagtag

SEQ ID NO: 126960 - DNA, 1134 bp, Artificial Sequence
  Description of Artificial Sequence: Synthetic coding sequence
atggctatggtcacggggggctggggcggtcccgggggagacgctgagccaggcgatgaagaaagacccggccttcaagtcgactgcgttgtctgcggggacaaatctagtggtaagcactacggagtatttacatgcgaaggttgcaagagtttctttaagcggagtatccgcaggaatcttagctatacctgtcggagcaatcgcgactgccagatcgaccagcatcaccggaaccaatgccagtattgcagactgaagaagtgcttccgggttgggatgcgtaaggaagccgttcagcgtggaagaattccccatagtctccccggggctgtcgctgcctcaagcggctccccccctggatctgcactggccgccgtggccagcgggggggacctcttcccaggacaacctgtgtcagagctcattgcccagctgctgcgcgccgagccctaccccgccgccgctggccgctttggggccggcggaggagcagcgggagccgttctggggatcgacaatgtctgcgagcttgcagctaggctgctgttctcgacagtggagtgggcaagacacgctccattcttcccagaactgcctgtggcagaccaagtagcacttttgcgtttgtcctggagcgagttgtttgtccttaatgcagctcaggccgcgctgcccctccacacagcccctttattggccgcggctgggttgcacgccgcgcctatggcagccgagcgcgccgtagccttcatggatcaagttagagcttttcaggagcaggtcgataagctggggcggctgcaggtggatagtgctgagtacgggtgtttgaaagcgatcgcattattcactccagatgcttgtgggctctcagatccggctcacgtggagagcctgcaggaaaaggcacaggttgcgcttactgagtatgtaagggctcagtacccctcccagccgcagcggtttggccggctcctgctcaggctgcctgccctcagagccgtgcctgcttcacttatttctcagctctttttcatgcggctagtgggaaagacccccatcgagaccctcattagggacatgctgctatccggctcaacattcaactggccctacggttccggacaatag

SEQ ID NO: 126961 - DNA, 2121 bp, Artificial Sequence
  Description of Artificial Sequence: Synthetic coding sequence
atggagactaagggctatcactcccttccggaaggtctagatatggaaagaagatggggacaggtgagccaagccgtggagagaagctcactcggtccaactgagaggaccgacgaaaacaactacatggagatagtaaacgtaagttgcgtgtctggcgcgatccccaataacagcacccagggctcaagcaaggagaagcaggagcttctgccctgcctgcagcaggacaacaataggcccggcattttgacatctgacatcaaaacagaattggagtctaaggagctgtccgccaccgtcgcagagtccatgggactgtatatggatagtgtgagggacgccgactacagctacgaacaacagaaccagcaggggagtatgtcacccgctaagatctatcagaacgttgaacagcttgtcaagttttacaaaggaaatggccaccgaccttctaccttatcctgtgtgaacacaccgctgaggtcgttcatgtccgactctggatccagtgtcaacggcggcgtgatgcgcgccgtggtgaaatcgccaattatgtgtcacgagaagtcccctagcgtttgctcacccttgaacatgacgtcttccgtatgctcgccagcaggcatcaacagtgtttcctctactaccgcaagctttggaagcttccctgtccattctccaatcacacagggtacgcctctgacctgcagccccaacgtggaaaatagggggtctagatctcattccccagcacatgccagcaatgtgggaagccccttatcatctcctctgtcctccatgaagtcgtccatttccagccctccttctcactgctctgtgaagtccccggtgtcaagccccaacaatgtaacactccgaagtagcgtgtcttcccccgcaaatatcaataattcacgctgcagtgtgtccagcccaagtaataccaacaaccgaagcaccctcagctccccggcagcatcgaccgtcgggagcatatgctccccagttaataatgctttctcttacaccgctagcgggactagtgcaggttccagtaccttgagggacgtggtcccttcaccagatacacaggaaaagggagctcaggaggtgccttttcccaaaaccgaagaagtggagagcgccataagtaacggcgtgaccgggcagcttaacatcgttcaatacattaaaccggagcccgatggcgccttttcatccagttgcttgggcggcaatagtaagatcaatagcgattcatccttttctgtccccatcaaacaggaatccactaaacactcatgctccgggacgtccttcaaaggtaacccaactgtgaacccgttcccgtttatggacggatcttatttctcgttcatggacgacaaggactactattctcttagcggtatcctgggacctcctgtcccaggcttcgacggcaattgcgaggggtccggtttcccagtcggtatcaaacaggagcctgatgacggttcatattacccagaggcttcgattccatcttctgctattgtgggggtgaattccgggggccagtcgttccactacaggatcggcgctcagggcaccatctccctctctcggtcagctagggatcagtcgttccagcacctttcatccttcccacccgtcaacacgttagtggagtcatggaaatcccacggtgacttgtcttccagaagaagtgacggttatccggtgctagaatacatcccagaaaatgtgtcatcatcaacattaagatcagtgtctacaggctcttcacgaccttcaaaaatttgcctcgtctgcggcgatgaagcttccggatgccactacggcgtggtgacctgcggatcctgcaaagtgtttttcaaacgggccgtggagggacaacataactatctctgtgcgggaagaaacgactgcatcattgataagatccgtcggaagaactgccccgcatgcaggctgcaaaagtgcctgcaggccggcatgaatctcggggaaaggcggtgtatcagcctcccctgtatgaattacgctcgggggtgtactaagtctgctttttcgtcatttgactgttcctctcccctgaagaacactccatcgtag

SEQ ID NO: 126962 - DNA, 2955 bp, Artificial Sequence
  Description of Artificial Sequence: Synthetic coding sequence
atggagacaaagggctaccactcgctgcccgaaggcttggacatggagagaaggtggggccaggtgtcacaagccgtcgaaagaagtagcttaggtcctaccgaacggaccgacgaaaacaattatatggagatcgttaacgtgtcctgtgtctctggcgcaatccccaataactccactcagggaagttcaaaggaaaagcaggagctgctcccttgtctgcagcaggataataataggccaggcattctcacttcggatatcaagactgaactggagtcaaaggaactgtcggcgacagtggctgaaagcatggggctttacatggactccgtcagggacgcggattattcttatgagcaacagaaccagcaaggaagcatgagccccgcaaagatatatcagaatgtggaacagctggtgaagttttacaaggggaacgggcatcggccctctacattgtcttgtgtaaacaccccactcagaagctttatgtccgactctgggtccagcgttaatggcggagtcatgcgggcagtagtcaagagtcctattatgtgccatgaaaaaagtccctcagtatgttcccctctaaatatgactagctccgtttgttccccggccggcatcaacagcgtgagttcaacaacggcttcatttggttcgtttccagtgcattctccaatcacccaaggcactccactgacatgcagcccgaatgtggaaaatagggggtctaggtcacattccccggctcacgcctcgaatgtgggatccccgctgtcaagtccactgtcctcgatgaagtccagtatcagctcgcctcccagccattgcagcgtgaaaagtcctgtgtcttccccaaataacgtaaccctcaggtcctctgtctcgagccctgctaatatcaacaatagcagatgcagcgtgagcagtccttcaaatacaaataatcgcagcaccctgtccagccccgctgcttccacggttgggtccatctgttctccagtgaataacgcttttagttatacagcttcaggcacatctgccggcagctccaccctgcgagacgtcgttccatctccagatacccaagagaagggggcacaggaggtaccgttccctaaaactgaagaagtagagtcggccatttctaacggcgtgacgggacagctgaacatcgtgcagtacatcaagcctgagcctgacggtgcattcagctccagctgcttggggggcaatagcaagattaacagcgattcttctttttccgtccccattaagcaggagtctaccaagcacagctgttcaggaacttcattcaaaggaaaccccactgtaaacccattccccttcatggacggttcttactttagtttcatggacgacaaagactactactcattgtctgggatcttgggaccacccgttccagggtttgacggcaattgtgagggctctggattcccagtgggaattaaacaggaaccagatgatggaagttactatcctgaagcctctattccgagtagcgcgattgtgggcgtgaactctggcggccagagcttccattaccgaataggtgctcagggaaccatctccttgtcccgttctgctagagaccaatcatttcagcacctgagctcctttccccccgtcaatacattagtggagagttggaagagccacggggacctcagctctcgacggtccgatggttacccagtgctggaatacatccccgagaacgtgagctcctcaacactcagatccgtgtccaccgggtcctcccgaccaagtaagatttgcctggtttgtggggacgaagcgtcagggtgtcactacggcgtggtaacctgcggcagctgcaaggttttcttcaagcgcgccgtcgagggccagcacaactatctgtgcgcagggcggaatgactgtataattgataaaataaggaggaaaaactgtcctgcatgcaggctacaaaagtgcctgcaagccggtatgaatctgggtgctaggaagtctaaaaagcttggaaaactgaaaggcattcatgaggagcagcctcagcaacagcagccaccaccaccccccccacctcctcagtccccagaggaggggaccacgtacattgctccagccaaagagccatcagtcaacaccgcgctagtgccccagttgtccaccatcagcagagccttaaccccaagccccgtgatggtactggaaaatatcgaacccgagattgtttacgctggatacgactcatccaaacccgatacggcggaaaatttattgagcaccctgaacaggctcgcagggaaacagatgatacaagtggtcaagtgggccaaagtgctgccagggttcaagaacctgcctctggaggatcaaataaccttgattcagtacagctggatgtgtttgagcagcttcgcactttcatggaggtcttataagcacactaatagtcagttcctttattttgccccggatctcgttttcaatgaggagaaaatgcatcagtcggctatgtatgaactctgtcagggtatgcaccagattagcttacagtttgtgagactgcagctaacattcgaagaatacaccatcatgaaggtgctgcttcttctttccaccattccaaaagacggactgaaatcccaggcagcatttgaggaaatgaggaccaactacataaaagaacttcggaagatggtgacaaaatgtccaaataactccggacaatcttggcagcggttctaccagcttactaagcttctagacagcatgcatgacctggtgtccgacctccttgagttctgtttttatacatttcgcgagtcgcacgccttgaaggtggagttccccgccatgcttgtggagattatttcagatcagctgcccaaagtggaatcaggcaacgccaaaccattgtatttccaccgaaagtag

SEQ ID NO: 126963 - DNA, 2967 bp, Artificial Sequence
  Description of Artificial Sequence: Synthetic coding sequence
atggaaactaaagggtatcactcccttcccgaaggacttgatatggagagacgctgggggcaggtgtcccaggctgtggagcgctcaagcctgggcccaaccgagagaacagacgagaacaattacatggagatagtgaacgtctcgtgcgtcagcggcgcgatacccaacaacagtactcagggatcatcaaaagaaaagcaagagctccttccatgtctccagcaagacaataatcggcctggcattctgacatccgatataaagacagagctagagtcgaaggagctctccgcaacagttgccgaaagtatgggcttatacatggactctgttcgggacgctgattactcttatgaacagcaaaaccagcagggatctatgtctcccgccaaaatctatcagaacgtagagcaacttgtgaagttctacaagggaaatgggcaccgtccatctactttaagctgtgttaacaccccactccgcagcttcatgtccgattcgggatctagtgtaaatggcggcgttatgcgggcagtggtcaagtctccaataatgtgccatgagaaatcccccagcgtctgctctccattgaacatgaccagctctgtgtgctctcccgccggcatcaactcggtcagctctaccactgcctcgtttggaagctttcctgtccattctccaattacccagggaactcccttaacctgcagtccaaatgtcgagaatcgcggatcaaggagtcactcccccgctcatgccagtaacgtcggtagtcctcttagtagccccctgtcctctatgaaaagtagcatcagcagcccaccgagccactgttctgtaaaatcacctgtaagttcccccaataatgtgaccttgcgatctagtgtgtcctctcccgctaatatcaacaactctcggtgcagtgtctcctctccatcaaataccaataacagatcaacactatcttcacctgcggcctcaaccgtgggctcaatctgctctcctgttaacaatgcattctcttatacagctagcgggacatcagccggctccagtacgctccgggacgtggttcctagccctgatacacaggagaagggggctcaggaagtgcctttccccaagacggaggaagtggagtccgcaatcagcaatggtgtgacagggcagctgaatatagtgcaatacatcaaaccagaaccagatggcgcgttctccagctcttgtctcggggggaacagtaaaattaatagtgacagcagcttctcggtgcccatcaaacaggagtctactaagcatagttgctcgggtacatctttcaaggggaatcctacggtcaatcctttccctttcatggatgggtcatacttcagtttcatggatgacaaagactattattctctttccggcatcctgggacctcccgtgcctgggttcgacgggaactgcgagggaagcggttttcccgtgggaatcaaacaggagccagacgatggctcatattatcccgaagccagcattccaagtagtgccatcgtaggcgtgaactccggtggccaatcctttcattataggataggggcccagggcacaatttccttgtccaggagtgcccgggaccagtcattccagcacctctcttccttcccaccagtgaacactctcgttgagtcatggaagtcccatggagacctgagtagtagacggtcagatgggtaccctgttctggagtacattccagagaatgtgtcttccagtacactgagatctgtgagcacaggctccagtcgacccagcaaaatatgcctcgtatgtggagacgaggcatccgggtgccactatggcgtggttacctgtggaagctgcaaggtgtttttcaagagggctgtggagggtaaatgttcatggcagcacaactatctgtgcgccggaagaaatgattgcattatcgataaaatacggagaaaaaactgtccggcttgtcggttgcaaaaatgtctgcaggcagggatgaacttaggagccagaaagtcgaagaagctggggaaactgaaagggattcacgaggagcagcctcagcagcagcagcctccacccccgcctcctccacctcagtccccggaggaagggactacttatattgcccccgcaaaagagccctccgtcaacaccgcgctggtaccacagctatctaccattagtcgcgctctgacaccctcacctgtgatggtgctcgagaacatcgagccggagatcgtctatgcggggtacgattcaagtaaacccgacactgctgagaatctgctatctacgctgaacaggttggccggtaaacagatgattcaggtggttaagtgggcaaaggtcctccctgggtttaagaatctgccactcgaggaccagatcacgcttatacaatactcctggatgtgcctttctagcttcgccctgtcttggcgctcttataaacacactaattcccagtttctttatttcgcaccagatctggtcttcaatgaagagaagatgcaccagtccgcaatgtatgagctgtgtcagggaatgcatcaaatctccctgcagtttgttcggcttcagctcacgttcgaagagtacactataatgaaggtgcttcttcttctgtcaacaattccaaaagacgggcttaaaagtcaggctgccttcgaggagatgcggactaactacataaaggagctgcggaagatggtcacaaagtgtccgaataactctgggcagtcgtggcagaggttctatcaactaaccaagctcttggactcaatgcatgacctcgtcagtgatcttctagagttttgcttctatactttccgcgagagccatgctttaaaagtggagtttccagcaatgctggtggaaattatttcagaccaactccccaaagttgaaagcggaaacgccaaaccactctatttccatcgaaagtag

SEQ ID NO: 126964 - DNA, 2955 bp, Artificial Sequence
  Description of Artificial Sequence: Synthetic coding sequence
atggagaccaagggataccacagtttaccagaaggtttggacatggaacgccgatgggggcaagtctcacaggcggtggaaaggagctcattggggcccaccgagcgcaccgacgagaataactatatggaaattgtcaatgtaagctgtgtgagtggagcaatcccgaacaacagcacacaagggtcttccaaggaaaaacaggaattgctgccttgtctccagcaggacaacaatcggccaggcatcctgacatccgatataaagacagaactggagtctaaggagctctctgcgactgtggctgaatcgatgggactatacatggattctgtcagggacgcagactactcctatgagcagcagaaccagcagggatccatgtcccctgcgaaaatctatcaaaacgtggaacagctcgttaagttttacaaaggaaacggacaccggccatccacattgtcctgcgtgaacacaccacttagatcatttatgtcagactctggttcctccgtaaacggcggagttatgcgggcagtagtgaagagccccatcatgtgccacgagaagtccccatcagtgtgcagcccacttaacatgacctcctccgtttgcagtcctgccggaattaattctgtgtctagcaccaccgcctccttcggctctttcccggtccactccccaattacccaggggacaccgctgacgtgctcacctaatgtggaaaacagaggaagccgctcacactcaccagcgcatgcttcaaatgtgggctcgccgctgtcctccccactgtcttcaatgaagtcttccattagtagtcccccctcccactgtagcgtgaaatcccctgtgagtagtccaaacaacgtcactctgaggtcctccgtgagcagccctgccaatatcaataattctcggtgttcagttagctctccatcaaatacaaataatcgctccacactgtcatcaccagccgccagcaccgttggttccatttgttccccggtaaacaacgcctttagctacactgccagcgggacctccgctggttcgagtacgctgagagatgttgtcccatcccctgacacccaggaaaagggggcccaggaggtgcccttcccaaagacagaggaggtggagagcgcaatctctaatggcgtcaccggccagctcaacatcgtccagtatataaagccggaaccagatggcgcattctcttcttcttgcctggggggaaattccaagatcaattcggactccagtttttctgtgccaatcaaacaagaatccacgaaacactcctgttctgggacatcattcaaagggaacccaaccgttaaccctttccccttcatggatggctcctatttttcctttatggatgacaaggactattacagcttgtcggggatccttggccctcctgtgccaggatttgatggaaactgcgaggggtccgggttccctgtgggcattaaacaggagcccgacgatggtagctactatcctgaagcttcaatcccatcttctgcaattgtcggagtcaatagcggggggcagagtttccactatcggatcggcgcacagggtacaataagcctctcaagaagcgctagggatcagtcgtttcagcatctgagctccttccctcctgtgaataccctagttgagagctggaagtcgcacggggatctaagcagccgcaggagcgatggttaccccgttctggagtatattcctgaaaacgtgagcagttccaccctgcgatctgtttccacaggttcatcccgtccctctaagatctgtttagtatgcggggacgaggcctcaggctgccattatggggtggttacttgcggtagctgcaaagttttttttaagcgtgctgtggaaggccagcataactatctgtgtgccggcaggaacgactgtataattgataaaattaggaggaagaattgtcctgcatgccgattacagaagtgtctgcaagcggggatgaatctcggggcaaggaaatctaaaaagctcggaaaattgaagggcattcacgaggaacagccgcagcagcaacagcctcctccaccacctccgccaccacagtcccccgaggagggcacaacttatattgccccggctaaggagccatcagtcaacacagcgctggtcccacagctgtccacaattagcagagccctgactccatcacccgtaatggtactggaaaatatagagccggaaatcgtgtatgctggctatgacagcagcaagcccgacacagctgagaatctgctgtctacattaaaccgtcttgcaggtaaacagatgatccaggtagtgaaatgggctaaagtgctgccaggcttcaagaatctccctctggaagaccagatcaccctgattcagtacagttggatgtgtctgtctagctttgctctcagctggcgctcttacaagcacacaaactctcagtttctttattttgcccctgacctggtctttaacgaagagaagatgcaccagtcggccatgtatgaattatgtcagggcatgcatcagatttccctgcagttcgtgaggctgcagttgacatttgaagaatacaccatcatgaaagttctgctcttgctgagcaccatccccaaagacggacttaaaagccaagccgcattcgaggaaatgaggaccaattatataaaggagttgcgaaagatggtgacaaaatgcccaaacaattccgggcagagctggcagcgattctatcagctgaccaagttgctcgactcaatgcatgatctcgtttctgatctcctggaattttgtttctataccttcagggaaagccatgctctcaaagtagagttccctgctatgctggtggagattatctccgatcaattgcccaaggtggagtctggtaacgcaaaacctttgtatttccatcgcaaatag

SEQ ID NO: 126965 - DNA, 2967 bp, Artificial Sequence
  Description of Artificial Sequence: Synthetic coding sequence
atggagaccaaaggctaccactcacttcccgaaggactggatatggaaagacgctgggggcaggtgagccaggccgtcgaaaggagttcgctgggccccaccgagcggacagatgaaaataattacatggaaattgtaaacgtctcatgtgttagcggtgccattcctaataatagcacccagggctcaagcaaagagaagcaggagctcttgccgtgtctccagcaggacaacaacagacctggcattctgactagcgatatcaaaaccgaattggagagtaaggaactgtccgccactgtggccgaaagtatgggcttatatatggacagtgttcgggacgctgactacagttacgaacagcagaatcagcaaggtagcatgtcccctgctaaaatttatcagaacgtcgaacagctagtgaagttctacaaaggaaatgggcacaggccgtcaacactttcctgcgtcaacacaccactgcggtccttcatgtctgattccggctccagtgttaacggaggcgtaatgcgcgctgtggtgaagagccctatcatgtgtcatgaaaaatcaccgagcgtgtgcagccctctgaacatgaccagcagcgtgtgtagtcctgccgggatcaactctgtgtcatctacgaccgcttcttttggctccttcccagtgcactctccgatcacccagggtacgcctcttacatgttcgcccaacgtggagaacagggggtctcggagccacagcccagctcacgcatcaaatgtgggttccccactgtcatcaccactgtccagtatgaagtcttcaatcagctcgcctccctctcattgtagtgttaagtcccccgtctccagccctaataatgttacactgcgatcctccgtgtccagcccagccaatatcaacaattcacgatgctccgtgtctagcccatccaacactaacaatcgatctaccctgtcgtcgcccgcggccagtaccgttgggtcaatctgcagcccagtgaacaatgctttttcctatacggcaagcgggacgagcgcaggaagcagcaccctccgagacgtggtccccagcccagacactcaagagaagggggctcaggaagtgcctttccccaagaccgaggaggtcgaaagtgctatatccaatggggtgaccggccagctgaatattgtgcagtacatcaaaccagagccagacggcgcattctctagtagttgcctcggcggcaactcaaaaatcaatagtgatagttccttctcagtgcctatcaaacaagaatctaccaaacactcatgctccgggacttcttttaagggaaatcctacagtcaaccccttcccattcatggacgggagctatttcagcttcatggatgacaaagactactacagtctgtccggcatcctcggaccgcccgttcccggcttcgatggaaactgcgaggggtcaggcttccctgtgggcataaaacaagaaccggacgatggttcttactatcccgaagcgtccatcccctcttccgccatagtgggcgtcaacagcgggggccagagtttccactacagaattggagcccaggggactatctctctgtctcggagcgctagggaccagagcttccaacacctctcaagctttccccctgtaaatacgctggtggaatcctggaagagccatggagatctatcctccaggcgatccgacggctacccagttctagagtatatcccagagaatgtgtcttcttccactttgcgctccgtgtctacaggcagctcccggcccagcaagatatgcctcgtctgtggcgatgaggcttcgggctgccactacggagtggttacatgcggctcgtgcaaagtgtttttcaagagggctgtggagggcaagtgctcgtggcagcataactacctgtgtgctggacgcaacgattgtataattgataagatccggcggaagaattgccctgcttgcaggttacagaagtgcctgcaggctggcatgaacctaggtgccaggaagagtaagaagctcggtaaactgaaaggtattcatgaggagcagccgcagcagcaacagccccctccccccccccctcctcctcagtcaccagaggagggaaccacatacatagctccggcaaaagaaccttcagtgaataccgctctggttccccagctgagcaccatctctcgcgccctaacgccttcgccagttatggtgctcgaaaatatcgagcccgaaatagtgtatgctggatacgattcctccaaacccgacactgccgagaacctcctttccacactgaaccggcttgcaggaaaacagatgattcaggtggtcaagtgggctaaggtcctccccggctttaagaaccttccactggaggaccagatcacactcatccagtattcatggatgtgcttatcatcttttgccttgtcttggagaagctacaagcatacaaattcgcaattcctttactttgctccagacttggtgttcaatgaagaaaagatgcaccagtccgccatgtacgagctttgccaaggtatgcaccagatttcattacaattcgtgcgtttacagttgacctttgaggaatatacgatcatgaaggtgctgctgctactatcaacaatccccaaagacggactgaagagtcaggccgcgtttgaagagatgaggaccaactacattaaggaactaaggaaaatggttaccaaatgccccaataacagtggccaatcttggcagaggttttatcaactgaccaagctgctagattcgatgcacgacctggtgagcgatctccttgagttctgtttttacacatttagagagagccacgctctcaaggtggagttccccgccatgctggttgagatcatctccgatcagctccctaaggttgaaagtggcaacgcgaaacccctttactttcaccgcaagtag

SEQ ID NO: 126966 - DNA, 2604 bp, Artificial Sequence
  Description of Artificial Sequence: Synthetic coding sequence
atggagaccaaggggtaccattccctgcccgaaggcttggacatggaacggcgatggggccaggtctcccaggcagtggagcgttcatccctcggccctacggaaagaacagatgagaataattatatggagatagtcaatgtctcttgcgtcagtggcgctattcctaataatagcactcagggatcgagcaaggagaagcaggaactgctaccctgtctgcagcaagacaataaccgaccaggaatcctcacaagtgatatcaagacagagctggaatctaaagagttgagcgcaacagtggctgagtctatggggctgtatatggattccgttagggacgcagattattcctacgagcagcagaaccaacaaggctctatgagccccgcaaagatctatcagaatgtggagcaactggtcaagttttataaaggtaatggtcatcgccccagtactttatcatgtgtgaatactcctctacgctcctttatgagcgacagcggatcgagcgtgaatggcggagtgatgcgtgctgtcgtgaagtcacccatcatgtgtcacgaaaagtctccctctgtgtgtagccctctgaacatgacctcgagtgtgtgctccccagcaggcatcaacagcgtgtctagcacaaccgcttccttcggctcgttccccgtacatagccccattacccaggggacccctctgacctgttcacctaatgtggaaaatcggggcagccggtcccacagtcccgcgcacgccagcaacgttgggagtccgctatcaagccctctgtcctcaatgaaatcatccatttcatcccccccctctcactgcagcgttaaatccccagtctcctcacctaataacgtgacgctgaggagtagcgtctcctccccagccaacattaacaatagtcggtgctcagtgtcctcaccaagcaatacaaataaccggtccacactatccagtccagctgcctcaactgtaggatccatttgttctccagttaacaatgctttcagctacacagcatctggcacatcggctgggagctccactttaagggatgtggtgcctagccccgacacacaagaaaaaggcgctcaggaggtgcccttccctaaaaccgaagaagtggagagtgcaatctccaacggtgtgactggccagctgaacattgtgcagtatatcaaacccgagccggatggggctttctcctcaagttgtctaggcggcaactccaagatcaattccgactcctctttttctgtgcctattaaacaggaaagtacgaaacactcatgctctgggacatcatttaaggggaaccctacagtcaacccattccccttcatggatggttcttatttctcttttatggacgataaggactattacagtctgtccgggatccttgggcctcctgtccctggtttcgacggaaattgcgaagggtcgggatttcccgtggggatcaagcaggaaccggatgacggtagctactaccctgaggcttccatccccagttcagccatagtgggcgtcaactccggcggacagtcttttcattatcggataggtgcccagggcacaatcagcctgagtcgtagtgcccgagaccagtcttttcagcacttaagttcttttccccccgttaacaccttggttgagtcctggaaaagtcacggggatctgagttctcggcgttctgatggctatcccgtgctggagtatatccccgagaacgtgagcagttctactctaagatcggttagtaccgggagtagtagacccagcaagatatgtctggtctgtggcgatgaagcttccggttgccactacggggtggttacctgtggttcttgtaaagtgttcttcaaaagagcagttgaaggccagcacaactatttatgtgctgggcggaacgattgtatcattgacaagattcggcgcaaaaattgtcctgcatgccggctgcaaaagtgcctccaggcaggaatgaatttaggcggattcaagaaccttccactcgaagatcaaattacattgattcaatactcgtggatgtgtttaagttctttcgccctctcctggcgcagctacaagcacacaaactctcaatttctgtactttgcccctgacctcgtgtttaacgaggagaaaatgcaccagtccgccatgtatgagctatgtcagggaatgcaccaaattagtctgcagtttgtgcggctgcagctcacattcgaagaatacaccataatgaaggttcttctgcttctctctaccatccccaaggatgggctgaaatcacaggccgcatttgaagagatgaggacaaattacatcaaagagcttagaaaaatggtcaccaagtgtccgaataatagtggccagagttggcagaggttctatcaactgaccaagctgttggactctatgcacgatctcgtgtcagatctactggaattctgtttttacacgtttagagagtcccacgccctcaaggtggaattcccggcgatgctggtggagatcatcagtgaccagctccccaaggttgagtccggcaatgcgaaaccgctctatttccaccgcaaatag

SEQ ID NO: 126967 - DNA, 1920 bp, Artificial Sequence
  Description of Artificial Sequence: Synthetic coding sequence
atggagaccaaggggtaccatagtctgcccgagggtctggacatggagagaagatgggggcaggtgagtcaggccgtggagcggagctcactggggcccaccgagcgaacagatgagaataactacatggaaattgtgaatgtgtcctgtgtgtcaggagccatccccaataacagtacacagggaagcagtaaggagaaacaggaactcttgccttgcctgcagcaggataataatcgccctggtattctcaccagcgatatcaaaaccgaacttgagtctaaagaacttagcgcaaccgtggccgagtctatgggcctctacatggatagtgtacgcgatgcagactacagctacgaacagcaaaatcagcagggatccatgtcgccggcgaagatttaccaaaacgtggaacagctcgtgaaattctacaaaggcaatggacaccggccctcaactctctcttgcgtgaatactcctctgagatccttcatgagtgattctggtagcagtgtcaatggaggagtcatgagggctgtggttaagagtcccatcatgtgccacgagaagtctccatcagtgtgttcgccactgaatatgacaagttcagtgtgctcgcctgcaggcatcaactccgtgagcagcaccactgcatccttcggtagttttcccgtgcactcacctatcacacagggaacaccactgacgtgtagccctaacgtggaaaatcgcggatcccgctcacatagtccagcccacgccagcaatgtggggagcccactttcaagtcccctctcgagtatgaaatccagcatttcctcccccccatctcattgttccgtgaagtcacccgtctcctcaccaaacaacgtgacactgcggagctcggtgtctagccctgcaaacatcaacaactcaagatgctcagtgtcttcgccctctaatacaaacaatcgaagtactctaagcagcccagccgctagcacagtggggtccatttgctcccctgtgaataatgcattctcatacaccgcctccggcacctccgcagggtccagtactcttagggacgtcgtgccatctccagatacgcaggagaagggggctcaggaggtgccttttccaaaaaccgaggaagtcgagtcagctattagtaacggtgtgacgggtcaattgaacatcgtgcagtatatcaaacccgagccggacggggcgttttccagttcgtgtctgggaggcaattctaaaataaactctgattcctcatttagcgtgccaatcaagcaggagtctaccaagcatagttgcagcggaacgtctttcaaggggaatccaacggtgaatcccttcccattcatggatgggtcttacttcagctttatggacgacaaggactattactcactcagtggaatcctcggacctcccgtgccggggtttgacggaaactgcgagggctctggatttcctgtgggcatcaaacaggagcccgatgacggtagctactatccggaggcctctatccctagcagtgccattgtgggcgttaatagcggggggcagtcatttcattacagaatcggggcccagggcacaatcagtctgtctcgctcagctcgggaccagtcttttcagcatctcagtagtttccctcctgtcaatactctggtggagagctggaagtcacacggcgacctgtcatcgcgacggtcagacggataccccgttttagagtatatccctgagaacgtgtcctcaagtactctcagaagcgttagcacagggagtagtaggccctcgaaaaagaacatttatagatttctgctgtgcaacaaccgaactcgtggagtaggacagcagctgcccctgagcccaagatctagtaccgtcttctgtataaccggaattcacacccgctag

SEQ ID NO: 126968 - DNA, 1797 bp, Artificial Sequence
  Description of Artificial Sequence: Synthetic coding sequence
atgccttgtatccaggctcagtatggaacgcctgctccaagtccaggccctagggaccacctcgcctccgacccgttgacacctgagttcattaaaccgactatggacctggccagtccggaggcagctccggccgcccccacagcactgccctcctttagtacgtttatggacggctacaccggcgagttcgatacgttcctgtaccaactgcctggtacagtacagccgtgcagttccgcaagttcgtccgcaagttctacgagcagtagctccgccacatctccagccagtgccagttttaagttcgaagattttcaggtatacggttgttacccaggacccttatctggacctgtggacgaggccctaagctcgtcagggtctgactattatgggagcccctgcagtgcaccaagcccttccacacctagttttcaaccgcctcagctttccccctgggatggcagctttgggcactttagcccgtcccagacttacgaggggctgcgagcatggactgaacagttaccgaaagcttcaggccctcctcagcctcctgccttcttcagcttctcacctccaacaggccccagtccaagtctcgcgcagtcccccctgaagctcttcccttcacaagctactcatcagcttggcgaaggggagtcctactctatgccgacagcatttcctgggctcgcaccgacaagtccccacttagaagggagcggtattctggatacccccgtcacatcaacaaaagctcgttctggcgcccccgggggttccgagggcagatgcgcggtatgcggagataacgcctcctgccaacactacggggtgcgcacctgtgagggatgtaaaggcttcttcaaaagaaccgtgcaaaagaacgctaagtatatctgcctcgccaataaggactgcccggtggacaagaggcgccgcaaccgctgccagttctgtagatttcaaaagtgccttgcagtgggaatggtgaaggaagtagtgcgaacagactccctgaaggggagacgcgggcgcctgccatcaaagccaaagcaaccacctgacgcttcccccgctaacctcctcacgtcgctcgtgcgagcacacttggactccgggccctctaccgcaaaactggactattccaagttccaggagctggtcctccctcattttggaaaggaagacgccggcgatgtccaacagttttatgatctgctttcgggctctctggaagtcataaggaagtgggccgaaaagatccccggattcgccgaattgagtcctgccgatcaggacttactcctcgaatctgcttttttggagctgttcatcctcaggctggcatataggtccaagcccggcgaagggaaattgatcttttgctccggattggtactgcaccgacttcagtgcgcacgggggtttggagactggatcgactctattcttgcttttagccggtcactgcacagtctcctcgtggacgtccccgccttcgcttgtcttagcgctttagtgttgattacggaccggcatggtctccaagagcctcgccgcgtcgaggaactgcagaaccggattgcctcatgtttgaaggagcacgtggccgctgtggcaggagaaccgcagcccgcatcttgtttgagcagactgctgggaaaattacccgaactccgcactctttgtacccaaggactgcaaaggatattttatcttaagctcgaagatttggtgccccccccacccataatagacaaaatctttatggacacgctcccattttag

SEQ ID NO: 126969 - DNA, 1836 bp, Artificial Sequence
  Description of Artificial Sequence: Synthetic coding sequence
atgtggctggcaaaggcatgttggtcaatccaaagcgaaatgccctgtatccaggcacagtacggtacgccagctcctagccccggccctagagaccatctggcgagtgaccctctaacgccggaatttataaagcccactatggacttggccagccccgaggctgccccggccgcccccaccgctctaccatctttttctaccttcatggatggttacaccggcgaatttgatacgttcctgtatcagctccccggaactgtgcagccatgctcgtccgccagttcaagcgcaagctccacgtcttcctctagcgctaccagccctgcgagcgctagctttaaatttgaagactttcaggtctatggctgctatcctgggcctctgagtggacctgtggacgaagcattaagttctagcggttccgactactatggctctccttgtagtgctcctagtccatccacaccatcattccagccccctcaactgtctccctgggacgggtccttcggacatttctccccatcccagacctatgaggggctccgagcgtggactgaacagctgcccaaggctagtggacctcctcagcctcctgcctttttttccttctctccccctaccggcccaagtcccagcctggctcagtctcctctgaagctgttcccttcccaggcaactcatcagctgggggagggtgagtcctatagcatgcctaccgcttttcccggcctcgccccgacctcacctcatctcgagggatcaggaattttggatacccccgtaaccagcaccaaggcccgctccggggctccgggcggatcagagggcagatgtgccgtctgcggtgataatgcttcatgccagcactacggagtacggacctgtgaaggatgcaagggcttctttaaacggacagtgcagaaaaatgccaagtacatatgcctggccaacaaggactgccccgtggataagaggaggaggaatcggtgccagttctgtagattccaaaaatgtctggctgttggaatggtcaaagaggtcgtcaggacggactctctcaaaggtaggagaggccgattaccctctaaacccaagcagcctcctgatgcctcaccggccaacctgctcacatctctcgtccgcgcccacctcgatagtggtccatcaacagctaagctggactattcaaagttccaagagctcgtcctacctcatttcgggaaggaggacgccggggacgtccaacaattttatgatctgcttagtgggtcactcgaggtgattaggaaatgggctgagaagatccccggatttgccgagctcagccccgctgatcaagacctgctgctggagtcagcgttcttggagctgtttatactgcgtctggcctaccgctcgaaaccaggcgagggcaaactgattttttgcagcgggctggtacttcacaggctccagtgtgccagaggtttcggtgattggatcgactccatactcgccttcagcaggtcattacacagcctgctggttgatgtccccgccttcgcatgtcttagtgccctggtgttgatcaccgaccgacacggactgcaagagcccagacgcgtggaggagctgcagaaccgcatcgccagttgcctcaaggagcacgtcgcagccgtggctggcgaaccgcaacctgcctcatgtctgagccggctgttgggtaagttgccagaactgcgcacgttatgtacacagggtctacagcgtatattttacttaaagctggaagatcttgtgccaccaccacctatcattgacaagatcttcatggacacccttccgttctag

SEQ ID NO: 126970 - DNA, 1797 bp, Artificial Sequence
  Description of Artificial Sequence: Synthetic coding sequence
atgccctgcattcaagcgcaatatggcacccccgcgcctagtcctggcccccgtgatcatctggcctcggatccactgactcccgaatttattaagccgaccatggatctggccagcccagaagccgcacccgcagcacccacagctttaccatctttttctacctttatggatggctataccggggagtttgacacattcctttaccagctcccaggcacagtgcagccttgttcatctgcctctagttctgcaagctcaacttcaagctcttcagcgactagccccgccagcgcaagcttcaaatttgaagacttccaggtgtatggatgctatcctgggcctctgtccggtccagtggacgaagccctgtcctcctctggtagcgattactatggctccccatgcagtgccccgagtccgtcaaccccatcattccaacctccacagctctctccgtgggatgggtcttttggacattttagccctagtcagacgtatgaagggctgagagcttggacagaacagctacctaaggcttcaggcccacctcaacctccagcattttttagctttagcccacccacaggccccagcccttctctcgctcaatctcctcttaagctgtttccttcacaggcaacacaccaattaggcgaaggcgagagctattcaatgcccacagctttccctggactggccccaacatccccacacctcgaaggttcaggcatactcgacactcccgttacatcgacaaaggctagatctggcgctcctggaggatcagagggtagatgcgcagtatgtggcgacaacgcgtcgtgccaacattacggggtacgtacttgtgaagggtgtaagggattctttaaaaggaccgtgcagaaaaacgcaaagtacatttgtctggctaacaaggattgtcctgtcgataaaaggcgtcgcaatcgatgccaattctgtaggttccaaaagtgcttagctgtcggcatggtgaaagaggttgtgcgcaccgactccctgaagggtaggcgaggccgtctcccttccaaacctaagcaacctcccgatgcctctcctgcaaacttattaactagcctcgtcagggcgcatcttgactccggaccttccacggccaaactcgattactcaaagttccaagagctggtgctgcctcattttgggaaagaggatgcgggagatgtccagcagttctacgacctgctctccggctcactggaggtgattcgaaagtgggctgagaagatccctggattcgctgagctgtcccctgccgatcaggacctcctgctggaaagcgccttcctggaactctttattctccgtcttgcgtacaggtccaagccaggcgaggggaaactaatcttttgctcaggccttgtgctacatagactgcagtgcgccaggggttttggagactggattgactccatcctggctttctcacgctccctgcatagcttgctggtggacgtccctgcgttcgcatgcttgtccgccctcgtgctgatcactgaccggcacggccttcaggagccccgcagagtagaggagctgcagaatcggatagctagctgtctcaaggaacacgttgccgccgttgcgggtgaacctcagccagcatcatgcctctcacggctgctcggtaagctgcctgagttgcggaccttgtgtacccaagggcttcagcggattttctacctgaaattagaagacttggttcctcctccaccaataattgataaaatttttatggatacattgcctttctag

SEQ ID NO: 126971 - DNA, 1797 bp, Artificial Sequence
  Description of Artificial Sequence: Synthetic coding sequence
atgccttgcatccaggcgcaatacggcactccagcaccctcccctggcccccgcgatcacttggcatctgatcctttaacccctgaattcataaagccaactatggacctcgcctcgcctgaggccgcacccgccgcacctaccgcgctcccgtccttttcaacattcatggacggttacacgggagaattcgatacctttctgtaccagctgcctggcactgtgcaaccgtgttccagtgcctctagctcagccagtagtacatctagcagcagcgcgacatcccctgcttccgcctcttttaagtttgaggacttccaagtgtacggctgctaccccggtccactgtcagggcccgtagatgaagccttgtcatcttcaggctcggactattatggtagcccatgctccgccccttcccccagcactcccagcttccagcctcctcagctgtctccatgggacggatctttcggccacttcagcccttcgcagacgtacgagggtctccgcgcttggacagaacagttgccaaaagcaagcgggccaccacagccaccggccttttttagcttttcgccaccaactggcccttctccatccctggcccagtcgcccctcaagctgtttcctagccaggctactcaccagctgggagagggggagagttattccatgccaaccgcctttcccggcttggcacccaccagccctcacctcgagggctctggaattctggacacaccagttacaagcacgaaggctaggtcgggggcgccaggcggctctgagggaaggtgtgcagtctgtggcgacaatgcttcctgccagcactatggagtgagaacttgcgagggctgtaaggggttcttcaaacgaaccgtgcagaagaatgccaagtacatctgtctggcaaacaaggactgccccgtggacaaacgtcgtcgtaacagatgccagttctgtcgcttccagaaatgtctggccgtaggcatggttaaagaggttgtgcgaactgacagcctcaagggccggagaggtagactgccctccaaaccaaaacagccacctgatgcatctcccgctaatttacttacctccctggtgagggctcacttggactcgggcccctctacagctaagttagactacagcaaatttcaagagttggtcctgcctcattttggcaaggaggatgcaggggacgtgcagcagttttacgatttacttagcggtagtctggaagtaatccgcaaatgggctgagaagatacccggattcgctgagctgtctcctgcggaccaggatctgcttttggagagcgcctttctggaactcttcatattgcggctcgcatacaggtccaagcctggtgagggaaagctcattttctgcagcggacttgtgctccaccgactgcagtgtgccagggggtttggggattggatcgatagcatcctggctttttcgaggtccctgcacagcctgctggtggacgtccctgctttcgcgtgcctctccgccctcgtactcatcactgacagacatggcctgcaagaaccgcgtagggttgaagagctccagaataggatcgcctcttgtctcaaagagcacgtggcagccgtggccggagagccacagccagcctcctgcctgtcccggctgctcggtaaactgcccgaactgaggactctttgcacccagggtctccagcggatcttttaccttaagctcgaggacctggtcccaccacctcccatcatcgataaaatctttatggacacactccctttctag

SEQ ID NO: 126972 - DNA, 1959 bp, Artificial Sequence
  Description of Artificial Sequence: Synthetic coding sequence
atgacgtccgcacagtacaagatcaagatcctaatagaaggtcttcaccatggacaacgacccgggcccgccccaccccgacagcccggctctttttgctgggctttgaaagccgatggcattatgtggctcgcaaaggcttgttggagtattcagtcagaaatgccttgcatccaggcgcagtatgggactcccgcgcctagcccgggtcctcgcgaccacttagcctctgacccactaacgcctgaattcatcaaaccgaccatggatctcgcgtcccctgaggcggcgccagcagcccccactgctcttccatctttttcaaccttcatggatggctacacgggggagtttgacacattcctctaccaattaccaggcaccgtgcagccatgtagcagcgcctccagctctgctagcagtacaagttcaagttccgcaaccagtcctgcctcagcatccttcaagttcgaggatttccaggtctacggctgttatccgggtcccctcagtgggcccgttgacgaggctctctcctcctctggttcagattattatggttccccatgcagcgccccctctccgagtaccccatcctttcagcctccccaattatctccctgggatggctcgttcggacacttttcccccagccagacatatgaaggtctgcgtgcatggaccgaacaactgccaaaagcatccggtcctccccagcctccggcgttcttctcctttagtccacctaccggccccagtccaagtttggcgcagtcgcccttgaagctgttccctagccaggccacccatcagttaggcgaaggagaaagctattcaatgcccactgcattccctggacttgctccaaccagcccccaccttgagggatccgggatcctggacacgccagtgaccagcaccaaggcccggtctggtgcgccgggaggctccgaaggaaggtgtgcagtgtgcggtgataatgcttcctgccagcactatggcgttcgtacctgcgagggatgtaagggcttttttaaacgcaccgtacaaaagaatgccaagtacatttgcctggcgaataaagactgcccagtggacaagagaagaaggaaccgatgccagttctgcaggtttcaaaagtgcctggccgtaggaatggtcaaggaggtagtgagaaccgactcgcttaagggccgacgcgggcgtttgccgtccaagcctaagcagcctcccgatgccagcccagctaacctcctgaccagtctggtaagggcacacctggactcaggaccaagcaccgccaagctggactactcgaagttccaggagctggtactccctcatttcggcaaggaggacgcgggggatgtgcaacagttttatgacctcctctccggcagtcttgaagtgataagaaagtgggccgaaaagatccctggatttgccgaactttcaccggccgaccaggacctgctcctggaaagcgctttcctagagttgtttattctgagactcgcctaccgctctaagccaggtgagggcaagctgatcttctgttccggtctagtactgcatcgcctccagtgtgcccgaggctttggggattggattgactccattctggcgttttctagaagccttcatagcctgctggtggacgttcccgcctttgcgtgtcttagcgctctcgtgctcataaccgacaggcatggcctgcaggagcctagacgggtggaggagctccaaaacagaatcgcttcctgcttaaaggagcacgtggccgccgtggcgggtgagccgcaacccgcatcatgtctgtccaggttgctggggaaactacccgaactccgcaccttgtgcacccagggtctgcagcgtatcttctatctcaagcttgaagacttggtacccccaccacctatcatagataaaattttcatggatactctcccattttag

SEQ ID NO: 126973 - DNA, 978 bp, Artificial Sequence
  Description of Artificial Sequence: Synthetic coding sequence
atgccttgcattcaggctcagtatgggaccccagcgccatctcctggacctagagaccatcttgcctcagatccactgacaccagagtttatcaagccgacgatggatcttgcttcgcctgaagccgcacccgccgcacccactgcgctcccctctttctccactttcatggatggatacaccggcgaatttgatacctttctctaccaactgcctgggacagtgcagccttgttctagtgcaagttcgagtgcttcctcaacctcaagcagcagcgccacatcgcctgcatccgcatctttcaagttcgaagacttccaggtgtacggctgctatccaggtccactcagcggccctgttgatgaggctctgtcatcctccggatcggattattatggttcgccgtgttctgctccatcacctagcacaccctcgttccaacccccacaactgtcaccctgggatggtagcttcggccactttagcccttcacagacctatgagggtcttagagcttggacagagcagctgcctaaggcctcaggtccccctcagccaccggcttttttttctttctcgccccccactggcccatccccctcattagctcagagcccactcaagctcttcccctcccaggctacccatcagctcggggaaggagagagctactccatgcccactgcgttccccggtctggccccaacctctccacacttagagggctctggcatccttgacacgcccgtcactagtaccaaagctcgctctggagctccaggtggaagcgaggggcgctgcgcagtttgcggcgacaatgcctcctgccaacactatggggtcagaacttgtgaaggttgtaaagggtttttcaaggttccgcgtagcccccggtggggcctattactggaaatggagcgcggctggccgcatcctatcgggacttgtggccttccactggggtcccctccttcctag

SEQ ID NO: 126974 - DNA, 1836 bp, Artificial Sequence
  Description of Artificial Sequence: Synthetic coding sequence
atgtggctcgccaaagcttgctggtctatccagtccgagatgccgtgtatccaggcacagtatggaaccccggcaccatctcccgggccacgtgatcatcttgcttctgatcctttgacgccggaattcatcaaacctaccatggatctcgccagtcccgaagcagctcctgccgctcccacggctctgccctctttttcaacttttatggatggctacaccggcgagtttgacactttcctgtatcagttgcctggcactgtgcagccttgttcaagcgcaagtagcagcgcaagcagcacatccagctcttctgccacaagccccgccagtgcttcctttaagtttgaagatttccaggtttacgggtgttaccccggacccctttctggccccgtggacgaagctctgtcctcctccggttccgattattacgggtccccatgttccgcccccagcccctcaaccccctcgttccaacctccacagttgagtccgtgggacggaagttttggacacttttccccttcacagacatacgaaggtcttcgcgcatggaccgagcagctccctaaagcatctgggccccctcagcctcccgccttcttcagcttctcccctccgaccggccccagcccgagtctggctcagagccccctcaaactcttcccgagtcaggccacacatcagctcggcgagggggaaagctactcaatgccaactgcattcccgggtttagctcccacctcaccacatctggagggatccggaatcttggacaccccagtaacaagcactaaagctcgatcaggggctcccggtggatcagaaggcagatgtgccgtgtgcggcgataacgcttcttgtcagcactacggtgtgcgcacatgcgaaggctgcaaagggtttttcaaaagaacagttcagaagaacgctaaatacatttgtctggccaataaagactgtccagtggacaagagaaggcgcaatcgctgccagttctgtagatttcaaaaatgtctcgcggttggtatggtgaaggaggtggtgcgtaccgactccctaaaaggccgcagggggaggcttccttccaagcctaaacagccacccgacgcctcccctgcgaacctgctgacttccctggtacgcgcccacctggatagcggtccttccactgctaaactggattactctaagttccaggagctggtccttccacattttggcaaagaagatgccggtgatgttcaacagttctacgacctcctgtcaggatcacttgaggtcatccgcaagtgggccgagaagattccgggcttcgccgaactctcacccgctgaccaagatctgctcctagagtccgcattcctcgaactgttcattttgaggctggcttataggtctaagccgggcgaaggaaagctcatcttctgctctggactcgtgctccaccgcctgcagtgtgcccgggggtttggggattggatagacagcatattggctttctcccgctcactgcatagcttactcgtcgatgtccccgcctttgcctgtctgtcagctctcgtcctcatcacagatcggcatggcctccaggagcctaggcgtgtagaagagctgcagaaccgaattgcttcatgcctgaaggaacatgtcgccgccgtcgccggcgaacctcagcccgcctcatgtctgagccgtcttctgggcaaattgcccgagcttcggacattgtgcacacagggcctgcagcgaattttctatctaaaactcgaggacttggttccacccccacccatcatcgacaaaattttcatggataccttgcctttttag

SEQ ID NO: 126975 - DNA, 1797 bp, Artificial Sequence
  Description of Artificial Sequence: Synthetic coding sequence
atgccttgcgtccaggcgcaatatggatccagtcctcaaggggcctctcccgcatcccagagctactcctaccactcgagcggggagtactctagcgatttcttgacccctgagttcgtgaaattctcgatggacctgaccaacacagagatcacggcaactacttccttgccctcctttagcactttcatggacaactactcgacaggctacgatgttaaacccccatgcttataccagatgccgctgtccggtcagcagagtagcataaaagttgaggacatccaaatgcacaattaccaacagcacagccacctcccgccacagagtgaggaaatgatgccccacagcgggtctgtatattacaagccaagcagcccaccaacacccacaactcccggatttcaggtccagcactcccctatgtgggacgatccaggttcactgcacaactttcaccagaattatgtcgcaaccacccacatgattgagcagagaaaaacccctgtgtccagactgtctctcttcagctttaagcagtcacctcctggcacaccagtgagtagctgtcagatgaggttcgacggccccctgcacgtaccaatgaatcccgagcccgctggtagccaccacgtagtggacggccaaacattcgctgtgccaaaccccataagaaaacccgcatctatgggctttcctgggttgcaaatcggccatgcgagccagctactggacacacaagtcccctctcccccttccagaggatcgccgtccaacgaaggcctgtgcgcagtctgtggagacaatgccgcatgtcaacactacggagtgcgaacttgcgagggctgtaaaggcttctttaaacggaccgttcagaagaatgccaagtacgtctgtttagctaataagaactgtccagtggataaaaggaggaggaataggtgccagtactgtcggtttcaaaagtgtctcgcagtgggaatggtgaaagaggtggtcaggaccgatagcctgaaagggaggcgcggccgtctcccaagcaagccgaaaagtccccaggagccatcgccaccttccccccccgtcagcttgatttctgccctggtgagagcccatgtagactctaaccccgcaatgacatcgttagattattccaggttccaagctaacccagactatcagatgtcaggagacgatactcagcacatccagcagttctatgacctgctaaccgggtctatggagatcatacgggggtgggccgaaaaaatccctggctttgccgacctgcctaaagcagaccaggacctgttgttcgaatcggccttcctggagctcttcgtgctgaggcttgcgtataggtccaaccctgtggaggggaagttaattttctgcaatggcgttgtgctccaccgtctccagtgtgtgcgaggattcggggaatggatagattccatagtggaattttccagcaatttgcagaacatgaatattgatataagtgcgttctcttgcattgcggccctcgccatggtgacggagcggcacggattaaaggaacccaaacgggttgaggaactccagaacaaaatcgtgaattgtctgaaggatcacgtgacgttcaataacggaggcctgaacaggcctaattatctctcgaagcttctgggcaagctccctgagctgcggaccctttgtactcagggacttcagcgcattttttatcttaaattagaggacctcgttccgccacctgccataattgataaactgttcctggataccctgcctttctag

SEQ ID NO: 126976 - DNA, 1797 bp, Artificial Sequence
  Description of Artificial Sequence: Synthetic coding sequence
atgccatgtgtgcaggcacagtacggaagcagccctcagggagctagcccggcctcccagtcatactcgtatcattcgtccggcgagtactcttcggatttcttgacccccgagttcgtaaagtttagtatggatctgactaacactgaaatcaccgcaaccacgtccctgccttcgttttcaaccttcatggataattacagcacaggctatgacgtgaaacctccctgcctttatcagatgcccctaagcgggcaacagtcttctatcaaggtcgaggacatccaaatgcacaactatcaacaacactcacacctcccgccacagagtgaagagatgatgcctcactctggctccgtttactataagcctagtagtccgcccaccccgacgacaccaggattccaggtccagcactccccgatgtgggacgacccaggcagcctacacaacttccaccagaactatgtggccaccacgcatatgatcgagcagcgcaaaacgcctgtgtctagactgtccctcttctccttcaagcagtcacctcctggaacacctgtgtcttcttgccagatgcggttcgatggtccactgcatgtgccaatgaacccagaacctgcaggcagccaccatgttgtggacggtcaaacatttgcggttcccaaccctatccgcaagcctgcaagcatgggattccccgggctgcagatagggcacgcatctcagcttctggacactcaggttccttcccccccgagccgagggtccccaagcaatgaaggcctgtgtgccgtgtgtggagacaacgccgcttgccagcactacggcgtgaggacctgtgagggatgtaaggggttcttcaagcggacagtacagaagaatgcaaaatacgtttgcctcgctaacaaaaactgccctgtcgataaaaggagacgcaatcgatgccaatattgccgcttccagaaatgtctggccgtggggatggtcaaagaggtcgtccgaaccgattccttgaagggacggagaggccggcttccatccaagcccaaatctccccaggaaccaagtccgccctcgccacccgttagcctgatcagcgccctcgttcgggcccatgtggactcaaatcctgcgatgacttccctggattatagcaggtttcaggcaaatcctgattaccaaatgtccggtgacgatacacaacatatccagcagttttacgacttgttaacgggctcaatggaaattatacggggatgggctgagaagatccctggatttgctgatctgcctaaggcagaccaggatttgctattcgagtccgcattcctcgaactcttcgtgttgaggctcgcctaccggtcaaatccagtggaagggaagttaatcttttgcaacggagttgtactgcaccgactacagtgtgtacgcgggttcggcgaatggatcgattcaatagtagaattctcttccaacctccagaacatgaatattgatatctctgccttttcatgcattgccgcactcgccatggtcaccgagaggcacggattaaaggagcctaagagggtggaggagctgcagaacaaaatcgtgaattgtctgaaagatcatgttacttttaataacggaggcctcaacagacccaattatctgtctaagctcctgggaaagctgccagagctgcggacactatgtacccaagggctgcagcgcattttctatttaaaacttgaggatcttgtgcccccccccgcaataattgataaactgtttctggacaccctgcccttttag

SEQ ID NO: 126977 - DNA, 1179 bp, Artificial Sequence
  Description of Artificial Sequence: Synthetic coding sequence
atggataattacagcactggttacgatgtaaagccaccatgcctctaccaaatgccattgtctggccaacagtcatcaattaaggtggaagacatccagatgcataactatcaacaacactcacacctgccaccccagtcagaagaaatgatgccacactctggctcagtatactacaaacctagtagcccacctacacccaccacaccaggttttcaggtacagcattcaccgatgtgggatgacccaggctccctgcataacttccaccagaattatgttgctaccactcacatgatagagcagcgtaagactcccgtctctcgcttatcattattctccttcaagcaatcaccccccggtacccctgtatcctcatgtcagatgcggttcgatggtccactacacgtgccaatgaaccccgagcccgcgggctcacatcacgtcgtggacggtcagacgttcgccgtgcctaaccctattcgaaagccagccagtatggggttccccggccttcagattggacacgcttcccagctcttggatactcaagttcccagccccccctctcgagggtctccctcaaatgaagggttatgtgccgtttgcggcgacaatgcagcatgccaacactacggtgtgaggacgtgtgaaggctgcaaggggttttttaaacgaactgtccaaaagaacgcaaagtacgtctgcctagccaataaaaattgtccggtggacaagcgtcgtaggaacagatgccaatactgccggtttcagaaatgtcttgcggtcggcatggtgaaggaggtggtcagaaccgactccctgaaggggagaagggggagactcccctctaaacccaagagcccgcaggagccttcacctccttctccccccgtttctctcatcagtgccctagtccgggcccacgttgattccaatccagcaatgacatccctcgattacagccggtttcaggcaaacccggactaccaaatgagtggcgacgacactcaacatatccagcaattctatgatctgttaaccggtagcatggagatcatccgcggatgggccgaaaaaattccagggtttgccgatttgcccaaggcggatcaggacctgcttttcgagagcgccttcctggaactgttcgttctgcggcttgcctataggatctag

SEQ ID NO: 126978 - DNA, 1179 bp, Artificial Sequence
  Description of Artificial Sequence: Synthetic coding sequence
atggataactactcaactggctacgacgtaaaacccccctgtctgtaccaaatgcctctctccggccagcaatcgtctattaaagttgaggatatccagatgcacaattatcaacagcactcccatctgcccccccagtccgaggagatgatgccccactccgggtcggtttattataagccttcctccccccctacaccgactactccaggctttcaggtgcagcactcccccatgtgggatgaccctggctccctgcacaatttccaccagaactatgtagccactacccatatgatcgaacaacggaaaacaccagtgtcacgcttaagcctattttccttcaagcagagtccccccggcactccagtgtcaagctgccagatgagattcgatgggcccctgcatgtgccgatgaatcccgaacccgctggaagccaccatgttgtcgatgggcagacttttgcagtacctaatccaatccgaaagcctgcttccatgggctttcccgggctgcagataggacatgcatcacagctgctggacactcaggtgccctctccaccttccaggggctcacccagcaacgagggactgtgtgccgtctgcggcgacaatgcggcgtgtcagcattacggtgtgagaacctgcgagggctgcaaaggcttctttaaacgtactgtgcagaaaaatgcaaagtacgtctgcctagctaataaaaactgtcccgttgacaagagacgtaggaacaggtgtcagtactgtaggttccaaaaatgccttgcagttggcatggtgaaggaggttgtacgcactgattctcttaaagggcggagaggacgtctcccaagcaagccgaagtcccctcaagagccatccccaccgagcccaccagtcagcctaatctctgcgcttgtccgggctcatgtggactcgaatccagccatgacatctctggactattccagattccaggccaatcccgactaccagatgtccggagacgacacacagcatattcagcagttctacgacctgttaaccggttctatggagattattcgaggatgggcagaaaagatcccaggtttcgcagacctgccaaaggcagatcaggacctcctcttcgagagtgcctttttggaactgtttgtacttaggttggcatataggatttag

SEQ ID NO: 126979 - DNA, 777 bp, Artificial Sequence
  Description of Artificial Sequence: Synthetic coding sequence
atgccctgcgtgcaggcacaatatggatcctcccctcagggcgcatctcccgcctctcagtcgtattcctaccacagctccggagaatattctagcgactttcttacccccgagttcgtgaagttttccatggacttgaccaatacggaaattactgccaccacaagcctgccatcattcagcacattcatggacaattattcgaccgggtatgatgtgaagccaccgtgcctgtatcagatgcctttgtctggacagcagtcttcaattaaggtagaagacatccaaatgcataactatcaacagcactcgcatttgccgccccagtctgaggaaatgatgccacactccggctctgtgtattacaagccaagctcccctcctactcccaccacgccaggttttcaggtccagcattccccgatgtgggatgatcctggtagcctccacaacttccatcagaattatgtggctactacccacatgatcgaacagaggaaaacccccgtctctcgcctttcgttgttcagctttaaacagagtccccctggcactcctgtaagtagttgccagatgagatttgacgggccgctgcatgtcccgatgaaccctgagcccgctggatcccaccatgtggtggacggccagaccttcgcagtgccgaaccccatccgcaagccagccagcatggggttccccgggcttcaaataggccatgccagtcagctgctcgatacacaggtgccttctcctccctcaagggggtcaccttcttag

SEQ ID NO: 126980 - DNA, 1608 bp, Artificial Sequence
  Description of Artificial Sequence: Synthetic coding sequence
atggataattactcaacaggttatgatgtgaaacccccttgtttataccagatgcccctatctgggcagcaaagcagcatcaaagtggaggacatccagatgcacaactatcaacaacattctcaccttcctccacagagtgaggaaatgatgcctcattctggatccgtttattataagccaagttctcctccaactcctacaactcccgggttccaggtacagcattccccaatgtgggacgatcctggatctttgcacaacttccaccagaattatgtcgccactacccacatgattgaacaaaggaagacaccagtatcaaggctgagcctgttctcattcaaacagagcccccccggcactccagtaagcagttgccagatgaggtttgacgggcccctgcatgtgccaatgaatccagagccggcaggcagccatcacgtagtcgatggacaaacattcgccgtccccaaccctattagaaagccggcaagcatgggcttccctggccttcagatcgggcacgcgtcccagctcttggacacccaggtaccaagccccccaagtaggggctctccttccaacgagggtctgtgtgccgtttgcggcgacaacgcagcctgccagcactatggcgtgcgaacatgcgagggctgcaaaggtttcttcaagcgtactgtgcagaagaatgccaagtacgtgtgcctcgcaaacaagaattgccccgtggataagcgccgacggaacaggtgccagtattgtcgcttccagaagtgtctggccgtagggatggtgaaagaagtggtgcgaacagattctctgaaggggagacgcggccgtctgcctagcaagcccaagtcgcctcaggagccatctccacccagcccacccgtctctctgattagtgcgctagtgcgtgctcacgtggacagtaaccccgcaatgacaagtctggactactcccgtttccaagcaaatccagattaccaaatgagcggcgacgatacccagcatatccagcaattctatgatttactcaccggcagcatggaaattattagaggatgggccgagaagattcccgggttcgcagacttgcctaaagccgaccaggatctgctctttgagagcgcgtttctcgagttgttcgtgctcagactggcataccgctctaaccctgtagagggtaagctaatcttttgcaacggcgtagtgttgcacagactgcagtgcgtgcgtggattcggcgaatggattgatagtatcgtggagttctcatcaaaccttcagaatatgaatatcgatatttctgcctttagctgcatcgcggccctggccatggttactgagaggcatggtctcaaggaacccaagagagttgaggaattgcagaacaaaattgtgaattgtctcaaggaccacgttaccttcaacaatggggggctgaaccgaccaaattacttgtctaaattgctagggaagctccccgagctgaggaccctctgcacccagggccttcagcgaattttctatcttaaattagaggatcttgtgccgccacccgctattattgacaaactttttctggatacccttcccttctag

SEQ ID NO: 126981 - DNA, 1830 bp, Artificial Sequence
  Description of Artificial Sequence: Synthetic coding sequence
atgaacgaagaccggcgaggggagctgttgacaatgccctgtgtccaggcccagtatggatcctcaccacaaggggcgtctcccgccagccagtcctactcctatcatagctcaggcgaatactcttcggactttctgacccctgaattcgtgaagttttccatggacctaaccaataccgaaatcacggcgacgacatcactgccctctttcagtacattcatggataactacagcacggggtatgatgtgaaacctccttgcctctaccaaatgcctctcagcggccagcaaagttctattaaggtcgaagatatacagatgcacaactatcagcaacactcccacttacccccacagagtgaagagatgatgccgcactccgggtccgtctactacaagccttcttctccacctactcccacaactcctgggtttcaggtccaacacagccctatgtgggacgatccgggaagtctgcacaattttcaccaaaactacgttgctacaacccatatgattgaacagagaaagactcctgtgtcacgtctaagcctgttttccttcaagcagtcccctcccggcactcccgttagttcctgccagatgagatttgacggccccctccacgtgccaatgaatcccgagcccgcgggctctcaccacgttgtagacggacagacatttgcagttcctaaccccataaggaaaccagcctcgatggggttccccggattgcagatcggacacgcctctcagttgctcgacacacaggtgccctctcctccctccaggggaagtcctagcaatgaggggctatgcgcggtgtgcggggacaacgcagcttgtcagcactacggcgtaaggacatgtgagggatgcaaaggcttctttaaaagaactgtccagaagaatgccaagtacgtctgcctggcaaacaaaaattgtcctgtggataaacgaagaagaaataggtgtcaatattgcaggtttcagaaatgtctcgcagtaggcatggtaaaggaggtggtgcggactgactcattgaaagggcggcgcggcagactgcctagtaagccaaagagcccacaggagccgagcccccctagccccccggtaagtctcataagcgcgttagttcgggcacacgtggattctaaccccgcaatgacttctttagactactccaggtttcaggcaaacccggactatcagatgtccggggacgacactcagcatatacaacagttctatgacctcctcactggcagcatggagatcatccgaggttgggccgagaaaattccaggattcgccgatttgccgaaggctgaccaggatttgctctttgagtctgcgtttcttgagttgtttgtgctccgcctagcttacaggtccaaccctgtcgagggcaagctgattttctgtaatggggtggtgcttcatcgtctccaatgtgtgcgaggttttggagaatggattgattcaatcgtcgaattctcttctaatctgcagaatatgaacatagatatcagcgctttctcctgtattgctgccctcgctatggttaccgagcgccatggactcaaagagcccaaacgtgtggaggagctgcagaataaaattgtgaattgcctgaaagaccatgtaacgttcaacaacggcgggctaaaccgccctaattacctcagtaagcttcttggcaagctgccagaactgcggactctttgtacacaagggcttcaaaggattttctacctaaagttagaggatttggtgccgcccccagctatcatcgataagctgtttcttgatacacttccgttttag

SEQ ID NO: 126982 - DNA, 738 bp, Artificial Sequence
  Description of Artificial Sequence: Synthetic coding sequence
gtggaagaggagggcgatgtttctaatcgcggcgtcgaactccttcagctagaaccagacgaagatcaggtacgcgcccggattctcggctgcttgcaggaaccaacaaagtccagacctgatcagccagccgcctttggccttttatgcaggatggcggatcaaacgttcatcagcattgtggattgggcccgtagatgtatggtttttaaagagctcgaggtggcagatcagatgacactgcttcagaactgttggtctgagctgctggtgtttgatcacatctatcggcaggttcaacatggaaaagaaggcagcattttgttggtgaccggacaggaagtggaactaacaaccgtggcaacccaggccggttccctgttgcactccctggtcctgcgcgcgcaggagttggtccttcagctactggccctgcagttggacaggcaagaattcgtgtgcctgaagtttattatcctattttctcttgatttgaagtttctgaacaatcacattctagtgaaagacgcacaggagaaggcaaacgcagccctgttggattacactctgtgccattaccctcattgtggcgataaatttcagcagttgctgctgtgcttggtggaagtgcgggccctgtcgatgcaggcgaaggaatacctgtaccacaaacatctcggtaatgaaatgcctagaaacaacttattgattgaaatgctgcaggcaaagcagacctag

SEQ ID NO: 126983 - DNA, 1386 bp, Artificial Sequence
  Description of Artificial Sequence: Synthetic coding sequence
atggattatagctacgatgaagatctggacgagctgtgtcctgtgtgtggtgacaaggtttccggttatcactacggactcctgacgtgtgagtcatgtaagggatttttcaaacggaccgtgcaaaacaacaagcattatacatgtaccgaatctcagagctgcaagatcgacaagactcagaggaaaaggtgtcctttctgccgcttccagaaatgcctgaccgtcgggatgcggctcgaggctgtgcgggccgatagaatgagaggtggccgaaacaagttcggccctatgtacaagagggaccgggccttaaagcagcagaaaaaagcccagattcgcgcaaacggctttaagctggagaccggcccccccatgggcgtgcctcctcccccaccacccgcccctgactatgttctcccaccaagccttcacggacctgagcccaagggactggccgctggcccccccgcaggccctctgggcgattttggggcacctgctttaccaatggccgttccaggtgctcatgggcccctggccggctacctgtaccccgcatttcctggtcgagcgattaaatctgaatatcccgaaccctacgcctccccacctcagcctggcctgccctatggttaccctgagcccttttcaggagggcccaatgtccctgagctcatccttcagctattgcaactggaacccgacgaggatcaagtgcgggcacgaatcctcggctgtctgcaggaacctacaaaatcaagaccagaccagccagcagccttcgggttgctctgccgcatggcagatcagacttttatcagcatagtggactgggctaggagatgtatggtttttaaagagctagaggtggcagaccagatgaccctgcttcagaattgctggtccgagttactggtgtttgaccatatctaccgccaggtccagcatggaaaagagggatcgatactgcttgttactggccaggaggtggagctgactacagtggcaacgcaggccgggagcctgctgcattccctggtgttaagagcccaagaactggtgttacaactcctcgccttgcagctggatagacaggagttcgtctgcctgaaattcattatactctttagcctcgacctgaagttcctgaacaaccatattctggtgaaagacgctcaggaaaaggccaacgcagctctgctcgattatacattgtgtcactacccccactgcggcgacaagttccagcaacttctcttgtgtctggtggaggtcagggcgctgtcgatgcaggccaaagagtacctctatcataaacacttgggcaacgagatgcctcggaataacctgctcatcgaaatgctgcaggccaaacaaacatag

SEQ ID NO: 126984 - DNA, 537 bp, Artificial Sequence
  Description of Artificial Sequence: Synthetic coding sequence
atggactactcatatgatgaggatctcgacgagttatgcccagtgtgtggggacaaggttagtgggtatcactatgggctgcttacgtgtgaatcttgtaaaggcttcttcaaaaggacagtgcagaacaacaagcattacacttgtacagagtcgcaatcctgcaagatcgataagactcagcgcaaacggtgtccattctgcagatttcagaaatgccttactgtaggaatgagattagaggctgtgcgcgcagatagaatgcgtggggggcggaataagttcggccccatgtacaaacgcgatagggccctgaaacaacaaaaaaaggcacagattcgcgctaacggattcaaactcgaaaccgggccccccatgggcgtgccccctccaccaccaccggcccctgactatgtgttgcccccctccttgcacgggcctgagccaaagggtctcgccgccggccctccagccgggcctttaggcgacttcggcgcaccagcactgcctatggccgtccccggggctcacggctag

SEQ ID NO: 126985 - DNA, 972 bp, Artificial Sequence
  Description of Artificial Sequence: Synthetic coding sequence
gatctcgaggaactttgtcctgtgtgcggagataaggtgagcggctaccactatggccttctgacctgcgaaagctgcaagggcttcttcaagcggacagttcaaaataacaagagatacacatgcatcgaaaaccaaaattgtcagatagacaagacgcagagaaagagatgtccttactgccgatttcagaagtgtctgtctgtcggcatgaagttggaagccgtgagggctgatcgcatgcgagggggtcggaacaaatttggcccaatgtataaaagagacagggctctgaagcaacaaaagaaagctctgatacgggcaaatgggctgaagctggaggccatgtcccaggtcattcaggcaatgcccagcgacctgacaatttctagcgctatccagaacatccactcagcctccaaggggcttcccctcaatcacgccgctctgccccctacagactacgatcgatctccgtttgtgacttctccgatttctatgactatgcccccgcacggatccctgcaggggtatcaaacctatggacattttccatctagggccatcaaatctgagtatcctgacccatatacgtctagccccgaaagcatcatgggctattcatatatggacagctaccagacttcgtcaccggcatcaatcccacatctcatcctcgaactgcttaagtgcgagccagacgaaccccaggtgcaggctaagataatggcttatttacagcaggaacaagcgaaccgttcaaagcacgagaagttgtcaacatttggcctcatgtgtaagatggccgaccagacccttttctccatcgtggagtgggccagaagtagcatcttcttccgggaactgaaagggttgaccttatccccttccctcgagtgttccggcagctggctcatggcaacctccacatcgtgtatccaggtgattcgactgcctcaaccccccgaatag

SEQ ID NO: 126986 - DNA, 1488 bp, Artificial Sequence
  Description of Artificial Sequence: Synthetic coding sequence
atgtcatcaaattccgatactggcgatctgcaggaaagcctcaagcatggtttaactccgatcgtctcccagtttaaaatggtaaactactcctatgacgaagacctggaagaattatgccctgtttgcggagataaggtgagcggataccattatgggctgcttacatgcgagagttgtaaaggattcttcaaaaggacagtgcagaataacaagagatatacgtgtattgagaatcaaaactgccaaatcgataaaacacagagaaaacgctgcccatattgtcgctttcagaagtgtttgagcgttgggatgaagctggaggcagtgagagccgataggatgcgtggaggaaggaacaagtttgggccaatgtataagcgcgaccgcgcattaaagcagcagaaaaaagcactgatccgcgcaaacgggctgaagctcgaggcaatgagtcaggtcatacaagccatgccttctgatctgaccatctcctccgccatacagaatatccatagcgcttctaagggcttgcccctcaatcacgccgcactccctcccacggactacgatcggagtcccttcgtgacttccccaatctctatgactatgccaccccacgggtcattgcagggataccagacctacggacattttccatcaagggctattaaaagtgagtaccccgacccatacacgagttcacctgagtccattatgggttattcctacatggactcctaccaaacttcctcaccagcttctattcctcacttgattttggagttgctcaaatgcgagcccgatgaaccacaggtacaggctaagatcatggcatacttacagcaagaacaggccaatcggtccaaacacgagaaactctcgactttcggcctgatgtgtaagatggccgaccagaccctattctccatcgtagagtgggcccgcagttcgatctttttccgggaactcaaagtggacgatcagatgaaactcctccagaactgttggagcgagcttctgatccttgaccacatctataggcaagtggtgcatgggaaggagggatctatattcctggtgactggccaacaggttgactactctatcatcgcctctcaggcaggcgccactctgaataatttgatgagccacgcacaggagctcgtggcaaagctgagatcccttcagttcgatcagcgggagtttgtgtgtttaaagttcttggtgcttttcagcctggacgttaagaacctagagaattttcaactggtcgagggcgtgcaagagcaagtgaatgccgccctgttggattatacaatgtgcaactatccacagcagacggagaagtttgggcagctgctcctaagactcccagagatcagagcaatatcaatgcaggcagaggaatacctgtactacaaacatctgaatggcgatgtgccttataacaatctcctgatagaaatgcttcacgctaagcgtgcttag

SEQ ID NO: 126987 - DNA, 1134 bp, Artificial Sequence
  Description of Artificial Sequence: Synthetic coding sequence
taagatctcgaagagctttgccccgtgtgcggtgacaaagtgtccggataccactacggtctactgacatgtgaaagctgtaagggctttttcaaaaggaccgtgcaaaataacaaaaggtatacctgtattgagaaccagaattgccagattgacaagacacagcgtaagaggtgcccatattgtaggtttcaaaaatgtctttctgtcggtatgaaactggaagcagtccgagcagatcgcatgcggggcgggcgaaacaaattcggtcctatgtacaagcgggacagggccctgaaacagcagaagaaggcgctgattcgcgcaaacggcctaaagctggaggctatgtcccaggtgattcaagcgatgccgtccgacttgaccatctcttccgctatacaaaacatccactctgcatccaagggtctgccactgaaccacgccgctttaccacctaccgactacgataggagcccttttgtgacttccccaatcagtatgaccatgccaccccacggatcgttgcagggctatcagacctacggacatttcccctcaagggccataaagagtgagtatccagatccctatacctctagtcctgaatcaattatggggtatagttacatggacagctaccagacttcaagcccagccagtataccccacctaatcttggagttacttaagtgcgaacctgatgagcctcaggtccaggctaagattatggcctatctgcagcaggagcaggccaacagatctaagcatgagaagctgtctaccttcgggctgatgtgcaagatggccgatcagacgctgttctccatagttgagtgggcccgcagtagcatcttcttcagggagctgaagggcctgactctttcgccaagcctggagtgttcgggaaccattctcgctcacggcaatttgcatttactgcatagctccgattctcctgcctccgcaagtagagtcgctgggatcacaggggtacaccacaatacccacttgatattcgtgttcctggtggaaatggggttttgccatgtcggccaagccggactcaagacccccgacctccgcgtcatttgcctgccgagacccccaaaagtgcttggactctgggcatag

SEQ ID NO: 126988 - DNA, 1626 bp, Artificial Sequence
  Description of Artificial Sequence: Synthetic coding sequence
atgagttctaactctgacacaggtgatctccaggaatccctgaaacacggccttacccctattggcgccggactccctgatcggcatggttcgccgatacctgcccgaggtcggttagtcatgctcccaaaagttgagaccgaagccttgggcttggcaaggtcccatggcgagcaaggacagatgccggagaacatgcaggttagccagtttaagatggtcaactatagctatgatgaggacttggaggagctctgccctgtgtgcggtgataaggtgtctggttaccactacgggctgctgacatgcgagtcatgcaaaggattctttaagaggacagtgcagaataataagcgatatacttgcatcgaaaatcagaattgccagatagacaagactcagcgaaagaggtgcccatattgtaggttccagaaatgcttgtcggtcggaatgaagttggaggctgtccgggccgatcgaatgaggggaggcagaaacaaatttggacccatgtacaagagagatcgcgcgttaaaacagcagaagaaggctctcattcgggcaaacggactgaaacttgaagccatgagccaagttatccaggccatgcctagcgacctgactatcagctctgccatccagaacatccatagtgcgagtaaaggattgccgcttaaccacgccgccttgccacccaccgattacgataggtctccgttcgttactagccccattagtatgaccatgcctccacacggtagccttcagggataccaaacttacggccactttcccagcagggctatcaagagcgagtacccagatccttacacatcatcacctgaaagtattatgggctactcctacatggattcttatcagacatctagccccgccagcattccgcatcttattctggaactcctgaagtgtgaaccggatgagccacaggtgcaggccaagatcatggcttacctgcagcaggagcaagccaatcggtcgaaacacgagaagcttagcactttcggtttgatgtgcaaaatggctgaccagacattgttcagtatcgtggagtgggccagaagttcaatcttctttagggagcttaaggtggatgaccagatgaagctgcttcagaattgctggtccgagctactgatactcgaccacatctaccgacaggtggtccatggcaaggaggggtcaatttttcttgtaaccgggcaacaggtggactattccatcattgcgtcacaggccggagccactctcaataacctgatgtcacatgctcaggagctcgtggctaaactacgttccctgcagttcgaccagagagagttcgtgtgcctcaagttcctcgtgttgttttcgttagacgtaaagaatctcgagaacttccaactggtggagggcgttcaggagcaggtgaacgccgctctgctggactataccatgtgcaattatccccagcagaccgagaagtttgggcaactgttgttgaggttgcccgagatcagggccatctcgatgcaggcggaagagtacctgtattacaaacaccttaacggagacgttccttacaataacctgttaatcgaaatgcttcacgctaagcgtgcgtag

SEQ ID NO: 126989 - DNA, 216 bp, Artificial Sequence
  Description of Artificial Sequence: Synthetic coding sequence
tgatctctgaaacacggtctcactcccattgatcgcggcaattgtagaagcggctgtttcagtttcgcagctaccctgaggcagcgcagtctgctgaccagctgtgctggcctgccagatcgccacggaagtcccattcccgcccgaggccgacttgtgatgttgcccaaagttgaaaccgaggctctaggcctggctagatcacatggcgagtag

SEQ ID NO: 126990 - DNA, 66 bp, Artificial Sequence
  Description of Artificial Sequence: Synthetic coding sequence
atgtcaagcaactccgatacaggggacctccaagagtccctcaagcacgggctcacgccaatctag

SEQ ID NO: 126991 - DNA, 249 bp, Artificial Sequence
  Description of Artificial Sequence: Synthetic coding sequence
atgagttcgaattctgatactggggaccttcaggaatctctgaaacacgggctgactcccatcgacaggggaaattgtcgcagtggctgcttttcatttgcggcaacactgcggcagcgatctctcttgacgtcctgtgcaggcctgcccgaccgacacggctcccctattccagctagaggcagactcgtgatgcttccaaaggtggagacagaggcactcgggcttgcacgctcacatggcgagtag

SEQ ID NO: 126992 - DNA, 1410 bp, Artificial Sequence
  Description of Artificial Sequence: Synthetic coding sequence
atggttaattatagttatgatgaggatctcgaggagctgtgccctgtgtgcggcgataaagtatctggttatcattatgggctactgacttgcgaaagttgtaagggattctttaaacgtacagtgcagaacaataagcgctacacctgcatagagaatcagaattgtcagattgacaaaacacagagaaagcgctgtccttattgccgtttccagaaatgtttaagcgtaggcatgaaactcgaggcagtgcgagcagatcgcatgcggggtggtcgaaataaatttggaccgatgtacaagcgggacagagccttgaaacagcagaagaaagctctgattagagccaacggacttaagcttgaagcaatgagtcaagtgattcaggcaatgccctcggatctcacgatttcgtcagctattcagaatatacattcagcttccaaagggttgcccttgaatcacgccgcgcttccccctaccgattacgacagatcaccttttgttacttcccccatctctatgactatgccacctcacggatcactccaaggctatcagacctacggccattttccgagtcgggccataaaatcagagtatcctgacccctacacaagctctccagaatccatcatgggctactcttatatggacagctaccagacttcatctcccgcctcgattcctcatttgatattggagctgctgaagtgcgaaccagacgaacctcaggtccaggcaaagatcatggcctacctgcagcaagaacaggccaaccggtcaaagcacgaaaaactctccacgtttggactgatgtgcaaaatggctgaccagaccttgttctccattgtggaatgggcccgaagctctatcttttttagagaacttaaagttgacgaccagatgaaactcctgcagaattgctggagcgaactcctgatcctggaccacatctatcgccaagtggtgcacggtaaggagggctctatctttcttgtgacaggccaacaggtggattactctatcatcgcctctcaagctggcgccacattgaataacctgatgagtcacgcacaggaactggtggccaaattacggagccttcagttcgatcaacgagaatttgtctgtctgaagtttcttgtattattttcccttgacgtaaaaaatctcgaaaacttccagctcgtggagggcgtccaagaacaggtaaacgcggcactccttgactacacaatgtgtaattacccacagcagaccgaaaaatttggacagctgctgctgagattgcctgagatcagggccatttccatgcaagccgaggaatacctgtactacaagcacctcaatggcgacgtcccttataacaacttgctgattgagatgctgcacgcaaagcgagcatag

SEQ ID NO: 126993 - DNA, 681 bp, Artificial Sequence
  Description of Artificial Sequence: Synthetic coding sequence
atgctcttgcgcctggtgtcaaactcatggccgcaggtaattttaccccctagaccccccaaggtcctgggcctgcaagcgccgaggcgagcccgtaagcgagcagaggggacagcttcatcaaatgttttcagtatgtttgaccagtctcagattcaagagttcaaagagtccttagccctctcaccccgcctcgagcggaacggcatgatctcagctcattgtaacttatgcctcacaggaagcagcaactctccagctagcgcatcccaggcctttacgataatggatcagaatcgagacgggttcatcgataaggaagacctcagggacacattcgctgcccttggccggatcaacgtcaaaaacgaagaactagaagctatggttaaagaagctcccggacctattaactttaccgtgtttctaaccatgtttggggagaagctgaagggaaccgacccggaggagaccatcctgcacgcctttaaagtgtttgacacagagggcaagggcttcgtgaaggcggacgtgatcaaggaaaagctgatgactcaggcggatagattcagcgaagaggaagtcaaacagatgttcgccgctttccctcctgatgtgtgtgggaatctggactatcgtaatctctgttacgttataacccatggcgaagaaaaagactag

SEQ ID NO: 126994 - DNA, 1569 bp, Artificial Sequence
  Description of Artificial Sequence: Synthetic coding sequence
atggaagaacacggggttacccagaccgagcatatggcaactatcgaggctcacgccgtcgcacagcaggtccagcaggtgcatgtagctacgtacaccgagcattctatgctgagcgccgacgaggattccccatcaagtcctgaagatacttcttacgacgattctgacatcctgaattctacagctgccgacgaggtaaccgcgcacctcgctgccgcaggcccagtcggcatggcagccgctgccgccgtcgcaacaggcaagaagaggaagaggcctcacgtgttcgaatctaacccctcaattcgtaagcgacagcagacacggctcctgaggaagctccgggctacccttgacgaatacacgactagagtaggccagcaggctatcgtactctgcatcagcccttcgaagcccaatcctgtttttaaggtgttcggcgccgcgcccctggaaaacgtggtccgaaagtataagagtatgatcctggaggacctggagtcagccctcgctgagcacgcccctgcacctcaagaagtaaactcagagctgcctccactcacaattgacggaatcccagtgtccgtggacaaaatgacacaggcccaactgagggctttcataccagagatgctgaaatactctacggggagggggaagcccgggtggggtaaggaatcatgtaaacccatatggtggccggaggatatcccatgggcaaatgttaggtccgacgtgaggaccgaggaacagaaacaaagagtatcatggacacaggccctccgcaccatagtgaaaaactgctataagcagcacggaagggaggatctattatatgcgttcgaggaccagcaaacccagacccaggcaaccgctactcatagcatcgctcatctggtgccgtcgcaaacagtggtacagacttttagtaatcccgacgggaccgtgagtctgatccaagtgggcacaggcgctacagtggcgacgctcgccgacgctagcgagctgcctacgacagttaccgttgcacaagtgaattacagtgccgtggctgatggcgaggtggagcagaactgggccacactccaaggcggcgaaatgacaatccaaactactcaggcgagcgaggctacccaggcagtcgcatctctcgccgaagcagccgtggccgcctctcaggagatgcaacagggtgctacggtcactatggcactcaattccgaggccgcggcacacgccgtggccaccctcgcggaagcaacgctccaaggcggggggcagattgtgttaagtggcgagacagccgctgcagtcggagctttaaccggtgttcaagacgcaaacggcctgtttatggcagacagagctggccgaaaatggattctgacggataaagcgactggactggtgcaaataccagtatcaatgtatcaaactgttgttacatccctcgcgcaggggaatggtcccgtgcaggtggccatggcaccagttaccaccagaataagcgactccgccgtcaccatggatggacaagcagtggaggtcgtaactttggaacagtag

SEQ ID NO: 126995 - DNA, 1314 bp, Artificial Sequence
  Description of Artificial Sequence: Synthetic coding sequence
atggaggaacacggagtaacccaaaccgaacatatggctacaatcgaagcgcatgccgtggcacaacaggtccagcaggtgcacgtcgcaacttacactgagcactccatgctaagcgctgacgaagacagccccagttcccccgaagacaccagctatgacgattccgacatcctcaactctaccgcagcggatgaggttacagcccacctcgctgccgcaggacccgttggcatggccgcagctgcagcagtcgcaacaggaaagaaacggaagagaccccacgtgtttgagtcaaaccctagcatcagaaaaaggcagcagaccaggttgctgagaaagctcagggcgaccctcgatgagtacacaacacgggtcggccagcaggctatcgtgctgtgtatctcccctagcaagccgaatcccgtctttaaagtattcggagccgcacctctggaaaacgtcgtacggaaatacaagagcatgattcttgaggacctcgagtcagcccttgctgagcacgctcctgcaccccaagaggtgaactcagagctgccacctctgacgatcgacggcatccctgtgagcgtggacaagatgacacaagcgcaactaagagccttcattcctgaaatgctgaagtatagcaccgggcggggcaagcctggctggggtaaggaatcatgtaagccaatttggtggcctgaggacatcccttgggctaatgtccggtccgacgtgaggactgaggaacaaaagcagagggtggggaccggagccacagtagccacactggcagacgcgtctgagctgcctacaactgtgactgtcgcccaggttaactactccgctgtggccgatggggaggtggagcagaactgggccaccctgcaaggaggcgaaatgacaatccagactactcaggcaagcgaggcgacacaggccgttgcttccctggccgaggcagcagtcgctgcctcccaagaaatgcagcaaggggccaccgtcaccatggctttgaatagtgaagctgcagctcacgccgtcgcaactcttgccgaagctactctccagggggggggacagatcgtcctcagcggcgaaacagctgccgccgtcggcgcactaacgggggtccaggatgctaatgggcttgtccagatacctgtctccatgtaccagacagtggtcacctcactggcccaaggcaacgggcccgtgcaagtggcgatggcgcccgttacaaccaggataagcgacagcgccgtgacgatggacggccaggccgtggaggtggtgacattggaacaatag

SEQ ID NO: 126996 - DNA, 1512 bp, Artificial Sequence
  Description of Artificial Sequence: Synthetic coding sequence
atggaggaacatggcgttactcagactgaacacatggcaacgattgaagcgcacgccgtggctcagcaggtccagcaagttcatgtcgctacttatactgaacacagcatgctgtccgctgacgaggactcaccctcctctccggaagataccagctatgatgactccgatatcctaaatagtactgccgcagacgaagtgactgcacacctcgccgccgctgggcccgtgggcatggctgcagctgcagccgtcgcaactgggaaaaaacgaaagagaccccacgtcttcgagagtaatcctagtattaggaaacggcagcagactcggctgcttcgcaaactgcgtgccaccctcgacgagtatacaaccagggtaggacagcaggccattgttctgtgcattagcccctcgaagccaaacccggtgttcaaggtattcggcgctgcccctctggagaacgtagtgcggaagtataagtcaatgattctcgaagacctcgagtccgcactggcggagcatgcccctgcaccccaggaagtcaacagtgagctgccaccattaaccatagacgggattcctgtaagcgtggacaagatgacacaggctcaactccgggcattcatacctgagatgctgaaatatagtacaggtcggggcaagcccgggtggggaaaagaaagctgcaagcccatatggtggccagaggatataccctgggctaacgttagatctgacgtgagaacggaagaacagaaacagcgcgtgtcgtggacacaggctctccggaccattgttaaaaattgctacaaacaacatggccgcgaggatttactctacgcgttcgaggaccagcagacccaaactcaggcaacggcaactcacagtatcgcacatctggtaccaagccaaaccgtcgtgcagaccttttccaaccctgatggaactgtctctttaatccaggtggggacaggtgctaccgtagctacattggccgacgcatcggagttaccaaccactgtgaccgttgcccaagtcaattatagtgcagtggccgacggcgaagtagaacagaactgggcaaccctccaggggggagagatgaccatccagaccacacaagcctccgaggccactcaggctgtggccagcctcgctgaggccgccgtggccgccagtcaggagatgcagcaaggtgccactgtgacaatggcccttaatagcgaagcggcagcccacgccgttgcaacgttggccgaggccaccctgcagggaggggggcagatcgttctatccggtgagacagccgccgctgtcggcgccctgaccggggttcaggatgccaacgggctggtgcagatccccgtttctatgtaccagactgtggtcaccagtctggctcagggcaatggccccgtgcaggtcgccatggcgcccgtgactactagaatctccgattccgccgtgactatggatggccaggccgtggaggtggtaacacttgagcaatag

SEQ ID NO: 126997 - DNA, 1569 bp, Artificial Sequence
  Description of Artificial Sequence: Synthetic coding sequence
atggaagaacatggagttacgcagacagagcacatggcaaccatagaagcccatgccgtggctcagcaggtccaacaagtgcatgtagctacatacacagagcactctatgctttctgccgacgaggattctccatcatcacctgaagatacatcatacgatgacagcgacatccttaattcaacggccgcagacgaggtcactgcacacctggccgccgcagggcccgtcgggatggcggcggccgcggctgtggctacaggtaagaagcgcaagaggccccacgtgttcgaaagcaaccctagtattcgcaagaggcagcagacgcgcctgcttcgcaagctccgtgcgacactggacgagtacaccactagggtggggcagcaagctattgtcctctgtatttctccttcaaagcccaacccagtgtttaaggttttcggcgctgctcctttggagaatgtggtgcgcaagtataaatccatgatactggaagacctggagtcagctctggccgagcatgcgcccgcgccccaagaggtgaactcggaactaccaccgttaactatcgatggtatccctgtgagcgttgataagatgacacaggcacaactgcgggcgttcatccctgaaatgttgaagtatagtacaggtcgcggcaagcccggctggggaaaagagtcatgcaagccgatctggtggcctgaggatatcccgtgggctaatgtgcggagcgacgttagaactgaggagcagaagcagagggtcagttggacccaggccctgcgcacaatagttaagaattgttacaaacagcacgggagggaggacctcctatacgccttcgaagaccagcagacccagacacaggccacagctacacatagcattgcccatctggtcccttcccagacagtggtccaaacatttagtaaccccgatggcaccgttagcttgatccaggtgggtactggtgccacagtggccacgttggccgatgcatcggagctcccaactacagtgactgtggctcaggttaactactccgctgtagctgatggggaggtcgaacagaactgggctacattgcagggcggggagatgacaatacagaccacccaagccagcgaggctacgcaggcagtagcgagtctggcggaggccgctgtggccgctagccaggagatgcaacagggagcaaccgtgacgatggcactcaacagcgaagctgccgcccacgcggttgcgaccctggcagaagccacgcttcagggaggcggccaaattgtcttgagcggggaaacggccgctgctgtgggggctctgacaggggtgcaagatgctaatggcctcttcatggccgatcgtgccggaaggaagtggatcctcaccgataaggcaaccggcctagtccaaattcccgtcagcatgtaccagaccgttgtaacctcactggcacaaggcaacggccctgtccaggtagcgatggcacccgttaccacccggatttcagattcggccgtgaccatggatggacaggccgtggaggtggtgacactggagcaatag

SEQ ID NO: 126998 - DNA, 1512 bp, Artificial Sequence
  Description of Artificial Sequence: Synthetic coding sequence
atggaagaacatggagtgacacaaacagaacatatggccacaatcgaggctcatgccgtggcccagcaggtccaacaggtgcacgtggcaacatacactgagcattccatgctcagcgcagacgaagattccccgtcctctcctgaggacaccagctatgatgattccgatatcctgaactctactgctgcagacgaggtgacggcccacctggctgcagcgggcccggtgggcatggccgcagcagcagccgtagctacgggcaaaaagagaaaacggccacacgtcttcgaaagtaacccttccattcgcaaaagacagcagacgagacttttacgcaagctcagagccacccttgacgaatacacaacccgtgtcggtcagcaggccatcgtcctgtgcattagcccatccaaaccgaaccccgtgttcaaggtctttggagcggctccacttgagaacgttgtgcgtaaatacaagtcgatgatcctggaggacctggagtctgcgctggctgaacacgcgccagcgcctcaagaggtgaactccgagttacccccccttacaatcgacggcatcccagtgtctgtcgataagatgacacaggcgcaactcagggcgttcatacctgagatgctaaagtattcgaccggacgaggaaagccgggttgggggaaagagtcatgtaaaccgatctggtggcctgaggatatcccctgggccaatgtcaggtcggatgtgagaacagaggagcagaaacagcgggttagttggactcaagccctgagaacaattgtgaaaaactgctacaagcaacacggtagagaggacctactttacgcttttgaagaccagcagactcagacacaggctaccgccactcatagcatcgcccacctggtccccagtcagaccgttgtgcagactttttccaatccggacggaacagtctctctgattcaagtgggtaccggggcaaccgtggccaccttggcagatgcaagcgaactaccaacaacggttactgtcgctcaagtgaattattctgcagtggctgacggagaggtcgagcagaactgggcgactttacaaggaggtgagatgacaattcagacgacacaggctagcgaggcaactcaggctgtggcctcccttgcagaggcggccgttgcagcctcacaggaaatgcagcagggggctacagtgactatggccctgaactctgaagcagccgcgcacgcagtcgccactctggcagaggctactttgcagggaggaggtcagattgtactaagtggcgagacggctgccgccgtcggagcgctgacaggcgtccaggacgcaaatggtctggtgcaaatacctgtgtcaatgtatcagactgtcgttacctccctggcccagggcaacggcccagtgcaggtcgcaatggccccggtgacaaccaggatctcagacagtgcagtgacgatggacgggcaagccgttgaagtggtaacattggaacagtag

SEQ ID NO: 126999 - DNA, 633 bp, Artificial Sequence
  Description of Artificial Sequence: Synthetic coding sequence
atggaggagcacggggttacccaaacagaacatatggctacaatagaagcacacgccgtcgctcaacaggtgcagcaagtgcacgtggcaacgtatacggaacactccatgctgtctgccgacgaagactctccttcttcccctgaagatacgagctatgatgatagcgacattctgaatagtaccgctgccgatgaggttacagcacatctggccgctgccgggcccgtcggtatggcagcagccgccgcagtggctaccggcaaaaagcgcaaacgccctcacgtctttgagtcgaatccaagcatccgtaaacgacagcagacaagactgttgcgtaagttgcgggccactctggacgaatacactacgagagtcgggcaacaggcaatagttctgtgtatcagtccgtccaagccaaatccagtgtttaaggtgttcggcgcggcaccactggagaatgtggtgcgaaagtataaaagcatgattttggaagacctcgagtcagccttggccgaacacgctcccgccccccaggaggtcaattcggaattacctccactgaccattgacggcattcccgtgtcagtagataaaatgacacaagcgcagctccgtgcttttattccctag

SEQ ID NO: 127000 - DNA, 1029 bp, Artificial Sequence
  Description of Artificial Sequence: Synthetic coding sequence
atgattctggaggaccttgagtcagccctcgctgagcatgcccctgctcctcaagaggtgaatagcgaactgcctcccctgacaatcgacggaatcccggtctccgttgataaaatgactcaggctcaacttagggccttcatccctgagatgctgaaatactccaccgggaggggcaagccaggctggggaaaggaatcctgtaagcccatttggtggccggaagatatcccctgggccaacgtcaggtctgacgtccgcacagaggaacagaaacagcgagtgtcatggacccaagctttgaggaccatcgtgaagaactgctacaagcagcacgggcgggaggatttgttatatgcttttgaagatcagcagacccagactcaggcaaccgccacacatagtatcgctcacctggtcccatcgcagaccgtcgttcaaacctttagcaatcctgacggtactgtctctcttattcaagtggggacaggcgcaaccgtcgcgaccctcgccgatgcatccgagttaccaacaacagtcacggttgcacaagtcaactattccgcggtggcagatggtgaggtcgagcagaactgggccacgctccagggcggcgaaatgaccatccagacgacccaggcctctgaagccacgcaggccgtggcctcactcgccgaagcggccgtcgctgctagccaggaaatgcagcagggggccacagtgaccatggcgttgaattcagaggctgctgctcacgcagtagctacgctagccgaagctaccctgcagggtggaggccagattgtcttaagcggtgaaaccgccgccgctgtcggggccctcaccggtgtccaggatgccaacggacttgttcaaatccccgtgagcatgtaccaaaccgtcgtgacgagcctcgcccagggcaacgggcccgtccaggtcgccatggcacccgtcactacaaggataagtgactccgcggtcactatggatggacaagcagttgaggtggtcaccctggagcagtag

SEQ ID NO: 127001 - DNA, 1860 bp, Artificial Sequence
  Description of Artificial Sequence: Synthetic coding sequence
atggctgacgaaggaaagtcctattcggagcacgacgacgagagggttaacttcccgcagagaaagaagaagggcagaggaccatttcggtggaagtacggagaaggaaaccgccggagcggcagagggggatctggcatacggagctcccgcctggaagaggacgacggcgacgttgccatgtccgatgctcaggatggcccacgcgttcggtataacccctacaccacccgtccaaatcgccggggggacacatggcacgaccgtgaccgcattcacgtgaccgtgcggcgagaccgggcccctcccgaaagaggaggcgcagggacttcccaggacggaacaagcaagaactggttcaagataacaattccctatggccggaagtatgacaaagcgtggctgttgtccatgatccagagcaaatgctccgtgcccttcactccgatagaatttcactatgaaaacacccgcgctcagtttttcgtagaagatgcaagcactgccagcgcgcttaaggccgtgaactacaagatcctggacagagagaaccggcgaatatccatcatcataaactcgtcagcacctccccacaccatactgaatgagcttaaacctgaacaggtggagcagctcaagctaatcatgagcaaaagatacgacggaagtcaacaggcgcttgacttgaaaggactgcgaagtgaccctgatctcgtggctcagaatatagatgtcgttttgaatcgaaggtcgtgcatggccgctacactcaggatcattgaagagaacataccagaactgctgtccctgaatctaagtaataatcgactttaccggctggacgatatgtcgagcattgtgcaaaaggcaccaaatctaaagatattgaatctgagcggaaatgagttaaagtccgaaagggagttggataaaatcaaagggctaaagttggaggagctctggctagatggcaactctctgtgcgacaccttccgcgaccagagtacatacataagcgcaatcagagaaaggtttcctaaacttctacgccttgatggacatgagctgccccccccgatcgcttttgatgttgaggcacccacaacactgcctccctgtaagggatcttatttcggcactgagaatcttaaaagtcttgttctacacttcttgcagcagtactatgcaatctatgactcaggggataggcaaggcttactggacgcttatcatgatggggcatgttgctcgctgtccattccttttatcccgcaaaatcctgcccggtcgtccctggcggagtactttaaagattcacggaatgtgaaaaagttaaaagaccccacactccgcttcaggctcctgaagcatacgaggttaaatgtagtagcctttttaaacgagctcccaaagacacaacacgatgtgaacagttttgtagtcgatatcagcgcacagacctctacgctcctgtgttttagtgtcaacggggtgttcaaggaagtggacggtaaatcaagggactctctccgggcctttacccgaaccttcatcgcagttccagcgagtaactcaggattgtgtatagtgaacgacgagcttttcgtccggaatgcctccagcgaggagatacaacgagccttcgccatgcctgctcctacacctagcagttcccccgtaccaaccctcagcccagagcaacaggagatgctgcaggcgttttccacccagtccggtatgaatcttgaatggtcccaaaagtgtctacaggataataactgggactatacccgctcggctcaagcctttacccatctgaaagccaagggggagatccccgaagtggcattcatgaagtag

SEQ ID NO: 127002 - DNA, 1071 bp, Artificial Sequence
  Description of Artificial Sequence: Synthetic coding sequence
atggccgatgaaggtaaaagctattccgaacatgatgacgaaagggtgaacttccctcagcgcaagaaaaagggccggggccctttccggtggaaatacggcgaaggaaaccgcagaagtggcaggggaggtagtggaatcaggagctctcgcctggaagaggacgacggcgatgtggccatgtcagatgcgcaggatggaccacgtgtaaggtataatccctacactacccgaccaaatcgacgcggcgacacctggcatgacagagaccgtattcacgtgaccgtgcgaagagacagggcccccccggagcggggcggtgccggcacctcacaggatggtacttctaaaaattggttcaaaattacaatcccctacggccgtaagtatgacaaggcctggctgcttagtatgattcagtcgaagtgttccgttccatttactcctattgaatttcactacgagaacacacgggcacagtttttcgtggaagacgcgagtaccgcgtccgccctcaaagccgtgaactataagatcctggatcgcgagaatcggaggatatcaattattattaacagctcagcccctcctcacacaattctaaacgagctcaaacctgaacaggtggaacagctaaagctgattatgagtaagcggtatgatggcagtcagcaagccctggatctgaagggccttcggtccgatcccgacctggttgcccagaacattgacgtggtccttaacagacggtcctgtatggccgcaactttgaggattattgaggagaatattcccgaactgctatccctgaatttatccaataatcggctgtatagactcgacgacatgtcttccatcgttcaaaaagctcctaacctgaagattcttaatctcagcggaaatgagttaaaaagtgaacgcgagttggataaaatcaaggggctgaaactcgaagagctctggctggatggaaacagcctgtgcgacacattcagagaccagagtacctatattcgcagcgttgttgcttgcgtctccccccccggagacctgcacccactgggcgggtag

SEQ ID NO: 127003 - DNA, 1071 bp, Artificial Sequence
  Description of Artificial Sequence: Synthetic coding sequence
atggcagatgaagggaagagttattcagagcatgacgatgagagggtgaacttccctcagagaaagaagaagggcaggggaccatttaggtggaaatatggggagggcaacaggcgatctggaaggggcggaagcgggattcgcagtagccgtctggaagaggacgatggtgacgtcgctatgagcgatgcccaggatggacccagggtgcgctataatccatacacaacacgcccgaaccgcagaggcgatacatggcatgacagagatcggatccacgtgactgttcgccgggacagggcccctccggagcgcggtggggccggcacaagtcaagatggaaccagcaaaaattggtttaaaatcactatcccatacggccgaaagtatgataaagcctggctcctcagtatgattcaatccaaatgctcagtgcctttcacccccatcgagtttcattacgaaaacactagggcccagttctttgttgaggatgcttccaccgcttccgcccttaaggcagtaaactacaagatcttggacagagaaaatcgccgaatatccatcattatcaattcatcagcacctccccacactatactgaatgagcttaaacctgaacaggtggaacaactgaaacttataatgagcaaacggtacgacggatcacagcaggccttagatttgaagggcctgcgatccgaccccgaccttgtcgcacaaaatatcgacgtggtcctgaaccgcaggagttgcatggccgcaacactgaggataatcgaagagaacatccccgagctcctctcactgaatctgtcaaacaataggctctaccggctcgatgatatgagctccatcgtccagaaggccccgaatcttaaaatcctaaacttgtccgggaacgaactcaagagcgagcgggagctggacaagatcaagggactgaagctcgaggagctttggctggatggcaattcactgtgcgataccttccgggaccaatcaacatatattcgctctgtcgtagcttgcgtgtctcccccaggtgacctgcatccattgggtggttag

SEQ ID NO: 127004 - DNA, 1860 bp, Artificial Sequence
  Description of Artificial Sequence: Synthetic coding sequence
atggcagacgagggtaaaagctattctgagcatgacgacgaacgggtgaattttccacagcgtaagaaaaaagggcgcggtccattccggtggaaatatggtgagggaaacaggcggtctggacgcggaggatcaggaattcgatcatctagattggaggaagacgacggagatgtagctatgagtgacgctcaagatgggccacgggtccggtacaacccatatacaacgagacccaatagacggggcgacacttggcatgatagagacagaatccacgtgacagtgcggagggaccgcgctccgcctgaacgcggcggggccggaacatctcaggatggcacctctaaaaactggtttaaaatcaccatcccatacgggagaaaatacgacaaggcctggcttttgtcaatgatccagtcaaagtgtagcgttcccttcactcccattgagttccactacgagaatactagggcacaattctttgtggaggacgcttcgactgcttccgcccttaaggctgtgaactataagattctggacagggaaaatcgccgtatcagtatcataattaacagttcagcccctccgcataccattctaaatgaactcaagcccgagcaggtggagcagcttaagcttatcatgtcgaaacgctacgatggatctcagcaggctttggacctgaagggcctacgcagtgaccccgacctggtggcccagaacatcgacgttgttctcaaccgcagatcatgcatggctgctacacttcggatcatcgaggagaatattcctgagctgttgtctctgaatcttagcaacaacagactgtacaggttagatgacatgagctccattgtgcagaaagctcctaacctgaagatcctaaacctttccggaaacgaactgaagtccgagcgggagttggacaagatcaagggacttaagctggaagagctgtggttggacggcaactcactatgtgacacctttagagaccagagtacttatatctcagctattcgtgagcgatttcctaagctcttgcgactggatgggcacgagcttcccccccccatcgcattcgacgtggaggctcccacaacgctgcctccatgtaaaggttcttatttcgggacggaaaacctgaagagtttagtgttgcacttcttgcagcagtattacgcaatctacgactctggtgataggcaggggctgctcgatgcctatcacgacggtgcatgttgcagcttatctattccattcatcccccagaatccagcacggagcagtctcgcggaatatttcaaagacagccgcaacgttaagaaattaaaagaccctacactgcgcttcaggctgttgaaacacacccgccttaacgtagtggcatttctgaacgagctgcccaaaacacagcatgatgtcaactcctttgtagtggacatctctgcccaaacaagcacactgttatgcttctccgtcaacggcgtgtttaaggaggttgacgggaaaagccgagactcattgcgtgcatttacccggactttcattgccgtgcctgcctccaactccggactgtgcatcgtaaacgacgagctctttgtacgcaatgcttcctcagaggagatccagagggccttcgctatgcccgcccctacaccttctagcagtccagttccaaccctgagtcccgaacagcaggagatgctgcaagcgttctcaacccaatccgggatgaatctcgaatggagccaaaagtgcttacaagacaataattgggactacaccagatctgcgcaagcttttacccatctcaaggcaaagggagagattccggaagtagcttttatgaagtag

SEQ ID NO: 127005 - DNA, 1881 bp, Artificial Sequence
  Description of Artificial Sequence: Synthetic coding sequence
atgtgcagtacactgaaaaagtgcggcacctaccgcaccgaggttgcggagtgccatgatcatggctccacctttcaagggcgtaagaaggggggcagctcttttcgagataatttcgacaaacgctcttgtcactacgaacatgggggttatgagaggcctcccagccattgtcaagagaacgatggttctgtcgagatgcgggacgtccacaaagatcaacaactgcgacataccccatactccatcaggtgcgaacgtagaatgaagtggcacagtgaagacgaaattcgcatcaccacttggaggaaccgtaaaccgccggagcgtaagatgagtcagaatacacaggatggatataccagaaactggtttaaggttactatcccttacggcatcaagtacgacaaagcctggctgatgaacagcatacagtcacattgctccgacaggtttacacccgtagattttcattatgttcggaacagggcatgcttcttcgtccaggacgccagtgccgctagcgcactcaaagatgtgtcgtataaaatttacgacgacgaaaatcagaagatatgtatctttgtcaatcactccacggcaccctacagtgtgaaaaataagctaaagcctgggcagatggagatgctcaagctgacaatgaacaaaaggtacaacgtttcacagcaggccctggaccttcaaaacctcaggtttgaccctgacctcatggggcgagatatagacatcatattgaaccgccggaactgtatggcagcaacacttaagatcattgagcgtaatttcccggagcttctgtctcttaacctgtgcaacaataagttgtaccagctggacggcctgagcgacatcactgagaaggcccccaaggtgaagaccttaaatctgagtaagaataagctcgagtcggcctgggagcttgggaaggtgaagggactcaaactggaagagctctggctggagggcaaccctctctgttccacattctcagatcagtccgcctatgtctcagccattagagattgctttcccaaactgctgagactggacggtcgcgagctgagtgcaccggttatcgttgacatagactcctctgagacaatgaaaccctgcaaggaaaacttcaccggttccgagacattgaaacatcttgttctgcaattccttcaacagtactactctatctacgacagcggagatcgtcaggggctactgggggcttaccacgacgaggcttgtttctccctcgctatcccatttgaccccaaagattccgcgcctagcagtctctgtaagtacttcgaagactcacgcaacatgaagactctgaaagatccatatctcaaaggggagctgctcagacgaacgaaacgcgacattgtcgactcactgtccgcattacccaagactcagcatgatctgagctctatcctggttgacgtctggtgccagacagagcgcatgctatgctttagcgtcaatggagtgttcaaagaggtggaagggcagtcccagggctctgttctcgcctttacaaggacgtttatagccacccccgggagctcctcctccctgtgtattgtcaatgacgaactcttcgtgcgcgatgcatcccctcaggagacgcaatccgcgttttccattcccgtatccaccttgagctctagctcagagccttcactttcccaggagcagcaggagatggtacaggctttttctgcccagagcggaatgaagctcgaatggagccagaagtgtcttcaggataacgaatggaattatacccgtgccggtcaggctttcacgatgctgcagaccgaagggaaaattcccgcggaagccttcaaacagattagttag

SEQ ID NO: 127006 - DNA, 1881 bp, Artificial Sequence
  Description of Artificial Sequence: Synthetic coding sequence
atgtgctctacgcttaaaaagtgcggtacctaccgaacggaggtggcggaatgccatgaccacggctcgacattccagggtcgcaagaagggcggctcctccttccgagataattttgataagcggagctgtcactacgagcacggtggatacgagagaccccctagccactgtcaggaaaatgatggatccgttgaaatgagggatgtccataaggatcagcaactgcggcacaccccgtactccatacgatgtgagaggcggatgaagtggcactccgaggacgagatcagaatcactacatggcgcaatagaaaaccccctgagagaaaaatgagccagaatacccaagacgggtacacaagaaactggttcaaggtgacgatcccttatgggatcaagtatgataaagcatggctcatgaattccatacagtcacactgcagcgaccggttcactccagtggacttccattacgtgaggaacagagcctgtttctttgttcaggatgccagcgccgcttctgccctgaaggatgttagctataaaatttatgatgatgaaaaccagaagatatgcatcttcgtgaaccattccacggccccatattcagtaaagaacaagctgaaacccggtcagatggagatgctgaaactgaccatgaacaaaaggtataatgtttcacaacaggcactggatctgcagaacctgagattcgaccccgacctcatggggagagatatagatattattttgaaccgaagaaactgtatggccgccacgctgaagattattgaacggaacttcccagaactactgtccctcaatctgtgtaataataaactgtaccaactggatggcctgtctgatataacagagaaggccccaaaagtcaaaacactgaatctctccaaaaataaactagagtccgcctgggagctgggcaaagttaaaggcctcaagctggaagagctgtggttggagggcaatcccttatgtagcactttctctgaccaatctgcctacgtgagcgcgattagagactgcttccctaagttgctccgtctcgatggccgcgagctaagcgctccggtaatagtagacattgatagttccgagactatgaaaccttgcaaagagaacttcacaggtagcgagacactaaaacacctggtgctgcagttcttgcagcagtactatagcatttatgactccggtgacaggcagggattgctgggggcctatcacgatgaggcctgtttttctctcgctatacctttcgaccccaaagactcggctccatccagtctgtgtaaatactttgaggattcccggaatatgaaaactctgaaagatccttatcttaagggagagttattgagacgcaccaagagagacattgtcgactcactgtccgcactaccaaaaacccagcacgatctgtcaagcatactggtggatgtctggtgccagacagaaaggatgctgtgtttctccgttaacggagtatttaaggaagttgaagggcagagccagggatcagtgctggcttttactcggacctttatagctacgccagggagctcttcctccctgtgtattgtgaacgatgagcttttcgtgcgcgatgcttccccacaggaaacgcagtccgccttcagcatccctgtgtcaacactgtcatcatcctcagagccctccctgtcacaggagcagcaagagatggtccaggcgttcagcgctcagtcaggtatgaagctcgagtggagccaaaaatgtctgcaggataacgaatggaactacacacgtgccggccaggcatttaccatgctgcaaactgaaggaaagattccagccgaagctttcaagcagatttcttag

SEQ ID NO: 127007 - DNA, 1881 bp, Artificial Sequence
  Description of Artificial Sequence: Synthetic coding sequence
atgtgtagcaccctgaaaaaatgcggcacatatcggacagaagtggccgagtgccacgaccacggctccacctttcagggccgcaagaaaggcggttcatcattccgggataatttcgataaaagaagctgtcactacgaacatggtggatatgagcgaccgccctctcactgccaagagaatgacggatccgtagagatgcgcgacgtccacaaagatcagcaactgagacatactccatatagcatccgatgcgaacgtcgcatgaagtggcactcagaagatgaaatcagaatcacaacctggcggaataggaagccaccagagcgcaaaatgagtcaaaatacgcaggatggctacacacggaactggtttaaagttacgatcccctatgggattaagtacgataaagcttggttgatgaattccatacagtctcattgcagcgatcgattcactccagtggactttcattatgtacggaacagggcttgtttcttcgtgcaggacgcatctgccgcatcagcgttgaaagatgtgtcatataaaatctacgatgatgagaaccaaaaaatctgtatctttgtaaatcattctaccgccccctatagcgtgaaaaacaaactgaaacccgggcagatggagatgctcaagctgacaatgaataagagatataatgtctcccaacaggccctcgatttgcagaatctgcgcttcgatcctgacctgatggggcgggacatcgatatcatcctgaacaggcggaattgtatggccgcaactctcaagatcatagaacggaatttcccagaattacttagtttgaatttgtgtaataacaaactgtaccagctggatgggttgtccgatatcacagagaaagctcctaaagtcaagacactgaacctcagcaaaaataagttggagtcagcttgggagttggggaaggtgaagggactgaagcttgaagaactctggctggagggaaatcccctgtgctcaaccttttcagatcagagtgcatatgtgtctgccataagggattgcttccccaagttactcagattagatggccgcgagctttctgccccggtcatcgtcgatatcgatagcagtgagaccatgaaaccatgcaaggaaaatttcactggttctgaaacactgaagcatttggtattacagtttctgcagcaatactactccatatatgattctggtgaccgtcaaggcttactgggcgcataccatgacgaagcctgttttagtctggctataccattcgatccaaaagacagcgctccaagttctctttgtaaatacttcgaagattcaagaaatatgaagactctgaaggatccataccttaagggcgagcttctgcgccggactaagcgggatatcgttgacagcttgtctgcacttcctaaaacccaacacgatctgtcctctatcctggttgatgtctggtgccaaacagagagaatgctgtgcttttccgtgaacggggtgtttaaagaagtggaaggtcagagccaggggtctgttctcgcctttacgcgcacatttatcgccacgccaggttcctcctcctctctatgcatcgtgaatgatgaactctttgtcagagatgcatcccctcaggagacacagagcgctttcagcattcccgttagcaccctttcttcaagttcagagccgtcactgtctcaggagcagcaagagatggtccaagccttctctgcgcagtctgggatgaaactggaatggagtcagaagtgcctccaggacaatgaatggaactatacaagggcaggacaggctttcactatgttgcagacagaggggaagataccggccgaggcttttaagcagatctcctag

SEQ ID NO: 127008 - DNA, 1230 bp, Artificial Sequence
  Description of Artificial Sequence: Synthetic coding sequence
atgaagtggcactccgaagatgaaatccgcattacaacatggcgcaatcgaaagcctccagaaaggaaaatgtcccaaaatacacaggatggatacacgaggaattggtttaaggtcaccattccctatggcatcaagtatgataaggcctggctgatgaatagcatccagagccactgcagtgacagatttacaccggtagatttccactacgtgcgaaaccgagcttgcttctttgttcaggatgcttccgcagcgagcgccctgaaggacgtctcttacaaaatttatgacgacgagaaccagaagatttgtatttttgtgaaccacagcacagctccctattctgtcaagaacaaactaaagcctggtcagatggagatgcttaagctgacgatgaacaaacgatacaacgtgagccagcaggccctggacctgcagaatttgagatttgatcccgatctgatgggccgcgatattgatatcatccttaatcgcagaaactgcatggctgcaacacttaagattattgaacggaacttcccagagctcttatcgcttaatctctgtaacaacaagctgtaccagctcgatggcctaagtgatataacagagaaagctcctaaggttaaaacactaaacctgagtaaaaataaactggagagcgcgtgggagttggggaaagtgaaagggctcaaactggaagaactgtggctcgaaggaaaccctttatgtagtactttcagcgaccagagtgcttacgtcagcgctattcgcgactgcttcccaaagttgctgagattagacggacgggagctctccgctccagtgattgttgacatcgacagcagtgagacaatgaagccgtgtaaagagaacttcactgggtccgaaactctgaagcacctcgtgctccagttcctgcagcagtactatagtatatacgattcaggggaccggcagggcctcctgggagcatatcacgatgaggcctgttttagtcttgctatcccttttgatcccaaggatagtgcgcccagttcactctgcaaatattttgaggacagccgcaacatgaaaaccttgaaagatccgtatctaaagggagagctgctgaggagaacaaaacgcgacattgttgacagtttgtccgccctcccaaagactcagcacgacttgtccagtattttggtcgacgtgtggtgccaaacggtgccttccgggcagtag

SEQ ID NO: 127009 - DNA, 1881 bp, Artificial Sequence
  Description of Artificial Sequence: Synthetic coding sequence
atgtgtagtacattaaagaaatgtggcacgtaccgaactgaggtcgccgagtgtcacgaccatggatcgaccttccagggacgcaagaaggggggctcaagtttcagagataacttcgacaaacggagctgccactatgaacatggcggatacgagcgtccacccagccattgccaggagaatgacgggtcagtggagatgcgtgatgtccacaaagaccagcagttgcgccataccccgtactccatccgttgtgagagacggatgaaatggcattctgaggatgaaattaggataaccacatggcgcaaccggaagcctccggaacggaagatgtctcaaaacactcaggacggatacacacgtaactggttcaaagtcaccatcccatatggcatcaaatatgacaaagcatggctaatgaactccatccagtctcactgttccgaccggttcactccagtggattttcattacgtccgaaatcgagcatgttttttcgtccaggacgccagtgccgcgtcagccttgaaagatgtgtcctacaaaatctacgacgatgaaaaccagaagatatgcatcttcgtaaatcactcaaccgccccctattccgtaaaaaataaactgaagcctgggcagatggagatgttaaagttgaccatgaataaaagatacaatgtctcccagcaggcgcttgatctccaaaatctgaggttcgatcccgacctcatgggcagggatattgacatcatactcaatcgaaggaattgtatggcagcgactctgaaaattattgaaagaaattttccagaactgttgtccctgaacttgtgcaataataagctctatcagctagacggtttgagtgacataaccgagaaagctcccaaggtgaaaacgttgaacttgtccaagaacaaattagagtctgcctgggaactgggcaaagtgaagggactcaagctcgaagagctttggctggagggaaaccctctgtgcagtaccttcagtgatcaaagtgcatacgtgagcgccattcgtgactgcttccccaagctgttacgcctggatggcagagaattaagcgcacctgtgatcgtcgatatcgattcttctgagaccatgaagccatgtaaggaaaatttcaccggaagcgagactctgaaacaccttgtactgcagttcctgcagcagtactatagcatttatgatagtggcgaccgccaagggctgctcggcgcgtatcatgatgaggcctgtttttcgttggccatccctttcgaccccaaggattctgcacctagcagcctgtgtaagtactttgaggatagtcgtaatatgaaaacgctgaaggatccatatttgaagggagagctgctcagacgcaccaaacgagacatagtggattccctgtcagctttgcccaaaacccagcatgacctgagttctatcctggtggatgtgtggtgtcaaacagaacggatgctgtgtttcagtgttaacggagtctttaaggaggtcgagggacagtcgcagggatcggttctcgcttttacccggaccttcatcgccactccaggatcatcgtcatcactgtgcatcgtgaatgatgaattgttcgtccgggacgcaagtcctcaagaaactcaaagcgcattttccatcccagttagtaccctgagcagtagctccgagccttctttgtcccaagaacagcaagagatggtccaggccttctccgctcagtctggcatgaagctagaatggtcccagaaatgcctgcaggataatgagtggaattacactcgcgcgggccaggcctttaccatgctccaaaccgagggtaaaatcccagccgaggccttcaagcagattagctag

SEQ ID NO: 127010 - DNA, 1596 bp, Artificial Sequence
  Description of Artificial Sequence: Synthetic coding sequence
atgagtctcccaagcggacatacaactgggcacacggaccaagttgtgcagagaagagccaggtgttgggatatttaccaacgccgcttttccagtcgatccgagcccgtaaatcccggcatgcattcttccagtcaccaacagcaggacggtgatgctgcaatgcatggcgctcacatggattcacccgtgagatataccccctataccattagcccctacaaccgtaaaggtagcttccggaaacaagaccaaactcacgtgaacatggagagggaacaaaagcctcccgagagaaggatggagggcaatatgccagacgggacgcttgggagttggttcaagatcacagtaccgtttgggatcaaatacaacgaaaagtggctcttgaatcttattcaaaacgaatgcagtgtgccgttcgtgccagtggaatttcactacgagaacatgcacgcttctttcttcgtcgaaaatgcttccatcgcctatgctctaaaaaacgtgagcggtaaaatttgggatgaagataatgagaagatatccatcttcgtcaaccctgccggaattccacactttgtgcacagggaactgaagtccgagaaggtggaacagatcaagcttgctatgaaccaacagtgcgacgtctcgcaggaggctctggatatccagcggctgccattttacccagatatggtaaaccgcgacaccaagatggctagcaatcccagaaaatgtatggctgcctccctcgatgttcatgaggagaacatccccactgtcatgtctgccggcgaaatggacaaatggaagggcattgagcccggcgaaaagtgtgcggaccgaagcccagtttgtaccactttctctgacacaagcagcaatatcaactcaattctggaattattcccaaaactcttatgtctggatggtcagcagtcgccacgagcaaccttgtgcggaaccgaagctcacaaacgactgcccacctgcaaaggttctttctttggcagcgagatgctgaagaacctcgtgctccagtttctccagcagtactatcttatctatgacagtggcgacagacagggcttgctctctgcttaccatgacgaggcctgcttctcacttagcatcccttttaacccagaggacagcgcaccatctagtttctgtaagtttttcaaggacagtcgaaacataaagatccttaaggacccgtaccttcgcggggaattgttaaagcacaccaaattggatatcgtcgacagcctctcagccttgcctaaaactcagcacgatctatctagctttctcgtggatatgtggtaccagaccgagtggatgttgtgcttttcggtgaatggggtgttcaaagaggtggagggacagagccagggctctgtcctggcctttaccagaacatttatcgctactcctgggtcttcgtcaagcctttgcattgtcaacgacaaattattcgtgagggatacaagccaccagggaacccagtcagctcttttcaccctggttcccacggcctttagtagctcggtgcccgctttttcgcaggaacagcagaagatgctgcccagttag

SEQ ID NO: 127011 - DNA, 702 bp, Artificial Sequence
  Description of Artificial Sequence: Synthetic coding sequence
atggagcgggagcagaagccgccagaaagacgcatggaaggcaatatgcccgacggtaccctggggagctggttcaagattactgtccccttcgggattaaatacaacgagaaatggttactcaatttgatccaaaatgaatgctccgtacccttcgtgcccgtcgagtttcactatgagaatatgcatgccagcttcttcgtggagaacgcctctattgcttacgctctaaagaatgtgagtggcaagatatgggacgaggataatgagaaaatcagtattttcgtgaaccccgctgggattcctcacttcgttcacagggagcttaagtctgagaaggttgagcagattaaattggctatgaaccagcagtgtgacgtgagccaggaggcactcgacatccaacggctccccttctatcccgatatggtgaacagagataccaagatggccagtaatcctaggaagtgcatggctgcctcacttgatgtgcatgaggaaaatattcccactgtgatgtctgccggcgaaatggacaagtggaaagggatcgaacccggggaaaaatgcgccgatagaagcccggtttgtactacattctcagacacatcatcaaatatcaagtcggtagttcccagtgtcaccacctgggatcctgatctgtgcttaattgctccattctgcaggcggaggcaacactag

SEQ ID NO: 127012 - DNA, 612 bp, Artificial Sequence
  Description of Artificial Sequence: Synthetic coding sequence
atggcctccagccacccggagcagctctatgtggtactcaagccaactcggggttatcagccagtgagatactacttgatctatgatagcggcgaccgccaaggcctgctgtcagcttaccacgacgaggcttgctttagcttatcgatacctttcaaccctgaagattccgcacctagctctttttgtaagttttttaaggatagcaggaatattaaaatcctcaaggacccctacctaagaggagaattgctgaagcacaccaaattggatatagtcgactcacttagtgccttacccaaaactcagcacgatctatcaagttttctagtcgatatgtggtaccagaccgaatggatgctgtgtttcagcgtaaacggcgtcttcaaagaggtggagggacagtctcagggaagcgtattggcattcacacggacttttatcgccacgccgggctcctcttcgagcttgtgcatcgttaacgacaagctgtttgtgagagacacttcccaccaaggcacccaatctgctctgtttaccctcgttccaacagctttctcctcctcagttcccgcgttctcacaggaacaacagaaaatgttgccctcatag

SEQ ID NO: 127013 - DNA, 1086 bp, Artificial Sequence
  Description of Artificial Sequence: Synthetic coding sequence
tagaatgagaagtggttgcttaatcttatacagaacgagtgttctgtcccatttgttccagtggagtttcactacgaaaatatgcatgcatcttttttcgtggagaatgcatccatagcatatgctctgaagaatgtgtcgggcaaaatttgggatgaggacaatgaaaagatctcaatctttgtcaacccggcgggaattccccacttcgtccaccgagaactgaagtctgagaaagtcgagcaaattaaactggctatgaaccagcagtgcgacgtgtctcaggaagctctggatattcagaggctcccattctatcccgacatggtgaaccgtgacacaaaaatggcttctaatcctagaaagtgcatggccgcttccctggacgtgcatgaggaaaacattcctactgtgatgtcagcgggagagatggataaatggaagggaattgaacccggcgaaaagtgtgctgaccgcagtcccgtgtgcactaccttctctgatacgtccagtaacatcaactccatattagagttgtttcccaagctgctgtgtctcgatggacagcagtcaccaagggcaaccctgtgtggcactgaagctcataagcgcctgccgacctgtaagggtagtttttttggatccgagatgctcaaaaacctcgtattgcagttcttgcaacagtattatctgatctacgacagcggcgatcgccagggtcttctgagtgcgtatcatgacgaggcttgtttcagtctctccatcccgtttaatcctgaggactccgcacccagttccttctgcaaattttttaaggattctaggaacattaagatattgaaggatccttatctgagaggtgaactactcaaacacaccaagcttgacatcgtggattccctcagcgcgttgccgaagacccagcacgatctgagctcatttctcgtcgatatgtggtatcaaactgaatggatgttgtgcttttctgtgaacggcgtgtttaaggaggtaagcgggttttgctctcggcttcaccccgaccttcactgttatccatggcagcagtttcagtccgtccacagatag

SEQ ID NO: 127014 - DNA, 1194 bp, Artificial Sequence
  Description of Artificial Sequence: Synthetic coding sequence
atgaggcgaaatactcaggacgagaatatgagaaagtggttcaaggttaccatcccttatggtataaagtatgacaaggcctggctgatgaattcaatccagagcaactgtagtgtccctttcacccccgttgattttcactatatacgaaatagggcctgtttcttcgtgcaagtagcctctgctgcatctgcactgaaagatgtgtcttacaaaatatacgacgatgaaaaccagaagatctgtatctttgtgtctcactttacagctccctactcagttaagaataaactcaaaccgggacagatggaaatgcttaaactcacaatgaataagagatacaacgtcagtcaacaagctctcgatttgcagaacctgcgatttgatccagacctcatgggccgggatattgatattattctaaacaggagaaattgcatggcggctaccctgaagataaccgaacgcaattttcccgaactgctcagccttaacttatgcaataataaactttaccagctggatggattgagcgatatcaccgaaaaggctccgaaagtcaagactttaaacctctctaaaaacaaactggaatctgcttgggaacttggcaaggttaagggactcaagctggaagaactgtggctggaaggaaaccctctgtgttcaaccttttccgaccagagtgcctacgtgtcagctattagggattgcttcccaaagctgcttcgattagacggcagagagctcagcgcccccgttattgtcgatatcgatagtagcgagacaatgaaaccttgcaaggagaactttacgggctctgaaacccttaagcatctcgttttgcaattcctgcagcagtctaacctgtgcaaatacttcaaggacagtcgcaacatcaaaatcctgaaggatccctaccttcaacgaaagctactgaaacacaccaaatgcccccggaacgtggactccttatctgcactccctgagacccagcacgactttactagcatccttgtggacatgtggtaccaaaccgtgaacacctgctttctgcctagggcggggcctgaatcccagcgctggtggtgcctgctgagtctgaagtggaaggatggactccgcgtgctgatactaccgtcgtgcggcccgtcatcactcccacttgccgctattccagtgtgcgccagctag

SEQ ID NO: 127015 - DNA, 1194 bp, Artificial Sequence
  Description of Artificial Sequence: Synthetic coding sequence
atgaggcgcaacacacaggacgaaaacatgagaaaatggttcaaggtgacaatcccttacggcataaaatatgacaaggcgtggctcatgaacagtatacagagcaactgctcggtcccctttacgcctgtcgatttccattatatccgcaaccgagcatgctttttcgtccaggtggcctccgctgcctcagctctgaaggatgtgtcctacaagatctatgatgacgagaatcagaaaatctgtattttcgtgagtcacttcaccgctccatacagcgtgaaaaataagctcaagccagggcagatggagatgcttaagctcacaatgaacaagcggtataacgtgtctcaacaggctctggatcttcagaacctacgtttcgaccctgaccttatgggcagggacattgacataatcctgaatagaaggaattgtatggccgcgaccctcaagattactgagaggaattttcctgaactcctgagcctgaacctgtgcaataataagctgtaccagcttgatggcctctcagacatcaccgagaaggctccaaaagtgaaaaccctcaacctaagcaagaataagttagaatctgcgtgggagctggggaaggttaagggtttgaaactcgaagagctgtggttggaggggaaccccttgtgttcaaccttctccgaccagtctgcctatgtctccgcaattagggattgtttccctaagctgctgagattagatggacgggagctgtctgctccggttattgtggatatagattcttccgagacgatgaaaccttgtaaggagaactttaccgggagtgaaactctgaagcaccttgtccttcaattcctacaacagagcaacctctgcaaatacttcaaggactcaagaaatattaaaatactgaaggatccctatctgcagcggaagttgttaaaacacacgaagtgtccccgcaacgtggacagcttaagtgccctccctgagacccagcatgactttacctccatcctcgtggacatgtggtatcagactgtgaatacttgtttcttgccaagggccggtcccgaaagccagaggtggtggtgtttgctgagcctgaaatggaaggacggactccgggtgctgatactgccaagctgtggtccttcctccctgcccttggctgccatccccgtctgtgcgtcttag

SEQ ID NO: 127016 - DNA, 1098 bp, Artificial Sequence
  Description of Artificial Sequence: Synthetic coding sequence
atgcggagaaacacccaggacgaaaacatgaggaagtggtttaaagtgacaattccatacggtataaagtacgataaagcgtggttgatgaactccattcagtctaactgctcagtgcccttcactccggttgatttccactatatacgcaaccgggcctgttttttcgtacaggtcgcctccgcagcttcagcactgaaggacgtcagctataaaatctatgacgacgagaatcagaagatctgtattttcgtaagccacttcacggctccctactctgtgaagaataaactgaagcctgggcagatggagatgctaaaacttacgatgaacaaaaggtacaatgtctcccagcaggcactcgatcttcagaacctgagatttgaccctgatctgatgggccgagatatcgacattatactgaataggaggaattgcatggcagccactctcaaaattaccgaaagaaactttccagaactcctctcactcaatctgtgcaataacaagttatatcagctggatggtctctccgacattacggaaaaagcccccaaggtcaagacactgaacctgagcaagaacaagttagaaagcgcgtgggaattgggcaaggtgaaaggattaaagttagaagaattgtggctagaaggcaatcctttatgttctacctttagtgatcaaagcgcttatgtcagcgccatccgggattgcttcccaaaactcttgaggctggacgggcgtgagctcagcgcacccgtgatcgtggatatagattcctcagagaccatgaagccctgcaaggagaacttcaccggcagtgagacgctcaaacacttggtcctccagtttctgcagcagagcaatctgtgtaagtacttcaaggattctcgaaacataaaaatcttgaaggatccatacctgcagcggaagctccttaaacataccaagtgcccaaggaacgtggactctcttagtgccctccccgagacgcagcacgacttcacaagcatcttggttgatatgtggtatcagacagtcaatacctgctttctacccagggccggacctgaatctcagtctttgcggccactttag

SEQ ID NO: 127017 - DNA, 1098 bp, Artificial Sequence
  Description of Artificial Sequence: Synthetic coding sequence
atgcggcgcaatactcaggatgaaaatatgcgcaaatggtttaaggtgacgattccatacggcatcaagtatgacaaggcatggctgatgaactcaatccagtctaactgctcagtgccgtttactcccgtggacttccactacattagaaaccgcgcgtgtttctttgtacaggtggcttcagctgcctccgccctcaaagacgtgagttacaaaatctacgatgacgagaatcagaaaatctgtatcttcgtatcccacttcaccgccccttattcagtcaagaacaagctaaaaccagggcagatggagatgttaaagctaaccatgaacaaaagatacaatgtctctcaacaggctctggatctgcaaaaccttaggtttgaccctgacctcatgggcagagatattgacatcatactaaatcgccggaactgcatggccgctactctgaagatcacagagagaaattttccagagctactctcactcaatctgtgcaacaataagctctaccagctggacgggctcagtgatatcactgaaaaggctcctaaggtgaagactctgaatctatcaaagaataaactcgagtctgcttgggagctgggtaaagtgaaggggctgaagctagaagagttgtggctcgaaggcaatccactctgcagcacctttagcgaccagagtgcctacgtttccgctattagagactgtttccccaagttgctgcgcctggatgggcgtgaactttctgcccctgttatagtcgacattgactcttcagagactatgaagccgtgcaaagaaaattttaccggctctgagaccctgaagcaccttgtgcttcaatttttgcagcagagcaatttgtgcaaatactttaaggattccagaaacatcaaaatactgaaggacccttatctccaacgcaagctgctgaagcacacaaaatgccccaggaatgtggactccctatctgctctcccagagactcagcacgattttacttccattttggtggacatgtggtaccagacagtcaacacctgctttttaccgcgggctgggcctgaatcgcagagcttgagaccgctgtag

SEQ ID NO: 127018 - DNA, 1044 bp, Artificial Sequence
  Description of Artificial Sequence: Synthetic coding sequence
atggagcaatatactgccaattctaacagcagtaccgaacagatcgtggtgcaagccggccagatacagcagcagcagcaggggggagtgactgccgttcaattgcagacggaggcgcaagtcgcatccgcgtctggacagcaagtgcagaccctccaggtggtccagggtcagccactgatggtgcaggtttctgggggccagctgataactagtacagggcagcccatcatggtccaagcggtgcccggtgggcagggccagactatcatgcaggtcccggtcagcggcacacagggccttcagcagatacagctcgtcccacccggccagattcaaattcagggaggacaggcagtgcaggttcaggggcaacaagggcagacacagcaaattatcatccaacaaccacagacagccgttaccgccgggcagacccaaacgcagcagcagattgcagtccagggccagcaagtcgctcagaccgccgagggacagactatcgtgtaccaacccgtcaacgccgacggcacaattctgcaacaggtcaccgtgccagtctcaggcatgatcactattcctgccgcttctctagcaggcgcgcagatagtccaaacaggtgccaacaccaacacaaccagcagtggacagggaacagtcacggtcacccttcccgttgctggcaacgtggtcaacagcggaggaatggtgatgatggttcctggagcgggtagtgtgccagccattcagcggattccactgcctggcgccgaaatgctggaggaagagcctctctatgtcaatgccaaacaatatcatcgcatccttaagagaaggcaggcccgcgctaaactagaggcagagggcaaaatccccaaggaaagaagaaaatacttacacgaatctaggcatagacacgctatggctagaaagaggggcgaaggaggtaggtttttttcccctaaggaaaaggatagccctcacatgcaggaccctaatcaggccgatgaggaggctatgacacagataattcgagtgagttag

SEQ ID NO: 127019 - DNA, 957 bp, Artificial Sequence
  Description of Artificial Sequence: Synthetic coding sequence
atggaacagtacacagctaacagcaactcaagcaccgagcagatcgtggttcaggctggacaaatccagcagcaggtgcaggggcaaccattgatggtgcaggtctccgggggacaactgatcacctccacaggccagcccatcatggttcaggcagtgcctggtggccagggccagaccataatgcaggtacccgtgagcggtacacagggactacaacaaatacagctggtgccccctggccagatccagattcaggggggccaggctgtccaggtgcaggggcagcagggacagacccaacagatcattattcagcaacctcagaccgctgtaacagcgggccagacacagacacagcagcaaatcgctgttcagggacagcaggtcgcccagaccgccgaagggcagaccattgtgtaccagcctgtgaacgcggatggcacgatcctccagcaggtgactgttccggtcagtggcatgatcactatccctgcagcctcgcttgccggcgcccagatcgtccagactggggctaatactaataccacaagcagtggccaaggaacagtgactgtgacacttcctgtcgccggcaacgtggttaattctggcgggatggtcatgatggttccaggggcaggctcagtccccgcgatacagcgcatcccactccctggagcagaaatgttagaggaggagcctctctatgtcaacgctaagcagtaccatcgcatactgaagagaagacaggcacgcgctaaactggaggcggagggtaaaatcccaaaagagcgtaggaaatatctgcacgaaagccggcatcgccacgctatggcacgcaagcgcggggaagggggacggttcttctccccgaaagaaaaggactcaccccacatgcaggatcccaatcaggctgacgaggaagcaatgacgcagattatccgagtgagttag

SEQ ID NO: 127020 - DNA, 624 bp, Artificial Sequence
  Description of Artificial Sequence: Synthetic coding sequence
atgacgatggatggcgacagttccacaaccgatgctagtcaattaggaattagtgcagactacatcggtggctcacactacgtaattcagccacacgacgataccgaagactccatgaacgaccatgaagacacaaatgggagcaaggagtccttccgggagcaggatatctacttgcctattgccaatgtcgcgaggatcatgaagaatgccatcccccagaccgggaaaatcgccaaggacgcaaaggagtgcgtgcaggagtgcgtctccgaattcatctctttcatcaccagtgaggccagcgagcggtgccaccaggagaagagaaaaaccattaacggtgaggatattctattcgccatgtccacactcgggtttgactcatacgtcgagccactgaagttgtacctgcagaagttccgggaggccatgaagggtgaaaagggcatcgggggagccgttaccgcgaccgacggactgagtgaggaactgaccgaggaagctttcacaaaccagctgcccgcgggtctgattactaccgacggccagcagcagaatgtgatggtatacacaacaagttaccagcaaatttcaggcgtgcaacagatccagttcagctag

SEQ ID NO: 127021 - DNA, 624 bp, Artificial Sequence
  Description of Artificial Sequence: Synthetic coding sequence
atgaccatggatggtgactcctccaccacagacgcatctcagcttggcatcagcgcagactatatcggcggaagccactacgtgattcaaccacatgacgacaccgaagatagcatgaacgatcatgaggatacaaatggcagcaaggagtctttcagggaacaagacatttacctcccaatcgctaatgtcgcccggatcatgaaaaacgcaatccctcagaccggaaagatagccaaagacgcaaaagaatgcgtgcaggaatgcgtatcagagttcatatcctttattacaagcgaggcgagcgagagatgtcaccaagagaaacggaaaaccatcaatggcgaggatattctgttcgcaatgtctacgctcggcttcgattcttatgtggaacctctgaagctgtacctgcaaaagtttagagaggcaatgaagggggagaaaggtatcggcggcgcggttacagccaccgacggactctccgaagagctaactgaggaggctttcactaatcagcttcctgctggcttgattactaccgacggtcagcagcagaacgtcatggtgtacactacttcctatcagcaaatcagcggcgtgcagcagattcagttttcttag

SEQ ID NO: 127022 - DNA, 1377 bp, Artificial Sequence
  Description of Artificial Sequence: Synthetic coding sequence
atgtctactgaaggtggctttggcggtaccagttcctctgatgcccagcaatccttgcagtccttttggccccgggtgatggaagagattaggaacttaacagtcaaggactttagggtacaagagctgcctctagcgcgaatcaagaaaataatgaagctggacgaggacgtgaaaatgatctccgctgaggcccctgtgctcttcgctaaggcagcccagatcttcatcacagagctgactctacgggcctggattcataccgaggataacaagaggaggactctgcagagaaatgatatagctatggccatcacaaagtttgatcagtttgatttcttgatcgacatcgtgccccgggatgaactgaaacctcctaagaggcaggaggaggtgcggcagtctgtgactcctgctgaacccgtgcagtactactttacgttggcacagcagcccaccgctgtgcaggtgcagggacagcagcaggggcagcagaccacctcctccacaactaccattcagccaggccagattatcatagctcagccacagcagggtcagaccactcctgtaaccatgcaggttggtgaaggccaacaggtgcaaatcgtgcaggcccagccgcagggacaagcacagcaggcacagtctggcacaggacagaccatgcaggtgatgcaacaaatcattacaaacactggcgaaattcagcagatccctgtgcaactgaacgctgggcagctccagtatatccggctggcgcagcctgtcagcggcactcaggtggtgcaggggcaaattcagacgctggccaccaacgcacaacagggacagagaaacgcttctcagggtaagccaagaaggtgcctgaaggaaacactgcagataacccaaacagaggtacagcaggggcagcagcagtttagccaatttaccgacggacagcggaacagcgttcagcaagcacgtgtgtccgagctgactggcgaggcagagcctcgcgaggtcaaggccaccggaaactccactccgtgcactagcagcttaccaactacccacccacccagccaccgagctggggccagttgcgtatgttgcagccagccccaacagagcagcacaagtcccccaccaagtgatgccctgcagtgggtggtcgttgaagtcagtgggacacctaaccagcttgagactcatagagaactacacgcccctctccccggcatgactagcctatctcctctgcacccttctcagcagctttatcaaattcagcaggttactatgccagccgggcaagacctcgcccagccaatgtttattcagtcagcgaaccagccctctgacggtcaggcccctcaagtcaccggggactag

SEQ ID NO: 127023 - DNA, 1008 bp, Artificial Sequence
  Description of Artificial Sequence: Synthetic coding sequence
atgagcaccgaaggcggtttcggagggacgagcagtagtgacgcacaacaatcacttcagtcattttggccacgggtcatggaggaaattcgcaatctgacagttaaggactttagagtgcaagagcttcccctcgcccggattaaaaagatcatgaaattagatgaggatgttaaaatgatctccgccgaggcccccgtgctgtttgctaaagctgcgcagatcttcatcacagaacttacattgagggcctggatacacactgaggataacaagaggagaaccctgcagaggaatgacattgcgatggctataacgaagtttgaccaatttgacttcctgattgacatcgtacctagagatgaactgaagccacccaaaaggcaagaggaggttagacaatctgtaacccccgcagagcccgtccagtattatttcactctggcacagcagccgacagccgtccaggttcagggacagcaacagggacagcagacaacgtcatccacaacaacaattcaaccagggcagatcattattgcacagcctcaacagggccaaactacccccgtcacaatgcaagtgggggagggtcagcaggttcagatcgtgcaggcccagcctcagggacaggcccaacaagctcagtccgggactggtcagacaatgcaggtgatgcaacaaattatcactaatacaggagaaatccagcagatccctgtgcaactgaatgctggccaattacagtacattagacttgctcagcctgtctcaggcacccaggtggtgcagggtcagattcaaacgctggcaacaaacgcccagcagattacccaaacggaagtgcagcagggtcagcagcagttcagtcagttcacagatggacaacagctctatcagatacagcaggttacgatgcctgctggtcaagacctcgcacagcctatgttcatccagtcagcgaaccagccatcagacgggcaggcccctcaagtgaccggtgattag

SEQ ID NO: 127024 - DNA, 1320 bp, Artificial Sequence
  Description of Artificial Sequence: Synthetic coding sequence
atgagcacagagggtggcttcggagggacctccagctccgacgcccagcaaagtctacaatctttttggccaagagtgatggaggaaatacgtaatctgacagtaaaggatttccgcgtccaggaactcccactcgctaggattaagaaaatcatgaagctggatgaggatgtgaagatgatcagcgcggaggctccagtattatttgctaaagcagctcagattttcattaccgaattaactctgcgcgcctggatacatactgaggataataaaagaaggactctgcaaagaaacgatattgccatggccatcaccaaatttgatcagttcgatttcctgatcgacatcgtcccaagagatgaactcaagccccctaaacggcaagaggaagtccggcaatctgtgacgcccgcagagcctgtccagtactatttcaccttagcccagcagcccactgccgttcaagttcaagggcagcagcagggacagcagaccacctcttcaactaccactatccagccaggacaaatcatcatcgctcagcctcagcaggggcaaactacacctgtgacgatgcaggtcggggagggccagcaggtccagatagtacaggcacaaccacagggccaggctcagcaggcccagagcggtactggccagaccatgcaggttatgcaacagatcatcacgaatactggtgagattcaacaaattccggtacagttaaacgccggacagttgcagtacattaggctagcccagcccgtttctggcactcaggtggtgcaaggacagatacaaacactagctacaaacgcacaacagatcacgcaaaccgaggtgcagcagggccagcaacagttcagccagttcacagatgggcagagaaactccgtccaacaagccagggtttcagagctcactggtgaggccgagcccagagaagtgaaggcaaccggaaatagcactccttgcacaagctcattgcctaccacccatcccccctcccatcgggcaggggcatcttgtgtgtgttgctctcagccccagcagtccagcaccagtccacctcccagcgatgccctgcagtgggtcgtggtggaggtgtctgggactccaaatcaactagagacccacagagagctgcatgctcccctgcccggaatgacctcgctatctcccttacacccttcacagcagctctatcagattcagcaagttactatgccggccggtcaggacttggcacagcccatgtttatacagagtgctaaccaacctagcgatggccaggccccccaggtgactggtgactag

SEQ ID NO: 127025 - DNA, 906 bp, Artificial Sequence
  Description of Artificial Sequence: Synthetic coding sequence
atgtctacagagggtggttttggggggacctcatcttccgacgcacaacaatctcttcagagcttttggcctcgcgttatggaggagatcaggaatctcacagtaaaggattttcgcgtgcaggagttacctctagcccgcattaagaagatcatgaagctcgacgaagacgtgaagatgatctcggctgaggctcctgtgctgtttgcaaaggctgcccagatctttattacagagctgacattacgtgcttggattcacacggaagacaataagcgccggaccctgcagagaaatgatatagctatggccataactaagttcgaccagtttgactttctgattgacattgtgcctagggacgaactgaaaccccctaaaaggcaagaagaggtgagacagtcagtcacaccggccgagcccgttcagtattacttcacgttagcgcagcaaccaacggctgtgcaggttcaaggccagcagcagggccagcaaaccacctcatccacaaccacaatccaacctggccaaatcatcatcgcgcagcctcaacagggtcagacaatgcaggtcatgcagcagattatcactaacacaggtgagattcagcagatccctgtgcagctcaacgctggacagctgcaatatatcagactggcccagccggttagtgggactcaagtggtccagggccagatacagacgttggccactaacgcacagcagattacccagaccgaggtgcagcagggccagcaacagttttctcagttcaccgatggacaacaactgtaccagatccaacaggtcactatgccagctggtcaggatctcgcccagcccatgtttatacagtccgctaaccagccttccgatggccaggctccccaggtcactggggattag

SEQ ID NO: 127026 - DNA, 1008 bp, Artificial Sequence
  Description of Artificial Sequence: Synthetic coding sequence
atgtctactgaaggcggcttcggtggtaccagcagcagcgatgcccagcagtcgttgcagtctttctggcctagggtgatggaggagatcaggaaccttactgtcaaagactttcgggtgcaggagctccccctggcccggattaagaaaattatgaagcttgacgaggacgtcaagatgatctcagccgaagcccctgtgctgtttgccaaggccgctcagatttttataacagaattgactctacgcgcctggatccacacggaagacaacaagcgtaggactctgcagcgcaacgatattgcaatggcaatcacaaagttcgatcagttcgattttctgatcgacatagttcctagagacgaattaaagcctcccaagcggcaggaagaagtccgacaatccgttacccctgctgagcccgtgcagtactatttcacactggctcaacagccgaccgcggtccaagtccagggacagcagcagggccagcaaactacctctagcactacaacgatccagccaggacaaatcatcattgcccagcctcagcaggggcagacaacccctgtcaccatgcaagtgggtgaggggcagcaggttcagattgttcaggcacagcctcagggacaggcacagcaggctcagagcggcaccggtcaaactatgcaggttatgcagcagattattacaaacacaggggaaattcagcagatccctgtgcaactaaatgctggccaactccagtacatcaggctggcccagccggtgtccggcactcaggttgtgcaaggccagattcaaactctggctacgaacgcccagcagatcacccaaaccgaagttcagcaggggcagcaacagttcagccaatttacggacggacaacagctctatcaaatacaacaagtcacaatgccagcaggccaggatctggcccaacctatgtttatccagtcagccaaccagccatccgacggccaggcccctcaggtcacaggcgactag

SEQ ID NO: 127027 - DNA, 702 bp, Artificial Sequence
  Description of Artificial Sequence: Synthetic coding sequence
atggctatcactaaattcgatcagttcgacttcctgatcgatattgtgcctagggacgaattgaagccaccaaaacgccaggaggaagtgcgccaaagcgtgaccccagctgaacccgtgcaatattatttcactctggctcagcaacccaccgctgtgcaagtgcagggccagcaacagggacagcagaccacttcttcaaccacgacaatccagcctggtcagatcattattgcgcagcctcagcagggacagaccacccctgtcacaatgcaggtcggagagggccagcaagtgcagattgtgcaggcacagccacagggtcaggcacagcaggcgcagtcggggaccggccagactatgcaggtgatgcagcagataataacaaacacaggagagatacagcagattcccgtgcagttaaatgctggccagcttcaatatatcaggcttgcccaacccgttagtggaacgcaagtagtccaggggcaaatccagaccttggcaaccaacgctcaacagatcacccagactgaggtgcaacaaggtcaacagcaattttctcagtttacagatggacaacagctgtatcagatacagcaggttactatgcgcgctagaaccagcccctcaccttgctccagctctcaacccacatctcctcctacgggacctcccggagacaggcggcttcgtgcctag

SEQ ID NO: 127028 - DNA, 606 bp, Artificial Sequence
  Description of Artificial Sequence: Synthetic coding sequence
atggcaataacaaaattcgatcagtttgatttccttatcgacatcgtccctcgagacgagctgaagcccccaaagaggcaggaggaggtcaggcagtctgtcactccagctgaacctgtacagtactatttcactcttgcccagcagccaacagccgtgcaagtgcagggacagcagcaggggcagcagactacatctagcactaccacgattcaacccggacagattatcattgctcagccgcagcaagggcagacaacgcctgtgacaatgcaggtgggagagggccagcaggtacagatcgttcaggcccagccccaaggtcaggcccagcaggcccagagcggcacaggccagaccatgcaggtgatgcagcagattataacgaatactggtgagatacagcagatcccggtgcagctgaatgccggtcagttgcagtatatacgtctggcgcagcctgtgagtggtacccaggtggtgcaggggcagattcaaacccaggcgatggaaaccttcttcgcttttaagaggcagatctactctctttggagggtgggaggattcatcgccacgctgttcagtccacgggaccccgggaactag

SEQ ID NO: 127029 - DNA, 942 bp, Artificial Sequence
  Description of Artificial Sequence: Synthetic coding sequence
atgtcaactgaaggtgggtttggtgggacttcgtcaagcgacgcacaacaaagcctgcagtccttctggccccgtgtgatggaggagatccggaatctgacagtgaaagattttagggtccaggaactgccactggcccggatcaagaagattatgaagttggacgaagatgtcaagatgatttctgccgaagcccctgttctcttcgccaaggccgcgcagattttcatcactgaacttactttaagagcatggatacataccgaggacaacaagcggaggacactacaaagaaatgatatcgcgatggccattaccaagttcgatcagtttgacttcctgattgacatcgtccccagggacgagcttaaacccccgaaacggcaggaggaagtccggcagtctgtgacccccgccgaaccagtgcaatattactttacgttagcccagcagcctaccgccgtacaggttcaggggcaacaacagggacagcaaactacgagcagcaccacaaccatccagccaggccagattattatcgctcagcctcagcagggccagactacccctgtgacaatgcaggtgggcgaaggacagcaggtgcagattgttcaggctcagcctcagggtcaagctcagcaggctcagagcgggaccggacagaccatgcaggtcatgcagcaaattatcacaaataccggagagattcagcagattccagagacaggcctggcggtgtcgctacggctcatgaaatgcagcggcttgatttccgcacactgttcatttcgattgcccggaagctcagactcacccgcgtccgcttccagagtcgctggaatcataggagcggcagagtgtcgccctgccgccgtatatccactgagcccagcatgcatccgtcatagcagctgtgccggcaccgaccctgacacttgctag

SEQ ID NO: 127030 - DNA, 543 bp, Artificial Sequence
  Description of Artificial Sequence: Synthetic coding sequence
atgtccaccgagggaggattcgggggaaccagcagctctgacgcgcagcagtccctgcagagtttttggccaagggtgatggaagagattcgcaatcttacggtgaaggattttcgggtgcaagaattgcctctggctagaattaaaaaaatcatgaagctcgacgaggatgtaaagatgatttcagccgaggcccccgtgctttttgctaaagcggctcagatcttcatcaccgagcttacactacgggcctggatacatacagaggacaataagagacgcaccttgcaagaagaggtgcgtcaaagtgtgactcccgcagagccagtccagtactactttacacttgctcagcaaccaacggccgtccaggtgcaaggtcaacagcaggggcagcaaaccaccagcagtactacgacaatccagcccggccagattataatcgcacagccgcagcagggtcagacaacacctgtcaccatgcaggtgggagaaggacagcaggtgcagatcgttcaggctcagccacagggccaggcctag

SEQ ID NO: 127031 - DNA, 1065 bp, Artificial Sequence
  Description of Artificial Sequence: Synthetic coding sequence
atgtccactgagggaggttttggcggcacgagttcctcggatgcccagcaatcactgcagagcttttggccacgggtgatggaggaaattagaaacctgaccgtcaaagactttcgagtacaggagctgcctttggcccgaataaagaaaattatgaagctggatgaggatgtcaaaatgatttccgccgaagcccccgtcctgttcgccaaagccgcccagatctttattacagaactaaccctcagagcctggattcataccgaggacaataagagacgcacactccagcggaacgacatagccatggccatcacaaaatttgaccagtttgatttcttgatcgacattgtgccacgtgacgaactgaagccacctaagaggcaggaggaggttagacagtccgtgacgccagctgaaccagtgcaatactacttcaccctggcccagcaaccgaccgctgtccaagtccagggacagcagcagggccagcagacgacctcctccactaccacaatacagcctggccagatcatcatcgctcagccgcagcaggggcagaccaccccagtaaccatgcaggtcggtgagggccaacaagtccagattgtgcaggcccagccccaagggcaggctcagcaggctcagtcaggcacgggccagaccatgcaagtgatgcagcagatcattaccaataccggggagattcagcaaatacccgtgcagttaaacgctggtcagctccagtatattaggctcgcccaacctgtgagcgggacacaagtggtgcaaggccagattcagacccttgctacaaacgcccagcaaggacagcgtaacgcgagccagggtaaaccacggcgatgcctgaaggaaacactccagattacacagactgaggttcagcaaggccagcaacagttctctcagtttaccgacgggcagcagctgtatcaaatacagcaggtcaccatgcccgcgggacaggacctggcccagccaatgttcatacagagcgctaaccagccttctgacgggcaggctccccaggttacaggtgactag

SEQ ID NO: 127032 - DNA, 894 bp, Artificial Sequence
  Description of Artificial Sequence: Synthetic coding sequence
atgtctactgaggggggattcggtggcacaagtagctccgacgcccagcagagcctacagagcttctggccaagggtgatggaggagattagaaatctcacagtgaaggattttcgagtccaggagctccctctagccagaataaagaagattatgaagctcgatgaagacgtcaaacgcaacgatatagccatggcaattacaaagtttgaccagttcgactttctcatagacattgtgcctagggacgaactaaaacccccaaaaaggcaggaggaggttcgacagagcgtcacccccgccgagcctgtgcagtactatttcacgcttgcacagcagcctactgctgtccaggtgcaaggccagcagcagggacagcaaacaactagctctactacaacaattcaacctggccagatcatcattgcgcagccacaacagggacagactacaccggtgaccatgcaggttggcgaaggccagcaagtccagattgtgcaggcccaaccacagggacaagcccaacaagctcagtcaggcaccggacaaaccatgcaagtgatgcagcagatcatcacgaacaccggcgaaatacagcaaatcccggtccaacttaacgctggtcagctgcagtacatccggctggctcaaccagtgtctggcacacaggtggtgcagggacagatccagactctagcgaccaatgcccagcagattacacagaccgaggtccaacaaggccagcagcagttctcccagttcacagatggccagcaactgtaccagattcagcaggtgacgatgccggcaggacaggatttggcccagccaatgttcattcaatcagctaatcagcctagcgacggacaggccccacaggtaactggagattag

SEQ ID NO: 127033 - DNA, 1008 bp, Artificial Sequence
  Description of Artificial Sequence: Synthetic coding sequence
atgagtacagaaggaggattcggtggcacgtcaagcagcgatgcccagcagtcactacagagcttttggccccgcgtcatggaggaaatcaggaatctcacggtcaaggatttccgggtgcaggagttgccgctggctcggattaagaagatcatgaaattagacgaggacgtgaaaatgattagcgcggaggcgcccgtactgtttgcaaaggcggcccagatattcatcacagagttaaccctgcgggcgtggattcatacggaggacaataagaggagaactctgcagcggaacgacattgccatggctattactaagtttgatcagttcgactttctgattgatattgtgccgcgcgatgaactaaagcctcctaaacggcaagaggaggtgcgacagagtgtaacaccagcagaacccgtgcagtactattttaccttagcgcaacagccaacggccgtgcaagtgcaggggcaacagcaaggccaacagacaacttctagtaccaccacaattcagcctggtcagatcatcattgcgcaaccccagcaagggcaaaccacccccgtcacaatgcaagtcggcgaaggacagcaggtacagatcgtccaggctcaaccccagggacaagctcagcaggctcagagtgggactgggcaaacaatgcaggtgatgcagcagatcattacgaatacaggggaaatccagcagatccctgtccagctgaatgccggacaattgcagtacatcaggctcgctcagccagtctccggaactcaggtggtgcagggtcaaattcagacactcgccacaaatgcccagcagatcactcagaccgaagtgcaacagggacaacagcaattttctcagttcactgacggccagcagttgtaccagatacagcaggtcaccatgccggcaggccaagatttggctcagcctatgttcatccaaagcgcaaatcagccctcggacggccaggccccccaggtgaccggagattag

SEQ ID NO: 127034 - DNA, 1008 bp, Artificial Sequence
  Description of Artificial Sequence: Synthetic coding sequence
atgtccacagaaggcgggttcggaggcacttcatcgtccgacgcacagcaaagcttgcaatctttttggcccagggtgatggaagagatacgtaacttaaccgtaaaagacttcagagtacaggaattacctctcgcgagaatcaaaaagatcatgaagttggacgaggacgttaaaatgatctccgccgaggctcctgttctgttcgcaaaggccgctcagatcttcatcactgaattgaccctacgggcctggatccataccgaggacaataagaggcgtaccctccagcgcaatgatatagcaatggctataacaaagttcgatcaatttgatttcttgattgatatcgtgccacgcgatgagctgaagccacccaagcgacaggaagaagtacgccaatcggtgacacctgcagagcctgttcaatactacttcaccctcgctcagcagccgactgccgtgcaggtccaggggcagcagcagggccagcaaacaaccagcagtactaccacaatccaaccaggtcagatcatcatcgcacaacctcagcaagggcaaactacccccgttacgatgcaggtgggggagggccaacaggttcagatcgtacaggcccaaccccagggccaggcccagcaggcccagagcggtaccggacagaccatgcaggttatgcagcaaataattaccaacactggcgagatccagcagatccccgttcagcttaacgctggccagctccagtacatacggctggctcagccagtgtcgggaactcaggtcgtacaaggacagattcagacactggccacaaacgcacagcagatcacgcagaccgaggtacagcagggccagcaacagttcagccagtttactgatggccagcagctgtatcagatccagcaggtcaccatgcctgctgggcaggatctggcacagcctatgttcattcagtccgcaaaccaaccatcagacgggcaggccccacaggtgacaggggactag

SEQ ID NO: 127035 - DNA, 390 bp, Artificial Sequence
  Description of Artificial Sequence: Synthetic coding sequence
atgagcactgaaggcgggttcggaggaacttcctcctcggacgcccagcagagtttgcagtccttctggccgcgagtgatggaagaaatccgaaacttaaccgttaaagacttccgcgtgcaggagttacccctggctcgcattaagaagatcatgaaactcgacgaggatgttaaaatgataagcgctgaggcacctgtcctcttcgcaaaggctgcccagatcttcataacagagcttacccttagggcatggatacatacggaggataacaagagaagaaccctgcaaaggaatgatattgctatggcaattactaaattcgatcagttcgatttcctcattgacatcgtgccgagagatgaattgaaaccacccaaacggcaatag

SEQ ID NO: 127036 - DNA, 1005 bp, Artificial Sequence
  Description of Artificial Sequence: Synthetic coding sequence
atgagcactgaaggtggctttggtgggacatcgtccagcgatgctcaacagtcactgcagtccttctggcctcgtgttatggaagagattaggaatctcaccgtgaaagactttcgtgtgcaagaactgcccctggccaggattaagaagattatgaagctcgatgaagatgtcaagatgatatctgcagaggctcccgtacttttcgccaaagctgcacagatcttcataaccgagcttacactgcgggcgtggatccacaccgaggataacaagagacgaactcttcagagaaacgacattgcaatggccattaccaaatttgaccagttcgacttcctgatagacattgtgccaagggatgagctgaagcctcccaaacgccaggaggaagtgagacagagcgttactcctgcagaacccgtgcagtattactttacacttgctcagcagccaaccgcagttcaagtccagggacagcaacagggccagcagaccaccagtagtactactaccatccagccaggacagatcatcattgcccagcctcagcaaggacagacaactcccgtgactatgcaagtcggcgaaggacaacaggtgcaaatcgtccaggcccagccccagggccaggctcagcaagctcagtccgggaccggacaaaccatgcaggtgatgcagcagatcatcactaacaccggcgagatccaacaaattcccgtccagctgaatgccggccaactgcagtatattcgcctggcccagccagtgtctgggacccaggtcgtccagggccaaattcagacactggcgacaaatgcccaacagattactcagacggaggtccagcagggtcaacaacagttctctcagttcacagacggacaactgtatcagatccaacaggtgactatgccagcaggacaagacttagctcagcctatgttcatacagtccgcaaaccagccttcggatgggcaggctccacaggtcacgggtgattag

SEQ ID NO: 127037 - DNA, 426 bp, Artificial Sequence
  Description of Artificial Sequence: Synthetic coding sequence
atgagcacagaaggcggatttggaggaacgtcgagttctgatgcccagcagtcattgcaatcattctggccaagggtaatggaggaaatcagaaatttaaccgtgaaggatttccgcgtccaagagctcccattggctcgtatcaagaaaatcatgaagctggatgaggacgtgaaaatgatttcggccgaggccccagttctgttcgcaaaagcggctcagatcttcatcactgaattgacgctgagggcttggatacacacagaagacaataagagacgcaccctgcagcggaatgatatagccatggctattacaaagttcgaccagttcgattttctgatcgacatagtgccaagggacgagctgaaaccccccaaacgccaagaggtacgacagagcgtcactcctgcagagccagtatag

SEQ ID NO: 127038 - DNA, 288 bp, Artificial Sequence
  Description of Artificial Sequence: Synthetic coding sequence
atgagcaccgagggcggctttggtggcacaagctcatctgatgcccaacaatccctgcagagcttctggccaagggtgatggaagaaatcaggaatctgacggtgatgatctctgccgaggcgccagtcctattcgccaaggcagcacagatctttatcacggaactgacgctgagagcctggatacataccgaggataataaacgcagaaccctgcagcgtaatgacattgcgatggctattaccaaattcgaccagtttgacttcctcatcgacatcgtgccctag

SEQ ID NO: 127039 - DNA, 183 bp, Artificial Sequence
  Description of Artificial Sequence: Synthetic coding sequence
atgtctacagaaggcgggttcggggggacttcttcctctgatgcccagcaaagcctgcagtccttttggccccgtgtgatggaggaaataagaaatctgacagtcaaagacttccgcgtgcaagaactgcctctggctaggataaaaaaaataatgaaactagacgaggatgtgaaaatgtag

SEQ ID NO: 127040 - DNA, 159 bp, Artificial Sequence
  Description of Artificial Sequence: Synthetic coding sequence
atgtctaccgaggggggtttcggtgggacatccagctccgacgcccaacagtcattgcagtctttttggcctagagttatggaagaaatcagaaacctgacagtgaaagattttcgggtgcaggagctacccctcgcacggatcaagaagattatgtag

SEQ ID NO: 127041 - DNA, 555 bp, Artificial Sequence
  Description of Artificial Sequence: Synthetic coding sequence
atggcaagatctctcgtccatgatacagtgttctattgcctgagcgtctaccaggtgaaaatctcacccacccctcagctaggcgcggcaagcagtgctgaagggcacgtagggcagggcgcacccggtctgatgggcaatatgaacccagagggaggtgttaatcacgaaaacgggatgaaccgggatggaggaatgatcccagagggcggaggggggaatcaggagccacgacagcagccacagccacctcctgaggaacccgcccaggccgcaatggaggggccccagcctgagaatatgcagccaagaacccgcaggacaaagttcacactgttgcaagtcgaagagttggagagcgtttttcgacacacccaatatcccgacgtccccacacgaagggaattggccgaaaacctgggcgtaaccgaagacaaagtgcgcgtgtggttcaaaaacaagcgtgctcgctgccggcggcaccagcgggagttgatgctggcaaatgaactgagagccgatccggatgactgcgtctacatcgtcgttgactag

SEQ ID NO: 127042 - DNA, 345 bp, Artificial Sequence
  Description of Artificial Sequence: Synthetic coding sequence
atggataagaggcgcagagcactgacgagactgtacttagacaaagcaaccctaatttggaatggcaacgctgtgtcgggcttggatgcattgaataatttctttgacactctgccctccagtgaattccaggttaatatgctcgactgccagcccgtgcatgagcaagccacacagtctcagaccacggtgctggttgtaacttcagggaccgtcaaatttgacggcaataagcagcattttttcaaccagaattttcttttgacagcccaaagtacaccaaacaacaccgtctggaaaatcgctagtgattgcttcagattccaggattggtccagctcgtag

SEQ ID NO: 127043 - DNA, 429 bp, Artificial Sequence
  Description of Artificial Sequence: Synthetic coding sequence
atggctacctctcttgactttaagacatacgtggatcaagcgtgccgcgccgcagaagagttcgtcaatatctactatgaaaccatggataagcgccgccgcgccctgactagattgtacctggataaggctacactgatatggaacggaaacgctgtttccggactcgatgccttaaataacttcttcgacacactgcctagttccgaattccaagtgaacatgctggactgccaaccagtgcacgagcaggccacgcagtcccagaccactgtgctggttgttacgtctggaacagttaagttcgatggcaataaacaacatttctttaaccagaacttcctgttaacagcccagagcacccccaacaatacagtgtggaaaatagcctcagattgctttaggtttcaggactggagctctagttag

SEQ ID NO: 127044 - DNA, 345 bp, Artificial Sequence
  Description of Artificial Sequence: Synthetic coding sequence
atggacaaacgccgccgcgctctcacacggttgtacttagataaagccactcttatttggaatgggaacgccgtaagtgggctggacgcactgaataactttttcgatacactgccaagctcagaattccaggtgaatatgctggattgccagcctgttcacgagcaggccacccagtctcagacgaccgtgctggtggtaacctcaggaactgtcaagttcgacggtaataagcaacatttctttaaccagaactttctgctgactgcacagagtactcctaataacacggtatggaagatagcttctgattgttttcgattccaggactggtctagcagctag

SEQ ID NO: 127045 - DNA, 882 bp, Artificial Sequence
  Description of Artificial Sequence: Synthetic coding sequence
atgaccggactttatgaacttgtctggcgcgtcctgcacgcattactctgccttcatcggacccttacttcatggctgagggtgagatttgggacatggaattggatctggcgacggtgctgcagagcagcatcagcagcggtactggctccactcggcttcacactgaggaagccgccagcagtgggaaggaatcgcagacaccatcgacatccccggggcggctcctgcctggcagccgcccatcaccgaatgcgctggcgtgcagacggccggagcctcgagaagctacccgtccacatggggctcgtaattactgaggtcgagcaggaaccatctttctcggatatagcctctctggttgtttggtgcatggcagtcgggattagctacatatcagtctacgatcaccagggaatcttcaaaagaaacaactcccgactcatggacgagattcttaaacaacagcaggaacttctgggactggattgcagcaagtattcccctgaattcgccaactctaatgataaagacgaccaggtgctaaactgccatttggccgtgaaagtgttgtcaccagaggacggcaaagcggatatcgtgcgagctgcccaggacttctgccaactggtggctcaaaagcagaaacggccaactgacttggacgtcgataccctcgcaagcctactgtctagcaatgggtgtcccgacccagacctagtcctcaaattcggccctgtggacagcacactgggattccttccatggcacataagactgacagaaatagtgagccttccctcacacctcaacattagctacgaggatttcttctccgcactgagacaatatgctgcctgcgagcagcggttaggcaagtag

SEQ ID NO: 127046 - DNA, 2571 bp, Artificial Sequence
  Description of Artificial Sequence: Synthetic coding sequence
atgaagccccgcccagccggttttgtggacaacaagctcaaacagagagtaatccagtatttgacctccaacaaatgcggcaagtatgtggatatcggcgtcctggctagtgacctgcaaagggtttatagtatagattacgggaggcgcaagagaaacgcattccgtatccaggttgagaaagtgttttctatcatctcctcagaaaaggagcttaagaacctgactgaattggaggacgaacacttggctaagcgggcccggcagggcgaggaggacaacgaatacaccgaatcctattccgatgacgactctagcatggaggactatcccgatccccagtctgccaatcacatgaacagctctctgctttcgctgtatcgtaaaggcaaccccgattctgttagcaacactcctgaaatggagcagcgtgagaccacgtctagcactccgagaatctctagcaagacgggttcaatacccctcaagacacccgcgaaggacagtgaggggggatggttcattgataaaacgccgtcagtcaaaaaagattccttctttcttgacttgtcttgtgaaaagtccaaccctaaaaagcccattaccgagatccaagactccaaggattctagccttctggaatccgatatgaaacggaaaggaaaacttaaaaataagggctcaaaacgcaagaaagaggaccttcaggaggttgacggggagatcgaggccgtcctgcagaagaaagcgaaagctcgaggcctcgagttccagatctccaatgtgaaatttgaggacgtaggcgggaatgacatgacgctgaaggaagtgtgcaaaatgctgatccatatgcggcaccccgaggtctaccaccacctgggggtcgtcccacctcgaggggtcctcctacatggcccaccagggtgcggaaagacattgttggctcacgccatagctggggagctcgatctcccgatcctgaaagtcgcggctccggagatcgtgtctggggtgtcaggcgaatctgaacagaagctccgagaactttttgagcaagccgtttcaaatgcaccatgcattatcttcatcgacgaaatcgatgcgattacccccaaacgagaagttgcctccaaggacatggagagacgcattgtggctcagctgctcacctgtatggatgacctgaacaacgtagccgctacagcacgagtattggtcataggtgctacgaacaggccggatagtctggacccagcactccgccgagctgggaggttcgatcgggagatttgcctggggatcccggacgaagcctcgcgggaaagaatcctgcaaaccctttgtagaaagctgcggctgccccaggctttcgacttttgccacctggcccacctcacccctggattcgtgggagcagatctcatggctctgtgtcgggaggccgctatgtgtgctgttaacagagtgctgatgaagcttcaagagcagcaaaaaaaaaatcctgagatggaagatctgccctcgaagggtgtccaagaagagcgattgggtactgaacctacaagcgagactcaggatgagttgcagcggctgctgggactgctgcgggatcaggacccgctgtccgaagagcagatgcaggggctgtgcattgagctgaacgattttattgtcgccctgagctccgttcagcctagcgccaagcgcgaaggttttgttacagttccaaatgtgacctgggccgacattggcgccctggaggacatcagggaggagttgactatggcaatcctggctcctgtgcgcaatcctgaccagtttaaggccctggggctggtcacgccagccggggtactgttggccggtcctcccggatgcggaaagaccctgctcgccaaggcagtggcgaacgagagcggtttgaacttcattagcgtgaaaggaccagagctgctgaacatgtacgtcggggagtctgaaagggccgtgcgccaagttttccagcgggcgaaaaacagtgccccctgcgtcatcttctttgatgaggtggatgccttatgtccgcgccgcagcgatagggagacaggggccagcgttcgcgtggtcaaccaactactcacagagatggacggactggaggcaagacagcaggtgtttatcatggctgcgacaaatcgtcccgacatcatagaccccgcaatcctgagacctggacgcctagataaaactttgtttgttggactgcctccccccgctgatcgcctagcgattttaaaaaccattacaaaaaacggcactaaaccccccctggatgctgatgtgaatctcgaggccattgccggggacctacgttgcgattgctataccggcgcggacctttccgctctggtccgcgaggcaagcatctgtgcgctccggcaggagatggcccgacagaaatctgggaacgaaaaaggagagcttaaggtctcacacaagcacttcgaggaggcctttaaaaaggtgcggtcttccatttcaaaaaaagaccagattatgtacgagcgtcttcaggagagtttgtctcgatag

SEQ ID NO: 127047 - DNA, 2004 bp, Artificial Sequence
  Description of Artificial Sequence: Synthetic coding sequence
atgaagaggaaaggtaagctgaagaacaaggggagcaaacgtaaaaaagaggacctgcaggaagtggacggcgagatcgaagccgtgctgcagaaaaaagctaaggccagagggctggagttccagataagtaacgtgaagttcgaggatgtggggggtaatgacatgaccctgaaggaagtgtgcaagatgctgattcatatgaggcatcctgaggtgtaccatcatctaggggtggtccctccccgcggtgtgttgctgcatgggccccccggctgtggtaagaccctcttagctcatgctatagcgggcgcagaatgttccggcatgataacggcccattgttcattcgatttcagcggcagcaatgacccacctgcctccgccagccaagagcttgacctgccaatcctgaaggtagctgcaccggagatagtttccggagttagcggcgagtcagaacagaagcttagggagctcttcgagcaggccgtgtccaacgccccttgcattattttcatcgacgagattgatgccatcactcctaaacgcgaagtggcatctaaggacatggaacgccgtatcgtagcccaactcctgacctgcatggacgatctaaataatgtggcagctacagctcgcgtgctggtgatcggcgcgaccaatagacccgattcactggaccccgccttgagaagggccgggagattcgatcgagagatttgcctgggaatcccagacgaagcgagtcgcgaacgcatcctacagacactgtgccggaaactgcggttaccccaggccttcgacttctgtcatctggcccacctaacccctggctttgtgggagccgacctcatggccttgtgccgcgaggcggccatgtgcgcggtgaatcgcgtcctgatgaagctgcaggaacagcaaaaaaagaatcctgagatggaggacctcccttccaagggggtacaggaggagaggcttggaaccgagcccacctctgaaactcaggatgagcttcagcggctattgggcctgctgagagaccaggacccactgagcgaggagcagatgcagggcctgtgcattgagctgaacgactttattgtggctctgtcaagcgtccagcctagcgctaaacgagaaggtttcgtcacagtacctaatgtcacatgggccgatatcggcgccttagaggatatcagagaagaactcacaatggccatactggcgccagtcaggaatcccgatcagttcaaagccctcggccttgttacacctgccggggttctgctggctggcccccctgggtgtgggaagactctgcttgccaaggctgttgctaatgagtcaggtctcaatttcattagcgtaaaaggccccgaacttttgaacatgtacgtcggggaatctgaaagggcggttcggcaggtctttcagcgggccaagaactctgccccttgcgtgatcttcttcgatgaagtcgacgctctctgccccaggcgatccgatcgagagacaggcgcctctgtgagagtcgtgaaccagctgctcacagaaatggacggcctggaagcacgtcagcaagttttcattatggccgcaaccaaccgtcctgacattatagacccagccattctcagacctggaagacttgacaaaacgctgtttgtcggactgccgccccctgccgatcgccttgccattttgaaaactatcaccaagaatggaacaaaaccaccactagacgccgatgtaaatctggaagcaattgccggggaccttaggtgcgactgttacaccggagccgacctgtctgcactagtgcgtgaggcatcaatctgtgctttgagacaggaaatggcgcggcaaaagagcggcaacgaaaagggggaattgaaagtaagccataaacatttcgaagaggcatttaagaaggtgcggtccagcatctccaaaaaagaccagatcatgtacgaacgcctgcaagaaagtcttagccgctag

SEQ ID NO: 127048 - DNA, 1770 bp, Artificial Sequence
  Description of Artificial Sequence: Synthetic coding sequence
atggaagattatcccgacccccagagcgctaaccacatgaatagctcccttctcagcttatatagaaaaggaaaccccgactctgtgagcaatacaccggaaatggagcagcgagagacaacatcctccaccccaagaatatcaagtaaaacgggatcaatccccctgaaaacacccgccaaggactccgagggaggatggtttatcgacaagactccctccgtcaaaaaagattcattctttcttgatctctcctgtgagaagtccaaccctaaaaagcccatcaccgagatacaagactccaaggacagctccttattggagagtgacatgaaaagaaaagggaagctaaagaacaaaggtagcaagcggaagaaggaagatcttcaggaggtggacggtgaaatcgaggcagtgctgcaaaagaaggctaaggcccgcggcctcgaatttcagatttcgaacgttaaattcgaggacgttggtggaaacgatatgacactcaaggaggtttgcaagatgctgatccacatgaggcatcctgaagtgtatcatcaccttggcgttgtaccaccccgcggggtgctgcttcacggtccacccggctgtggcaaaacacttctggctcacgcaattgctggtgaactggacctaccaatcttaaaagtcgccgccccagagattgtcagtggagtttccggagagtcagagcagaagctgcgcgagctcttcgaacaagctgtgagcaatgcgccttgcatcatctttatagatgagatcgatgcaatcaccccgaagcgtgaggtcgccagcaaagacatggaacgtaggattgtggctcaactgctcacctgcatggacgacttgaataatgtggccgctacagcccgcgtgttagtgataggagctacgaacaggccagactcattagatcccgcactgaggcgcgctggtcgcttcgatcgggaaatttgcttaggaatacccgacgaggcgagccgcgaacgtattctccaaaccctgtgtcggaaattgagactgccgcaggcttttgatttctgccatctcgcacacctaacccccggcttcgtgggcgcggacctgatggcactctgtcgcgaggccgccatgtgcgctgtaaatagagtgctgatgaagctccaggaacagcaaaaaaaaaaccccgagatggaagacctgccctcgaaaggtgttcaagaggagcgcctgggcacagagccaactagcgagacccaggacgaactccagagactcctgggtttgcttcgtgatcaggacccactgagcgaggaacaaatgcagggcctatgcatcgaactcaacgactttatagtggctctctccagtgtgcagccctctgccaagagagaggggtttgtgacggtgcctaatgtcacttgggccgacatcggcgcattggaggatatccgggaggaactcacgatggcgatactcgcacccgtccggaacccagaccagtttaaggctttagggcttgtgactccagccggcgtgctccttgccggccctcctggctgcggtaagacattactcgccaaggccgtcgccaacgagtctggactgaatttcatcagtgtgaaggggcccgagctgctgaacatgtacgtgggggaatccgaaagagctgtcaggcaggtatttcagcgagccaaaaattcagcaccttgtgttatcttttttgacgaggtcgatgctctgtgccccaggagatctgatagggaaatctag

SEQ ID NO: 127049 - DNA, 2253 bp, Artificial Sequence
  Description of Artificial Sequence: Synthetic coding sequence
atggaagactaccccgatcctcagtccgctaatcatatgaattcctcattactaagtctttaccgcaaaggtaacccagacagcgtgtccaacacacctgaaatggagcagcgagagacaacatcatcaactccccgcatttcatctaagaccggtagtattcctttaaaaaccccagcaaaggattcagaggggggctggttcatcgacaaaactccctcagtcaagaaggatagcttctttctggacctgtcctgcgagaagagtaaccccaagaaacccataactgaaatccaggattcaaaggactcttcccttctggagtccgacatgaagagaaaggggaaactgaaaaataaaggcagtaagcgcaagaaagaggatcttcaggaggtggatggtgaaattgaggcagtacttcaaaagaaagcaaaagccagaggtctcgaatttcagatcagtaatgttaagttcgaagatgtgggcggaaatgatatgacccttaaagaggtgtgtaaaatgcttatccatatgagacaccctgaagtttaccaccacctgggcgttgttccaccgcgaggagtgttattacatggtccccctggatgcggcaaaaccctcctcgcacacgccattgcaggagagctcgatctgccgatactgaaagtagccgcccccgaaattgtctctggtgtcagtggggagtctgagcagaagctcagagaactctttgagcaggccgtgtctaatgcgccctgtatcatattcatcgacgagattgatgccataactcccaagagggaagtcgcctcaaaggacatggaacgccgaattgtggcgcaactccttacctgtatggacgatcttaataatgtcgctgcaaccgcaagggtacttgtcattggagcaaccaaccgcccagattctctggatccagcgctgagaagggctgggcgcttcgaccgcgagatctgccttggcatccccgacgaagccagccgcgagagaatattacagacactgtgtcggaaactacgcttaccccaggcctttgatttttgccacctcgctcacctgacacctgggtttgtgggagctgatctgatggctttatgtcgagaggccgctatgtgcgccgtaaatcgcgtgctcatgaagctccaagaacagcaaaagaaaaatcctgaaatggaggacttgccaagcaaaggggtgcaggaagaaagattgggtacagagccgacgtctgagacccaggacgaactgcagcggctgttgggattactgcgcgaccaggatcccctgagtgaggaacagatgcagggcttgtgcattgaactgaatgatttcatagtagctctaagctccgtgcaaccatctgccaagcgtgagggcttcgtgactgtccctaacgtgacctgggcagacattggggccctggaggatatccgggaagagctcacgatggccattttagctcccgtacgcaatccagaccaattcaaagctttgggactcgtaacgcccgctggtgtcttactcgctggccctcctggctgtggaaaaactctgctggcgaaggccgttgcaaatgagtcaggcctcaactttatctccgtgaagggccctgaactcctgaatatgtacgttggcgaatccgaaagagcagtgagacaagtgttccaacgtgccaagaactcagccccttgcgtgatcttcttcgacgaggtggatgccctttgtccaaggagatccgacagggagactggagcttcggtgcgcgtggtaaaccagctgctcactgaaatggatggtcttgaagcccgacagcaagtgtttatcatggcagcaaccaacaggccagatataattgatcccgcaattctccgcccagggcgccttgacaagacgctgtttgtggggcttccaccacctgcggacagactggccatactcaagaccatcacaaagaacgggaccaagcccccgctagatgccgacgttaacctggaggccatcgctggcgatctcaggtgcgattgttatactggcgctgacctgtcagccttagtgcgggaggcatccatctgtgccctccgccaggagatggcccgccagaagagcggaaacgaaaaaggggagctcaaagtgagtcataagcactttgaggaagcctttaagaaagtgaggtcatccatttctaagaaggaccaaattatgtatgagcgtctccaggagagtctgtctcggtag

SEQ ID NO: 127050 - DNA, 2298 bp, Artificial Sequence
  Description of Artificial Sequence: Synthetic coding sequence
atgaagcctagaccagccggtttcgtggacaacaaactgaaacagcgcgttatccaatatttaacctccaataagtgcggtaaatacgttgatattggtgtgttggcttctgatctgcagcgcgtttactcgatcgactacggtaggcgtaagcgcaacgccttccgcatccaggtggagaaggttttttctatcatttctagcgaaaaagagttaaagaatttgacggaactcgaggacgaacatctggctaagagggcaaggcagggcgaagaggataacgaatacacagaatcatatagcgacgatgactcgtccatggaagattatccagatccccaagacagcaaagactcaagcctgctggagtccgacatgaagaggaagggaaaactgaaaaataaggggtctaagcgtaaaaaagaagacctccaggaggtcgatggagaaatcgaagcagtcctgcagaagaaggctaaggcaagaggcctggaatttcagatttcaaatgttaagttcgaggacgtgggaggcaacgacatgaccctgaaagaagtgtgcaagatgctcattcacatgagacaccccgaggtctaccatcacttgggggtggttcccccaagaggggtgctgctgcacggtccacctgggtgtggcaagactcttctcgctcatgccatcgcaggagagcttgacctaccgattctgaaggtggcggcccctgagatagtgtctggagtgagcggtgagagcgagcagaaattgcgagagcttttcgagcaggcagtgagcaacgccccttgtatcatttttattgacgaaatcgacgctattaccccaaaacgggaagtggctagcaaagacatggagcggcgtatcgtcgcacagctcttgacttgcatggacgacctgaacaatgttgctgccacggcccgtgtattagtgatcggcgccaccaatagaccagattctctggacccggctctcagaagagccgggcgctttgacagagaaatttgccttggtattcctgacgaggcctcccgcgaacgaatcctgcagactttatgcagaaaactgagactgccccaggcatttgacttctgccacctcgcacacttaacacctggattcgtcggcgccgacctcatggcactgtgtcgcgaggctgccatgtgtgccgtgaatcgagtgctcatgaaacttcaggaacagcagaagaaaaacccagagatggaggatctgccatcaaaaggtgtacaggaagagcgcctgggcaccgaaccaacgagcgagacccaggatgagttgcagcgcttattggggctgctgagggatcaggacccactgtccgaggagcagatgcagggactatgtattgagctaaatgatttcatcgtagcactctcctctgtccaaccgagcgccaaacgagaaggcttcgttacagttccaaacgtcacctgggccgatattggcgctttggaggacataagagaggagctgaccatggcaatcttggccccggtcagaaaccccgatcagtttaaagcactgggcctcgtaacgcctgctggcgtactcctggccgggccccccgggtgcggcaaaacactcctggccaaagctgtagccaatgagtctgggcttaactttatcagcgttaaggggccggagcttttgaatatgtacgtgggcgaatccgagcgcgcggtccgccaggttttccagcgggcaaaaaattctgctccttgcgtgattttcttcgacgaagtcgacgccctttgccctcggcgatctgaccgagaaaccggcgcctcggtgcgggtggttaatcaacttctcactgagatggacggtctagaggcaaggcagcaggtctttataatggccgccacaaaccgccctgacatcattgaccccgcaatcctgcggccaggacgcttagataaaacgctcttcgtcgggctgcccccgcccgctgatcggctggccatactgaaaactatcacaaaaaatggaacaaaaccacccctggacgccgacgtgaatttagaggcaattgccggcgatctgcgatgtgactgttacaccggggccgatctctcagctctcgtgcgagaggcgagcatttgcgccttgcgccaagaaatggctcggcagaagagtggcaacgaaaagggcgaattgaaggtttcccacaagcactttgaggaagctttcaagaaggtccggtcatcgatcagcaaaaaagatcagatcatgtacgaacgccttcaagaaagcctgtcaaggtag

SEQ ID NO: 127051 - DNA, 1386 bp, Artificial Sequence
  Description of Artificial Sequence: Synthetic coding sequence
atgccaccttcagggccccgtggaacccttctcttactgcctctcctcttgctcctgctgctccgggctgtcctggcagtcccactggagagaggggcccctaataaagaggaaacaccagcaacggaatctcccgatactggactgtattaccacagatatttgcaggaagtaatcgacgtgctggagaccgacggccacttcagggagaagctgcaggctgccaacgcggaggacattaaatccggcaagctgagtagagagctggacttcgtctcccatcatgtgcggacgaagctggacgagttgaaacggcaggaggtgagcaggctccgcatgctactgaaagccaaaatggatgcggaacaggatcccaatgtgcaggtagaccacctcaacctcctgaaacaattcgaacatctcgatcctcagaaccagcacacctttgaagcgcgcgacctggaactcctcattcaaacggccacacgcgatctagcccagtatgacgccgcccatcatgaggagtttaagagatatgaaatgcttaaagagcatgaacggaggaggtacctggagtcccttggtgaggaacagaggaaggaagccgaacggaagctggaggaacaacagcgtcgccaccgtgaacatcccaaggtaaatgtgccaggcagccaggcccagctgaaagaagtgtgggaagagctcgatggactcgacccaaacagatttaatccaaagactttctttatcctacacgatataaattccgatggcgtcctggacgaacaggagctggaggctctattcacaaaagagttagagaaggtgtatgatcctaaaaacgaggaagacgatatgagagagatggaggaggaacgactgcgtatgcgagagcatgttatgaaaaacgttgatactaatcaggacaggctcgtgacactcgaggagtttctcgcctccacgcaacgcaaagaatttggggatacaggcgaagggtgggaaactgtggagatgcaccctgcctataccgaggaagagttgcgccggtttgaggaggagctggccgcgagggaagctgaactgaacgctaaggcacagcgactctcacaagaaaccgaggctcttggaagatcccaggggagactggaggcgcagaaaagggaactccagcaggctgtcctccatatggaacaaaggaaacagcagcagcaacagcagcagggccacaaggctcccgccgcccaccctgaaggacagcttaaattccaccctgacaccgatgatgtgccagtgccagcaccggccggcgatcagaaagaagtggacaccagcgagaagaagctgttggagaggctgcccgaggtggaggtgccacagcacttgtag

SEQ ID NO: 127052 - DNA, 1386 bp, Artificial Sequence
  Description of Artificial Sequence: Synthetic coding sequence
atgcctcccagtgggccacgcggaaccctcctccttctcccgctgctgcttcttctgctcctgcgtgcagtccttgctgttcctctggaaaggggcgcgcccaacaaggaggagacacccgccacagagagtccggatactggcctgtattaccaccgctacttgcaagaagtcatagatgtgctagaaactgatggtcactttcgtgagaaactccaggccgcaaacgccgaggacataaagtctgggaaactgagtcgcgagctcgactttgtgagccaccatgtgcgtacaaaactcgatgaacttaagagacaggaagttagcaggctaaggatgctgctgaaggcaaaaatggacgcagagcaagaccccaacgtacaggttgaccatctgaacctcctcaagcagttcgagcacctagaccctcaaaaccagcatacatttgaggcacgtgatctggaacttcttatacaaacagctactcgtgatctggcccaatacgacgccgctcaccacgaggagttcaaaaggtatgagatgctgaaggagcatgaacgcagaagatatttggaatctctgggggaagagcagagaaaagaggccgagcgtaaactggaggaacagcagaggagacaccgagagcaccctaaagtcaacgttcccgggtcccaagcccagctcaaagaagtttgggaggaactggatggcctggatccgaatcggttcaatccaaagacattctttattttgcacgatatcaactccgacggtgtactggacgagcaggagctagaagccctgttcaccaaagagttagaaaaagtttatgatcccaagaatgaagaagatgatatgcgggagatggaagaggaacggctcagaatgagagagcacgttatgaagaatgtggatactaaccaagaccggttagttactctagaagaatttctggcctcgactcaacggaaggaattcggcgacaccggggaaggatgggagaccgtcgagatgcatcccgcctataccgaggaggagctccgaagatttgaggaggagcttgcagcgcgagaggccgagctgaatgccaaggcgcagcgcttgtctcaggagacagaggcactcgggcgctctcaggggcggctggaggctcagaagcgcgaactgcagcaagcagtcctgcacatggagcagcgaaagcagcagcagcagcagcaacaaggacacaaggcccccgctgcccatcccgaggggcagctgaagtttcatcctgacaccgatgacgtgcccgtgcctgcccccgcaggtgaccaaaaggaggtggacacgtcagagaagaagctccttgagcgcttgcctgaagttgaagttccccagcatctatag

SEQ ID NO: 127053 - DNA, 1386 bp, Artificial Sequence
  Description of Artificial Sequence: Synthetic coding sequence
atgccaccctccgggccgagaggcactttgctgctgctcccactcttgttactgctcctcttacgggcggttctcgcagtgccactggaacgaggggcccctaataaagaggagaccccggccaccgagtcacccgacaccggactgtactatcatcgctacttacaagaggttattgacgtgctggaaactgacggacattttagagagaagctgcaagcagcaaatgcagaagatatcaagtctgggaagctcagtcgtgagctagacttcgtttcacatcacgtccggacaaaactggacgaattaaagcgtcaagaagtgagtagattgcgcatgctcctgaaggcgaagatggacgctgagcaggatccaaatgtgcaggtcgaccacctgaacctgctcaaacaattcgaacaccttgaccctcaaaaccaacacacttttgaggctcgggatcttgaactccttatacagacagcaacacgcgacctggcccagtacgacgctgcacatcacgaggagttcaagcggtacgagatgctgaaagagcatgaacggcgacggtacttggaaagtctcggtgaagagcagcgcaaagaggcagagcgcaagttagaggaacaacaacgaaggcacagggagcatcccaaagtgaatgttcctgggagccaagctcaactgaaagaggtgtgggaggagctcgacggtttggaccctaatagattcaatccaaagactttcttcatactgcatgacatcaattctgacggggtgctagatgagcaggagctggaggccctcttcactaaagagttggaaaaggtttacgatcctaagaacgaggaggacgacatgagggagatggaggaggaaagactgcgcatgagagagcatgtgatgaagaacgtcgacacaaaccaggaccgcttggtgactttggaagagtttctcgcaagtacacaacgtaaggaattcggggatactggcgaagggtgggagactgttgagatgcatcccgcctacacagaagaggagctgagacgtttcgaggaggaactcgcagctcgtgaggcagaattgaacgctaaagcccagagactctcccaagagactgaagctctgggtcggagccaggggcgacttgaggcacaaaaaagagaactccagcaggccgtcttacacatggaacagcggaaacagcagcagcagcaacagcagggccataaagcgcctgcggcccatccggagggacagcttaagtttcatcccgatacagatgatgttccggtgcctgcccccgccggggatcagaaagaggttgacacatccgagaagaagctccttgaacgtctccctgaagttgaagtcccacagcatctctag

SEQ ID NO: 127054 - DNA, 375 bp, Artificial Sequence
  Description of Artificial Sequence: Synthetic coding sequence
atgcccccgtctggccctagaggtactctcctgcttctgccactactgcttctgctgttacttcgggccgtcctggccgtacccctggaaaggggtgctcccaacaaggaagaaacacctgcaaccgagtcacctgatacaggactttattaccatcgctacctgcaggaggttatcgacgtgctcgagaccgacgggcactttagagaaaaacttcaggccgctaacgccgaggatataaaatctggcaagctctctcgagaattagatttcgtttcccaccatgttcggaccaaattggatgaattgaaacgccaggaggtctccaggctgagaatgctgctgaaggcaaaaatggacgcggagcaggactag

SEQ ID NO: 127055 - DNA, 336 bp, Artificial Sequence
  Description of Artificial Sequence: Synthetic coding sequence
atgcctccatcaggccctcggggcacactgttgttactccccctgctgcttctcctacttttgcgagccgttctggccgtgcctctagaacggggagccccgaataaagaggaaaccccggccaccgagtcccctgacacaggcctgtattatcaccgctacctgcaggaggtaatcgacgttctcgagacagatggccacttccgcgaaaagctgcaggccgccaacgcagaagatattaagtcaggaaagctgtcacgcgagttagatttcgtttcgcaccatgtacggaccaagctcgatgaactgaaaaggcaagaagtgtcaaggctgtag

SEQ ID NO: 127056 - DNA, 1263 bp, Artificial Sequence
  Description of Artificial Sequence: Synthetic coding sequence
atgagatggagaactatcctcttacaatattgtttcttgctaataacttgcctgctcactgctctcgaggcagtgcctattgacatcgataaaacaaaggtgcagaatattcacccagtggagagtgccaaaattgagcccccagatactggtctctactacgacgaatatctgaagcaagtcattgacgttttggagaccgataagcattttcgggaaaaactgcaaaaggccgatatcgaggagataaagagcggacgtctgtcaaaggagctagacctggtgtcgcaccatgtgcggaccaagctagatgaactaaagcgccaagaggtgggtcggctgcggatgctgataaaggcaaagcttgatagcctacaggatatagggatggatcaccaggctttgctcaaacagttcgaccaccttaatcacctcaatcctgataaattcgagtccactgaccttgacatgttgattaaggctgccactagtgaccttgagcattacgacaagacaaggcacgaggaattcaagaaatatgaaatgatgaaagagcacgaacggcgggagtatttgaagacccttaatgaagagaagaggaaggaagaggagtccaagtttgaggagatgaagaagaaacacgagaaccatccaaaggtgaatcatccagggtcaaaggatcagttgaaggaggtatgggaagagacagacggacttgatcccaacgatttcgatccaaagactttttttaagctccatgacgtgaattcagacggattcttagatgaacaggagctcgaggccctgttcaccaaggaattagagaaggtctatgacccaaagaacgaagaagacgatatggtagagatggaagaagaacgactgaggatgcgcgagcatgtcatgagcgaggttgataccaataaggataggctcgttactcttgaggagttcttgaaggctacggagaagaaagaattcctggagccagacagttgggagaccttagaccaacagcagttttttactgaggaggaactgaaggaatacgagaacatcatcgcactgcaagagaatgaactgaaaaaaaaagcggacgagctgcaaaagcagaaagaggaacttcagcggcagcatgaccagctggaggcacagaaattggagtaccatcaggtcattcaacagatggagcagaaaaagctgcaacaaggaattcctccttctgggcccgcgggcgagctgaagttcgagccgcgcgtgtag

SEQ ID NO: 127057 - DNA, 1173 bp, Artificial Sequence
  Description of Artificial Sequence: Synthetic coding sequence
atgagatggcgcacaatcctgctccagtattgttttcttttgatcacctgcttgctgaccgctttggaagccgtccccatcgacatagacaagactaaagttcagaacatccaccctgtggaatcagctaaaatagagcctcctgacacaggcctctactacgacgaatacctgaagcaggtgattgatgtcctggaaacagacaagcattttcgagaaaagcttcagaaggctgacatagaggagatcaaaagcggcaggctctccaaggagcttgacctggtctcccaccacgtacggacaaagctagacgagctgaaacgtcaggaggtcgggcgcctgaggatgctgatcaaggcaaagctggattcccttcaggacatcggaatggaccaccaagccttgctcaaacagtttgatcacctgaatcacctgaacccagacaagtttgaatcaactgacctggatatgctgattaaggcggcaacctccgacttggagcactatgataagactcgccacgaagagtttaagaagtatgagatgatgaaggagcacgaacggagagaatatcttaaaactctgaacgaagagaaaaggaaggaagaggaaagcaagttcgaggaaatgaagaaaaaacatgagaatcaccccaaagtaaaccacccggggtcaaaggaccaattgaaggaggtgtgggaggagaccgacggactggatcccaacgattttgatccaaaaactttctttaagcttcacgacgtgaactcggacggcttccttgacgaacaggagttggaggctttgttcaccaaggagctcgagaaagtgtacgatcccaagaacgaagaagacgacatggtggagatggaagaagagaggttgcggatgcgggaacacgttatgagtgaaaccctcgatcagcagcagttttttaccgaggaggaactgaaggaatacgagaacattattgctcttcaggaaaacgaactgaagaaaaaagctgatgagctgcaaaagcagaaagaggagttgcagaggcagcatgatcagctagaagcccagaaattagagtaccatcaagtgatccagcagatggagcagaagaagctccagcagggcatccctccttccgggccggctggggaacttaagttcgaaccccacatttag

SEQ ID NO: 127058 - DNA, 210 bp, Artificial Sequence
  Description of Artificial Sequence: Synthetic coding sequence
atgcggtggagaaccatccttctccagtactgtttccttctaattacatgcctattaacagccctggaggccgtgccgattgacattgacaaaaccaaggtccagaatatacaccctgttgaatcagccaaaatcgagccacccgataccggcttatactacgacgaatatctgaagcaggtgattgatgtgttggaaacggacaaatag

SEQ ID NO: 127059 - DNA, 105 bp, Artificial Sequence
  Description of Artificial Sequence: Synthetic coding sequence
atgcgctggagaactatcctcctacagtattgcttcttgctgatcacctgtctgcttactgctctcgaggccgttcccatagacattgacaaaaccaaagtttag

SEQ ID NO: 127060 - DNA, 1263 bp, Artificial Sequence
  Description of Artificial Sequence: Synthetic coding sequence
atgcgctggcgtaccattctgcttcaatactgcttcctgctgataacctgcctattgacagccctggaagcagtgcctatcgatattgataagaccaaggtgcagaacatccaccccgtagagtccgccaaaatcgaaccccccgatacggggttgtattatgatgaatacctaaaacaggtgatcgatgtccttgagaccgacaagcacttcagggagaagctgcagaaagcagacatcgaggaaattaagagtggcaggctgagcaaagagctggatctggtcagtcatcatgtgaggaccaagctcgacgaactaaagcggcaggaagtgggaaggctaagaatgcttataaaggcgaagctcgattcgttacaggatatcgggatggatcaccaagctctgcttaagcagtttgatcatctgaatcacctaaatccagataagtttgagagcactgaccttgacatgttgattaaggcagcaaccagcgacctcgagcattacgataagacgaggcatgaagagttcaagaaatatgaaatgatgaaagagcacgagcgccgggagtacttaaaaacgctcaatgaagagaagaggaaggaggaggagtctaaattcgaagagatgaagaagaaacacgaaaatcatcctaaggtgaaccacccaggcagtaaggatcaactgaaggaggtgtgggaggagacagacggcctggaccctaacgatttcgacccaaagaccttcttcaagctgcacgatgtgaatagcgatgggtttctggacgagcaggagctggaggcactgttcaccaaagagcttgaaaaggtatacgatcctaagaacgaggaggatgacatggtcgagatggaagaggagcgactaaggatgagggaacacgtgatgtcagaggttgataccaacaaggaccgtttggtcaccctggaagagttcctgaaggccaccgagaagaaggaattcctcgagccagactcatgggagacactggatcagcagcagtttttcacagaggaggaactaaaagagtatgagaacataatcgcattgcaagagaatgagctcaaaaagaaggcggatgagcttcagaagcagaaagaagaactccagcgacaacacgatcaactcgaggcccaaaagctggagtatcatcaggtgatacaacagatggaacaaaagaaattgcagcaaggcataccaccctccggccccgcgggtgagcttaaattcgagcctcacatctag

SEQ ID NO: 127061 - DNA, 588 bp, Artificial Sequence
  Description of Artificial Sequence: Synthetic coding sequence
atgaggtggcgcaccatcctcctgcaatattgttttctcctcatcacctgtctgctgactgctcttgaggccgtgcctatcgatattgataaaactaaagtacagaatatccaccccgtggagtcagctaagatcgagccacccgatactgggctatactatgacgagtatcttaaacaggtgattgatgtgctcgagactgataagcacttcagagaaaaacttcagaaggccgacattgaagaaatcaagagcgggcggctgtccaaggagcttgaccttgttagtcaccacgtccgaaccaagttggatgagctgaagcggcaagaggttgggcgtttgaggatgcttattaaggccaaattggattccctgcaggatatcgggatggaccatcaggcgctactgaaacagttcgatcacctaaatcacctcaaccctgacaagtttgaaagcacagacctggacatgctgattaaagccgccacctcagatctggaacattatgacaagactcggcatgaagaatttaagaagtatgagatgatgaaggagcacgagagaagagaatacctgaaaacactctag

SEQ ID NO: 127062 - DNA, 597 bp, Artificial Sequence
  Description of Artificial Sequence: Synthetic coding sequence
atgcggtggcgtaccatattgctacaatactgtttcttgctgatcacgtgcttgttgacagctctggaagctgttccgatcgatattgataagacaaaagtccagaatatccaccctgtcgagtcagcaaaaatcgagccccctgacactggactgtattatgacgagtacctaaagcaggtcatcgatgtcctggaaaccgataaacactttcgggagaagcttcaaaaggccgatatcgaagaaataaaaagtggacggctgagcaaggaactggatctcgtcagtcatcacgtgcgaacaaagcttgatgagctgaagagacaggaggtaggaagactgcgaatgctgatcaaagcgaagctagactctctgcaagacataggtatggatcaccaggccctgctgaagcagtttgaccacctgaaccatctgaatccagacaagtttgagtctacagacttggacatgttgatcaaggcggccacatctgatttggaacattacgacaaaacccgccacgaagaatttaagaaatacgaaatgatgaaagagcacgaacgcagggaatatttgaagacccttaatgaagagtag

SEQ ID NO: 127063 - DNA, 105 bp, Artificial Sequence
  Description of Artificial Sequence: Synthetic coding sequence
atgagatggaggacaatcctgctacagtattgctttctactcattacctgcctgttaactgcactggaagccgtcccaatcgacatcgacaaaacgaaagtctag

SEQ ID NO: 127064 - DNA, 120 bp, Artificial Sequence
  Description of Artificial Sequence: Synthetic coding sequence
atgaggtggaggaccatactcctgcagtactgttttcttctcattacctgcctactgacagccctggaggccgttcctattgacatcgataagactaaggtgcagaatattcacccctag

SEQ ID NO: 127065 - DNA, 210 bp, Artificial Sequence
  Description of Artificial Sequence: Synthetic coding sequence
atgcggtggcgcactatcttgctacagtattgcttccttttaattacctgcctgttgaccgccttggaagccgtaccaattgacatcgacaagacaaaggtccagaacatacaccccgttgaatcggccaagattgaaccccccgatacaggattgtattacgacgagtacctcaagcaggtgatcgatgtgcttgaaacagacaagtag

SEQ ID NO: 127066 - DNA, 273 bp, Artificial Sequence
  Description of Artificial Sequence: Synthetic coding sequence
atgcgctggcgtaccattttgctccagtattgcttcctcctgattacctgtctactgacggctctggaagctgtgcccatcgacattgacaagacgaaagtccaaaacatccatcctgtagagtccgcgaaaatcgagcccccagataccggcctttactatgatgagtatctgaaacaagttatagacgtacttgaaactgataagcatttccgggaaaaactccagaaagctgatatcgaagagatcaaaagcgggcggctgtcaaaatag

SEQ ID NO: 127067 - DNA, 1323 bp, Artificial Sequence
  Description of Artificial Sequence: Synthetic coding sequence
atgattatcccatctttggaagagctcgacagcctgaagtactctgatctacagaacttggctaaatcgctcggactgagggctaacttgcgtgcaaccaagttattgaaggctctcaaaggatacatcaagcatgaagcaagaaaagggaacgagaatcaggatgagtcccagactagcgcttctagttgtgatgaaaccgagattcagattagcaaccaggaggaagcggagcgccagcctctaggccatgttaccaaaacgcggcgaaggtgtaaaaccgtgcgggtggatcccgatagtcaacagaaccacagcgaaattaagatatccaaccctacagaatttcagaaccacgagaaacaggagtcccaggatctgagggctactgcgaaagtgcctagcccgccagatgaacaccaggaggcagagaatgctgtgagctccggaaaccgtgactccaaagtaccctccgaaggaaagaaaagcctatatacagacgagagctctaagcccggcaaaaacaaacgcaccgccatcaccacaccaaattttaagaagttgcatgaggcgcactttaaagaaatggagagcatcgaccagtatattgaaagaaagaaaaagcacttcgaagagcacaactctatgaatgaattaaaacagcctataaataagggaggcgtgaggacaccggtcccaccccgggggagactgtctgtcgcctcgacccctattagtcagaggcgcagccagggaagaagctgcggaccagcctcacagtcaacactcggcctgaagggctccctgaagcggagcgccatcagcgcggctaagaccggcgtgcggtttagcgcagccactaaggacaacgaacacaagcggagcctgacgaaaacccctgcgcgcaaaagcgcacacgtgaccgtgagtggcgggacccccaagggagaggccgtactgggaacacacaagttgaaaaccattaccggaaatagcgcagcggtcattacaccattcaagctgaccactgaggcgacccagactcctgtgagcaacaaaaagcctgtgtttgacctgaaagcctcactctcccgcccgctgaactatgaaccacataaaggaaagctcaagccttgggggcaatccaaagaaaacaactaccttaatcagcacgtcaaccgaattaatttttacaagaagacctataagcagccgcacttgcagactaaggaagaacagagaaagaaaagagaacaggaacggaaagaaaaaaaggccaaagtactcggcatgcgccgcggcctgatattagcagaagactag

SEQ ID NO: 127068 - DNA, 1209 bp, Artificial Sequence
  Description of Artificial Sequence: Synthetic coding sequence
atgatcattccttcgctggaggaactggattcactcaagtattccgacctccagaatctcgctaaaagcctcggactcagagccaatttaagagccacaaaactcttgaaggcactgaaggggtacatcaaacacgaggcgagaaaggggaatgaaaatcaggatgagtctcagacttccgcttcatcatgcgacgaaaccgaaatacaaatctcaaaccaggaggaggccgagagacagcctctggggcacgtgacaaaaactaggcgcaggtgcaagaccgtgagggtggacccagactcccagcagaaccattcagaaattaaaatcagcaaccccaccgagttccaaaatcacgaaaaacaggagtctcaggaccttcgggcgaccgccaaggtgccttccccccccgatgagcatcaagaagctgagaacgccgtgagtagcggaaacagggacagcaaggtacccagcgaaggtaaaaaatcactctacaccgatgaaagttctaaacccggcaagaataagaggaccgcgatcactacacctaactttaaaaaattgcacgaggcacacttcaaagagatggaatcaatagaccaatacatcgagaggaagaagaagcacttcgaggagcataattccatgaatgaactcaaacagcagccaattaacaagggtggcgttagaacacccgtccctcctcgaggtagactgagtgtcgcctctactccaatctcacagagacgcagccagggccggtcctgtggccctgcctctcagtcaaccctaggcctgaaggggtccctgaaaaggtcagccatttctgccgccaagacaggggtgaggttctccgccgccacaaaagataacgagcataagcgctcgctgacgaagacaccagcgcggaaatccgctcacgtgactgtcagtgggggtacacccaaaggggaagcagtcctagggactcacaagctcaagactatcacaggtaactcggctgctggcaagttgaagccttggggccagagtaaagagaataattatcttaaccagcacgtcaatcggattaacttctacaagaagacttataagcagccgcacctgcaaaccaaggaggagcagaggaaaaagagggagcaagagaggaaggaaaaaaaagctaaggttctgggcatgcgcagagggctaatattggcagaggactag

SEQ ID NO: 127069 - DNA, 1326 bp, Artificial Sequence
  Description of Artificial Sequence: Synthetic coding sequence
atgattataccatcactcgaagagttggacagcctgaagtactccgatttgcagaatttagctaagtccctaggtcttagggctaatctgagggccacaaaattactcaaggcattgaagggttatattaagcatgaagcgagaaaagggaatgagaaccaggatgagtcccagacctcggcctcatcgtgtgacgaaaccgagattcagatttctaatcaagaagaggccgagagacagccgctcggccatgtaacgaaaaccagaagacggtgtaagaccgtgagggtggatccggatagtcagcagaatcactctgagatcaagatcagcaaccctacagagtttcagaaccacgagaagcaggaaagtcaggatctacgggccaccgctaaggtaccatctcctcctgacgaacaccaggaggccgagaacgcagttagcagcggaaacagagactcgaaagtgccttctgaggggaagaagtcgctgtatactgatgagagttcgaagccaggcaaaaacaagcgcaccgctatcacaactcccaacttcaaaaagctacatgaggcccatttcaaggagatggagtccatagatcagtatatagaacggaaaaagaagcacttcgaagaacacaactctatgaacgagctaaaacaacaacctatcaacaagggtggtgtgagaaccccggtaccaccccggggacggctcagtgtcgccagcacccccattagtcagagaaggtctcagggaaggagttgtggacctgcctctcagagtaccctgggactaaaaggaagcctcaagagaagcgcaatttctgctgcaaaaaccggagtccgctttagcgccgcgaccaaagacaacgagcacaagaggtcccttactaagacaccagctagaaagtctgcccatgttacagtgagtggtgggacccccaagggcgaagcagtgttgggaacacataagctgaaaaccatcacaggaaactcggcagccgtgattacaccttttaaactgactaccgaggccactcagacccccgtgtccaataagaagcctgtctttgacctaaaagcctccttgtcacgcccgctgaattacgagccgcataaagggaaattaaagccctggggacagagcaaggagaataattacctaaaccagcacgtgaaccggatcaacttctataagaagacttataagcaaccccatctccagactaaggaggaacagaggaaaaaaagggagcaggagcgaaaggaaaagaaagcgaaggttctgggtatgaggcggggccttatcctggcagaagactag

SEQ ID NO: 127070 - DNA, 1323 bp, Artificial Sequence
  Description of Artificial Sequence: Synthetic coding sequence
atgataattccaagcctggaggagctcgacagcttgaagtactccgaccttcagaaccttgctaaatcgctgggcctgagggctaacttgagagccacaaagcttctgaaggcacttaagggatatattaagcacgaggcaagaaaaggaaacgaaaaccaggacgagagtcagacatccgcgtctagttgcgatgagacagagatccagatcagcaatcaagaggaagctgagaggcaaccattaggccacgtgacaaaaacaagacgtcggtgcaagaccgtaagagtggatccagacagccagaatcactcagaaatcaaaatatccaaccctacggaattccaaaaccacgagaagcaggaatcccaggatctccgtgctactgcaaaagttccatctccaccagacgaacatcaggaggcggagaatgcggtctcctctggaaaccgggattctaaggtcccatctgagggcaaaaagtcgttatacacagatgagagttctaaaccagggaagaataaacgcacggccatcaccacccccaacttcaagaaactgcacgaagcacacttcaaagaaatggaatccattgatcagtacattgaaaggaagaagaaacactttgaagaacacaacagcatgaacgagctaaagcaacagcctataaataaaggaggcgtacgaacaccggttccgccacgagggagactgtcagtggccagcaccccaatttcacagcgccggagccagggccgcagctgcggtcccgcatcccaatccactttaggattaaaaggctctctgaagcgatccgcaatctccgctgcaaagacaggagtgcgcttttctgcggccaccaaggacaatgagcataagaggtcccttaccaagacacctgcccgcaaaagcgcgcatgtgactgtgagtggcgggacgcctaagggtgaggcagtgctgggaacccataaacttaagactatcaccggcaacagtgccgccgtgatcacgccattcaaacttaccacagaagctactcagacgccagtgtccaataaaaaacctgtcttcgatttgaaggccagtctgtccaggcctctaaattatgaacctcataaagggaagctcaagccgtggggacagagtaaggagaataactatctgaaccaacacgtgaaccggatcaatttttacaagaagacctacaaacagccacatctgcaaaccaaggaagaacaacgaaagaagagagagcaggaacggaaagaaaaaaaagcgaaagtcctggggatgcggcgcggactgatcctggctgaggattag

SEQ ID NO: 127071 - DNA, 1320 bp, Artificial Sequence
  Description of Artificial Sequence: Synthetic coding sequence
atgataatcccatcccttgaagaactggatagtttgaaatactccgacctccagaatttggccaagagcctggggttaagagccaaccttcgggctacaaaacttctgaaagctctgaagggttatatcaagcacgaagcgcgaaaagggaatgagaatcaagatgagtcacagacctcggcaagctcttgcgacgagacagagatccaaattagcaatcaggaggaggccgaaaggcaaccactcggacacgtcaccaagacacgccggaggtgcaaaactgtcagagtcgaccctgactctcagaatcattccgagatcaagataagcaatcccactgagtttcaaaatcatgaaaagcaggagtcacaggatctaagggctaccgccaaggtcccttcaccccccgatgagcaccaagaggctgagaacgctgtgtcatccggaaaccgcgactcgaaggttccttccgaggggaaaaaatcactttacaccgatgagagcagtaagccaggcaagaacaagcggacggccatcactactcctaatttcaaaaagttacacgaggcccatttcaaggagatggaaagtatcgatcagtatatagagagaaaaaagaaacacttcgaagagcacaacagcatgaatgagcttaaacaacccatcaacaaagggggggttaggacaccagtgcccccacgcgggaggctctccgtggcatctaccccaatctcccagcgccgcagccagggacgatcatgtggcccagctagtcagagtaccttgggcttaaaggggagcttgaagagatctgcaatctctgccgccaagactggagtgcgtttctcagccgcaactaaggacaatgagcataaacggtccctgacaaagacgcctgcgcggaagagcgcgcatgtaacagtgtctgggggcactcccaaaggagaagctgtcttgggcacgcataaactgaagacaattaccggcaattcggcagctgtcatcactcctttcaagcttacgaccgaagccacccaaacccctgtgtccaacaagaagcctgtgtttgacctaaaagcgagcctatcccgcccattaaactacgagcctcataaaggaaagctgaaaccatgggggcagtccaaagagaacaactacctgaaccaacacgtaaatcgcattaacttctacaagaagacatataaacagccacacctgcagacaaaggaagaacagagaaagaaacgggagcaggagcgcaaggaaaagaaggcaaaagtgctaggcatgcggaggggcctgatcctggcggaagactag

SEQ ID NO: 127072 - DNA, 1281 bp, Artificial Sequence
  Description of Artificial Sequence: Synthetic coding sequence
atgatcattccttccctggaggaactcgattctttaaagtacagtgacctccagaacttagcaaagagcctcggtttgcgagctaacctgcgagccacgaagctgcttaaggccctgaagggctacattaagcatgaagctcgaaagggtaatgaaaatcaagacgagagtcagactagtgcttcttcatgcgatgaaaccgagatccagatatccaatcaggaggaggcagagcgccagcctctgggccatgtgacaaagacgaggaggcggtgtaaaacagttcgggtggacccggactcccagaatcacgaaaaacaggagtctcaggatcttcgggcaaccgccaaagtgccttcccctccagacgagcaccaagaggctgagaacgccgtgtcatccggaaatcgcgactccaaagtgccttctgagggaaagaaatcactgtataccgatgaatcctcaaaacccggtaagaacaaacgtactgcaatcaccacacctaatttcaagaaactccatgaagcccatttcaaagaaatggagagcatcgatcagtatatagagaggaagaagaagcatttcgaagagcacaatagcatgaacgaactgaaacagcagccaattaacaaaggcggggtgcgcacgcccgtaccaccgcgaggccggttgtctgtggctagcacacccatcagtcaacggaggtcgcagggacggtcgtgcggtcctgcttcccagtcaactctcgggctgaaaggcagtctgaaaagaagcgcaataagtgccgctaaaaccggtgtgcgattttccgccgctacgaaggacaacgaacacaagcggtcactcactaagactccagctagaaagtccgctcacgtaacagtgtccggtggcacccctaagggtgaggcggttctcggcacacacaagttgaaaaccattactgggaactcggcggccgtgatcacccctttcaagctgaccactgaagccacacagacaccagtcagtaacaagaagcctgtctttgacctcaaagcctccctgtccagacccctgaactacgaaccccacaagggtaagctgaaaccctgggggcagtccaaagagaacaactatctgaaccagcacgtcaataggatcaatttctataaaaagacttacaagcagcctcaccttcagaccaaggaggagcagcgcaaaaaaagagaacaggagcggaaggagaagaaagccaaagtgctggggatgaggagagggctgatcctggccgaggattag

SEQ ID NO: 127073 - DNA, 2250 bp, Artificial Sequence
  Description of Artificial Sequence: Synthetic coding sequence
atggccgccgccggttcccgcaagcgtcgcctcgctgagctaacagtcgacgagtttttggcttctgggtttgattcagaatcggaatctgagagcgagaacagcccacaggcagagaccagagaggcacgcgaggctgcgcgctctcctgataaacccggcggatccccatcagcctcacggagaaagggaagagcctcagagcacaaagaccagcttagcagactgaaagatagggatcctgagttttataagttcttgcaagagaacgatcagagcctgctgaacttctcagactctgactcttcagaggaggaggaagggcccttccactccctgcccgatgtccttgaagaagcatctgaagaggaagacggagccgaagaaggagaagatggcgacagagtgccgagggggctcaaggggaaaaaaaactctgtccccgtcacagtcgctatggtggaaaggtggaagcaggccgccaagcagaggttgactcctaaactgttccatgaggtggtgcaggcttttcgcgcagcagtcgctaccactcgcggggatcaagaatctgcagaggccaataagttccaggttactgactctgcagcatttaacgccttggtgactttctgtatcagggacctaataggctgtttgcaaaagctgttattcgggaaagtggccaaggacagctctcggatgcttcagccgtctagcagtcctctgtggggtaaactgcgggtggatataaaggcgtacctcggctctgccatccaactagtgtcatgcttgtcggagactacggtgctggccgccgtgctcagacacataagtgttttggtgccttgctttcttacctttcctaaacagtgccgtatgctccttaagagaatggtgatcgtttggtccacgggggaggaatctctcagagtgctcgccttcctggtattgtctcgcgtgtgccgtcacaagaaggatacatttctcggacctgtgctgaagcagatgtacattacgtacgtgagaaactgcaaattcacctctcccggcgctcttccttttatatctttcatgcagtggacacttaccgagttgcttgcactcgagcctggagtagcctatcagcacgctttcttatacattcgccagctggctattcacctgagaaatgcgatgactactcgtaaaaaagaaacatatcagtccgtctataattggcaatacgtgcactgcctttttttgtggtgtcgcgttctgtcaacggctggcccgtctgaggctctgcagccactggtttaccccctcgcgcaagtgatcattgggtgcataaaattgatacctactgcccgattttacccactcaggatgcactgtatccgcgccctgacactgctgagtggcagctccggggcatttatccctgttctaccatttatccttgaaatgtttcagcaggtggacttcaaccggaaaccaggacgtatgtcctctaaaccgatcaacttctcagtgatactaaagttaagtaacgtgaatctgcaagaaaaggcgtaccgggacggtctggtagaacagttgtacgatctcactcttgaatacttgcacagccaagcacattgcattgggtttccagagctggtgctgcctgtggtgcttcagttgaaatcctttttaagagagtgcaaggttgctaactactgtcgtcaagtccagcagctcctcggtaaggtgcaagagaattctgcgtatatctgtagtagacggcaacgcgtctctttcggcgtttccgagcagcaggccgtggaggcatgggagaagcttactagagaagaagggacgcctcttacactctactactcacactggcgcaaattgcgagatcgcgagatccagctggaaatttcgggaaaggagaggctcgaggacctgaatttccccgaaatcaagagacgaaaaatggctgacaggaaagacgaagatcgaaagcagttcaaggacctatttgatctaaacagtagcgaagaagatgataccgaaggcttcagtgagcgtggcatattgcgacctttaagcaccaggcacggtgtggaggacgatgaagaagacgaggaggaaggagaggaggactcgtccaactccgaagacggggaccccgacgcggaggcagggttagcccccggggagcttcagcagctcgcacagggccccgaggacgagctggaggacctacaattatctgaagatgactag

SEQ ID NO: 127074 - DNA, 2403 bp, Artificial Sequence
  Description of Artificial Sequence: Synthetic coding sequence
atgaaattccgacggaacaagaagcaaattccttctttcaggaagctaattaagacatccaaggtcaagctggagaacaaactgaaaaacaaacagttcaagcagcagagcacattgaagaaatacagaaaggagcagcgaaaactgcgtcaggctgtgaaagatgccgtgtctaagaagccaatcccgctcgaaaacccaaaagaaaaaagacccgggaagaggattgaaagggaagaggaggaggaggaggaggcgcttcccctggacatgatggacgaagacgatttgcagttgatgaaggaccttggccagagagtgtcatttctgacccgagacctgtccagcagcgagccagtccacgccaagaagagaaagcacgaacggatcatcgacaaatatgagaagatacctcgcacacttcagacggctcctgagaaggaacttattcacctgttgcccatcaaagacaagtcagggatcataccccagactcgcgaaaaacctgtgaccgattcaaataaggacgaggaggatcaagaggaggagcgcgagttagaggaggagataattgaggatcctattcaggaacttactattgaggaacacctgatcgagaggaaaaaaaagcttcaggagaagaaaatgcatatcgctgcgctggctagcgccatcctgtctgaccccgagaacaatattaaaaaattgaaggagttgcgctcaatgcttatggaacaggatccagacgtggccgttacagtgcgcaagttagtgatagtatcccttatggaactctttaaagatatcacaccatcatataagatccgccccctcaccgaagccgagaaatctaccaagactcgcaaagagacccaaaaactgagagagttcgaggaaggtttagtaagtcagtataaattctacttagaaaatctagagcaaatggtgaaagattggaaacagaggaagctgaagaagagcaacgttgtatcattaaaggcctacaaaggactcgccgaggtggctgtaaaatctctgtgcgagcttctggtcgccctaccccacttcaatttccataataatatcatcgtgctcattgtccctttgatgaatgacatgagcaaactcatttccgaaatgtgctgcgaggcggtaaaaaagctgttcaaacaagataagctgggccaggctagtctgggcgtcataaaagttatatccggcttcgtgaagggacgtaactatgaagtgaggcccgaaatgctgaagacttttctttgcttaaggattaaggaggttgaagtgaaaaaggacacggaggatatcaacaagcccaaaaagtttatgaccttcaaagagaagcggaaatctcttagccgaatgcagaggaagtggaagaaagccgaggagaagctcgagcgggaacttcgggaagcagaagcaagtgagagtactgagaagaagctgaaactgcatacagagacattgaacatcgtcttcgtgacatacttccgcattctaaaaaaagctcagcggagccctttgctgcctgccgtcctggaagggctggcaaagtttgcgcaccttatcaatgtggagtttttcgatgatctgctagtcgttctgcacacattaattgagagcggagatctctcctatcaggaatccctgcactgtgtccagaccgcatttcatatactgagtggacaaggagacgtcctaaatattgacccacttaaattttacacacatctatataagaccttgttcaagctgcacgcaggagctactaatgagggagtagaaattgtgctgcagtgcctagacgtgatgctgaccaaaagacggaaacaggtcagccagcaacgagctcttgcatttatcaaaagactttgtactctggccttacatgttttacccaatagtagcattgggatcctcgcaaccactagaatactgatgcatacttttcctaagacagacctgctcttggatagcgaatcccagggcagcggggtgttcctgccagaattagacgaacccgagtattgcaacgctcagaatactgctctatgggagctccatgccctgagacgtcattatcaccctattgtgcagagattcgccgctcatctgatcgctggcgccccttccgaaggcagcggggcacttaagcctgaactctcgaggcggagcgcaactgagcttttcgaagcctatagtatggcagaaatgacttttaacccccctgttgagagtagtaatccgaagatcaaaggcaagtttctgcagggggatagcttcttaaacgaggaccttaaccaactcatcaaacgctactcttcagaggtggccactgagtctcctctggacttcaccaagtatctcaagaccagcctacattag

SEQ ID NO: 127075 - DNA, 2403 bp, Artificial Sequence
  Description of Artificial Sequence: Synthetic coding sequence
atgaaggcaaggcgcaataagaaacagataccttcctttcggaagctgatcaagacatctaaggtgaagctcgaaaacaagctgaaaaacaaacagttcaaacagcagagcacgctgaagaagtacagaaaggaacagaggaagctgagacaggctgtcaaagatgccgtgagtaagaaaccgatcccattagaaaaccctaaggaaaagcggcccggaaagcggatcgagcgtgaagaagaggaagaggaggaggctctgccactcgacatgatggacgaggacgacctgcagctcatgaaggacctcggccagagagttagcttcttgactagggatctgtcctctagcgaacccgttcatgccaagaagagaaagcacgaacggatcattgacaagtacgagaagatccccagaacactacagacagcgccagagaaagagctgatccatctgctccccatcaaggacaagagtgggattatcccgcagacacgagaaaaacccgtgacggacagtaacaaggacgaggaagaccaggaagaggagagggagctggaagaagaaatcattgaggatcccatacaggagctgactattgaggaacacctcatagagcggaagaagaagctgcaagagaagaagatgcatatcgctgcgcttgcgtccgctatcctgtctgaccctgagaataatattaagaagcttaaggaactgaggtctatgctgatggagcaagatccagatgtggcagtgaccgtaaggaagctggtgatcgtttcgctgatggagcttttcaaagatattacaccctcgtacaagatcagacccctgactgaggccgagaaatcaactaagacgaggaaagagactcagaagctccgtgagtttgaggagggcctggtgtcgcagtataagttttacctggaaaatctggagcagatggtgaaggattggaagcagcgcaaactgaagaagtccaacgtggtaagcctgaaagcctataaaggtctcgcagaggtggccgttaagtccctgtgcgagctcctggtggccttgccacatttcaactttcacaacaatattatagtattgatcgtccctctgatgaatgatatgtccaagcttatcagtgaaatgtgttgcgaggctgtgaagaagctgtttaagcaggataaactggggcaggccagcctcggagtaatcaaggtcatctccggtttcgtgaaggggaggaattatgaggtgagaccagagatgctgaaaaccttcctgtgtcttagaatcaaagaggtggaagtgaagaaggatacagaagatatcaacaagcccaagaagtttatgaccttcaaagagaagaggaaaagtctgagtcggatgcagcgtaagtggaaaaaagcagaggagaaactagaaagagagctgcgggaagccgaggcctctgagagcaccgagaaaaagcttaagctgcacaccgagactttgaatatagtgtttgtgacatactttagaattctaaaaaaagctcagcgctctccgctcctgccagccgttctggagggtctagctaagtttgcccatttgattaatgtcgaatttttcgacgatctgcttgtcgtgttgcatacccttatcgaaagtggggacctctcctaccaggagagcttacattgcgtccaaaccgctttccatatcctttcgggccagggcgacgtactcaatattgacccactcaaattctatactcacctgtacaagacattgttcaaactgcatgccggggccactaatgagggcgtcgagatcgttctccagtgtttagatgtgatgctgacgaagcgaagaaaacaggtgtcgcagcaacgagccctcgctttcattaagaggctttgcactctcgccctgcatgtgctgccgaactctagcattgggatcctggctactacgcggattttgatgcacacatttcccaaaaccgaccttttgctagatagtgagtctcagggaagcggtgttttcctgcccgaactggacgagccggaatattgtaatgctcagaacactgcactgtgggaactgcacgccctccgtcggcactaccatccaatcgttcagaggttcgcggcacatctgatagccggcgccccttccgaaggcagcggagccctgaagcctgagttgagcaggaggtcagcaaccgaactgtttgaagcttactccatggccgagatgacgtttaatccacccgtggaaagttcaaatcccaaaattaagggaaagtttctgcagggcgactcgtttctgaacgaagatttaaaccagctcataaagcgctattcatccgaggttgctacagagtcaccattagacttcaccaaataccttaagacatcactccattag

SEQ ID NO: 127076 - DNA, 1506 bp, Artificial Sequence
  Description of Artificial Sequence: Synthetic coding sequence
atggaattatttaaggatataactccctcatataaaattcgacccttgaccgaagcagagaagtctaccaaaacacggaaggaaacacagaaactcagagaattcgaggagggactggtctctcaatataagttttaccttgagaacttggagcagatggttaaggactggaaacaaaggaaactgaagaaatccaatgttgtaagcctgaaagcctacaagggattggccgaagtggccgttaagtccctctgcgaattactagtagccctgcctcacttcaacttccacaacaacatcatcgtgctcatcgtgccgctgatgaatgatatgtcaaaactgatctctgagatgtgctgtgaagctgtgaagaagctgttcaaacaggacaaactgggccaggcctcacttggggtgattaaggtcattagtggattcgtgaagggacggaactacgaggtacgacccgaaatgctgaagacatttctctgtctgcggattaaggaggtggaggtgaagaaagataccgaggatatcaacaagccaaagaaatttatgactttcaaagagaaaaggaaaagtttgagtcgcatgcaacggaaatggaagaaggctgaagagaaactggagagagagctgagggaagcagaggcatcggaatccacagaaaagaagctgaaattgcatacagagactttgaatatagtgttcgtgacgtattttaggatactgaagaaggctcagcggtccccgttactgcctgcagttctggagggactggcaaaattcgctcacctgatcaacgttgaattcttcgacgatctgctggttgtcttacacactctcattgaaagcggcgacctgagctaccaagaatctctccactgcgtgcaaaccgctttccacattctctcgggccagggggatgtcctgaacatcgacccgctgaaattctatacacacctctacaaaaccttgtttaagcttcacgctggggccactaacgagggggtggaaatcgtattacagtgccttgatgtgatgcttacaaagaggagaaagcaggttagccaacaacgcgccttagcctttatcaagcggctctgcacgctggccctacacgtgctgcctaattcaagcattggcatccttgccacaacacggattctgatgcacacctttcccaaaaccgacttactcctggactctgaatcccagggtagcggggtgtttctgcccgagctggatgagccggagtactgtaatgcccaaaataccgctctgtgggagctgcacgcacttagaagacactaccatccaattgtgcagagattcgccgctcacctgatagccggggcacctagcgaaggtagtggcgcactaaagcccgagctgtcaaggagatctgccacggagttatttgaagcctatagtatggcggaaatgacctttaacccaccagttgagtcttccaatccaaagatcaaggtaacaacgaagggatag

SEQ ID NO: 127077 - DNA, 1551 bp, Artificial Sequence
  Description of Artificial Sequence: Synthetic coding sequence
atggaaagagaaccaggcgccgcgggcgtccgcagagccctggggaggcgcctggaggccgttttagcgtccaggagcgaagccaacgctgtatttgacatcctggccgttttgcaatctgaggatcaggaagaaattcaggaagctgtacgaacttgtagcaggctgttcggtgcactgctcgaacggggcgagctgttcgtcggccagctgccatcagaggaaatggtcatgacgggcagccagggagcaacccggaagtacaaggtatggatgaggcaccggtatcattcctgttgcaatcggcttggcgagctgctggggcatccatcatttcaggttaaggaacttgcgctttccgccctactgaaatttgtccagcttgagggcgcacacccccttgaaaagagtaagtgggaaggtaattatctattcccacgcgaactgttcaagcttgttgtgggagggctattaagccccgaggaagaccaaagcctactcttgagtcaattccgagagtatctcgactacgacgatacacggtaccacacgatgcaagccgccgtcgacgcagtggctagggtgaccgggcaacatccagaggtcccacccgccttttggaataacgcttttaccctcttgagtgcagtcagcctgccgaggagagaacccaccgtgagtagtttctatgtcaaacgggccgaactgtgggacacctggaaagttgctcacctaaaggagcatcgaagggtctttcaggctatgtggctctcctttcttaaacacaaattacctctgtccttatacaagaaggttctgttaatagtccatgatgcaatcctcccccagctggcccagccaaccctaatgatcgattttctgaccagagcctgcgacctcggcggggcactatccttgctcgccctgaatggccttttcatattaattcataagcacaacctcgagtacccggacttctacagaaaactgtatggtttactcgatccttccgtgttccacgtgaagtacagagcacgtttttttcatctcgccgatctatttttgagttcttcccacctgccagcctatttggttgctgccttcgccaaaagactggccaggctcgctctcaccgctccaccggaggcactgctcatggtactaccgtttatttgtaatttactgagaaggcacccagcatgccgcgtcctggtgcaccgcccccatggtcccgagctggatgcagacccatacgacccgggtgaagaggatccagcacaatcccgggccctcgaatctagtctctgggaactccaggccctgcaacgacactaccatcctgaggtcagcaaggcggcgtccgtgatcaatcaggcattgtccatgccagaagtttccatcgcgccgctcctggaattaaccgcctatgaaatttttgagcgcgatctcaaaaaaaaaggccctgaaccggtccccctggagtttatccccgcccaggggcttcttggccgcccaggcgaactctgcgcccagcactttactttgagctag

SEQ ID NO: 127078 - DNA, 252 bp, Artificial Sequence
  Description of Artificial Sequence: Synthetic coding sequence
tagccggaggagctgacgttcgcttctgctcaggccgaggcgagagaagaggagaggcgtgtaagagaaaccgtgaggagagataaaaccctgctcaaagaaaagcgcaaacgccgagaggagctcttcatcgaacagaagaaaaggaaactgctccctgatacaattctggagaaactgacaaccgcttcccagacgaatattaaaaaaagccccggtaaagtcaaggagggtatgactattttgatctag

SEQ ID NO: 127079 - DNA, 774 bp, Artificial Sequence
  Description of Artificial Sequence: Synthetic coding sequence
atggtgcaactgaggccccgagcctctcgcgcccccgcctcagccgaggctatggtcgatgaggggcagttagcgagtgaggaggaagaggcagagcatgggctcctcctgggacagccctccagcggagccgccgctgagccactcgaggaggacgaagagggggatgacgagtttgatgatgaagcccccgaagagctcactttcgcttcggcgcaggccgaagctagggaggaagagcgtcgtgtgcgggaaaccgtgcgacgggataaaactctcctgaaagagaagaggaagcggcgcgaagagttgtttatcgagcaaaaaaagcggaaactgttaccagataccatcctcgaaaaactgacgactgcatcgcagaccaacatcaagaagtcaccgggaaaagtgaaggaggtgaatctgcagaagaagaatgaagattgtgagaagggtaacgactcgaagaaggtaaaggttcagaaggtgcaaagtgtgtcccagaacaagagttacctggcggttcgacttaaggaccaagacctccgggacagccgtcaacaagccgcccaggcctttatacacaatagtctgtacggcccagggacaaatagaacgacagtgaataagtttcttagcctggccaataaaagactgccagtgaagcgcgccgccgtgcagttcctgaacaacgcatgggggattcaaaaaaagcaaaacgcgaagaggtttaagcggcggtggatggtcaggaagatgaagactaaaaaatag

SEQ ID NO: 127080 - DNA, 3300 bp, Artificial Sequence
  Description of Artificial Sequence: Synthetic coding sequence
atgagcgtattgaataaaaccaaatggaagggaggaacccttcagattcagcttgccaaggagtccttcctgcatagacttgcccaggagcgagaagctgccaaagccaagaaagaggagtcaacgacagggaatgccaacctgctggagaagaccggcggcgtcgattttcatatgaaagccgtccctggcactgaagtccccggtcacaagaattgggtcgtgtctaagtttggccgcgtattacccgtgttacacctcaagaaccaacataagcggaaaatcattaaatatgacccgtccaagtactgtcataatttgaagaaaattggagaggacttcagtaacaccattcctatctcctccttaacttgggagctagaaggggggaatgatccaatgtccaagaaacggcgtggtgaattttccgattttcacggaccacccaagaagattatcaaggttcagaaggacgagagcagcactggctcattggccatgagtacacggccacgtagagttatagagcgcccccccttaactcagcagcaagcagcacagaagcgcacatgcgactcaattaccccctctaagtccagtcctgtgcccgtcagcgatacccaaaaactgaaaaacctgccgtttaagacaagcggactggagaccgcaaagaaacggaacagtatctccgatgatgacacggactctgaggacgagcttcgaatgatgattgccaaagaagagaacctgcagcgcacaacacagccaagtattaatgaatctgaaagtgatccattcgaagtcgtacgggacgacttcaaaagtggcgtgcataaacttcatagcctcatcggactggggattaaaaatcgagtctcctgtcatgactctgacgatgacattatgaggaacgatagagagtacgacagcggggatacggatgagatcatagctatgaaaaagaacgtagcgaaagtgaagaactccactgaattctcacaaatggagaagtccactaagaagacatcatttaagaaccgcgaaaattgcgagctttctgaccactgcattaaactccagaaaagaaaaagcaatgtcgagtccgcactttctcacggacttaagagcctcaatcgcaaatcaccctcccactcatccagctccgaagacgccgacagtgctagcgagctggcggattccgaaggcggagaagagtataacgccatgatgaagaactgccttagagtcaatcttactttggctgacctggaacagctggcgggttccgacttaaaagtcccgaatgaggataccaagagcgatggcccagaaacaaccactcagtgtaaattcgacagaggctccaagtcgccgaagacaccaaccggcctgcggagaggccgtcagtgtattcggcccgctgagatagtggctagtctactcgagggggaggaaaatacctgtggcaagcagaagcctaaggaaaataacctgaaaccaaaatttcaggcattcaagggggttgggtgcctctatgagaaggaatctatgaaaaagtctctgaaagattcggtcgcttcgaataacaaggaccagaattctatgaagcatgaagatccttctattatctcaatggaggacggatctccttacgtcaatgggtccctcggagaagtcactccatgtcagcacgcaaagaaagcaaatggcccaaactacatccagccccaaaaacgtcagaccactttcgaatcacaggacaggaaggccgtgtccccatcatccagcgaaaagaggagcaagaaccccatctcacgtcctctggagggcaaaaaaagcctcagcctgagcgccaaaacgcacaacatcggatttgataaggactcttgccatagtacaaccaagactgaggcatcccaggaagagcggtcagatagtagtggattaacctccttgaaaaaatccccgaaagtcagcagcaaggacacacgagaaattaaaaccgatttctcattaagcatcagcaactcttcagacgtgagcgctaaggataaacacgctgaggacaatgagaaacgcctcgccgccctagaggcccgacagaaggccaaagaggtgcagaaaaaactagtccataatgctttagccaacctcgacggtcaccctgaagataagcccacacatattattttcggtagcgacagcgagtgcgaaaccgaggaaacatccacgcaggaacagtctcacccgggtgaggagtgggtgaaagaatctatgggcaagacttctgggaagctgttcgactctagcgatgatgacgagtccgattctgaggacgatagcaacaggttcaagatcaagccacagtttgaaggacgggcaggccagaagcttatggacctgcaaagccattttggcactgacgacagatttaggatggactcaagattcctcgagaccgattctgaggaggagcaagaagaggttaacgagaagaagacagcagaagaggaggaattagccgaggaaaaaaagaaagcacttaacgttgtgcaatctgtgctgcaaattaatctatccaatagcaccaatagagggagtgtggcagccaagaagttcaaggacatcatccactatgaccccacaaagcaggatcatgccacatacgaaaggaagagagatgataaaccaaaagagagcaaagcaaagcggaagaagaaaagggaagaggccgaaaaactgccggaggtatctaaagaaatgtattataacatagccatggacctaaaggaaatcttccagactactaaatataccagtgagaaagaggaaggcaccccatggaatgaggactgtggcaaagagaagcccgaggagattcaggacccagcagccctgacttctgatgccgagcagcctagcggcttcacttttagcttttttgattccgatacgaaggacataaaagaagaaacataccgcgttgaaaccgtgaagcccggtaaaattgtctggcaggaagacccaagactgcaggactctagctccgaggaagaagatgtcacggaagagactgaccatcggaactctagcccaggtgaggctagtctgcttgaaaaggaaacaacccgattttttttcttctccaagaatgacgagcgactgcaaggcagtgacctgttttggcgcggagtgggcagtaatatgtctcgcaattcatgggaggcacgaaccacgaacctccgaatggattgtcggaagaaacataaagacgccaaacgcaagatgaaacctaagtag

SEQ ID NO: 127081 - DNA, 3396 bp, Artificial Sequence
  Description of Artificial Sequence: Synthetic coding sequence
atgaaagtgaatcgagagacgaagagactttacgtgggtgggctatctcaggacatctctgaagccgacctgcagaaccaatttagccgctttggagaagtatcggatgtggagattatcactagaaaggacgatcagggaaacccccaaaaagtcttcgcatatatcaacataagcgtcgcggaagcagacctaaaaaagtgcatgtccgtcctgaacaaaactaagtggaaggggggcaccttgcagatccagctggcgaaagagtctttcctgcacagactggcacaggaaagagaggctgctaaagcaaagaaagaggagagtacaaccggaaacgccaatctactggagaaaactggcggagtggacttccatatgaaagctgtcccaggaacagaagtgccaggacacaaaaactgggtcgtgtccaagtttggaagagttctccctgtccttcatctcaagaatcagcataagcatctccgaaatatcatcaaatacgacccttctaaatattgtcataatctaaaaaagattggtgaggatttttcaaatacaatcccaatatcaagcctgacctgggaactggagggaggaaacgatccaatgtccaagaagcggcgcggcgagttctctgatttccacggcccccccaagaagattataaaagtgcaaaaagacgaaagcagcactgggagcctggcaatgagcacccgacctaggagagtcatcgagaggccacccctcacacaacagcaggctgcacagaagcgaacttgcgactcaattactccatctaagtccagccctgtacccgtcagtgatacccagaagctcaaaaacctgccctttaaaacatcaggcttggagacggcaaagaaaagaaactccatttcagatgacgacaccgattctgaagatgagctccgtatgatgatcgcaaaggaggagaacctgcagcgcactacccagccgtcaatcaacgagtcagagtccgaccccttcgaggttgtgagagacgattttaagtccggagttcacaagctgcactccttgatcgggttgggcatcaagaacagggtgagctgtcacgattccgatgacgacattatgaggaatgaccgggagtatgatagcggggataccgatgaaattattgccatgaagaagaacgtggcgaaggtcaaaaactccaccgagttcagtcagatggagaaatctacaaagaagacctcctttaaaaatcgcgagaattgcgagctctcagaccattgcatcaaattgcaaaagcgaaagagcaacgtcgaatccgcgctgtcccatgggctgaagtctttgaaccgtaagagccctagccacagctctagctccgaggacgcagattctgcatcggaactggctgactctgaaggcggcgaagagtacaacgccatgatgaaaaattgccttagggtcaatctgaccctggctgaccttgaacagctggcgggatccgaccttaaagtgcccaatgaagacacaaaatccgatgggcctgaaaccacaacgcagtgcaagttcgaccggggcagtaaatcaccaaaaactcctactggtcttcggcgcggacggcagtgcatccggccagccgagattgtggcatcgctgcttgaaggcgaagaaaatacatgcggaaagcagaagccaaaagaaaataacctaaaaccaaaattccaggctttcaagggagttgggtgcctgtatgaaaaggaaagtatgaaaaagtcacttaaagattccgtcgcttccaacaacaaggatcagaactcgatgaagcatgaggaccctagcatcattagcatggaagacggatccccttacgttaatgggtccctcggtgaggtcacaccatgccagcacgctaagaaagctaatgggcctaactacattcaacctcagaagcgccaaaccacatttgagagtcaagatcgcaaagccgtgtcaccctcgtcgtccgagaaacgttctaagaaccctatatctcgccccctggaaggcaagaaaagcttatctctgagtgcgaaaacccacaacatcggatttgataaggattcctgccattcaactacgaagacagaggcttcccaggaagaacgtagcgacagctctgggttgacctctctgaaaaaatctcctaaagttagttctaaagatactagagagatcaaaactgattttagcctgtccatctctaacagctctgacgtgagcgcgaaggataaacatgcggaggataatgagaagagactggctgcattggaggcgaggcagaaggcaaaggaggtgcagaagaaattagtgcataatgcattggcaaacctcgaaagcatgggcaaaacctccggcaagctcttcgacagttctgacgacgatgagtccgactcagaggatgacagtaaccggtttaagataaagccccaattcgagggtagggccggccagaaacttatggacctgcagtctcatttcggtaccgatgatcggttcaggatggacagccgatttctcgaaacagacagcgaggaggagcaggaggaggtcaacgagaagaagacagcagaagaagaagagttggccgaggagaaaaagaaagcattaaatgtggtgcagtctgttctgcagattaacctgtctaacagtactaatcggggttccgttgccgccaaaaaattcaaggatatcatccattacgatcccacaaagcaggaccacgccacgtatgagaggaagagggatgataagccaaaagagtcaaaggctaagagaaaaaagaaacgagaggaggccgagaaactccctgaagtcagcaaagaaatgtactacaacattgcaatggatctgaaggagattttccagaccaccaagtacacgagcgaaaaagaagaaggcaccccttggaatgaggactgcggaaaggagaagccagaggagattcaggatccagccgcccttaccagtgacgcagagcagccttcaggatttaccttttccttcttcgacagtgacaccaaagatattaaggaggagacctacagagtggaaactgtaaaaccaggcaagatcgtgtggcaggaagaccctcggctgcaggattcatccagcgaggaggaggatgtgaccgaagaaacagaccacagaaatagctcacctggcgaggcaagcctgctagagaaagaaactacgcggtttttctttttcagcaagaatgacgagaggctccaggggtcggatttgttctggaggggagtgggatcaaatatgagcaggaatagctgggaagcgaggaccactaacttgaggatggattgccgcaaaaagcacaaggatgccaagagaaaaatgaaacctaagtag

SEQ ID NO: 127082 - DNA, 777 bp, Artificial Sequence
  Description of Artificial Sequence: Synthetic coding sequence
atgaaggtcaacagagagactaaaagactctacgttggcggcttgagccaggacattagcgaggcagatctacaaaaccagttttccaggtttggggaggtgagcgatgtggaaattataacccggaaggatgatcaggggaatcctcagaaagtgtttgcttatataaacatttcagtggccgaggcagatctgaagaagtgcatgagcgtcctgaataagactaagtggaaggggggtactctgcagattcagttagcaaaagagagttttttacatagactggcacaagagcgcgaagctgcgaaggccaaaaaagaggagagtactaccggcaacgctaaccttctggagaagactggaggggtggattttcacatgaaggccgtccctggcacagaggtacccggccacaagaattgggtagttagcaagttcggaagggttctgccagtgctccatttgaaaaaccagcacaagagaaagattattaagtatgatccctccaagtattgtcataacttaaagaagattggggaagatttctctaacacaataccgatatcctcactgacgtgggaactcgagggaggcaacgatccgatgtctaaaaaaagaaggggcgaatttagcgacttccatggcccacccaaaaagataatcaaagtgcagaaggatgaatcatcaacaggctctctcgccatgtctacaaggcccagacgcgtcatcgagcgcccccctctgacacagcagcaagccgcccagaaacggacctag

SEQ ID NO: 127083 - DNA, 2913 bp, Artificial Sequence
  Description of Artificial Sequence: Synthetic coding sequence
atgaaagtgaacagggagacaaaacgcctttatgtaggcggcttgtcccaggacatctcagaggctgaccttcaaaaccagtttagcaggttcggcgaggtgagtgatgtagagatcatcacacgtaaagatgatcagggtaatccccaaaaagtgtttgcatatatcaatatctctgtggcggaggccgaccttaagaaatgtatgtccgtgctgaataaaacaaagtggaagggaggaacactccagattcaactcgccaaggagtcctttctgcacagactagctcaggaacgtgaggctgcaaaggccaagaaagaagaatccactaccgggaacgctaacctccttgagaaaacaggcggagtcgactttcacatgaaggcggttcccgggacagaagtccctggtcataagaactgggtggttagcaagttcggacgagtgttgcccgttctgcacctgaaaaatcagcataaaagaaaaattattaagtacgatcctagtaagtactgtcacaacctgaaaaaaatcggggaggatttcagcaataccatccctatttcatcccttacatgggagctcgaggggggaaacgatcctatgtctaagaaacgtagaggagagtttagtgatttccatggtccccccaagaaaataattaaagttcagaaagatgagagtagcactggctcattggcgatgtcaacgaggccacggcgagtgatagaacgacctccactcactcagcagcaggccgctcagaagcgcacatgcgactcgatcacaccgtctaaaagcagtccggtgccagtgtcagatacacagaagctcaaaaatctgcccttcaagaccagtgggctcgagacagccaaaaaaagaaattccatcagcgatgacgacaccgacagtgaggatgagctacggatgatgatcgcgaaagaggaaaacctgcagcggaccacccagcccagcatcaatgaaagcgaatccgaccctttcgaggtcgtccgggacgatttcaaaagcggggtccataaactgcattccctcatcggcctaggcatcaaaaatagggtgagctgccatgactcggacgatgatataatgcgaaatgaccgagagtatgatagcggcgacacggacgagattattgcgatgaagaagaatgtggctaaagtcaaaaactccactgaatttagccagatggagaaaagcacaaagaagactagcttcaaaaatagggaaaattgtgagctgtcggatcactgcatcaaactccagaaacgcaagtcgaatgtcgaaagtgcactcagccacggtctaaagagtctaaatagaaagagccctagccatagctcctcatccgaggacgcagatagcgcatccgaattggctgactccgaagggggcgaagagtataatgcaatgatgaaaaattgtctcagagtcaatctgacattggccgacctggagcagctcgctgggagtgatcttaaggtccccaatgaagacaccaaaagcgacggccctgaaaccacaactcagtgcaagttcgaccgaggttccaaaagccccaaaactcctactggactccgtcgaggccgtcagtgcattagacctgcggagatagtcgccagtcttctggagggtgaggagaacacatgtggtaaacaaaaacccaaggagaacaacttgaagcccaagtttcaggcattcaagggggtcggttgcctctacgaaaaggagagcatgaagaagtccctcaaagattctgtggcttccaacaataaggaccagaattccatgaaacacgaagatccttcaattatcagcatggaggatgggagcccctatgtcaacggaagccttggtgaagtgacgccctgtcaacacgcgaagaaagccaatggcccaaattatatccagccccagaaaaggcagacaacctttgagagtcaggacagaaaagcagtgtccccctctagcagcgagaagagatccaaaaacccaatcagcaggcctcttgaaggtaagaaatcattgagcctgagtgcaaaaacccacaacattggatttgataaggattcatgccacagcacaacaaagaccgaagcatcacaggaagagagatctgatagcagcggtcttacttcactcaagaagagccctaaagttagctcaaaggacacacgtgagattaagactgattttagcctctctatatcaaactcctcagatgtatcagcaaaggacaagcacgccgaagataacgagaagaggcttgcagctctagaagcccggcagaaggcgaaagaagtgcagaaaaagttggtgcataacgccctggccaatctggatggacaccctgaggacaagccaactcatataatattcgggtctgacagtgaatgtgagacagaggagaccagtactcaggaacagagccacccaggagaagaatgggtgaaagaatctatgggtaagactagcggtaagctcttcgattcgagtgacgatgacgagtctgactcggaggatgattctaaccggttcaagatcaagcctcaatttgaggggcgggcaggacagaaacttatggatctccagtcgcattttggtaccgatgaccgctttagaatggacagtagattcctagaaacagactccgaggaggaacaggaagaagttaatgaaaaaaagactgctgaagaggaagagctcgccgaggagaagaagaaagccctcaatgtcgtgcagtccgtgctgcagattaacctatcaaactcgactaatcgcggtagcgtcgccgccaaaaagttcaaagacatcattcactacgatcctaccaagcaggatcacgccacctacgagcggaagagagacgacaagccgaaggagtctaaagcgtag

SEQ ID NO: 127084 - DNA, 1242 bp, Artificial Sequence
  Description of Artificial Sequence: Synthetic coding sequence
atgaaagtcaatagggagaccaagcgtctctacgtcggggggttgagtcaggatataagcgaagccgatctgcaaaaccagtttagcaggttcggcgaagtgtctgatgtcgaaattattacacgcaaagacgaccagggaaatccacaaaaagtatttgcgtatattaacatttccgtcgcagaagcagaccttaagaaatgtatgtccgtactgaacaagaccaagtggaagggtggaaccctgcagattcagctggctaaagagtcttttctacatcgtctggcccaagagcgggaggcagccaaagccaagaaagaggagtctacaactggaaacgcaaatctcctggaaaaaacgggaggggtggattttcacatgaaggccgttcctggcaccgaagtaccaggtcacaagaattgggtcgtgagcaaatttggtcgagtgctgcctgtgttgcacttaaaaaatcaacacaagcgtaagatcataaaatacgacccctccaaatactgtcataatctaaagaagattggggaggacttttccaataccatcccaatctccagccttacttgggagctggagggaggcaatgaccccatgtcaaagaagaggcggggcgaattcagcgatttccacggacctcccaagaagatcattaaggtgcagaaggacgagtcatcaacaggatctctggctatgtctactcgacctcgccgcgtaatcgaaagacctccactcacccagcagcaggcagcccagaaacgaacctgtgactctattactccttccaaaagctcacccgttccagtgagtgacacccagaagcttaagaacctcccatttaaaacttcagggcttgagacggcgaagaagcggaacagcattagcgacgatgatacagacagtgaggatgagctacggatgatgatcgccaaggaagagaatctgcagcggacaacacaacctagtataaacgaatcagagtctgacccattcgaggtagttcgggatgactttaagtctggagtgcacaaactccattccctgattggcctggggatcaagaatagagtgtcttgtcatgactcagatgacgatattatgcgtaatgaccgggaatacgattctggcgacaccgacgagataattgccatgaaaaaaaatgttgcaaaagtgaagaatagcacggagttcagccagatggaaaagtcaacgaagaagacatcatttaaatag

SEQ ID NO: 127085 - DNA, 3504 bp, Artificial Sequence
  Description of Artificial Sequence: Synthetic coding sequence
atgaaggtcaacagggaaacaaagagactatatgtcgggggcctgtcacaggacatttcagaggccgacctccagaatcaattctctcgattcggagaagtgtccgatgtcgaaataatcacgaggaaagacgaccagggcaatccccagaaggtgtttgcttacattaacatcagcgtggccgaggccgacctaaagaagtgtatgagcgtgctaaacaagaccaaatggaaaggcggtacccttcagatacagctggccaaggaaagttttttacatcgactcgcacaagagcgggaggcagccaaggccaagaaggaggaaagtacaaccggcaatgcaaatctgcttgaaaaaactggcggggtggatttccacatgaaagccgtacccggtacagaggttccgggccataaaaattgggtagtgtccaaatttggtcgcgtgctgccagtgctccacttgaaaaaccagcataagcgaaagataataaagtacgatcctagcaaatactgtcacaacctcaaaaagataggcgaagacttttccaatactattccaatcagcagcctgacttgggaactggagggagggaatgatcccatgagcaagaagcgccggggcgagttctcagatttccatggtccgccaaagaagataatcaaggtgcagaaagacgagtcctctacgggctccctggccatgtccacccgcccacgacgcgtgatcgaacgaccgccgctcactcagcagcaggctgcacagaagcggacctgtgattccattacacccagtaagtcatcacctgttcctgtctcggatacacagaagcttaagaatctgccatttaagacatctggattagaaactgcgaaaaaacgcaattcgattagtgatgatgacaccgattctgaggacgaactacgaatgatgatcgctaaggaggaaaacctgcaacgcaccacgcaaccaagcattaatgagtccgagtccgaccccttcgaagtcgtccgcgacgatttcaaaagcggcgtgcataagctccatagcctaatcggcctcggcatcaagaaccgtgtgagctgtcacgactctgacgatgacataatgcgcaacgacagagaatatgacagtggagatacagacgaaattattgccatgaaaaagaacgtcgctaaggtgaaaaatagcaccgaattttcccagatggagaaaagcacgaaaaagacttcctttaaaaacagagaaaactgcgaactttccgatcactgcatcaaactccagaagcgtaagtctaatgtagagtccgctctttcacacgggctgaaatcactgaataggaaaagtccgagccattcctcatcttctgaggacgccgacagcgcgtccgagctggctgactcagaaggaggcgaggagtataatgctatgatgaagaactgcctgagggtgaatctgaccttggctgatctggaacaattggccggatcagacctgaaggttccaaatgaggataccaagagtgacggcccagagaccaccacccaatgcaagtttgatagaggctcaaaatcccccaaaactcccacggggctgcgacggggaagacagtgcatcagaccagccgagattgtcgcttcattattagagggtgaggaaaacacttgcggtaagcagaaacctaaagaaaacaatttgaaacccaaattccaagcattcaagggagttggttgtttatatgagaaagagtcaatgaaaaagagtttaaaggattccgtagcatctaataacaaagaccagaactccatgaagcatgaagatccatctataatcagcatggaggatggctcgccttacgtgaacggctcgctgggagaggtgacaccctgccagcacgccaaaaaggccaatggccccaactatatccagcctcagaagcgacagaccacttttgagtcccaggaccgtaaggccgttagcccttctagcagtgagaaacggtctaaaaaccctatctctaggcctctagagggaaagaagtccttatccctgagcgctaagacacacaacattggctttgataaagattcctgccactccacgactaagacagaagcttcacaagaagagcgttctgacagctcaggcttgaccagtctgaagaaatcaccaaaggtgtccagcaaggacactagagaaataaaaactgatttctccctgtcaatctccaattcatccgacgtttctgctaaggacaagcatgcggaggataacgaaaagaggctcgcagccctagaagctcgtcagaaagctaaagaggtgcagaaaaagctcgtgcataatgccttggcaaacctcgatggacatcctgaggacaagccaacacacatcatctttgggtccgatagtgagtgcgaaactgaagaaacaagcacacaagaacagtcacatccaggggaagagtgggtcaaggaaagcatgggcaagacctccggcaaactgttcgactcgtcagatgatgatgaaagcgacagcgaagacgattccaatcgctttaaaatcaagccacagttcgagggacgggctggccagaaactgatggacctccaaagccacttcgggaccgacgaccgattccggatggatagccgcttcctcgaaacagacagcgaggaagaacaggaggaagtcaacgagaaaaagacagctgaagaagaagagctggctgaagaaaagaagaaggctttaaacgtagtgcaatctgtgcttcagattaacctctctaactccacaaatcgaggttccgtggctgcaaaaaaatttaaggatatcattcattacgatcccaccaagcaggatcatgctacctacgaacggaaacgggatgataagcctaaggagagcaaagcgaaacgtaagaagaaacgcgaggaggctgaaaagcttccggaagtgtcaaaggagatgtattacaacattgccatggacctgaaagagatttttcagaccacgaaatacacaagcgagaaggaagagggcaccccctggaacgaagactgtgggaaggagaaacccgaggagatccaggaccctgccgccctgacatcagatgccgaacaaccaagcgggtttaccttcagttttttcgactccgataccaaagatataaaagaagaaacatatcgcgtggagactgtgaagccgggcaagattgtttggcaggaagatcccagattacaagatagctcatccgaagaggaagatgtcaccgaggaaacagaccatcgcaatagctctccaggagaggcatctttgttagaaaaagagacaaccagattctttttcttctctaaaaatgacgaacgtctgcagggatctgacttgttctggcgcggtgttggctcgaacatgtccagaaacagctgggaagctagaacgacaaacctcagaatggactgtagaaaaaagcataaagacgcaaaaaggaagatgaaaccaaagtag

SEQ ID NO: 127086 - DNA, 438 bp, Artificial Sequence
  Description of Artificial Sequence: Synthetic coding sequence
atgaaagtgaaccgtgagaccaaacgtctctacgtgggcgggctgtcccaagatatttcagaggcagacttgcaaaatcaattctcaaggtttggcgaggtctccgacgtcgagataatcaccaggaaagatgatcaggggaatccacagaaggtctttgcttatatcaatataagcgtagccgaggcagacttgaagaagtgtatgtcagtgctcaacaagacaaaatggaagggcggaacattacaaattcaactggccaaggaaagctttctgcacagactcgcacaggaaagagaagccgcaaaggccaagaaggaggaaagcactacagggaacgcaaatctgctggagaaaaccgggggagtggacttccatatgaaagcagtaccgggaaccgaggtgcctggtcacaagaactgggtcgtgagcaagtag

SEQ ID NO: 127087 - DNA, 3504 bp, Artificial Sequence
  Description of Artificial Sequence: Synthetic coding sequence
atgaaagtgaaccgagaaacaaaacgcctgtatgtgggcggtctttcccaggatatttctgaggccgatctccagaatcaatttagcaggtttggcgaagtgagcgacgtagagatcattactcggaaggacgaccagggaaatcctcaaaaagtctttgcctatattaacatctcagtcgcggaagcagacttgaagaagtgcatgagcgtgctgaataagaccaagtggaaaggcggaactctgcagattcagttagccaaagagagctttctgcaccgactggctcaggaaagggaggccgcaaaagccaagaaagaggagagtacaacaggcaacgctaatctcctagaaaagaccggtggagtagatttccacatgaaagctgtgccgggcacagaggtcccgggccacaaaaactgggtcgttagcaaatttggccgcgttctgcctgtgcttcatctcaagaaccagcacaagagaaagattattaaatatgaccccagcaagtactgccacaatctgaagaagatcggggaggacttttccaacactatccccatcagtagtctgacatgggagcttgaagggggcaacgaccccatgagcaagaaacgacgcggagagttctctgactttcacggtccacctaaaaaaattataaaagtgcaaaaggatgagtcttcaacgggtagcttggctatgagtacgcggccaaggcgtgtgatagaacggccgcctctgacacagcaacaagctgcccagaagcgtacttgtgactcaattaccccttctaagtcctctcccgtccctgtcagcgacacacagaaactcaagaatttaccttttaagaccagcggcctcgaaaccgcgaagaagcgcaacagcatttccgacgatgacaccgattcagaagacgagctgcggatgatgatagccaaagaagaaaatctgcaacgcaccacccaaccatcgattaatgaatccgaatctgatccttttgaggtggtacgtgatgattttaaatctggggtccacaaactgcactccctgattgggctaggcatcaaaaatcgagtcagctgccacgatagtgacgacgatatcatgcggaatgacagggaatacgacagcggcgataccgacgagatcattgcaatgaaaaaaaatgtcgcgaaggtgaagaactccactgagttcagccagatggagaagtctactaaaaagacgagctttaaaaatcgtgagaattgtgagttgtcagatcattgtatcaagttgcagaaacgaaagtccaatgtggagtctgcccttagccatggccttaaatccctgaatagaaagagtcccagccatagctcttcctcagaggatgccgatagcgcctccgaactcgccgactccgagggtggagaggagtataatgccatgatgaagaactgtcttagagtcaatctaaccttagccgacctggagcaactggcaggctctgatctgaaagtacctaacgaagatacgaagtcagacggccccgaaaccacgacacagtgcaagttcgataggggtagtaaaagtcctaaaaccccaacgggtctgcggcgaggccggcaatgtattcgacctgcggagatcgttgcgtctctactggaaggagaagagaacacatgtggcaagcaaaaacccaaagaaaacaatttaaagccaaagttccaagccttcaagggcgtaggttgtctttacgagaaagagtctatgaaaaaatccctgaaagatagcgtcgcctctaacaataaagaccagaattctatgaaacacgaggacccatccattatcagtatggaggacggcagcccatacgtgaatggtagcttgggagaagtcactccctgccagcacgccaagaaggcaaacggtccaaattatattcagccacagaagcggcagaccaccttcgagtctcaagacagaaaagccgtgtcaccctcttcaagtgagaaaagaagcaaaaatccgatctcccggcctttggaagggaagaagtctctgagtctcagcgcaaaaacccataatattgggtttgacaaggatagctgccattcgacaactaagacggaagcttctcaagaggagcgctcggacagctctggtctgacttcgctcaaaaagtctccaaaagtgtcatctaaggatactagagagataaaaaccgatttttcactctcgatttcaaatagcagcgatgtgtccgctaaagataaacacgctgaagataatgagaaacggcttgccgcccttgaggctcggcagaaagccaaggaagtgcaaaagaagcttgtgcacaacgctctggcaaacctggatggccatcccgaggataaaccaactcatatcattttcgggtcggactccgaatgcgaaaccgaggaaacatcgacgcaggagcagagtcaccctggcgaagagtgggtgaaggaatcaatgggcaagacatccgggaaattatttgatagctctgacgacgacgagtcggactcagaagatgatagcaataggttcaagataaagcctcagttcgaaggcagagctgggcagaaactcatggatttgcagtcccattttgggaccgatgaccggttcaggatggattctcgctttctggagaccgacagcgaggaagagcaggaagaggtgaacgagaaaaaaaccgcggaagaagaggagctcgcggaagaaaaaaagaaggctctgaacgttgtacagtcagtcctccaaattaacttgtcaaactccactaaccgcgggagcgtggctgcaaaaaaattcaaggatattatccactacgatccaaccaagcaagaccacgccacatatgaaagaaaaagagatgataagccaaaggagagtaaggccaagaggaaaaagaagcgggaggaggctgagaagctccctgaggtcagcaaggaaatgtattacaacatagccatggatctgaaggaaatttttcaaacaacgaagtacacatccgaaaaagaggagggaactccgtggaacgaggactgtgggaaggagaagcccgaggagatccaggatccggccgctctgacatctgacgctgagcagcctagtgggttcacattttccttcttcgattccgacaccaaagacattaaggaagaaacctatcgtgtggaaacagtgaagcctggcaaaatcgtttggcaggaagatccacgcttacaggattcatcttctgaagaggaggacgtaacggaagaaaccgaccaccgcaactcctctcccggcgaagcaagcctgttagagaaggagaccaccagattcttctttttctccaaaaatgatgaacgactccaaggatcagaccttttctggcgcggagtcggaagcaatatgagtagaaattcctgggaagcccgcaccacgaatttaagaatggactgccggaaaaaacataaagacgcaaaacgcaagatgaagccaaaatag

SEQ ID NO: 127088 - DNA, 261 bp, Artificial Sequence
  Description of Artificial Sequence: Synthetic coding sequence
atgaaggtcaatcgggagaccaagcgactgtacgtgggagggctgtcccaggatatttctgaggctgatcttcagaatcagttctcccggttcggagaggtgtccgacgtggaaattattactaggaaagacgaccagggcaacccccagaaagtgtttgcctatatcaacatttctgtggccgaggcggatcttaaaaagtcaattttccacgttattcagcgggattcttcggacgaagaaaactcatctattgtctag

SEQ ID NO: 127089 - DNA, 3441 bp, Artificial Sequence
  Description of Artificial Sequence: Synthetic coding sequence
atggggccggcgcctgcaggagaacagctgaggggcgctactggagagccggaagtgatggagcccgcccttgagggaactggaaaagaaggaaaaaaggcttcatcacggaaaaggacattggctgaaccccccgccaaggggctgctgcagcctgtgaagctgtcccgggctgagctttataaagagcccacgaatgaagagttaaatcgcctccgcgaaactgaaatactgttccactcttcacttctgcgtctacaggtcgaagaattgctcaaggaggtaaggctatctgaaaagaaaaaagatcgaatcgacgctttcctccgagaggtgaatcaaagggtagtgcgagtgcctagcgtccctgaaacagagcttactgatcaggcctggttgccagccggcgtccgggtcccactgcatcaggtgccttacgccgtgaagggctgctttcgtttcctgcctcccgctcaggtgacggtggtggggagttacctactgggtacctgtatcagacccgacatcaatgttgatgttgctcttacaatgcctcgggagatactccaggataaagatgggttgaaccagagatactttcgaaagcgtgccctctatctcgcccacctagcacaccacctggctcaggacccactttttggctccgtgtgttttagctatactaatggatgccatttgaagccaagcctattactccgcccccgtggcaaggacgaacgcctggtgaccgtgagattgcatccctgcccgcctcccgacttcttcaggccatgtcgacttctgcctacaaagaataatgtcagaagcgcttggtatcgcggtcagtcaccagccggagacggctcccctgagccaccaactccgcgctataacacatgggttctccaggacacagttctcgaaagccacctgcaactcttatccactatcctcagcagcgcacaggggctgaaggatggcgttgcccttttgaaggtctggcttagacaacgggaactggataaaggccagggtggatttacgggattccttgtgagcatgcttgtggtgtttctggtgtctactcgcaagattcacactacaatgtctggctatcaggtgttgcgttccgtactccagttcctggctaccaccgatctgactgtgaacggtatatcactgtgcttgtctagtgacccaagtctccccgcactggccgatttccatcaagccttctccgtggtcttcttggactcatctgggcacctgaatctgtgtgcagatgtgacagcgagcacctatcatcaggtgcaacacgaagcacgtctgtcaatgatgctgttagattctcgggcggatgacgggtttcatctgctgctcatgacccccaagcctatgatccgagcattcgaccatgtgctccacctgcggcctctcagccgactccaggcagcttgtcacaggcttaaactttggccggaattgcaagataacggtggcgactacgtgtcggctgccctcggacccctgaccacactcctggaacaaggtctcggcgctagactcaatctgttggctcacagccggccccctgtacccgagtgggacatttcacaggaccctcctaagcacaaggatagcggaaccctgacactggggctgctattgaggccagaaggactcacaagtgtgcttgagctggggccagaggccgaccagcctgaggccgccaaattcaggcagttttgggggagcagaagcgagcttaggcgattccaggatggggccattagggaggccgtggtgtgggaggcagcttctatgagccaaaaaaggctgatcccacaccaggtagtgactcatctcctggctttgcacgcggatatccctgagacctgtgtgcactatgtcggagggcctctcgacgccctgattcaaggtctgaaggagacatctagcactggagaggaagctttggtggctgctgtgaggtgttatgacgatctgagcaggctcctctggggcctcgagggtttacctctgacagtctccgccgtccagggcgcacaccccgtcttacgctacaccgaggtgttcccgccaactccagtgcgccccgcttttagcttctacgagacactccgcgaaaggagtagcctcctgcccaggcttgacaagccctgccctgcatacgtggaacctatgaccgtggtttgccatcttgaggggagtggtcagtggccccaggatgccgaggccgtacagcgtgtccgagcagccttccaactccgcctggccgaattgcttactcagcaacacggactccagtgccgggcaacagccacgcacactgacgtgttgaaggacggcttcgtcttcagaatcagagtggcctaccagagagagccacagatcttgaaggaagttcagagccccgaaggtatgatatcccttagggatactgctgcatctctccgtctcgaaagagacacacggcaactccccctgctgacttcggctctgcacggtctgcagcagcagcatcccgcattttcaggagtcgcccggctggcaaagaggtgggtacgagctcagctgctaggggaagggtttgccgacgaaagcctcgatctggtcgccgctgcccttttccttcatcctgagccatttacgcctccgtctagcccccaagtggggtttctgcgttttctgtttctggtctccactttcgactggaagaacaatcctctgtttgttaacttaaataacgagctgactgtggaggagcaggtcgagattagatccggcttcctggctgctagggcacaattgcccgtcatggtgattgtcaccccgcaggaccgcaagaacagcgtctggacccaggatggtccctcggcacaaattcttcagcaactggtggtacttgccgctgaagccctgccaatgctggagaagcagctgatggatcctaggggaccgggggatataaggacagtctttcgtcctcccctggacatttatgatgtgctgattagattaagtccgcgtcatatcccacgccacagacaagcggtcgatagccctgctgcatcattctgccggggactgctgtcccagccaggaccctcatccctcatgcctgtgctggggtacgaccctccccaactctacctcacccagctgagagaagctttcggcgatttagctctgtttttctacgaccagcacggcggagaggttattggagtcttgtggaagcctacttcttttcagccccaaccttttaaggctagtagtacaaagggccgaatggtgatgagtaggggaggcgagctggtaatggtcccaaatgtggaagctatcctcgaggattttgcagtcctcggggagggcctggtgcagacagttgaggcccgctcagagcgatggaccgtgtag

SEQ ID NO: 127090 - DNA, 3024 bp, Artificial Sequence
  Description of Artificial Sequence: Synthetic coding sequence
atgggcccagcaccagcaggtgaacaactgcgtggagccaccggggagcctgaggtcatggagccggcactagagggtacaggcaaggaaggtaaaaaagccagctcccgaaaacgcactcttgccgaaccaccagcgaagggtctgctccagccggtgaaactgtcacgtgccgaactgtacaaagagcctactaacgaagaattaaatcgcctgcgcgagaccgagattctgtttcactcgagcctactgaggcttcaggtagaggaactcctcaaggaagtccgactgtctgagaaaaagaaggataggatcgatgccttcctacgggaggtaaaccagcgggttgttagagtgccatctgttcccgaaaccgaattgacggaccaggcttggctgccagctggagttcgcgtaccactccatcaggtgccttatgccgtgaaggggtgctttaggttcctcccacctgctcaagtcacagtggtggggtcatacctcctcggtacctgcattagaccagatattaatgtagatgtggccttgaccatgccgcgggagatcttgcaggataaggacggactcaaccagagatactttagaaagcgggcactctacctggcacatctcgcccatcatctcgctcaggatcctctctttggctcagtgtgtttcagttacactaacggttgtcatctgaagccatctcttcttctgcgcccacggggaaaagacgagcgccttgtgacagtgaggctgcatccctgccccccaccagacttcttccggccttgtcgcttgctgcctacaaagaataatgtccggtccgcttggtacaggggccagagccccgctggtgacgggtctcccgaacctcctactccccgctacaatacctgggttctgcaggatacggtactcgaaagtcacctgcaacttcttagtaccatcctcagttcagcccagggcctgaaggacggcgtcgccctgttaaaagtgtggctgcgtcaaagagaacttgacaagggacagggtggctttacgggatttctggtgagcatgttagtggtcttcctggttagtactaggaaaatccacacaactatgtcaggttaccaagtgttgagaagcgtcctccagttcctggccaccaccgatttgacagtaaacggcatctccttgtgcctttctagcgacccaagtctgccggccttagctgattttcatcaggcattttccgtcgtattccttgacagctccggccacttgaacctgtgcgccgacgtaactgcttccacctatcaccaagtgcagcacgaagccaggctcagcatgatgctgctggatagcagagcggatgatggattccacttactcctgatgaccccaaaacccatgataagagccttcgaccatgtattacacctgcggcctctatctcgtcttcaggctgcttgccacaggcttaagttgtggccagaacttcaggacaatgggggcgattacgtttcagccgccctgggccctctaacgaccctgctagaacaaggcctgggcgcaagactgaatctcttagctcacagccgacctcctgtacccgaatgggacatttcgcaggacccgcctaagcacaaggactccggaacccttacactaggccttctcctgaggccagaaggtttaacatctgtcctcgagttgggaccggaggccgatcagcccgaggctgccaaatttagacagttctggggatctcggagcgagctgcgccgctttcaggatggtgccattagggaagcagtggtgtgggaggctgcctccatgagccaaaagagactgatcccgcatcaggtggtgactcaccttctggctctgcatgcagacattccagagacctgcgttcactacgttggcgggccgttggatgccctaatccaaggtctgaaggagacatcatcaactggagaggaagctctcgttgctgctgtgaggtgctatgatgatctgagtcgactcctgtgggggctggagggattgcctctgaccgtgtctgccgtacagggcgcccatcctgtccttcgttacaccgaggtgttccccccaactcctgtgaggcccgctttttctttttacgagactttgagagaaagatcctctctacttccaagactggataagccatgtcccgcctatgtagaaccaatgacagtggtgtgtcatttggaagggtctggacagtggccccaggacgctgaggctgttcagagagtcagagcggcatttcagctccggctggccgagctgctcacgcaacagcacggtctgcagtgcagggcaacagctacacatactgatgtgctgaaagatggattcgtgttcagaatacgagtcgcgtatcagcgggaacctcagatcctgaaagaagtccaatcacccgagggcatgattagccttcgggataccgcagcctcacttcgtctcgagagagacactagacagcttcctttgttgaccagcgctctccatggcctccagcagcagcatcctgctttcagcggagtcgctagactcgctaagagatgggtgcgcgctcagcttctgggagagggctttgccgatgagtccctggacctggtcgcagccgctctttttctgcacccggagccctttacgcctccatcaagcccccaggtgggtttcttgaggtttctgtttctggttagcacctttgactggaagaataaccccctcttcgtaaacctgaataatgagcttaccgttgaggaacaagtagagattcgcagcggattccttgctgctcgggcacagctgcccgtcatggtcattgtcacacctcaggacagaaagaacagtgtgtggacccaagatggcccatccgcccagatattgcagcagctggtcgtgctggccgccgaagctctgcccatgctggagaagcaactgatggatccacggggacccggagatattagatgggatcccgcgaagatgtggcccttctag

SEQ ID NO: 127091 - DNA, 2100 bp, Artificial Sequence
  Description of Artificial Sequence: Synthetic coding sequence
atgggtcccgccccggcgggcgaacagctgcgaggcgccaccggggagccagaagtaatggaacccgctctcgagggtactggaaaggaagggaaaaaggctagtagcaggaagaggaccctagccgagccacctgcaaagggtctgttgcagccagtgaaactctctcgagcggagctgtataaggagccaacaaatgaggagttgaaccgcctgagagaaaccgaaattttgttccattcgtccttgcttcgtttgcaggtagaggaactcttgaaggaagtgcgcctgagtgagaagaaaaaagacaggatcgatgcctttctgagggaggtcaaccaaagggtggtgcgcgtcccatctgtcccagagactgaattgaccgatcaagcttggctgcctgccggcgtgcgggtaccattacatcaagtaccatatgccgtcaaaggctgcttcagatttctgccaccagctcaagtgaccgtggtcggctcctaccttctaggaacgtgcatcaggcccgatataaacgtggacgtggccttgaccatgcctagggagatccttcaggataaagacgggctgaaccaaagatattttcgaaaacgtgctctttacttagcccatttggcacatcacttggcccaggaccccctcttcgggtccgtgtgcttcagttataccaacgggtgtcacctcaagccgagcttactgctgcggcctcgagggaaggatgaaaggctagtgacagtccggttacacccttgtcccccacccgacttctttaggccatgtaggctgctgccaaccaagaataacgttcgctcggcatggtaccgggggcagtcccctgctggagacggttcccctgagcctcctactcctagatataatacgtgggtccttcaggatactgtgttggaaagccacctgcagttgctaagtactatactgagcagtgctcagggactaaaggacggcgtggcgctgcttaaggtctggctccgccagcgcgagctggacaagggacagggcggttttaccggcttccttgtctccatgctggtggtttttctggtctctacgcgcaaaatccatactaccatgtccggctatcaggtactccgctccgtgctgcagttcttagcaaccacagacttgaccgtgaacggaatttccctttgtctttctagtgacccatccctgcctgccctagccgactttcatcaagccttctctgtcgttttccttgatagttcagggcacctcaacttgtgtgctgacgtgacagcttccacataccaccaggtacagcatgaggctagactatcaatgatgttgcttgacagccgggctgacgatgggtttcaccttctgttaatgacaccaaaaccaatgattcgggctttcgaccacgtgctgcacttaaggccactgagcagactgcaagcggcctgtcataggttaaaactttggccagaacttcaagacaacggtggggattacgtcagcgccgccctgggaccactgaccactctgctcgagcagggcctaggcgctcgcctcaatctcttagcacactctcggcctcctgtgcctgaatgggacatttcccaagaccctccgaaacataaagattcaggcacccttacgcttgggctactgctcagaccagagggtctgacaagcgtgttggagctaggtcctgaggcggaccagccagaggctgcgaaatttaggcagttttggggtagccgctcggagctgaggcgtttccaagacggcgccattagagaggctgtagtctgggaagcggcctctatgtcccaaaagagattgatcccacaccaagtcgtcacgcacctgctggctctccatgcagacatacctgaaacctgcgtgcactatgtgggcggtcccctggatgccctgattcagggcctgaaggaagccagctcaaccaaaggtaggatggttatgtctcggggcggcgaactggtgatggtcccgaacgtcgaggccatcctagaggacttcgccgttcttggcgagggtctggttcagactgttgaagcccgttcagaacggtggactgtctag

SEQ ID NO: 127092 - DNA, 603 bp, Artificial Sequence
  Description of Artificial Sequence: Synthetic coding sequence
atggtgattgtcacaccacaagaccgtaagaactcggtatggacgcaggatggccctagcgctcaaattctccagcaacttgtcgttctggcagccgaagctcttcccatgctggagaagcagctaatggatccccgaggaccaggggacatcagaaccgtgttccgtccgccgttagatatctacgatgtcctgattaggttatcgcctagacacatccccaggcacaggcaagccgtggacagccctgccgcctccttttgcagaggacttctgagtcagcccggcccgagctctctcatgccggtgctcggctatgaccccccccagctttacctgacacagcttagagaagcttttggcgatttggcactgttcttttatgaccagcacggtggggaagttattggtgtcctttggaaacccacaagcttccagcctcaaccgtttaaagcttcctccaccaagggacgtatggtgatgtccaggggtggcgaactcgtcatggtgccaaatgtggaagctatcctcgaggacttcgctgtgctaggagagggcctggtccagactgtcgaagcccgctccgagaggtggactgtgtag

SEQ ID NO: 127093 - DNA, 3072 bp, Artificial Sequence
  Description of Artificial Sequence: Synthetic coding sequence
atggggccagcaccggcaggtgaacaactgagaggagctacaggcgagcccgaggtcatggagcccgccctggaaggaacaggcaaggaaggaaaaaaagcatcaagcaggaagagaacactggctgaacctcccgccaagggtctgctgcaacccgtgaagctatctagagcagagctgtataaggagccgaccaacgaagagctgaataggctgagagaaacagaaatcctgtttcactctagtttattgcgcttgcaagtggaagaactcctcaaagaagtgcggctgtcagaaaaaaagaaggatcggatcgacgcttttctgcgggaggtgaaccagcgggtcgtgagagtgccatctgtgcctgagacggagctcaccgaccaagcatggctccccgcgggagtgcgcgtcccgctccaccaagttccatatgccgtcaaggggtgtttccggtttcttcctcctgcccaagtcacagtggttggctcatacctgctgggcacctgtatacgacctgacataaacgtcgatgtcgccctgacaatgcctcgggaaattcttcaggataaggatggcctgaatcagcgatactttagaaaacgagctttatacctggcccacctcgctcaccatctcgcccaggaccctctattcggcagcgtctgcttttcttacaccaatggctgtcacctcaagccttccctgctgctgagaccacgtgggaaggatgaacggctggtcacagtccgcctgcatccatgcccaccacccgacttcttccgaccctgtcgactgctgcctaccaagaacaatgtgcggtctgcttggtaccggggtcagagtcccgctggtgacggatcgccagagcctccaacccctcggtataatacgtgggtcctgcaggacactgtgttagagagtcacttgcagttgctgtctaccatcctcagctcagcgcagggtcttaaagatggagtggcactactgaaggtgtggctcaggcagagggagctagacaaagggcagggcggtttcactggctttcttgtgtctatgttggtagttttcttagtgagcactcgtaagattcacaccacgatgtcgggctatcaggttctgaggtcggttctgcagttcctcgcaacaactgacctgactgtgaatggcatcagcctttgcttaagctccgatccttcgctcccagccttggccgatttccaccaggcattcagcgttgtgttcctggacagctctgggcacctcaacctttgcgccgacgttactgcctctacctaccaccaggtgcagcacgaagctcggctttcgatgatgctcctggacagtcgggctgacgacgggtttcatctcctgctgatgacccccaagcccatgatccgggcctttgaccatgtgttacatcttaggcccctgtcaagactgcaggccgcgtgccacaggctgaaactttggcctgagctccaggacaacggcggggactatgtgtctgcagccctgggcccgttgactaccctgttggagcaaggccttggtgcccgcctgaacctcctggcacatagccgtccacctgttcctgagtgggatattagtcaggaccctccaaaacataaggactccggaactctcaccctgggcctcctcctgagacccgaaggactcactagcgtgctcgagctcggccccgaagctgatcaacctgaagccgccaaatttaggcagttttggggatcacgctccgagttaagacggttccaggatggcgcaatcagggaggcagttgtgtgggaagcagcctcgatgtcgcagaagcgcttaattcctcaccaagtggttactcacctcctcgccctgcatgcagatatccctgagacttgtgtgcattacgtcggcggtccgttggacgctctgatccaaggcctgaaagaaacatcctcaactggagaggaagcactcgtagctgccgtaaggtgttacgacgacctcagccggctgctgtggggcctcgaagggcttcctctgaccgtgagtgccgtgcagggtgctcacccagtgctgaggtacacagaggttttcccccccaccccagtgcgtccagctttctctttttacgagaccctgcgggaacggagcagcttgctcccaaggttggataaaccttgcccagcatatgtggagcccatgaccgtggtctgccatctggagggaagtggccaatggccacaggatgcggaggccgtacagcgcgtgcgggctgcatttcaattacgacttgccgaattgcttacccagcaacatgggcttcagtgtcgggctactgccacccacaccgacgtgctcaaagatggtttcgtgttcagaatcagggtcgcctaccaaagagaacctcagatccttaaggaggtgcaatcacccgaagggatgatttctctcagggacaccgctgctagtttgcgccttgagagagatacgagacagttgcccttgttaacgagcgctttgcacggcctgcagcagcagcaccccgcattctccggcgttgctcgactcgccaaaaggtgggtgcgtgcacagctactgggcgagggcttcgccgatgagagtctggacctggtagcagctgcactctttctgcacccagagccattcacccccccatcctcaccccaggtgggcttcctgcgcttcctctttttagtgtctaccttcgactggaagaataacccactgttcgtaaatcttaataacgagctgactgtcgaggagcaggtcgaaatacgcagtgggtttctggccgcccgtgcccagctgccggtgatggtgatcgtcacgcctcaggacagaaaaaactccgtgtggactcaggatggaccgagtgctcaaatcctgcaacagctcgtagtcttggcagccgaggcccttcctatgctcgaaaagcagttgatggatccacgcggaccaggggacattcggatgggcccctccgagaacgtggcgctccttagccacataacggataccgagcaatggaaaggggctatctgcgtgtag

SEQ ID NO: 127094 - DNA, 3285 bp, Artificial Sequence
  Description of Artificial Sequence: Synthetic coding sequence
atgggaccagcacccgcgggggagcagctgcgtggagcgacaggtgaacccgaggtgatggagcctgccctcgaaggcaccggaaaggaagggaagaaggctagttcccgcaagcgcaccctcgctgagccgccggccaagggacttcttcagccagtgaaactcagtagagcagagttgtacaaggaacccactaacgaagaactcaatcgcttacgcgagacagaaatcctgttccattctagcttgctgagactgcaagtcgaggaactgctgaaagaagtgcgtttgtctgagaaaaagaaagaccgcatagatgcattcctgcgggaggtgaaccaacgggtggtgcgtgtgccgtccgttcccgaaaccgaggagatcctgcaggacaaggatggacttaaccaaagatactttcgcaagcgggcactgtatctcgcccacttagcacaccatctggcccaggaccctctgtttggctctgtttgcttttcctatactaacggttgtcacttgaaacccagcctgttactccggccacgcgggaaagacgaaaggctagtaaccgtgagattgcacccctgtccgccccctgatttcttcagaccatgccggttactgcctactaagaacaacgtgcggagcgcctggtatagagggcaatcacccgcgggggacggaagtccggagccacccactccccgatacaatacctgggtgctgcaagacacagtgctggagtcacatctgcagctgttaagcacgatcttatcgagtgcccaaggattgaaggacggagtggcactgctgaaggtttggctgaggcaaagggagttagacaaagggcagggaggtttcacaggatttcttgtcagcatgctcgtggtgttcctcgtctcaacacggaagatacacacgacaatgtcggggtaccaggtgctgcgctctgtactccagttcttggccacgacagaccttaccgttaatggtattagtctctgtctcagcagtgatccttctcttccagccctggctgatttccaccaggcattcagcgtcgtctttctggattcttctggtcatttgaatttgtgtgctgacgtgaccgcctcaacctaccatcaggggtggagccttctgtggttgcaagtccagcacgaggctcgcttgagcatgatgctcctagattcaagagccgatgacggttttcacctgctgctgatgacaccaaagccaatgattagggcttttgaccatgtgctgcaccttcgtccattatcaaggctgcaagccgcttgtcacaggctgaaactctggcctgagttgcaggataatggcggggattacgtcagtgctgcactggggccgcttacaaccctgctcgaacagggcctgggggctcggttgaacttgttagctcactcccgcccgccagtccctgagtgggatatctcacaggaccctcctaaacacaaagatagtggaacccttacgctaggcctgcttctacggccggagggtctgacaagtgttctggaactgggacctgaagctgatcagccggaagcggctaagttcagacagttctggggctccaggtcagagcttagaagatttcaagatggggcaatcagggaggcagtagtgtgggaggcagcatcaatgtcccagaaacgtcttatcccccatcaagtcgtgacccacttactggcgcttcatgcagatattcctgagacctgtgtgcactatgtcggtgggcctctcgacgctctcattcagggattaaaagagactagttccaccggagaagaggctttggtggccgccgtcaggtgctacgacgatttgtcccgcctcctttggggcctggaagggttacctcttaccgtgtccgccgtgcaaggcgctcatcctgtgctgagatataccgaagtgttccctccgaccccagtgagaccagccttctctttttacgaaaccctgcgggaacggtcctctctcctgccaagactcgacaagccttgtcctgcatatgtagagcctatgacagtcgtttgtcatctcgagggaagtggccagtggccccaggacgccgaagccgttcagcgggttcgagcagctttccagttgagattagccgagctgctgacacagcagcacgggctgcagtgccgagcaactgccactcatacggacgttcttaaggacggcttcgtgttccgcatccgtgttgcctatcaaagagagccacagatcctgaaggaagtccaatcgccagaaggaatgatctcgttaagggatacagcggcttctttgagactagagagagataccagacagctgccgctgttaactagcgctctccacggccttcagcaacagcatcccgcattttctggggtcgcgcgcctggcaaaaagatgggtgagagcccaacttttgggagaagggtttgcagacgagagtctggacctcgtcgccgctgccctgttcttacaccccgagccatttacaccaccttcaagcccccaggtgggattcctcagattcctcttcctggttagtacctttgattggaagaacaatccactgtttgtgaacctgaataatgagctcacggttgaggagcaagtcgaaatccgctcaggatttttggccgccagagcgcagcttcctgtcatggtgatcgtgactccacaggatcggaaaaactctgtgtggacgcaggatgggccctcagcccaaatacttcagcagttggttgttctcgctgcagaggctctgccaatgcttgagaagcagctgatggatcccagagggcccggagatattagaacagtgtttcgtcctccactagatatttacgatgttctgatccgactgtcaccgcgtcacatccctcgacaccggcaggctgtggacagtccagctgccagcttttgtcgaggactgttgtcccagcccggacctagctcactgatgccagtgttgggctacgacccaccccaattgtacctgacccaactgagggaagccttcggagatctcgcccttttcttttacgatcagcatggtggtgaagtgatcggagttctgtggaagcctacctcttttcagcctcagcccttcaaggcttcttccactaaaggccgcatggtaatgtcccgaggcggcgaacttgttatggttcctaatgtggaggctatactggaagacttcgctgtcctcggagaggggctggttcagacagtggaagcaagaagcgagcggtggacggtatag

SEQ ID NO: 127095 - DNA, 2109 bp, Artificial Sequence
  Description of Artificial Sequence: Synthetic coding sequence
atgatgctactagatagccgcgctgatgatggattccacttgttgctcatgactccgaaaccgatgattagggcctttgatcatgtgttgcacctgcgcccattatcccggttgcaggctgcgtgccataggctgaaattgtggcctgagctgcaggacaatggaggagactatgtgagcgccgcgcttgggcctctcaccaccttgctggaacagggcctgggcgctcggctcaatctcctcgcccactcccgcccccctgtgccagagtgggatatctcccaggacccacccaagcataaagacagcggcactctgacattaggcttgcttctaaggcctgagggccttacatccgttctcgaactgggcccagaggccgaccagccagaagcagctaaattcagacagttctggggaagccggtccgagctcaggcggttccaggatggggccattcgagaagctgtggtctgggaagccgccagcatgtctcagaaaaggctgattccacaccaggtggttacacacctgctggctttgcacgctgatatccccgaaacatgtgtgcactacgttggaggcccactagatgcgctaatacaggggctgaaggagacttcttctacaggagaggaggcactagtggctgccgtgcgctgttacgacgacctttcacggttgctttggggactagaggggctgcccctcaccgtgtccgctgttcaaggggcccatccagtgctgcgctacactgaggtgttcccacccaccccagtacggccagcgttttctttttacgagaccctgagggagcgctcctccttgctgccccggcttgataagccttgccctgcatacgtagaacccatgaccgtcgtgtgtcatctggaggggtccggacagtggcctcaagacgcggaagccgtgcagcgtgtgcgcgccgcctttcagctgcggctggcggagttactcacacaacaacacggattgcaatgccgggcgaccgcaactcacaccgatgtgctgaaagacgggttcgtgttcaggatcagagtagcctaccagcgggagccccaaatactcaaagaggtgcagagcccggaggggatgatttcgcttcgcgataccgccgcaagcctccggctcgagagggacactcggcagttaccactgctgacttccgccctccatggtctccagcagcaacatcccgcttttagcggtgttgcccgcctcgctaagcgctgggtgagagctcagctgctcggcgagggcttcgctgatgaatcactcgatctagttgcggctgcattgttcttgcacccagaacctttcacacctcctagcagtccacaggtaggctttttaaggtttctttttttagtctctacattcgattggaaaaataaccccttgttcgtgaacttaaacaatgagctgaccgtggaggaacaggtggaaatcagatcaggcttcctggctgctcgagcacagctgcccgtgatggtcatagtcacaccccaggataggaaaaactccgtgtggacccaggacgggccatccgcgcagatcctgcagcaactggtggtgctggccgcagaagcattacctatgcttgagaaacagctcatggatcccagaggacctggagacatccggaccgttttcagaccaccactcgatatatatgatgtgctcattcggctgtccccacgacacattccacgccacaggcaggccgtagactctcccgccgcctccttctgccggggattactgtcacagccaggtccttcctccttgatgccggtcttaggatacgatcccccccagctatatttgacgcaactgagggaggcgttcggtgatctcgcgctttttttctatgaccagcacgggggtgaggtcattggtgtgctgtggaaaccgacatcttttcaaccgcagccattcaaggcctcctcaactaaagggagaatggtgatgtctcgcgggggagaacttgtcatggttcctaacgtggaggccattcttgaggactttgcagtgctgggcgaaggtttggtccagaccgtggaggctcggagcgaacgatggaccgtgtag

SEQ ID NO: 127096 - DNA, 645 bp, Artificial Sequence
  Description of Artificial Sequence: Synthetic coding sequence
atgaatctgtcatccgcttcctccaccgaagagaaggcagttaccacagtgctgtggggctgtgagttaagccaagagcgaaggacttggacattcagaccccagctagagggtaagcagtcatgtcgcctcttactacacactatctgcctgggggagaaggcaaaagaggaaatgcacagggtcgaaatcctgccgcctgctaaccaggaagacaaaaagatgcagcccgtgaccattgccagcctccaggcctccgttctgcctatggtgtccatggtgggagtccagctttctccccctgtaacattccagctaagagccggatctggacccgtcttcttgagcggccaggaaaggtatgaggcttccgatcttacgtgggaggaggaggaggaagaagagggcgaggaggaggaggaggaggaggaggacgatgaagatgaggacgccgacatcagcctcgaggaacagtcgcccgtgaaacaggtcaagaggctagtacctcaaaagcaggcctctgtggcaaagaaaaagaagttagagaaggaagaggaggaaatccgggcaagtgtccgggataagtcacctgtgaagaaagcaaaggctactgctagggctaaaaagccaggatttaagaaatag

SEQ ID NO: 127097 - DNA, 411 bp, Artificial Sequence
  Description of Artificial Sequence: Synthetic coding sequence
atgaatctgtcgagcgccagcagtacggaagagaaggctgtaacaaccgtactctggggatgcgaactgtcacaagagcgcagaacgtggacattcagaccccagcttgagggcaaacaaagctgccgcctacttctacacactatttgtctaggcgagaaggctaaagaggaaatgcatcgcgtcgagattttgccccccgccaaccaggaagataaaaagatgcagcccgtcacaattgcctccctacaggcatctgtccttcctatggtgtcaatggtgggagtacagttatctcctcctgtgacgttccaacttagggctggaagcgggcctgtttttttgagcggacaagaacgctacgaaaaaaaagcagggaagcgaaggcgtggtaacaagagtcagagatag

SEQ ID NO: 127098 - DNA, 645 bp, Artificial Sequence
  Description of Artificial Sequence: Synthetic coding sequence
atgaatctctcatctgcttcttcaaccgaggagaaggccgtgactaccgtgctttggggctgtgaactcagccaggaacgaagaacgtggacatttcgacctcaactggaggggaagcagtcttgtcgcttgctcctgcacaccatttgtctgggggaaaaagcgaaggaggagatgcacagggtggaaattctccctcctgcaaaccaggaagacaagaaaatgcagccagttacaatcgcctccctgcaggccagtgttctgcctatggtgagcatggtgggtgtgcagctctctcctcctgtgaccttccagctacgggcaggtagcgggcccgtttttctctcaggacaagaaaggtatgaggctagcgacctcacatgggaggaagaggaggaggaggaaggcgaggaggaagaagaggaggaggaggatgacgaggatgaagatgccgatatatccctggaggagcagagtcccgtgaaacaagtgaaacgcctagtaccacagaagcaggcctctgtcgccaagaaaaagaaactggaaaaggaggaggaggagatcagagctagtgtgagagataaatctcctgtcaaaaaggccaaggccactgcaagggccaagaagccaggatttaaaaaatag

SEQ ID NO: 127099 - DNA, 645 bp, Artificial Sequence
  Description of Artificial Sequence: Synthetic coding sequence
atgaacctgtcttcagcatcttctaccgaagagaaggccgtgaccacagttctgtgggggtgcgaattgtctcaggaacgtcggacatggacgtttcgcccccagctcgagggaaagcaatcctgtcgactcctcctgcacaccatttgcttgggggaaaaggcaaaagaagaaatgcaccgagttgagatcttgcccccagctaatcaggaggacaagaaaatgcaacctgtgaccatcgccagccttcaggccagtgtgctgcctatggtctccatggtaggcgtccaactgtcgccccctgttactttccagctcagagcagggagtggccccgtctttctgagcggccaagagaggtacgaagcaagtgacctcacctgggaagaggaggaagaggaggagggggaggaagaagaggaggaagaagaggacgacgaagatgaagacgcagacatttcgctggaggagcaaagccccgtgaagcaggtcaagcggctcgtgcctcagaaacaagcatctgtcgcgaagaaaaagaagctcgaaaaagaagaggaagagattcgcgcctcggtgcgagacaagtctcccgttaaaaaagccaaggccacagcccgagcaaagaaaccaggatttaaaaaatag

SEQ ID NO: 127100 - DNA, 645 bp, Artificial Sequence
  Description of Artificial Sequence: Synthetic coding sequence
atgaacctgtctagcgcgtccagtacagaggaaaaggccgtaacaacggttctctggggatgtgagctgtcacaggagaggcgcacgtggacgtttagaccacagctggaaggcaagcagagctgccgattgctactacacacaatttgccttggcgagaaggcaaaggaggagatgcaccgagtggagatacttccaccagctaaccaggaggataaaaagatgcagccagtgactattgcctccttacaggctagcgtgctccccatggtaagtatggttggtgtgcaactgtcgcctccagtgacctttcaactgcgcgcgggcagcggaccagtctttctgagcgggcaagagcgatatgaggcttcggatttaacctgggaagaggaagaggaagaagagggtgaagaggaggaagaagaggaagaagacgacgaggacgaagatgcagatatctcgttggaggaacagtcacccgttaagcaagtaaaaagactcgtcccccagaaacaggcttccgtggcaaagaaaaagaagttggaaaaagaagaagaagagatccgagcgagcgttagggataagagccccgtcaaaaaagctaaagctactgcaagggctaaaaagccagggttcaagaaatag

SEQ ID NO: 127101 - DNA, 537 bp, Artificial Sequence
  Description of Artificial Sequence: Synthetic coding sequence
atggcggcggggacggctgctgcactggccttcctgtctcaggagtctcggacaagagcaggtggcgtggggggactgcgggtaccagccccagtaacgatggattcattctttttcgggtgcgaactctccgggcatactcgatctttcacgttcaaggtggaagaggaggatgatgcagaacacgtgctggccctgacaatgctttgtcttacagagggcgctaaagacgagtgtaatgtggtggaggtagtggcccgaaatcacgaccatcaggagatcgccgtcccagtggccaatctgaaactaagttgccagccaatgctaagtctggacgattttcagctacagccaccggtaactttcaggctcaaaagcggttcaggaccggtgcgcatcactgggagacatcagatagttactatgtctaacgatgtgtcagaagaggagagtgaggaggaagaagaggactccgatgaggaggaggtggaactctgccccatcttgcctgccaagaagcaagggggccggccctag

SEQ ID NO: 127102 - DNA, 501 bp, Artificial Sequence
  Description of Artificial Sequence: Synthetic coding sequence
atgaaatatacttcatacatcctggcattccaactctgcatcgttctgggctcattgggctgctattgccaggatccatacgtcaaagaggccgagaatctgaagaaatacttcaacgcaggccactcagatgtggcggataatggaacactgtttctcgggatcctgaaaaattggaaagaggagtcagataggaagatcatgcagagtcagattgtgagtttttacttcaagcttttcaaaaatttcaaggatgatcagtcaattcagaaaagcgtcgaaaccattaaggaagacatgaatgttaagtttttcaattctaataaaaaaaaacgcgatgacttcgagaagctcaccaattattcagtgaccgacttaaatgtgcagagaaaagccatacacgaactcatccaagtgatggccgaacttagcccagcggctaagaccggaaagcgcaaaagatcccagatgctttttcggggtcgccgcgctagccaatag

SEQ ID NO: 127103 - DNA, 2061 bp, Artificial Sequence
  Description of Artificial Sequence: Synthetic coding sequence
atgtccatgttctctgacttcctgcagagtttcttgaagcattccagctcgacggtattcgaccttgtggaggaatatgagaatatatgtggaagccaggtaaacatcctcagtaaaattgtgtcgcgagcgacgccaggcctacagaagttctctaagacagcctcaatgctgtggctgcttcagcaggaaatggttacgtggcgcttactagcatctttgtaccgcgaccgcatacaatccgccctggaggaagagtccgtgttcgcagtgactgccgtgaatgcttctgaaaagacagtcgttgaagcgctcttccagcgggacagtctcgtgcgccagagccagttggtggtggactggctggaatctattgccaaggacgagattggagaatttagtgataatattgaattctacgccaaaagcgtctactgggagaatacactgcataccctgaagcaaagacagctgactagctatgtaggcagtgttcgcccactggtcaccgagctggatcccgacgcccccatacgacagaaaatgcccctggatgacttggatcgggaggatgaagtgcggctgctcaagtacttgttcactttgattagagctggtatgacggaggaggcacagaggctctgcaagcgatgcggccaggcctggcgagccgctactctggaaggatggaagctgtaccacgaccctaatgtgaatggaggtaccgagctggaacccgttgaaggaaacccttaccgcaggatttggaaaattagctgttggaggatggcggaagacgagctatttaatcggtacgaacgcgctatctacgcagctctgtccggaaaccttaagcagctcctcccagtgtgcgacacatgggaggatactgtttgggcttatttccgcgtgatggtggattctttggtcgagcaggaaatccagaccagtgtagcaacacttgatgagacagaggagctgccaagggaatacctcggggctaactggaccttggagaaggtctttgaggagctccaggcaaccgacaagaagcgggtgctggaagaaaatcaggagcattaccacattgtccagaaatttctgatactgggggacattgacgggctgatggacgaatttagcaaatggctgtccaagtcgaggaacaaccttccaggccatctcttaaggtttatgacccatctgatcctgtttttcagaacgcttggactgcagacgaaagaagaggtatctattgaggttctgaaaacctatatccaggaagataggctaaagatcgacgtgattgattggttggtcttcgaccctgctcaacgcgctgaggccttgaagcaggggaatgccataatgcgtaagtttttggcttcaaaaaagcatgaagccgccaaggaggtgttcgttaagataccacaggactctatcgctgagatttataatcagtgtgaagaacagggtatggaaagtccacttcccgccgaggacgacaatgcaatccgtgagcacctctgtatccgcgcctacctggaggcgcacgagacctttaatgagtggtttaaacacatgaattccgtccctcagaaaccggcgctgattccgcaaccaacattcaccgagaaagtcgcccacgagcacaaagagaagaaatatgagatggattttggcatatggaagggacacctggacgcgttgaccgcggacgtgaaggagaagatgtacaatgtgttactgttcgtggatgggggctggatggtggatgtccgtgaggatgcaaaggaggaccacgaacgcacacaccagatggtcttgctgcggaaactgtgccttccaatgttgtgtttcctgttacacaccatattacattccaccggtcagtatcaggaatgcctgcaacttgcagacatggttagcagcgagaggcataaactttatttggtttttagtaaagaagagctccgtaagctcctacagaaattgcgggagagcagcctcatgttacttgaccagggtctcgaccctctgggttacgagatacagctgtag

SEQ ID NO: 127104 - DNA, 2691 bp, Artificial Sequence
  Description of Artificial Sequence: Synthetic coding sequence
atgaagatactcgtcattctccaccaagaaactaggctgtcgctagagctgctcgcccactttgactcactggtactgagcaccaatctgctcttcatcgtgacaccaacttcaagatcgttgttacgccagccagatatcagctgcatcctaggaacaggtggaaaaagtccaaggttaacccagtcctcaggtttttttggcaacctgtcgatggttacaaatctggatgactctaattgggctgcggcttttagttcccaacgcagcggcttatttacgaatactgagccacactcaataaccgaggatgtgaccatatcggccgtcatgttgagggaggacgaccctggggaggccgcctctatgagcatgtttagcgacttcctgcaatcttttcttaagcacagtagttccaccgtgtttgatctcgtcgaagaatacgagaatatttgcggctcgcaagtgaacattctgtctaagattgtgtcacgcgcgacacccggcctacagaaattctctaaaacagcctccatgctctggctgctgcagcaggaaatggtgacttggagactcttagcctctctgtacagggatagaattcagtccgccttagaggaggagtcagtgttcgccgttacagctgtgaatgcctcagagaagacagtagtagaggcgctcttccagcgtgatagcttagtgcggcagtctcaacttgtagtggattggctagagagcatcgccaaggatgagatcggtgagttctcggataacatcgagttctatgccaagtccgtctattgggaaaataccttgcatactctcaagcagcgacagctgacctcttacgtaggcagtgttcgccccttggtgacagagttggaccctgacgctcctatcaggcagaagatgccactagatgacctggatagagaggacgaggttagactgctgaaatatctgtttaccctgatacgtgcaggtatgacagaagaggcacaacgcctctgcaaacgctgtggtcaggcctggcgggctgctaccctggaaggatggaagctgtatcatgatcccaacgtcaacgggggcaccgaactcgaacccgttgaaggtaacccataccgcaggatctggaagatctcctgttggcggatggccgaggatgaacttttcaaccggtatgaaagagccatctacgcagcactgtcaggtaacctgaaacagttactaccagtgtgtgatacttgggaagatacagtgtgggcatatttccgcgtgatggtggacagcttggtggaacaggagatccagacctccgttgcgaccttggatgagaccgaggaacttccaagagagtacctgggagccaattggacactggaaaaagtcttcgaagagctgcaagccacagacaaaaagcgtgttctggaggaaaatcaagaacactatcatatcgtacagaagtttcttattctcggagatattgatggacttatggacgaattctccaaatggctttctaagtcaaggaataacctccctggacatctgttacgtttcatgacacaccttatcctgttcttccgaacactagggctccagactaaagaagaagtctcaatcgaggtgctgaaaacctatattcagttgctgattcgggagaaacacaccaacctcatcgcattctacacctgtcatcttccgcaagacttggcagtagcccagtacgccctttttctggaatcggttactgaatttgaacaaagacaccactgcctggagcttgcaaaagaagctgacctagatgtcgcaaccataaccaagaccgtggttgaaaacatccgcaaaaaggacaacggcgagtttagtcaccacgacctggcacctgcactggatactggcaccacggaggaggataggctgaaaatagacgtgatcgactggctggtgtttgatccggctcagagggctgaagcccttaaacaagggaacgcaattatgaggaagtttctggcctctaagaaacacgaagctgctaaggaagtctttgttaagataccccaggacagtattgccgagatttacaaccaatgtgaagagcaaggaatggaatcgccactgcctgccgaagatgataacgccattagggaacacttgtgtattagggcatacttagaggcacatgaaacattcaacgagtggttcaaacatatgaatagtgtgccccagaagcccgcccttatcccgcaaccaacgtttacagagaaagtagcccacgaacacaaggaaaagaaatacgaaatggacttcggaatctggaaaggccacctggacgcgctaactgctgatgtcaaagaaaagatgtataacgtactcttatttgttgacggaggatggatggtggacgtgcgagaagacgccaaggaagatcacgagcgcacacaccagatggttctgctgaggaaactttgccttcccatgttatgctttttgttacacactatcctgcactccactggccagtaccaagaatgcttgcagttggctgatatggtctctagcgaacggcacaagctctatctggtcttctctaaagaggaactgcgaaaactcctgcagaagctcagggaatctagtttgatgttgctggatcagggtcttgaccccctgggctacgagatccagttgtag

SEQ ID NO: 127105 - DNA, 3471 bp, Artificial Sequence
  Description of Artificial Sequence: Synthetic coding sequence
atgttccctgctgcgccctctccaagaacccccggcacaggtagccgaaggggcccgttggcgggactcggaccaggcagcactcctcgtaccgccagtcggaagggtctccccctcggaagtgcggtgtcctcacctgttttgttttccccagtgggaaggcgcagcagtctctctagtagaggcactcccactcggatgttcccccatcactcaattacagagagcgttaactatgatgttaagaccttcgggagctcgctccctgtcaaggtgatggaggcactcacgctcgccgaggtggatgaccagttgacaattaatatcgacgaggggggctgggcttgcctagtctgtaaggaaaaactcataatttggaaaatagccctgtcaccaatcacaaaactttccgtatgcaaggagctacagctgcctccctcagattttcactggtctgccgatctggtggccctgtcatattctagcccaagcggggaagcccattctacccaagcggtcgccgtcatggtagcaactcgcgagggaagcatccgatactggccctctctggcaggtgaagacacgtatactgaagctttcgtggactccgggggggataaaacttactcgtttctgaccgccgttcaaggtggttcctttatcctcagctctagcggtagccagctgatacgtttgatcccagagagttctgggaaaatccatcagcatattttacctcagggacaaggcatgctctctgggattgggaggaaagtgtcatctttatttggaatactgtccccatcatccgacctgaccctgagcagtgtgctgtgggaccgggaaaggagtagcttttacagtctcacctctagcaatatctccaagtgggaacttgatgattcgagcgagaaacatgcttatagctgggatatcaatagagccttgaaggaaaatattacagatgccatctgggggtctgagtctaattatgaagctatcaaagaaggtgtgaatatccggtatctcgacttgaaacagaattgtgatgggctggtgatcctcgccgccgcttggcactccgccgataatccatgtttgatttactattctctgatcacaatcgaggataacgggtgtcagatgtccgatgctgttaccgtagaggttacccagtataatccaccttttcagagcgaagatctgattctctgccagctgacagttccaaatttctcaaaccagaccgcctacctgtacaatgagagcgctgtttacgtgtgttccactggaacaggtaaattttcgctgccccaggagaaaatcgtctttaacgctcaaggagattcagtgctgggcgctggagcttgcggaggagtgcctataatttttagccgcaacagtggcctcgtcagcattacctccagagaaaatgtgagcattctggccgaggatctcgaagggtctctggcctctagcgtggccggccccaactctgagtctatgattttcgagactaccactaagaacgaaacaatagcgcaggaggacaaaattaagctgcttaaggccgcattcctccaatattgccggaaggatctgggacatgcgcagatggtggttgacgagttgttctcaagccattcggacctggactctgacagtgagctggatcgagctgtgacccagatttctgtggacctgatggacgactaccccgcgagcgaccccaggtgggctgagagtgtccccgaggaggctcccggattctctaatacctctcttataatactacatcagttagaagataagatgaaagctcatagcttcctgatggatttcatacatcaagttgggctgtttggccggctagggtccttccctgtgcggggcaccccaatggctacacgcctgctcctgtgcgaacatgcagaaaagctgtcggccgccatagtgctgaaaaatcatcactcacggttgtcagacctcgtcaacacagcaattctcattgccctgaataaacgggaatacgagattccttcaaatctgacaccggccgatgtattttttcgcgaagtgagccaggttgacacaatctgtgaatgtctgctcgagcacgaggaacaagtgctgagggatgcgcctatggatagcattgaatgggcagaggtagttatcaacgtcaacaacatattgaaggacatgctacaggcagccagccactatcgtcagaaccggaattcactgtatcggcgcgaggaatcactggaaaaggagccagagtatgtgccctggacagcaacctcgggccccgggggtatccgcaccgtgattataagacagcatgaaattgtccttaaggtggcctacccacaggccgactcgaacctgcgaaacatcgtgacagagcagcttgtcgccctaattgattgctttctggacggatatgtgagccagctgaagagcgtggacaagagctccaatagagaaagatatgataatctagagatggagtacctgcaaaagaggtcggatttgctgtcaccattattgtccttaggccaatatttatgggccgccagtctggctgagaagtactgcgatttcgacatcttggttcaaatgtgtgagcaaactgataaccagtcacggctgcagcgctacatgacccaattcgccgatcagaatttcagtgattttctgttccgatggtaccttgagaagggaaagcgcggcaagctgctctcccagcccatcagtcaacatggacagcttgcgaatttcctgcaggcccacgaacaccttagctggttgcatgagataaattcccaggaactggagaaggcacacgccacactactcgggctggcgaacatggaaacacgttacttcgccaaaaaaaaaacgctcctcggtctttccaagcttgctgccctggcctcagacttcagcgaagatatgctacaggaaaagatcgaggagatggctgagcaggagcgctttcttcttcaccaggagactttgccggagcagttgcttgccgaaaaacagctcaatctcagtgccatgcccgtgttgaccgcgccgcagcttatcgggctatacatctgtgaggagaacagaagggccaacgagtatgacttcaagaaagccttggacctcctagagtatatcgacgaagaagaagatattaatatcaatgatttgaaattggaaatcctatgtaaggcgttgcaaagagacaattggtcatcctcggatggtaaggacgaccccattgaagtgagcaaggattcaatcttcgttaagatcttgcaaaagttacttaaggacggaatccagctgagcgaatacttgccggaggtaaaagatctgctgcaggccgatcagttggggtcactcaagagtaatccctacttcgaattcgtgctgaaggctaattacgagtattacgttcaggggcagatttag

SEQ ID NO: 127106 - DNA, 675 bp, Artificial Sequence
  Description of Artificial Sequence: Synthetic coding sequence
atgttcccagcagccccatcgccgaggacccctggcaccgggtctaggcgcgggcccctagccggactggggccaggtagcacaccgcgcaccgcaagccgcaagggccttcctttgggatccgccgtaagtagtcccgttctttttagccccgtgggaaggcgaagcagcctgagcagccggggaacgccgacccggatgtttcctcatcacagcattacagaatctgtgaattacgacgtgaaaacctttggcagtagcctgccagttaaggtaatggaagcgctgacgctcgctgaggtagacgaccagctcaccattaacattgacgaggggggatgggcctgtctggtgtgtaaggaaaaactgatcatttggaagatagccctgagccctataacaaagctcagcgtatgcaaagagctgcagctccccccctccgatttccattggtctgcggacctggtcgcattgagctattcgtcaccctcaggggaagcacacagcacacaggccgtggctgtgatggtcgctacacgcgaaggcagcatcagatattggccctctctggccggggaagatacgtacacagaagcattcgtcgattctgggggagacaaaacctactcatttctgactgctgtacaagtgcacaaggaaacaaaatcaggctag

SEQ ID NO: 127107 - DNA, 3207 bp, Artificial Sequence
  Description of Artificial Sequence: Synthetic coding sequence
atgtttcccgccgcgccaagcccacgcacgccaggtacagggtctcgtcgaggaccactagcgggactgggacctggctccactcccaggacggccagcagaaagggactcccgctgggatcagcagtgtctagtccagtgctattctcaccagtgggacgcaggagcagccttagtagcagagggacgcctacgcgcatgtttcctcatcactctatcacagagtctgtgaactacgacgtcaagacgtttggatcaagcttacccgtgaaggttatggaggccctgacactggctgaggtggacgatcaactcacaataaacattgatgaggggggctgggcttgcctggtatgcaaagagaagctgatcatttggaaaatcgccctgagccccatcactaaactgtcagtttgtaaggaacttcaattgcctccctccgactttcactggagtgccgatcttgtggctttatcatattcttctccttctggcgaagcccactcaacacaggctgtcgccgtcatggttgccacccgggagggatcaattaggtattggccaagccttgccggcgaggatacgtacaccgaagctttcgtggacagtgggggcgataagacctattcctttttaaccgcagttcagggtggctcctttattctatccagtagcggttcacagttgattaggctaattccggagagctccgggaaaatccatcagcacatactgccacaaggccaggggatgctgagcggaattggtcgtaaagtgtcatcactgtttgggatattgagcccgagttccgaccttacactaagctctgtgctatgggatcgcgaacggtcaagcttctactctctcaccagctccaacatcagtaagtgggagttggacgacagtagcgagaagcatgcctactcttgggatatcaatcgggctttgaaagagaatatcaccgacgccatctggggcagcgaaagcaattacgaggccattaaggagggcgtcaacattagatatttagatctcaagcagaactgtgacggcctcgtcatccttgctgcggcctggcattccgcggataacccatgcctgatttactattcactcatcactatcgaagacaatgggtgtcaaatgagtgacgctgtgacggtggaggtcacacagtacaatcccccgttccagtccgaggatctgattctttgtcagctcactgtccccaactttagtaaccagactgcctacctttacaacgagtcagccgtttatgtatgcagcactggcacgggaaaatttagtttgccgcaagaaaagatagtattcaatgctcagggggactcagtcctgggtgctggtgcgtgtggcggcgtaccaataatcttttctcgaaatagcggcctcgtgagtatcacatcccgggagaacgtgagcatcctcgccgaggacctggaaggatcacttgcctcttccgtggcaggacctaactcggagtctatgatctttgagacaacaacaaagaacgagacgatcgcacaagaagacaagattaagttgttgaaagcagctttcctccaatattgtcgtaaggatcttggccacgcacagatggtggttgatgaactattcagctctcattccgacctggatagcgactcggaactagatcgagctgtcactcagatctctgtagacctaatggatgactaccctgcctccgaccccaggtgggctgagtccgttcctgaggaggcgcctggcttttcaaataccagcctcattatactgcatcagctggaagacaagatgaaagcacactcattcctaatggatttcattcaccaggtggggctgtttggaaggcttgggtcatttccggtgcgcggcaccccaatggctactagactcctcctgtgtgagcatgcagagaagctatctgccgccattgtactgaaaaaccaccactctcggcttagtgatttagtaaacaccgcgatactcattgcactaaacaagagagaatacgaaattccatccaacctcacacccgcggatgttttttttcgagaggtgtcccaagtggacaccatttgtgaatgcctgttagaacacgaggagcaggtgctgcgggacgctccaatggattctatcgagtgggcagaagtggtcatcaatgtgaacaacatccttaaggatatgctgcaggccgcctcccattatagacaaaatcgcaattcattatacaggcgcgaggagagtttagagaaagagcctgaatatgtcccctggacagcgaccagtggacctgggggaatccgcactgttattatccggcagcatgagattgtattgaaagtggcctatcctcaagcagattcaaacctgagaaacattgtgacggagcagctcgtggctctaatcgactgctttttggatggatatgtgtcccagttaaaatctgtggacaaaagctctaatcgcgaaagatacgataacctagagaaagggaagagggggaagcttttatctcagccgattagccagcacggccagttggccaattttctgcaggcacacgagcatttgagctggttacatgagatcaatagtcaagagctcgaaaaggcacacgccactctactgggcctagcaaatatggaaacaaggtacttcgccaaaaagaagacgctcctgggcctgagtaagctggccgccctggcctctgatttctcagaggatatgctgcaagaaaagattgaagagatggcggagcaggagcgcttccttctgcatcaggagacccttcccgagcagctcctcgctgaaaagcagttaaatctaagtgcaatgcctgtattgactgccccccaattgatcggcttatacatctgcgaggagaatagaagggcaaatgaatacgactttaaaaaagccctcgacctgcttgagtacatcgacgaggaggaagacatcaatattaatgatctgaagcttgagatcctgtgcaaggcccttcaaagagacaactggagtagtagtgatggcaaagatgatcctattgaagtgagtaaggattctatatttgtaaaaatcttgcagaagcttctgaaggacgggattcagttgtccgagtacctccccgaagtgaaggacttgctgcaggcagatcagctcggcagtatcaatgtgaatttctgttag

SEQ ID NO: 127108 - DNA, 3258 bp, Artificial Sequence
  Description of Artificial Sequence: Synthetic coding sequence
atgttccccgcggcaccgagtccgagaaccccagggactgggtccaggcgcgggcccctggccggcctggggcctggttccacacctcgcaccgccagcaggaaaggcctaccgctgggtagtgcagtgtctagtccggtacttttttctcccgtgggccgtcgctcttctctaagttcacggggaaccccaacaagaatgttccctcaccactccataacagagtctgttaattatgatgtaaaaacatttggctcttcacttccggtgaaggttatggaagctctaacgctggcagaagtggatgatcagctgacaatcaatatcgatgagggcgggtgggcatgcctagtctgtaaagagaagcttatcatctggaagatagctctctctcccatcaccaaattatcagtgtgtaaagaattacaactacctcccagtgactttcactggagcgcggatctcgtggccctatcatactctagcccgagtggtgaggctcactcgactcaggcggtcgcagtgatggttgctacaagggagggctctatacgatactggccctcactggccggcgaggatacatacactgaagctttcgtggacagcggcggggataagacctactctttccttaccgctgtgcaaggaggatccttcatcttgtcaagcagtggcagccagttgatcaggttgatcccagagtcgtcagggaagattcaccagcatatactgccacaggggcagggaatgcttagcgggatcggacgcaaggtttcatctctgtttggcatactgagccccagtagcgatctgaccttgagctctgtgttatgggaccgggagcgtagcagtttttactcgcttacatccagcaatatttcgaagtgggagctggacgactcatcagaaaagcatgcctactcctgggatatcaacagagcgctcaaggaaaatatcaccgacgccatatggggctctgagagcaattacgaggctatcaaggagggagtgaacatccgttacctagaccttaagcagaattgcgatggtctggttatcctggcagcagcttggcattctgctgataatccttgccttatctactatagcttaattaccattgaggacaacggctgccaaatgtccgacgccgtgactgtggaagtgacccagtataaccccccctttcagtctgaggatctgatcctgtgccaactcacggtgccaaatttctcgaaccaaacagcgtatctttataacgagagcgccgtttacgtgtgctccaccggcactggtaaattctctctaccccaggagaagatcgtgtttaatgcccagggggactccgtactaggcgctggtgcctgcgggggggtgcccattatctttagtcggaactcagggcttgtgtctattacctcccgggaaaatgtttccattctggcggaggatttagagggttccctggcgagttctgtggcgggcccaaacagtgagagtatgatcttcgagaccacgacaaagaacgaaaccattgcacaggaagacaagatcaaattgttaaaagcggccttcctgcagtactgccgtaaggacctaggacacgctcaaatggtggtcgacgagctcttttcctctcactccgatctcgatagtgactctgagctagaccgcgctgtgacacagatctctgtggatctgatggatgattaccccgcatctgaccctcgttgggctgagagtgtgcccgaggaggcacccggcttcagtaatacctctctcataatcctgcatcagcttgaggataaaatgaaggcccacagctttttaatggattttattcatcaagtgggactgttcggccgccttggtagctttcccgtgcggggcaccccaatggcgaccaggctgctcctttgcgaacatgccgaaaaattatctgctgcgattgtcctgaaaaatcatcactcccggctgtcggacctggttaacacagccatactgattgcgctgaacaagagggagtatgagattccttccaatctgactcctgcagatgtgttcttcagagaggtgagtcaagtcgataccatctgtgaatgccttctcgagcatgaggagcaggtccttagagacgcaccgatggactcaatagagtgggccgaagtagtcatcaacgtgaacaacatcctgaaggacatgttgcaggcggcctcccactatagacagaatagaaactctctctatagacgggaggagtccctcgaaaaagagccagaatacgttccgtggacagcaactagtggacccggcgggataaggaccgtgataatcaggcaacacgaaatcgtgctgaaagttgcgtatcctcaggcagatagcaacttacggaatatagtcacagagcagctcgtggccctcattgattgtttcctcgacggctatgtgagccaactcaagtcagtggacaagtctagcaatcgcgagagatatgataatcttgaaaagggaaagcgaggcaaactactctcacaaccaatttcccagcatggacagctggctaattttctccaggcccacgagcatctgagttggctgcacgaaatcaatagccaggagctcgaaaaggctcatgccacattgctgggcttggcgaacatggaaacccgctactttgccaagaaaaaaacgctcctaggcttaagtaagctggccgctcttgcatccgactttagtgaagatatgctccaggagaaaatcgaagagatggcggagcaggaaaggtttctgctgcaccaagagacactgcccgagcaacttttagctgagaaacagctgaatttaagtgcgatgccagttctcactgccccacaactgattggtttatatatctgcgaagaaaacagacgagctaatgagtacgatttcaagaaggccctggatctgctggaatacatcgacgaagaggaggatataaacataaatgatctaaaactcgaaattctttgtaaggccctacagcgcgacaactggtcttcatctgatggcaaggatgatcccattgaggtatcaaaagattccattttcgttaagattctccagaagctgttaaaagacggtatccaactgagtgagtacctgcccgaggtcaaggatctacttcaagcagatcagctgggcagtctgaagagtaatccatatttcgagttcgtgctgaaggctaattacgaatattatgttcaaggccaaatttag

SEQ ID NO: 127109 - DNA, 3423 bp, Artificial Sequence
  Description of Artificial Sequence: Synthetic coding sequence
atgggaccactggcaggtctggggccaggttccacacccagaaccgcgtctcgaaaggggctaccactggggtcagcagtgagttcccctgtgctgttctcccctgttgggcggagatcatcgctgagcagcaggggaactccaacacgaatgtttccccatcatagcataaccgagagtgttaactatgatgttaaaacattcgggagctctttaccagtcaaagtcatggaggccttgacgctggctgaggtggatgaccagctgaccatcaacattgacgagggcggatgggcttgcttagtttgcaaggaaaagttgattatctggaagattgctctctctcccattaccaaactcagcgtttgcaaggaacttcagctccctccatctgactttcactggtccgccgatcttgtggccctatcatactcctcacctagtggggaggcgcatagcacgcaagccgtagccgtgatggtggccacccgggaaggctcgattagatattggccctccttagctggagaagacacctacacggaggccttcgtggattctggtggtgataagacatattcatttttaacagccgtacagggaggcagctttattctcagcagctcaggttctcagctcatccggttgattcccgaatcctcaggcaagatacaccagcacatactcccacaaggccagggcatgctgtctggaatcgggcgcaaggtgtctagcctcttcgggatactctcgcctagttccgacctaaccctgagctccgtgctttgggaccgcgagcggagttctttctacagtctgacaagctccaacatcagcaaatgggaactagacgattctagcgaaaagcacgcttacagttgggatatcaacagagccctgaaggagaatataactgacgctatctgggggtccgagagcaactacgaggcaattaaagagggtgttaatattcgctatctggacctgaaacagaattgtgacggactcgtgatcttggctgctgcctggcacagtgctgataatccatgcctcatctactactccctcatcaccatcgaagacaacggatgtcaaatgagcgacgcagtgacagtcgaggttacccagtataatcctccatttcagtctgaggatctcattctctgccagctaacagtaccgaactttagcaatcagacagcttatttgtacaacgagagtgctgtgtacgtctgctctacaggaactggcaagtttagtctcccacaggaaaagatcgtgtttaatgcccagggcgacagtgttctcggcgccggcgcctgtgggggagttcccattatattcagtcgtaattctggattagtgagcatcacatccagagaaaacgtgtcaatcctagctgaggatctggagggctcactcgcctccagtgtagccgggcccaactccgaatctatgattttcgaaactactaccaagaacgagacaatcgcccaagaggacaaaataaaactgctcaaggccgcatttctccagtattgtaggaaggatctcgggcacgcccaaatggtagtggatgaactgttcagttctcacagcgaccttgactctgatagcgagttggaccgcgcggtgactcagattagcgttgatctcatggatgactatccagcatctgacccaaggtgggccgagtcggtgcctgaggaggcgcccggctttagtaatacttccttaatcatcttacaccagctcgaggataaaatgaaggcacattccttccttatggacttcatacaccaagtcggactgtttggtcgcctaggtagttttccggtacggggcactcccatggcgacccgattgctcctgtgtgagcatgcagagaagctgtctgcagcaatcgtgctcaagaaccatcactctcgactgagtgatttagtgaataccgcgatactaatcgcccttaataaaagagaatatgaaatccctagtaatctgacccctgctgacgtgttcttcagggaggtgtctcaggtcgacacaatctgtgaatgcctcctcgaacacgaggaacaggttctgcgcgacgcacctatggactctattgagtgggccgaggtggttatcaacgtaaacaatattctgaaggacatgctgcaagctgcctcccattaccgacagaatcgcaactccctgtacagacgtgaagagagtctggagaaagaacccgaatatgtgccttggacggctacttctggccccggggggattcgcacagtgattattcgacagcacgagatagtgctcaaagttgcctacccgcaagctgactccaatcttcgtaacatcgtgacggaacagttagtagccctgatcgattgctttcttgacgggtacgtgtctcagctgaaaagcgtcgacaaatcatccaatcgggaacgctacgataatttggagatggaatatctgcagaaaagaagcgatctactttcacctctgctgagtctaggacagtatctgtgggccgcttctctggctgaaaaatactgcgactttgacatcctggtccaaatgtgcgagcagaccgacaaccagtcaaggttgcaaaggtacatgacccaatttgctgaccagaatttctccgactttctgtttcggtggtacctcgagaagggtaaacgagggaagctgctcagccagccaatttcccaacacggccaactggctaatttcctgcaagcgcacgagcatctatcttggttgcatgagattaactctcaagaattggagaaggcacacgcaaccctgttagggttggcaaatatggagacaaggtactttgctaaaaaaaagaccctgttgggccttagcaagctcgctgcactggccagtgacttctccgaggatatgctacaggagaaaattgaagaaatggccgaacaggagcgcttcctgcttcaccaggagacactgcccgagcaactattggccgaaaagcaactgaacttgagcgctatgcccgtgctaaccgcacctcagcttatcggcctttacatttgcgaagagaaccggcgagccaacgaatacgacttcaaaaaggctctagacctcctcgagtatatcgacgaggaagaggacatcaatataaatgatctcaagctggagattttgtgcaaggcgctccagcgtgacaactggtctagtagcgacggaaaggatgacccaatagaggtgtctaaagatagcatttttgttaagattttgcaaaagcttctgaaagatggcatccagctgtcagaataccttccagaagttaaggacctcctgcaggcggaccagctggggagtttaaaaagcaacccatactttgaatttgtactcaaagcaaattatgagtattacgtccagggtcagatttag

SEQ ID NO: 127110 - DNA, 4428 bp, Artificial Sequence
  Description of Artificial Sequence: Synthetic coding sequence
atggctagtggggcaggaggggtcggaggtgggggaggcggcaaaattagaaccagacggtgccaccagggcccgatcaagccatatcaacagggaagacagcagcaccaaggaattctgagtagggtgaccgagagcgtgaagaatatcgtcccagggtggttgcaacgttattttaataaaaatgaggacgtttgtagttgcagtacagataccagcgaggtaccaaggtggcctgagaacaaagaagatcatctagtatatgccgacgaggagagctcaaatattaccgatggccgtataacaccagaaccagctgtttctaacacagaagagccttctacaaccagtaccgcatccaattatcccgatgtcctcactcgccccagtttgcatagaagccacctgaattttagcatgttagagagccctgcccttcactgtcagccctccaccagtagcgcgttccccattggcagctctgggtttagcttggtgaaagagatcaaggactctaccagccagcatgacgatgacaatatatcaaccaccagcgggttttcaagtagggctagcgacaaggatataactgttagtaagaatacctcactgcctcccctgtggagcccggaggcagagcggtctcattcactctcccaacacaccgctacatcaagcaagaaacctgccttcaatctgagcgccttcggtaccttgagcccctctctgggaaactcctccatactgaaaacctcacaactaggtgatagtcctttttatcctggaaagacaacctatggcggcgccgctgctgccgtcagacagtccaaactgcgcaacacaccatatcaggccccagtgagacgccagatgaaggccaagcagctctcggcgcagtcttacggagtgacatcctctaccgctcggcgcattctccagagtcttgagaagatgtcctcacctttggccgatgccaagagaatcccatcaatcgtcagtagcccattaaatagcccccttgacaggagcgggatagatataaccgattttcaggctaagcgggagaaggtggacagccaatatccccctgtccaacggttgatgactcccaaaccagtgagtatcgccactaaccggtccgtctatttcaagccaagcctgactccaagcggagaatttagaaagacaaatcagcggatcgacaacaagtgttctactggctacgaaaagaatatgaccccggggcagaatagagaacagcgcgaaagtggcttctcttacccgaacttctcacttccggctgcaaacggcctgtcttccggagtaggggggggcggcgggaagatgagacgtgaaaggacccgattcgtcgctagcaagccccttgaagaggaagaaatggaggttccggtgctgcccaaaattagcctgccaataacatccagctctctgccgacattcaattttagctcacctgaaatcactacttctagtccctcacccataaacagcagccaggccctgacgaataaagtgcaaatgaccagcccctcatctaccgggagcccaatgttcaagttttcttctcctattgtgaagagtactgaagccaatgttttgcccccatcttcaattggattcacattcagtgtacccgtcgcaaaaaccgcagaactatccgggtcatcttccactcttgaaccaatcatttcctctagcgctcatcacgtaacaacggtaaatagtactaattgtaaaaaaaccccacccgaagactgtgagggcccctttaggcctgctgaaattttgaaagaaggctccgtattggatattctgaagagtccgggtttcgcatctcctaaaatcgacagcgtggctgctcagcccaccgctaccagcccggtcgtgtacacgaggccagccattagttcattttcgtcctccggtattggcttcggcgagtcactgaaagcgggctcttcctggcagtgtgacacctgcctcctgcagaataaagtcacggacaataagtgcatagcctgtcaggctgccaaactatccccccgagacaccgctaagcagacagggatcgaaacgcccaacaagagcggcaaaaccacattgtccgcatcaggaacaggattcggggataagtttaaaccggtcattggcacgtgggattgtgatacatgtttggtgcaaaataaaccagaagcaatcaagtgtgtagcttgtgagacgccgaaaccaggtacgtgtgttaagcgcgccctgacgttgactgtcgtatctgagagcgctgagaccatgaccgcaagttccagctcatgcaccgtcactaccgggacactcggttttggtgataaattcaaacgccccatcggctcctgggagtgttccgtgtgctgtgtgagtaacaacgctgaggataacaagtgcgtctcttgtatgtctgagaagcctggcagttctgtgcctgcaagtagtagtagtactgtgcccgtgtcattaccatctggggggtccctcgggctcgaaaaattcaagaaaccagagggaagctgggactgtgaattgtgccttgtacagaataaagctgacagcaccaagtgccttgcctgtgagagtgccaagccgggaactaaaagtggatttaaagggttcgataccagtagctcttcctctaattcagctgcaagctcatcatttaagtttggggtcagttcctccagcagtggccctagtcagacactcacaagcactgggaattttaaattcggggatcagggaggcttcaagatcggtgtatcgtcagacagcgggagtataaaccccatgtcagaaggcttcaagtttagcaaacctattggggacttcaagtttggggtgtcctcagagagcaaacctgaggaagtgaagaaggactcgaaaaacgacaattttaagtttggcctgtcctctggactatcaaatcccgtgagtctgacgcccttccagtttggtgtgtctaacctgggccaagaggaaaaaaaggaagaactgcccaaatcctcaagtgcggggttcagcttcgggacaggcgttattaactctactcccgcccccgctaacactatagtgacaagcgaaaacaagagtagcttcaatttgggaactatcgaaactaaatctgccagtgtggcccctttcacatgcaaaacaagtgaggccaaaaaggaagaaatgccagccaccaaaggagggttttcattcggcaatgtggaaccagcgtccctgccctcagccagcgtcttcgttttgggaagaacagaagagaagcaacaggagcccgtgacatctacctccctagttttcgggaaaaaggccgacaacgaagaacccaagtgccaacccgtgtttagctttggtaactcggagcagacgaaagacgaaaattcctcaaaaagtaccttctcttttagcatgactaagccgtccgaaaaagagtccgaacagccagctaaagctacattcgccttcggagcccaaacttcaaccaccgctgaccagggtgccgcgaagccagtcttttcctttctgaataattcttcaagtagcagcagcacacccgccaccagcgcgggaggaggcattttcggcagctccacaagctcttcaaacccacctgttgccaccttcgtcttcggccagagctctaatcccgtgtcttctagcgccttcgggaacacagcggagagcagtacctctcagtctttgttgttcagtcaggacagcaagttggcaacgacttccagcacaggaacagccgtgactccctttgtcttcggccccggtgcctcctccaataatactactaccagcggcttcggcttcggcgccacgacaacaagcagctccgccgggtctagttttgtgttcggcactggcccatcagcacccagcgcctcccccgccttcggggccaatcagacgcccacctttggacagtcacagggcgcatctcagcctaatccacccggtttcggtagcatttctagttcaacagctctatttcccacaggctcacagccagctccccctacctttggcactgttagcagttctagccaaccacctgtgtttggacagcagccaagccagtcagccttcggcagtggcactacaccaaattcctcatctgccttccagttcgggtcctccacaactaatttcaatttcactaataactcgcctagcggcgtgttcacttttggtgcaaattcttctacccctgcggcttcggcccaaccttctggctcaggtgggttcccatttaatcagtcaccggccgccttcactgtcggctctaacgggaaaaacgtattttcatcctccggtacatcgttctctggacggaaaatcaaaactgccgtccgaagacgtaaatag

SEQ ID NO: 127111 - DNA, 4368 bp, Artificial Sequence
  Description of Artificial Sequence: Synthetic coding sequence
ggtctcaggttgtgcttgtctcgccccctgactagacctggtgccggctctgggggtgggtccgctatggccagtggcgccgggggggtggggggaggtggaggaggtaagattcgtacaaggaggtgccatcagggacccatcaagccgtatcaacagggccgtcaacagcaccaggggatcctctcccgggtaaccgagagcgtgaagaatattgtacccggctggctgcagagatatttcaacaaaaatgaagacgtctgttcatgttccaccgacacatccgaggtgccccggtggcctgagaacaaggaagatcacttagtctatgccgatgaggagtcaagcaacattacagatggaaggattactcccgagccagccgtcagtaataccgaggaaccaagcaccacaagtacagcatcaaattacccagacgtgctgacccgaccaagcctgcatagatcccaccttaacttcagcatgctcgaatcgcctgcgttgcactgtcagccctcaacatcgtcagccttccctataggaagctccggcttcagcctcgtcaaagagattaaggacagcacctcccagcacgacgatgacaacatctcaaccactagcggcttctcctcgagggccagtgacaaggacatcactgtttccaaaaatacctcacttccccctttatggagtccagaagctgaacgttctcacagtctgagccagcataccgccacttcatcgaagaagcctgcatttaacttgagcgcgttcggcacgctctcccctagcctcggtaacagctccatcctgaaaaccagtcagctgggcgattcacccttctaccccggcaagacaacctacggtggtgcagccgccgcggttagacagagcaagcttaggaatacaccttaccaggctccagtgagaagacagatgaaagcaaaacaattgagtgcacagagttatggagtcacaagcagtactgctcgaagaatcctccagtctttagaaaagatgtcttcgccactggccgatgcaaaacgcatcccatccatcgtgagttcacccctgaacagcccacttgacagaagtggtattgatatcaccgatttccaggccaagagagaaaaggtcgactcccagtatcctccagtccaaaggctcatgacccctaagcccgtgtccatcgccacaaataggtcagtgtatttcaagccgtcactaaccccgagcggggagtttagaaagactaatcaacgtatcgacaataaatgttctaccggttacgagaagaacatgaccccaggccagaatcgggagcagcgggaaagcgggttcagttatcccaatttttcccttcctgctgctaacggattaagcagtggggtgggtggaggcggcgggaagatgaggagagagagaactcgtttcgttgcatccaaacccttggaggaggaggagatggaggtaccagttctgcctaagatctcacttcccattacgtcttctagcctgcctaccttcaatttctcatccccagagattaccactagctcgccatcaccaattaattcaagtcaggctcttacaaacaaggtgcaaatgacaagccccagctctaccggatctcctatgttcaagttcagttcgcccattgtgaagtcgaccgaagccaatgtcctgccccccagcagtattggttttacattcagtgtacctgtggcgaagaccgcagagctctctggatctagcagcaccctggagccaatcataagttcatctggctttgccagcccaaaaattgactcagtggccgcgcagccaactgccactagcccagtcgtttatacaaggcccgcaatatcttctttcagttcttctgggattggttttggggagagccttaaggccgggtcctcctggcagtgtgatacctgtcttctgcagaacaaagtgactgataacaagtgtattgcatgtcaggccgctaagctgtcaccaagggataccgcaaaacagacgggaattgagacccctaacaagtctgggaagacaacccttagtgcaagcgggacaggcttcggagacaaattcaagccagtgataggaacctgggattgtgatacttgtctggtccaaaataagcctgaggctatcaaatgcgtggcatgcgaaactccgaagcctggtacatgtgtcaaaagggccttgaccctaacagtagtaagcgaaagcgcagagacaatgacagcatcttcgtcttcatgtacggtgactacaggcacgcttggattcggagataagtttaagcgccccatcggctcctgggaatgctcagtttgttgtgttagcaacaacgctgaagataataaatgtgtttcctgcatgtcagagaagcccggctcaagtgtcccagcttcatcttcctccactgtcccagtatctctgccctcaggtggctccctaggacttgaaaagtttaaaaagcccgaagggtcctgggactgtgagctgtgcctggttcagaacaaggccgacagcacaaagtgccttgcgtgcgagtccgcgaagccagggactaaatccggcttcaaaggtttcgatactagctcatccagtagcaacagcgccgcatcaagctcctttaaatttggcgtgtcaagtagctccagtgggccctcccagactctaacatctaccggaaacttcaaattcggagatcaggggggttttaaaattggagtttcgtcagacagtggatctatcaatcctatgtccgagggcttcaagtttagcaagcctattggtgatttcaaattcggcgtgagtagcgaatcaaagcccgaggaggtgaagaaggactccaagaatgataattttaagtttggtttaagttctggcctgtctaaccctgtctccctgacgccctttcagttcggagtctcaaacctcgggcaggaggagaaaaaagaagagctgcccaagagttcctcagccggattctccttcggtactggagtgatcaattccacacctgccccggccaatacaatcgtcacgtccgagaacaaatcttcgtttaatctgggcacaattgaaactaaatccgcttcagtggcccccttcacctgtaagaccagtgaagccaagaaagaggagatgcctgccacgaagggaggattttccttcgggaacgttgagcctgctagcctgcctagcgccagcgtcttcgtcctcggcaggacagaggagaaacagcaggagcctgtgacgtccacatccctggtgttcggcaagaaagctgataacgaggagccaaagtgtcagcctgtgttttcgttcggaaacagcgaacagacgaaggacgaaaattcgagcaagagcacatttagcttcagtatgactaagccatcagagaaggagtctgagcagcctgccaaagccacattcgcctttggcgctcagacttcaacaaccgcagaccagggggccgccaagcctgtcttttcctttctgaacaattctagctctagctcctcaacccctgcaacctctgctggtggcggcattttcggttcttctacaagctcttcaaaccctcccgtggccaccttcgtgttcgggcagtcatccaaccctgtcagttcgtcagcatttggtaatactgccgagagctctaccagtcagagcctcctattttctcaggattccaaactggccaccacatctagtaccgggaccgctgtcactcctttcgtgtttggacccggcgcttctagcaataacaccaccacctccggatttgggttcggagctaccacaacctcttcttccgccggaagctcttttgttttcgggacaggccccagcgcaccctcagcatccccggcctttggggcaaaccaaactccgacattcggccaatcccagggcgctagccagcccaatccacccggcttcggctctatcagctcttctaccgccctgttccccactgggagtcagccagcaccacctacctttggaactgtctcttccagctcacaaccacccgtgtttgggcagcagccctcacagtcggccttcggctcaggcaccaccccgaattcttcgtccgcctttcagttcggatccagtactactaacttcaacttcactaacaacagcccctccggcgtgttcacattcggagcaaacagctccacgcccgccgccagcgcccaaccatcaggcagtggcggcttccccttcaatcagtctcccgcagccttcacggtaggttctaacggcaagaatgtgttttctagttcagggacctcgttctccggccgtaaaattaagactgccgtgaggaggcgcaaatag

SEQ ID NO: 127112 - DNA, 4521 bp, Artificial Sequence
  Description of Artificial Sequence: Synthetic coding sequence
atggcctcaggcgccgggggcgtcgggggcgggggcgggggaaaaatcaggaccagaagatgccatcagggtccaatcaagccgtatcaacagggaagacaacagcaccaagggattctgtctagagtgactgagagtgtgaagaacatagtgcccggatggctacagaggtactttaacaagaatgaagatgtctgtagttgtagtaccgatacttctgaggttcctcggtggcctgagaataaggaagatcatctggtgtacgcggacgaagagtctagtaatatcaccgacggcaggattacccccgagcctgcagtgagtaacactgaagaaccgtctactacctcgacagctagcaactatccagacgtcctgacacgtccctcacttcaccgatcccatctcaacttttccatgctagaatcccccgccttgcattgccaacccagtaccagtagtgcctttccaataggcagtagcggctttagtctggtcaaagaaataaaggacagcaccagccagcacgacgacgataatattagcacaacaagcgggttctccagtagagccagcgataaggacattactgttagcaagaacactagcctacctccgctttggtccccagaagctgagagatcacactccctgtctcaacataccgccacctcttccaaaaaacccgcctttaacctctccgccttcggcacattaagtcccagccttgggaactctagcatcctgaagacttctcagctcggggactcccctttctatcctggcaagacgacctacgggggggccgcggccgcggtgcgacagagtaagctaagaaacaccccttaccaagcccccgttcggagacagatgaaagccaagcagctttccgcccaaagctatggcgtcacaagcagtaccgctagacggatactccagagcctcgagaagatgagttctccactggccgatgccaagagaatcccgtctattgtcagtagtcctctcaactcccctctggaccgttcgggaatcgatattactgattttcaagccaagcgcgagaaggttgatagccagtatcccccggttcaacgcctgatgacccctaaaccggtcagcatcgcaactaaccggtccgtctatttcaagccctcactgaccccgtctggcgagtttcggaagacgaatcaaaggatagacaacaaatgtagtaccggttacgaaaaaaatatgaccccaggccagaatagagaacaaagggagtcggggttttcctaccccaactttagcctaccagctgcaaatgggctcagctccggagtggggggcggcggtggaaagatgcggagagagagaacaaggtttgtcgcttcaaagcccttagaggaggaacgtcagggcttgacagtgctccccaagctgattagcagctcctgcgcgcaggctattattccatcgtggcccctgaaggttctgcgcctccaggaaatggaggtgcccgtcctccccaagatctcactacctatcacgagctctagcctgccaacgtttaatttttcttctcccgagattactactagcagcccttcccccatcaattcctcccaggctctgactaacaaggtacagatgacctctccttcctctacagggtccccgatgttcaaattctctagtccgatcgttaaatccactgaggctaacgtgttgccaccaagcagtattggtttcaccttttccgtaccagtggcaaaaacagctgagctgagtggttcatcaagcaccctcgaacccattatcagcagttctgcccaccatgtgactacggttaactccacaaattgcaaaaaaacaccccctgaagattgcgaggggccatttcggcccgctgagattcttaaggaaggtagtgtcttggatattctcaaatcgcctggctttgctagccccaaaatcgacagcgtcgccgcccagccaacagccacctctccagtggtctacacccgccccgcaatttcctcattctcctccagtgggatcgggttcggcgagtctctgaaagctggcagtagttggcagtgtgatacatgcttgctgcagaacaaagtgactgataataaatgtattgcatgccaagctgccaaactttcgcccagggataccgcgaagcaaaccggaatcgagacacccaataagtccggcaaaacaaccctgtcggcgtccggaactggcttcggcgataaatttaagccagtcatcggtacatgggactgcgatacttgcctggtccagaacaagccagaggccattaagtgtgtggcctgtgagactcctaagccaggaacatgtgtgaaacgcgctcttaccttgacagttgtgtcagaatctgcggaaacgatgactgcaagctccagctcctgcacggttaccactgggacactagggtttggagacaaatttaagcgcccaatcgggagctgggagtgtagtgtctgctgcgtgtctaataatgcagaggacaacaagtgtgtgtcttgcatgagcgagaaacccggatcgtccgtgccggcaagcagcagttcaacagtgcctgtgagtctcccatccggtggctcactcggcctcgagaagttcaagaaacctgaggggagctgggactgtgagctttgtctcgtccagaataaagccgacagtaccaaatgcctcgcctgcgagtcagccaagcctgggacaaagtcggggtttaaaggatttgatacaagcagcagtagttcaaactcagccgccagttcatctttcaaatttggagttagctccagtagtagtggcccgtcacagacccttacctctacgggtaactttaagttcggtgatcagggagggtttaagataggagtgagcagtgactctgggagtatcaacccaatgagtgagggatttaagtttagcaaacccatcggtgactttaagtttggcgtgtcgtcggaatcaaagccggaggaggtaaagaaagactccaaaaatgataatttcaagtttggactttcaagcggcttgagtaaccccgtgagcctgacacctttccaatttggagtcagtaatctcggccaggaagagaagaaagaagaattgccaaaatccagctccgctggtttttctttcggcacaggtgtgataaactccaccccagcgcctgctaacaccatagtgacttcagagaataaatccagtttcaacctggggacaatcgaaacaaaatcagcttcagtcgccccattcacatgtaaaaccagtgaggctaagaaagaggaaatgccagcaactaaagggggattcagctttggcaatgtcgagcccgccagccttccctcagccagcgtattcgtgctggggaggactgaggagaagcaacaggagcccgtaacctccaccagtctggttttcggaaagaaagctgataacgaggaaccgaagtgccaacctgtcttctctttcggcaactccgagcagacgaaggacgagaactcgtcaaaaagcacattttcgttttccatgactaagccaagtgagaaggagtctgagcagccagccaaagcaacattcgcattcggagcccagactagtaccacagctgatcagggcgcggccaaaccggtcttctcctttctcaacaactccagttcatctagctccacacccgcaacgagcgcaggcggggggatatttggatccagtacttccagcagtaatccacccgtggccacttttgtgttcggacagtcttccaacccagtgagctcatcagcgttcggaaataccgctgagagcagtactagtcaaagcctgttgttcagccaagattcaaaactagctacaaccagtagcacaggcacagccgtaacccctttcgtgtttggccctggggcaagcagcaataatacaaccacttcggggtttggcttcggtgcaactaccacctcctcttctgcaggaagctccttcgtgttcgggaccggaccgtctgctccctctgccagcccagctttcggcgccaatcaaacccccaccttcggccagagccagggggcctcacagccgaatcccccaggcttcggatctatcagcagcagtacggctctgttcccaacagggtcacaacccgcccctcccacctttggcaccgtatctagtagctctcagccccctgtcttcggtcaacagccctcccaatccgctttcggaagtggtacgacccctaacagttccagcgccttccagttcgggagcagtactactaacttcaatttcaccaataacagtccttccggagtcttcacctttggcgcaaactcaagtacaccagcagccagcgctcagccctctgggagtggtggattcccattcaatcagtctccagctgcttttacagtcggtagcaatggaaaaaacgtattctccagctctggtacttccttctccggcagaaagattaagaccgctgtccgcagaagaaaatag

SEQ ID NO: 127113 - DNA, 3555 bp, Artificial Sequence
  Description of Artificial Sequence: Synthetic coding sequence
atgatgcagttgcttcagctcctgctcgggctgcttggtccgggcgggtaccttttcctcctgggagattgtcaagaagtaaccacgctaaccgttaaataccaggtatctgaggaggtgcccagcggaaccgtgattggtaagctgtctcaggaactggggagggaagaaaggcggcggcaagccggagctgcattccaggtgctccagctgcctcaggccctgcccattcaagtcgatagcgaagagggacttttgtccaccggcaggcgccttgacagagagcagctgtgccgccagtgggatccgtgtctcgtgtccttcgacgtgctagctactggagatctggcgctgatccacgtagaaatccaggtactcgacatcaatgatcatcagcctcgttttcccaaaggtgagcaggaattggagataagcgagtctgccagtctccgaacaagaattccgctggatagagccttggatcccgacacagggcctaatacactgcacacctacactcttagcccctccgaacacttcgccttagacgtgatcgttggacctgatgaaaccaaacacgccgaattaatcgtggttaaagaactcgacagggagattcattcttttttcgatctggtgctgaccgcgtatgataatggcaatccccccaaaagtggcaccagtctggtcaaggttaacgttctggactccaatgataatagccctgcgttcgctgagagctccttagccctcgaaattcaggaggatgctgcgcccggcacgttattaatcaaactgaccgccaccgaccctgatcagggcccaaacggtgaggtggagttctttctctccaaacacatgcccccagaggttttggacaccttttcgatcgacgcaaagaccggccaggtgatactgcgcaggcccctggactacgaaaagaacccagcctatgaggtggacgtccaggcgagagacttgggcccgaatcccatccctgctcactgtaaggtgttgatcaaagtgctcgatgttaatgacaacatccctagtattcacgtaacttgggctagtcagccttctctagtttcagaggccctgccgaaggattcatttattgcccttgtgatggccgacgaccttgactccgggcacaacggtctcgtccactgttggctgagccaagagttggggcacttcaggctgaagagaaccaatgggaacacgtacatgctcctcaccaatgccaccctggatagagaacagtggcccaaatacaccctcacattgctggcgcaagaccaaggtctccagcccctgagcgcaaagaagcagctcagcattcagatctccgatatcaatgataatgcaccagtcttcgagaagtctcgatacgaggttagcacaagggaaaataatttgcccagcctccacctgatcacgataaaggcccatgatgccgacctgggcattaacgggaaagtatcttacagaatacaggactccccagtggcccatctggtggccattgatagtaatacaggcgaagttacagcacagcgaagtctgaattatgaggagatggctggctttgagtttcaggtcatcgcagaagattctggccaacccatgcttgcaagctccgtcagtgtgtgggtttcactgctggacgccaatgacaatgccccagaggtggtacagccggtgcttagtgacggcaaggcctctcttagcgtactggtgaacgcttctacaggtcaccttcttgtgcctattgaaactcccaacgggctagggcctgcagggactgataccccccccctcgctacccattctagcagaccttttctcttaacaaccatagtggccagagatgctgactcaggggccaacggagagcctttgtactccatcagatctgggaacgaggcccatctcttcattttgaaccctcataccgggcaactctttgtgaatgtgaccaacgcctcaagtttaattggttctgaatgggagctggagatcgtcgtggaagatcagggctcaccaccgctccagacacgggcactacttcgcgtgatgttcgttactagcgtcgatcacttgcgggactccgctagaaagccgggcgctttatccatgtccatgcttaccgtgatttgcctcgctgtgttgctcggaatattcggtctcattctggcgctgttcatgagtatttgtagaaccgaaaaaaaggacaatagggcctataattgtagagaagctgaatctacctacagacagcagcccaagcggccccaaaaacacatccaaaaggccgacatacaccttgtccccgtgcttagggggcaggccggcgagccttgtgaagtgggccagagccataaagacgtggacaaggaggccatgatggaagccggctgggacccttgcctacaagctccttttcatctgacaccaacactgtaccggaccctgagaaaccaggggaatcagggtgctccggcggagtcacgcgaggtcttgcaggatactgtcaacctgctatttaatcacccgaggcagcgcaacgcttctagagaaaacctcaatctgccagaaccgcagccagctacgggccagcctagatctcgtccactgaaggtcgcggggagccctactggacgtttagcaggagatcagggcagcgaggaggccccccaaagaccaccagcttccagcgcaactctcaggcgacagcgccacctcaatggcaaagtatcccctgaaaaggaatccgggccgaggcagattttacgatccctggttagactaagcgtggcggctttcgccgagcggaaccctgtggaggaattgacggtagacagcccgcccgtacagcagatcagtcagctactgagcctactgcatcaaggccagttccagccaaaaccaaatcatagaggaaataagtatctagcaaagcccggaggaagtagaagtgctattccagacactgatggaccatcagctcgcgcgggcggccagacagatccggagcaagaagagggccctctcgatcccgaggaagatctgtctgtgaagcagttgcttgaggaggagctgtcatccctgttggatcctagtaccggcctcgctctggaccggctctctgccccggacccagcctggatggccagactcagtctaccgttaaccactaattaccgagataatgttatctctcctgacgctgcagccactgaggagccacggacttttcagacctttggtaaagctgaggcacccgaattgtcaccgacaggcacgaggcttgcctcaacctttgtgtccgaaatgtcctctcttcttgaaatgcttctggaacagcgttctagcatgcccgtggaggccgcttctgaagccttgcggcgattgagcgtgtgtgggcgcacactgagcttggacctggccacctcagccgcttcaggcatgaaagtacaaggtgaccctggaggcaagaccggaacggaggggaagtccagaggttcatcgagtagcagccgatgtctgtag

SEQ ID NO: 127114 - DNA, 3999 bp, Artificial Sequence
  Description of Artificial Sequence: Synthetic coding sequence
atgagtgacatggactatcctctgcagggtcccggactgctgtccgtccccaatctcccagaaataagtagtatccgcagggtcccccttccaccagagctggttgagcagttcgggcacatgcagtgcaactgcatgatgggtgtattccctccgatttctcgggcttggctgaccatcgactcggatattttcatgtggaactacgaggacggcggagacctcgcttattttgacggcttgagcgaaacaatactcgccgtgggtttggtaaagccaaaggcaggcatattccagccacacgtgcggcacttgttagtgctggccacaccagtagacatcgtgattcttggactgtcttacgctaatttgcagaccggaagcggggtgttgaatgattccctttcaggcggcatgcagttgcttcctgatcctctctattctttgccgaccgacaatacctaccttctgacaatcacttcgacagataatggccgcatattcctggccggcaaggacgggtgtctgtatgaggtcgcatatcaagctgaagcagggtggtttagtcagcggtgtcgcaaaattaaccattcaaaatccagcctatcattcctcgtccccagtctgctgcaattcaccttttcagaagatgacccaattcttcagatcgccatcgacaacagccggaatatcctctacaccagaagcgaaaagggagtgatccaggtttacgacttggggcaggatggccagggaatgagcagagtcgcttccgtctctcagaacgcgatagttagcgctgctggcaatatcgcgaggacgatcgatcgttccgtttttaaacctatagttcagatcgccgtgattgaaaattccgaatctcttgattgccagttgttggccgtcacccatgccggtgttagactctatttctcaacctgtccgttccggcagcctttagctagaccgaatacattgaccctggttcatgttcgcttaccacccggcttctcggcctcgagcactgtagaaaagcccagtaaagttcatagggcactgtactccaaggggatccttctcatggcggccagcgagaatgaggataacgatatcctgtggtgtgtaaaccacgataccttcccgttccagaagccaatgatggaaactcagatgaccgccggtgtcgatggacatagctgggcacttagtgctattgacgaactcaaggttgataagattataacacccctgaacaaagaccacatcccaataactgacagtcccgtggtggttcagcagcatatgctgccgcctaaaaagttcgtcttgcttagcgctcagggctctttgatgttccacaaattgcgaccagtggatcagctgcggcatctgctggtcagcaacgtgggcggagatggggaggaaattgagaggttttttaagctgcaccaagaagatcaggcttgcgctacatgcttaatcctggcctgtagcacagcagcatgcgaccgggaagtgagcgcatgggcaacccgggccttctttcgctacggcggcgaagctcagatgagatttcccaccaccctgcctccaccaagcaacgtcggcccaatcttgggttcccctgtatattcaagctcaccagtcccttctggaagcccttaccccaacccttcattcctgggaacaccctcacacgggattcaaccccccgccatgtcaacgcctgtctgtgctctgggcaatcccgctacccaggcaacaaatatgtcctgcgtcaccggtccagagatcgtctatagtggaaaacacaatggcatatgtatttatttctctaggatcatggggaatatttgggacgcgtcacttgtggttgagcggatctttaaaagcggaaatagagagatcacggccatcgagtctagcgtcccatgtcagttattggaatctgttctgcaggagctgaagggcctgcaagagttcctcgatcgcaattcgcagtttgccgggggtcccctgggaaacccgaatacaacagccaaggtacagcagaggctgattggatttatgcgcccagagaatgggaacccacagcaaatgcagcaggagcttcagcgaaaattccatgaagcccagttatctgaaaagatttccctccaggctattcaacagctggttagaaagtcctatcaggctctggcattatggaaattactctgcgaacatcagtttacaataatcgtcgccgaattacagaaagagcttcaggagcagctgaagattaccacattcaaggatctggtcatccgcgataaagagctgactggagccctcatcgccagccttatcaattgctacatccgggataatgctgccgttgatggtatttctctgcatctgcaggacatctgtccactattgtattccacagacgacgcaatctgcagcaaagctaacgagctgcttcaaaggagcaggcaggttcagaataaaacggaaaaagaacgaatgctgagggaatcattaaaagaatatcaaaaaattagcaatcaagtggatctgagtaatgtctgcgcacagtacaggcaagtgcgattttatgagggcgtggtggaactgtcgctgactgctgcggagaagaaagatccccaaggcctagggctacatttctataaacatggcgagcctgaggaagacatagtggggctgcaggcgtttcaggagaggctgaactcatacaaatgcatcacagatactttgcaggagctggtgaatcagtcaaaagccgctccccagtcgccatccgttccaaagaagcctggcccccctgtgttatcttctgacccaaatatgctaagcaacgaggaggctggccaccattttgaacaaatgcttaagctttcacaaagatctaaagatgaactgttctccatcgccctgtataattggctgatccaggtggatctagctgacaagctcctccaggtggcttcgccgttcctggaaccacatctggtgaggatggcaaaagtggaccaaaatcgggtcaggtacatggatctcctgtggaggtactatgagaaaaatcgaagcttctctaacgcagcccgagtgctcagccggctagcagacatgcactcgacggagatttcactccagcagaggctcgagtacattgctagggccattttatctgcgaagtcttccactgctatctccagtatcgctgctgatggtgagtttttgcatgagttggaagagaagatggaggtggctcgcattcagctgcagattcaggagactctccagcgccaatattctcaccattcctccgtgcaggacgccgtcagccagcttgattctgagctgatggacatcactaaactctacggagagttcgcagatcctttcaagttagctgaatgtaagctggcgattatccactgtgcgggctacagtgatcctattctggtacaaaccctgtggcaggatattatcgaaaaggagctcagtgatagcgttactctgtccagttcggacagaatgcatgctctgtctctgaaaatcgtcctcctcggcaagatctacgccggcaccccccggttctttcctctggacttcatagttcagttcctcgagcagcaggtgtgtactctgaactgggacgttggctttgttattcagacgatgaatgaaatcggtgtgccattgcctagacttttggaggtgtatgatcagttatttaagagtcgggatcccttctggaaccggatgaagaaacctctccacctgcttgactgcatccacgtgctgctaattagatacgtggaaaatccctctcaggtactgaattgcgagaggcggcgtttcactaacctatgtctggacgccgtgtgtggctacctcgtggagctacaaagtatgtcttccagcgtcgccgtccaagctattacgggtaatttcaaatccctacaagctaagctggaacggctgcattag

SEQ ID NO: 127115 - DNA, 4062 bp, Artificial Sequence
  Description of Artificial Sequence: Synthetic coding sequence
atgtacccagatttgagcgagctgcttatggtgagtgctccgaacaatccaacggtttccggcatgtctgacatggactatcctttgcagggccccggtctcttgtcagtccccaatctacccgagatttcttccatcagacgagttccgctgccgccagagctggtcgagcaattcggccacatgcagtgtaactgtatgatgggtgtcttcccaccaatctcacgggcatggctgacaattgattcagacatattcatgtggaactatgaggacggaggggatttagcatacttcgacggcctgagcgaaaccatcttagccgtgggcctggtcaaaccaaaagctggcatcttccagccacacgttagacaccttctggttctggctaccccagttgacatcgtgatcctgggactctcttatgcgaatctccagactgggtcgggcgtgctgaacgacagcctgtccggcgggatgcagctgctgccagacccgctgtattctcttccaacagataacacatatttactgacaattaccagtaccgataatggtagaatctttctggcgggcaaggacggatgtctctatgaagtggcctaccaggcagaagctggttggtttagccaacgctgcagaaagatcaatcattcaaaaagttccctgagcttcctggttcccagcttactccaattcacgttcagtgaagatgaccctattcttcaaatcgccatcgacaattcccggaacatcctgtacacacgcagcgagaagggggtgatacaagtctacgatttaggacaggatggacagggcatgtcgcgagtagcgtccgtgtcacagaacgcaattgtgagcgccgctggtaatatagccaggacaatcgatagaagcgtcttcaagccaattgtgcagattgcagtgatcgagaacagcgagtctctcgattgccaattgttggctgtgactcatgccggcgtgagactgtatttctcaacatgtccttttcggcagcccctggctagacccaacactctgaccctggtgcatgtccgcctccctcccggatttagcgctagttctacagtagaaaagccgtccaaggtgcaccgtgccctctattctaagggtattctactgatggccgcttcagagaatgaagacaatgatatactgtggtgtgttaaccacgacaccttccccttccaaaagcccatgatggagactcagatgaccgccggtgtggatgggcactcttgggcgctttctgccatcgacgagttgaaagtcgataagattattactccactcaacaaagatcacattcccattactgattctccggtggtcgttcagcagcacatgctgccacccaagaagtttgtgcttctcagcgcccaaggttcactgatgttccataagctgaggcccgtcgaccagctgagacacctcctggttagtaacgtgggaggtgacggggaagaaatagaaagattttttaaactacaccaggaagaccaagcctgtgccacctgtctgatactggcctgctcaaccgcggcatgtgatcgcgaagtgtctgcatgggctacgcgagccttttttagatacggcggcgaggcccagatgagattccctaccactttacctcctcccagcaatgtcggacctattctcgggagtcccgtgtactcctccagccctgtgccctctggctcgccataccctaaccctagctttctaggcacaccttctcacggcatccaaccacccgccatgtcgaccccagtctgcgctctgggaaatccggcaactcaggcaaccaatatgagctgcgtgactggcccagagatcgtgtattcaggaaaacataacggtatctgtatctacttctccagaataatgggtaatatttgggacgcttcgcttgtggtggagcgaatttttaaatctggtaatagggagatcaccgccatcgagtccagcgtgccctgtcaattactagaaagtgtgttgcaggaactcaagggattgcaagagttcctggaccgaaactcccaatttgcagggggacccttggggaatccgaataccactgctaaggtccaacagcgactcataggattcatgagacctgaaaatggaaatccacaacagatgcagcaggagctgcagcgcaaatttcacgaagcccagctcagcgagaaaatcagtctccaagctatccagcaactggttcgaaagtcctaccaggcccttgcgctgtggaagttgctgtgcgaacatcagttcacaataatcgtggcagaattacagaaagagttgcaggagcagctcaaaataactactttcaaagatctcgtgattagggataaagaactaaccggagctcttattgcatcgttaattaattgttatatccgagacaacgcggctgtcgacggcatcagcctgcacctccaggatatctgtcctctgctctatagtacagatgatgctatctgttccaaggcgaatgagctgcttcagaggtccaggcaggtccagaataaaaccgaaaaagaaagaatgcttcgggagtctctgaaggagtatcagaagatctccaatcaggtagacttaagtaatgtgtgcgcccagtacaggcaggtccgcttttacgagggagtggtggagttatctttgacagcagctgaaaaaaaagacccgcaaggtttaggattgcatttctataagcatggtgagccagaggaggatatcgtggggctccaggcctttcaggagcgtttaaattcctataagtgtattactgacactttacaggagctcgtgaatcagagcaaagcggccccacagtctcctagtgtgcctaagaagccaggccctccagtactgagttcagaccctaatatgctgagcaatgaagaggccgggcaccactttgaacagatgttgaaactctcacagcgaagcaaggatgagcttttctcgattgccctgtacaactggctaatacaggttgatctggccgataagctgctgcaggtcgccagcccctttctggaacctcacctcgtgaggatggcaaaggtggaccaaaatagagttcgatatatggacttactgtggaggtactacgaaaagaatcgcagcttcagcaatgctgcccgggtcttgtcccggctggctgatatgcattcaaccgagatcagcctgcagcagagactggaatatatagccagagccatcttatccgccaaatcttcaactgcaataagcagcatcgccgccgatggggagtttttgcacgagttggaggagaaaatggaagtcgcacgaattcaacttcagattcaggaaaccctccagcgacagtattcccatcattccagcgtccaggatgctgttagtcagttggactctgagcttatggacattaccaaactgtatggcgagttcgccgatccctttaagctggcagagtgtaaacttgccattattcattgcgccggttactccgaccctattctggttcagaccttatggcaggacatcatagaaaaggaactgtcggactccgttacactgtcctcctctgaccgcatgcacgcactatctctgaaaatcgtccttctcggaaagatttacgcgggaaccccgaggtttttcccactggactttattgtccagttcttagagcagcaggtgtgcacactgaactgggatgtggggtttgtgatccagacgatgaatgagattggcgtaccactaccgcgactactagaagtatacgatcaattgttcaagagccgggacccattctggaatcggatgaagaaaccgctgcaccttttggactgtatccacgtgctgcttatccgctatgtcgagaacccttctcaagtccttaattgtgaaaggagacgctttactaatctgtgtcttgacgcggtctgtggctacttggtggaactccaatcgatgagcagctccgtcgctgtccaggccattacaggtaacttcaaaagtctacaagccaagctggagaggctgcactag

SEQ ID NO: 127116 - DNA, 3984 bp, Artificial Sequence
  Description of Artificial Sequence: Synthetic coding sequence
atgcccagctcactcctgggggctgcaatgcccgctagcaccagcgccgccgcccttcaagaggccctggaaaatgcaggacgtctcattgatcgacaactgcaagaggataggatgtatcctgacctcagtgaattattgatggttagcgcacccaataatcccaccgtgtctggcatgagcgatatggactacccgctacagggacctggacttctgtccgtgcctaatctgcccgagatttccagcattcgaagagtgcccctcccacccgaactggtggagcagttcggccacatgcagtgtaattgtatgatgggagtctttccacctatctctcgggcgtggcttacgatcgactccgatatttttatgtggaattatgaagatggcggtgaccttgcctattttgacgggctgtcagagaccattctggcagtcggcttggtgaagcccaaggctggcatctttcaacctcatgttcggcatctactggtactggcaaccccagtcgacatcgtgattctcggattatcatacgcaaatctacaaacaggttcaggggtgttaaacgactctctctccggagggatgcagctgctgccggaccctttgtacagtctacccaccgacaacacatatctgctgacaatcacctccactgataacggccgcattttcctcgcaggcaaggacggatgtttgtacgaagttgcatatcaggctgaggctggatggttctcccagaggtgccgcaaaattaaccactccaagtcctctttgtcttttctggttccctctttgcttcagtttacatttagcgaggatgacccgatcttgcagatcgcaatcgacaattcgagaaatattctatatacacggagcgaaaagggagttattcaggtctatgacctggggcaagatggccaagggatgagcagggtggcgagcgtgtctcagaatgcaatcgtctcagcagctggtaatatcgctcgaacaatcgaccgctcggtattcaagcctatcgtgcagatcgctgtcattgagaactccgagagcctcgactgtcagctgctggctgtgacccatgctggagtgcggctgtatttttccacctgtccattccggcagccactggcccgcccaaataccctgactctcgtgcatgtaaggctccccccaggattttctgcctcatctacagtcgaaaagcctagcaaggttcacagagctctatacagcaaggggatcctacttatggctgcttccgagaatgaagataacgacattctgtggtgtgtcaaccacgacacattcccctttcagaagcctatgatggaaacacagatgaccgcgggggttgacggacacagctgggccctgagtgcaatcgatgagcttaaagtcgacaagatcattacaccgctgaacaaggaccatataccaatcaccgattctcccgtcgtagttcagcaacacatgcttcctcccaaaaagttcgtgttgctcagcgcgcagggatctttaatgttccataagctaagacccgtggaccagctacgacacctcctggtgtccaatgttgggggagacggcgaggagatagagcgtttctttaagttgcaccaagaggatcaggcctgcgcgacctgtctaatcttggcgtgctcaaccgccgcctgtgaccgagaggtctcagcgtgggcaacaagggcttttttcaggtatggtggagaggcacaaatgaggttccctaccaccctaccacccccaagtaacgtcgggccaattctgggctcccccgtctattccagttccccggttccctctggcagtccatatcccaatccgtcatttctcggaacgccttctcacggcattcagccaccagccatgagcacccctgtgtgtgccctgggaaatccagctacccaagctaccaacatgtcctgcgttacagggcccgagatcgtgtactccggcaagcacaatggtatatgcatatactttagtcgaatcatggggaacatttgggatgcaagtctcgtggtggagagaatctttaagagcggaaaccgggagattaccgctattgaatcttctgtcccatgtcagctgctagagagtgtgctgcaggaattgaagggactccaggaatttctggaccgcaattcacaattcgccggtggacctcttggaaaccctaacacaaccgccaaggtccagcagcgccttataggctttatgcggccggaaaacggaaatcctcagcagatgcagcaggagctccagaggaagttccatgaggcacagctatctgaaaagatttctctccaagctatacagcaactggtgagaaaatcgtaccaggccctggcactttggaagctcctctgtgagcaccagtttaccataattgtcgctgagctacagaaggctaacgagctgctgcagcgatctaggcaagttcaaaacaagaccgagaaggaacgtatgctgcgcgagtcccttaaggaatatcaaaaaattagtaaccaggttgacctgtctaatgtttgcgcccagtaccggcaggtaagattttacgagggcgtggtcgaactttcgctgactgctgctgagaaaaaggaccctcagggcctggggctgcatttttacaagcatggtgaaccagaggaggatattgttggccttcaggcatttcaggaaaggctcaactcatacaagtgcatcacggacacactgcaggaactggtgaaccagagtaaagctgctcctcaaagtcccagcgttcccaaaaaacccggacccccagtgctctcgtccgatccaaatatgctcagcaatgaggaagcagggcaccactttgagcagatgctgaaattaagtcagagatcaaaggatgaactctttagcatagccctgtacaactggctcatccaggtggacctggcagacaaactgttgcaggtagcttcaccattcctggagccccatctggtgaggatggccaaggtagaccaaaacagagtgcggtacatggacctgctgtggaggtactacgagaagaatcggtcctttagcaacgcagctcgagtcctctctcggcttgccgacatgcacagcacagagatctcactccagcagagactagaatatatcgctcgagcgatcctgagtgctaagagttcaaccgcaatctcgtcaattgcagcggacggcgaattcctccatgaactggaggagaagatggaagtggcccgaattcagctccagattcaggaaacgcttcaaaggcagtattcacaccatagctctgtccaggacgccgtaagtcagctagacagtgagctgatggatataactaaactgtatggagaatttgctgacccatttaagctggctgaatgcaagctggctattattcattgcgcaggttactctgatccaattcttgtgcagactttgtggcaagacatcatcgaaaaagagctgtcagactctgtgactctctcgtcctcagatcggatgcatgctctgagtcttaagatcgtgctgctggggaaaatatacgccgggacccctcggttctttcctctggatttcatcgttcagttcctggaacagcaggtctgtaccctgaactgggacgtaggcttcgtcattcagactatgaatgaaattggcgttcctttgccccgactgttggaagtctacgatcagctgtttaagtctcgcgaccccttctggaataggatgaaaaaaccactgcatcttctggactgtatacatgtactgctgatcaggtacgttgaaaatccatcacaggtgctgaattgcgaaaggcggcgctttacaaacctgtgcttggatgctgtctgcgggtatttggtagaattacaaagtatgagctcctctgtcgcagtccaggcaatcaccggtaatttcaagtccttgcaggcgaagttagagcgtctgcactag

SEQ ID NO: 127117 - DNA, 4311 bp, Artificial Sequence
  Description of Artificial Sequence: Synthetic coding sequence
atgttacatttgagcgccgccccgcctgcccctccacctgaggtgactgctactgcacgaccttgtctctgtagtgtaggtcgaagaggtgacggaggtaaaatggccgccgcaggtgcactggaaaggagcttcgtggaactgagcggcgctgagagagagcgccctcgccactttagagagttcacagtctgtagcataggcactgccaatgcagtagccggtgccgtcaagtacagcgaaagtgcaggtgggttttactatgtcgagagtggcaaacttttttcagtgactcgcaaccgatttatccactggaaaactagtggagatactctggagctcatggaagaatctctggatatcaacctcctgaacaacgcaataagactgaaattccagaactgttccgtcctgccaggaggggtttatgtgtctgagacgcagaaccgtgttatcatcctgatgctgactaatcaaaccgttcaccggctgcttctgccccatcctagcaggatgtaccgcagtgaattagtcgtggacagccagatgcaatccatattcacggatattggaaaggtggatttcaccgatccttgcaactatcaactgatccctgcggtgcccggcatttcccccaactccacggctagcactgcatggctgtccagcgacggagaggctctgtttgcgctgccgtgcgcttctggtggtatattcgtcctgaagctgcctccgtacgatatccctggcatggtgagcgtcgttgaattgaaacaaagcagcgtcatgcagcgcctcctgactggttggatgccaaccgctatacgcggggaccaatcaccatctgatcgtccactctctctggccgtacactgtgttgagcacgatgccttcattttcgcgctgtgtcaggatcataaactgagaatgtggagctacaaagaacagatgtgcctcatggtggctgacatgctcgaatacgtccccgtgaaaaaagatttgcggctgaccgccggaacaggccacaaacttcggctcgcatattccccaacaatggggctgtacctgggcatatacatgcatgcccctaaaagggggcagttctgtatcttccagctggtgagtaccgagtccaacaggtacagcctggatcacatctccagcctcttcacttctcaggaaacccttatagatttcgccctgacatcgactgacatctgggccctgtggcacgacgctgagaatcagaccgtggtgaagtacatcaacttcgaacataatgtggcaggacagtggaacccagtgttcatgcagcccctccctgaggaggagatcgtcatccgcgatgaccaagaccctcgggagatgtacctacaatcattgtttacacctggacagtttacaaacgaggctctctgcaaggcccttcagatattttgcagaggaacagagcgaaacctggatctgtcctggagcgaactcaagaaggaagtgaccttggcagtggagaatgaactgcagggtagcgtaactgagtatgagtttagtcaggaggaatttcgcaatcttcagcaagagttctggtgtaagttctacgcctgttgcctccagtaccaggaagccctgtcccacccactcgctctgcatctgaacccacacacgaatatggtctgcctgttgaagaaagggtatctgtccttcttgatcccctctagcctagttgatcacctttatcttctaccctatgaaaacctgctgacagaagacgaaaccaccatctctgatgacgtggatatcgctagagacgtgatctgtctgattaaatgcctgagacttatcgaagagagtgtgacagttgacatgagcgtcattatggaaatgtcctgctataatcttcaatcgcctgaaaaagccgcagagcagatcctggaggatatgataacaatcgatgtcgaaaacgtgatggaggacatctgctccaagctgcaggaaattcgcaatcccattcatgccattggcctcttgatcagggagatggattatgagacagaggtcgagatggagaaaggatttaatcccgcccagccattaaatattcggatgaatctgacacagctgtatggcagcaataccgcaggatatatcgtctgcagaggagtgcataagattgcaagtaccaggttcctgatttgcagagacttgttaatccttcagcaactgctaatgcgtctgggcgacgcagtcatttggggtaccggtcaactcttccaggctcagcaagacctgctgcaccgcactgctcccttactcttatcttactatctgattaaatggggttccgaatgccttgcaactgatgtgcccttggacacgttggagagcaatctccagcatctctcggtgctagaactcactgatagtggagcgctgatggctaacaggttcgtgagcagcccgcagaccattgtggagttatttttccaagaggtggcacggaaacatatcatcagtcacctgttctctcagcccaaagccccgctgagtcagaccggacttaattggcctgaaatgatcacagccataacctcatacttgttgcagctactgtggccgagcaaccctggctgcctatttctcgaatgtctgatgggcaattgccagtatgtgcagctgcaggactatatccagctgttgcacccctggtgccaagtgaatgtgggcagttgccggttcatgctgggacgctgttacctggtcaccggggagggacagaaggccttagaatgcttttgccaggcagcttcagaggtaggtaaggaggaattcctggatcggctgattcgtagcgaggacggagaaattgtcagtacgccccggcttcagtattacgataaagttctgcgcttgctggatgtcatcggcctgcctgaactagtcatccagctggccacttcagccattactgaggcaggggatgattggaaatctcaggcgacactccggacatgtatcttcaagcatcacctggaccttggacacaactcccaggcctacgaggcgttgacccaaatacccgatagttccaggcagctggactgcctgaggcagcttgttgtagtgctgtgtgaaagatctcagttacaagatttggtagagtttccctacgtgaatctgcataacgaggtggtgggaatcatcgagtcccgcgcccgcgccgttgacttgatgacacataactactatgaattgctgtacgccttccacatatataggcataattaccgtaaggccgggactgtcatgttcgagtacgggatgcgccttggccgcgaggtgcggactctgcgtggtttggagaaacagggcaattgctatttggctgctcttaattgtctgagattgatccgccctgaatatgcatggattgtgcagcccgtgtccggagcggtctacgatcgccctggggccagtcctaagaggaaccatgacggagaatgtacagctgcgcctactaacaggcagattgagatactcgaacttgaggacttagagaaggagtgctccttggcccgtattaggctcaccctggcccagcacgatccatcagccgtggccgtggctgggagtagctccgctgaggagatggtgacactgttggtgcaggccggcctgtttgacacagctatatccctctgtcagacattcaaattaccactgacacccgtgttcgaggggctggcatttaaatgcatcaaactgcagtttggaggtgaagctgcacaagcagaagcgtgggcttggttggctgctaaccagctctccagtgtgattaccacgaaggaatccagtgccactgatgaagcttggcggcttctgtcgacttatttggaaaggtacaaagttcaaaacaatctataccatcattgcgtgatcaataaactcctgagccacggggtgcctttgcctaactggttaatcaacagctataagaaggtggacgctgccgagttgctgcggttatacctgaactacgaccttctggaggaagccgtggatctagtctccgaatatgtggacgctgtgctagggaagggacaccagtactttgggatagaatttcccttgagtgctacagcccctatggtgtggctgccttacagtagtatagaccaactactgcaagctcttggtgagaacagcgccaattctcacaacatagcactctctcagaagatcctagataagcttgaggattaccagcaaaaagtagacaaggccacccgcgacctactctaccgaaggaccttgtag

SEQ ID NO: 127118 - DNA, 1452 bp, Artificial Sequence
  Description of Artificial Sequence: Synthetic coding sequence
atggtgtcagtggtagaactgaaacagagcagtgtcatgcagagactgctcaccggatggatgcctacggccattcgcggtgatcagtcaccttccgacaggcccctgtccctcgccgtccattgtgtcgagcacgatgctttcatattcgccctctgccaagaccacaagctccgcatgtggtcctataaggagcagatgtgtttgatggtggccgacatgctggaatacgtccccgttaagaaggatctacgcctgacggccggaactggccacaagctgcggttggcctactccccaacgatgggcttgtatcttggcatctatatgcacgcacccaagaggggacagagacgggggtttgccatgttgcccggtctcaagctcctgagctcctcatctccccctacatctgccagccagtgcgcaggcatcaccagcgttaaccatagcacacagcccgagttttttttctgtattttccagctggtcagcacagaaagcaataggtattccctcgaccatatctcgtccctgtttacaagccaggaaacactgattgatttcgcactgacgtctacagacatttgggccttgtggcatgacgccgaaaatcagactgttgtgaagtatatcaattttgagcacaacgtggccggccagtggaaccctgttttcatgcagcctctccctgaagaagagatcgtcatccgagacgaccaggacccaagagagatgtacctgcaatctctgtttacccctgggcagtttactaatgaggccctgtgcaaggctctgcaaattttctgtcgcggtaccgaacggaacctggatctctcatggtccgagctgaaaaaagaggttacacttgccgtcgaaaacgagctgcagggtagcgtaacagagtatgagttctcccaggaggaatttaggaacctgcagcaggagttctggtgcaagttttatgcttgctgcttacagtaccaggaggcactcagccatcccctcgcactgcatctaaacccgcatactaacatggtgtgcttactcaagaagggctatctatcatttctaatacctagttccctggtggaccatctttacctgctgccttacgagaacctgctgacagaagacgagactacaatttctgatgacgtggacattgcaagggacgtcatttgccttattaaatgcttaagactgatagaggagtcagtgaccgtggatatgagcgtgataatggaaatgagctgttataacctacaaagcccggaaaaggcggccgagcagatcttggaagacatgattacaatcgatgtggagaatgtgatggaagatatttgctcgaagctgcaggaaattcgaaatccaatccacgctatagggctgctcattcgggagatggattatgaaacggaggttgagatggaaaaggggtttaacccatag

SEQ ID NO: 127119 - DNA, 675 bp, Artificial Sequence
  Description of Artificial Sequence: Synthetic coding sequence
atgctgcatctcagcgccgcgcccccggcgcccccccctgaggtgactgctaccgcccggccttgtctatgttctgtgggccgtcgcggcgacggcgggaagatggccgcggctggcgccctcgagcggtctttcgtcgaactatcaggcgccgagagagagaggccccggcactttcgggaatttaccgtgtgttctattggtactgccaatgcagttgccggggctgtgaaatactccgagtcggccggaggcttttattacgtggaatccgggaaacttttttcggtcactcgaaataggtttatacattggaaaacttcaggcgatacccttgagttaatggaagagagtctcgatattaacttgctcaacaacgctattcgcctgaagttccagaattgctctgtgctccccggcggagtgtacgtgtccgaaactcagaacagagtgatcatactcatgctgaccaatcaaacagtgcatagactgctactgccacatcccagcagaatgtaccggagcgtgagctggctgtcggcaatcagcttcatatcccaaataactttgggggttacaaacgtggtgcttgagcgatgtctgctggagctgaaggaaatctggattttggtgatcccacaccaagcctatttcgactcgtacagactgaagtag

SEQ ID NO: 127120 - DNA, 6039 bp, Artificial Sequence
  Description of Artificial Sequence: Synthetic coding sequence
atggcaacacctcttgccgtgaattcagccgcatctctgtggggcccctataaggacatctggcataaggttggtaacgcactctggaggcgccagccggaggccgtgcatctgctggataagattctcaagaagcacaaacctgacttcatatccttgttcaagaatccaccaaaaaatgttcaacagcatgagaaagtacagaaggcgtctacagagggcgtggctattcagggacagcaggggactagattgctgcctgaacagcttattaaagaggctttcattttatccgatttgttcgatattggcgaactagctgcagtggagctgctgcttgccggcgagcatcagcagccccacttcccaggcctcaccagggggctggtggctgtgcttctctactgggacggaaagcgatgtatagccaactcactgaaggctttgatccagtctagaaggggaaaaacatggactctggaattgagtcctgaactcgcctcaatgaccacacggttcacggatgagcttatggaacaggggctgacctacaaagtgctgactctcgtatctcagattgatgtaaacaatgaatttgaaaaactgcagcgcgagaggggccttggatcagaaaaacaccggaaggaggtttcagacctgatcaaggaatgtaggcagagtttggccgagagtttatttgcttgggcctgccagtctcctctgggcaaggaggatacactgctgcttatcgggcatctggagagagtgaccgtcgaggccaacggatcacttgatgctgtcaacctggcgcttctgatggctttattgtattgcttcgatatctccttcatcgaacagagcaccgaggagcgagatgacatgatccaccagctgcccctcctgaccgaaaagcaatacattgcgactatccacagccgccttcaggactcccaactgtggaagcttcccgggcttcaagccacagtgaggctggcctgggcactcgcactacgtggaatatcccagcttcccgatgtgacagctctggccgagttcaccgaggctgacgaggccatggcggagctggcaatcgccgacaacgtattcttgttcctgatggaatcagtggtggtttcggaatatttctatcaagaggaattttatatccgccgtgtgcacaacctcataacagacttcttggccctcatgccaatgaaagtaaaacagctccgcaaccgcgccgacgaagacgcacggatgatccatatgtccatgcagatgggcaatgagccacccatttctctcagacgggacttagagcaccttatgctgttaatcggtgaactgtataaaaagaatcccttccacctggaactggctctagaatattggtgcccaacagaacctctccagacccctacaatcatgggctcttacctgggcgtggcccaccaaaggccccctcagcgacaggtggtcctgagcaagtttgtcaggcaaatgggcgatcttttgccgccaacgatctacatcccctatctgaagatgctccagggactggccaatgggccacaatgcgctcattattgtttttctcttctgaaagtgaacgggagcagccacgtggaaaatatccagggtgctgggggatcgcctgtgagttgggagcactttttccacagtctaatgctgtatcacgaacacttgcggaaggacctaccctcagccgactccgtgcagtatcggcatctgcctagccgcggaatcacccaaaaagaacaggacggactgattgcttttctgcaactgaccagcacaatcattacctggtctgaaaatgcccgtctggccctgtgtgagcatccccagtggacaccggttgtcgttattctgggtcttttgcaatgcagtataccaccagttctgaaggccgaactgctgaagacactggctgccttcggcaagtccccagagattgcagcctcactttggcaatcgctcgaatatactcagatcctacaaaccgtacgaatcccctctcagcgtcaagcgataggtatagaggttgaactgaacgaaattgaaagccgatgtgaggagtatcccctgacacgcgctttctgtcagctcatttccaccctggttgagagctccttccctagcaatctgggtgccgggttgcggcctcccggctttgacccttaccttcagtttcttcgcgactccgtcttcctgcgattccgcacacgggcttaccggcgagctgcagaaaagtgggaagtcgcagaagtggtccttgaagttttctataagctcctgcgcgattatgagccacaactcgaggatttcgtggatcagttcgtcgagctccagggggaggaaatcatcgcctacaaacctcctggattcagtttgatgtaccatctgctgaacgaatccccaatgctggaacttgctctgtctctgctggaggaaggagtgaagcagctagacacctatgcccccttcccagggaagaaacatcttgagaaagcagtgcaacactgcttggccttactcaatttgaccctgcagaaggagaacctgttcatggatctgctgagggagtcccagctggcactgattgtgtgcccgctagagcaactgttacagggaataaatcctaggactaaaaaggccgacaacgtcgtaaatattgcgcgatatctataccatgggaacactaacccagagctcgcttttgagagcgccaaaatcctctgctgcatttcttgcaatagtaacattcaaattaagcttgtgggagattttacccacgaccagtcaatttctcaaaaactgatggccggatttgttgagtgtttggattgtgaggacgccgaggagttcgtccggctggaggagggttctgagctcgaaaagaagcttgtcgccatccgtcatgaaacacgcattcatatcttgaacttgctgatcacaagcttggagtgtaatccccctaacttggctctgtacctgctggggttcgagctgaagaagcctgtgtctaccaccaatttgcaagatccgggggtactcggctgtcctagaacatgtctgcatgctattttgaacatcctggaaaaaggcacagaggggagaaccgggccagttgctgtcagggaatctccgcagctcgccgaactgtgttaccaagtgatttatcagctctgtgcttgcagcgacacgagtggtcctacgatgcggtatctccgtacatcgcaggatttcctgttcagccagctacagtatctgcccttttctaataaggaatatgagatcagcatgctcaatcagatgtcttggctgatgaagactgccagtattgaactgcgtgtcaccagtttaaacagacagaggagtcacacacagagacttctgcacctcctcttggatgatatgcccgttaaaccatattctgacggcgaaggcggcatagaagacgaaaacaggagcgtctccggcttcttacactttgatacagcaacgaaagttcgcaggaaaatactgaacatactagattcaattgacttctctcaggaaataccagagccactccaactcgacttcttcgacagggcccagatagagcaggtgattgccaactgcgagcataagaatctccgaggtcagacagtatgcaacgtgaagttgctgcatagggtgctcgtggctgaggtgaacgccctgcagggtatggcagcgattggacagagacccctccttatggaagaaatctcaaccgtgctgcagtacgtggtgggccgcaacaagctgctgcaatgcctgcacgctaagcggcatgcacttgagagctggcgtcagcttgtggagataatcctgaccgcctgcccccaggatctgatccaggccgaggacagacaacttatcataagggacattcttcaagatgtccatgacaaaattctggacgatgaggctgctcaggaacttatgcccgtagtcgccggtgcggtctttacactgacagcacacctgagccaggcagtgctgaccgagcagaaggagacttcagtcctggggcctgctgaagctcactacgcttttatgttggattcatgctttacatctcctcctccagaggagaacccactcgtaggcttcgcatccatcggcgattcatcactgtatattatccttaagaaactgctggactttatcctgaagaccgggggcggctttcaacgtgtgcggacacatctctacggtagcttactttattacctacagatcgcacagcggcctgatgaacccgatacactagaagcggcaaagaagaccatgtgggagcggctcaccgctcccgaggatgtgttctccaagttgcagagggaaaacatagcaattattgagtcttatggtgctgcactgatggaagtggtctgccgcgacgcctgtgatggccacgagatagggagaatgttagctttggctctgttggacagaatcgtatccgtggataaacagcagcagtggctcttgtacctcagtaattccggctaccttaaagtcttagttgattcactcgtcgaggatgaccggaccctgcagtctctactgacccctcagcccccgttgctgaaagctctctatacatacgagtctaaaatggcatttctgactagggtggcaaaaattcagcagggggccctagagttgttaagatctggggtcattgtgagactggctcaatgtcaggtgtacgacatgagaccagagaccgatccccagagtatgtttggaatgcgtgacccacctatgtttatccctacccctgttgatcgttaccgccagattttactgcccgctctgcagctatgccaggtgatcctgacatcttcaatggctcaacatctgcaggccgccggccaagtcttgcagttcctgatatcacattccgataccatccaggcgatcttgcgatgtcaagatgtgtctgcgggttctcttcaggagctggccctgctgacagggatcatttctaaggccgcgttaccaggaatcctgtccgaactggatgtcgacgtaaatgaggggagtttgatggagctgcagggacatattggacgcttccagaggcaatgcctgggcctattgtccaggtttgggggctcagatcgcttacgccagtttaagttccaggacgataacgtcgaaggagataaggtgagcaaaaaggacgaaatcgagttggccatgcaacagatctgtgcgaacgtgatggaatactgccaatcattaatgttacagtcttcaccaaccttccagcatgccgtgtgtctgttcactcccagcttgagtgaaacagtaaatcgcgatggtccccggcaagatacccaggcacctgtagttccctactggaggctgccaggccttgggattattatctatctcctgaagcaatcggctaacgacttcttcagttactacgactcacatagacagtcagtgtccaagctccagaatgtcgagcagttgcccccggatgagatcaaggaattatgtcagtcggtaatgccggctggggtggataaaatctcaacagctcagaaatacgtgctagcccgccggagattagtgaaggtcatcaataaccgggcaaagcttttatctctttgttcattcataattgaaacatgcctctttatcttatggcggcacctggaatattacctgctccactgtatgccaactgacagccaagacagcctctttgcaagtcgcaccctctttaaaagtaggcgattacaggacagcttcgcatccgaaaccaatcttgatttccgaagcggcctggccattgtatcacagcacgacttggaccagttgcaggccgatgccatcaatgcctttggcgagtcccttcagaagaagctgttggacattgaaggactttactccaaagttcggtctagatactcctttatccaggccttggtccgaagaattagggggctgcttcgcatctctcggaattag

SEQ ID NO: 127121 - DNA, 750 bp, Artificial Sequence
  Description of Artificial Sequence: Synthetic coding sequence
atgagccttagaaattattctgagagggaggtcagtgaccttatcaaagagtgcagacagtctttggcagaatccctgttcgcctgggcttgccagtccccacttggtaaagaagacacactactgctgattggacacctggagagagtgaccgtcgaggccaatggaagtctcgatgccgtaaatctcgcactgctgatggcgctgctatattgctttgatatttcttttatagagcagtcaaccgaggagagagacgatatgatccaccaactgccgctgctgactgaaaaacagtacattgccactattcatagccgcctacaggattcacagctttggaaactgccaggactacaggccactgtgaggctggcctgggccctggcccttagagggatttctcagctgcccgatgtgaccgctctggcagaatttacagaggccgatgaagccatggccgagttagctattgccgacaacgtcttcctgtttttaatggagtccgtcgtcgtttctgagtatttctaccaggaagagttttacatccggcgggtgcacaacttgattactgattttttggccctgatgccgatgaaggtaaagcagctgcggaatcgagccgacgaggatgccaggatgattcatatgagcatgcagatggggaacgaaccacccatttctcttaggcgcgacctggagcacctgatgttactggtgtcaaaacttttggtgctgagactcaactag

SEQ ID NO: 127122 - DNA, 5664 bp, Artificial Sequence
  Description of Artificial Sequence: Synthetic coding sequence
atggcagcaagggggcgggggctgttgctgttgacgctgagcgttttgcttgctgcaggcccatctgcagcagcagcgaaacttaacatccctaaggttctgctaccttttacccgagccactcgcgtgaacttcacacttgaggcttccgagggctgttatcggtggctgtctactcggccagaagtcgcaagcattgagcccctcggactggacgaacagcagtgctcacagaaggcagtggttcaggccaggcttacccagcctgcccggctgacctcaattatattcgctgaggatatcacgaccggccaggttcttaggtgtgacgctatcgttgatcttattcatgacattcagattgtttcaacgacacgagaactctatctggaagactccccgctggaactcaagatacaggcgctggactcagaaggaaatacctttagtacgctggctggactggtctttgagtggaccattgttaaggactcggaggcagatcggttctccgactcgcacaatgccctcaggatcttgacattcctggagtcaacttacattcctccctcctatattagtgaaatggaaaaggcagccaaacaaggagacaccatcctggtgtcaggaatgaaaacgggttctagcaagctaaaggcaagaattcaggaggcagtctataaaaacgtccgacctgccgaagtcaggctgctgatactcgagaacatcctgcttaatcctgcttatgacgtttatctaatggtgggtacatcgattcattacaaagtgcagaagattcggcaaggcaagattacagaactcagcatgcctagcgatcaatacgagctacagctgcagaactccataccaggacctgagggcgatcctgcaagaccggtggctgttctcgcccaggacacgagtatggtgaccgcacttcaactggggcagtcaagtctggtgctaggccatcgctccatccggatgcagggggcctctaggttgcccaactccacgatttacgtggtcgagcctggctacctggggtttaccgtgcatcccggtgatagatgggtgctggaaacagggagactgtacgagattaccatcgaagtttttgataaattttctaataaagtttacgtcagcgacaatatccgcattgaaaccgtccttcctgcagagtttttcgaggttctcagtagctcgcagaatggctcttatcataggattagagccctcaagcggggtcagactgcaatcgacgccgcactgacatcagtggttgaccaggacggcggggtgcacatcctgcaagttcctgtttggaaccagcaggaagtcgaaatacacatccccattactctttacccctcaatcttgacttttccttggcaacccaaaacgggcgcttaccagtataccatccgggcacacggcggcagcggcaacttctcttggtcctccagcagccacctcgtcgctacagtgacagtgaaaggggtgatgaccacagggtctgacataggttttagcgtgatccaggcccacgatgtccagaatccattgcacttcggggagatgaaagtgtacgtgattgagccacactcaatggaatttgccccatgtcaggtggaagcccgggttggacaggctctggaactgcctctccgcataagcgggctcatgccgggtggcgcgtcagaagtcgtcacactcagcgattgtagtcactttgaccttgccgtcgaggtcgagaaccaaggtgtcttccaaccattgcctggcagacttcccccagggtcagagcactgcagtggaatacgcgttaaggcagaggcccagggttccacaacactgttggtgtcataccgccacggacatgttcatctgtccgctaagatcacaatcgcagcttacttgcccctgaaagccgtggatccatccagtgtggccctcgtcaccctgggtagcagcaaagagatgctattcgaaggggggcccaggccttggatcctggagccttcgaaattctttcagaacgttactgctgaggatacggatagtatcggactagctctcttcgccccacactcctcccgaaattaccagcagcactggattctagttacgtgtcaggctctgggtgagcaggtaatcgcactctctgtcgggaacaagccttcgttgactaacccctttcctgctgtcgaacctgctgtcgtcaaatttgtgtgcgcaccccctagcaggctgacgctggcgcccgtctacacttctccacagctagacatgagttgtcctctattgcaacagaacaagcaagtcgtgccagtgagcagccaccggaatcccaggctcgacctggcggcgtacgatcaggaaggccgaagattcgacaacttctcgtcgctctcgatccaatgggaaagcacgagaccggtcctggcaagcatcgagcctgagctccccatgcagttagtatcccaggatgatgaaagtggccagaagaaactccacggcctccaagctattctggtgcatgaggcatctggcacaacagccataactgctaccgcaaccggctaccaagaaagccatctctcttccgccagaacaaaacagccacatgacccactcgttcctttgagcgcctccattgaactcatattggtcgaggatgttcgtgtctcacctgaagaagtcacaatctacaaccaccccgggatacaagcggagttaagaatccgcgaaggaagcggatattttttcttgaatacaagcaccgctgatgtggtgaaggttgcttaccaagaggccaggggagttgccatggtacacccactgctgcccggcagctcaactatcatgatccacgacctttgtctcgtattcccggcccccgccaaggccgtcgtgtacgttagtgatatccaggaattgtacatcagagtggtggataaagtggagattggcaaaacagtaaaagcttatgtgcgcgtgctggatctccataaaaaaccttttctcgctaaatattttcctttcatggatctgaagctgagagctgcatccccaatcattacactcgtcgctctggatgaggccctggacaactacaccatcacattcctcatccgcggggtggcaatcggtcagacttccctgaccgcctcagtaactaacaaagctggtcagcggattaacagcgccccacagcagattgaagtgttcccacctttcaggctcatgcctagaaaagtaactttactgattggagccaccatgcaggtcacctcagaaggtggaccacagccccaaagcaatatactcttctccatcagcaatgaatccgtcgcgctggtgtcagccgctgggcttgtgcaaggtttggccatcggcaacggtacagttagcggcctcgttcaggccgttgacgcggaaacaggcaaggtggttatcatcagccaggaccttgtgcaggttgaagtgctcctactgcgggccgttcggattagggcccctatcatgaggatgagaacaggaacccagatgcctatttacgtaaccggaattaccaatcatcaaaaccctttttcgttcggtaatgccgtccccggcctcacattccactggagtgttaccaaacgggatgtattggatctgcgcggtcggcatcatgaagcctccattcggttaccctctcaatataatttcgccatgaacgttctagggagggtgaagggcaggactggattacgagtcgtggtcaaggccgtggaccctacaagcggccagttgtacggtctggctcgcgagctctcagatgaaatccaagtgcaagtgttcgaaaaactgcaattattaaaccccgagattgaagctgagcaaatattgatgtccccaaactcctacattaagctgcagactaatcgggatggcgcagcgagcctttcctatcgtgtgctcgatggccccgagaaagtccctgttgtgcacgtggatgagaaaggttttctcgcctccggcagtatgattgggacaagcaccatcgaggttatcgcccaagaacctttcggggccaatcaaactatcattgtagcagtgaaagtatctccagtgagctacctgagagtgtccatgagccctgtgctgcacacccagaacaaggaggctctggtagccgtgccactgggaatgacggttaccttcactgtacatttccacgacaattccggagacgtgtttcatgcgcactccagcgtgcttaactttgccaccaatcgcgacgacttcgtccagatcggcaaggggcctaccaacaatacgtgtgtggtgcgaacagtatccgtagggttgacactgctcagagtttgggacgcagagcatccaggactctcagactttatgcccttgcccgttcttcaggccatcagtcccgaactgagcggcgctatggtggttggcgacgtcctctgcctcgctacggtccttacttcactggaaggactcagcggcacttggtcgagttccgctaattccatcttacacattgaccctaagacaggtgtggccgtggcccgggccgtggggagcgtgacagtgtattacgaagtcgctggtcacctacgaacctacaaggaggtggtcgtgtctgttccacagcgcataatggcacggcacctgcatccgatccagacctcgtttcaggaagctaccgcctccaaggtgatagtcgctgtgggcgacaggtccagcaacctgcggggcgaatgcacgcccactcagcgagaagttatccaggcactccaccccgagaccctgattagctgccagagccagttcaaaccagcagtctttgacttccccagtcaagacgtgtttactgtcgagcctcagttcgatacggccctgggacaatacttttgttcaatcaccatgcatcgactgacagataaacagcggaaacacctaagcatgaaaaaaaccgctttggtggtctccgcaagcttaagctcatcacacttcagcacagagcaggtgggtgcagaagtgccttttagtcctggtctgtttgccgatcaagcagagattctgttgtctaatcattacacgagctctgagataagggtgtttggagcaccggaggtgctcgaaaatctggaagtgaaatccggctcaccagccgtcctcgcttttgccaaggagaaatcctttggctggcccagcttcataacctacacagtgggtgttctcgatcccgctgcagggagtcagggccccttgtccactaccctcacgttttcgtctcctgtgaccaatcaggccatcgctatacctgtgacggtggcctttgttgttgaccgtcgcggaccaggaccctatggtgcttccctgttccaacactttctcgattcttatcaagttatgttcttcacgttattcgctctgttggccggcaccgccgtgatgatcatcgcataccatactgtctgtaccccacgcgacctggccgtgccagccgccttaacccctagggctagccctggtcactcaccccattactttgctgcatcttcacctacgtcacccaacgctctgccacccgcccgaaaggcctccccacctagcgggctttggagccccgcctacgcgagccattag

SEQ ID NO: 127123 - DNA, 6273 bp, Artificial Sequence
  Description of Artificial Sequence: Synthetic coding sequence
atgggtgatgaaatggacgctatgatccccgagagggagatgaaggacttccagtttcgagcgttaaagaaagttagaatctttgacagccccgaggagctacccaaggagcgtagctccctgctggctgtcagtaataaatacggactggtgtttgccgggggcgcctcaggattgcaaatatttccgaccaaaaatttgctgatccagaacaagcccggggacgatccgaacaaaattgtagataaggttcagggtctcctagtgccaatgaaattccccattcatcacctcgcactcagttgtgataatctcaccctgtcagcttgcatgatgagctcagagtatggaagcatcatcgcgttcttcgacgtcaggacattctcaaacgaggctaagcagcaaaagcgcccattcgcatatcataagttactaaaggatgctggcggaatggttatagacatgaagtggaatcctactgtgccaagcatggtcgccgtgtgtctcgcagatggtagtatcgcagttctgcaggtgaccgagacagtcaaagtctgcgctacactcccaagcacagtcgcagtcacatctgtgtgctggtctccaaaaggaaagcagctggctgtagggaagcagaatgggaccgtggtgcagtacctgccaaccttgcaagaaaaaaaggtgatcccgtgcccgccgttttacgaaagcgaccatccagtcagagtgctcgacgtgctgtggatcggcacatacgtgttcgcaattgtgtatgctgcagctgacggaacactagaaacgtcccccgacgtcgtgatggcgctcttacccaaaaaggaagagaagcatccagaaatcttcgtgaactttatggagccatgctacgggtcttgcactgaacggcaacaccattattatttatcatatatagaggaatgggacctggtactcgccgcctcagctgcatctactgaggtgagcatcttggcgagacagtctgatcagatcaactgggaatcctggctgttggaggattctagccgggccgaactccctgtgacggacaagtcggacgactccctccccatgggcgtggttgtcgattacacgaaccaggtcgaaatcactatctcagacgagaagaccctgccaccagcccccgtcttgatgttgctcagcacagatggcgttttatgtcccttttacatgattaatcaaaacccaggcgtgaaaagtttgattaagacccccgagaggctgagtctggagggcgaaaggcagcccaagagcccaggaagcactcctacaaccccaacctcgtcacaagcccctcagaaactggacgcatccgctgccgccgcgccagctagcctcccaccctcttcaccagccgctccaatagccactttcagtctacttcccgccggaggcgcccccacagtgttcagttttggctcaagcagcctgaaaagctctgcgacggtgactggggaacccccctcttacagcagcgggtccgacagcagtaaagcagccccaggtcccggcccctctacatttagcttcgttcctccatctaaggcctctcttgctccaaccccagccgccagcccagttgctccttccgccgcatcattctctttcgggagctctgggttcaagcctacactagaatctacacctgtccctagtgtgagcgccccaaatattgcaatgaaaccctcgtttcccccaagcacaagcgcagttaaggtcaacttgtccgagaagtttacagctgccgccacaagtacaccagtttcaagctcacagtctgcccccccaatgtctcctttttcatccgcatcaaaacctgctgcatctgggcctctctctcatccaaccccgttatctgcacccccgtctagcgtgccactgaaatcttccgtacttcccagtccttcaggtaggagcgctcaaggttcatccagtcccgtcccttcaatggtgcagaagtccccgaggattacaccccccgccgctaagcccggaagtccccaggcgaagtcactgcaacccgccgttgcggaaaaacagggacatcagtggaaggatagtgacccagttatggctggcataggtgaggagatcgcccacttccaaaaggagctggaggaactcaaggctaggacgtccaaggcatgcttccaggtggggacgagcgaggagatgaagatgctacggaccgagtcagatgatctgcacacatttcttcttgagatcaaggagacaactgaaagcctccacggagacatttcttccttaaagaccactctcttggaggggtttgctggggtcgaggaagctagggaacaaaacgaaaggaaccgggatagcggctatctccacctgttatacaagcgcccactggatcctaaaagtgaggcccagcttcaggaaatccgccgactgcatcagtacgtcaaatttgccgtccaggacgttaatgacgtgcttgatctagaatgggatcagcatttagaacagaagaaaaagcagcgacacctgctggtgccagaaagggagacactttttaacacccttgctaacaatcgggagatcatcaaccagcaacgcaaacgtcttaatcacttggttgattcgttgcagcagctgcgattgtataagcagacctccctctggtcactctcaagcgcggttcccagccaatcaagtatccactcctttgatagcgacctggaaagtctgtgtaatgccctcctcaagacaaccattgagagtcataccaagagcctgcctaaagtgcccgcaaagttgtccccaatgaaacaggcccagctgaggaatttcctggctaaacgtaagactccccctgtacggtccaccgcccctgcctctctgtcacgtagcgcatttttatcccagaggtattacgaggatttagacgaggtgagcagtactagttccgtgagccagtctctggaatcggaggatgctcgtacatcctgtaaggatgacgaggcagtggttcaagccccacgacatgccccagtggtcaggactccgagcatacagccctctcttttgccacatgcggcccccttcgccaagtcgcacttagttcatgggtcctcccccggcgtaatgggtacttctgtggcaaccagcgcctctaagatcataccccaaggtgccgactcaaccatgctggctactaagactgtgaaacatggcgcaccatcaccatcccatcccatctccgcaccccaggctgccgctgcagctgcacttcgaagacagatggccagccaggctcccgcggtgaataccctgacggagtccaccctcaagaacgtgcctcaggtggttaacgtgcaggagctgaaaaacaatcccgccactcccagcacagctatgggtagcagtgtcccatactccaccgcgaaaaccccacacccagtactgaccccggtcgccgcaaatcaggcgaagcaagggagcctcataaactccttaaaaccaagcggtccaacccctgcctcagggcaactttctagcggagacaaggcttctggaacagccaagatcgaaaccgccgtgacctccacccccagcgcaagcgggcagttttctaaacctttttcattcagcccaagtggcacaggatttaatttcggcattataacacccactcccagctctaacttcactgccgcccagggagccaccccttccacgaaggagtcgagccaacccgacgcattcagctctgggggcgggtcaaaaccctcgtacgaagctattccagagtcaagtccgccgtctggaatcacatcagcttccaatacaactccaggcgagcccgccgctagctcatcaaggcctgtggccccttcagggactgcactgtcgactacatcgagtaagctggagacaccacccagcaaactgggcgagttgctctttccgagctccctcgccggggagaccctgggctctttctctgggctaagggtgggccaggcagatgactccactaagcctacaaacaaggcttctagtacctcactcacgagcacacaacctactaaaactagcggcgttccctccggtttcaatttcacagccccccccgtgcttggaaaacacacggaaccgcctgttacgtcctcagccacaacaacctcagtggcgcctccagccgcaacaagcacctccagtacggcggtgttcggcagtcttccagtaacatcggccggttcttccggggtcatcagtttcggcggcacaagtctcagtgcaggaaagacaagcttctccttcggctcacaacagactaattccacagtcccgcccagtgcccccccccccacaacagcagccacaccgctgcctacaagttttcctacgctcagtttcggttcgctactttctagcgctacaaccccctctctgcctatgagcgcagggagatcaacggaagaggccacaagctctgctttacccgagaagcctggagattctgaggtgagcgcttctgccgcatcgcttctcgaggagcagcagagtgcacaacttccacaagcccctccccagacttctgatagtgtgaagaaggaacctgttctggctcagcccgccgtgtccaatagcgggacagctgcatcttctacatctctggtggcactgtccgccgaggccacaccggcaacgactggcgtgccggacgctcgaaccgaggctgttccgcccgccagcagcttcagtgtgcctgggcagactgcggttacggcagccgcaatttcaagtgctggaccggttgctgttgagacatctagcacccctatcgcaagttccacgacatctatagtggcccccggacctagtgcggaagcagcagctttcgggaccgtgaccagcggaagctccgtattcgcccagcctccagccgctagctctagctcagccttcaatcagcttaccaacaacactgccaccgcaccgagcgcgactcctgtgttcggtcaggtcgccgcgtccaccgcaccaagtctgttcggccagcagaccggatctactgccagtacagccgctgcaaccccacaggtaagttcttctggattctctagcccagcatttggaactaccgcaccgggagtatttgggcagacgacatttggccaagcatctgtttttgggcagagcgcttcgtctgccgcctccgtcttttcattttcacagccgggattttcttcagttccagctttcggacagccagcctctagcactcccacaagtacttccgggagtgtgtttggggctgcatcctcgacctctagttctagtagcttctcattcggacagagttccccaaacacgggcggagggctcttcggccaatcaaatgccccagccttcggacagtccccaggcttcggccagggggggagcgtctttggtggtacctctgctgctacgacaacagccgcaacatctggcttttcgttctgtcaggcctccgggtttggttccagcaataccggctctgtcttcggccaggccgctagcaccggtggtatcgtgtttggccagcagtccagttcttctagtggatccgtgtttggctctggaaacacaggccgaggcgggggattcttctcaggactcggcggcaaaccttctcaagatgcagctaacaaaaatcctttcagcagcgcatctggtgggttcggctccacagctaccagtaatactagcaacctgttcgggaactcaggggccaaaacatttggaggtttcgcctctagcagttttggtgaacagaaacctaccggaacctttagtagtggcgggggtagcgtcgcgagtcaggggtttggcttcagctctcccaataagacagggggtttcggcgccgctccagtctttggcagccctccgacatttggcgggtcccccggcttcggcggagtgcccgcattcgggagtgcccccgcctttacctccccactcggatccaccggcggcaaggtatttggtgagggcactgctgcggccagtgccggaggtttcgggtttggcagcagcagcaataccacctcatttggcaccctggctagccagaatgccccaacctttgggagcctgtcccaacagacatcaggttttggcacgcagtctagtggcttctcgggatttggctcaggaactggtggctttagtttcggctcaaataattcctctgtacaaggattcggtgggtggcgctcctag

SEQ ID NO: 127124 - DNA, 6243 bp, Artificial Sequence
  Description of Artificial Sequence: Synthetic coding sequence
atgggcgatgaaatggatgccatgatccccgagagggagatgaaggacttccagtttagggccctgaaaaaggtgcgaatttttgacagccctgaggagcttcctaaggaaaggtccagcctcctcgcagtctcaaacaagtacgggctagtcttcgcggggggcgcaagtgggctacagatcttcccaaccaagaacctgctaatccagaacaagccaggggacgacccgaataaaatcgtcgacaaagtgcagggactgctggtgccaatgaagttccccatacatcacttggctcttagctgcgacaatttgaccctgtccgcctgcatgatgtctagcgaatatggaagcatcattgccttcttcgacgtgcggactttctcaaatgaagctaagcagcagaagaggccattcgcctaccataaactcctgaaggatgctggggggatggtgatcgacatgaagtggaaccccactgtgccttccatggtggctgtgtgtcttgcggatgggagcatagccgtgctgcaagttaccgaaaccgttaaagtgtgtgccactctaccttctacagtggccgtcacttctgtgtgctggtcccccaagggcaaacagcttgctgtgggcaagcaaaatgggacagtcgtgcagtacctgcccacactccaggaaaagaaggtgataccatgtccccccttctacgagtccgaccatcccgtgagagtcctagacgtactgtggataggtacctacgtctttgccattgtgtatgccgcagctgacggaactctcgagacgagtcccgatgtagtcatggctctgctgcctaaaaaagaagaaaagcaccccgaaattttcgtaaacttcatggagccatgttacgggagttgtacagaaaggcagcatcactactatctgtcatacatcgaggagtgggacttagtgctggctgcctcagctgcctccacggaagtatccattcttgcaaggcagtctgaccagattaactgggagagctggcttctggaggacagctcaagggccgaactgcctgttacggataaaagcgacgactcccttccaatgggagtcgtcgtggactacacgaaccaagtggaaataacaatcagcgacgaaaaaacactccctcctgcccctgtgctgatgctactgagcacagatggtgtattgtgtcccttttatatgatcaaccagaatcccggcgtgaagtctctcataaaaacacctgaacgcttgagtctcgagggggaacgccagcctaaatctccaggttccactcctactactcccacgtcatcccaggctccacagaagctcgacgccagtgctgctgcagccccggcttccctgcccccatcttcacccgctgctccaatagctaccttctcactgctgccggctggcggcgctcctacagtgtttagcttcggctcctcctctctaaaatcctccgctactgtgacaggggagccccccagttactctagcggatcagattcaagcaaggccgcccctgggccaggcccgagcactttttcgttcgtgcctccatcgaaggcttccttagccccgacccctgcggcttcaccggtcgccccatcggccgcgtcctttagcttcggatcctcaggatttaagcctacgctcgaaagcacgcccgtgccctcagtgagcgcgcccaatattgccatgaagccaagctttccaccttctacttccgccgtcaaagtgaacctttcggaaaatagctcacagagcgcccctcctatgtctccattttcaagtgcctctaagccagctgctagcggtcctctgagccacccaaccccactatccgcaccacccagcagcgtccctctgaagtccagtgtgctcccttcgcctagcgcaggccgaagtgcccagggtagttcctcccccgtgccatcaatggttcagaaatccccgaggattaccccacccgctgccaaacctgggtcgccccaggccaagtccctgcagccagcagtcgcggagaaacaggggcatcagtggaaagattcggaccccgtgatggccgggatcggagaggaaatcgcacacttccagaaggaacttgaggaattgaaagccaggactagcaaggcctgctttcaggtcgggacttcagaagagatgaagatgttgcgaacagagagcgatgatctgcacacgtttctactggagatcaaggaaacgacagagagcctccacggtgacatctcctctctgaaaaccacgctcttagagggatttgccggcgtggaagaggcacgggaacagaatgagcggaatagggacagtggttatctgcacctcctatataaaagacctcttgatccaaaaagtgaagcacagctgcaggagattcggcgcctacatcagtacgttaaatttgctgtgcaggacgtaaatgacgtcctggacttagaatgggatcagcaccttgaacagaaaaaaaagcaacggcacctgctggtgcctgagcgagaaactcttttcaacacactggccaataatcgggagattatcaatcagcagaggaagagactgaaccacctagtggattctctacaacagctgaggctctataagcaaacatccctatggtctttgtccagcgccgtgccatctcaatcctcaatacactcttttgatagtgatctggagtccttatgtaatgcattgctgaagaccacgatcgagagccataccaaaagtctaccgaaggtgcctgctaaactgtcccctatgaaacaggcacaattacggaattttctcgcaaagcggaagactcccccagtgagaagtaccgcccctgcctccctcagtcggagcgcattcctgtcacaacggtactacgaggacttggacgaagtgtcttccaccagttcggtgtcacagagccttgagagcgaggacgcaaggacatcgtgcaaggatgacgaggcagtggttcaggctccaagacatgccccggtcgtgcggaccccatccattcagccctcgttgctccctcatgcagcccccttcgccaagagccatctcgtgcatggatccagtccaggagtgatgggcactagcgttgcaaccagcgcatccaagatcatccctcagggagctgattccactatgctcgccaccaaaactgtgaagcacggcgccccctccccatctcatccaatttccgctcctcaggcagctgctgcggccgccctaagacgccagatggcgagccaggctccagctgtaaatactctgaccgaatctacgctgaagaatgtacctcaggtcgtgaacgtccaagaactgaagaataatcccgcaacacccagcacagccatgggcagttcagtaccttacagtacggccaagacaccccatcccgtattaaccccggtagcagctaatcaggctaagcagggatccctgataaactctctgaaaccgagcggaccgacccctgcctctggacagttgtcctctggagacaaagctagcggaactgctaaaatcgagacagctgtcacctcaaccccatccgcctctggccagttttccaagccgttttcattttctccttcggggacaggattcaatttcggtatcatcactcctacgcccagcagtaacttcaccgcggctcagggagctacgccatcgacgaaggaatcgtcccagccagacgccttttcttccggcggtggctccaagcccagctatgaggcgatcccagaatcttccccccctagcgggataacttctgcttcaaacaccacaccaggagaaccagcggcctcaagttcacggccagtcgccccatccggcacagcgctctcaaccaccagttccaagttggagaccccaccatcgaaattgggcgagctgctatttccaagtagcctcgctggagagacactggggtcctttagtggactgagggtgggtcaggccgatgattcaaccaagcccaccaataaggcttcgtctacctccctgacgtccactcaaccaacaaaaactagtggcgtgccctccgggtttaattttaccgcacccccagtgctggggaaacacacagaacctccagtcacctcttctgcaacgacgacgtccgtcgccccaccagccgcgacatcgacctcttccacagccgtgttcggatccttgcctgtgactagtgcaggctcttccggagtcatctctttcggtggtacctccctgtcggcagggaagacctctttctcatttggctcgcagcagacaaactcaactgtgcccccctccgccccacccccaacgaccgctgctacacctctcccaacatcattccctacgctgagtttcggatcgttgctgagctcagctacaacaccttctcttcccatgtcagcaggccgctccacagaggaagctacctcctccgccctgcccgaaaaacccggtgactcagaggtatccgcatctgccgcctcattactggaggaacaacaaagtgcccagctgccccaggcccctccacaaacgtccgatagtgtcaagaaggagcctgtattggcccagccagccgtgagtaactctggcactgcggcctcttctacttctctagtcgctttgtccgccgaggcaacaccagctacaaccggggttcctgatgctcggaccgaagctgtgccgcccgctagttcgttttccgtccctgggcagacagccgtgacggccgccgccatctcctctgccggtccagttgcagttgagacaagtagcactccgatcgccagcagcacaacttcgatagtagccccagggccgagcgccgaggccgcagccttcgggacagtcacatccgggtctagtgtgtttgctcagccccctgccgccagctcgtcatccgcctttaatcagctcacgaacaacactgcgactgctccatcagcaacaccagtctttgggcaggtagccgcgtctaccgctcccagtctcttcggacagcagacgggatctactgctagtacagccgctgccaccccgcaggtgtcttcttctgggttcagtagtccagcttttgggactaccgcaccaggtgtctttggacagacaacttttggccaggcctccgttttcgggcagagcgctagttctgcagcatcagtgtttagtttctcacagcccggattctccagtgtgcctgccttcgggcaacctgcctcatctactccaaccagcacctcaggctcagtctttggagccgctagttccacatcttccagctccagcttttcgttcggccagtccagtccgaatacaggcgggggactttttggccaatcaaacgcgccagccttcggacagagccccggttttggacagggaggaagcgtgtttggcggaacttctgccgctactactactgctgctaccagcggtttctcattttgccaggcatcaggatttggtagttcaaacacaggcagtgtgtttggtcaggctgcgtccactggtggcatcgtgttcggacagcaatcatcctcatcttccggtagcgtgttcggctcaggaaatacagggcggggcggagggtttttttccggactcggagggaagcccagccaggatgcagccaacaaaaaccccttctcaagtgctagtggggggttcggtagcacggcgacttcgaacacaagtaatctttttggcaatagcggcgccaagacctttggcggcttcgcttccagttcgtttggtgaacagaaaccaacaggtacattctcctcaggaggcgggagtgtggcctctcagggtttcgggttctcctctcccaataagaccggtggtttcggcgcagctcctgttttcgggagccctcctacttttggaggtagcccggggttcggaggtgtacccgcattcgggagtgctcccgcctttacttctccacttggaagtactggaggaaaggtgtttggggagggaacagccgctgcatctgctggcggtttcggttttggctctagcagcaatactaccagcttcggaacactcgcctcccagaatgcccctaccttcggtagcctgtcccagcagactagcggattcggaacccaatcatccggattttccggcttcggatcaggaacagggggattcagcttcggatcgaacaattcctctgtgcagggttttggaggatggaggtcctag

SEQ ID NO: 127125 - DNA, 4560 bp, Artificial Sequence
  Description of Artificial Sequence: Synthetic coding sequence
atgaaaccaagcttccctcccagcacctccgcagtcaaggtgaacctatcagagaaatttaccgctgccgcaacctctacccccgttagcagcagccaaagtgcacctcccatgagccccttttccagtgccagcaagccggccgcctctggtcctctaagccatcctactccactgagtgcgcctcctagttcggtcccgctaaaaagttccgtgctgccgtctccttctgggagaagcgctcagggtagttctagccccgtgccttcgatggtgcagaagtcccctcgcattactcctcccgcagcaaagcctggctcccctcaggccaaatctcttcaacctgccgtggctgagaaacaggggcaccagtggaaggactctgatcccgtgatggcaggcatcggagaggaaatcgcgcactttcagaaggaattggaggaattgaaggcacgtacctcgaaagcctgcttccaggtcggcaccagcgaggagatgaaaatgcttcgaactgaatccgatgatctgcacacttttctattggagattaaggagaccactgaatctctgcatggagacatttcatcactgaagactacactgttggaaggctttgccggggttgaagaagcaagagaacagaacgaacgtaaccgcgacagtggttacttacacttgctgtataagcgccccctagatcccaagtctgaagctcagctgcaggagatcagacgtctgcatcagtacgttaagtttgctgttcaggacgtgaatgatgtgctcgatctggaatgggaccagcacctagagcagaagaagaagcagaggcatctactggtccccgagagagagacactgttcaacacgctggccaataaccgcgagatcattaatcagcagcggaagcggctgaatcacttagttgactctcttcagcagttgcgtttgtacaaacagacatcactctggagcctgtcttccgccgtaccatcgcagagctctatccattccttcgactccgacttggagtcactctgcaacgccctgctcaaaacaaccatagagagccacacgaagagcttgcccaaagtacccgcaaaactgagccccatgaagcaggcgcaattacgtaattttttggccaaacggaagacgcctccggtaagatcgactgccccagctagtttatccagatcagccttcctctcccagcgatattacgaggacctagacgaggtaagtagtacatcttctgtgtcccagtccctggagtcggaggatgccagaacatcatgtaaagatgatgaggcggtggtacaagctccgcgccatgcccctgtggtccggacacctagcattcagccatctttgttacctcatgccgcaccttttgccaagtcccacctcgtccacggatcctctcccggcgtgatgggtaccagtgtcgcaaccagcgcttcgaagattattcctcagggcgccgatagtactatgctggcaacgaagacagtcaagcatggggcccctagtccatcccaccccatttctgctccacaggctgcagctgctgctgccctccggaggcagatggcctcccaggcccctgcggtcaacacattgaccgagagcactctgaagaacgtgccgcaagttgtaaacgtccaggaactcaaaaacaaccccgccaccccttctacagcaatgggcagtagcgttccatattctactgctaagactccacatcccgttctaacccctgtggcggctaatcaagctaaacaggggtcacttattaatagtctgaagcccagcggaccaactccggcttctggccaactgtcttctggtgacaaggcttcgggcaccgccaagattgaaacagctgtgacaagcactccaagcgcttctggccagttttccaagccattttccttttctccctccgggacaggatttaactttgggatcataactcccaccccctcgtctaatttcacagctgcccagggcgcaaccccaagcaccaaggagagcagccaaccagacgcatttagctccggagggggatctaaacccagctacgaggcgatccccgagtcttccccacccagtggaatcaccagtgcgagcaataccacccccggggagccagctgcttcctctagtcggccagtggcaccatctggtaccgccctgagcaccacaagtagcaaactggagacaccgccatcaaagctcggagaactcctctttcctagtagtctcgcaggcgagacattggggtctttctcgggcctccgcgttggccaagcagatgactctactaaacccaccaacaaagccagtagcacctctcttacaagtactcagcccacaaaaacaagcggagtaccctctgggtttaattttacagctccacctgtcctcggcaagcataccgagcctccagttacgtcttctgccaccacaacttcagtggcgcccccggccgccacgagcacctctagcacggccgtcttcggatccttacctgtgacgagcgccggctcttctggagttatcagctttgggggcacctccttgtctgccggaaagacatcttttagttttggatcacagcaaacaaactctacagtgcccccctccgcaccccccccaacaacggcagctactccactccctactagtttccctaccctctctttcggttctctactcagctcagcgacaactccttctctcccaatgtccgccggcagatcaactgaagaggccaccagctctgcactcccagaaaaacccggagacagcgaggtaagcgcatcagctgcaagccttctggaagagcaacagtccgcccagctgccccaggctccccctcaaacaagcgacagtgtcaaaaaggaaccagtgctggcccaaccagcagtctccaactcaggcacagctgcatcttccacttccctagtcgccctttctgcagaagccacgcctgctaccacaggggtgcccgacgcaaggacagaagcagtgcctccagccagcagcttcagcgtgcctgggcaaactgcggtgacagctgctgccatatcaagcgccggcccagtggctgtggagacatcaagtacccctatcgcatcctccacaacctccatcgtggccccgggaccctcagccgaggcagctgcattcgggacagttacctccgggtcgtccgttttcgctcagccaccagccgcttcctcctcctcagcattcaaccagctgacaaacaatactgcaactgcgccatcagccacacccgttttcggccaggtggctgcttcaactgccccttcattattcggccagcagaccggctctaccgcttcaacagcagctgctactccacaggtgagcagtagcggcttcagtagccctgcttttgggaccaccgctcctggtgtgtttggccagaccacatttggacaggcctctgtattcgggcagtcggcatcatccgccgcgagtgtgttcagtttcagccagcccgggttcagcagtgtaccagctttcggacagcccgcctctagcacacctacctccacctcaggctccgtgttcggggcggcgtcctccacttcttctagttcctccttttcctttggtcagtctagtcccaacaccggcggcggcttatttgggcagtcaaatgcacctgcgttcggccagagtccaggattcgggcaaggagggagcgtttttggggggacttccgccgcgacaacgactgctgctacaagtggcttcagcttctgtcaggcctccggcttcggatcctccaacaccggctctgttttcggtcaggccgcttcaactgggggcatcgttttcgggcagcagtcctcttcaagttccggaagtgtttttggctctgggaacactggcagaggaggcggcttcttctcaggactgggagggaaaccctcacaggatgcggccaacaaaaaccctttctcaagtgcctctggcggattcgggagcactgcaacatcaaacacttccaacttgttcgggaattccggagcaaagacttttggcggattcgcctcctcatcatttggcgaacagaaacccaccggcactttttcttccggcggaggatccgtggcatcgcagggatttggcttctccagcccgaataagaccgggggattcggggccgctcccgtgtttggctctccgcccactttcggcggcagccctggtttcggtggggtgcccgccttcgggagcgcccccgcgtttacgtctccacttgggtctactggggggaaagtgtttggagagggaaccgccgctgcttccgccggcggctttggctttggatcttcctctaacacaacaagttttggtaccctggcgtcccagaacgctccaacttttgggtcattgtcacagcagactagtggatttggaacccagtcatctggcttttctggtttcggatccggcaccggtgggttctcttttggatccaataactcctccgtgcaggggttcggagggtggcgctcctag

SEQ ID NO: 127126 - DNA, 6276 bp, Artificial Sequence
  Description of Artificial Sequence: Synthetic coding sequence
atgggcgacgaaatggacgcaatgatcccggagagagagatgaaggacttccagtttagagcactaaagaaggttcgaatctttgacagtccagaagagctacccaaggaaaggagctctctccttgctgtgtcaaacaaatatggcctggttttcgccggaggtgcctcgggcctgcagatatttcccacaaagaacctactgatacagaacaagcccggggatgatcctaataaaatagttgacaaggttcaaggcctacttgttcccatgaaatttcctatccatcacctggccctaagttgcgataacctcacactcagcgcttgtatgatgagttctgagtatggaagcatcattgcttttttcgatgttagaaccttctcgaacgaggccaagcagcaaaaacgtccgtttgcctaccacaagctgctgaaagatgccgggggcatggtcattgatatgaagtggaatcctacagtcccttctatggtcgctgtatgcctggctgatggctccattgctgtccttcaagtgaccgaaaccgtgaaggtttgtgctacactcccatcgacggtggccgtgaccagtgtttgttggtccccgaaaggcaaacagctggctgttgggaaacagaacgggactgtcgtgcagtatctgcccacgctgcaggagaagaaggtcatcccctgtccacctttctacgagagcgatcatccagtgagagtgctggacgttctgtggatagggacatacgtgtttgctattgtgtatgctgcagccgacgggactctggagaccagccctgatgtggtgatggctcttctcccaaaaaaggaggaaaaacaccccgagatctttgttaacttcatggagccctgttatggatcatgcactgaacgccaacaccactactaccttagttatatagaagagtgggacctcgtcctggccgcctccgccgcctctaccgaggtttcaattttagcaagacagagtgatcaaataaactgggagagctggctgttagaggattcatcaagagctgagctcccagtgaccgacaaatccgacgattctctgcctatgggagtggtcgtggattataccaatcaagtggagatcacgatatccgacgagaaaacactgccccctgcccccgtactgatgcttttgtccaccgatggcgtactctgtcctttttatatgattaaccaaaacccaggggtgaagagtctgataaaaacgcctgagcgcctctcattggaaggggagcggcagcccaaatctccaggctcaaccccaactacccccacgagttctcaggcaccacagaagctagacgccagcgctgcggctgcccccgccagcctccccccaagcagccccgcagcacccatcgcaactttctctctgctccccgccggtggagccccaacggtgttcagcttcggatcatccagtctgaagtcctctgcaaccgttacgggagagcccccgagctattcttcaggctcagactcatctaaggcagcgcccgggcccgggcccagtacattctctttcgtaccaccttccaaggctagccttgcgccgacacccgccgccagccctgtcgcccctagcgccgccagcttctctttcggaagcagtggctttaagccaacactcgagtccaccccagtcccctctgtgtccgccccaaatattgccatgaaaccctcatttcctccttcaaccagtgcagtgaaggtaaatctgtcagaaaagttcaccgcagcagccacttcaactcccgtctcaagcagccagtctgccccaccaatgtcacctttcagtagcgcctcgaagcccgccgcttccggcccactgtcacatcccacacccctgtctgctcctcccagtagcgtgcccctcaagtccagtgtgttaccatctcccagtgccggaagatccgcgcagggatcctcctctcccgtcccgagcatggtgcagaagtctccaagaattaccccgcctgcagcgaagcctggcagtccgcaagctaaatctctgcaacccgcggtggctgagaagcagggacatcagtggaaggatagcgatcccgtgatggccggaattggagaggaaattgctcatttccagaaggagttagaggaattgaaggcccgtacatcaaaggcttgtttccaggtgggtacaagcgaagaaatgaaaatgctgcgcactgaaagtgacgacctccacactttcctgctggagattaaggaaacgacagagagtctgcatggggatattagttcgctcaaaaccacactgttggaaggcttcgccggtgtagaagaagctcgtgagcagaatgagaggaatcgtgattccggatacctgcatctgctttacaagcgcccgctggaccccaagagcgaagctcagctacaggaaatcaggaggctgcaccaatacgtaaagtttgccgtgcaagacgtaaatgacgtgctagatttggagtgggatcagcacttggagcaaaaaaagaagcagaggcacctgctggtgcctgaacgcgaaaccttgttcaacaccctggcgaataaccgagaaatcatcaaccagcagagaaagagactgaaccatctggtagatagtctgcaacagctgcgcctgtacaaacaaacttccctgtggagtctcagttccgcagtgccatcccagtcttctattcattcgttcgacagtgacctagaaagcctctgcaatgcacttttgaaaacgacgatcgagtcccataccaagagcctgcccaaggtacctgctaagctaagtcccatgaaacaggcccaactgcgcaactttttggctaagcggaagacaccgcctgtcaggtcaaccgcgccggcatcccttagccgcagcgcttttctgtctcagaggtactatgaggaccttgatgaagttagttccactagcagcgtcagccagtctcttgaaagcgaggacgccaggacctcttgtaaagatgacgaggctgtcgtgcaggccccgcggcacgctcccgtggtcaggacaccttcaatacaaccatctctcttgccgcatgccgcacccttcgccaaatcccacctggtgcatggatctagcccaggagtgatgggtacttctgttgccacaagcgccagtaagataatcccacagggggccgactcaacaatgcttgccaccaaaaccgttaagcatggagccccgtcaccttctcaccctatctctgcaccacaagctgctgcggcagcagcgcttcgaaggcagatggctagccaggcgcccgctgtgaacacgcttactgagagcactttaaagaatgtgccccaagttgtgaacgtccaggagctcaaaaacaaccccgctactccttctactgccatgggtagcagcgtgccttattcaacagctaaaactccgcacccagttctgacaccggtcgcagctaaccaggccaagcaaggttccttaatcaactcactgaagccttccggtcctacacctgcctctggccagctgagtagcggagacaaagcttccggaactgccaaaattgagaccgcggtcacgtccacgccgtctgcatctggccaattctcaaagccattcagctttagcccatcagggaccggcttcaactttgggatcatcactccaacacccagctccaattttaccgctgcccagggggccacacccagcaccaaagaatcatctcagcctgacgcattctcctcgggaggcggctctaagcccagttatgaagctattccagagtccagcccgccttctggcattaccagcgcctcaaacaccacaccaggcgagcccgctgccagctcatctaggcccgtggcccccagtggcacagcactgtctaccacgtcttcaaagcttgaaaccccccccagtaaactcggagagcttttgttccccagctcactcgccggcgagaccttaggtagcttttcggggttgagggtggggcaggcggacgacagcactaagccaactaacaaggcaagttcgacgtcccttactagtacacaaccaacaaaaacaagcggtgtgccaagtggatttaatttcaccgcgccgcccgtcctcggcaagcatactgaacctccagtgactagctcagctacaactacaagtgttgcccctccggccgctacaagtacgagcagcaccgccgtgttcggctctttaccagtcacatctgccgggtcttctggagtcatctcctttggcggtacttctctgagcgccggcaagacatcattttcatttggttctcagcagactaatagcactgttccgccaagcgctccgccacccacgactgcggctaccccactgcctactagcttccccacgctgtctttcggaagcctcctgtccagcgccaccacacctagtctgccaatgtctgccggtcggagtactgaggaggcaaccagctcagccttacctgagaagcccggtgacagtgaggtgtctgcatccgctgcatcattgctggaagaacaacaatctgcacaattgccacaggctcctccccagacctcagattccgttaagaaggagcccgtcctggcacagccggctgtttctaattccggcaccgctgcctcttcaacctcacttgtggccctgtccgccgaggcgaccccagcaacaaccggagtccccgatgcccggacggaggcagtgccccccgcatcctcgttctctgtccccggtcagaccgctgtgactgccgctgccattagcagcgctgggcctgtggcggttgaaacatcaagcaccccaatcgcgtcgtctaccacgtccatcgtcgctcctgggccttcggcagaagcagctgcctttggaaccgttacctcaggaagttctgtctttgcgcagcctcccgccgccagtagctcgagcgcgtttaaccaactgacaaacaataccgctaccgccccttctgccactccggttttcggacaggtggcagccagtaccgcgccgtccttgtttgggcagcaaacaggctctaccgcctctacagccgctgccacccctcaagtgtcttcatcaggcttttccagccctgctttcgggacaacagcacctggagttttcgggcaaaccaccttcggacaggctagcgtgttcggtcaaagcgcctctagcgccgcctctgtgttttcattctctcaaccaggcttttcgtctgtgcccgcctttgggcagcccgcttcttctactcccacgtccaccagcggctcagtctttggggcagcttcgagcactagcagcagcagtagtttctcattcggccagagctcccctaataccgggggcggccttttcggacagtcgaatgcccccgcgtttggacagtctcccggttttggccaaggcggtagtgtctttggagggaccagcgctgccaccacgactgctgctacgagtgggttttcgttttgccaagccagtggtttcggaagcagcaatacaggcagcgttttcggacaagccgctagtactggcggcatcgtgttcggccaacagagtagttcaagctcaggctcagtttttggcagtggcaacactggtaggggaggaggctttttcagcggcctgggagggaagcctagccaggacgcagccaacaaaaatcccttttcttccgcgagtggtggcttcggctctaccgcaaccagcaacacatccaacctgttcggaaattccggagccaagactttcggaggattcgcgtcgagcagctttggtgaacagaagccaacaggcacattcagcagcggtggcgggagcgtggcatcacaaggcttcggattctcatcacctaataagaccggtgggttcggagctgccccagttttcggctcaccacccactttcggaggatctccaggctttggcggggtgccagctttcggcagcgcacccgcatttacttcccccctgggatcaaccggaggaaaggtgttcggcgaaggcacagcggccgctagtgctggaggcttcgggtttgggagcagtagcaacactacatcctttggaactctggcatcacagaacgcacctacatttggaagcttgagtcagcagaccagcggcttcggcacgcagtcgagcgggttctcaggctttggtagcggtacaggaggattttcttttggctcaaacaactcatctgttcagggctttggcgggtggcgatcctag

SEQ ID NO: 127127 - DNA, 237 bp, Artificial Sequence
  Description of Artificial Sequence: Synthetic coding sequence
ggagaaggcaccgctgctgcctcagcaggaggctttggcttcggatcgagttccaatacaactagctttgggacactggcatcgcagaacgccccgacatttggttcactatcgcagcaaactagcggcttcggaacccagtcatccggattctccggctttgggagtggcacagggggatttagttttggctcaaataactctagcgttcagggatttggaggttggaggtcttag

SEQ ID NO: 127128 - DNA, 5055 bp, Artificial Sequence
  Description of Artificial Sequence: Synthetic coding sequence
ggcgctgagggccgtaaatttgcagtcgagagacccggctttcgcggacagggtaggggccggcagcggtggctgctgcgccatactactcccacaagctcacaggccccccaaaaactggatgcaagtgcggcagccgccccagcttccctgcctcctagtagccctgctgcgccgatcgccactttcagtttgctgcctgcggggggcgctccaacagttttctcttttggtagctctagcctgaaaagctcagcaacagtgaccggagagcctccctcctattcctctgggtctgatagcagtaaagccgctcccggacccggacccagtacatttagttttgttccaccttcaaaagcatccttggcccctactccagctgcgagccctgtcgccccctcagcagccagcttctcctttggctccagcggttttaagcccacgttagagagcacccctgtgcccagcgtgtctgcccccaatatagccatgaagccctctttccctccctcgactagcgcagtgaaggttaatctgagcgagaaattcacagccgccgccaccagcactccggtgtcctcttcacaatctgccccgccgatgtcaccattctcatccgcaagtaaaccagccgcttcgggcccactgtctcatccaacccctctgtcagccccgcccagttctgtaccactgaaatcctcggttttgccctcacctagtgccggccggagcgctcaagggagtagctcacctgtccccagcatggtccagaagagcccacgcatcacaccccctgccgcaaaaccaggcagtcctcaagctaagagtcttcagcccgctgtcgccgaaaaacagggacaccagtggaaagactccgacccagtaatggccggaatcggagaagagatcgctcatttccaaaaggagctggaagaactcaaggctcgaacttctaaagcttgtttccaagtaggaacttccgaagaaatgaagatgctgagaaccgaatcagacgatctacacacttttctcctggagattaaggaaactactgaatcccttcatggggatattagttcactgaaaactacgttgcttgaaggatttgcgggggtcgaagaggcgcgcgagcagaatgagcggaaccgggattccggctaccttcaccttctttacaagcggcccctggaccccaaatctgaggctcaactgcaggagataaggcgtttgcaccagtatgtgaagttcgccgtccaggatgttaatgacgtactggacctggagtgggatcagcacctggaacagaagaaaaaacagcgccacctgttagtgcctgaacgcgagaccctctttaacactctcgcaaataaccgagagattattaaccagcagcgcaagagattgaatcaccttgtggatagtttgcaacaactgcgactgtacaagcagacctcactgtggtcccttagttctgcggtgccatcgcagagttccatccactcttttgactcggatctggaaagtctctgtaatgctctcctgaagaccaccattgaaagccacaccaagtcgctacccaaggtgccagctaaactgtcacccatgaagcaggcccagttgcgaaattttctggcgaagaggaagacccccccagttcgcagcactgctcccgcttcactgtccagaagcgcattcctctcccagcgctattacgaggacctggacgaggtttcgtccacgtcttctgttagtcaatctcttgagagtgaggacgcccggacttcatgcaaggacgatgaggccgtcgtccaggccccccggcatgctcccgtcgtgagaacaccgtcaatccagccctcgttgcttcctcacgccgctccctttgccaagagtcacttggtccacggcagcagtccaggggttatgggtacgtccgtcgcaacctctgccagcaagattattccacaaggagcagactctacgatgcttgccaccaaaactgttaagcatggagccccgtccccctcccacccaatctcagccccccaagctgcagctgccgccgccctgcgccgccagatggcctcccaggcacctgctgttaacacactcacagagtccacgctgaagaacgtgccccaggtggtcaatgtgcaggagttgaagaataacccggcaaccccctccacagctatggggtcaagcgtgccatattctacagccaagaccccacatcccgtgctgacccctgtggccgcaaatcaggctaaacagggcagtctgatcaattctttaaagcctagtgggcccaccccagcgagcggccagctgtctagcggagataaggcctcaggaactgcaaagattgaaaccgcggttacgtctacgcctagcgctagtggccagtttagcaaaccatttagctttagtccctctggcacaggtttcaactttggcatcatcaccccaaccccatcttcgaactttaccgccgcgcaaggcgcaactccctctacaaaggaatccagtcagccggacgcattcagcagcggcggtggatctaaaccttcgtatgaggcaatccctgagtctagccccccttccggtataacctcggcgtcaaatacaactccaggggagcctgccgcatcgtctagtcgcccggtggccccaagtggcacggccctctccacaacctcatcaaagttagaaacccccccttccaaactcggggaacttctcttcccatcaagcttagctggtgagacccttggttccttttctggcctccgtgtcgggcaggcggacgatagtactaaaccgaccaataaagcctccagcaccagcctcacttctacacaaccaacaaagacttccggcgtgccatcaggcttcaactttaccgcccctcctgtattgggcaagcatacagagccacccgtaacctcgagcgccaccactaccagtgtggcgcccccagccgccacctccacatcctcaacagcagttttcgggtctttgcccgtaacgagcgccggatcttcaggagtaatttcttttggggggaccagcctgtcagccggtaagacttccttttccttcggaagtcagcagaccaacagcactgtcccaccaagcgctcccccaccaaccaccgccgccacccctctccccacaagcttcccgactctgagcttcggttccctcctgagctcagctacaactcctagtctgccaatgtctgctggccggagcaccgaggaagccacatcttctgctcttccagagaagcccggggactccgaggtctcagcctccgccgccagcctgctggaggagcagcagtcagctcagttaccacaggcacctccgcaaacctccgactctgttaagaaggaaccagtgttggcccagcccgcagtctctaacagcggcaccgctgctagcagcacctcacttgtggccctgtctgctgaggccacgcctgccactactggagtgcccgatgctagaactgaagcggttccgcccgcgtcttcattctccgttccagggcagaccgccgtgacagcggccgccatatcgtccgctgggccagtggctgtagagacctcaagcaccccgatagccagtagtaccacaagcattgtggctcccggccccagcgccgaggcagccgcttttggcacagtgaccagcggatcctcagtttttgcccagcctcccgccgcctctagtagttcagctttcaatcaactgaccaacaacactgcaacggctccaagtgccacgcctgtcttcggccaagttgccgccagcacagctccttcactattcggtcagcagaccggatctacagcctcaaccgcagcagccacgccccaggtgtcctctagtggattcagctctcctgcctttgggaccaccgcaccaggcgtgttcggtcaaacgacgtttggtcaggcttctgtttttggccagtcggcaagctccgcagcctcagtcttctcattctctcagcctggcttctcctcagtgcctgccttcggccagcctgcaagttcaactccaacatccacttctggctctgtctttggggccgcctctagtacttcttccagcagtagctttagctttggccagagttcacccaataccggaggaggcctttttggccaatccaacgctcctgcattcgggcaatccccaggatttggccaaggaggctccgtgttcggcggcaccagcgccgcgacgaccactgcagcaacctcaggatttagtttctgtcaggcatccgggttcgggtcttcaaacactgggagcgtgttcgggcaggccgcatctacaggcggtatcgtgtttggtcagcagagcagtagcagcagcggtagcgtgttcggatctgggaacacaggaagaggaggtggcttttttagcggcctgggtggaaagccgtcccaggatgcggcaaacaaaaaccctttctccagcgcttccggcgggttcgggagcactgccacctctaacacttcgaatctgttcggtaactccggcgccaaaactttcgggggcttcgccagttcatcatttggtgaacaaaaacctacaggaacctttagctcaggcggtggttcagtagcatctcagggcttcgggttctcctctcctaataaaactggtgggttcggggccgctcctgtgttcggaagccctcccacatttgggggatctcccggcttcgggggggtccccgcatttggcagcgcccctgctttcaccagccccctgggttcaacaggcggcaaagtttttggggaaggaaccgcagccgcttccgctggcggctttggctttgggtcaagctctaacaccacaagctttggaaccctggcttctcagaatgctccaacatttgggtcactgtctcagcagacctcaggattcgggacacagtcaagcggattctcaggttttggttccggcaccggcggattttccttcggcagtaataacagttcagtccagggattcggagggtggcggagttag

SEQ ID NO: 127129 - DNA, 6282 bp, Artificial Sequence
  Description of Artificial Sequence: Synthetic coding sequence
atgggcgatgagatggacgctatgataccagagcgcgaaatgaaagatttccaatttcgagccttgaaaaaagtgagaattttcgatagtcctgaggaactgccaaaggagagatcatcactgctagcagtgagcaataaatatggcttagtgttcgctggcggtgcgagcggcctccagatcttcccaaccaagaatctactgatccaaaataaacctggcgacgatccaaataagatagtcgacaaggtacaggggcttctggttcccatgaagtttccgatacaccatctggcactcagttgtgataatcttacactgtctgcgtgcatgatgtcctcggaatatggttccattatcgccttctttgatgttcggacattctccaatgaagccaaacagcagaaaaggccgttcgcatatcacaagcttcttaaggatgccgggggcatggttatcgacatgaagtggaatcccacagtgccatctatggtggctgtctgtctggctgatggctctatcgcagtcttgcaggttacggagactgttaaggtgtgcgccacacttccctccactgtggccgtgaccagcgtttgctggtctcccaaagggaagcaactcgccgttggaaagcagaacggtaccgttgtacaatatctgccaacacttcaggaaaaaaaagtgatcccatgcccccctttctacgagtctgaccacccagttcgcgtgcttgacgtgctatggataggtacctacgtgttcgccattgtgtatgccgccgcggatggcacacttgaaacttctcccgacgtggttatggccctgcttcctaaaaaggaagagaagcacccagaaatctttgtcaacttcatggagccttgttacgggagttgcacagaacgccaacatcactattacctgtcctatattgaagaatgggaccttgtgctagcagcgtctgctgcctccaccgaggtgtctatcctggcacggcagtcagatcagatcaactgggaaagctggctgttagaggactcaagtagagcagagttgcccgtgacagacaagtctgatgactccctgcccatgggagtggtggttgactatacaaatcaggtggagattactatttctgacgagaagaccctgcccccagccccggtcttaatgctgctgagtaccgatggagtgctctgccctttctatatgatcaaccagaatcccggagtgaagtctttgattaaaacaccggagaggctgagcctggaaggagagcggcagccgaaaagtccaggttccacccctaccacccccacaagctcgcaggcgccgcaaaagctggacgctagtgccgccgccgcaccagcttctcttcccccttcaagccctgcagctccaattgctacattttccttgctccctgccggcggagcccctactgtgttctcttttggcagcagtagtctgaaaagttccgccacagtgacaggtgagcccccgagttattcttctggttccgactcgtctaaggctgcaccaggtcccggaccttcaaccttctcctttgtcccccctagcaaagcctcactggcgccaacacctgccgcctcccctgtagctccttccgccgcatcattcagtttcgggtcctcaggattcaaacccacgctagaaagcacgccggttccctccgtaagcgcacctaacatcgccatgaagccttcctttccgccatcaacgtcggcagtgaaagtaaatctctccgagaactcatcacagtctgccccccccatgtctccattttcatctgcatctaaacccgctgccagcggccctctgagccaccctactccactttctgcccctcctagttccgtaccgttaaagtcgtcagtgctgccctcaccttccggccgatctgcgcagggaagcagcagccccgtcccctcaatggtccaaaagtcgccacggataactcctcccgccgcgaagcctggcagccctcaggcaaagtccctgcagccagcagtggccgagaagcaggggcaccagtggaaagactcggaccccgttatggccggcatcggtgaggagatagctcactttcagaaggagctcgaagagctgaaagcgcggacctctaaggcttgcttccaggtcggcacatctgaggaaatgaaaatgctaaggaccgaaagcgacgacctgcataccttcctgctggaaattaaggaaactaccgaaagcctgcatggcgatatatcttcactgaagaccacattgctggaaggctttgccggtgtggaggaagcaagggagcagaacgaaaggaatagggatagtggatatctacatttgctatacaagcggccattagacccgaagagcgaagcccagctacaggaaatccgcagactgcaccagtacgttaaattcgcggttcaggatgtcaatgatgtcctcgatctggagtgggaccagcacctcgagcagaagaagaagcagcggcacctgctcgtgccagaaagagagacgctgtttaacacgctcgctaataatcgggagatcatcaatcaacagaggaaacggctgaaccacttagtggattcgctccagcagctacgcctgtacaaacagaccagtctttggagtctctcctccgctgttccatctcagagtagcatacactcttttgacagtgacctcgagtcactgtgtaacgccctcctaaagaccaccattgagtcccacaccaaaagcctgcctaaggtccctgccaaactgtcaccaatgaagcaggctcagctgcgtaacttcctcgctaaacgaaaaacccccccagtgcgttccaccgctccagcgtctctcagtcgtagtgcctttctgtcacaacgatactacgaggacctcgacgaagtgtcctctacttcctccgttagccagagcctagagtctgaggatgccaggacatcatgcaaggacgatgaggccgtggttcaagcgcctcgccacgcccccgtcgtccgcactccctcaatccaacctagtctcctgccgcatgcagctccctttgcaaaatcccacctggttcatgggtcctcaccaggcgttatggggacgtctgtcgctacatccgcgtcaaagattatccctcaaggtgcagattctactatgttggccaccaaaacggtgaagcatggcgccccctcaccttcccacccaatcagtgcgccccaagccgccgcagccgctgctctacgccggcagatggcctcacaggctcccgccgtcaacactttgaccgagtcaaccctgaaaaatgtgccacaggttgtgaatgtacaggaattaaagaacaatcctgctaccccctccaccgcaaagaccccccacccggttttgacccctgttgctgccaaccaggcgaagcaggggtcactcatcaattcactgaaaccttccggtcccacgcccgcaagcggacagctgtcttcaggcgataaagccagcggcactgccaaaatagaaactgcagtcacaagcacaccttcagcttccgggcagttctctaagccattttcatttagccctagtggaactggctttaattttggaatcataactccaacaccctccagcaatttcacggctgcacaaggtgcgaccccaagcaccaaagagagttcacagcccgacgcattttcctccggaggaggtagcaaaccaagctacgaagccatacccgaatcctcccctcccagcggaatcaccagtgcctcgaacactactcctggggagccagccgcatccagctcccgccctgtggccccaagcggaactgcactgagtacaactagcagcaaactcgagactcccccttccaaactgggcgagctgcttttcccgagcagcctggccggggagaccttgggctccttctccggcctgagggttggacaggcagatgactctaccaaaccgacaaacaaagcgtcttccacctcattaacatcaacacagccaacgaaaacctccggggttcccagtgggtttaatttcactgccccccccgtcctgggtaagcacacagagcccccagtaactagcagtgctactacgacctccgtcgccccacccgccgccacttctacgtctagcaccgccgtcttcgggagtctgcccgtgaccagcgccgggagtagcggcgtcatatcttttggagggacctccctgtcagccggaaaaaccagtttctctttcgggagccagcagacaaactccaccgtgcctccatccgccccgcctcctacgaccgccgccacaccgcttccaacgtcttttcccacactgagctttggctcactgttatcctcggctaccactccctcgctgcctatgtcagcaggtcgcagcacagaagaagccacatcaagtgccctcccagagaagccgggggattcagaagtttcagcatccgccgcatccttacttgaggaacaacagtctgcacagctgccacaggctcctcctcagacctccgacagtgtgaaaaaggaacccgtactggcacaaccagccgtctccaacagcggcacagcggccagctctacctccctagttgcactctctgcagaggctactcccgctactactggcgttccagacgcacggacggaagcagtccctcccgcttcttccttctcagttcccggacaaacagctgttaccgccgcagccatcagtagcgccggccctgtagcggtggaaacctctagtaccccgatagcaagctcaactacctcaatagtggcgcccggcccaagtgccgaggctgctgctttcggtacagtaacctctggctctagtgtattcgctcaacccccagcggcgtcatctagtagtgccttcaatcaactgaccaataatactgccactgcccctagtgctacaccagtgtttggacaggtcgccgcctctacagccccttctctcttcgggcagcagacgggatctactgcatcaaccgctgcggccacaccccaggtatcctcgtctggctttagctcccccgccttcgggaccacagctcccggcgtgttcgggcagacaaccttcggtcaagctagtgtgtttggtcaatccgccagctccgccgcgtccgtgttctctttctctcagcccggtttcagctccgtgccagcattcggtcagccagcctcgtccacacctacaagcaccagcggcagcgtgttcggtgcagcatcctctacgtcttcatcgtcctcctttagtttcggccagtccagcccaaatacaggcggtggtctgttcggacagagtaacgcgcccgcattcggccagagcccagggtttggacagggcgggagcgtatttggtggtacgagtgctgctacgaccacagcagccacttccggattttcattttgtcaagcaagtggctttggctcaagtaataccggatccgttttcggccaggccgcctccactgggggaattgtctttgggcagcagtcttcctcatcttccggttctgtctttggatccggaaacactggccggggaggcggcttcttttctggcttaggcggaaaaccatctcaagatgccgccaataagaatccgttttctagtgcctccggcggatttggttccacagctacctccaacacgagtaatctgtttggcaacagtggcgcaaagacatttggcggattcgcctcttccagttttggcgaacagaaacccaccggaaccttcagctcgggtggtggaagcgtggcctcccaagggtttggttttagctcaccgaacaaaactggtggttttggagcagcccctgtgtttggaagcccccctacgtttggtggtagccccggttttggaggtgtgcctgcatttggttcggcaccagcttttacaagccccctcggttccaccggcggaaaggtgttcggagagggaactgcagctgcaagcgctggcggtttcggttccctggctatgtcactctctccgaccctaaagggcagactactgctcatgcgacctaaagcaggaggcgggcgcgaacaagccgcaccgggacgcaaatctaacgagtctcgctccttaggtcacctgtgcatggagagggctcttacctcccccctcaaggtgtgggagcagcagcagcaccatatattgcggcatgcaagggagtccgaatgcccacactttcggattacagtgcctactgacttctggttctgggaccctgagtag

SEQ ID NO: 127130 - DNA, 1308 bp, Artificial Sequence
  Description of Artificial Sequence: Synthetic coding sequence
atgaagtctagcctgctattaagaggcgtgcacttctgcttccacctgcctggcgcgacgccgtcgactaaggaaagctctcagcccgatgccttctcatccgggggcgggtctaagccttcctacgaggcaatccccgaaagctctcccccctctgggatcacttcagcaagcaatacaacacccggcgaaccggccgcgtcctcttcgcgacccgtggccccatccggtaccgccttgtcgacaacctcctcaaagctggagacccccccgagcaaactgggtgaacttttgttcccctcctcattggccggcgagacgctgggctcattttcaggactgagggtcggacaagctgatgactccaccaaacctactaacaaggcttcatctacttctttgacgtctacccaacccactaagacatccggtgtcccctcaggattcaatttcacggccccgcctgtcctaggaaaacacaccgaaccacccgtgacttcaagcgcaaccaccacttcagtggcacctcccgctgccacctcaacctcttctaccgccgtgttcggcagtctcccggtgaccagtgctggatccagcggagtcatttctttcgggggtaccagcctgagcgctggaaaaactagcttttcattcgggtcccaacagacaaattctaccgtacccccctcagccccgccacccaccactgccgccactccactgccaacttcctttcccacacttagcttcggctccctcctaagtagcgccaccacgccatccttgcctatgtctgctgggcggagcaccgaggaggcgacaagctccgccctcccggagaagcctggtgacagcgaggtaagtgcctcagccgcatcgttgctagaggagcagcagagcgctcagctgccccaggctccaccccagacctccgactctgtcaaaaaagaacccgtgttggcccagccagcggttagtaactccgggaccgctgcctcctcaacgagtctggtcgcgctcagcgccgaagctacccccgccacaacaggtgtgcctgatgcaaggacggaagcggtgccccccgcatcatcgtttagtgtaccaggccagacagccgtgaccgctgcggctatctcctctgctggacctgttgccgtggagacttcatctacacctatcgcatcctcgacaacatccatagtagcccccgggccctccgctgaggccgcggctttcggaaccgtgacatcgggatcatctgtgttcgcccagcctccggctgcctcgagttcctccgccttcaattag

SEQ ID NO: 127131 - DNA, 981 bp, Artificial Sequence
  Description of Artificial Sequence: Synthetic coding sequence
atggcggctttcgcagttgagcctcagggacccgctttagggagcgagcctatgatgctcggctctccaaccagtcctaagcccggtgtgaacgcacagttcctgccaggattcctcatgggggacctacccgctcctgtgaccccacagccaagatctatttccggcccatctgtaggcgtcatggagatgcgctccccgcttctggccggtggcagccccccgcagcccgttgtgcctgctcacaaagataagtcaggcgctccccccgttcgctccatctatgacgatatatcctctcctgggctgggatcaactccgctgaccagtcgacgacagccaaacatctctgtgatgcagagccctctggtgggcgtgacatccacccccggaacaggccagagtatgttttctcctgccagcataggtcagcccaggaaaacaactctctctcctgcccagctagaccccttttacactcaaggggattctctgacttcggaagaccacctggatgatagctgggtaaccgtgtttggcttcccgcaggcttcagcatcatacatcttgcttcagttcgcgcagtacggcaatatcctcaaacatgtgatgagcaataccggaaactggatgcacattcgataccaatcaaagcttcaagctagaaaggccctatctaaggatggaaggattttcggggagtctataatgatcggggtgaaaccttgcatagataaatctgtcatggagtccagtgacaggtgtgcactcagttcaccatctctggcattcactccaccgattaagacattgggtacgccaacccagcctgggtctacaccacgcatttctacgatgcgaccgttggccaccgcttacaaagctagtacaagcgattatcaggtaatctccgaccggcaaactcctaaaaaagatgagtccctcgtttcaaaagccatggagtatatgttcggttggtag

SEQ ID NO: 127132 - DNA, 930 bp, Artificial Sequence
  Description of Artificial Sequence: Synthetic coding sequence
atgatgttaggctcaccgacctcaccaaaacctggagtcaacgctcaatttctacccggcttcctcatgggtgatttacccgctccggtgaccccccagcctaggagtattagcggtccctctgtcggcgttatggagatgaggtcacccctactagcaggaggaagtcctccccagccagtcgttcccgctcataaggataaatctggtgccccccccgtgcgtagcatatatgacgatatttcttcccctggattaggctctacccccctaacatcccgacggcagcccaacattagcgtgatgcagtcgcctctggtgggggtgacatcaaccccagggacaggccagagtatgttttcacctgcatctattggacagccgagaaagactacattgagtcctgcacagttggatcccttttacacccagggagatagcctcacaagcgaggaccacctggatgattcttgggtgaccgtgttcggattcccacaggccagcgcgtcttacatcctgctgcaattcgcccagtatgggaacattctgaaacacgtgatgtccaatactggcaattggatgcatatacggtaccaatctaagttgcaggccagaaaggctctgtctaaggacggcagaattttcggagagagtattatgataggagttaaaccctgtatcgataagtcagtaatggagtcaagtgatcgatgtgctctatcaagcccctctctcgcgttcactcccccaataaagacactgggaacacctactcagcctggatcaacaccacggatctcaacgatgagacccctggcaaccgcctataaggcctccactagcgactatcaagttatcagtgaccgacagacgccaaagaaagacgaatcattggtgtcgaaggcgatggaatatatgttcgggtggtag

SEQ ID NO: 127133 - DNA, 576 bp, Artificial Sequence
  Description of Artificial Sequence: Synthetic coding sequence
atgttcagcccagctagcatcggacagcctagaaaaaccactctcagccccgcacagcttgatcccttctatacacaaggcgacagcctgacctccgaagaccacctggacgatagttgggtcacggtttttgggttcccccaggcttctgcgagctacatcctcttgcaattcgcgcaatacggcaatatactaaaacatgtgatgagcaataccggaaactggatgcatattaggtatcagagtaaacttcaggcacggaaggccctgtctaaagatggtaggatcttcggcgagagtatcatgatcggtgtaaaaccatgcattgacaagtccgtcatggaatctagcgatagatgcgctctgagctcaccctcccttgcctttactccccccattaagactctggggacaccaacacagcccggcagcacacctaggatttctaccatgcggccgctggccacagcttacaaggccagtaccagcgactaccaagttatcagcgatcgccagaccccgaaaaaggatgagagcctggtcagtaaggccatggaatacatgttcgggtggtag

SEQ ID NO: 127134 - DNA, 981 bp, Artificial Sequence
  Description of Artificial Sequence: Synthetic coding sequence
atgaaacaggacgcttccagaaacgccgcttatactgtcgattgcgaagactacgtgcacgtggtggagttcaatcctttcgagaatggggactccggcaacctcatcgcatacgggggtaataattatgtggtgattggtacgtgcaccttccaagaagaggaggcagacgttgaagggatccagtataagacgctccgcaccttccatcatggcgtcagagtggacgggatagcatggagtcccgagacacgactcgattctttacctcctgtgatcaaattttgtaccagtgcggctgacatgaaaataaggttgtttaccagcgacctgcaagataaaaatgaatacaaagtgctggaggggcataccgacttcatcaacggactggtgtttgatcccaaagaaggtcaggaaatcgcctctgtgtctgatgatcacacttgtcggatctggaacctcgaaggcgtccagacagcacattttgtcctgcactcccctggcatgtcggtgtgctggcatcccgaggaaacatttaagctaatggtcgcggagaagaatggcaccatccgtttttatgatctcctggcacagcaggccatcctctccctcgaaagcgaacaggtcccactaatgtcagctcattggtgcttgaagaatactttcaaggtcggggccgtggccggcaatgactggctgatctgggatataactcggagctcttaccctcagaacaagcggccagtgcatatggatagagcctgtctctttcgatggagtactatttccgaaaacctgttcgctacgaccgggtatcctggtaaaatggcttcacagttccagattcatcaccttggacacccacaaccaattttaatggggagcgtggcagttgggagcggtttaagctggcatcgtaccctaccactgtgcgtgataggaggcgaccataagctcctgttctgggtgactgaggtgtag

SEQ ID NO: 127135 - DNA, 156 bp, Artificial Sequence
  Description of Artificial Sequence: Synthetic coding sequence
atgaagcaggacgcctccagaaatgctgcctatactgtggactgtgaagactacgtgcacgtcgtggaatttaatccgttcgaaaatggtgactcgggcaatctgattgcatatgggggaaacaactacgttgtgattggtacatgcactttctag

SEQ ID NO: 127136 - DNA, 981 bp, Artificial Sequence
  Description of Artificial Sequence: Synthetic coding sequence
atgaaacaggatgccagccgcaatgcagcttatactgtggattgtgaagactacgtgcatgtggtcgagtttaacccgttcgaaaatggggactctgggaacctgatcgcctacggcggcaacaattatgtcgttattggtacgtgtactttccaggaagaggaggctgacgtcgagggtatccagtacaaaacactacgtacctttcaccatggcgtgagggtggatggcatcgcctggtcacctgagacaagactggacagccttccccctgtgataaagttctgtacgtctgccgcagacatgaaaattcgcctgtttacctcagacctgcaagacaagaacgaatataaggtgcttgaaggacacaccgattttatcaacggactcgtcttcgaccccaaagaggggcaagaaatcgctagtgtgagcgatgaccatacgtgtcgcatctggaacttggagggagtccagacagcccattttgtacttcactccccgggaatgagcgtgtgttggcatccggaggagactttcaagctgatggttgcagagaagaacgggacgataagattctatgatttactcgctcagcaggctatcctctcactcgagtcagagcaggtgccactgatgtctgctcactggtgcttgaagaacacattcaaggtaggcgctgtggctgggaacgattggttgatttgggatataacccgctcatcctaccctcaaaataaacggcccgtccacatggacagagcctgtctgtttaggtggagtacgatctccgagaatctcttcgctactaccggataccctggcaaaatggcctcccagtttcaaattcaccacctcggccacccccagccgattctcatggggagtgtcgccgtggggtctggcctgtcgtggcaccgcactttaccactttgcgtaattggaggggaccacaagctgttgttctgggtgaccgaggtttag

SEQ ID NO: 127137 - DNA, 1143 bp, Artificial Sequence
  Description of Artificial Sequence: Synthetic coding sequence
atggaggagatctatgccaaatttgtgtcccagaagattagcaaaacccgctggcgccctctgccaccggggagccttcagacagctgaaactttcgctacagggagttgggacaatgaagagaattacatctctctgtggtccatcggcgactttggcaacctcgacagtgatggtggattcgaaggagatcatcagttgctgtgcgatatacgtcatcacggcgatgttatggatttgcagttcttcgaccaggagcgaatcgtcgccgcctctagtaccggatgtgtgactgtgttcctccatcaccccaacaaccagaccctgagcgtgaatcagcaatggactacagcacactatcacacaggccccgggtcccctagctactcgtccgcaccgtgtaccggagtggtatgtaacaatccagagatcgtgacggtgggggaagacggacgcatcaaccttttcagggccgaccataaagaagcagtcaggacgatcgacaacgctgactcatcaacactgcacgctgtaaccttcttgcgcactccggaaattctgacagtgaactctataggacagctgaagatttgggactttcgccagcaaggtaatgaaccgtcccagattctctccctgaccggggatagggttccactgcactgcgtggacagacaccctaatcaacagcacgtcgtggccacaggcgggcaggatggaatgttgtcaatttgggatgtgaggcaggggacgatgcctgtgtctctgctgaaagcccatgaggcggagatgtgggaagtgcatttccatccaagcaatcccgaacacctgtttacatgtagtgaagacgggagcctgtggcattgggacgcgagtaccgacgtacccgagaagtcttctctattccatcagggcggtcgtagctctactttcctgtcacacagcatttccaatcaggccaacgtacatcagagtgttatctcctcttggctttccacggacccagctaaagatcggatagagattaccagcttactccctagccggtctctcagtgtcaacactctcgacgtgctgggaccttgcctggtttgcggtactgacgcagaagccatctacgtaacgaggcaccttttttcatag

SEQ ID NO: 127138 - DNA, 747 bp, Artificial Sequence
  Description of Artificial Sequence: Synthetic coding sequence
atgggcggacctctgagcctgggcactgactgcgcccacacagggtacaggcgagagctcacattatgtagccatcgcctgagacctaaggtgccttccaatcaaggctccgctgggagaggaggggcggagagaagggttctctgtcttcttttcgctgtccctgcggccgcagccttcggaatggaagaaatctacgcgaaatttgtgtcacagaaaatctcaaagaccagatggcgcccgctgccaccgggtagccttcagaccgccgaaacattcgctactggaagttgggataacgaagagaactacatatctctgtggtcgataggtgactttggcaaccttgactctgacgggggatttgagggggaccaccagctcctgtgtgacattcgacatcatggcgatgtcatggatctgcagttctttgatcaggagcggattgtggcagcttcttccacgggctgtgtaaccgtgttccttcaccaccccaacaaccagactcttagcgtgaaccagcagtggactacggctcactaccacacgggcccgggcagtccttcgtactcttcagcaccatgcacaggcgtggtttgcaataatcccgagattgtgactgtgggcgaggatgggaggatcaacttgttccgggcagatcataaggaggccgtcaggaccatcggcttggtgaccgagtgtcactctaccgtattaattgatatccccacgaacagtatgctgtag

SEQ ID NO: 127139 - DNA, 1143 bp, Artificial Sequence
  Description of Artificial Sequence: Synthetic coding sequence
atggaagagatttacgccaagttcgtgtcccagaaaatctcaaagactagatggaggccactccctcccgggtccctccagacagcagagacttttgccacaggctcctgggacaatgaggaaaattatatcagcctgtggtctatcggcgattttggcaacctcgatagcgatggaggcttcgagggcgatcaccagctcctctgtgacataagacaccacggagatgtcatggacctccagttctttgaccaggaacgcatcgtggccgccagttctactggctgcgtgacggtcttccttcaccaccctaataaccaaactttgtccgtgaaccagcagtggacgaccgcacattatcacaccggcccaggaagccccagttactcctcagcaccatgtacaggggttgtgtgcaacaatcccgaaatcgtgactgtgggggaggacggaagaattaatctgttcagagccgaccataaagaagcagtgaggactatcgacaatgccgacagctccacactgcacgccgtcacttttttgaggacaccggagatcctgaccgtgaatagtatcggccaattgaagatttgggacttccgtcagcagggcaacgagccaagccagatcctctctctgaccggggatagggtacccttacactgtgtcgaccgccatccaaaccaacaacatgtggtagcaacaggaggccaggatgggatgctgtctatatgggacgttaggcagggaaccatgcctgttagcctgttgaaggcacatgaagccgagatgtgggaggtgcattttcatccatcgaaccccgaacatctgtttacttgctccgaggatggctccctctggcattgggacgcctcaacagatgtcccggaaaaatcttcgctgttccaccagggagggcggagcagcacctttctgtcgcacagcatctcgaaccaagccaatgtgcaccagtcggtgatcagttcttggctttccactgacccagctaaagatagaatcgagatcactagccttctcccaagtcgcagtttgagcgtcaacactcttgacgttctgggcccctgtctagtgtgcggaacggacgcagaagccatatacgtaacaaggcatttgttcagctag

SEQ ID NO: 127140 - DNA, 1407 bp, Artificial Sequence
  Description of Artificial Sequence: Synthetic coding sequence
atggcgaaacgcaatgctgaaaaagaactgacagaccgcaactgggatcaagaggatgaggccgaagaggtagggacctttagcatggcctccgaagaagtcctgaagaatagagcgatcaagaaggcaaagagacggaacgtagggtttgaaagcgacactggcggggctttcaagggttttaaagggttagtggtcccctcaggcgggggacgcttttccggcttcgggagcggggcaggcggcaagccactcgagggattgtccaacggcaacaacattacgagcgcaccccctttcgctagcgcgaaagccgctgcagaccccaaagtggccttcggcagcctagccgctaatggtcccacgacccttgtggacaaagtgagcaacccaaagactaacggggactctcaacaaccatcctccagtggactcgccagtagcaaggcgtgtgttggcaacgcataccataagcagctagccgcgctcaactgttctgtaagagattggatcgttaagcacgtaaacaccaatccactttgtgacctaacccccatcttcaaagactacgagaagtacctcgcgaacattgaacaacagcatggcaattcaggtaggaatagtgagagcgaatcaaacaaggtcgccgcggagactcagtctccaagccttttcggatctaccaagctgcaacaagaatctacattcctgtttcacgggaataagaccgaggacacccccgacaaaaagatggaagtggcctcagaaaaaaaaacagatccctcatctctaggggctacatccgcgtcatttaactttgggaagaaagtagacagctccgtcctagggtccctttcctccgtgccactgacaggctttagcttcagcccgggaaattctagtttgttcgggaaagacaccacccagagcaaacctgtctcttctcctttccctactaagcctttagaaggccaggcggagggggacagtggggaatgtaaaggaggagacgaagaggagaacgacgagcctccgaaggtcgtagtgacagaggtgaaagaggaggatgcattttactctaagaaatgcaagctattttacaaaaaggataacgaatttaaggaaaagggcattggaaccctgcacctcaaacctactgcgaatcaaaagacacagttattggtacgcgctgataccaatctggggaacatcttgcttaatgtgcttataccacctaatatgccctgcacccgtacgggtaaaaacaatgtgttgatcgtatgtgtgcccaacccaccaatcgacgagaagaatgctaccatgccagtgaccatgctgatcagggttaagacctctgaggacgcagacgagctgcataagatacttctggaaaaaaaggatgcatag

SEQ ID NO: 127141 - DNA, 1323 bp, Artificial Sequence
  Description of Artificial Sequence: Synthetic coding sequence
atggcttctgaagaggtgctaaagaacagagccatcaagaaggccaagcgccggaacgtgggcttcgaatctgacacaggcggagcttttaaaggcttcaaaggtctcgttgtcccctcgggcggagggagattttctgggttcggttctggcgcaggagggaagccgcttgagggactctccaacggaaacaacattaccagcgcaccacccttcgccagcgcgaaagccgcagctgacccaaaagtggcattcggctcactggccgcaaacggtcctaccacgttagtggataaagtctctaaccccaagactaacggggattctcagcagccttcaagttccgggcttgccagtagtaaggcctgcgttggcaacgcgtaccataaacagttagcggccctgaattgctctgtgagagactggatcgtgaaacatgtgaatactaacccgctttgcgacctgactcccatcttcaaggattacgagaagtatctcgctaatatcgaacagcagcatggcaatagcggacggaatagcgaaagtgagtcaaacaaagttgctgctgagacgcagtctccatccctgtttggatcgacaaaactgcagcaggagtcaacattcctctttcacggcaacaagacagaggataccccagataaaaagatggaggtggcttccgagaagaaaactgaccctagctccttgggcgcaacctccgccagctttaacttcgggaagaaggtagactcttccgtcctggggtccttgagtagtgtgcctctgactggattcagtttcagccccggaaacagtagcctttttggcaaagatactacacaatcaaagcctgtgagctcacccttccccactaagcctctcgagggtcaagcggaaggagactcaggcgagtgcaaagggggagatgaggaggagaatgacgagcccccaaaagtggtggtaaccgaggtcaaagaggaggatgccttctatagcaaaaagtgcaaactgttttacaagaaggacaatgagtttaaggagaaaggaattggtacactgcatctcaaaccaacggccaaccagaaaacgcagctgctggtgcgcgccgacaccaacctgggaaatattctactcaatgtgcttatccctccaaatatgccctgtacgaggaccggtaaaaataatgtattgatagtttgcgttcccaatcccccaattgacgagaaaaacgcgaccatgcccgtcactatgcttatcagagtgaagaccagcgaggatgccgacgaacttcacaagatacttctggaaaagaaagacgcatag

SEQ ID NO: 127142 - DNA, 1323 bp, Artificial Sequence
  Description of Artificial Sequence: Synthetic coding sequence
atggcctctgaggaggtgctgaagaacagagccatcaaaaaggctaagcgcagaaacgtcgggtttgaatccgacacagggggggccttcaaaggctttaagggactggttgtgccatctggaggcggtcgttttagcggcttcgggagcggcgctgggggtaagcccttggaaggcctttcaaatggaaacaacatcaccagcgctccaccctttgcgtccgccaaagcggcggctgatcccaaagtggcctttggcagcctggctgcaaacggacccacaacgctcgtggataaagtgagtaacccaaagactaacggggactcacaacaaccgtcgagtagcggacttgctagcagtaaggcatgcgttggcaatgcctaccacaaacagttggctgctctgaactgcagcgtgagagattggattgtaaagcatgtgaacacaaatcctctttgtgacttaactcctattttcaaggactacgagaagtaccttgccaatattgaacagcagcacgggaacagtggcaggaatagcgaatccgaatctaataaagtggccgctgaaacccagagccccagtctatttggcagcactaaacttcagcaagagagtacattcctgtttcatggcaacaagaccgaggatacccccgataaaaaaatggaagtagcctcagaaaaaaaaaccgatccgagttcactcggagcaacctcagcatcctttaactttggtaaaaaagtggattctagcgtgcttggttcactgagttctgtccccctgaccggcttttctttcagccctggcaacagctccttattcggtaaggacactacccaatctaaaccagtcagcagccccttcccaaccaagcctctggaggggcaggccgagggagatagtggggaatgtaaaggaggggacgaggaggagaacgacgaacctcccaaagtggtggtgactgaagtgaaagaagaggatgcattctattctaagaagtgcaaactgttttacaaaaaagacaacgagttcaaggagaaaggcattgggactctgcatctgaagccaaccgcaaaccagaagactcagctgctggtgagggccgacacgaatcttggaaatatcctactgaacgtgctgatcccacccaatatgccgtgcacaaggacaggaaaaaacaacgtgctcatcgtttgcgtccccaaccctcctattgacgaaaagaacgccactatgcccgtgacgatgttgattcgcgtgaaaacgtctgaggatgctgacgaactgcataaaatcctgctggaaaagaaggatgcatag

SEQ ID NO: 127143 - DNA, 27 bp, Artificial Sequence
  Description of Artificial Sequence: Synthetic coding sequence
atggcatccgaagaggtgttgaagtag

SEQ ID NO: 127144 - DNA, 537 bp, Artificial Sequence
  Description of Artificial Sequence: Synthetic coding sequence
atggccaagcgtaacgcagagaaggagctgacggaccgtaactgggaccaggaagacgaggccgaggaggtgggcaccttttcgatggcctctgaagaggtactgaagaacagggccattaaaaaagcgaagaggaggaacgtggggtttgaatctgatactggcggggcttttaaaggattcaaaggcctagttgtccctagtggcggggggcgattctcggggtttggcagtggggccggtggcaagccactggaagggctgtcaaatggaaacaatatcacctccgcccctccgtttgcctcggccaaagctgctgcagatcccaaggtcgcatttggtggtgatgaagaggagaatgatgaacccccaaaggtagttgtgaccgaggttaaagaagaagacgcgttctactcgaaaaagtgtaagttattttacaagaaagataatgaatttaaagaaaaaggaattggtaccctgcatctcaagccaaccgccaaccagaaaacccagctactggtcagagccgatacctag

SEQ ID NO: 127145 - DNA, 138 bp, Artificial Sequence
  Description of Artificial Sequence: Synthetic coding sequence
atggcaaaacggaacgctgagaaggagctgacagatcgcaactgggatcaagaggacgaggctgaggaggtcggcacattctccatggcttccgaggaagtcctaaaaaaccgtgccattaaaaaggccaagcggtag

SEQ ID NO: 127146 - DNA, 657 bp, Artificial Sequence
  Description of Artificial Sequence: Synthetic coding sequence
atggaagtagcgtccgaaaagaagactgatccctcttcattaggtgccaccagtgcatcctttaacttcggcaagaaagtggattctagtgttctcggatcgctgtctagtgtccctctgacaggcttctcttttagtccagggaatagcagcttgtttgggaaagacaccactcagagtaaaccagtatcaagccccttccccacgaaacccttggagggacaggccgaaggggactcaggggaatgtaaggggggcgacgaggaagaaaacgacgagccaccaaaggtagtcgtgaccgaagttaaagaagaggatgcattttatagtaaaaagtgtaagcttttttacaaaaaagacaacgaattcaaagagaaaggcattgggaccctccacctgaagcctactgcaaaccagaagacccagctgttggtccgcgcggacacaaatcttggcaatatcctcctcaatgtgctgatcccccctaatatgccttgtacccgaaccgggaaaaataacgtgctcatcgtgtgcgttccgaatcctccgattgacgagaagaatgccactatgcctgtgaccatgcttatccgtgtgaaaaccagcgaagatgccgatgaactgcacaagattcttctcgagaagaaggatgcttag

SEQ ID NO: 127147 - DNA, 231 bp, Artificial Sequence
  Description of Artificial Sequence: Synthetic coding sequence
atggccaaaagaaatgctgaaaaggaacttactgatcggaactgggatcaggaggatgaagcggaagaagtggggactttttcgatggcctccgaggaggttctcaagaacagggccataaagaaagccaaacggcggaatgtgggattcgaagtgttgctcctgcaaatggccctccctccttggctgattaaattccagattccgaaactgatgggtactgtctcctag

SEQ ID NO: 127148 - DNA, 15 bp, Artificial Sequence
  Description of Artificial Sequence: Synthetic coding sequence
atggccaagcggtag

SEQ ID NO: 127149 - DNA, 33 bp, Artificial Sequence
  Description of Artificial Sequence: Synthetic coding sequence
atggctaagcggaacgccgaaaaagaactgtag

SEQ ID NO: 127150 - DNA, 1524 bp, Artificial Sequence
  Description of Artificial Sequence: Synthetic coding sequence
atggcgtttaattttggggcaccctctggaacctcaggcactgctgctgccaccgcggcacctgcagggggctttggaggcttcgggacaacctcaaccactgctggatccgctttcagtttcagcgcccccacaaacaccgggaccactggactgtttgggggtactcagaataagggattcggctttggaactgggttcggcactaccacaggaacttcaacagggctgggtactggcctgggaacaggactgggttttggcggcttcaacactcagcagcagcagcagacaacactggggggtctgttctcacagccgactcaagctcccacgcagagcaatcagttaatcaacacggccagcgccctgtccgctccaacccttttgggggacgagagggacgccatcctcgctaaatggaatcagctacaggcattctggggcacagggaaggggtactttaataataacataccaccagtagaattcactcaagagaacccgttctgcagatttaaagccgtcgggtacagttgcatgccgtctaataaggacgaagatgggctggtggtgctcgtgtttaataaaaaagagactgagatccggtcgcagcagcaacagctggtcgagagcctgcacaaagtcctgggcggtaatcagaccttgacggttaatgttgaggggaccaagactttacctgatgatcagacagaggttgtgatctacgttgtggaaaggagcccaaatgggacaagccgccgcgtgccagcaacgaccttgtacgcacacttcgagcaagccaacattaaaacacagctccagcaactgggagtgacactctctatgacgaggacagagttgagtcccgcacagattaaacagctgctgcagaacccccctgcaggtgtcgaccctatcatttgggaacaggctaaggtcgacaaccctgactccgagaagctgattcccgtgcctatggtggggtttaaggaactcctaagacgactcaaagtacaagaccagatgaccaagcagcatcagacccggttggacataatcagcgaggacatctccgaactccaaaaaaatcagaccacttctgtggccaagattgctcaatataagcgaaagctaatggacctgtctcatcggacgttacaggttttaatcaagcaggagatccaacggaaatccggttacgccatccaggcggacgaggagcagctccgggttcagctggacacaatacagggagaactgaacgcccccacacaattcaagggtaggctgaatgagcttatgagccagatacggatgcaaaaccatttcggagctgtgcggtcagaggagcgctactacatcgacgctgacctgctgcgggaaataaagcagcacttgaagcaacaacaagaaggcctgtctcacctgatcagcatcattaaggacgatcttgaggacattaaactggtcgagcacggtctcaacgaaactatccacatcaggggcggagtcttcagctag

SEQ ID NO: 127151 - DNA, 876 bp, Artificial Sequence
  Description of Artificial Sequence: Synthetic coding sequence
atgccctctaataaagatgaggatggcctggtagtgctcgtctttaacaagaaagaaaccgaaatcagaagccagcagcagcaactcgtggaatccctccataaagtcctgggaggtaatcagacattgacagttaatgtggaaggcaccaagaccctgccggatgatcagacggaggtggtcatctatgttgtggagagatcccccaacggcacaagtcggagggtaccagctacaaccctctatgctcactttgagcaagctaacatcaaaacgcagctgcagcagctgggcgtcacactctctatgaccaggactgagctttcaccagcacaaatcaagcagctgctacagaaccctccagctggcgtggatcctatcatatgggagcaggcaaaggttgacaaccccgacagcgagaagcttatccctgttccaatggtgggtttcaaggaactgttgcggagactgaaagtgcaggatcagatgacaaagcagcatcagacccggctggatgttttgatcaaacaagagattcagcgaaagtctggttacgccatacaggccgacgaagagcagctgcgcgtacagctggacacaatccagggggaactgaacgcccccacccagttcaagggacgcctgaatgaactaatgtcccaaattagaatgcagaaccactttggcgccgtgcgctctgaagagagatactatatcgacgcagatctgttacgcgagatcaagcaacatctcaagcagcagcaagaaggcctatcacacctgatatcaattattaaggatgaccttgaggatataaaactcgttgagcacgggttgaatgagactattcatatccgcggcggcgtctttagctag

SEQ ID NO: 127152 - DNA, 984 bp, Artificial Sequence
  Description of Artificial Sequence: Synthetic coding sequence
atgccgagcaataaagatgaggatggcctcgtggtactggtctttaacaagaaggagacagaaattaggtcgcagcaacagcaactcgtagagtccctgcataaggtgctcggcggcaaccagaccctaacagtaaatgtggaaggaacgaaaactctcccggatgaccaaacggaggtcgttatttatgtcgtcgagcgatctcccaatgggacatcacgccgcgtccccgcaacaaccttgtacgcgcattttgagcaggccaacatcaagacccagcttcagcaactcggcgttacactgtcgatgactagaactgaactgtcccctgcccagattaaacagctcttgcagaatccgcccgctggggtcgatcccattatctgggaacaggccaaagttgataatccagactctgagaagctgattcctgttcccatggttgggttcaaagagcttctgcgaagattaaaagttcaagatcagatgacaaagcagcaccaaaccagactggatattatctccgaagatattagcgaattacagaagaaccagacaaccagcgtagcgaaaattgcgcaatataagcgcaagctgatggatctttctcacagaacacttcaggtgctcatcaaacaggaaattcagcgcaagtcagggtatgcgattcaagctgacgaggaacaattgagagtgcagctggatacaatccaaggcgagttgaacgctccgacccagtttaaggggcggctaaacgagctcatgagtcaaataaggatgcagaatcacttcggggctgtgcggagcgaagagagatactatatcgacgcagatctccttcgtgagatcaagcagcatctgaagcagcagcaagaaggcttgtcacacctgatctccattattaaagatgatttagaagacatcaaactggtggagcatggcctaaacgaaacgattcatatacgcggcggagttttttcatag

SEQ ID NO: 127153 - DNA, 1380 bp, Artificial Sequence
  Description of Artificial Sequence: Synthetic coding sequence
atggcctttaacttcggggctccatcggggacatccggaaccgctgccgctactgcagctcccgcaggcggatttggagggtttgggaccacctccacaacagcggggtcggccttttcattcagcgcaccaaccaacactggaacaactgcactaggcggtctcttttcccagcccacgcaggccccaacacaatcaaaccagctgattaacaccgccagcgctctcagtgcacccaccctgctcggagatgaaagggacgccatcctggccaagtggaatcagctacaggctttttggggaacaggcaaggggtacttcaacaacaacatccctcctgtcgagtttactcaagagaatccgttctgtcgcttcaaagccgtaggatattcatgcatgccctctaataaggatgaagacgggctcgtggtgctcgtgttcaataagaaagagacagaaatacgatcccaacagcagcaactcgtcgagtccctccacaaagtattaggagggaatcaaactctcacagttaacgtggaaggtactaagacgctccccgatgatcaaactgaggtggttatatatgtcgtggaaaggagccctaatgggacgtcccgaagggtgcctgcaaccaccctgtacgctcattttgagcaagccaacatcaaaacacagctgcagcagctcggagtgaccctgtctatgactagaaccgagctgagccccgcccagatcaagcagctcttacagaacccccctgctggtgtggacccaattatctgggagcaggcgaaggtcgacaaccctgattctgaaaagctaatccccgtccctatggtaggcttcaaggaactgcttaggcgcctcaaggtccaagatcaaatgacgaaacaacatcaaactcggttggacattatatcagaagatatttccgagcttcagaagaatcagacgacatcagtagccaagatcgcacaatacaagagaaagttgatggacctaagccacaggacgctgcaggtgctgataaagcaagaaatccagcgtaagtctgggtacgcaatacaagctgatgaagaacaactgagggtacagctggacactatccagggtgagctgaatgcacccacgcagttcaaggggcgtcttaatgagctgatgtcccagattcggatgcaaaaccatttcggggcagtacggtccgaagagcggtactacattgatgctgaccttctgcgcgagattaagcagcaccttaagcaacagcaggagggactatcacatctcattagtatcatcaaggacgatctggaggacatcaaattagtggagcacgggcttaacgaaaccattcacatcagaggcggagtgttttcgtag

SEQ ID NO: 127154 - DNA, 582 bp, Artificial Sequence
  Description of Artificial Sequence: Synthetic coding sequence
atgagcgggtttaactttggagggacaggcgctcctaccggtggttttacattcggtaccgccaaaactgccactacaacgcccgccaccgggtttagcttttctacaagcggaacaggcgggttcaattttggggctcccttccaacccgcaacatccacaccatcgaccggactgttcagcctcgctacgcagacaccggccactcagacgactggatttacatttggaacagctaccctggcaagcggtgggacaggattcagcctgggcattggagcatccaaactgaatctctccaacacagccgctacacctgccatggcaaacccatctggcttcgggctcggctcgtccaatctcacaaatgcaatatcatccacagtaacttccagtcaggggactgctcccaccggtttcgtgttcggcccgtctactaccagtgtggccccagcaaccacttctggcggcttcagttttaccggcgggagcacagcgcagccaagcggctttaacattggaagcgcaggaaacagcgcccaacctacagctccagccacccttcctttcacgccagcgtag

SEQ ID NO: 127155 - DNA, 1569 bp, Artificial Sequence
  Description of Artificial Sequence: Synthetic coding sequence
atgtctggatttaattttggagggactggtgcacccaccggcggcttcacattcggcactgcaaagacagctactactacgcccgccacgggcttcagcttttccacctcgggaacaggcggattcaacttcggggctcccttccagcccgcaacaagcactccttccacaggccttttcagcctggctacacagaccccagcaacccagacaactgggttcacattcggcaccgccacgctagcatcaggaggaactggattctccctcggtattggggcttctaaactgaacctgagtaatacggcagcgacaccagccatggcaaaccccagtggttttggcctgggcagctctaacttaacaaacgcaatatcatccacggtgacgtcctcgcaggggactgctcccactggctttgtgtttggccctagtacgacatccgtagcacccgctacaactagtgggggattctcttttactgggggaagcacagctcagcctagcggatttaatattggaagcgccgggaactcggcacagcccacagcccccgcgacgctgcctttcacgcccgcaacacctgccgccacgaccgctggtgctacacagcccgccgcccctactcccaccgccactattacaagcacgggcccttcactgttcgcttctatcgccacagctcctacaagcagcgctaccactggactgagcctgtgcacgcctgtcaccaccgcaggcgcaccgacagccggcacgcagggctttagcctaaaggcccctggcgccgcctcgggaacatccaccactacgagtactgctgccactgctaccgctaccactactagcagctcctccacaacaggcttcgctcttaacctaaagcctctggcccccgcagggataccatcaaacaccgccgcagctgtcactgcacctcccgggcccggagccgccgcgggcgcggctgccagttctgctatgacctacgcccagctcgaaagtcttatcaacaagtggagcctcgagctggaagatcaggagaggcatttcctgcaacaagctactcaggtcaatgcctgggataggactctcattgagaacggggagaagatcacgtcactgcatagagaagttgaaaaggttaaactggaccagaaaagactggatcaggagctcgactttatattgagccagcaaaaggagctggaggatctcttgagccccctggaagagcttgtgaaggaacagtcgggaacaatttatctgcagcacgccgacgaggaacgagagaagacctacaaattggccgaaaatatagatgcccagcttaaacggatggcccaggacctgaaggacattatcgagcacctgaatacctccggggccccggcagatacatccgacccactccaacagatatgtaagattctgaacgcccacatggacagcctgcaatggatcgaccagaattccgctctgcttcaaagaaaagtagaagaagttacaaaggtatgcgagggaaggagaaaggaacaggaacgttcattccgtatcaccttcgactag

SEQ ID NO: 127156 - DNA, 1569 bp, Artificial Sequence
  Description of Artificial Sequence: Synthetic coding sequence
atgtcaggttttaatttcgggggaacaggtgcacctaccggaggattcaccttcggaacagctaagaccgctaccaccactcccgctacagggttttcgttttcaacgtccggcacgggggggtttaatttcggcgcaccgtttcaaccagccacctccaccccaagtaccgggcttttctccctggcgacacaaactcctgcaacccaaacaacgggatttacttttggaaccgcaactcttgcaagcggcgggacaggcttttctctcggaataggcgcctctaagcttaacctctccaacaccgctgccacccctgctatggccaacccttctggattcggcctgggcagctccaacctcacaaacgctattagtagcaccgtgacaagtagtcagggaactgcgcccacaggtttcgtgtttggtccgagtaccacatcagtggcaccagctacaacctctggcggattctcattcaccggcggctccacagcacagccaagtggttttaacatcggcagtgccggaaattccgcccagcctactgccccggctaccctcccatttactcccgccaccccagctgctaccactgccggggccacgcagcctgccgctccgactcctacagccaccataacatcaaccgggccgtccttgtttgctagcattgcaactgcccccacatcaagtgccactacaggtttgagcctgtgcacacccgtaaccaccgccggagcgcctaccgcggggacccagggcttctctctcaaggctcccggtgctgcaagtggaactagtacaactacgtctacagccgctacagcaactgccacaaccacaagtagctcatcaaccacaggcttcgcattgaatttgaaacccctggcaccagcaggcattcctagcaataccgctgctgccgtcactgcaccccccgggcccggcgcggccgctggagcagccgcatcgagcgcaatgacctacgctcagctggagtctttaattaacaagtggtcactcgagttggaagaccaggagcgccactttcttcaacaggcgacccaggtgaatgcttgggacaggacactgatcgagaacggcgagaagattactagcctacacagggaggtcgaaaaggttaagctggatcagaagcggttggatcaagagctggattttatcctcagccagcagaaggaactcgaagatttgctgtcaccattggaggagctcgtcaaagagcaaagcgggactatctacctgcagcatgccgatgaggagcgcgagaaaacgtacaagctggccgagaacatagacgcccagcttaaaagaatggctcaggacctgaaggatattatcgagcacctgaacaccagtggagctcccgccgacacgtccgatccactccagcaaatatgtaagattttgaacgcccacatggattccctgcagtggatagaccaaaacagcgcactcttacagaggaaggttgaagaagtgacgaaggtttgcgagggacgacgaaaagagcaggaacgcagcttccggatcacgttcgactag

SEQ ID NO: 127157 - DNA, 1569 bp, Artificial Sequence
  Description of Artificial Sequence: Synthetic coding sequence
atgtctgggttcaacttcggcggtacgggtgcccctacgggtggattcacctttggaaccgctaagactgcaacaactacacctgctaccgggttcagttttagcacgtctggcacaggcgggttcaactttggcgccccttttcagcccgccacctctactccatctaccgggctgttctcgctcgctacacaaactccagccacccaaaccaccggatttaccttcgggactgctacgctggcgagcggcggtactggcttttcacttggcataggcgcgtcaaagctaaacctgtccaacaccgccgccactcctgccatggctaatcctagcgggttcgggctcggatctagtaatttgacaaacgccataagctctactgtgacctcttcccagggtacagcccccacaggttttgtgttcggtccctcgacgaccagtgtggctccagccacaacctcgggcggcttcagttttactggcggatccacagcacagccgagtggatttaatattgggtcggccgggaattccgcacagccgacggctcctgcaactctgccctttacccccgcaaccccagcagccaccacagccggcgctacacagcccgctgctccaactcctaccgccacaatcacaagtaccggcccaagtcttttcgcctcaatcgccaccgccccgacttccagtgccactaccggcctttccttgtgcactccggtgacgactgcaggagctccaacggctgggacgcaaggatttagcctgaaagcaccaggggcagcgagtggaaccagcactacaacaagtaccgccgctaccgccacagcaaccaccactagctcctcctcaaccacagggtttgcactgaacttgaagcccctggctcccgccgggattcctagcaacacagctgcggccgtgaccgctccaccaggaccgggggccgctgctggtgcggctgcatcctctgccatgacatacgcacagctggaatccctaattaataagtggtccttggaacttgaggatcaagagcgtcactttcttcagcaggctacccaggtgaatgcctgggatcgcacattaatcgagaatggcgaaaagattactagccttcatcgtgaagtagagaaggtgaagctggaccaaaagaggctggaccaggagctggactttattcttagccagcaaaaagagctcgaggacctcctcagtccactggaagagctcgttaaagagcagtccgggaccatctatctgcagcatgccgacgaagagagagaaaaaacttacaagctggctgaaaacattgatgctcaattgaagagaatggcccaggacctcaaggacatcattgaacatctcaacactagtggtgcccccgccgatacttccgaccctctgcagcagatttgcaaaattctaaacgcccacatggacagccttcagtggatcgatcaaaattcagccctgttacaacggaaggtggaagaagttaccaaggtttgtgagggtcggcgcaaggaacaagagagatccttccgcattacatttgactag

SEQ ID NO: 127158 - DNA, 1971 bp, Artificial Sequence
  Description of Artificial Sequence: Synthetic coding sequence
atggaagaactagacggggagcccaccgtgaccctgatccccggtgtgaacagcaagaagaaccagatgtactttgactggggccccggcgaaatgctcgtgtgtgagaccagctttaataagaaagagaagagtgagatggtgccatcatgccccttcatttatatcatcagaaaagatgttgacgtgtattctcaaatactacgaaagttgtttaacgagtcgcacggcattttcctcggcctccagagaatcgacgaggaactgactggcaaatcccggaagagtcagcttgtccgggtgtctaaaaactatcgttcagtgataagagcatgcatggaggagatgcaccaagtcgctattgccgctaaagaccccgccaacggcaggcagttcagctctcaggtgtccattctgagtgcgatggagttaatttggaacttgtgcgagatcctgttcatcgaagtggcacccgccgggcccctattactgcacttgctggactgggtccggctgcatgtctgtgaagtcgatagtctctcagccgacgtgttggggtccgaaaacccctcaaagcacgactccttctggaacctcgtcaccattctggtgctccagggtagactcgacgaggctagacaaatgctctctaaggaggccgatgcgtccccagcatctgccggtatctgcagaatcatgggcgatctaatgagaactatgcctatacttagccctgggaatacacaaactctgactgagttggaattgaagtggcagcattggcacgaggagtgtgagcgatacctgcaggattcgacattcgcgacttcaccccacctggaatcccttctgaaaatcatgctcggagacgaggccgctctgctggagcagaaagaactcctgagcaattggtaccactttttggtgacacggttactgtacagcaacccaaccgtgaaacctatcgatctgcactactacgcgcaaagtagtttggacctgttcctcggcggtgaaagctcaccagagcctctggacaacatattgctcgccgcctttgagttcgacatccaccaggtgatcaaggaatgcagcatcgctttgagtaattggtggtttgtagctcacctgaccgacctgctagaccactgtaagttgctgcagtctcacaacctgtatttcggtagcaatatgagagaatttctgttgttggagtacgcctccgggctgtttgcccacccaagtctgtggcaactgggcgttgactactttgactactgcccagagctaggtcgcgtatcactcgagctgcatatcgaaaggattcccctgaacacagaacaaaaggcactgaaggtgctgaggatttgcgagcagcggcagatgactgagcaagtgcgaagtatatgtaagatactggctatgaaggctgtgagaaataataggcttggaagcgccctgtcctggagcattcgggcgaaagacgctgcctttgctacactagtgtccgatcggttcctgcgagactactgtgaacgcggatgcttttcagatttagatcttattgacaatctggggcctgcaatgatgctctcggatagactgacatttttgggcaaatatcgggagttccaccgcatgtacggcgaaaaacggttcgcggatgctgcgtcccttctactgagcctgatgaccagcaggatcgctccaagaagtttttggatgacactgcttacagacgcccttcctttgctggaacagaagcaagtcattttctctgccgagcagacatacgagcttatgagatgcttggaagacctcacttcccgcaggcccgtccatggcgagagtgacaccgagcagcttcaggatgatgatattgaaacgactaaggtggaaatgctacggctgtcgctagctcgaaacctggcccgcgctatcatccgcgaaggctcactcgaggggagctag

SEQ ID NO: 127159 - DNA, 1389 bp, Artificial Sequence
  Description of Artificial Sequence: Synthetic coding sequence
atggccgctagctcagctgccaggagtcctttctgccagcagtggtcaagttccggtacttgcgtgcgcttctttctgcttaagtggccccaggtgactatattggttcttcaggggcggttagatgaggctaggcaaatgttatctaaagaagccgatgcatcaccagccagcgccggcatttgccgaatcatgggggatctgatgcggacaatgccgattctgagtcccggaaacactcagaccctgactgagttggagctgaagtggcagcactggcatgaagagtgcgaaagatatctgcaggatagcacattcgccacatctccacacctcgaaagtctcctcaaaattatgcttggggatgaggctgccctgttggagcagaaggaacttttgtcaaattggtatcacttcttagtcaccaggctcttgtattctaatccaactgtcaaaccaattgacttgcactattatgcacagagcagcctcgatctcttcttgggaggcgaaagctctccagaacccctggataacattcttctcgcagcgttcgagttcgatattcaccaggtaatcaaagaatgttctattgcgttaagcaactggtggttcgtggctcatctaacagatctcttggatcattgcaaacttctccagtcacataatctttatttcggaagtaatatgcgcgaatttctgcttcttgagtacgccagcgggttattcgcacaccccagcttgtggcaactcggcgttgactactttgactattgtcctgaactaggccgggtcagcttagaacttcacatcgagcgcattccgttgaatacggaacagaaggccctcaaggtgctgagaatctgcgagcaacggcaaatgacagagcaggtccgctccatctgtaaaatcctggcgatgaaggctgtgcggaacaaccggctgggctctgctctgtcctggtcaatccgcgctaaggacgccgcgttcgcgacgttagtgtccgataggttcctgagagactattgtgagcgcggctgcttctccgatctggacctgatcgataatctcggaccggcgatgatgctgagtgacagactgactttcctcggcaagtacagggaattccacaggatgtacggcgaaaaacgattcgcagatgcagcaagcctcctcttatcactgatgacgagccggatagctccccgttccttctggatgactctattgactgatgctcttccgcttctggagcagaaacaggttaaagttgcagcggccgtggtattttttgcttgtcagtcgctgttggagctgagctgtatagctgtcgctgacgttcgcgtctccagcttcgtggtgcttccggtgcgtgtgtatagtccttag

SEQ ID NO: 127160 - DNA, 975 bp, Artificial Sequence
  Description of Artificial Sequence: Synthetic coding sequence
atggtccccagctgcccattcatctacatcatcaggaaggacgtcgatgtgtacagccagattctgcggaagctttttaacgagagtcatggaatttttctaggcctccagaggattgacgaggagttaacggggaaatcaagaaaaagccagctggtcagggtctcgaagaactaccgcagcgtgatccgcgcatgtatggaggaaatgcatcaagtcgcaatcgccgcaaaagaccccgcaaacggtcggcagtttagtagtcaggtcagcatattgtcagcaatggagctgatctggaatctttgcgagatcctgtttatagaagtggcacctgccggtcctctccttctacacctgctcgattgggtaaggctgcatgtatgcgaggtagattccctgagtgctgacgttctggggagcgagaatccttcaaagcacgattcattttggaacttagtgactatactcgtcctccagggcagattggacgaggccaggcagatgttgtccaaagaagcggacgcttctccggcctctgccgggatttgcaggatcatgggagatctgatgagaacaatgccgatcctcagtcccggtaatactcagaccctcacagaactcgagttaaaatggcagcactggcatgaggaatgtgaacgatatctgcaggactcaactttcgcaactagtccccatcttgagagcctgttgaaaatcatgctgggcgatgaagctgccctcttagagcaaaaagagcttctatccaactggtatcacttcttagttaccagactgctgtactcaaacccaactgtgaagcctatcgacctgcactactatgcccaatcaagcctggacctcttcctggggggcgagtcttctccggaaccactcgacaacatattgctggccgccttcgagtttgatatccatcaagttattaaagagtgtagagatgtgcacttaaagtag

SEQ ID NO: 127161 - DNA, 780 bp, Artificial Sequence
  Description of Artificial Sequence: Synthetic coding sequence
atgcgcgagttcttgctcctcgagtacgcctcgggattgtttgcccatcccagcctttggcagctcggcgtagattacttcgactactgcccagagttgggaagggtctctctggagttgcatatcgagcggattcccctgaacaccgagcaaaaggcactgaaagtcctcaggatttgcgaacagaggcaaatgactgagcaggtgagatctatctgtaagattctggctatgaaggccgtaagaaacaaccggctggggagtgcgttgagttggtctattagggccaaagacgccgcctttgcaacgttggtctccgatcggttcctccgagactattgtgaacggggttgtttttctgacctcgatttgattgataacctcggacctgccatgatgctctcagatagactcacatttctcgggaagtacagggagttccacaggatgtacggcgagaaacgcttcgctgacgccgccagcctcttgctcagtctcatgacctccagaattgctccacggagcttttggatgacgctattaactgatgccttaccacttttagaacagaaacaagtgatcttcagcgcggaacagacctatgagctgatgcgctgcttagaggatctgactagccgccgcccagtccatggtgagagcgacaccgaacaattacaggatgatgacatcgagactactaaagtggagatgctgaggctcagtcttgcccggaaccttgctcgcgctatcattagggaggggtctctcgaaggctcctag

SEQ ID NO: 127162 - DNA, 1833 bp, Artificial Sequence
  Description of Artificial Sequence: Synthetic coding sequence
atggtgccctcatgtccatttatatacatcatccggaaagacgtggatgtttatagtcagatattgcgcaaactgttcaacgaaagtcacgggatctttctcgggctgcagcgtattgacgaggaactgactgggaaaagccggaagtcacagctggtgcgggtgagcaagaactataggtcagtgatccgggcttgtatggaggagatgcaccaagtcgccatagccgccaaggatccagctaacggcaggcagttctcctcccaagtctccatcctttccgcaatggaactaatttggaacctgtgcgaaattctgtttattgaagtcgcccctgcaggaccactgctcttgcatctactggattgggtacgtctgcacgtctgcgaggtggacagcttaagcgccgatgtactggggtctgagaacccttcaaaacacgattctttttggaacctcgtgacaattctggtgttgcaaggacgactggacgaggctaggcagatgttgtcgaaggaagctgatgcctcacccgcctcagccggaatatgcaggatcatgggcgatctgatgcgtaccatgccaattttaagccctggcaatacacagactttgaccgaactggaattaaaatggcagcactggcatgaagaatgcgagagatacctgcaggattctacatttgctacctccccccatctcgaatccctgctaaaaattatgctgggggacgaagctgcattgcttgagcagaaagagctcttatcgaattggtaccatttcctggtcactaggttgttatacagtaacccaactgtgaaacccattgatctgcattattacgcccagtctagccttgacttgttcctgggtggcgaaagttcccctgagcctctggacaatattctgttagccgcattcgaatttgacattcaccaggtgataaaggagtgctccatcgcattaagcaattggtggtttgtcgcccatctaaccgaccttctggaccactgtaaattgctgcaatctcataacctgtattttgggagcaatatgcgggagtttctcttactcgagtacgctagcggcctgttcgcgcatccaagcttgtggcagcttggagtggactactttgactattgccccgaattaggcagagtctctttggagctgcatatcgaacgcatcccactgaacacagagcaaaaagccctgaaggtgctcaggatttgcgagcaaaggcagatgactgagcaagtgcgctctatctgtaagatccttgctatgaaggcagtgaggaacaacaggttgggatcagcgcttagctggtccattcgagccaaagatgcagcgttcgccaccctggtctccgaccggtttttaagggactattgtgagcggggttgcttttcagaccttgacctgatcgacaatttaggcccggctatgatgttgtccgacagacttacttttcttggcaaatacagagaattccaccgtatgtacggggagaagcggtttgctgatgccgcctctctcctcctgagcctgatgactagcagaattgcgccaagatctttttggatgaccctcctaacggatgcgttgcccctgctcgaacagaagcaggttatcttctccgccgaacagacttatgagctcatgcgctgtttggaggacctaacttcacgaagaccagtccatggtgaatctgacaccgagcagctgcaggacgacgatattgagaccacaaaggtggagatgttgcgtctttctttggccagaaacctagcaagagccattatccgcgagggatctttggaaggctcatag

SEQ ID NO: 127163 - DNA, 846 bp, Artificial Sequence
  Description of Artificial Sequence: Synthetic coding sequence
atgaaactcgccgctatgataaagaagatgtgtccctctgactccgagctgtcgatcccagcaaagaactgctatcgaatggtgatactggggtcctcaaaagtcggcaaaacagccatagtctcccggttcttgacaggtcggttcgaggatgcatacacgcccaccattgaagattttcacagaaaattttacagcatcagaggcgaggtgtatcagctggatatcctggacacctccgggaaccacccattccctgctatgcgcagactgagcattctgactggcgacgtgttcatcctggtattctcattagacaatagagactcctttgaggaggtgcagagactgcggcaacagattctggacaccaaaagttgtctgaagaacaaaacaaaagaaaacgtggatgtgccactggttatctgtggcaataagggggacagggacttctacagggaggtggatcagcgagagatcgagcagttagttggggacgacccacagcgctgcgcatacttcgagatatctgcaaagaagaacagctcgctcgatcagatgttccgcgcactgtttgccatggcaaagctgccgtcagagatgtcacccgatctgcacaggaaggtctcagtgcagtactgcgacgtcctgcataaaaaagcactgagaaacaaaaagctgttgagagcgggctctggcggcggcgggggcgatcctggtgacgctttcggcatcgttgcaccatttgctaggcggccatctgtacactcagatttgatgtatatccgagaaaaggcatctgctggatctcaagctaaggataaagaacgctgcgtgatttcttag

SEQ ID NO: 127164 - DNA, 1881 bp, Artificial Sequence
  Description of Artificial Sequence: Synthetic coding sequence
atggttctggaacttcctaaacgttggggcaaaaactcagagtttgaaggtggaaagagcaccgtaaactgtagtacaacccccgtggcggagcggtttttcacaagttctacaagcctcaccctcaagcacgcagcctggtatccttctgagatcctggacccgcacgtcgtgctcctgacttccgacaatgttattaggatctattctctacgcgagcctcagacccctactaacgttattattctgagcgaggccgaggaggagtctctggtgctgaacaaggggcgcgcgtataccgcgagtctgggcgaaactgcagtggcatttgactttggcccgctcgctgcagtgccaaaaaccctgttcggacagaatggcaaagacgaggtggttgcctatcctctctatatcctgtacgaaaatggcgaaacttttctgacctacatctccctgctacacagtccggggaacatcgggaagctgctcggacctttgcccatgcacccagctgccgaagataattacgggtatgacgcgtgtgccgtgttgtgcctaccatgcgtacctaacatcctggtgatagctacagagtctggaatgctgtaccactgtgtcgtcctagagggcgaagaagaggacgatcacacaagtgagaagagttgggattcaaggatagatttgatccctagcctgtacgtgtttgaatgtgtggaactggaattggccttaaaactggcctctggcgaggacgacccctttgactccgatttttcttgtccagtgaaacttcatagagaccccaagtgtccatctagatatcactgcacgcatgaagcgggcgtgcactccgtgggcctgacctggatccacaaactgcataaattcctgggaagcgacgaagaagacaaggacagtctgcaggagctgtccactgaacagaaatgttttgttgagcacatactgtgtactaagcctcttccctgccgccaacctgctcctatccgcggtttctggatcgtccctgacatcctggggccaacgatgatctgcattaccagcacctatgagtgtcttatatggcctctcctgtcaactgtacaccccgctagccccccgctactttgcaccagagaggatgtggaagtggcagagagccctttacgcgtactcgcggagactcctgatagttttgaaaaacatatccgaagcatactgcagcgaagcgtcgctaatcccgcattcctgaactgcttcacgcagttgcgtaagattaaagtggagaccctgtttctcagggcctcagaaaaagatatcgctccgcctcccgaggagtgtttacaactgctgtcccgagccacacaggtgtttagggagcaatacatattgaagcaggatctagccaaggaggaaattcagcgccgcgtgaagctactctgcgaccagaaaaaaaaacagctggaggacctgtcgtactgtcgggaggaaagaaagtcattgagggaaatggccgagcgactggccgacaagtacgaagaggctaaggaaaaacaggaagatattatgaacaggatgaaaaagctgttacatagcttccacagcgagctcccggtcctatcagattccgagcgggacatgaaaaaagagttacagcttataccggatcagcttagacatctgggaaacgcaattaaacaggtcacaatgaagaaagactaccagcaacagaaaatggaaaaagtgctgtctttgcccaagccaaccattatactgtctgcctatcagcggaagtgtatccagtcgattctcaaagaggaaggcgagcacattcgcgagatggtgaaacagatcaacgacatacgcaatcacgtcaacttctag

SEQ ID NO: 127165 - DNA, 2226 bp, Artificial Sequence
  Description of Artificial Sequence: Synthetic coding sequence
atggcagcggctgagggtccagtgggagacggcgagctctggcaaacttggctccccaaccatgtcgtctttctcagactccgcgaaggactcaagaaccaaagccccacagaagccgaaaaacctgcctcatcttcccttccctctagtccccccccccagctgctaacaaggaacgtcgtcttcgggttaggcggtgagctgttcctttgggacggcgaagattctagttttctggtggtgcgacttcgcggtcccagtgggggtggcgaggaacctgcgttgtcacaataccagagactgctatgtattaaccccccactcttcgaaatttaccaggtactactcagcccgacacaacaccacgtggccctgatcggcattaagggcttgatggtgctagagcttcccaagaggtggggcaagaacagtgagttcgaaggaggaaagtcaactgtgaactgctctacgacccccgttgcggagcgcttcttcacctcctccacctcactcacactgaagcatgccgcttggtatccgtcagagatcctcgatccccacgtggtcctcttgacctccgataacgttattcgcatatacagcctgagggagccgcagactcctaccaacgtgataattttgtctgaagctgaagaagaatcccttgtgctgaataagggaagggcatataccgcttcattgggtgagactgccgtcgcgtttgacttcggcccattagccgctgtgcctaagacgctgtttgggcagaacggaaaagacgaagtggtcgcatacccactctacatcctgtacgaaaacggcgaaaccttcctgacatacatcagtctgctgcatagccccggtaacatagggaaattacttggcccacttcctatgcacccagccgccgaggataactatggctatgacgcctgtgctgtcctgtgtctgccatgcgtgcctaatatcttggtgattgcgacagaatcaggcatgctgtatcactgcgtggttctagagggcgaagaggaggacgatcatacctcagagaagagctgggactcccgcattgatctgatcccatctctttacgtctttgaatgcgtcgagctagagctcgccttgaaactcgcttcaggagaagacgatccgttcgactcagacttttcctgcccggtgaaactgcaccgggatcccaagtgcccatctcgatatcactgcacgcatgaggctggggtgcattccgtgggccttacctggatacataaactccacaagtttctgggtagtgacgaggaagacaaggacagcctacaagaacttagcactgagcaaaagtgctttgtcgaacatatcctctgcaccaaacctctaccgtgcagacaacccgcaccaatcagggggttctggatagtcccagatatcctgggtcctacgatgatttgtattacaagtacatacgaatgtctgatttggcctctgctttctactgttcacccagcatccccccctctactctgcacgcgcgaagacgttgaggttgccgagagcccattaagggtgctggcagagactccagatagcttcgagaagcacatcaggtctatcctgcagcgctccgtggccaaccccgccttcctcaaagctagtgagaaggatattgcccctcctcccgaggagtgccttcagctgctgtcgcgcgccacacaggtttttcgagaacagtacattctaaagcaagacctagccaaggaggagatccagagaagggtcaaactcctgtgtgatcaaaagaagaaacagttagaggatctgtcctactgtcgggaggagaggaaatctcttcgggaaatggccgagcgcttagccgataaatacgaggaagctaaggaaaaacaagaggacataatgaaccgcatgaagaagctgctgcacagtttccacagcgagctgccagtcctaagtgactctgaaagagacatgaaaaaagagctccagctgatacccgaccagcttcgccatctggggaacgccataaagcaggtgaccatgaagaaggactaccaacagcagaaaatggaaaaggtcctctccttgcctaaacccaccatcatcctatctgcctatcagcgcaagtgtattcagtctatacttaaagaagaaggggaacacatccgcgagatggttaagcagatcaatgacattagaaatcacgtgaacttttag

SEQ ID NO: 127166 - DNA, 2460 bp, Artificial Sequence
  Description of Artificial Sequence: Synthetic coding sequence
atggatacagaggggttcggcgaattattacagcaggcagagcagcttgctgctgaaacggaaggtatctccgagctccctcatgtggaaagaaaccttcaagagatccagcaggccggcgaaagattgcggtcacggacactcacccgcacctctcaggaaacggcagatgtcaaggcttccgtcctgttagggtctagagggttggacatcagccacatctcccaacgactcgagagcctgtcggcagccacaaccttcgagcccctcgagcctgtgaaagacactgatattcaaggattcctaaagaacgagaaggataacgctttgttgtctgcaattgaggagtctcgtaagcgcacattcggaatggccgaggaatatcatcgcgagtccatgttagtggagtgggaacaggtgaagcaaaggattcttcacaccctcctcgctagtggggaagatgcactcgactttacccaagagtccgagcctagctacattagcgacgtaggcccacccggacgtagttctttagacaacattgaaatggcctacgcccggcaaatttatatctacaacgagaagatcgtgaatgggcacctccagcccaacctggtggatctatgcgcgagcgtggccgagctagatgataagagcatcagcgatatgtggaccatggtgaagcagatgacggatgttctgctgactcccgccactgatgcacttaagaaccgttctagtgttgaggtgcgaatggagttcgtcagacaggctctcgcatatttggagcagtcatacaagaactatacactggtcaccgtgtttgggaacctccatcaggcccagttggggggagtgccgggaacataccaacttgtgaggtccttcctgaatatcaaactaccagcccctttgccaggcctgcaggacggtgaggtcgaagggcatccggtttgggctctgatttattactgcatgcgctgtggcgatctcctagctgcgagccaggtggtgaacagggctcaacatcagcttggcgagtttaagacttggttccaggaatatatgaactcaaaggacagaagactttctcctgccaccgaaaataagctcaggctgcactaccggagagccctgaggaataatactgacccatacaagcgtgccgtatactgcatcatcggcagatgtgacgttacagacaatcaaagcgaggtggctgataagaccgaggactacctgtggttaaaactgaaccaggtttgtttcgatgacgatggcactagcagccctcaggacagacttactctgtcacagttccaaaagcagctgctggaggattatggggaatcacatttcacagtgaatcaacagccattcctttactttcaagttttgttcctaaccgcccagtttgaggcggcagtggcattcctattcagaatggagaggctaaggtgccatgcagtccacgtcgctctggtgctatttgagctcaagctactgctaaagtcttccggccaaagcgcccaactgttgtcccatgagccgggggatcctccttgcctacgacgattgaactttgtgagactgttaatgctatacacacgcaagttcgagagcactgatccccgggaagccctgcagtatttttacttccttagagacgaaaaggacagtcaaggcgagaatatgttccttagatgtgtttctgaattagtcatcgaatcacgcgaattcgacatgatcctcggaaaactggaaaatgacggatcccggaagccaggggtaattgacaagttcacgagcgataccaaacctattatcaacaaggtagcaagtgtcgcagaaaataaagggctattcgaagaagctgctaagttatatgacttggccaaaaatgccgacaaggtcctggaacttatgaataagttattatctcctgtcgtgcctcaaatttcggcccctcagagtaacaaggaaaggttgaagaatatggcgctgtctattgcagagagataccgcgcccagggcatatccgctaacaagtttgtggattcaacgttttacctgctccttgatctgattactttttttgatgagtaccacagcgggcatatcgaccgtgccttcgatatcatagagagacttaagctggtccccctgaaccaggaatctgtggaggagagggtggcagcattcaggaatttctcggacgagatacggcacaatttatctgaggtgttactcgcgacaatgaacatcttgtttacccagttcaagaggttaaagggcactagcccaagctcttcctcacgcccgcagcgggtgattgaggatagggatagccagctgcggtcccaagctcgcaccctgattaccttcgccggaatgattccttatcggacctccggcgataccaatgcccgcctagttcagatggaagtcctgatgaactag

SEQ ID NO: 127167 - DNA, 2091 bp, Artificial Sequence
  Description of Artificial Sequence: Synthetic coding sequence
atggcagaagagtaccaccgggaatcaatgctcgtcgagtgggaacaggtcaagcagagaattctccacacactgttggcctctggcgaagacgccctggatttcacacaggaaagcgagccaagctatatcagtgatgtgggccctccagggcggtccagcctggacaacatagaaatggcatacgcccggcagatctatatctataacgagaaaatcgtcaatggacaccttcagcctaatcttgtggacctgtgcgcttctgttgccgaacttgacgacaagagtatcagcgatatgtggactatggtcaagcagatgacagatgtcttgcttactcccgcgacggatgctctgaagaacagatcgagcgtggaggtgagaatggagttcgtgagacaagcccttgcttacctcgagcaatcttataaaaattacactttggttaccgttttcgggaacttacaccaggctcaactggggggtgtgcctgggacctaccaacttgttcggtctttcctgaatattaagctacccgcccctctgcccggactgcaggatggcgaagtggaaggacatccagtttgggctctgatttactattgcatgcgctgcggggatctcctagctgcttcgcaagtggtgaatcgagcccaacaccagctcggcgagttcaaaacatggtttcaggagtatatgaattcaaaagatagaagacttagcccagcaacagagaacaagctgcggttgcactatagaagagctttacgaaacaacaccgacccctataagcgagcagtttactgtatcatcggccgctgtgacgtcactgataatcagagtgaggtggcagataagactgaagactacctgtggctgaaactgaaccaagtgtgttttgacgacgacggcacttcttcgccccaagaccggttaacgctctcccaattccaaaagcagctcctcgaagattatggggagtcccacttcacagttaaccagcagccatttctttactttcaggtcctgtttctgaccgcacagtttgaagctgccgtggctttcctttttaggatggagcgactgcgctgccacgctgttcacgtggcactcgtcttattcgagctgaagctgctgttaaaatcttctggacagtccgctcaactgctcagccacgagcccggagaccccccctgtctgagacgcttgaatttcgtgcgcttgctcatgctatatacgcgaaagttcgaatcgacggaccctagggaggcccttcagtacttctattttctgagagacgaaaaggatagtcagggtgaaaacatgttcctcagatgcgtcagcgagctggttatcgaaagcagggaatttgatatgatcctggggaagctggagaatgacggatctagaaagcctggcgtcatagacaagtttacctcagacacaaaacctatcatcaacaaagtcgcctctgttgcggagaacaagggcctcttcgaagaagcggctaagctgtatgacttggccaagaacgctgacaaggttctagaacttatgaacaaactgctgtctcctgtcgtaccccagatttccgctccgcagtccaacaaggaacggttaaagaacatggctttaagtattgccgaaagataccgagcccagggaatctccgcaaacaagtttgtcgatagcacgttctatctactcctggacttgattacgttctttgatgagtaccactccggccacatagacagagccttcgacattatagagcgactgaagctggtcccactgaaccaagagtccgtggaggagagagtcgccgcattccgcaatttcagcgatgagataagacacaacttgagcgaggtcttattggccaccatgaacattctctttactcaatttaaaagactgaaggggacgtctcccagttcctcttcccgccctcagcgggttattgaggatcgggacagccagctgaggtcacaggccaggaccctcatcacctttgcggggatgattccgtacaggactagtggcgacaccaacgcacgtctggtccaaatggaagtactcatgaactag

SEQ ID NO: 127168 - DNA, 2091 bp, Artificial Sequence
  Description of Artificial Sequence: Synthetic coding sequence
atggcagaggaatatcacagggaatcaatgctggtggagtgggaacaagttaagcagcgcatcttgcacacactgctggctagtggggaggacgcccttgattttacacaagaatcggaaccttcatatatctctgatgtgggccccccgggccgttcttctcttgataacatcgagatggcctatgctcgacagatttacatctataatgagaagatagttaacggtcacctgcagcctaacttggtggatctgtgcgcgtccgtcgctgagctcgacgataagagcataagcgacatgtggacaatggtgaagcaaatgactgatgtgttgctgacgcctgcaactgacgctctgaaaaatagaagctcagtggaagtacgcatggaatttgtgcggcaggcgctggcctatctcgagcaatcatacaaaaactacacactcgttaccgtctttggcaatctgcatcaggctcagctcggaggggtccctggtacatatcagttggtccgctcctttcttaatattaagctgcccgcccctctgccaggactgcaagacggcgaggtggagggccatcccgtgtgggctcttatctactactgcatgcgttgcggggacctcctcgctgcatcccaagttgtaaacagggctcagcaccaactaggtgaattcaaaacctggttccaggaatacatgaatagcaaggaccgacgcctatccccagcgacagagaacaaattgcgacttcactaccggcgcgcattgaggaataacaccgacccatataagcgggccgtgtactgtataattggacgctgtgatgtgaccgataatcagagcgaagtcgcagataagacggaggactatctctggctgaagctgaaccaggtgtgctttgacgatgacgggaccagcagtccccaggaccgtctcacccttagccagtttcaaaagcagcttctggaagactatggagaatcccactttactgtgaaccaacagccttttctctatttccaggtcttgtttctgactgctcagttcgaggcagccgttgcattcttgttccgcatggagaggcttcggtgccatgcagtgcacgtggccctcgtcctgttcgaactcaaactcttactgaagtcatctggccagtcagcgcagcttctaagtcatgagccaggcgatcccccatgcctgcgcaggctcaacttcgtgcgcctgctcatgctgtacacaagaaagtttgagtccactgatccccgggaggccctccaatacttctacttcttacgcgatgagaaggactctcagggagagaatatgtttcttcggtgcgtcagtgaattagtaatcgagtcaagggagttcgacatgatcctgggcaagctcgagaacgatggaagtaggaaacccggcgtgattgataaattcacctccgataccaaaccaatcatcaacaaggtcgcgagtgttgccgagaacaaagggttattcgaggaggctgctaagttgtacgacctggctaagaacgccgataaagttctggagctgatgaacaaactcctgagtccagtcgtgcctcaaatctctgcaccgcagtctaataaggaaagactgaagaatatggccctatcgatcgcagaacggtatcgtgcccaggggatttctgcaaacaagtttgtggactcaaccttttatctactactcgatctaatcactttcttcgacgagtaccattccggacacatagatagagcattcgatattatcgagagattgaagttagtaccattgaatcaggagagcgtggaggagcgcgtggccgccttcagaaacttttctgacgagatcaggcacaacctgtctgaagtgctgctggctacaatgaacattctgttcactcaattcaagcggctgaagggaacatcaccttcttcgagttctcgcccacagagagtcatcgaggacagagattcacagctgagaagccaggcccggactctcatcacattcgcagggatgattccatatcggacatccggcgacactaatgctcgccttgttcagatggaagtgctgatgaactag

SEQ ID NO: 127169 - DNA, 5403 bp, Artificial Sequence
  Description of Artificial Sequence: Synthetic coding sequence
atgttcaacaagagtttcggcacaccttttggaggcgggaccggtgggttcggcacaacatctacattcggccagaacacgggatttggtacaacatctggcggagcgttcggaacttcggctttcggcagttccaacaacacaggaggtctgttcggaaactcacagaccaagcccggaggtctcttcggaaccagttcgttttctcagcccgctacaagtacgagcactgggtttggctttgggaccagtactgggacagctaatactttatttggcaccgcctctaccggaacttcacttttcagctctcagaataacgcattcgcacagaacaaaccaacgggcttcggaaatttcgggacttccacatcatcaggcggcctgtttggcactacaaatacaacctcgaatcctttcggcagcacatcgggttccctgttcgggccatcgtccttcaccgcagctccaacgggcacgaccattaagttcaatcctccaacaggaacggacaccatggtaaaggcaggagttagcaccaatattagtaccaaacaccagtgcataacagccatgaaagagtatgagagcaaatcgcttgaagaactgaggctggaagactatcaggccaatcgcaagggaccacagaaccaggtgggcgctggcacgaccacaggactttttgggagctcccctgccacatccagcgccaccggactcttctcatcgagcaccactaatagcggctttgcgtacgggcaaaacaagaccgcgttcggcacttcaacaacaggctttggcactaacccaggagggctattcgggcagcaaaatcaacagactacatcgctattctccaagccgtttgggcaggcaaccacgacccagaacaccgggttttccttcggcaacacttcaacgatcggacagccttctaccaacacaatgggattgttcggcgtcacccaagcttctcagccgggcgggctcttcgggactgccacaaacacatctaccggcacagccttcggcactggaactggtctgttcggacagaccaatacaggtttcggagcagttggcagtactcttttcggcaataataaacttaccaccttcggaagcagtacaacctcggcaccgagctttggtaccaccagcgggggactctttgggtttgggactaatacatcgggtaacagtatttttggcagcaagccagcacctggaactttgggaactggtctcggggctggctttggcacagcactgggtgccggacaagcctctctgttcggcaacaaccagcctaagatcgggggcccgctgggtactggagctttcggcgctcctgggtttaacacgactactgcaaccctgggcttcggcgcaccccaagcgccagtggccctgaccgaccctaacgcaagtgctgcacagcaggctgtactccagcagcatatcaactccctcacctattcaccctttggagacagcccactcttccggaatcctatgtcggacccaaagaagaaggaagagcgactgaagccaacaaatcctgctgctcaaaaagccctgaccacgccaactcattacaaactcacacctaggccagccacccgggtcaggccgaaggccctgcagaccactggaaccgcgaaaagtcatcttttcgatggcctggacgacgatgagccctcacttgctaacggcgcttttatgccaaagaagagcatcaagaagctggtgctcaaaaatctaaacaacagcaatctcttctcacccgtgaatcgggactctgagaatctagcgtccccgtctgagtaccccgagaacggagagaggtttagttttctgtcgaaacccgtggacgagaatcatcagcaggatggagacgaggacagcctggtatctcacttttacacaaaccccatcgccaagcctatcccacaaacaccggagtcagccggtaacaagcactccaactccaacagcgtggacgacactattgtcgcgttaaatatgcgtgctgctttgaggaacggactcgagggttccagtgaagaaacaagttttcatgatgagtcactgcaagatgatcgagaggaaatcgagaataattcttatcacatgcaccctgcgggaatcatcttgacaaaggtggggtattacaccatcccatcaatggacgacctcgcgaaaatcacaaatgaaaagggcgaatgtatcgtatctgacttcacgatcggccggaagggttacgggtcgatctactttgagggcgacgtgaacttaacgaacctcaatctcgatgacatcgtccacataagacgcaaggaggtggtggtgtaccttgacgacaaccagaaaccccctgtcggggaagggctcaatcgtaaggcagaggtcactttggatggggtgtggcccaccgataagacctccaggtgcctgattaagtcccccgatcgcctcgccgatatcaattatgaaggccggctagaggccgtaagccggaagcagggcgcacagtttaaggagtataggccagagactggaagctgggtgttcaaagtgtcccatttcagtaaatacgggttgcaggatagcgacgaggaagaagaagaacatccaagcaaaaccagtactaagaaacttaaaactgccccgcttccacccgcctcccagactacacctctgcagatggcccttaacggaaagccagctccccctccacagagtcagagtccagaggtggagcagctcggaagagtagtggaactggactccgatatggtcgacattacgcaggagcccgtgctcgacacaatgctcgaggagtcaatgccagaggaccaagaaccagtgagcgcctctacacatatcgcttcttccttgggaatcaatccacatgtgctgcagattatgaaggctagtctgctgactgacgaagaagacgtcgacatggccctggatcaaaggttcagtagactccccagtaaagcagatacttctcaggagatttgttctccacgcctgcccatctctgcaagccactctagcaagactagatcactcgtcggcggactgctccagtctaagttcactagtggggcattcctgtcaccctcggtgagcgtccaggagtgcagaactccacgggccgcttcattaatgaatatacccagtacttctagttggtcagttccccccccattgaccagcgtgtttacaatgccgtcccctgcccctgaagtgcccctcaagaccgtggggacacgtcgccagctcggtctggttccacgcgagaaaagcgtcacctacggcaaaggcaaactgctgatggatatggcactgttcatgggtcggagttttagagtaggttggggccccaactggacactcgcgaactcaggcgaacagctgaatggaagtcatgagcttgagaatcatcagatcgccgacagtatggaatttgggttccttcccaaccctgtcgccgttaagcctcttactgagtctccattcaaagtgcacctagagaagctgtctctgcggcagcgtaagcccgacgaagatatgaaactgtaccagacgccactggagcttaagctgaagcacagcaccgtgcacgtggacgaactctgcccgttgatagtgccaaaccttggagttgccgtcatccacgattatgccgattgggttaaggaagcatccggggatctgccagaggctcaaatcgtcaaacattggagtctgacatggactctttgcgaggccttatggggacatctcaaagaactggacagccagttaaacgaacctcgcgagtacattcagattctggagagacggcgcgctttctcccgctggctgtcttgcaccgccaccccacagatcgaggaagaggtttctctgacacagaagaactcaccagtggaggctgtttttagctatctgaccggcaagagaatttcggaagcctgcagcttggcccagcagagtggcgatcacagattggcactcctgctctcccagtttgtcggctcgcagtccgtgcgcgagctgcttacaatgcagctggtggactggcaccaactgcaagccgactcattcatccaggacgaacgtctccgtatattcgctctgctggcaggaaagcctgtgtggcaattatcagagaagaagcaaattaatgtgtgtagccaacttgactggaagcggtccctggcaatccacctgtggtacctccttcctcctacggctagtatcagtagggcccttagcatgtacgaggaagcatttcagaacaccagcgacagtgatcgatatgcctgcagcccactgccaagttacctggaggggagtggctgcgtgatcgccgaagagcagaatagtcagacgcctttgagggacgtgtgtttccacctgctaaagctgtacagtgatcggcactacgacctgaatcagctgctcgaaccacgctctatcaccgcagatcccctggattaccgcttgagctggcacctctgggaggtcctgcgggcgttgaactacactcacctgagcgcgcagtgtgagggagtactgcaggcttcttacgctggccagctcgagagcgaagggttgtgggagtgggctattttcgtccttctgcatatcgacaattcgggaattagagagaaggcagttcgcgaattattgacacgtcattgtcagctgctcgagacccccgaaagctgggccaaagagacctttctgacccagaagctccgcgtgcccgccaagtggattcatgaggccaaagcggtgagagcacacatggaaagtgacaagcacctggaggccctgtgcctgtttaaggccgagcactggaataggtgccacaaactgattattagacatttggcctcggacgctattatcaacgagaactacgactatctgaaaggctttctggaagacttggcccctcccgaaaggtcttctcttatccaggattgggagacatcgggactcgtatatttagactatatccgagtcattgagatgctccgacacatacagcaggtggactgttcaggcaatgacctcgagcaattgcatatcaaagtaacctccctgtgcagtagaatcgaacagattcagtgttattcggccaaagaccggcttgctcaatccgatatggccaaaagagtggccaatcttcttcgcgttgtgctcagtctccaccatcctcctgatcgtacctctgattctacgcccgatccccagagagtcccccttaggctgttggcgcctcatatcggccgcttgcctatgccagaagactacgccatggacgaactgaggagcctgacacagagctatctccgagaattggctgtcggatcactttag

SEQ ID NO: 127170 - DNA, 5181 bp, Artificial Sequence
  Description of Artificial Sequence: Synthetic coding sequence
atgtttaataaaagttttgggacaccctttggaggtggtaccggcgggttcggcactactagcaccttcggtcaaaatactggattcggcaccaccagcggtggggctttcggcacatcagcttttgggagctcaaataatacgggaggcctctttgggaattcgcagaccaagccaggaggtttatttgggacatcctcattttcccaacctgccaccagcaccagcacggggttcggttttggaacttcgacaggcaccgccaacactctctttggaaccgcttccaccgggaccagcctgttctcctcgcaaaataacgcctttgcccagaataagccaacaggctttgggaattttgggacttcaaccagtagcggcggtctgtttggaactacgaataccacatccaaccccttcggcagcacgagcgggtctttattcggaccatcctccttcacggccgctcccactggtaccaccataaagttcaatccacccaccggaaccgacactatggtgaaggccggggtgagcaccaacatttccacgaagcatcagtgcataaccgcaatgaaggaatacgaaagcaagtctctcgaagagctcaggcttgaggactaccaggccaacaggaagggccctcagaaccaggtcggggccgggactacaaccggcctctttggctcatcacccgctacgtcctccgcaacaggactgttcagtagctccacaactaactcaggctttgcctacggccagaataaaactgcgttcggtacatccaccacgggatttgggacaaaccctggcggtttgtttgggcagcaaaaccagcagaccacctcactgttctccaaaccattcggccaggccaccacgacccagaatacaggctttagctttggaaacactagcaccattggacaaccatctactaacaccatgggcctattcggtgtcacccaggcgtcccagccaggcgggctctttggcacggcaaccaacacaagcaccggaacagcctttgggactggcaccggtctttttggccagaccaatacaggctttggggcggtcggatccacattattcggcaataataaattaactacattcggcagctcaaccacaagcgcgccctcctttggtacaaccagcggggggttgttcggtttcgggaccaacacttctggtaattctatcttcggctctaaacccgccccgggcactttagggactggcttgggggcaggatttgggaccgccctcggtgcaggccaggcatccttattcggaaataaccagcctaagattggcggtcccctaggcacaggggcattcggagccccgggattcaacactaccacagccacactaggcttcggcgccccacaggcgcctgtagctctgactgatcctaatgcctccgccgcgcagcaagcagttctgcagcaacacatcaactccctgacctacagcccatttggtgactcccccctgtttcggaatccaatgtcagatccgaaaaaaaaggaagaaagactcaaaccaaccaatcccgcagcacaaaaggccctcactactcctacgcattacaagttaacaccacgaccagctacacgagtacggccaaaggctctgcaaaccactggaacagccaagagccatttgtttgacggtctcgacgacgatgagccaagcttggccaatggtgctttcatgcccaagaaatcaattaagaaactggtccttaaaaatcttaacaattctaacctgttctcccctgtgaatagggactccgaaaacctggccagcccatcagaatacccggagaatggagagcgattctcctttctgagtaaaccagtggatgagaatcaccaacaggatggcgatgaagactccttagtttctcacttttatacaaaccctatagccaagccaatcccacagactccagaaagtgccggcaacaagcatagcaattctaactccgtggacgatacaatcgtcgcgctgaacatgagagcagctctcagaaatgggctggaaggcagttccgaggaaactagcttccatgacgaatctcttcaggacgacagagaggaaattgaaaataatagttaccatatgcatcccgccggaatcatacttactaaggttggctattacactatcccgagcatggatgatctcgcaaagataaccaacgagaagggcgagtgtatcgtctccgatttcactatcggcaggaaggggtatggttcaatatatttcgagggcgatgtgaatcttacaaatctaaatctggatgacattgtgcacatccggcggaaggaagtggttgtgtacctggatgacaatcagaagccccctgttggcgaaggattaaatcggaaggccgaggtcaccctggacggggtgtggcccaccgacaaaacttctagatgcctaataaagtctccggaccgcctggccgacattaactacgaaggccgactggaggccgtaagccggaagcagggcgcccagttcaaggagtaccgtccagaaaccggaagttgggtgttcaaagtgagtcacttcagcaaatatggacttcaggacagtgatgaagaggaggaagaacacccgtccaagaccagtacaaagaagctgaaaacagcccctctcccacctgcgtcccagaccactcctctgcagatggcactgaacggtaaaccggcacctcccccccagagtcagtctcctgaagtggagcaactgggacgcgtagtggagctcgacagtgacatggtggacatcacccaggagccagtactagacaccatgttggaggaatctatgcctgaggaccaagagccagtgagcgcctccactcatatagcctcgtctctggggatcaatccacacgtgctccaaatcatgaaagcgtctctgctgacagatgaggaagatgtggatatggctctggatcagcgttttagtcgtctcccttccaaagccgacacgtcacaggagatctgttcacctagactgccaatatccgcaagccacagctctaagacccggtcactcgtcggcggtttactgcaatcaaaatttacaagtggcgctttcctctccccatcagtctctgttcaagagtgccgcacccctcgagctgccagtctgatgaacatcccaagcacatccagctggtctgtgccgcctccccttacaagcgtatttacaatgccttcaccggcaccagaggtacctctcaagacagtcggtaccaggcgccagctgggcctcgtccctagggaaaaatcagtaacctatgggaagggtaaactgttgatggatatggccctgtttatgggccgctcctttcgagttgggtggggaccaaattggacactggctaactcgggggaacagctgaatggctcacacgagctggagaaccatcagatcgctgatagcatggagttcggattcctgcccaatccagtagcagtgaaaccgctgaccgaatcgccctttaaggtgcatttggaaaagttgtctctgcggcaacgcaagcccgacgaggatatgaagctgtaccagacccctctggagctcaagctcaagcattcgaccgtgcacgtcgatgagttatgtcccctgatcgtccctaacctaggcgtggccgtcatccatgattacgccgattgggtgaaggaggcctcgggtgacctgcccgaggcacagattgtaaagcactggagcctgacttggactctctgcgaagccctttggggacatctcaaggaactggacagtcagctcaatgagccaagagaatacatccagatcctcgagcgccgtagagcattttcccgttggctgagttgtaccgcaactcctcagatcgaggaggaagtaagtctgacacagaaaaatagtcccgtggaagcggtcttctcatacctcactggcaagcggatatccgaagcgtgctccctggcccaacaaagcggcgatcacagactagcactgctactgtcacagtttgtcggaagccagtccgtgagagagctgctgactatgcagctagttgactggcaccagctgcaggcagacagcttcattcaggacgagagactccgcatttttgctcttctggccggtaagcctgtctggcaactgagtgagaaaaagcagatcaatgtgtgctctcagctggattggaaaaggtctctggcaattcatttatggtatctgctgccccccaccgcaagcatttcacgggctctgagtatgtatgaagaagccttccagaatacgagcgactccgaccgctacgcatgctcccctcttcctagctatttggagggatcaggctgtgtgattgcagaagaacagaacagccagacaccccttcgtgacgtgtgttttcatttgctgaagctttactccgattctattcgcgagaaggccgtcagagaactgctgactcgtcactgccagctactggaaacccccgagtcatgggcaaaggagacatttttgactcagaagctacgtgtgcctgctaaatggatacacgaggctaaagccgttcgcgcccacatggaaagcgataagcatttagaggcattgtgcctgttcaaggccgagcactggaatcggtgccataaactaattattagacacctggcctccgatgccattatcaatgaaaattacgactatttgaaaggcttcctggaggacctcgctcctccagaaaggtcatcgctcatccaggactgggagacctcaggcttggtctaccttgattacattagggtgattgagatgctgcggcacattcagcaggtggattgctccggtaatgacttagagcagctgcatatcaaggtcacttcactttgtagtcgcattgagcaaattcaatgttatagcgctaaggatcgtctagcccaaagcgatatggccaagcgggtcgctaatctgcttcgcgtcgttctctcactgcaccacccccctgatcggacatctgacagcacaccagacccacagagggtgccgctccgactgctggccccccacattggtaggttgcccatgcctgaggattatgccatggacgaactcagatccctcactcagagctatctacgggagctcgccgttgggtccctttag

SEQ ID NO: 127171 - DNA, 4917 bp, Artificial Sequence
  Description of Artificial Sequence: Synthetic coding sequence
atgttcaataaatcctttggaacgcccttcggtgggggtaccggaggttttggaaccacgtccacgttcgggcagaataccgggtttggcacaactagtggcggcgcttttggcacttccgcattcggatcctctaacaataccggcggactgtttggcaattcccagaccaagcccggaggtttgttcggcacctctagtttcagccagcccgcaacatccacaagcacgggctttggatttggaaccagcaccggcaccgccaatactctatttggaacagcatcgacaggcacctcccttttttcttcccaaaacaacgcattcgcacaaaacaagccaaccgggttcggtaacttcggaacatcaacttccagtggcggtctgttcgggacgactaacaccacgtccaacccttttggctctacctctggcagtttattcggtccctcctcattcactgcagctcccacagggacaactatcaaattcaatccccctacaggtactgatacgatggtgaaagccggtgtttcaacgaatattagcacaaagcatcagtgcatcaccgcaatgaaggagtacgagtccaagtccttggaagaattgcggctggaagactaccaggcgaatcgcaagggtccacagaatcaagtaggcgccggcacaaccacaggcttattcgggagcagtcctgccacgtcatctgcaactggcttattttcctcttctacaaccaattcaggatttgcttacggacagaacaagactgccttcggtactagtactactggatttgggacaaaccccggcgggctctttggccagcaaaaccaacagacaacgtctctcttttccaaacctttcggccaggcaaccacaacacagaacactggcttttccttcgggaacacatctacaatcggtcagccatctaccaacacgatgggactgttcggcgtaacccaggcaagccagcccggaggccttttcgggacagccaccaacacctccactggaaccgccttcgggaccggcactggcctgtttggacagaccaatacaggttttggcgctgtaggctctaccttattcggtaacaacaagttgaccacttttggcagctccaccacatccgccccaagttttggtaccaccagtggcggtctctttggatttggcactaatactagtggcaatagcatctttggctccaagcctgccccaggaacgctgggaaccggactgggagcaggctttggtactgccctgggcgcaggacaggccagcctgtttggaaacaatcagcccaagatcggtgggcccctaggaaccggggcttttggcgcccccgggtttaacaccaccaccgccacactcgggttcggggccccacaagctcccgtcgctctaacagatcccaacgcttctgctgctcagcaggccgtcctgcagcaacacattaattctttgacctattcccccttcggtgactcccccctcttccgtaatccaatgtcggaccctaaaaagaaggaggagagactgaagcctaccaacccagctgcccagaaggccctaacaacacctacccactataaactgacccctaggccggccacaagggtccggccaaaagcgctgcagaccactggcactgccaagtcacacctgttcgatgggttggatgacgacgagccatctctcgccaacggggcttttatgccgaaaaaatctatcaagaaactggtattgaagaatcttaataattcgaatctctttagcccggtgaaccgcgattcggagaatttggcgtcaccgtccgagtaccctgagaacggtgagcggttcagttttctcagtaagcccgtggatgaaaaccatcaacaagatggcgacgaggacagcctggtttctcacttttacacaaaccctatcgccaagccgatccctcagacccccgagtctgctggtaataagcatagcaacagtaatagcgtggatgacactattgtcgctctcaatatgcgcgctgccctaagaaatggcctggagggaagctccgaagaaacctcattccatgatgagagtctgcaggatgatcgggaagagatcgagaacaactcttaccacatgcatcccgctgggatcatcctgactaaggttggttattatactattcccagcatggatgatctggcaaagatcaccaacgagaaaggcgaatgtatcgtcagcgacttcacaattggacggaagggatatggtagcatatatttcgaaggtgacgtgaatcttactaacctcaatctagatgacattgtacatatcaggcgcaaagaagtcgtggtatatctagacgacaatcaaaaaccacctgtaggagaagggctgaataggaaggccgaagttacactggatggggtgtggcctaccgacaaaactagtaggtgtctcataaaatcgccggaccggttggccgacattaattacgaggggcgcctggaagccgtcagtaggaagcagggcgcccagtttaaggagtatcggcccgaaaccggcagctgggtgttcaaggtttctcacttcagcaaatacggcctgcaggacagcgatgaagaagaggaggagcatccgtctaaaacatccaccaagaagctgaagacagcacccctgccacccgcatcccaaactactccattacagatggccctaaatggtaagcccgccccaccaccccagtctcagagtcctgaagtcgaacagctgggacgagtcgtagagctagactctgatatggtggacatcactcaggagccagtgctcgatacgatgctggaagagagtatgcccgaggatcaggagccagttagcgcatctacgcacatcgcaagcagcctaggtattaacccacacgtcctacagataatgaaggccagccttcttaccgatgaggaggatgtcgacatggcactggaccaacgctttagccgcctgccaagcaaggcagatacctcccaggaaatctgctctccccggttacctatctctgcatcccacagctctaagacaaggtcgttggtaggtggactcctgcaaagcaaattcacatctggagcattcttgtccccctccgtctccgttcaggaatgccgcaccccccgggcagcctctctgatgaatattccgtccacttcctcttggtccgttccgccacccctaacctccgtctttacaatgccctcacccgcgcctgaggttccattgaaaaccgtcggaacccgaaggcagcttgggctggtgccccgcgagaagtccgtgacatatgggaaaggcaagctgctgatggacatggctctatttatggggcgctccttccgcgtgggatgggggcccaattggaccctggctaatagcggggaacagctgaatggcagccacgagttggaaaaccaccagatcgccgatagcatggagtttggttttctccccaacccagtcgccgttaagccactcacagaaagtcccttcaaagtgcatttagagaagttaagcttacgacaaaggaaacccgatgaagacatgaagttatatcagactcctcttgaactgaaactgaagcactccacagtccacgtggacgagctgtgtcccctaattgttcctaatttgggtgtcgccgtgatacatgactacgccgactgggtgaaagaggcgagtggtgacttgccagaagcgcaaatcgtcaaacactggtctctcacctggactctgtgcgaagctctttggggtcacctgaaggaactggacagccaactgaacgagcctagagagtacatacaaattttagaaagacgacgcgccttctcacgttggctgtcatgcacggccactccgcagatcgaagaggaggtgagcctgactcagaagaactcacccgtggaagcggtgttttcatatctgaccggcaagaggatctcagaggcctgcagtctcgcccagcagtctggagaccatcggctggcccttcttctctctcagttcgtgggtagtcagagcgtgcgagagctcttgacaatgcagttagtggattggcatcaattacaggctgacagctttatacaggatgaacgcctacgcatattcgccctcttggctggaaagcccgtgtggcaactcagcgaaaagaaacaaatcaacgtgtgcagccaattggactggaagaggtcgcttgcaattcacctgtggtacctcctcccacccacagcctcaatctcaagggctttgtccatgtatgaagaagcttttcagaacaccagtgactccgaccggtacgcatgttctcctctgccatcatatctcgagggatccggatgcgtgattgcggaggaacagaattctcagaccccgctcagagatgtctgcttccacctccttaagctatatagtgatagcattagagagaaagccgtgcgagaacttctgacccgtcactgtcaactgcttgagacgcctgagtcctgggctaaggagacatttttaacgcagaaacttcgcgtgcctgccaagtggatacatgaggctaaagccgtgagggcccacatggagagcgacaagcatctggaagctctgtgtctgttcaaagccgaacactggaatcggtgccacaagctgatcatccggcatctggcgtcggacgcaatcattaacgagaactacgattacctgaaaggctttctcgaggacctcgcaccccctgagaggagctccttgattcaggactgggagaccagtggactggtgtacttggattatatccgcgttatagaaatgctgcggcacatccagcagatagccctcttctgtgtggaatggatcgcccaagtcatgacctggagttcttatacttccaaatag

SEQ ID NO: 127172 - DNA, 2763 bp, Artificial Sequence
  Description of Artificial Sequence: Synthetic coding sequence
atgttcaacaaatcttttggaaccccattcggaggcggcactggaggatttgggacaacgagcacctttggtcagaatactggctttggaaccacatctgggggggcattcggaaccagtgcctttgggagctctaataacacaggtggactgttcggtaatagccaaaccaaaccgggaggtctgttcggcacttcttccttctctcaaccagccacaagcacctcaaccggatttggattcggaacatccaccggtacagctaataccctcttcggcacggcttccacgggcacgtcccttttttcctcacagaataacgccttcgcgcagaataaacccacagggttcgggaactttggcacatcaacctcttcaggcgggttgtttgggaccactaacaccactagcaacccattcgggtctacctccggcagcctcttcggacccagctctttcactgcggcgcccacgggcacaacgattaagtttaatccacctactggaaccgataccatggtaaaggccggcgttagtacaaacatctccacaaagcaccaatgtataactgcaatgaaagagtatgaatctaaatccttggaagagctccgtttggaagattatcaggccaatcgaaaggggccacagaatcaggttggcgctggcaccacaaccggactgttcgggagttcacccgctacatccagtgccacaggcttattttcatcctccaccactaacagtggattcgcctacgggcagaacaagacggccttcggaacttcaacgactggatttggaaccaaccctggggggttgtttggccaacagaatcagcagactacgtccctcttttctaagccctttggacaagcgacaactactcaaaataccggatttagcttcgggaacacttcaaccataggacaacctagcaccaacacgatgggtctgtttggcgttacacaagcatctcagcctggcggcctgttcggcacagccaccaacactagtacaggcactgcctttggcactggtactggattatttggccagactaatactggatttggcgccgtaggctctactttatttgggaacaacaagctcaccacattcggctccagcacaaccagcgccccaagctttggcaccacttctggcggattgtttggcttcgggactaatactagcggcaattcaatttttggtagcaagcctgcaccaggaacactcggcaccggactgggggctggattcggaacggccttgggggccgggcaagcgtcgctctttgggaataatcagcctaagattgggggtcctctgggcacgggcgcattcggtgcccccgggttcaacactacaaccgcgacactgggattcggtgccccgcaggctcccgtggcattaactgaccctaacgcctccgctgcgcagcaggctgtgttacagcaacacatcaacagtctgacttatagccccttcggcgactcgcccctattccggaatcccatgtcagatcccaaaaagaaagaggagaggttgaagcccaccaacccagcagctcagaaggcactgaccacaccgacccactacaagctcacaccccgccccgcaaccagagtgcgtccaaaggcgctccagacaaccggtactgccaaatcccacttgtttgacgggctggacgatgatgagcccagcttagcaaacggcgcttttatgcccaagaagagcatcaagaagttggtgctgaagaaccttaacaattcaaatcttttcagcccagtgaaccgcgatagtgagaacttggcttctccttccgaataccctgagaacggagaaaggtttagctttctctcaaagcctgtggatgagaaccatcagcaggacggggatgaagacagcctggtgagtcacttttacacgaaccccatagccaaaccaataccacagacaccagaatctgcagggaataagcattccaactccaactccgtcgacgacaccattgttgctctcaatatgcgggcagccctgaggaacggcctggaaggatcgagcgaagagacatcattccatgatgagtcactccaggatgatagagaagagatcgaaaacaacagctaccacatgcatccagcaggaattatcttgaccaaggtgggctactacaccattccaagcatggatgatctcgcgaagatcacaaacgagaaaggagagtgcatagtcagtgactttaccattgggcggaagggatatggaagcatctacttcgaaggggacgtgaacctgaccaatctgaacctagacgatattgtccacatccgccgtaaagaagtggtggtctatctagatgacaatcaaaaaccccccgtaggagaaggactgaaccgaaaggctgaagtcaccctggatggagtgtggcccacagataaaacctcacggtgtctgataaagtctcctgatcgactggcagacatcaattacgaaggccgcctggaagctgtgtcaaggaagcagggagctcaatttaaagagtacagaccagagacaggctcatgggtgttcaaggtgtcacacttcagtaagtacggcttgcaagattctgacgaggaagaggaggaacacccgtctaagactagtaccaaaaagttgaaaactgccccacttccccctgcatcgcagactactcctctacagatggctctgaacggaaagcccgcaccaccaccccaggtggagaagaagggacaatag

SEQ ID NO: 127173 - DNA, 2814 bp, Artificial Sequence
  Description of Artificial Sequence: Synthetic coding sequence
atgtttaataaatcattcggcactccgtttggaggcggtaccggcggatttgggactacgtccacgtttggccaaaacaccggctttggaaccacgagtggtggagccttcggtacaagcgccttcggatcctcaaataatacaggcgggctatttggaaacagtcagaccaaacccgggggtctctttggtacaagcagcttctcccagccagccacttccacaagcaccggctttggatttggaacatccacagggacggctaacacacttttcgggaccgcgagtactggtacttcactcttttcgagtcagaataacgcctttgcccagaacaagcctacggggttcggaaactttgggacaagcaccagctccggcgggcttttcggcactacgaatacaacctctaatcccttcggcagtactagtggctctctctttggccccagtagcttcacggccgcacctacaggaaccacaattaaatttaacccaccaacaggcacggatactatggtgaaagcaggcgtgtcgaccaacatttcaactaagcaccagtgtatcacagcgatgaaagagtacgagtccaagtcccttgaggagctcaggctggaagattatcaggcgaataggaagggacctcaaaaccaggtcggtgcaggaacgacgactggcttgtttggcagttcacctgccacctccagcgccaccggccttttcagttcttcgaccaccaattctggcttcgcttacggtcaaaacaagacagcctttggtacatccactacaggattcggcacgaaccctggcgggcttttcggtcagcagaatcagcaaacaaccagcctcttctctaaaccatttggacaggcaaccacaacacagaacactggcttttcattcggcaacacctcaacaataggccagccttcaactaacaccatggggctgttcggtgttacacaggcaagccagccaggaggcctgttcggtactgccacgaatacctccacaggcaccgcattcgggactggcacagggctatttggtcaaacaaataccggcttcggggccgtggggagcaccctttttggaaataataagctgaccacatttggctcatctactacatcagcaccttcattcggtacgactagcggtggactgtttggcaacaaacctaccctgacgcttgggactaacactaatacatccaatttcggattcgggactaacacatcaggcaacagcatttttggcagcaagcctgctcccggcacgctcggaactggcctcggtgcaggattcggaaccgctttgggtgctggccaggccagcctgttcggaaataatcaacctaaaattgggggaccacttggtactggagcttttggggctcccggattcaatactactacagccacactaggctttggagcccctcaagcccccgtggccctcacagaccccaatgcaagcgcggcacagcaagcagtactgcagcagcacattaatagccttacatactccccttttggtgactctcctctattcagaaacccgatgtcagatcccaagaaaaaggaagaacggctcaaacccaccaaccctgccgcgcagaaggccttgacaacgccaacacattacaagctgacgcccagacccgctaccagagtcaggcccaaggccctgcagaccacaggcactgcgaagtcgcacttattcgacggattggacgacgacgagccctctctggccaacggggcctttatgcctaagaagagtatcaagaagctggtgcttaaaaacctgaataactcgaacttgttcagccctgtgaatagagattctgagaacctcgctagtccaagtgaataccctgagaacggagagcgcttttcctttttgtccaaacctgttgacgagaatcaccagcaggacggggacgaggacagcctggtttctcacttctataccaaccccattgcaaaaccgatccctcagacccccgaaagtgcgggaaataaacattctaacagtaactccgtggacgacacaattgtcgcactgaacatgcgagctgcactgaggaacggcctggaaggtagcagcgaagaaacgtcgtttcatgacgaaagcctccaagacgatcgggaagagatcgagaacaattcttatcacatgcaccccgccggcatcattcttaccaaagtcggctactatacgattccatccatggatgacctggccaagatcacgaatgagaaaggcgaatgcatcgtttctgactttaccatcggacgcaagggttatggtagtatatactttgagggcgacgttaacttgactaacctgaacctagacgatatagtccatatacggcggaaagaggtggtggtgtatctcgacgataatcaaaaacctccagtgggagagggcttaaatcggaaggctgaggtgacgttggacggagtatggccaacggacaagacatcccgatgccttatcaaatcacccgacaggttggcggacattaactatgaggggcggctggaagcggtgagtcggaagcagggtgcccaattcaaggaatatcggcctgagactggttcatgggtgtttaaagtgtcccatttttccaaatacggtttacaggatagtgatgaagaagaggaggagcacccaagtaaaacaagcaccaaaaagctaaaaactgctcccttgcctcccgccagccagaccacccctcttcaaatggcacttaacggcaaaccggctccacccccgcaagtcgagaaaaaggggcagtag

SEQ ID NO: 127174 - DNA, 1731 bp, Artificial Sequence
  Description of Artificial Sequence: Synthetic coding sequence
atgtctaccgggtttagctttggaaccggggcttcttctaatcctagtgttggactaaatttcggaaatctcggcagcacgagcacccccgcgactacctccgcaccatcaagcggttttggaaccggactgtttggttcgaagcctgccaccggcttcacactggggggtaccaacaccggaatcgcaactacaattactacgggactgaccctgggtacgcccgcgacaacctctgcagctactacgggcttctccctgggctttaataaacctgctgcctcggccacaccattcgctctgcctatcacaagtacaagcgcttccgggctcactttgagttctgctctgacctcaacccccgctgctagcactgggtttacactgaataacctgggcgggacaacagctactacaactactgcgtcaacagggctgtctctggggggtgctcttgccggccttggcggaagcctgttccagtccacaaatactggaacctcaggacttggccagaatgcccttggtcttactttaggaaccacggcggcgacctcaaccgccgggaacgaagggcttggtggcattgacttctccagctcttcagacaagaaatctgacaagacgggcactagacccgaagatagcaaagccttgaaggacgaaaaccttccccctgtgatttgtcaggatgtggagaacctgcagaagtttgtgaaagagcagaaacaggtgcaagaggagattagccgaatgtccagtaaagccatgctgaaagtgcaggaggacattaaggcgttgaaacagctgctgagcctggctgctaatgggatccaacggaatacccttaatatagataagctaaagatcgaaacagcccaggaactaaagaacgctgagatcgctctgcggacccagaagacaccccctgggctacaacatgagtacgccgctcccgctgactatttcaggatcctggtgcagcagtttgaagtgcagttacaacagtaccggcaacaaatcgaggaactcgaaaaccatctggccacccaggcaaataacagtcacatcacccctcaggacctctctatggctatgcagaagatttaccagacctttgtggctctggccgcccagctccagagcattcacgaaaacgtcaaggtcttaaaggagcaatatctgggctataggaagatgttccttggggatgcagtcgacgtgtttgaaacaagaagagcggaagcaaaaaagtggcagaacaccccaagagtcacgacaggtcctacacccttcagtactatgccaaacgccgctgcggtggctatggccgcgactctgacacaacaacaacagccagccacaggtccccagcctagcctgggcgtatcatttggaaccccttttggatcagggattggcacagggcttcagtcctctggactcggatcctctaatctcggcggttttggcaccagctccggctttggatgctctaccactggagcctcgaccttcggatttggtacaactaataagccatccggctctctctcagccggctttggaagttcctctacatccggatttaacttctctaaccccggcatcacagcctctgccggcctgacctttggggtctcaaatcctgcatcagcaggctttggtactgggggtcagctgttgcagctgaaaaaaccccctgctgggaacaagaggggaaagcggtag

SEQ ID NO: 127175 - DNA, 1764 bp, Artificial Sequence
  Description of Artificial Sequence: Synthetic coding sequence
atgtctaccggttttagtttcgggtcgggaacactgggctccactacagtggcagccgggggcacgagcacagggggagtattcagcttcggcactggagccagttctaatccatcggtcggtctcaactttgggaaccttggctccacctcaaccccagctaccacatctgccccatcgagcggattcggtacaggcttattcggctcgaagcccgctactggttttacattgggtggaactaacacaggaaccccggccaccactagcgccgcaaccactggcttcagtcttggttttaacaaacccgccgctagtgcgacaccgttcgctctccctatcaccagtaccagtgctagtggactgactctcagctctgccctgacgtccaccccagccgcaagtaccgggttcacactgaataatctcggcgggacaacggctaccaccacaactgccagcaccggcttatcactcggcggagccctggccggcctgggagggtcgctgttccagtccacaaatactggcacttcagggctgggccagaacgcactggggcttacgctgggcacaacagccgccacaagcaccgccggaaatgaaggactcggaggcatcgacttctcatcgtcttcagacaaaaaatctgacaaaactggcacgcgcccggaggacagcaaagctctgaaggacgaaaatctgccacccgtcatatgccaggacgtcgaaaacctgcaaaagtttgtcaaggaacagaaacaggtgcaggaagagatcagcaggatgtctagtaaagctatgctgaaggtacaagaggacattaaggccttgaaacagctactgtccctcgcagctaacggtatccagagaaacactttaaacatagacaaactgaaaattgagacagcccaggagttaaaaaacgccgagatcgcgttgcggacccagaaaacaccaccaggattacaacatgaatatgccgctccggcggactacttcaggatcctcgtgcagcagttcgaagtccagctgcagcagtatcggcagcaaatcgaggaactcgagaaccacctcgctactcaggcgaacaactcacatatcacccctcaggatctatctatggctatgcagaaaatctaccagacatttgtggccttggccgcacagctacaaagtatccatgaaaacgtcaaggtcttaaaggagcagtacctggggtataggaagatgttcctgggggacgccgtggatgtgttcgaaacccgcagggccgaggcaaagaagtggcaaaacaccccacgagttacgaccggcccaactccattttctacaatgcctaatgccgcagctgtggctatggctgccacgctcacacaacagcagcaaccagcgactggcccccagccgtcactgggcgttagctttggtacaccgttcggatctggcatcgggacaggcctgcagtcctccggcttgggctcttctaacctgggaggctttggcacttctagtggcttcggttgtagtactacgggcgcaagcactttcggatttggtacaaccaacaagccatctgggagcctgagcgccggatttggatcatcaagcacatccggattcaatttttccaatcccggaatcactgcctcagccggtttgacatttggggtctcgaatcctgctagcgctggattcggcaccgggggtcagctcctccagctcaagaagccccccgccggcaacaaacgaggaaagaggtag

SEQ ID NO: 127176 - DNA, 1800 bp, Artificial Sequence
  Description of Artificial Sequence: Synthetic coding sequence
atgtcaactgggtttagcttcggcagtggcacacttggttctactactgtggcagctggcggtacctccactggtggagtatttagttttgggactggagcctccagcaacccatcggtaggcctgaacttcggaaatctcggaagtaccagcacccctgccaccaccagtgcccccagctcaggatttggaactggactgttcggaagcaagcctgctaccggattcactctgggaggcacaaacaccgggatcgcaacgaccatcactacaggcttgaccctgggcactcctgccactacttccgctgccacaacagggtttagtctaggcttcaataagcctgctgcgagcgccacaccattcgccctccccataacgtcaacgtccgccagcggcctgactctgtcaagcgccctgaccagtaccccggccgcttcaactggattcaccctgaataatttgggagggacaaccgcaactactacaactgccagcacaggcctgagcctgggaggcgctctggctggattagggggctcactatttcagtccacaaacaccgggacatccggacttggccagaatgctttgggccttacacttggcaccactgcggccacctctactgccggaaacgaagggctcggaggtattgatttttcctcctcctccgataagaagagcgacaaaactggaacacgaccagaggatagtaaagcgttgaaagacgagaatctgccccctgtaatctgccaggacgttgaaaacctgcaaaaatttgttaaggaacagaagcaggtgcaggaggaaatttctagaatgtctagtaaagcaatgctgaaggtgcaagaagatattaaagcactaaagcagcttctgagtctcgccgcaaacggaatccagcggaataccttgaatatagacaaattgaaaatcgagaccgcccaggaattaaaaaacgctgagatcgctctaaggacacagaaaacacctccgggtctgcagcacgaatatgcggcgccagcagactactttcgcattctggtacagcagttcgaggtgcagttgcagcagtaccgccagcagattgaggaactcgaaaaccatttggcaacccaggccaataattcacatattacgccccaggacctgtcgatggcaatgcaaaaaatttaccagacgtttgttgcactggcggcccagctccagtccatccatgaaaacgtgaaagtcctcaaggagcaatatctgggttaccgcaagatgtttttaggtgatgcggtggatgtttttgaaactagaagggccgaagcaaagaagtggcagaacacgccgagggtcaccaccggacctacaccttttagcacaatgccaaatgccgccgcagtcgccatggcagccacattgacccaacagcagcagcccgcaactggcccccagccgagcctgggcgtatctttcggaactccatttggatcagggatcgggaccggactgcagagtagtggcctcggcagctctaatctcggtggctttggcaccagcagcgggttcggctgtagtaccactggggcaagcacattcggcttcgggacgaccaataagccctcggggtctctgtctgccggctttggatcgtcaagcacatctggctttaatttttcaaatcctggcatcaccgcctctgcggggctcacgttcggcgtttcaaacccagcttccgccggttttgggaccggaggacagctgttacagcttaagaagccaccagccgggaataagcgcggaaagcgatag

SEQ ID NO: 127177 - DNA, 1515 bp, Artificial Sequence
  Description of Artificial Sequence: Synthetic coding sequence
atgtccactggcttcagtttcggttcaggaactctgggcagcaccactgtggcagccggcggcacctcaacaggaggcgtgttctcctttggaactggcgcgtcttcaaatccttctgtgggccttaactttggcaatttgggctccacaagcactcccgccaccacaagtgcaccatctagcggatttgggactgggctttttggctccaagcccgccacggggtttactctgggtgggaccaacactggaactccagcaactacgagtgccgccactactggcttctctctgggctttaataaacccgccgctagcgccactccattcgctctgcctatcacttcaaccagcgcgtccggactcacactctcttctgcattgacgtcaacacctgccgcaagtactgggtttacactgaacaacctgggaggtaccactgcaactaccacaacggcgagtacaggtttgagcctcggcggggctcttgccggcctgggcggctccctctttcaaagtactaacacaggcacgagtgggcttggtcagaatgctctcggattaactctaggcactactgccgcaacctctaccgccggaaacgaaggcctgggtggtatcgacttctcttctagcagcgacaaaaagtcagataaaacggggacaagacccgaggactcaaaggccttgaaggacgagaacctgccaccggtgatttgccaggatgtcgagaacctgcagaagttcgttaaagaacagaaacaggtgcaggaggagattagcagaatgagttctaaagcaatgctcaaggtgcaagaagacatcaaggcattaaaacaactgttgagcctggcagcaaatggcatacagcggaatacattgaatatcgacaagcttaagatcgagacggctcaggagctcaaaaacgccgagatagccttacgcactcagaagaccccaccagggctgcagcacgagtatgccgcaccagccgattactttcgcatcctcgtgcaacagttcgaggtgcagcttcaacagtaccgtcagcagattgaagagctagaaaaccatctggccactcaagccaataactctcacatcactccacaggacctgtcgatggcaatgcagaagatttatcagacgtttgtcgcattggccgcacaattgcaaagtatccatgaaaatgtaaaagtgctgaaagagcagtacctaggctaccgcaaaatgtttttaggcgatgccgtggatgtgttcgaaacaagacgtgcggaagctaagaaatggcagaacacaccgagagtcactactggccctactccgttttcaaccatgcctaatgccgccgcagtggccatggccgcaactctcacgcagcagcaacagccagctaccggagataagtggtgtaacgttgccgaactcaaaaaccgcacacagctgagtctctttgtgaacaaactggaattatcctgttactgcgtgatcgacctgctctacaacgaacagtag

SEQ ID NO: 127178 - DNA, 1458 bp, Artificial Sequence
  Description of Artificial Sequence: Synthetic coding sequence
atgtcaacgggattcagctttgggtccggaacactaggctctaccactgttgccgccggaggaacatctaccggtggggtgttctcttttggtaccggggcctcttctaatccttccgtgggtttaaacttcgggaacctcggtagcaccagcacacctgccacaacaagcgcgccaagctccggctttggaacaggactctttggtagtaagccggctacaggcttcaccttggggggcacaaacaccggaatagccaccacaattactacaggactgacgctgggaacgccagccacaacatccgcagccactactgggttcagtctggggttcaataagcccgccgcctctgcaacacccttcgcgctacccattacctctacctcggccagcggtttgactctctcttctgcattgacctctaccccggccgcttctacaggcttcactctgaacaatctcggagggacaacagccaccaccactaccgcttctacaggactgagcctcgggggcgctctagctggtctcggcggctctctctttcaatccactaacactggcaccagcggacttggtcaaaacgctctcgggctcacgctgggcacaactgccgccacttccaccgcaggtaatgagggcctcggggggattgatttcagctcaagtagcgacaaaaagtctgataaaaccggaactcgccccgaggattctaaggctctgaaagacgagaatctaccgcccgtcatctgccaagacgtggaaaatttgcagaaattcgtcaaagagcagaagcaggtgcaggaagaaatctctcggatgtctagcaaagccatgctcaaggtgcaggaagatattaaggcccttaagcagctgctgtccctggccgccaacggaattcagaggaatactcttaatatcgataaactgaaaattgaaacagcacaggagctcaagaatgcggaaatcgctcttagaacccagaaaacccctccgggcctgcaacacgagtatgcagccccagccgactatttcagaattctggtccagcagtttgaagtgcagcttcagcagtataggcaacaaatcgaggaactggaaaaccaccttgccacgcaagccaacaattcccatatcaccccacaggacctgtcgatggccatgcagaaaatttaccagacctttgttgctctggccgcgcagcttcagagcattcacgaaaatgtcaaagtcttaaaggaacaatatctgggatatcggaagatgttcttgggcgatgccgtggacgtctttgagacccggcgtgctgaggccaagaagtggcagaataccccaagagttaccacaggccctactcctttttctactatgccaaacgccgctgccgtggccatggccgccactttgactcaacagcagcaacctgctaccgggttaaacgcgttcaaactgtag

SEQ ID NO: 127179 - DNA, 1308 bp, Artificial Sequence
  Description of Artificial Sequence: Synthetic coding sequence
atgtccgggttcctggaagaactcctcggggaaaagctcgtgacaggtggtggcgaagaagtggatgtgcactctttaggtgcaagaggaatcagcctccttggcctctacttcggttgctccctttccgccccgtgtgctcagctgagcgcaagccttgccgcattctacgggcggcttagaggcgatgctgcggccggcccggggcccggcgctggggccggtgccgccgcagagccggaacctcggagaaggctcgagatcgtcttcgtctctagtgaccaagatcagcgtcagtggcaggatttcgttcgcgatatgccatggcttgcgctcccatataaagaaaagcaccgcaaactgaaactgtggaacaaatatcgcatttctaacatcccaagtcttatattcctggacgccacgacaggtaaagtcgtgtgtcgcaacggacttctggtcatacgagatgatcctgaaggcctcgaatttccatgggggccaaaaccctttagggaggttatcgcaggaccccttcttcggaataacggccagtctcttgaaagcagctccctcgaaggaagccacgtaggggtttatttttctgcccactggtgccccccgtgtcgatccttaacacgggtgcttgtcgagtcataccggaaaattaaggaggcaggccagaatttcgagatcatcttcgtgagcgctgatcgatcggaggagtcttttaagcagtacttctccgaaatgccttggcttgccgtgccctacacagacgaggcccgcagatcaaggctgaacagactctatggtatccaaggcatccctacgctgatcatgctcgacccccagggggaagtgattacccgccagggccgtgtggaggtcctcaacgacgaagactgtcgcgagttcccgtggcaccctaagcccgtcctggaactctccgacagtaatgctgcacaactcaacgaggggccctgcctggtcttgttcgtggattcagaagatgacggggagagtgaggccgccaagcagctgatccagcccatagctgaaaaaatcatcgcaaaatacaaagcaaaggaggaagaggcacctctgctcttctttgtggctggcgaagacgacatgactgacagcctgcgtgactacacgaatctgccagaagccgccccgctactaactatcttagatatgtctgccagagcgaagtacgtgatggacgtggaggaaatcactcccgcaatcgttgaggcctttgtgaatgactttctggccgagaaactgaaacctgaaccaatttag

SEQ ID NO: 127180 - DNA, 984 bp, Artificial Sequence
  Description of Artificial Sequence: Synthetic coding sequence
atggcggatgtgagcctccatagaaatccagcgacactgaaattatggaacaaatataggatctccaatatcccttcactgatattcctggacgctaccaccggcaaggtcgtttgtcggaatgggctccttgtgatccgggacgaccctgagggcctggaatttccatggggccctaaaccatttcgggaagtgatcgccgggccacttctgcggaacaacgggcagtccctggagtcttcctctctagaaggcagccacgttggggtctattttagtgcccattggtgcccaccttgcagatcactgaccagagtcttagttgagagctacaggaagatcaaagaagcagggcaaaacttcgagattatcttcgtgtcagccgaccgtagtgaagagagtttcaagcagtacttcagcgaaatgccctggctggctgtcccttataccgatgaggccaggcgctcacggctgaacaggctctatggcattcagggaatcccaaccctcataatgctggatccacagggagaagtgataactaggcaggggagggtggaagtcctgaacgacgaagactgtagagagtttccttggcacccaaagcctgttctggaattgtccgattccaatgccgcacagctcaacgagggtccctgcctggtcctctttgttgactctgaagacgatggcgaatctgaagcagctaagcaactgatccaacccatcgcagaaaagataatcgctaagtacaaagccaaggaggaagaggcacctctactattcttcgtcgctggggaggatgacatgacagactccttgcgggattacactaatctccccgaggccgcccccctccttacgatcctagacatgtccgcgcgcgcaaagtatgtgatggacgtggaagaaataacgcccgctattgtggaagcattcgtcaatgattttctggctgagaagctgaagcctgaacctatctag

SEQ ID NO: 127181 - DNA, 381 bp, Artificial Sequence
  Description of Artificial Sequence: Synthetic coding sequence
atgccttggctcgccgtgccatataccgacgaagcccgacgtagcagactcaaccgactgtacggcatccaagacagcgaggatgacggcgagtctgaggctgcgaaacagctgatccagcccatcgcggagaagatcatcgcgaaatacaaggccaaagaagaggaagcccccctcctgtttttcgtcgccggggaagacgatatgactgacagcttaagagactacacgaacctgccagaggctgccccattactaacgatcttggacatgtccgctagagccaaatacgtgatggacgtggaagagatcacgcccgcgatagtcgaagcctttgtgaacgatttcctagctgagaaactcaaacccgaaccaatctag

SEQ ID NO: 127182 - DNA, 984 bp, Artificial Sequence
  Description of Artificial Sequence: Synthetic coding sequence
atggccgacgtctctctgcaccgtaacccggccactctcaaactgtggaacaaatatcgcatcagcaacattccaagcttgatcttcctggatgcgacaacaggaaaggtggtgtgccggaatggactgcttgttatccgtgacgatcctgaagggttagagtttccctggggtcccaagccattcagggaggttatcgccgggccactgcttcgcaacaatggccagagtctcgaatctagtagcctcgagggaagccacgtcggcgtttacttctctgcccactggtgtcctccatgtcggtccctgacccgggtgctggtcgagagctatcgcaagatcaaagaggccgggcagaacttcgagattatcttcgtaagcgcagaccgctcggaggagtcgtttaaacagtatttcagcgaaatgccatggctggccgttccttataccgacgaagccagaagatcaagattgaaccgcctgtatgggatccagggaataccgacactgataatgctcgacccccagggcgaggttattaccaggcagggccgggtggaagttctgaacgatgaagactgcagagaatttccatggcacccaaagcccgtactggagcttagcgacagcaacgccgcacaattaaatgagggtccctgtctagtgttgttcgtggatagtgaagacgacggtgagagcgaagccgctaaacaacttattcaacccattgctgagaagataatcgccaagtataaggccaaagaagaagaggcccctttgttgtttttcgtggcaggggaggatgatatgacagacagtctacgggattacacaaacctgcccgaggctgccccactcttgacaatcttagatatgagtgcccgggctaaatacgttatggacgtagaggaaataacccctgcgatagtcgaagctttcgtgaatgattttttggccgagaagctgaagccagaaccaatttag

SEQ ID NO: 127183 - DNA, 1176 bp, Artificial Sequence
  Description of Artificial Sequence: Synthetic coding sequence
atggctgatatcgataacaaggagcaaagcgagttggaccaggacctggatgacgtcgaggaggttgaggaggaggagaccggggaagagaccaagctgaaagccaggcagctgactgtgcagatgatgcagaatccccagatcctggccgcacttcaggaaaggctcgatggtttggtggaaacccctacaggttatatcgagtctcttccaagagtggtcaaaaggagggtgaatgcgcttaagaatctgcaggtaaaatgcgcccagatagaggccaagttctacgaggaagtgcacgacctggaaaggaaatacgccgtgctgtaccaacctctgttcgacaaacgttttgaaatcatcaacgctatctatgagccgacagaagaagagtgtgaatggaagcccgacgaagaagatgagatctccgaagaacttaaggaaaaggctaagattgaggacgaaaaaaaagatgaagaaaaggaggaccccaaaggtattcccgaattttggctgacagtctttaagaatgtggacttgctgtcagatatggttcaggagcatgatgagcccattttgaaacacctgaaggacatcaaggtgaaatttagtgacgccggccaaccaatgagtttcgtcctcgaattccattttgagccgaatgagtacttcactaacgaagtgctgaccaagacgtaccgtatgcgctcagaaccagacgacagtgatcccttctctttcgatgggccggagattatgggctgtaccggctgtcaaatcgactggaagaaagggaagaacgtaacgctgaagactatcaagaagaaacagaagcataaagggagaggtaccgtgagaactgtaaccaagacagtgagcaacgattcattttttaactttttcgcgcctcctgaagtgccagaatcaggtgaccttgacgatgatgccgaagctatactggcagctgactttgagatcgggcattttctccgtgaaagaatcattccacgttcagtattgtatttcacaggcgaggctatcgaagatgatgatgatgactacgatgaagagggggaagaggcggacgaagagggagaggaagagggtgatgaggaaaatgaccctgattatgatccaaagaaagatcagaatcccgccgaatgtaagcagcaatag

SEQ ID NO: 127184 - DNA, 1176 bp, Artificial Sequence
  Description of Artificial Sequence: Synthetic coding sequence
atggccgacatcgacaacaaggagcagagcgagctcgatcaggatctcgacgacgtggaagaggtcgaagaagaggagactggagaggaaacaaaactgaaagctaggcaattaaccgtgcagatgatgcaaaacccgcagattctcgctgcactgcaagaacgcctggacggactggtggaaactccgactggatacattgagagccttccacgcgttgtgaagcgtcgcgttaacgcactaaaaaatctgcaggtgaagtgcgcgcagatcgaagcaaaattctatgaagaagtgcacgacttagagcggaagtacgccgtactgtaccaacccctctttgacaagcgattcgaaatcattaacgccatttacgagcccacggaagaagagtgcgagtggaaacctgatgaagaggatgagatctccgaagagttaaaagaaaaagccaagatagaggacgaaaagaaagacgaggagaaggaggatccaaaagggatacctgagttctggttaacggtctttaaaaacgtggatctgctgtctgatatggtgcaagaacacgatgagcccattctaaaacatctgaaggacatcaaggttaaatttagcgacgccggacaaccgatgtcatttgtattggaattccattttgagcccaacgagtatttcacaaatgaagtgcttaccaagacatataggatgagatccgagcccgacgactccgatcccttttcctttgatgggccggaaatcatgggctgcaccggttgtcagatcgactggaaaaaaggaaaaaacgtgacacttaagactatcaagaagaagcagaaacataagggcagggggaccgtcagaacggtgacaaaaacagtcagcaacgatagcttctttaatttctttgcaccccccgaagttcctgaaagcggtgacctggatgatgatgcggaggctatattggcggccgactttgagattggccatttcctacgtgagaggattattcctagaagcgtgctctacttcacaggcgaggcaatcgaagacgatgatgacgactatgacgaggaaggagaagaagccgacgaagagggtgaggaagagggtgatgaagagaatgacccagattatgacccgaagaaggatcagaatcccgccgaatgcaagcaacagtag

SEQ ID NO: 127185 - DNA, 972 bp, Artificial Sequence
  Description of Artificial Sequence: Synthetic coding sequence
atgatgcaaaaccctcagatcctggctgcgcttcaagaacgcctcgacggcctggtagaaacaccgacaggctatatagagagcttgccccgggtcgtgaagcgacgcgttaatgccctgaagaacctgcaggtcaaatgtgcccagatagaagctaagttttacgaggaggttcacgacctagagagaaagtacgccgtgctgtatcaaccactttttgacaaggaggagcttaaggaaaaagcaaaaattgaagacgaaaagaaggatgaagagaaggaagaccctaagggaattccggaattttggctgacagtttttaaaaatgttgacctcctttctgacatggtgcaggaacacgatgaacccatcttgaaacatttgaaagatattaaagtcaaattttccgatgcaggccagcccatgagcttcgtgcttgaattccattttgagccgaacgaatacttcactaacgaggtcctcactaaaacatataggatgcggagtgagccagacgacagcgaccctttctctttcgacggccctgaaattatgggatgcacaggatgccagatcgattggaaaaaaggcaagaatgtcaccctcaagaccatcaagaagaagcagaagcacaaaggaagaggaaccgttaggacagtgactaagacggtgtccaacgatagtttctttaacttcttcgcccccccagaggtgcccgaatctggagacctcgatgatgacgccgaagccatcctagctgccgacttcgagatcggtcacttcctgagagaaagaattattccgcggtctgttctgtactttaccggcgaggccatagaggatgacgacgatgattatgatgaagaaggagaagaggccgacgaggaaggcgaagaggagggcgatgaagagaatgaccccgattacgaccctaagaaagaccagaatcccgctgaatgtaagcagcaatag

SEQ ID NO: 127186 - DNA, 1050 bp, Artificial Sequence
  Description of Artificial Sequence: Synthetic coding sequence
atgatgcagaatccgcaaatcctggccgccctgcaggagcgtctggacgggctcgtcgaaacacccactgggtacatcgaaagcttaccacgtgtggtgaagagaagggtgaatgcccttaaaaacctgcaagtgaaatgcgcccagatcgaggcaaaattctacgaggaggttcatgacttggaaagaaagtatgctgtgctgtatcagcctctgtttgacaaacgtttcgagattattaatgctatctatgaaccgaccgaggaggagtgtgagtggaagcccgacgaggaggacgagatttccgagcttaaagagaaagccaagattgaagacgaaaaaaaggacgaggagaaagaagaccctaaggggatccctgagttttggttgacagtctttaagaatgttgacctgttgagcgacatggtgcaagaacatgacgagccaatcctaaagcatcttaaggatatcaaagtcaagttcagtgatgccgggcagcctatgtccttcgtgttggaattccatttcgaacctaacgagtattttacaaatgaggtgctgacaaagacttaccgtatgcggtcggagccagacgatagcgatcctttctcattcgacgggccggaaatcatggggtgcaccggatgccagattgactggaagaaagggaaaaatgtcaccctcaaaactattaaaaaaaagcagaagcacaagggaaggggaacagtgaggactgtgaccaaaaccgtgtccaatgatagctttttcaatttcttcgccccccctgaggtgcctgagagcggcgatctcgatgacgacgccgaggctatcttggcagcggattttgagataggccatttcttgagagagagaattattcctcggagtgtgctttattttacaggcgaagctatcgaggacgacgatgatgattacgacgaagaaggcgaagaggccgatgaagaaggagaggaagaaggtgacgaggagaacgaccctgattacgatcccaagaaagatcaaaaccctgctgagtgcaagcagcagtag

SEQ ID NO: 127187 - DNA, 627 bp, Artificial Sequence
  Description of Artificial Sequence: Synthetic coding sequence
atggtccaagagcacgacgaacccatattgaaacatttgaaagacatcaaagtgaaattctccgacgccggccaacctatgagctttgtgctggaattccactttgagccaaacgagtatttcaccaacgaggtgctgacaaagacatacaggatgaggtcagaaccagatgatagcgatcccttcagcttcgacggccctgagattatgggctgcacgggctgtcagatcgactggaaaaaaggtaagaatgttacactcaaaaccataaagaagaagcagaagcacaagggaagaggaaccgtcaggacggtgacgaaaactgtaagcaacgattccttttttaattttttcgcccccccagaggtgcctgaatccggcgacctggacgacgatgctgaggctatcctggccgcggatttcgaaatcggccacttccttcgcgaacggattatcccccgctcagtgctgtattttacaggcgaggcaattgaagacgacgacgatgattatgatgaggagggcgaagaggctgacgaagaaggggaggaagaaggcgacgaggagaacgaccccgattacgaccccaagaaagaccagaatccagccgagtgtaagcaacaatag

SEQ ID NO: 127188 - DNA, 987 bp, Artificial Sequence
  Description of Artificial Sequence: Synthetic coding sequence
atggcagatatcgacaatttaccaagggtcgtgaaacgaagagtaaatgcactgaagaatctccaggtgaaatgtgcacaaattgaggctaaattttatgaggaagtgcatgatctggagaggaaatacgcagtcctatatcagcccctgttcgacaagcgatttgagataatcaatgctatttatgaacctactgaggaagaatgcgagtggaaaccagatgaggaggacgagatctctgaggagctcaaagagaaggcaaagattgaggacgaaaagaaggatgaagagaaagaggatccaaagggtatacccgaattctggttgaccgtgtttaagaatgtagacctgctctctgacatggtccaggagcacgatgagccgattctgaagcacctcaaggacataaaggttaaattcagcgatgcgggtcagcccatgtcttttgtgcttgagtttcacttcgagccaaatgagtattttactaatgaggtcctgaccaagacataccgcatgagatcagaacccgacgacagcgaccccttctctttcgacggccctgagatcatggggtgcactggctgccaaatcgactggaaaaagggcaagaatgtaacactcaaaactataaagaagaaacagaaacataaggggagggggacggtacgcaccgtcaccaaaacggtgagcaacgattctttcttcaattttttcgccccccccgaggtgcctgagtctggagacctggacgacgacgccgaggcgattctcgccgccgacttcgaaattggccattttctgcgcgagcggatcatcccaaggtccgtcctgtactttacgggcgaggccattgaggatgatgacgacgattacgacgaggagggggaggaagcggacgaggagggggaggaagagggagacgaggaaaacgatcccgattacgaccccaaaaaggaccagaatcccgcagagtgcaagcaacaatag

SEQ ID NO: 127189 - DNA, 1107 bp, Artificial Sequence
  Description of Artificial Sequence: Synthetic coding sequence
atggccgacatagataataaggaacagagtgaactcgaccaagatcttgacgatgtggaggaagtggaggaagaggagaccggggaagagaccaagctgaaggctagacaattaacggtgcagatgatgcagaatcctcagatcctggcggcgttgcaggagagactcgatggtcttgtggagaccccaaccggctatatcgagagtctcccgcgggttgtaaagcggcgggtcaatgcccttaagaatctccaggtaaagtgtgctcagatcgaagcaaagttctatgaagaagtccacgatctcgaacgcaaatatgccgtcttataccagcccttattcgacaaaagattcgagattataaacgctatctacgagccaacggaagaggaatgcgaatggaagccagatgaggaagacgagatctccgaggagctgaaggagaaagccaaaatagaagacgaaaaaaaagacgaagaaaaggaggaccccaaagggattccagagttttggctgaccgtgttcaagaatgtcgacctgctttccgacatggtgcaagagcatgatgaaccaatactgaagcatctgaaggatattaaagttaaatttagtgacgccgggcagccaatgtccttcgtcctcgagttccatttcgagccgaatgagtactttacaaacgaagttctgacaaaaacctacagaatgagaagtgaaccagacgatagcgatccattctcctttgacgggcctgagattatgggctgtactggctgccaaatcgactggaaaaaggggaaaaacgtgactctcaagactatcaagaaaaagcagaaacacaaaggcagaggaaccgtgcgaaccgttactaagactgtgtccaatgactctttcttcaatttcttcgccccccccgaagtgccagaaagtggggacctggacgacgatgcagaggccatccttgctgccgattttgaaatcggtcacttcctgcgggaaaggatcattcctcgctccgtgctgtactttaccggtgaggcaattgaagacgacgacgacgactacgatgaagagggggaagaggcagacgaagtgatgtttactaaatag

SEQ ID NO: 127190 - DNA, 795 bp, Artificial Sequence
  Description of Artificial Sequence: Synthetic coding sequence
atggccgatatcgacaacaaagagcaaagtgagctggaccaggatctggatgatgtggaggaagtcgaagaggaggagactggtgaggagacaaaactcaaagcccggcaattgactgtacagatgatgcagaatccacaaatcttggctgcgcttcaggagcggctggatggactcgtggagacaccaacgggttatatcgagtctctcccccgagttgtaaaacgcagggtgaacgctttgaaaaatctgcaagtaaaatgcgcccagattgaagcaaagttttacgaagaggtgcatgacctggagcggaagtacgcggtattatatcaacctttgttcgacaaacgatttgaaattatcaatgccatctatgagccaactgaagaagaatgtgagtggaagcccgatgaagaggacgagataagtgaagagcttaaagaaaaggccaagatcgaagacgaaaaaaaggatgaggaaaaggaggatccaaaaggtattccagagttctggctcacggtgtttaagaacgtcgacttgctgtcagatatggtgcaggaacacgacgagcccatcctgaaacacttaaaggatatcaaggtgaagttcagcgacgctggacagccgatgtcgttcgtgctcgagttccacttcgagccaaacgagtatttcacaaacgaggtcctaacaaaaacatatcggatgcgcagcgaacccgacgactctgatcccttttctttcgatggaccagagatcatggggtgcaccggatgccaaatcgactggaaaaagtag

SEQ ID NO: 127191 - DNA, 1158 bp, Artificial Sequence
  Description of Artificial Sequence: Synthetic coding sequence
aaggagcaaagcgaactagatcaggatttggatgatgtagaggaagtggaggaggaagagacaggagaggaaaccaaactgaaggcacgccagctgaccgttcagatgatgcaaaatccccagattttggcagccctgcaagagagattggacggacttgttgagacccccacgggctatatcgaatccttgccacgggttgtgaagcggcgcgtgaatgctcttaagaacttgcaggtgaagtgcgcgcagatcgaggccaagttttacgaggaagtacacgacctggaaaggaagtacgcagttttatatcagcccttatttgacaagcggtttgaaattattaatgcaatctacgagcctacagaggaggaatgtgagtggaagcccgatgaagaagacgagataagtgaagagctgaaggaaaaagcaaagatcgaggatgaaaagaaagatgaggaaaaggaggatccaaaagggattcctgagttctggttgactgtgtttaaaaatgtggacttgctgtctgacatggttcaggaacacgacgaaccgatcctcaagcacctgaaggatatcaaagttaaattcagcgatgccggtcaaccaatgtcctttgtgctggagttccacttcgagccaaatgagtacttcacgaacgaagtgttgaccaaaacttatcgtatgagatcagagccagacgattccgatcccttttctttcgatggcccggaaattatggggtgtaccggatgccaaattgattggaagaagggtaaaaacgtgacccttaagactattaaaaagaaacagaagcacaagggccgtgggacagtgagaacagtgacgaaaactgtcagtaacgactctttctttaatttttttgcccctccggaggtcccagagtctggagacttggatgacgatgccgaggcgatcttggcggcggattttgagattggacacttcttgcgcgaacgaattatcccccggagtgtgctctacttcacaggggaggcaatcgaggatgacgatgacgactacgacgaggaaggcgaggaggcggacgaagagggtgaggaagaaggagacgaggagaatgaccctgactacgacccaaaaaaggatcagaatcccgccgagtgcaaacagcagtag

SEQ ID NO: 127192 - DNA, 1521 bp, Artificial Sequence
  Description of Artificial Sequence: Synthetic coding sequence
atggccgaagcagacttcaagatggtcagtgagcccgtcgcgcatggggtggcggaggaggaaatggccagcagtactagcgacagcggcgaggagtctgactcttcaagctcttccagttccacttctgactcatcgagttcatcttctacatccggtagctcctcgggaagcggtagctcttcctctagctccggcagtacttcaagccgttcccgcctgtataggaagaagcgagttcccgagccctcccgcagagcgcggcgtgcccccctagggaccaacttcgtggatcggctgccccaggccgtcagaaaccgtgttcaggctctcaggaacattcaggacgagtgcgacaaggtggataccctgttcctgaaggccatccatgatttggagcgcaaatatgccgagctaaacaaacccctctatgataggaggtttcaaattatcaatgcagagtacgaacctaccgaggaggaatgtgagtggaattccgaagacgaagagttcagcagtgacgaggaggtgcaggacaataccccaagcgagatgcccccattggaaggggaagaggaggaaaaccctaaggaaaatcctgaggtgaaagccgaggagaaagaggtcccaaaggaaattcctgaggttaaagatgaagagaaagaggtgcccaaagagataccagaggtgaaagcagaagaaaaggcagattctaaagattgcatggaggccaccccagaggtcaaggaggacccaaaggaggtgccccaagtgaaagctgatgacaaagaacagccaaaagccacagaagcaaaagcccgagccgccgttcgcgaaacacataagagggtccccgaggagcgcctgcaggacagcgtcgacctgaagcgggcgagaaaaggtaagcccaagcgggaggacccgaagggcatccccgactactggctgattgtcttgaaaaacgtagataagctcggacctatgatccagaagtacgacgagcccatcctgaaattcctgagcgacgtgtctctgaagttctccaaacccgggcaaccggtatcatatacattcgaatttcactttctacctaacccctattttcgcaatgaagtcctggttaagacgtacattattaaagctaagcccgatcataatgatccctttttcagctggggctgggagattgaggattgtaagggttgcaagatagactggcgaagaggcaaagatgtgacggtcaccactacacagtctcgcaccactgctaccggggaaatcgaaattcaaccaagagtggtgcccaacgcatcatttttcaacttcttctctcctcctgagatacctatgataggcaagctggagcccagagaagacgccatacttgatgaagatttcgagatcggccaaatcttgcacgacaatgtgatcttaaaatccatctactactacactggcgaagtgaacggaacctattatcagtttggcaagcattacggaaacaagaaataccgcaaatag

SEQ ID NO: 127193 - DNA, 1500 bp, Artificial Sequence
  Description of Artificial Sequence: Synthetic coding sequence
atggtgtccgagcctgtagcacacggggtagctgaggaagagatggcctccagtacatcagactcaggcgaggaaagcgacagttccagttcgtcctcttccacctcagactcctcctcctcctcatcgacaagcggttcttcatccggtagcggttccagcagctcatcgtctggaagtacaagcagccgttctagactttatcgcaagaaacgcgtgcccgaaccctcacgacgcgcccgacgcgcccctctaggaacaaattttgttgatcggctgccccaggcggtgaggaacagggtacaagccctgaggaatattcaagacgaatgcgacaaagtagacacgctgtttctgaaggctatccatgatcttgaaagaaagtatgccgaactcaataagccactgtacgacagacgatttcagatcatcaatgctgaatacgagccaacggaggaggagtgtgaatggaacagcgaagatgaggagttctccagcgacgaagaggttcaagacaataccccttctgagatgccgcccctcgagggagaggaagaggaaaaccccaaagaaaatcccgaggtgaaggccgaggagaaggaagtgccgaaggaaataccagaagtaaaagacgaggagaaggaggtgcccaaagaaattccagaagtaaaggcagaagagaaggcggactccaaagattgcatggaggctacccccgaagtcaaggaagatccaaaagaagtgccccaggtgaaggcggatgacaaagagcagcctaaagccacagaggccaaagctcgtgccgcggtgagggagacccataagcgcgtgcctgaggagagattgcaggactccgtggacctgaaaagggccaggaaaggcaaaccaaaacgggaggatcctaagggaattcctgattactggctaatagtcctgaagaatgtcgataaactgggccccatgatacagaaatacgatgaaccaatcctgaagtttttgtccgacgtatccctgaagttttccaagcctggccagcctgtgtcgtacacctttgaattccattttttgcccaatccatattttagaaatgaggtgctggtgaagacttacatcatcaaagccaaacctgatcacaacgatcccttctttagctggggctgggaaattgaggattgcaaaggctgcaaaattgattggcgcagaggaaaggatgtgacagtcactacaacccagtcccggacaactgctacaggggaaatcgaaattcagcctagggtcgtgcccaacgcctcattcttcaacttcttcagcccaccagagatccccatgatcggaaaactggaaccaagagaagacgccattctagatgaggatttcgaaatcgggcaaatccttcatgacaacgtgatcctaaaaagtatatactattacactggggaagttaacggaacatattaccaattcgggaagcattacgggaataagaaatatcggaagtag

SEQ ID NO: 127194 - DNA, 1128 bp, Artificial Sequence
  Description of Artificial Sequence: Synthetic coding sequence
atggccgaccactccttttccgacggtgttccgagcgacagtgttgaagctgcaaaaaatgcctcgaacactgaaaaactgactgatcaggtgatgcagaacccacgggttttagccgccctgcaagaaaggcttgacaatgtgccccacaccccatcaagctacattgagacacttcccaaagcagttaagagacgcattaatgcactgaagcagctgcaggtaaggtgcgcccacatcgaggcgaaattttatgaagaggtccacgatctggaaaggaagtacgccgcactgtatcaacccctctttgacaagcgaagagaattcattaccggtgatgttgagcctacggacgctgaatccgagtggcattccgagaatgaggaagaagagaagctggccggcgacatgaagtcaaaagtggtggtgactgaaaaagccgcggccactgcagaggaacccgacccaaaaggcattcccgagttctggtttacaatatttcgaaacgtggacatgctttctgaattggttcaggagtatgacgagccgatcctgaaacatctgcaggacataaaagtgaagttctcagaccccggtcagcccatgagttttgtgctagaatttcatttcgagcctaacgactacttcaccaacagtgttctgacaaagacctacaaaatgaaatcagagcctgataaagccgacccattttcattcgagggcccagaaattgtggattgcgatggatgtaccatcgattggaaaaagggcaagaatgtgaccgtaaagaccatcaagaaaaagcagaagcataagggtcgtggcacagtgaggacaatcaccaagcaagttccgaatgagtccttcttcaacttcttcaaccccctcaaggcttcaggggatggagagagcctagacgaggacagtgaattcacccttgcttccgacttcgagatcggccacttcttccgcgaacgcatagtgcctagggctgtgctctacttcaccggagaagccatcgaggatgatgataactttgaagagggtgaggaaggcgaagaggaggaattggagggggacgaggaaggggaggacgaggatgatgcggagataaatcccaaagtgtag

SEQ ID NO: 127195 - DNA, 1161 bp, Artificial Sequence
  Description of Artificial Sequence: Synthetic coding sequence
atggcagatcacagtttttctgatggcgtgccttcagactcagtggaggccgccaaaaacgcgtcaaacactgaaaagctaacagaccaggtgatgcagaatccaagggtcttagcagctttgcaggaacgactagataacgttccccatacccccagtagctacattgagactcttcctaaagctgtcaaaaggagaattaacgcgttaaagcaactgcaagtaagatgtgcccatattgaggcgaagttctacgaggaggtacatgatctggagcgcaagtatgccgccctctaccagcctctgtttgataagcgtagagaatttatcaccggagacgttgagcctactgacgccgaaagcgagtggcactcagaaaacgaggaggaagagaagttggccggggatatgaagtccaaggtggtggtgaccgagaaagcagccgcaaccgccgaagagcccgatcctaagggcatcccggagttctggttcacaatcttccgcaacgtagacatgttgagcgagctggtgcaggagtacgacgagccgattctcaagcacctgcaggacattaaggtgaaattcagcgatccaggccagcctatgtcttttgtgctcgagtttcacttcgaaccaaatgattacttcaccaattccgtcttgacaaaaacatacaagatgaaatctgagccggataaggcagatccgttcagctttgaggggccagagattgtggattgcgatggttgtacaattgattggaaaaagggcaaaaacgtgactgtgaagaccataaaaaaaaagcagaaacataaaggccgcggcaccgtgcgaactattaccaaacaagtgccaaacgaaagtttctttaacttttttaaccccctgaaggggaaagggcagtcgaagtcgaaggatgaagattccgaatttacactggccagtgactttgaaataggccatttcttcagagagagaatcgtgccgcgtgccgttctctatttcacaggtgaagccatcgaagacgacgacaatttcgaagaaggcgaggaaggcgaagaagaagagctggaaggcgatgaggagggggaagacgaggatgatgctgagataaaccctaagaaagagccatcgcagccggcggaatgcaagcaacagtag

SEQ ID NO: 127196 - DNA, 537 bp, Artificial Sequence
  Description of Artificial Sequence: Synthetic coding sequence
atggctgaccactccttttccgatggtgtacccagtgacagtgttgaagccgcgaagaatgcatctaataccgaaaaacttactgatcaggtcatgcaaaatccaagagtactcgctgctctgcaagagaggctcgacaatgtgccacatacaccatcgtcctacattgagaccctgccgaaggccgtcaaacgcagaattaacgccctgaaacagctacaagtccgatgtgcacacatcgaagctaaattttacgaagaggttcacgatctggaacggaagtacgccgccctgtatcagcctctgtttgacaagcggagagagtttataacgggtgatgtggaacccaccgatgcagaatcagagtggcattctgagaatgaagaagaagagaagcttgcaggcgacatgaaatccaaagtcgtggtcacagaaaaagctgccgctaccgcggaagaacccgatcccaagggaatccccgagttctggtttacgatattcaggaatgttgatatgctcagcgaactggttcaatag

SEQ ID NO: 127197 - DNA, 1161 bp, Artificial Sequence
  Description of Artificial Sequence: Synthetic coding sequence
atggccgatcacagttttagcgacggggtccctagcgacagcgtggaagcagcaaagaacgcttcaaacactgaaaaactgacagaccaagtgatgcagaatccacgtgttctggctgcactccaggaaaggctggataacgtcccccatacacctagctcctatatcgagaccctccccaaggccgtgaagcgacggatcaatgctctgaagcagttgcaagtccgctgtgcccacatcgaggccaaattctacgaggaggttcacgacctggaacgaaaatacgcagccctttaccagcccctatttgataaaagacgcgaattcatcacaggtgatgtggagcccaccgacgccgagtccgaatggcatagtgagaatgaagaagaagaaaagctggcgggcgatatgaaaagcaaagtggttgtgaccgagaaagcggccgcgaccgccgaggaaccagacccaaagggcattcctgaattctggtttactatcttccgcaatgtagatatgctcagcgagctggtgcaagagtacgatgagcccatccttaagcacctacaggatatcaaagttaaattctccgatcccggacagccaatgagctttgtcctggaatttcacttcgagccaaacgattatttcactaatagcgttctgacaaagacctacaagatgaaaagcgagcccgataaggccgatccattttcgtttgaaggccccgaaatcgtagactgcgatgggtgcaccatagattggaagaagggcaagaacgttacagtaaagaccattaaaaagaagcagaagcacaagggcaggggtactgtccgcactatcacaaagcaggtgccaaacgagtccttttttaactttttcaacccattgaaagcctcgggagatggggagagcctagacgaagacagtgagttcaccctggcctctgacttcgaaatcggtcatttctttcgggaaaggattgttccacgtgccgtactgtatttcaccggagaggcaatcgaagacgatgataacttcgaggagggagaagagggtgaggaggaagagctcgaaggcgacgaagaaggggaggacgaagacgacgccgaaatcaaccctaaaaaagagccttcccagcctgccgaatgtaagcagcagtag

SEQ ID NO: 127198 - DNA, 387 bp, Artificial Sequence
  Description of Artificial Sequence: Synthetic coding sequence
atggcggaccacagtttttcagacggagtgccctcagactcagtggaagctgctaagaatgctagtaacaccgagaaactgacagaccaggtgatgcagaatcctagggtgctggccgcactacaagagaggctagataatgtgccccatacaccttcttcatatatcgaaaccctcccaaaggcagtcaagagacggataaatgcgctcaagcagcttcaagtaagatgcgcccacatcgaagccaagttctatgaggaagtgcacgacttagaaagaaagtatgctgctctttatcaaccactgtttgacaaacgacgcgagttcattactggagatgtggaacctactgacgctgagagcgagtggcattcagagaatgagtag

SEQ ID NO: 127199 - DNA, 423 bp, Artificial Sequence
  Description of Artificial Sequence: Synthetic coding sequence
atggccgaccatagctttagcgatggcgtgccttctgattctgtggaggccgccaaaaacgcgagtaacacagaaaaattaacagaccaggtgatgcagaatcccagagttctggctgctctacaagaacggctagacaacgtgccacacactccttcctcctacatcgaaacactccccaaggccgtgaaacggcgcatcaacgccctgaagcaactccaagtgagatgtgcccatattgaagcaaaattctacgaggaggttcacgacctagagcgaaagtatgccgccctttatcagcccctgttcgataaacgccgcgaattcatcacaggagatgtggaacctaccgatgctgaatccgaatggcactccgagaacgaagaggaagagaaactggccggagatatgaagtcaaaatag

SEQ ID NO: 127200 - DNA, 402 bp, Artificial Sequence
  Description of Artificial Sequence: Synthetic coding sequence
atggcagatcatagctttagtgatggcgtcccatccgacagtgtggaggctgcaaaaaacgccagcaacactgagaaattaacggaccaggtgatgcagaatcctcgagtcctcgcagcactgcaagaaaggctggacaatgtacctcatacgccctcttcgtatatcgaaactctacccaaggccgtgaaacgtcgtattaatgccctaaagcagctccaggttcggtgtgcgcatattgaagcaaaattttacgaggaggtgcacgacttagaacgcaaatatgcagccctgtaccaaccactgttcgataaacggcgggagtttatcacaggtgatgttgaacctactgacgctgagagcgaatggcactccgagaacgaggaagaggagaaactatag

SEQ ID NO: 127201 - DNA, 324 bp, Artificial Sequence
  Description of Artificial Sequence: Synthetic coding sequence
atggctgatcactcctttagtgacggcgtcccaagtgattctgttgaagctgcaaagaatgcgagcaacaccgagaagttgactgatcaagtgatgcagaatccacgcgtgctggctgcccttcaagaacgtcttgataatgtgccacacaccccatcgtcttatatcgagacactgcctaaggctgtgaagcggcggatcaatgccctgaaacaactgcaagttcggtgcgcacatatcgaggcgaagttctacgaggaggtgcatgatctggagagaaaatacgctgccctataccaaccactgttcgataagagacgttag

SEQ ID NO: 127202 - DNA, 237 bp, Artificial Sequence
  Description of Artificial Sequence: Synthetic coding sequence
atggctgaccattcctttagcgatggtgttccatctgactcagttgaggctgctaagaatgcaagcaacaccgagaaactgaccgaccaagtgatgcaaaacccacgggtattagccgcgttgcaagaacggctggataacgtgccccatacacctagtagttacattgaaaccttaccgaaggctgttaagagacgaattaatgcactgaaacagctgcaagtcagatgtgcttag

SEQ ID NO: 127203 - DNA, 549 bp, Artificial Sequence
  Description of Artificial Sequence: Synthetic coding sequence
atggcagattcagagaatcaagggccggcagaaccttctcaggcggccgcagccgccgaggcagctgccgaggaagtgatggctgaaggcggtgcacagggtggtgactgcgacagtgctgctggagatcccgattctgctgccggccagatggccgaggaaccccaaaccccagctgagaacgctcctaaacccaaaaacgatttcatagagagtctgcccaacagcgtgaaatgtcgggtgctggcgctgaaaaaacttcagaagcggtgtgacaagattgaggccaagtttgataaagaattccaagcacttgagaagaagtacaatgatatctacaagcctttgctagcaaaaattcaggaactcacaggagagatggaggggtgtgcctggacgctggaaggcgaagaagaagaggaagaggaatatgaggacgatgaagaggagggggaggacgaggaggaggaggaggccgccgccgaggctgcagcgggggctaagcacgacgacgctcacgctgagatgcctgacgatgccaagaagtag

SEQ ID NO: 127204 - DNA, 438 bp, Artificial Sequence
  Description of Artificial Sequence: Synthetic coding sequence
atggctgattcagagaatcagggccctgccgaaccaagccaggcggcggcagcagctgaggccgcagccgaggaggtgatggcagagggtggggcccaaggaggggactgtgacagcgccgccggcgaccctgactcagccgccgggcagatggccgaggagcctcagaccccagcggaaaatgcgcccaagcctaagaatgatttcattgaatcactccctaattccgttaaatgtcgcgtattagccttgaagaagctacagaaacggtgcgataaaattgaggctaagtttgataaagaattccaagctctggagaaaaaatacaatgacatctacaaacccttactggcaaagatccaggagctgacaggggagatggaaggctgcgcctggactttggaaggcgaggagagacgtaagcgagtaaggggctag

SEQ ID NO: 127205 - DNA, 963 bp, Artificial Sequence
  Description of Artificial Sequence: Synthetic coding sequence
atggaggaagtgccacatgattgccccggggctgacagcgcccaggctggcaggggcgcctcctgtcaaggctgcccaaaccagcggctgtgcgcctcaggagctggtgctacccccgacacagcaatcgaagagataaaagaaaagatgaaaaccgttaagcataaaatcttagtcctgtctggcaaaggcggcgtgggtaagtctacatttagcgcccacttagcccatggcttagcagaagatgaaaacactcagattgcacttctggacatagacatctgcgggccatctatccccaaaataatgggccttgagggggagcaggtccatcagagcggttcgggctggtctccggtttacgtagaagataatctgggagtgatgtccgtgggctttctgctgtcttcccccgatgatgccgttatttggcgcgggcccaagaagaacggaatgattaagcaattccttagggatgtcgactggggggaggtggattacctgatcgttgatactccccccggtacatcggatgaacatttgtccgtggtgaggtacctcgctacagcccatatcgatggtgccgtaatcataaccacgccccaggaggtgagcctgcaggatgtcaggaaagaaattaacttctgcagaaaggtgaagcttccaataataggcgtggtagagaacatgtctggattcatctgccctaaatgcaagaaggagtcccagattttccccccgacaaccggaggggctgaactgatgtgtcaggatctggaggtgcccctcctcgggcgagtccccctcgatccattgataggcaagaattgcgataaaggtcagagcttcttcatcgacgcacctgactcgcctgctactctggcgtatagatccatcattcaacgcatacaagagttctgcaacctgcatcagagcaaggaggaaaatttaatctcaagctag

SEQ ID NO: 127206 - DNA, 930 bp, Artificial Sequence
  Description of Artificial Sequence: Synthetic coding sequence
atggaagaggtgccccatgactgtccaggcgcagactctgctcaagctggtcgaggagcgtcgtgccaaggctgccccaatcagagattatgtgcaagcggcgccggggccactccagacacggcgatcgaagaaatcaaagagaaaatgaagacagttaagcataaaattctggtgctgtccggcaagggaggggtcggcaaatcaaccttctctgcccacctggcccatgggttagcagaagacgagaatactcaaattgccctactggatattgatatatgtgggcctagtattcctaagattatgggcttagagggagagcaatatgtggaggataacctgggcgttatgtctgtagggtttttgttgtccagtcccgatgatgccgtgatctggcgcggcccaaagaagaacgggatgatcaagcagttcctgcgggatgtggactggggggaagtagactacctgattgttgacactccaccagggaccagcgacgagcatctgagcgtagtaaggtacctggcaaccgcgcatattgacggagccgttattatcactacgccacaggaagtgagtttgcaagacgtgcggaaagagatcaacttctgtagaaaagttaagttgccaatcataggtgtggttgagaacatgtccggattcatatgccctaaatgtaagaaggaaagtcagatcttccctcccacaactgggggagctgagctgatgtgtcaggatttagaggtgccattacttgggagagtgcccctggaccctttgatcgggaaaaattgtgataagggccagagcttcttcatcgacgcccctgactcacccgccacccttgcttacaggtcaattatccagcgcattcaggagttttgtaatcttcaccagagcaaagaggaaaacttaatcagtagttag

SEQ ID NO: 127207 - DNA, 816 bp, Artificial Sequence
  Description of Artificial Sequence: Synthetic coding sequence
atggaggccgcagccgagcctgggaacctcgctggagtccggcatataatcttggtgctgtccggtaagggtggagtcggcaagagcactatttctaccgaactggctctggcacttagacatgccggtaaaaaagtgggtatcctagacgttgacctttgcggccctagtatccctcggatgctgggagctcagggccgagcagttcaccagtgtgaccgcggttgggctcctgtattcctcgaccgcgagcagtctatttcactcatgagcgtggggttcctgctggagaagcccgatgaagcggttgtttggcgtggaccaaagaaaaatgcacttatcaagcaattcgtgtctgatgtcgcctggggagaattagactacctggtagtggacacaccccccggaacttccgacgaacatatggccacaattgaagccctgcggccatatcagcccctgggggcattggtggttaccaccccacaggcggtctcagttggagacgtaaggagagaactgactttctgtaggaagacagggctccgcgtgatgggaatagtcgaaaatatgagtgggttcacttgccctcactgtactgagtgtacgtctgtcttctctcgtggtggaggcgaagagctggcccagctggcaggtgtgcctttcctcggaagtgtccccctcgaccctgcacttatgcgaacactggaagaagggcacgatttcatacaggagtttccggggtcacctgccttcgctgcacttacaagcatcgctcagaagatcctcgatgcgacccccgcgtgtcttccttag

SEQ ID NO: 127208 - DNA, 393 bp, Artificial Sequence
  Description of Artificial Sequence: Synthetic coding sequence
atggccactatagaggcactgcgtccataccagcccctgggcgcacttgttgtgactacaccccaggccgtctcagtgggagacgtaaggagagaacttacattctgtcgaaaaacaggacttcgcgtgatgggcatcgtcgagaatatgagcggattcacatgcccgcactgcacagaatgcacttccgtcttcagccgcggtgggggagaagaactggcccagctcgccggggtgccatttctcggcagtgttcctctcgaccccgcactcatgaggactctggaagagggacacgacttcattcaagaattccctggttcacccgcgttcgcagccctgacctcaatagcccagaaaatcctggacgctactccagcttgtctgccttag

SEQ ID NO: 127209 - DNA, 960 bp, Artificial Sequence
  Description of Artificial Sequence: Synthetic coding sequence
atgggcatttggcaaaggctcctcctcttcgggggcgttagcctccgcgcgggggggggggcgaccgctccgttaggcggttccagggccatggtgtgcggcagacaactgtccggggcaggatccgagaccctcaaacagcgcagaacgcagatcatgagcaggggcctgccaaaacagaaacccatcgagggagtaaaacaggtgatagttgtagccagcggaaaaggaggagtcgggaagtctaccacagcagtcaatttagccctggccctcgctgctaatgattccagcaaagcaatcggcctgcttgatgtggatgtgtatgggcctagtgtgcctaaaatgatgaatctgaaaggaaacccggaactctcccagtcaaacctgatgcggcctctcttgaattatggcatcgcttgtatgtctatgggattccttgtagaggagagtgagccagtggtatggcgcggcctgatggtcatgagcgctatcgaaaagctgctacgccaggttgactggggacagctggattatctggtcgttgatatgccaccaggcactggtgacgtgcaactgtccgtgtcacaaaacattccaattacaggagctgttatcgtgtccacgcctcaggatatagccctgatggacgcccacaagggcgctgagatgttccgtcgcgtacacgtcccagttcttggactcgttcagaacatgtccgtttttcagtgtcctaagtgtaagcacaaaacgcatatctttggtgccgacggagcccgcaagcttgcccagacattgggtctagaagtgctaggcgacatccctctgcatctgaacatccgtgaagcatccgatacaggccagccaatagtcttttcccaaccagagtcagatgaggctaaggcctaccttaggattgcggtggaagttgtgagaagacttccttctcctagcgagtag

SEQ ID NO: 127210 - DNA, 672 bp, Artificial Sequence
  Description of Artificial Sequence: Synthetic coding sequence
atgtctaaagccatcgggctcctggacgtggatgtgtacggaccgagtgtcccaaaaatgatgaatctgaaagggaacccagaactcagtcagtccaacctgatgaggccgttgctcaactacgggatcgcctgcatgagcatgggcttcctggtagaggagtccgagcctgttgtgtggcgggggttgatggtgatgtccgccattgaaaagctcctgcgccaggtggactggggacagctggattatctcgtggtcgacatgcctcctggcacaggggatgttcagctctccgtttcccagaatattccaatcaccggggccgtcattgtgagcacacctcaggatattgcgctgatggatgcccataagggcgcagaaatgttcagacgcgtgcatgtacccgtgctgggcctggtccagaacatgtctgtttttcaatgtccaaagtgcaagcacaagacacatatattcggagccgatggcgctagaaaactggcgcagaccctggggcttgaagtcctcggcgatataccattgcatctgaacatcagggaggcatccgacacagggcagcctattgtgttctctcagcccgaaagcgatgaagcaaaggcctatttgaggatagcagttgaggtcgtgcgacgactcccttccccctctgaatag

SEQ ID NO: 127211 - DNA, 3123 bp, Artificial Sequence
  Description of Artificial Sequence: Synthetic coding sequence
atgggggaggaagggggctccgcatctcacgacgaagaggagagggcctctgtgctgctcggacacagccccggttgtgagatgtgcagtcaggaagcatttcaggcacagagatcacagctggttgagttgctggttagcggatctctggagggcttcgaaagtgtgctcgactggctgctgtcttgggaagtgttatcatgggaggattatgagggcttccacttactcgggcaacctctcagccacttagccagacgactactcgacaccgtttggaataagggcacatgggcctgccaaaaactcattgcagctgcgcaagaagcacaggctgattcgcaaagccccaagcttcacggctgttgggacccccacagtcttcaccctgctcgcgacctgcagtcacatcgcccagccatcgtgcggcggcttcattcacacgtcgagaatatgcttgacttggcttgggagcgtggctttgtctcacagtacgaatgcgacgaaatccgactgcccatctttactccatcgcagcgggcgcggcgtctgctggacctagcaacagtcaaggccaatggattggccgcctttctgctccaacatgtacaagagttaccagtgccccttgctctgccactggaggccgcaacatgtaagaaatacatggcaaagttacgcaccacagtttccgcccagtcccgctttctgtccacctatgacggcgctgagaccctgtgcctggaggacatatacaccgaaaacgtcttggaggtctgggcggatgttggaatggcaggacctccccagaagtcccctgccaccctcggcctagaagagttgttctctactccgggccaccttaacgacgatgctgacacagtgctggttgtcggagaggcagggtctgggaagagcacactcctgcagcggctgcatctcttgtgggctgccggccaggacttccaagagttccttttcgtattccctttttcctgccggcagttacagtgcatggccaagccactctccgtgcgaacattgctcttcgagcactgctgttggcccgatgtcggtcaggaggatatttttcagcttcttctcgaccaccccgatcgcgtactgttaacctttgacggcttcgacgaattcaaattccgcttcacagacagagagcggcattgcagccccaccgaccccacatctgtacagaccctgctcttcaatctgctgcagggaaacctgttgaagaatgcccgtaaggttgtcactagccgacccgccgctgtctcagcattcctgcgcaaatacatccgtacagagttcaacctgaagggattctcagaacagggcatcgagttgtacctgagaaaacgccaccacgagccaggcgtggctgacagactgattagacttctgcaggagacctccgctctgcacggcctgtgtcatttgcctgtctttagctggatggtcagcaagtgtcaccaggaactactgcttcaggagggcggctctcctaaaactacaacagatatgtatttactgattctccaacacttcctactccatgccacacctcctgactctgcatcccagggtctgggcccctctcttctgcgaggtaggctacccacactgcttcatcttggccggttggctctgtggggcctcgggatgtgctgctacgtatttagcgcccagcagctccaggccgcccaggtttcccccgatgacattagtctcgggtttctggtgcgcgcaaagggggtggtacccggctctactgcccctctggaattcctgcacattacattccagtgtttcttcgctgcgttctatcttgctctttctgctgatgtcccccctgccctgttgaggcaccttttcaattgtggccggcccggaaactctccgatggcacgactgctcccgactatgtgcatacaggcttcggaggggaaagactccagcgtcgctgccctgctgcagaaggctgaacctcacaatttacagataaccgctgctttcttagctggtttactgtccagggagcattggggcctccttgccgaatgtcagacaagcgagaaagctctcttacggaggcaagcttgtgctaggtggtgtcttgcacggagcctgcgtaagcacttccactcaatcccacctgctgcacctggcgaagcaaagtcggttcacgcaatgcccggtttcatatggttgatccgcagcttgtatgaaatgcaggaggagaggctagcaaggaaggctgcaaggggactgaacgtgggccatctgaagctgaccttctgctccgtcggaccaactgagtgtgccgccctggcctttgtgctccagcacctcagacgccccgttgcactccagctggactacaacagtgtaggcgacatcggagtggaacagttactcccctgtctcggcgtgtgcaaagctctgtatttgcgggacaataacatttccgatcgtgggatttgtaaactgattgaatgcgccttgcactgtgaacagctgcagaagctcgccttgttcaacaacaagctgactgacgggtgtgctcactctatggcaaagttactggcctgtagacagaattttctggcattgagactcggcaataattatatcactgcagccggcgcacaggtgttggccgaaggacttcgggggaatacgtccctacagtttctgggcttttggggcaatagagttggcgacgaaggcgctcaggctttagctgaggcgcttggcgaccaccagagcctgcggtggctgagtctcgtggggaacaacatcggctctgtgggcgcacaagcgctggctctgatgctcgcaaagaacgtgatgttagaagagctgtgtctggaagaaaaccacctgcaggacgaaggcgtctgtagcctcgccgagggtcttaagaagaactctagcctgaagatcctcaaactgtctaataattgcataacatatttgggtgctgaagccctcctgcaggcccttgagagaaacgatactatcctcgaggtatggctgcgagggaatacattcagcctagaagaagtagataaactcggctgccgcgacactcgtttacttctgtag

SEQ ID NO: 127212 - DNA, 543 bp, Artificial Sequence
  Description of Artificial Sequence: Synthetic coding sequence
atgtggctcctgccccccggtcaagtgtttaatgccttctttccgagtcgactaggcaataattatatcacagcagccggcgctcaagtgcttgctgagggtttgaggggcaatacctcacttcaatttcttgggttttggggcaacagggtgggggatgaaggagcccaagccctcgccgaggctttaggtgaccaccagtcgctccgctggctgtccctggttggtaacaacattggttctgtgggggcccaggcgctcgccctgatgcttgcaaagaacgtgatgttagaggaactctgtctggaggagaaccatctgcaggacgaaggggtgtgctcactggcagagggccttaaaaagaacagctccctaaagatcctgaagttaagcaataactgcatcacatacctgggcgctgaggctttgctccaagccctcgaaagaaatgatactatcctggaagtgtggctgcgcggaaacacgttctcacttgaagaggttgataagctgggctgtcgtgatacaagacttcttctgtag

SEQ ID NO: 127213 - DNA, 1008 bp, Artificial Sequence
  Description of Artificial Sequence: Synthetic coding sequence
atggaagacagcggcaagacatttagctctgaggaagaagaagcaaactattggaaagacctagctatgacatataagcagcgtgccgagaacacgcaggaggaattgcgcgaattccaagaaggatctagggagtatgaagctgaactggagactcagttgcaacagattgagaccagaaatcgtgatctcctgagtgagaataatcggttgaggatggaactggagactatcaaggagaaattcgaggtccagcacagcgagggataccgccaaatatccgcactggaggacgatctggcacagactaaagctatcaaggatcagctgcagaaatatatcagggaactggagcaggccaacgatgaccttgaaagagcaaagcgcgccaccataatgagcctggaagattttgaacagcgacttaaccaagcaattgagcggaacgctttcctggagagcgaactggacgagaaagaaaacctgctggaaagtgtccagcgcctgaaggatgaagctcgcgacctgagacaggaactggccgtccaacagaaacaggaaaaaccgcggactccaatgccttccagtgtggaggcagagcgcactgatactgccgtgcaggctacaggctcagtgccatcgaccccaattgcccatcggggaccgtcctccagccttaatacacctggctcctttcgccgggggttagatgactctacaggaggcacccccctgaccccggctgctcgtatttcagcactaaatatcgtgggagatctgcttcggaaagtgggggcgctggagtccaaattagcatcatgccgcaatttggtgtatgaccagagcccaaataggacgggcgggcccgcatctgggcgttccagcaagaacagagatgggggagaaaggcgaccaagctcgactagtgtgcccttgggagataaaggcctggacacatcatgtagatggctatccaagagtactacaagaagctctagctcctgctag

SEQ ID NO: 127214 - DNA, 1041 bp, Artificial Sequence
  Description of Artificial Sequence: Synthetic coding sequence
atggaggactccggaaaaactttcagttccgaggaagaggaagcgaattactggaaagaccttgccatgacgtataagcaacgggccgagaatacccaggaagaactcagggagtttcaggagggaagtcgagagtacgaggctgaattggagacacagttgcaacagattgagacacgtaaccgggacttgctttctgaaaataatcgactgaggatggagctggaaactataaaggagaaatttgaggtgcagcactctgagggttacaggcaaattagcgccctagaggacgatttggcccagacaaaggccataaaagatcagctgcagaaatacatcagagagttagagcaagcaaacgacgacctcgagagggctaagcgcgccactatcatgtccctggaagattttgagcagcgtctgaatcaggcgattgagaggaacgcctttctggaatcggagctcgacgaaaaggaaaatctcctggagtcggtgcaaaggctcaaggatgaggccagagatctcaggcaagagctggctgtccagcagaagcaagagaagccaaggactcccatgccctcatccgtagaagcagaacgtacagacacggctgtgcaagctaccggcagcgtccccagtacaccaatcgcccatcgtggtcccagctctagtcttaacacccccggctctttcaggagaggcctggatgacagcaccgggggaactcctctgactccagccgccagaatctctgcattgaatatcgtcggggaccttctgcgcaaagtgggggcactggaaagcaaactggcttcctgcagaaatctcgtatacgatcagagtcccaaccgcaccgggggaccagcatcaggcaggagctcgaagaaccgggacgggggagagcgtcgccccagctccacatctgtacccttgggggataagggattaggtaaaagactggaatttggaaaacctccttcccatatgtcaagctctcctctccctagtgctcagggggttgtgaaaatgctgctctag

SEQ ID NO: 127215 - DNA, 1008 bp, Artificial Sequence
  Description of Artificial Sequence: Synthetic coding sequence
atggaagattcaggaaaaactttctccagtgaagaagaagaggctaattactggaaggatttggcaatgacgtacaagcagagagctgagaacacacaggaggaacttcgcgagtttcaggaggggagccgggagtatgaagctgaactcgagactcaactgcaacaaattgaaactcgtaaccgggatctgctgtcagaaaacaaccgactccgaatggaactcgagacgattaaagagaagttcgaagtccagcatagcgagggctaccggcaaatatccgctctggaggacgatttggctcagaccaaagccattaaggaccagctgcagaagtacattcgcgagctggaacaggccaatgacgatttggagagggccaagagagcaacaatcatgagcctcgaggactttgagcaaagattgaaccaggcgatcgaacgcaacgcctttttggagtccgaactagacgaaaaggagaatcttctggaatccgtccagcgcctcaaggacgaggctcgcgacctccgacaggagctggccgtgcagcagaaacaggagaagcctaggacccccatgccttcctcagtagaagcagagcggaccgatactgccgtccaggccactggctccgtcccatccaccccaatcgctcaccgcggaccgtcaagcagtctcaatacacccgggtcttttcgaagggggcttgacgactctacaggaggcacccctttgactcctgctgcgcgaataagtgcccttaacattgtgggcgacctgctcagaaaagtcggcgcgctcgagtccaagctggcatcttgcagaaacctggtctatgaccaatctccgaacaggacagggggtccggcctctggccgttccagtaaaaaccgagatggtggggagaggagacctagtagcactagcgtacccttgggggacaagggcttggacactagctgtaggtggttgagcaaatctacgacacggtcatcttcctcgtgctag

SEQ ID NO: 127216 - DNA, 1008 bp, Artificial Sequence
  Description of Artificial Sequence: Synthetic coding sequence
atggaggacagcggtaaaactttcagtagcgaggaagaagaggcaaactactggaaggacctcgctatgacatacaagcagcgggccgagaacacacaggaggagctaagagagtttcaggagggaagtcgggagtatgaggcggagctggagacccaattgcagcagatagaaacacgcaaccgtgatctgctgtccgagaataatagactccgaatggagctggagaccattaaggaaaagtttgaagtgcagcactccgaaggttatcgccagatttctgcgctggaagacgaccttgcgcaaactaaggccatcaaggatcagctccagaaatacatccgggagctggagcaggcgaacgatgatctcgaacgcgccaagcgggcgaccatcatgagcttggaagactttgagcagcgtctgaatcaggctatagaacgaaacgcatttctagagtctgaactagacgaaaaggagaatctgctggagtccgttcaacggttaaaggacgaggcccgtgacctgagacaggagttggctgtccagcagaagcaagagaagccgcgaactcctatgccttcaagtgtggaagctgagcggactgatacagcagtccaggccaccggcagtgtccctagcactcctattgctcaccggggcccctcatcatccttaaataccccgggaagtttccgacgaggattggacgattcaaccgggggaacaccactcacacctgcagctcggatcagcgctctaaatatagtcggtgacttgttgaggaaagtgggggccctcgagtccaagctagccagctgtagaaatctggtgtatgaccagagtccaaatagaaccggagggcctgctagcgggcgtagcagcaaaaaccgggatgggggggagagaagaccgagctctacctcagtccccctgggagacaaaggtctggatacttcctgtcggtggctgtccaagagtactactcgctcaagctccagttgctag

SEQ ID NO: 127217 - DNA, 471 bp, Artificial Sequence
  Description of Artificial Sequence: Synthetic coding sequence
atgggagcctcccggctctatacattagttctcgtgctgcagccccagagagttctgctaggcatgaaaaagcggggttttggagctggaagatggaacggtttcgggggcaaagtgcaggagggagaaaccattgaggatggtgctagacgggagcttcaggaagagagtggacttacggtagacgctctccacaaggtagggcagatcgtgtttgagttcgtgggagaacccgagcttatggacgtccacgtgttctgtactgattctattcaggggacgcccgtggagtccgacgagatgagaccctgctggttccagctggatcaaatcccgttcaaagacatgtggccagatgactcatattggttccccctgctgctgcagaagaagaagtttcatgggtatttcaaatttcagggacaggacacgattctagattacaccttgcgcgaggtggacacagtgtag

SEQ ID NO: 127218 - DNA, 540 bp, Artificial Sequence
  Description of Artificial Sequence: Synthetic coding sequence
atgagcgggattagcccccagcagatgggcgaaccagaaggaagctggagcggtaagaatcccggtacgatgggcgcctccaggctgtacactctggttctcgtcctgcagcctcaaagagtgctgctgggcatgaagaagcggggcttcggtgcggggcgctggaatggattcggcggtaaggtccaggaaggggagactatagaagacggagctaggcgcgaactgcaggaggaatccggactcacggtggatgcactgcacaaagtcggccagattgtgtttgaattcgtgggggaaccagagctgatggacgttcacgtattttgtaccgatagtatccagggtacgccggtggaatctgacgaaatgcggccatgttggtttcagctggaccagatccctttcaaagacatgtggccagatgattcatactggttccctctccttctccagaagaagaaattccatggctatttcaagtttcaagggcaggacaccatactggactatacattacgggaggtggatacagtgtag

SEQ ID NO: 127219 - DNA, 471 bp, Artificial Sequence
  Description of Artificial Sequence: Synthetic coding sequence
atgggagctagcagattatatactctggtacttgtgctgcagccacagagggtattactcggcatgaaaaaacgcggattcggagcgggcagatggaacggatttggaggcaaggtacaggaaggagaaaccatcgaagacggagcaagacgggagttgcaggaggagtcaggcctcacggtggacgccctgcacaaggtaggccagatagtcttcgaatttgtaggggaacctgagctgatggatgtccatgtgttctgtaccgactcaattcaggggactcccgtcgaaagtgatgagatgagaccatgctggtttcagctagatcagattccatttaaagacatgtggcccgacgattcgtactggttcccactcttactgcagaagaagaagtttcacggatattttaaatttcaaggccaggatactattttggattacaccctgcgggaagttgatacagtgtag

SEQ ID NO: 127220 - DNA, 471 bp, Artificial Sequence
  Description of Artificial Sequence: Synthetic coding sequence
atgggtgcctcgaggctgtacacactggtgctggtccttcagcctcagagggtgctcctggggatgaaaaagcgcggcttcggtgccggcagatggaatggattcggcggaaaggtgcaagagggtgaaacaatcgaggatggagcaagaagagagttgcaggaggaaagcggactgaccgtggacgctttacataaggtgggacaaatcgtcttcgagttcgtcggcgaaccagagctcatggacgtccatgtgttttgcacagacagtattcagggaactccagtcgagagcgatgaaatgagaccctgttggtttcaacttgatcagattcccttcaaggatatgtggcccgacgactcatattggtttcctcttttgcttcagaaaaagaagtttcacggctatttcaagttccagggccaggataccatcctcgattacaccctgcgcgaggtcgacactgtttag

SEQ ID NO: 127221 - DNA, 540 bp, Artificial Sequence
  Description of Artificial Sequence: Synthetic coding sequence
atgtctggcataagcccgcagcaaatgggagaacctgagggctcttggagtggcaaaaaccccggtactatgggcgcctctcggttgtacacgttggtactggtcctacagcctcagcgcgtattactcggcatgaagaaaagggggtttggagcggggaggtggaatggctttggcggaaaagttcaagaaggcgaaacaatcgaagatggcgccaggcgcgagcttcaggaagagtctggactgacagtggatgccctacataaagtcggccagattgtctttgagttcgtgggagagcccgagcttatggatgtacatgtcttctgcaccgacagtattcagggaacgcccgtggaaagtgacgagatgcgcccctgttggttccagctggaccaaatcccttttaaagatatgtggcctgatgactcatactggttccctctgctattgcaaaagaagaagttccacggctattttaagttccaggggcaggatacaattctggattataccttgagagaagtcgacaccgtgtag

SEQ ID NO: 127222 - DNA, 540 bp, Artificial Sequence
  Description of Artificial Sequence: Synthetic coding sequence
atgtccggaatttctccccagcagatgggcgaaccggagggtagctggtccggcaagaatccaggaactatgggagcttcgaggctgtacactcttgtgcttgttttgcagcctcagagagtgcttcttggtatgaagaagcggggattcggcgcgggtcgatggaatggctttgggggcaaggtacaggagggggagaccattgaggacggagccaggcgtgagcttcaggaagaatccggactaaccgtagatgccctccacaaagtgggacagatcgtgtttgagttcgtgggagagcctgaactgatggatgttcacgtcttttgtactgactccattcaaggcacaccagtggagtcagatgagatgagaccttgctggtttcagctcgaccagattcctttcaaagacatgtggccggatgactcgtattggtttcccttgctgcttcagaagaagaagtttcacggctactttaaattccagggtcaggacaccattcttgattacactctgagagaggtggatacagtgtag

SEQ ID NO: 127223 - DNA, 114 bp, Artificial Sequence
  Description of Artificial Sequence: Synthetic coding sequence
atgggagccagcaggctatacaccttagtgctcgtgctgcagcctcagcgcgtcctgctgggcatgaagaaacgaggtttcggggccgggagatggaatggcttcggagggtag

SEQ ID NO: 127224 - DNA, 495 bp, Artificial Sequence
  Description of Artificial Sequence: Synthetic coding sequence
atgaagtgcaaaccaaaccagacaagaacctatgaccccgagggctttaagaagagggccgcttgcctctgctttagaagtgagcgtgaagatgaagttctgctcgtttcttcaagcaggtatccggaccgctggatagtgccaggaggaggcatggagcccgaagaagaacccggtggggccgcagtccgggaggtctatgaagaggcaggcgtcaaaggtaaactgggacgcctgcttggcgtttttgaacaaaaccaagatcctaaacaccggacgtacgtttatgtcctgacggttacggaactcctcgaagactgggaagactctgtgagcattggcagaaaacgggaatggtttaaggtcgaggacgcaatcaaagttctgcagtgccataaacccgtccacgccgagtacctggagaagctgaagctgggaggatctcctaccaatgggaattccatggccccatctagccccgattccgatccctag

SEQ ID NO: 127225 - DNA, 495 bp, Artificial Sequence
  Description of Artificial Sequence: Synthetic coding sequence
atgaagtgcaagcctaaccaaacgcgcacctatgaccctgagggctttaagaagagagcagcgtgcttgtgctttcgctcagagcgggaggacgaagtgctgctggtttcaagctctcgctacccagaccggtggatcgtgcccggcgggggtatggaacctgaagaggaacccggcggtgccgctgtgcgtgaggtgtatgaggaagccggagtgaaagggaagctaggacggctcctgggcgtgttcgaacagaatcaggaccctaagcatagaacctacgtgtacgttctgacggtaacagaattactggaagattgggaggattctgtttcgataggacgtaagagagaatggtttaaggtggaagacgctatcaaagtcctgcaatgccacaaacctgtccatgcagaatatctggagaaactgaaacttggagggtcaccaaccaatggaaacagtatggctccgtctagcccagactcggatccttag

SEQ ID NO: 127226 - DNA, 444 bp, Artificial Sequence
  Description of Artificial Sequence: Synthetic coding sequence
atggccctgcgggcctgcggtctaattatttttcgccggtgcctgatccctaaagttgataataacgctatagagtttctactgctgcaagcgtcagatggaatccaccactggacacccccaaagggccacgtggagcctggcgaagatgatctggaaacagccctccgcgagacacaggaagaggccgggattgaagctggacaactgacgataatcgaaggattcaagcgcgagctgaactacgttgcacgcaacaaacccaagactgtgatatactggcttgcggaagtcaaggactacgacgtggagatacgactgtcccatgaacatcaggcctatcggtggctgggccttgaggaggcatgccagcttgcccaatttaaagagatgaaagctgccttgcaagaggggcatcagttcctgtgttctatcgaggcgtag

SEQ ID NO: 127227 - DNA, 444 bp, Artificial Sequence
  Description of Artificial Sequence: Synthetic coding sequence
atggctttgagagcctgcgggctcattatcttccgccgatgtttgattccaaaggttgataataatgctattgaatttctccttctccaggcatccgatgggatacaccactggaccccccccaaagggcacgttgaacctggagaagatgacctggaaactgctctgcgagagacacaggaggaggcagggatcgaggctggacagctgaccatcatagagggattcaagcgagagttgaactatgtggcgcgcaataagccaaaaactgtcatttactggctggctgaggttaaggactatgatgtggagatccggctgtctcacgagcaccaggcttacaggtggctgggtctcgaagaagcatgtcagttagcccagttcaaggagatgaaagccgctcttcaggaaggtcatcagtttctgtgttccattgaggcttag

SEQ ID NO: 127228 - DNA, 444 bp, Artificial Sequence
  Description of Artificial Sequence: Synthetic coding sequence
atggctctccgagcctgtggtctgatcatcttccggcgctgtctgatcccgaaggtcgacaacaatgccattgaatttttgcttttacaagccagcgacggtattcaccactggacccctccaaagggtcacgttgagccaggcgaggacgaccttgagacagccttgcgagaaacccaggaagaggccggtattgaggcaggtcagctgacgatcatcgagggctttaaaagagaactcaactatgtggccaggaataaacctaagaccgtgatttactggctggctgaagtgaaagactacgacgtggagatacggctgtctcacgaacatcaggcataccgttggttaggtctcgaagaggcgtgccaactcgcccagttcaaagagatgaaagctgcacttcaggagggccaccagttcctgtgctcgatagaggcttag

SEQ ID NO: 127229 - DNA, 444 bp, Artificial Sequence
  Description of Artificial Sequence: Synthetic coding sequence
atggccttgagagcatgtggactgataatctttagaaggtgtctgattccaaaagttgacaataacgccatcgaatttctactgttgcaggcctctgacggaatccaccactggaccccccccaagggtcacgtggagccgggagaggacgacctcgaaactgctctccgcgagacccaggaggaggcagggattgaggctggacagcttacaattatcgaaggatttaagagagagcttaattatgttgctagaaacaaaccgaaaaccgtaatttattggctggcggaggtgaaggattacgacgtcgagattcgtctgtcgcacgagcatcaggcgtataggtggttggggctcgaggaggcctgccagctggcgcagtttaaagaaatgaaagcggcactgcaagagggacaccagtttctgtgcagcatagaggcctag

SEQ ID NO: 127230 - DNA, 444 bp, Artificial Sequence
  Description of Artificial Sequence: Synthetic coding sequence
atggctttgagggcctgcggccttattatttttcgtagatgtctcatccctaaagttgataataatgcaatcgaatttctgcttctgcaggcttctgacggaattcaccattggactccacctaaggggcacgtagagccaggcgaagatgacctggagactgccctacgggagactcaggaagaggccgggatagaagccggacagctaaccattatcgagggttttaagcgggagctgaactacgtcgcccgtaacaagccaaaaaccgtgatttactggctggccgaagtcaaggactatgacgtggagatccgcctctctcacgaacatcaagcgtaccggtggctgggtctcgaagaggcctgccagctggcacaatttaaggagatgaaggctgctttacaggagggccaccaatttttgtgcagtatcgaagcatag

SEQ ID NO: 127231 - DNA, 1395 bp, Artificial Sequence
  Description of Artificial Sequence: Synthetic coding sequence
atggagactctgtcttttccccgatataacgtggctgaaattgtaatccacatacggaataagatcctgacaggagccgacggtaagaatttaaccaagaatgatctgtaccccaacccaaaacctgaggtgctccatatgatctatatgcgtgctctccaaattgtttacgggatcagactagaacacttctatatgatgcctgtcaattcagaggtgatgtacccccacctcatggaaggatttctgcccttttcgaatttggtgacccacctcgattcctttctgccaatctgccgtgtgaatgactttgaaactgcagacattctgtgtccgaaagcaaagcgcacaagcaggttcctgtcgggcatcatcaatttcatccacttccgtgaggcctgccgagagacttacatggaatttctctggcagtacaaaagttctgccgataagatgcagcagctcaatgctgctcaccaggaggctctgatgaagttggaaagactcgactccgtgcccgtggaagaacaggaggaattcaaacagctttcagatggcattcaggaactccaacagtcactgaatcaagactttcaccagaaaacaatcgtgctgcaagaagggaattcacagaagaagtctaacatttctgaaaaaaccaaacgcctgaacgagctgaagctgagcgtggtcagtctcaaagagatacaagaaagtttaaagacgaagatcgtagactcacccgagaagctgaagaactacaaggaaaaaatgaaggacacagtacagaagcttaagaacgccagacaggaagtggtggagaaatatgagatatatggggactctgtggattgcctcccttcgtgtcaactcgaggtccagctgtaccagaagaagatccaggatctgtctgacaatagagagaaactggcctcgatcctcaaggaatccctgaatctagaggatcagatcgagagcgacgaatccgaactcaaaaagctcaagactgaggaaaattcattcaagagactgatgatcgtaaagaaagagaagctcgccacagcccagtttaagataaataaaaaacatgaagacgttaagcagtataaacgaaccgttatcgaagattgcaacaaggtgcaggaaaaacgcggggcagtctatgagcgcgttaccacaatcaaccaagaaatacaaaaaatcaagttgggaatccaacaactcaaggatgccgcggagagggagaagctcaagtctcaggagatctttcttaatttgaagactgcactagagaaataccacgacggcatcgaaaaagctgctgaagactcctacgctaagattgacgagaagaccgctgaattgaaacgcaaaatgttcaagatgagtacatag

SEQ ID NO: 127232 - DNA, 1395 bp, Artificial Sequence
  Description of Artificial Sequence: Synthetic coding sequence
atggagaccctttcctttcctagatataacgtggccgagatcgttatccatattcgtaataagatccttactggtgccgacgggaagaatctcactaaaaatgacctctaccccaaccccaagccagaagttctgcacatgatctacatgcgggctctgcagatagtgtatggtattcgccttgagcacttctatatgatgccagtgaactccgaggtcatgtatcctcacctgatggaaggatttctgcctttctctaatctggttacacatctggacagcttcttaccaatctgtcgagtaaacgactttgaaactgctgatatcctgtgtcccaaagctaaacgaacaagccggttcctctccggtattatcaattttatacatttccgcgaggcctgcagggagacctatatggagttcctgtggcagtacaagagttctgctgacaagatgcagcaacttaatgccgctcatcaggaggcacttatgaagctggagagactggactctgtgccagtcgaagaacaagaggaattcaagcagctctctgatggaatccaggagctccaacagtctctgaaccaggatttccaccaaaaaactattgtactgcaagaaggcaactcccagaaaaagagcaacattagtgaaaagaccaaacgcctgaatgaactcaagctctccgtggtgtccttgaaggagattcaagagtctctgaaaactaagatcgtagacagtcccgagaaactcaagaattacaaagagaaaatgaaagatactgtccagaagctgaagaacgccaggcaagaagtggtagaaaaatacgagatctatggagactcagtggactgtctaccaagctgccagctcgaggtacaattgtaccagaagaagatccaggacctgtctgataatcgggaaaagttggcctcaatacttaaggagagcttaaacctggaggaccagattgagtccgatgagagtgagctcaagaaactgaaaactgaggaaaattcattcaaaagactgatgattgtgaagaaggaaaaacttgccacagctcaattcaagattaataaaaaacacgaggatgtaaaacaatacaagagaacagtcatcgaagattgtaataaggtgcaggaaaaacgcggggccgtgtacgaacgggtgactacgatcaatcaagagattcagaagatcaaactgggcatccagcagctgaaggacgctgcagagcgagagaagttgaagagccaggaaattttcctgaacctcaaaacagcactggaaaagtaccacgacggaatcgaaaaggccgctgaagatagctatgccaaaatagacgagaagaccgccgagctcaagcgcaagatgttcaaaatgagtacttag

SEQ ID NO: 127233 - DNA, 609 bp, Artificial Sequence
  Description of Artificial Sequence: Synthetic coding sequence
atggaaaccctttctttcccccgatacaacgttgccgagattgtgatccatatccgcaataagattctgacaggagccgacggtaagaaccttaccaagaacgatctgtatccaaatcccaaaccagaagtcctccatatgatatacatgcgggctctgcagatcgtttacggcattcggttggagcacttttatatgatgccagtcaactctgaagtgatgtacccccatctgatggaaggtttcctccctttttctaatctcgttacacatctggatagctttttaccgatctgtagggtcaacgacttcgagaccgcagacattttatgcccgaaggctaagcggaccagtcgttttctctctggaatcatcaacttcattcacttccgggaggcctgtcgtgaaacctatatggagttcctgtggcagtataagtctagtgctgacaaaatgcaacaattgaacgccgcacatcaggaggccctgatgaagctggaaagacttgactccgtgcccgtggaagagcaggaagagtttaaacagctgagtgacggcatccaggagctgcaacagtccttgaatcaggacttccatcaaaaaacgtag

SEQ ID NO: 127234 - DNA, 438 bp, Artificial Sequence
  Description of Artificial Sequence: Synthetic coding sequence
atggaaacattatctttcccccggtacaacgtggccgagattgtcatccacatcagaaataaaattttgacaggggccgacgggaagaatctcaccaagaacgatttgtatccaaaccccaagcccgaagtactgcacatgatttacatgagggcactgcagatcgtgtatggtatcaggttagagcacttttatatgatgccggtgaacagcgaggtgatgtacccacacttgatggagggatttctgccatttagcaacctagtcacccacctcgattcattcctgccaatctgcagggtgaacgactttgaaacagccgatatcctctgtccaaaggctaaaagaacatccaggttcttgagcggaatcatcaacttcattcacttccgagaggcctgcagagaaacatacatggagttcctttggcagtattag

SEQ ID NO: 127235 - DNA, 666 bp, Artificial Sequence
  Description of Artificial Sequence: Synthetic coding sequence
atggagacgctgtcgttcccgagatacaatgtagccgaaatcgtgatccatatccgcaacaagatcctgactggcgcggatggcaaaaatctgacaaagaatgatctgtatcccaacccaaaacctgaggtgctacacatgatctacatgcgggcccttcagattgtttatggaatcaggcttgaacacttttacatgatgcccgttaactctgaagtcatgtatccacacctaatggagggatttcttcccttttctaacctggtgacgcacctagactcgttcctcccaatctgccgtgtgaacgactttgagaccgcggatattttgtgtccaaaggcgaaacgtacctctcgtttcctttctgggatcatcaattttatccactttcgagaggcttgtagggagacctatatggaatttctgtggcagtacaaaagctctgcagataaaatgcagcagcttaatgccgctcaccaggaggcgctgatgaaactcgaacggcttgattctgtcccagtggaggagcaagaagagtttaagcagctgagtgatggaattcaggagctgcagcagagtctcaatcaggacttccaccagaaaacgtgttgtaagcgggaaattcccaagagatcccagatcttccagcgaaaacctagcgtttag

SEQ ID NO: 127236 - DNA, 1254 bp, Artificial Sequence
  Description of Artificial Sequence: Synthetic coding sequence
atggagaccctgtccttccctcggtataatgttgccgagatcgtgattcacattagaaacaagatcctcaccggggcagatggcaagaatctgacgaagaatgatctgtatccgaacccaaaacccgaggttctgcatatgatatatatgcgggcactgcagattgtgtacgggatacggctggaacatttttatatgatgcctgtcaattcggaggtgatgtaccctcatcttatggaggggtttttgcccttttcaaacctcgtcacccacctcgactcctttctgccaatatgccgggttaatgacttcgaaactgccgacatactgtgccccaaggcgaaaagaacatccaggtttttaagcgggatcattaatttcatacattttagggaagcttgccgtgagacctacatggagttcctttggcagtacaaatccagcgccgacaagatgcaacagctgaatgccgcgcatcaggaggcgctgatgaagctggagcgcctagattcagtgcctgtggaggagcaagaagaatttaagcagttgtccgacgggatccaagagctgcagcagagcctgaatcaggacttccaccagaaaactatcgtcctgcaggagggcaactctcagaaaaaatccaacatctctgaaaagaccaaacggctgaacgagctcaagttatctgtggtttcccttaaagagatacaggaaagcctgaagacaaagatcgtagatagcccagaaaagctcaagaattacaaagaaaaaatgaaggatactgtgcaaaaactaaaaaacgccaggtctctgaatctcgaagatcagatcgaatctgatgagagcgagttgaaaaagctcaagacagaagagaacagcttcaagcgcctgatgatcgtgaaaaaggaaaaacttgcaacagcacagtttaaaatcaacaaaaagcatgaagatgtgaagcaatataaacggaccgtcattgaggattgtaataaggtgcaggagaaaaggggggccgtgtacgagcgagttactacaataaaccaggagattcaaaaaatcaaacttggaatccaacagctcaaagatgcagcggagcgggagaaattgaagtctcaggaaattttcctaaacctcaagaccgctttagaaaagtatcacgacgggatcgaaaaagctgcggaggatagttatgccaagatagatgagaagaccgctgaactgaaacggaaaatgttcaagatgtcaacatag

SEQ ID NO: 127237 - DNA, 375 bp, Artificial Sequence
  Description of Artificial Sequence: Synthetic coding sequence
atggaaacactgagtttcccaaggtataacgttgccgagattgttatccatatccgtaacaaaatcctcacaggggccgacggaaagaatctaacaaagaatgacctgtaccccaacccaaaacccgaggttttgcatatgatttacatgagagccctccagatcgtttacggcattagattggagcatttctacatgatgcccgtgaactccgaggtgatgtaccctcatctcatggaaggattccttcctttttcgaatctggtgactcatctcgacagctttctccctatttgcagggttaatgacttcgaaaccgccgacatcctatgcccaaaggcgaagagaacctcaagattcttaagcggcatttag

SEQ ID NO: 127238 - DNA, 702 bp, Artificial Sequence
  Description of Artificial Sequence: Synthetic coding sequence
atgaacaaactgcgccagagctttcgacggaaaaaagatgtttatgttcccgaagcgagccgaccacaccaatggcaaacggacgaggaaggggtgaggaccgggaaatgttcgtttccagtcaaaacaggtaagaaagcagttaaagccgtgctgtgggtatccgccgatggcttgcgagtggtggacgaaaagaccaaagacctgattgtggatcagaccatcgaaaaagtctctttttgtgctcccgaccgcaacttcgaccgcgctttcagctatatatgtcgagacggaaccacccgccgctggatttgtcactgtttcatggcagtcaaagacactggcgaacgattaagtcacgccgtcgggtgtgcttttgccgcctgtttagaaaggaagcagaaacgggagaaagaatgtggcgttactgctactttcgacgcctcaaggacgacgttcactagagagggaagctttcgggtgacaactgcaactgaacaagcagagcgggaagagatcatgaaacagatgcaagacgctaagaaggcagaaacagataaaatcgtagtaggctcgtcggtcgcccccggtaataccgcacctagcccgtcctcccctacctctcccactagcgacgccacaacctccttggaaatgaacaacccacatgcgatccccagacggcatgcaccaatcgagtag

SEQ ID NO: 127239 - DNA, 1956 bp, Artificial Sequence
  Description of Artificial Sequence: Synthetic coding sequence
atgaataaactgagacagtcattccgcagaaagaaggatgtatatgttcccgaagcgagccgaccacaccagtggcagacagatgaagagggtgtcaggaccggtaagtgcagtttcccagtgaagtatctcggacatgtggaggtagacgagtccaggggcatgcacatttgtgaggatgcggttaaacggctaaaagccgaacggaagttttttaaaggtttctttggtaaaaccggaaaaaaagcagtgaaagcagtactatgggtgagtgcagatggtttgagagtggtggacgagaagacgaaggacttgattgtggatcaaaccatcgaaaaagtatctttctgcgcacccgatcggaacttcgatcgcgcgtttagctatatctgccgtgatgggacaaccaggcggtggatttgtcactgcttcatggcagtcaaggataccggcgagaggctgtcgcatgcggtgggctgcgcttttgccgcatgcctggaaaggaaacagaaacgcgaaaaagaatgtggcgttactgctaccttcgatgcctctcgcaccacgtttaccagggaggggtcattccgggtgactactgccacagaacaggcagagcgagaggagatcatgaaacaaatgcaggacgcaaagaaagctgagacggataaaatagtcgtgggatctagcgtggctcccgggaatacagcccccagcccttcctcacctacaagcccaacttccgacgcaacgacatccctcgagatgaataatcctcatgccatccctagacggcatgcgcccattgagcagctagccaggcaggggagctttagaggtttcccggccttaagtcagaagatgagcccattcaaacggcagctgtccctgcgcatcaacgagctcccttccaccatgcagcgcaaaaccgacttcccgatcaagaacgccgtgcccgaagtagagggcgaagccgagagtataagtagcctatgcagccagataaccaatgcgttctccacaccagaggatccattttcatcggctcctatgactaagccagtgactgttgtagcaccacaaagcccaacgttccaggcaaatgggactgactctgccttccatgtcctggctaagcctgcacacactgccctggcacccgtggccatgccagtgcgggagacaaacccttgggcacacgcacctgacgccgccaataaggaaattgccgcgacatgttccggcactgagtgggggcaaagttcaggggcagcctcacctgggctttttcaagccgggcacaggcgcactccaagcgaagctgaccggtggctcgaggaagtctcgaaatcagtccgggcacagcagccacaggcgtctgccgccccactccagcctgtactgcaaccccctccccctacagctattagccagccagctagtccattccaaggtaacgcattcctgacaagccaacccgtgccagtgggcgtagtaccagccctgcagcccgcattcgtgccagctcaaagctatcccgtcgcgaacggcatgccataccctgccccaaacgtacctgtcgtaggcatcacaccttcccaaatggtggctaacgtcttcggcacagctgggcaccctcaggccgcgcatccacatcaatccccaagccttgtccgtcagcagacatttccacattacgaggcctcctccgcgactaccagccctttcttcaagcccccagctcagcatctgaacggttcggcggcatttaatggcgtggatgatggacgattggccagcgccgatcgacacacagaggtgcctactgggacctgccctgtggaccctttcgaagcccagtgggctgcattggagaataaaagcaagcagagaaccaatccaagcccaactaatcccttttcatctgatctccagaagacctttgagattgaactttag

SEQ ID NO: 127240 - DNA, 1812 bp, Artificial Sequence
  Description of Artificial Sequence: Synthetic coding sequence
atgaataagctgcggcagtcttttagacgcaagaaagacgtatacgtccccgaagcctcaagacctcaccaatggcagaccgatgaggagggcgtccgtacaggaaagtgctcatttcctgtgaagtacttggggcacgtggaggtcgacgagtcgcgcggaatgcatatctgcgaagacgcagtcaaaagactgaaggctgagagaaagtttttcaaggggtttttcgggaaaaccggtaaaaaggcagtcaaggccgtcctttgggtttctgccgacgggctgcgggtggtagatgagaagactaaggacctgatagtcgatcagactattgaaaaggtttccttctgcgcgccggacaggaacttcgatagggccttttcatacatctgtcgggacggaactacacgcaggtggatttgtcactgcttcatggctgtcaaagacacgggcgagcggctgtctcatgccgtggggtgcgctttcgcagcctgtctggaaaggaaacagaagcgcgaaaaggagtgcggagtgaccgccacgttcgatgcttcacgaaccacttttacgcgggagggctcctttcgcgttacaacggccactgagcaggcggaacgcgaagagattatgaaacaaatgcaggatgcaaaaaaggccgagacagataagattgtggtagggtctagcgtggctcccggcaataccgccccaagtcccagttcccctacaagccccacatctgacgccaccactagtctggaaatgaataaccctcatgctatccctcgccggcatgcgccaatcgaacagctcgcccgccagggctcttttcggggatttcccgcactttctcagaagatgtccccctttaagcgacagctctctcttcgcataaatgaattgcctagtaccatgcagaggaagactgactttcccattaagaacgccgtgcctgaggtggaaggcgaagcggagtcaatctctagtttatgttcccagattaccaatgctttttccaccccagaagaccctttctcgtccgctcccatgaccaagcccgtgacagtggtcgcacctcaatctcctaccttccaaggcactgaatggggccagagctccggtgctgcttcccccggactgtttcaggccgggcataggcggacaccgtccgaggccgatcgttggctggaagaagtgtcaaagtctgtgcgcgcgcagcaaccacaagcgagcgccgcgcccctgcaaccagtgctgcaaccgcctccaccaaccgcaatatcacagcctgcctccccctttcaaggaaacgcttttctaacttctcagccggtcccagttggagtcgtgcctgcattacagcccgccttcgtccctgctcaatcctatcctgttgcgaacggaatgccatacccagctcctaacgttcccgtggtgggcatcacaccaagccagatggtagccaacgtgtttggaaccgcaggtcacccccaagctgctcatccccatcagtctcctagtctggtcaggcagcagacattcccgcactacgaagcctcatccgcaaccacttccccgttctttaagcctcccgcgcagcacctcaatggtagcgcagccttcaatggagtcgacgatgggaggttggccagtgccgaccgtcacacagaagtgcccacagggacctgtccagtggacccatttgaggcccagtgggcagccctcgagaataaatccaagcagcggacgaatccttcccccactaatccattttcttctgatctccagaaaacattcgaaattgagctgtag

SEQ ID NO: 127241 - DNA, 1923 bp, Artificial Sequence
  Description of Artificial Sequence: Synthetic coding sequence
atgaacaagcttcgtcagagctttaggcgaaaaaaggacgtgtacgttccagaggctagtcggccgcaccagtggcaaactgacgaggagggggtgagaacagggaaatgctcttttccagtcaagtacctcggtcatgtcgaggtagacgaatctcggggcatgcacatttgcgaggatgccgtgaagcgactgaaggctaccgggaagaaggcagtgaaggctgttctttgggtgtccgccgatggacttcgtgtggtggacgagaaaacaaaggacctgattgtagatcagacgatcgagaaggtgagcttctgtgcaccggatcgcaacttcgatagggctttctcttacatttgccgggacggcacaacccgcagatggatttgccactgtttcatggcagtgaaagacacaggagagcgcctgtcacacgccgtgggctgcgccttcgcagcctgcctggagcggaagcagaagcgggaaaaggaatgcggggtgaccgcgactttcgatgcctcacggacaacctttactcgtgaaggcagttttcgcgtgacgaccgccaccgaacaagcggagagggaggaaattatgaagcagatgcaggacgccaaaaaagcggagacagataagatagtggtaggatcctcagttgccccgggcaacaccgcccctagtcccagtagtcccacgagccctaccagcgacgcaacaacatccctggaaatgaataatccccatgctattcctaggagacatgcaccaattgagcaacttgccaggcagggttctttccgtgggtttcctgcgttgagccaaaaaatgtctccatttaaacggcagttatcccttcggatcaacgagctccccagcaccatgcagcgtaagacggactttccaattaaaaatgccgttcccgaggtggagggcgaggctgagagcatcagttcactgtgtagccaaatcactaacgcattctctacccctgaagacccattcagtagcgcccctatgacaaaaccggttaccgtggtcgctcctcagtcccctaccttccaggccaacgggacggatagtgcgttccatgtgctggccaaacctgcccataccgcccttgcccccgtcgcaatgccagtccgggagaccaacccatgggcacacgccccagacgcggccaacaaggaaatcgctgctacttgttctggcaccgaatgggggcagtcttcaggggccgcctcaccaggcttgtttcaggcaggacaccgtcgaaccccatcagaagcagacaggtggctggaggaagtctctaagtctgtgcgcgcacaacagccgcaagcctcggccgcccccttgcagccggttctccaaccacctcccccaaccgccatctcacagcctgcctccccttttcaagggaacgccttcttgaccagtcagcctgttcctgtaggcgtcgtgcctgccctgcaaccggcgtttgtcccggcgcagtcatatccggtggctaacggaatgccttacccagctccgaacgtgcccgtcgtgggaatcacccccagccagatggttgctaacgtgttcggaaccgcaggccatccccaagctgcccacccccaccagagtccctcactggtcaggcagcagactttcccacactatgaggcctcaagcgcaactacatcacctttttttaaaccgcctgcgcagcatctaaatggatccgcagccttcaacggggtggacgacggtcgcctggctagcgctgacagacacactgaggtgccgaccgggacatgtccagtcgatcccttcgaggcccagtgggccgcgttagagaacaaatctaagcaacggacaaaccccagccccaccaaccccttcagtagcgatttacagaagacctttgagatcgagctgtag

SEQ ID NO: 127242 - DNA, 1518 bp, Artificial Sequence
  Description of Artificial Sequence: Synthetic coding sequence
atgaacaagctgcgacagtctttcaggaggaagaaggacgtatacgttccggaggcttcccgaccccatcaatggcaaactgacgaggagggtgtgcggactggcaaatgcagctttccagttaagtatctgggccatgttgaagtggatgagagtcgaggaatgcacatttgtgaggacgctgtcaaaagattgaaagcagaaaggaaattttttaagggcttcttcggaaagaccggaaagaaggccgttaaagccgtcctgtgggttagtgcagacggacttagggtcgtggacgagaaaactaaggacttgatagtggaccaaactatcgaaaaagtgtctttttgcgctccggatcggaacttcgatcgggccttcagttatatctgccgtgacggtacgacaagacgctggatctgtcattgctttatggccgtgaaggacacaggggaaaggctaagccatgccgtgggctgcgcttttgcggcttgcctggaacggaagcagaagcgtgagaaggagtgcggcgtcaccgccaccttcgacgctagccgcacaacgtttacccgggagggcagtttccgggtcactaccgccacggagcaggccgagcgggaggagatcatgaagcagatgcaagatgcaaaaaaagtgcccgaggtggaaggcgaagctgagtccatctcttcactttgtagccagattacaaatgcctttagcactcctgaggatcctttttcttcagctcctatgacaaagcctgtaacggtggtggcaccacagagtcccacattccagggcacagagtgggggcagtcctccggcgccgcgtcccccgggctgttccaagcgggccaccgtaggaccccatcggaggctgaccgttggcttgaagaggtgtccaagagcgtcagagcccagcaaccacaggcctctgccgcccccctgcagccagtgctgcagccgcccccacccactgccattagtcagccggcttcacccttccagggaaatgcattcctgaccagtcaaccagtgcctgtcggcgttgttcctgccctgcaacccgctttcgtacctgctcaatcctacccggtggccaatggcatgccctatcctgcacctaacgtaccagtggtgggtataacaccgagtcaaatggtagcgaacgtcttcggcaccgccggtcaccctcaggcagcccatccacaccagagtccctccttagttcgtcagcagacctttccgcattatgaggctagttcagctacaactagtcctttcttcaagcctcccgcgcagcatctgaacggatccgcagcctttaatggtgttgacgatggccgactagccagcgctgacaggcacactgaggtacccaccgggacctgcccggtggatccctttgaggcacaatgggcagcgctggagaataagtccaagcagcgcaccaatccatcccccacaaaccctttttcaagtgatctccagaagaccttcgagatcgaactctag

SEQ ID NO: 127243 - DNA, 1923 bp, Artificial Sequence
  Description of Artificial Sequence: Synthetic coding sequence
atgaacaaactaagacagagttttcgccgaaaaaaagatgtctacgttcctgaggctagtaggccacaccaatggcagactgacgaggaaggtgtcagaaccgggaaatgcagctttccagtcaagtatctcggacacgtcgaggtagacgagtcgagaggaatgcacatatgcgaggatgcggtgaaaagattgaaggctacaggtaagaaagccgttaaagccgttctttgggttagcgcagacggcctgagagtagtggacgaaaaaaccaaggacctaatagttgaccagaccatagagaaggtgtccttttgcgcaccagacagaaatttcgacagagcatttagctacatctgccgtgacggtaccacacgcaggtggatctgccattgtttcatggctgtgaaagatacaggtgaacggctgtcgcatgccgtgggctgcgcctttgcggcatgtttagaacgcaaacagaaacgcgagaaggaatgtggagtcactgccacgttcgacgccagcagaacaacattcacccgggaaggatccttccgcgtcaccaccgctaccgaacaggccgaacgcgaagagattatgaagcagatgcaagatgccaagaaagccgagaccgataagatcgtggtcggctcaagcgttgcccctggtaacaccgccccatcacctagctcacctacttcccccacgagcgacgcaacaacttcactcgagatgaacaatccccacgccatccctagaagacacgccccaatcgaacagttagccagacaaggctcattccgcgggtttcccgccctttcccagaagatgagccccttcaaaagacagctgagcctacgaattaatgagctgccctccaccatgcagcgcaaaactgacttcccgataaagaatgccgtccctgaagtcgagggagaagcagagagcatctcttcactctgttcccaaattaccaatgccttctccacacccgaggacccgttcagctccgcgcccatgaccaagcccgtaactgtggtagcaccacaaagtccaactttccaagccaatggcacagattctgccttccacgttctcgctaagccagcacacaccgccttggctcccgtcgctatgccggttcgggagacaaacccctgggcgcacgctcccgacgcggcgaataaagagatcgctgccacatgttcaggcacggaatggggacagagttccggcgccgcttctcccgggctattccaggctggccaccggaggacgccttctgaagctgaccggtggctcgaggaggtaagcaagagtgtgcgggcacagcaaccccaggcctccgcagcgcccctgcagccagtgctgcagccaccaccccccacagctattagccaaccggcgtcccccttccagggcaatgctttcttgacgagccagcctgtaccggtgggcgtggtcccagccctgcaaccagcctttgttcctgcgcagtcttacccggtggctaatggaatgccttatcccgcccccaacgtaccggtggtgggtataacaccatcacaaatggtcgccaatgttttcggcaccgccggccacccccaggctgcgcatcctcaccagtctccttctctcgtgagacagcagactttccctcactacgaggcgtcctctgcaaccacgagcccttttttcaagccgccagcacagcatcttaatggtagtgctgcattcaacggcgtagatgacggtagacttgcctctgcagatcggcatactgaagtaccgacaggcacctgccctgtcgatccattcgaagcccaatgggcggcgctggaaaataagagcaagcagcggacgaaccccagcccaactaacccctttagcagcgatctccagaaaacgttcgagattgagctttag

SEQ ID NO: 127244 - DNA, 1371 bp, Artificial Sequence
  Description of Artificial Sequence: Synthetic coding sequence
atgaataaactccgtcagtcttttagaaggaagaaggacgtctacgtgcctgaagcttcacgacctcaccagtggcagaccgatgaggagggcgtgagaactggcaagtgctcattcccagtgaaatatcttggccacgtcgaggtagacgagtcccgtgggatgcatatctgtgaggatgccgttaagcgcctcaaagctgagcgaaagttctttaaaggcttcttcggtaagaccggcaaaaaagccgtgaaggccgtactgtgggtgagtgcagatggcttgagagtagttgatgagaagacaaaagatctgatcgtcgatcagaccatagagaaggtcagcttctgcgcgcctgataggaacttcgatcgagctttttcttatatttgcagggatggcacaaccaggcgctggatttgccactgtttcatggccgtgaaagacacgggtgagaggctaagccatgccgtagggtgtgcatttgccgcctgtctcgaacgcaaacagaaaagagaaaaggagtgtggagtgactgccaccttcgacgcctcaaggacgacgttcaccagagagggctcatttcgcgtgactaccgccaccgagcaagccgagcgggaggaaattatgaaacaaatgcaggatgccaagaagggtacagagtgggggcaatccagtggcgccgcatccccaggcttgtttcaggccgggcaccgccgtacaccctccgaggcggaccggtggttggaggaggtttcaaaatccgtccgcgcacaacaaccgcaggctagtgcggctcccttacagcctgtgctgcagccgcctccccccacagccatctctcagccggccagccccttccagggcaatgctttcctgacgtcgcagcccgtgcctgtgggagtggtgcccgccctccagcccgctttcgtaccggctcaatcttatcctgtagccaatggaatgccataccccgccccaaatgtgcccgtggtgggcattacgcccagtcagatggtcgcgaatgtcttcggcacggcaggccatccccaagcagcccatccacatcagtcacccagcctggtcagacagcagacgttcccgcactacgaggcttcctccgcaactacctctcccttcttcaaacccccggcccagcatctgaacgggagcgcggctttcaacggtgtagacgatgggcggctggcttccgcagatcggcacacagaagtcccaacaggtacatgtccagtcgacccttttgaagcccagtgggccgctctcgaaaacaagagcaagcagcggaccaatccttcgcctactaatcctttctctagtgacctgcagaagacttttgagattgaattatag

SEQ ID NO: 127245 - DNA, 777 bp, Artificial Sequence
  Description of Artificial Sequence: Synthetic coding sequence
atgaacaagttgcggcagtctttcagacgaaagaaggatgtttacgtgcctgaagcctcccgtcctcaccagtggcagacagacgaagagggtgtccgcaccggtaagtgctctttcccagtaaaatatcttgggcacgtggaggttgatgagtctcggggaatgcacatctgcgaggacgcagtgaagaggctgaaggctgagagaaaatttttcaaaggcttctttggaaaaaccggaaagaaagcggtgaaggccgtcctgtgggtaagcgcagacggtctccgggtggttgacgaaaagactaaggatctcatcgtggaccagacaattgaaaaggtgagcttttgtgccccggaccgaaattttgatagggcattctcctacatatgccgggatgggacgactcgacggtggatttgtcactgcttcatggcagtgaaggacactggggagaggctgagtcacgccgttgggtgtgcttttgctgcttgcctggagaggaagcagaaacgcgagaaggaatgtggggtgacggcaacattcgacgctagccggaccacctttacacgggagggatcatttagggtgaccactgccacggagcaagcagagcgagaggagattatgaagcagatgcaggatgctaaaaaagccgagaccgataaaattgttgtgggttccagtgtggctcctggaaataccgccccaagccccagttctcccacctctcctactagtgacgctaccacctctttggagatgaataacccctag

SEQ ID NO: 127246 - DNA, 1779 bp, Artificial Sequence
  Description of Artificial Sequence: Synthetic coding sequence
atgaataaactgaggcagagttttagacgcaagaaggacgtatacgtgccagaagcttcaaggccgcaccagtggcagacagacgaggaaggagtgcggacggggaaatgcagctttcctgttaaatacctcggtcacgtggaagttgacgagagtcgcggaatgcatatctgcgaagacgccgtgaaaagactcaaggctactgggaagaaggccgtcaaggctgtgctttgggtctcagctgacggattacgtgtcgtagacgagaagacaaaagacctcattgtggatcagactattgaaaaggtgagtttctgtgcccccgatcggaattttgatagggcctttagctatatttgccgggatggcaccacccgacgctggatttgtcactgcttcatggccgttaaagacactggagagcgcctaagtcatgccgtggggtgcgcgtttgcagcctgcctggagcggaagcaaaagagagaaaaggagtgtggcgttaccgcaacattcgacgcctctcgtaccacattcactagggaaggcagttttagagtgactaccgccactgagcaggctgagagagaagagattatgaagcagatgcaggatgcgaaaaaggcggaaaccgacaaaatagtggtgggcagttctgtggcaccgggcaataccgcgccaagcccgtcttcccctacgtctcccacgtctgacgcaaccacctctctagagatgaataatccccatgctatacccaggagacatgcaccgattgagcagctcgcccggcagggatctttccgtggattccccgcgctttcacagaagatgagtccctttaaaagacaactcagcttgcgcattaatgagctgcccagtactatgcagcggaaaactgattttcctatcaaaaacgccgtgccagaagtggagggcgaggccgagtcaatctcttccttatgtagtcagatcaccaatgccttttcaactcccgaagaccccttctcttcagcccccatgactaagcctgttaccgtggtcgcaccgcaaagccccacctttcagggaacggagtggggccaatcatccggagcagcctctcctggactttttcaggccggtcaccggagaacgccttctgaggcggatcgatggctggaggaagtgtctaaatccgtccgcgctcaacagccgcaggcctctgccgcacctttacaacctgttttgcagccgccccctcctacagctatcagccaacccgcctctccttttcagggtaatgccttcctcactagccagcccgtgccagtgggggtggtaccagcactgcagcctgcatttgtgccagctcaatcttatccagtcgcaaatggaatgccctaccccgctccaaacgtgcccgtggttggcatcacgcctagccagatggtggctaacgtctttgggactgccggtcacccacaggctgcccacccacatcagagccctagccttgttaggcagcagactttcccacattatgaggcctcaagcgcaacgacgtccccattttttaagcccccagctcagcatctcaatggcagtgccgcatttaacggcgttgatgacggcagactcgcctctgccgacagacacaccgaggttcctacaggaacctgtcctgtggatccttttgaggcccagtgggccgctttagagaataagagtaagcagagaaccaatccttcacctacgaatccattttcaagtgacttgcagaagaccttcgaaatcgagctgtag

SEQ ID NO: 127247 - DNA, 204 bp, Artificial Sequence
  Description of Artificial Sequence: Synthetic coding sequence
atgaacaagttaaggcagtcttttaggcgaaaaaaagacgtgtatgtacccgaggcctctcgacctcaccagtggcaaacagatgaagaaggtgtgaggacaggcaagtgcagctttccagtcaagtatctcggccacgtggaggtggacgagtccagaggtatgcacatctgcgaggacgccgttaagaggctgaaagcttag

SEQ ID NO: 127248 - DNA, 1956 bp, Artificial Sequence
  Description of Artificial Sequence: Synthetic coding sequence
atgaataagctacgacaatcatttcggaggaaaaaggacgtctacgtgcctgaagcatctcgcccccatcaatggcagactgatgaagaaggagtgagaaccggcaagtgctcctttcctgtgaagtatcttggacacgttgaggtcgacgagagccgtgggatgcatatttgcgaggatgccgtcaagaggcttaaagctgagagaaagttctttaagggtttcttcggcaaaacgggcaaaaaagcagtgaaagccgtcctttgggtgagtgctgatgggttgagggtggtggacgaaaagacgaaggatctgatcgtcgaccagacgatcgagaaagtcagcttctgtgctcccgacagaaactttgatcgagctttctcttatatatgccgtgacgggacaacgcgtcgctggatctgtcactgtttcatggctgtgaaggatacaggtgagcggctgagtcacgctgtcggatgtgccttcgctgcgtgcctggagagaaagcagaagcgcgaaaaagaatgtggggtgaccgctacatttgatgcatctcggacaacattcacccgcgaggggtccttccgggtcaccacagcgacagagcaagcggagcgcgaggaaatcatgaagcagatgcaggacgctaagaaggctgagacagataagatagtggtgggatcctctgttgctcccggtaacaccgctccttcaccgagttcccctacatcccccaccagtgatgcgaccaccagtctggagatgaacaacccgcacgctatcccaagaagacacgcgcctattgagcagctggcccggcaaggcagcttccggggtttcccagccctctctcagaagatgtcaccttttaaacgccagctctcattacgcataaatgagctcccctccaccatgcagaggaagactgacttccctattaagaatgcagtaccagaagtggagggcgaggctgaatctatctcaagtctgtgcagccaaataactaatgccttcagcacccccgaggatccgttctcctctgcaccgatgactaagcccgtgaccgtagtagcccctcagtctccaacttttcaggccaacggcaccgatagtgctttccacgtcctggccaagccagctcacactgccctggcccctgtagctatgcccgtgagagagacaaacccatgggcacacgctccagacgcggcgaacaaggagatcgccgctacttgctcaggaaccgaatggggacaatccagcggagctgctagcccgggcctgttccaggcgggacataggaggaccccatctgaagcggacaggtggctggaggaggtcagcaaatctgtccgggctcaacagcctcaggcatcagccgcgcccttgcagccagtactccagccaccaccacccacggccatatctcaaccagcttcaccatttcagggcaacgctttcctgacgagccaacccgtgcctgtcggggtggtcccagctttacagcctgctttcgtacctgcccagagctatccagtggccaatgggatgccttatcctgctcccaatgtacccgtggtggggattactccctctcaaatggtggccaacgtgtttgggaccgcaggacaccctcaggccgcacaccctcatcagtccccttccctcgtcagacaacagacatttccacattacgaggctagctcagctaccactagtcctttttttaaaccacccgcccaacatctgaacggctctgccgcatttaatggggtcgacgacggccgcctcgctagcgcggaccgacacaccgaggttccaaccggcacctgtcctgttgatcctttcgaagcccagtgggccgctttagagaataagtctaagcagcggaccaatccctctcctactaatcccttcagctccgacttacaaaaaacttttgagatagaactgtag

SEQ ID NO: 127249 - DNA, 777 bp, Artificial Sequence
  Description of Artificial Sequence: Synthetic coding sequence
atgaacaagcttcggcaatctttccgcaggaaaaaggacgtttatgtgccggaagcctcaaggccacaccaatggcagaccgatgaggagggggtgcgcaccgggaaatgctcattccccgtgaaatacctggggcatgtggaggttgacgagtcaaggggaatgcacatctgcgaggacgcggtgaaaagattaaaggccgagcgcaaattctttaaaggcttcttcgggaaaactggtaagaaagccgtgaaggctgtactctgggttagcgccgatggcctgcgcgtggtggacgagaagactaaggatctgattgtggaccagaccatagagaaggtgagcttttgcgccccagataggaacttcgaccgcgccttttcgtatatctgtcgagatggaaccacccgccgttggatttgccattgcttcatggctgtgaaggacactggggagcgcctgtctcacgccgtgggatgcgctttcgcagcatgcttagagaggaagcagaaaagggagaaagagtgtggggtgaccgccacttttgatgcttctcgcaccacatttacaagggaagggtcattccgggttacaacagcaacagaacaggccgaacgggaagagatcatgaagcagatgcaggacgccaagaaggctgaaactgataaaattgtggtgggttcaagtgtcgctccaggcaacacagctccgtccccgtcttcccctacaagcccgacaagtgacgcaaccacctcattggagatgaacaatccctag

SEQ ID NO: 127250 - DNA, 1812 bp, Artificial Sequence
  Description of Artificial Sequence: Synthetic coding sequence
atgaataagctgcgtcagagcttccgaagaaaaaaagatgtgtacgtgccagaggcatctcggccgcaccaatggcagactgatgaggagggcgtgcgaaccgggaagtgctcctttcccgtgaaatatctgggccatgtggaagttgacgagtctcgaggaatgcatatttgtgaggacgccgtcaagaggttgaaagctgagcgcaaattcttcaagggttttttcggcaagactggtaagaaagctgttaaggcagtcctctgggtatccgccgatgggctgagagttgtggatgaaaagacaaaggatctaattgtggaccagaccattgagaaggtgtctttttgtgcacctgataggaattttgacagagcattcagctacatctgccgggatggtactacaagacgatggatatgccattgcttcatggcagttaaagacacaggagagagattgtctcacgcggtcggatgcgccttcgcggcttgcttagaacgaaagcagaaacgggagaaggagtgcggtgtgacagcaacatttgatgccagccgcacaactttcacacgggaaggttcttttagggtcaccacggccacggagcaggccgagcgagaagagattatgaaacagatgcaggacgcgaaaaaggccgaaacagataaaatcgtggtcggcagctccgtggctccaggcaacacagccccctctcccagtagccccacgagccctacatctgacgctaccacctccctggaaatgaacaaccctcacgccattcccaggcggcatgccccaatcgaacaactagcaaggcagggttcctttcggggttttcccgctctctcacagaaaatgagcccgttcaaacggcagctgagtctgcgaatcaatgagcttcccagcaccatgcaacggaaaaccgatttcccaatcaaaaatgcagtacctgaagtagaaggcgaagctgagtcaatttcgtctctgtgttcacagataactaacgccttcagcacgccagaagatcccttctcctcagctccaatgacaaagcccgtgaccgtggtagctccccagagtcctactttccagggaactgagtggggccagtccagcggggctgcatctcctgggctctttcaggctggccaccggaggaccccgtctgaggccgaccggtggctggaggaagtatctaagtcggtgagggctcagcagccccaggcctctgccgccccgttgcagcccgtactgcagcctccgcctcctacagcgatcagccagcctgcttctccttttcaggggaatgcattcctgacaagccagccagtacctgtgggtgtcgtacccgcactccaacccgctttcgtgcccgcacagtcatacccagtcgcgaacggaatgccatatcccgctccaaacgttcctgtcgtcggcatcacgccttcacagatggttgcaaatgtattcggcaccgcaggacatccccaggccgcccacccccatcagtcaccaagtctggtgcggcagcagactttcccccactacgaggcaagttctgccacgactagtcccttcttcaaaccacccgctcagcacttaaacggttcggcggccttcaatggcgtggatgacgggcgcctcgcgagcgcagaccgccatactgaggtgcccactggaacctgccccgtagacccatttgaggcacagtgggccgctctcgagaataagagcaagcaacggactaacccaagcccaactaatccctttagttccgacttacagaagacctttgagatagaattatag

SEQ ID NO: 127251 - DNA, 1923 bp, Artificial Sequence
  Description of Artificial Sequence: Synthetic coding sequence
atgaacaaactgcgacagtcttttcgacgcaagaaagacgtatacgtccctgaagcttcaaggccacaccagtggcaaacagatgaggagggagttagaactggcaagtgcagtttcccggtgaagtaccttgggcatgttgaggtcgacgaatcccgcgggatgcatatatgtgaagatgcagtcaaaaggttaaaagctacaggaaagaaagcagtgaaagctgtgttatgggtttccgccgatgggctgagagtcgtggacgaaaagaccaaggacctcatagtagatcagacaatcgaaaaggtgagtttttgcgcccccgataggaatttcgacagagccttttcctacatctgccgtgacggaaccacgaggcgctggatttgccattgtttcatggccgtcaaggatactggagaacgactgagccatgccgtggggtgtgcatttgcggcctgtctagaacgaaagcagaagcgcgaaaaagaatgtggcgtcacagcgacatttgatgcttcaagaacaactttcactcgtgaaggctcctttcgagtgaccaccgcaacagaacaagccgaacgagaagaaatcatgaagcagatgcaggacgctaaaaaggccgaaacggataagatcgtggtggggagtagcgtagcccctggaaatactgctccctccccttcatcaccaacaagccccacatccgacgcgaccacaagcctggagatgaacaaccctcacgcaatacccagaagacacgccccgattgagcagttggccagacaggggtcattcagaggatttcccgccctgagtcaaaagatgtcccctttcaagcgacagttatccttacgcatcaatgaactccctagcaccatgcaacgtaagactgacttcccaattaagaatgcagtgcccgaggtggaaggcgaggccgagtctatcagcagcttatgcagtcagattacaaatgctttttcaactcccgaggacccgttctccagcgcccccatgactaaacccgtcacagttgttgccccacaaagtcctaccttccaggcaaacggcacagacagtgcctttcatgtgctggccaagcccgcccacacggcattagctcccgttgcaatgcctgtcagggaaacaaacccctgggcccacgcgcccgatgccgccaataaagagatagccgcaacctgcagcgggactgagtggggacagtccagtggcgccgctagtcccggcctgttccaggcagggcatagaaggaccccaagcgaagccgataggtggttggaggaagtgtcgaagtctgttagggcacagcagcctcaggcaagcgccgcccccctgcagccagtcctgcagccgccccctcctactgccattagtcagccagctagccccttccaggggaacgccttcctcaccagccagcctgtgcctgttggagtggtccccgctctgcagcctgcatttgtgcccgcccagagttacccagtagctaatggcatgccatatccagcccccaacgtgcccgttgtaggtatcaccccatcacaaatggttgccaatgtgtttgggaccgcaggtcaccctcaggccgcacaccctcatcagtccccttcactcgtgaggcagcagacgtttcctcactacgaagctagctcagccactaccagcccttttttcaagcctcctgctcagcacctgaatgggagcgctgccttcaacggagttgacgatgggcgtctggcatctgctgatagacacaccgaggtgcctacaggcacctgcccagtggacccttttgaagcccagtgggcagcgctggagaacaaaagcaaacagaggaccaatccaagccctacgaatcccttctccagcgacttgcagaaaaccttcgaaatcgaactctag

SEQ ID NO: 127252 - DNA, 1830 bp, Artificial Sequence
  Description of Artificial Sequence: Synthetic coding sequence
atgtcacgatcagcagctgcctctggcggtcctaggcgccctgagaggcatctgcctccggccccgtgtggagccccgggcccaccagaaacttgtcgcaccgagcccgatggggccggcaccatgaacaaattgcgacagtcactacgacggcggaaacctgcgtatgtgcccgaggccagccgaccacaccagtggcaagctgacgaagacgctgtgcggaaaggcacgtgttcctttcccgtacggtatctggggcacgtagaggtggaggaatcccgcggcatgcatgtttgtgaggacgctgtgaaaaagctgaaagctatggggcgtaagtccgttaagagcgtgttatgggtctccgccgacggtctgcgcgtggtggatgacaaaaccaaggacctacttgtcgatcagaccattgaaaaggtgtcattttgcgctcccgatcgaaatctggacaaagctttctcttacatctgtcgggacggtactactcggcgttggatctgccattgtttcctcgcactgaaggacagtggagaaaggttaagccacgccgtgggctgcgcatttgccgcctgtctcgagagaaaacagcgccgcgagaaggagtgcggcgtcactgccgcctttgacgctagtaggaccagctttgcacgagaagggtcatttcgcctatcaggaggcgggcgacccgcagagcgtgaggcccccgataagaagaaggccgaagccgccgcagcacccaccgtcgctccaggcccggcacagcctgggcacgtttcccccacgcctgcgactacctcaccaggagagaaaggtgaagctggcactccagttgccgctggcactaccgcagctgcaatccccagaagacatgctcccctcgagcagctcgttcgccagggctcctttcgcggatttcccgccctttcccagaagaattcaccttttaagcggcagctgtcactcaggttgaacgaactgcctagcacactgcagcggagaaccgactttcaggtgaaaggcacagtgccagaaatggaaccgcctggagccggtgactcagactccatcaacgccttgtgcacccagataagctcctctttcgcctccgcaggtgcaccagctcctggcccgccacccgcaactactggtacttccgcctggggggagccctccgttcccccagccgctgcttttcagccagggcacaaaaggaccccttccgaggcggagcgttggctcgaggaagtatctcaggtggctaaggcacagcagcaacaacaacagcagcagcagcagcagcagcagcagcagcagcagcagcagcaggccgccagcgtggcccctgttcccacaatgccgcccgccctgcaaccattccccgcccccgtgggacccttcgacgccgcgcctgcacaggtggctgtgttcctccccccgcctcacatgcagccacccttcgtaccagcttatccgggcctgggttatcccccaatgcccagagtgcctgtcgtcggcatcacgccctcccagatggttgccaacgcattttgtagtgctgcacagctgcagccacagcccgccaccctgctcggcaaagccggtgcctttcctccacccgccatccccagcgccccaggatcacaggcaaggccacgccccaacggagccccctggcccccagagcctgcccccgcacccgctcccgagctggatccatttgaagctcagtgggccgctcttgaaggtaaagctactgtcgagaagccctctaatccattctctggggatctccagaaaactttcgaaattgagttgtag

SEQ ID NO: 127253 - DNA, 1707 bp, Artificial Sequence
  Description of Artificial Sequence: Synthetic coding sequence
atgaataagctgcgtcaatccttacgccggcggaaaccagcatacgttcctgaagcgagtagaccccatcagtggcaagcagacgaggatgccgtgcggaaaggcacatgttccttcccggtgcgatatctcggacacgtggaagtggaggagagcagaggcatgcacgtatgtgaagacgctgtcaagaaactgaaggccatgggccgcaaatctgtgaagtctgttctttgggtttcggccgatgggctgcgtgtcgtagatgacaagacgaaggacctgcttgtcgaccagacaatcgagaaggtctctttctgtgcacccgaccgaaacttagataaagcctttagttacatctgccgcgatggaacaactagaagatggatctgtcactgtttcttagcactgaaggactctggagaaaggctttcccacgccgtgggatgcgcctttgccgcctgtctcgagagaaagcaaagaagggagaaagagtgcggagtgactgccgctttcgatgcttcacggacctctttcgcccgtgaaggctcgtttagactatccggcggcggccggcctgccgaaagagaagctccagataaaaagaaagcagaggccgcagctgcccccaccgtcgccccgggtccggcccaacctgggcacgtgtcgccaacccccgctaccaccagcccaggagaaaaaggggaggcaggcacccctgtagccgccggcaccactgcagccgctattcctagaaggcatgcaccactggagcagctcgtccgccaggggtctttccgtggatttccagctctgagtcagaaaaactcccctttcaagaggcagttgtctctgaggctgaacgagttgccgtccaccctccaacggcgtacagacttccaggtcaagggtactgttcctgaaatggagcctcccggagccggggattctgattctatcaacgccctgtgcacccagatctcttcgagctttgccagcgcaggtgctcctgcaccaggtcctccacctgcaaccaccggcacgtctgcctggggcgagcctagcgtgccgccagctgcggcctttcagcctggacacaagcgcaccccatcagaggctgaaaggtggttagaagaagtttcacaggtagctaaggcacagcaacagcagcaacagcagcagcagcagcagcagcagcagcaacagcagcaacaacaagctgcctccgtagcccctgttcccactatgcctcctgcactccagccattccccgcacctgtgggccctttcgatgctgcccctgcacaggtcgccgtgttcctgcctcctccacacatgcagcctcccttcgtgcccgcttatcccggcctgggttatccacctatgcctagagtccccgtcgtcgggataaccccgtctcagatggtagcgaatgccttctgttctgccgcacagctccaaccacagcctgctaccctgctaggtaaggcgggagcattccccccccccgcaatcccaagcgcccctggctcccaggctcgtccccggccgaacggggccccatggccaccagaaccagcccctgccccagcaccggagcttgatcctttcgaagcacaatgggcagcgcttgaaggaaaggctacagtggaaaagccttcaaaccccttttcaggcgatttgcagaaaacattcgagatcgagctctag

SEQ ID NO: 127254 - DNA, 1446 bp, Artificial Sequence
  Description of Artificial Sequence: Synthetic coding sequence
atgaaaggtcgggggatgttggtcttactgctccacgcagtggtgctggggctaccatcagcttgggcagtgggcgcctgcgccagggcttgtccagcagcttgcgcatgttccacagtggagagggggtgcagtgtcagatgcgacagagctgggctcctccgcgttccagccgaactcccatgcgaggctgtaagtatcgatctggataggaacggcttgcgattcttaggagagcgcgcctttgggactctgccgtccctacggagactgagcctgaggcataataaccttagttttattactccaggagcttttaaaggcctgccgaggcttgccgagctgcggctagcccacaatggcgacttgagatacctccacgcccgaacatttgcagctttaagtcgcctgcgccgactcgacctggctgcctgtaggctcttcagcgtgcccgaaaggcttctggccgagctcccagcccttcgcgaacttgctgcattcgacaatttgtttaggcgggtccctggagcacttcggggcctcgctaacttgactcacgcgcatctggaaagggggcggatcgaagctgtcgcctcgagctcattacaggggttgcggagactgcgctccttatcattgcaggcaaaccgggtcagggcagtgcacgcgggcgcatttggggactgtggtgtgctcgaacaccttcttttaaacgacaacttgctggccgagttgccggccgacgcattccgtgggctgaggcggctgaggactctgaacctgggcgggaacgcactcgaccgagtggcacgcgcatggtttgccgacctcgcagagctggagctcttatatttggaccgaaactcaattgctttcgtcgaagagggcgcgttccagaatttgtctggcctgctggctctccacctcaatggcaaccgtttgactgtgctggcttgggtggctttccagcccgggttcttcctcgggaggctgttcctctttaggaacccctggtgctgtgactgtagactagagtggctgcgggattggatggagggctcggggcgggtgaccgatgtgccttgcgcctctccagggagcgtagctgggttggatctatctcaggttactttcggtaggagctccgacggtctctgcgtagacccagaagaactgaacctcactacgtcatctccagggccaagccccgagcccgccgcaacaaccgtgagccgcttctcctcactgctgtcaaagctccttgccccaagggtgccagtggaggaggccgctaatacaacaggcgggttggctaacgcttccctgtccgattctctgagttcccgaggggtcggtggagctggtcggcagccatggttcctgctcgcgtcgtgtcttctcccttctgttgcccagcacgtagtctttgggctgcagatggattag

SEQ ID NO: 127255 - DNA, 1446 bp, Artificial Sequence
  Description of Artificial Sequence: Synthetic coding sequence
atgaaagggcgaggaatgcttgtgcttctcctccacgcggtggtcctgggcctaccatccgcatgggctgtgggggcgtgtgcccgtgcctgccccgccgcttgtgcctgttccacagtcgagcgagggtgcagtgtaaggtgcgaccgcgccgggctcctgagagttcccgcagagttaccgtgcgaggcggtttctattgatctcgatcggaacggcctgcgatttctgggtgaaagagccttcggaaccctaccctcactgcgccggctgtctctgaggcacaataacctctccttcatcactcctggcgctttcaagggactcccccgcctggccgagctgaggctggctcacaatggggatcttcgctatttgcatgctcggacctttgcagcactgagtcgcttacgtcggctggacctggccgcttgccgccttttctccgtccccgagcgactcctggctgaactgcctgctctgcgggagctcgccgcttttgacaacctgttcagacgcgtacccggtgccctaagagggctggccaacctgacccacgcacacctcgaaagaggacgcattgaagcggtggcgtcctccagcctacagggactgcggagattgcgtagcctgtccctgcaagccaacagggtacgagccgtccacgctggagcctttggagattgtggtgtcctggaacacctgctgttaaacgataacctgctcgcagagctgccagccgatgccttcagagggttacggcgcctgcgcactctaaatcttggtggtaacgccctggacagagtggcaagggcctggttcgctgacctcgcagaattagaattgctgtacctggatcgaaacagtatagcttttgttgaagaaggcgcttttcagaacctaagtggcttgcttgccctccacctgaacgggaatcgtctgaccgtgctggcctgggtggctttccagcctggtttcttcctcggacgcctatttctctttaggaatccctggtgctgtgactgtcgtctcgagtggctccgcgattggatggaggggtcaggaagggtcactgatgtcccctgcgcatctccgggttccgtggcaggtcttgatctgtcccaagttacatttggcaggtcctctgatggcctttgcgtggatccggaggagctgaacttgaccacctcatcccccggtccaagcccagaaccagctgctacaacagtgtcaagattttcttctttgctgtctaagctcctcgcccctcgtgtacctgtcgaagaggcggccaacacaacggggggactggcaaatgcttcactgtccgactctctgtccagtcgaggcgttggcggagcaggcaggcaaccgtggttcctgctagcatcatgcctcctgccgtcagttgcccagcatgttgtcttcggccttcagatggattag

SEQ ID NO: 127256 - DNA, 1191 bp, Artificial Sequence
  Description of Artificial Sequence: Synthetic coding sequence
atgccaccgaagaagggaggtgacggcatcaaaccacccccgattatcggccggtttgggactagtctgaagatcggaatcgtgggtctgccgaacgtcgggaaaagtacattcttcaatgtacttaccaacagccaggcttcggcagaaaatttccccttttgcacaattgatcctaacgaatccagagttcccgtaccagatgagaggtttgattttctctgtcagtatcataaacctgcgtcaaaaatccctgccttcttaaatgtggtcgatatcgctggactggtcaagggcgctcataacggacagggtctgggcaatgccttcttgtctcacattagtgcatgcgacggaatcttccatcttacccgggcttttgaagacgacgacattacgcatgtggagggttctgttgaccctatccgcgacattgagattattcatgaggaattgcagctgaaggacgaggaaatgattggcccaatcattgataagcttgaaaaggtggctgtgcgggggggcgataagaagctgaaacccgaatacgacattatgtgtaaggtcaaaagctgggtcatcgatcaaaaaaaacccgtcaggttctaccacgactggaacgacaaagaaattgaggtgctgaataagcacctgttcctcaccagtaagcctatggtgtacctcgtgaatctaagcgagaaggactacatacggaagaaaaataagtggctaattaaaatcaaggagtgggtagacaagtatgaccctggggccctggtcattcctttcagtggagcccttgaattgaaactgcaagaacttagcgctgaagagagacaaaaatatttagaggctaatatgacacagagtgcactacctaaaatcatcaaggccggttttgcggctttgcaactggagtatttttttacagcaggacccgatgaggtgagggcctggaccattcggaagggtacaaaggctccacaggcagctggcaaaattcacacagattttgaaaagggattcataatggcagaagtcatgaaatacgaagattttaaggaagagggtagcgaaaacgccgtcaaggcggccggcaaatataggcagcagggaagaaattatatcgttgaagacggagacattatttttttcaagtttaataccccgcagcaacccaagaagaaatag

SEQ ID NO: 127257 - DNA, 717 bp, Artificial Sequence
  Description of Artificial Sequence: Synthetic coding sequence
atgattggaccgatcatcgataagctggagaaggtggccgtcagaggcggcgataaaaagttaaaaccagagtacgacattatgtgtaaggttaaatcctgggtgattgatcagaaaaagcctgtgcgcttctaccacgactggaatgacaaggagatcgaggtgcttaacaagcatctgtttttaacctctaaacctatggtttacctggtgaatttatccgaaaaagattacatcaggaagaagaacaaatggctgattaaaataaaggaatgggtggacaaatatgacccgggcgcactggttattccattttccggcgcgctcgagcttaagctccaagaactgtccgcggaggagagacagaaatatctggaggcaaacatgacccagagcgcactgccaaagataattaaagcagggttcgccgcattgcaactggagtacttttttacggccggccccgatgaagtccgtgcctggacaatcaggaaggggactaaagcccctcaagcagccggcaagatccacacagactttgaaaaggggtttattatggctgaggttatgaaatatgaggacttcaaggaggagggatcagagaatgccgtgaaggctgccgggaaatacagacagcaggggcgcaattacatagtggaggatggagatattatcttttttaaattcaatacacctcagcagccaaagaagaagtag

SEQ ID NO: 127258 - DNA, 1251 bp, Artificial Sequence
  Description of Artificial Sequence: Synthetic coding sequence
atgtcaaggactttctctgccaaaggagggagggacctggtggaaggcccccagtatctcatgccaccgaagaagggcggcgacggaataaagcctccacccattattggtaggttcggcacaagcttgaagatcggcattgtggggttgcctaatgtcggtaagtccacgttcttcaacgtactgacaaacagtcaagctagcgcagagaatttccctttctgcacaatcgatcctaacgagtcacgagtccctgtgccagatgaacggttcgatttcctctgtcagtaccacaaacccgccagcaaaatcccagcatttcttaacgtggtggatatcgctggactcgtcaaaggggctcacaacggacaaggtctcggcaatgcattcttgtctcacattagcgcttgtgatggcatcttccaccttacccgggccttcgaggacgacgacattacgcacgtggaaggatccgtggacccaatacgggacatcgagataattcacgaggaactgcagttaaaagatgaggaaatgatcggaccaattatcgacaaactggagaaggtggccgtgcgcgggggcgacaagaaactgaagcccgagtacgatatcatgtgtaaagtgaagtcctgggtgatcgatcaaaaaaaacctgtgaggttctatcacgattggaatgataaggagattgaggtcctgaataagcatttgtttctgacttctaagcctatggtgtatttggtgaacctgtctgagaaagattacattagaaaaaagaacaaatggctgataaaaattaaggagtgggtggataagtatgacccaggggctctggttattcctttttctggcgcccttgaactgaaactgcaggagcttagtgccgaggagaggcaaaaatacctcgaggcaaatatgacacagtccgctctccctaagataattaaggctgggttcgccgctttgcagcttgagtacttttttacggctggacccgatgaagtgagggcctggaccattcgaaagggtacaaaggcgcctcaagcagccggtaagattcatacagattttgagaaaggcttcatcatggcagaggtaatgaaatacgaagacttcaaggaggagggctcagagaacgccgtgaaggctgcaggaaaataccgtcagcagggccggaactacattgtggaggacggagatatcattttttttaagtttaacaccccacagcaacccaagaagaagtag

SEQ ID NO: 127259 - DNA, 351 bp, Artificial Sequence
  Description of Artificial Sequence: Synthetic coding sequence
atgccaccaaagaaggggggggacgggatcaagcctcctccgattatcggtcggtttggtaccagccttaagattggcattgtgggcctccccaatgttggaaagagtacttttttcaatgtgctgaccaactcccaggcctcagcagagaatttccctttctgcacaatagaccccaacgagtccagagttcctgtgccagacgagcgctttgacttcctctgccaatatcataaacccgccagtaaaatcccagcattcctgaatgtggttgatatagcgggtcttgtgaaaggcgcccacaacggacaaggactgggcaacgccttcctcagccacatcagtgcatag

SEQ ID NO: 127260 - DNA, 837 bp, Artificial Sequence
  Description of Artificial Sequence: Synthetic coding sequence
atgccgcctaagaaggggggcgatggtataaagccacctcccataatagggcggtttggcaccagtctgaaaattggaattgtcgggctgcctaatgtcggaaaaagcacttttttcaacgtcctgacaaacagccaggcatctgccgagaactttcctttctgtacaattgatcccaatgagtctcgtgttcccgtccctgatgagcggttcgacttcctgtgccagtaccacaagccagcctcgaaaatacctgcatttcttaacgttgtggatattgcagggttagttaagggcgctcacaatggacaggggttaggaaatgcattcctgtcccatatcagcgcatgtgatggaatctttcatctgacccgcgcctttgaggacgacgatattactcatgtcgaagggtcagttgacccaataagagacatcgaaattattcatgaggagctgcagctcaaagatgaggaaatgatcggaccaatcatcgataaactcgaaaaggtcgctgttcgcggaggggacaaaaaactgaagccggagtacgacataatgtgcaaggttaagagttgggtgattgatcaaaagaaacccgtgcgcttttatcacgactggaatgacaaggagatcgaagtgctgaataagcatctctttctgacctcaaagccaatggtgtatttggtgaatttgtccgagaaggattacatccgcaagaagaataaatggttgttggaaagcaccgacaataaagcagagatcatcctcctaaaaatggagatattgagtagtagcaatctgacacatctgaataaccgacgcagaaacaaaatctag

SEQ ID NO: 127261 - DNA, 312 bp, Artificial Sequence
  Description of Artificial Sequence: Synthetic coding sequence
atgataggacccatcatcgataaattggagaaggtggccgtccggggaggagataagaagctgaaaccggaatacgacataatgtgcaaggtgaagtcttgggtcattgaccagaagaaacccgtgcgtttctaccacgattggaatgataaggaaatcgaagttctgaacaaacacctgttccttacgtcgaaacccatggtctacctggtcaatttatctgaaaaggactacatcagaaagaaaaacaaatggcttattaagataaaggagtgggtggacaagtacgatccaggagccctggttatctag

SEQ ID NO: 127262 - DNA, 1329 bp, Artificial Sequence
  Description of Artificial Sequence: Synthetic coding sequence
atgtgcgaactgagccgggaagatgcaccggtgagatggtacaaggacggacttgaagtggaagagagcgaagccctcgtccttgagcgagatgggccaaggtgccggcttgtcttaccagcagcgcaacccgaagatggtggtgaatttgtgtgtgatgcaggcgacgacagcgcctttttcacagtcactgtgacggcacctcctgaacggatagtgcaccccgcagctaggtccctggatcttcacttcggtgcccccggccgagtagagctccggtgtgaagttgcacccgccgggtcccaggtgcgctggtataaggatggactggaggtcgaggcaagcgacgctctgcagctaggggcagaggggcccacgagaacccttacactgccccatgctcagccagaagatgctggcgagtacgtttgtgaaactcggcatgaagccatcaccttcaatgtaatcctggccgaaccccccgtgcaattcttggcccttgagaccacgccaagtcctctatgtgtcgcacccggtgagcccgtggtcctaagttgcgaattgtcacgggccggcgcccctgtggtgtggagccacaacggccgccctgtgcaagagggggagggtctagaactccacgccgagggtcctagacgggttttgtgcatacaggccgccggcccagcacatgcaggcttgtatacttgtcaaagtggcgcagcacctggggccccctcactatccttcactgtgcaggtggctgagccccttcttgttaagctggtgagtgaactcacccctctgactgtccacgagggagatgacgcgacgtttaggtgtgaggtgtctccacccgacgccgacgtgacatggctccggaacggagcggtagttaccccggggccccaagtggaaatggctcagaacgggtcaagccgcatcttgacactcagaggatgccagcttggggacgctgggactgtgactttgcgggctggatcaacagctacatctgcccggctacacgtgcgggagacagagttgctgttcctgcgtcgcctgcaggatgtgcgggctgaagaaggccaagatgtttgtcttgaagtggaaacgggtcgggtgggcgccgctggtgctgttcgctgggtccgcggcggtcagcccttaccacatgacagccggttgtccatggcccaggacggccacatccacaggctctttatacatggagttatacttgccgaccagggaacctacggctgtgagagtcatcacgaccgtaccctggctaggctaagtgttcgtcgggaatgcccagtcctgagctag

SEQ ID NO: 127263 - DNA, 4206 bp, Artificial Sequence
  Description of Artificial Sequence: Synthetic coding sequence
atgaaggccagttctggggatcagggctcgcctccatgttttttgcggtttcctagacctgtgagggttgtttccggcgccgaggcagaactgaagtgtgtagttctgggcgagcctccgcccgtcgtcgtttgggaaaaaggtggtcagcagttagctgcgtctgagcgattgtcgttcccggccgatggagctgaacacgggctgctgctgaccgctgctctgcccacagacgctggggtgtatgtatgtagggccagaaacgccgcaggcgaggcctacgccgccgccgctgtcactgtcctcgagcctcccgcaagcgaccccgagttacaacctgcagagagaccacttccatccccggggagcggagaaggagcaccagtgttccttactgggccccgctctcaatgggttttgagaggtgcagaagtggtgttgacctgtcgcgcgggaggactccctgaacctaccctgtactgggaaaaggacggcatggcgctggatgaagtgtgggacagcagtcactttgcactgcagccgggacgtgctgaggatgggccaggtgcatcacttgcgctaagaatcctggccgctcgactgcctgactcaggggtgtacgtgtgccacgctcggaatgctcatggtcatgcccaagctggggctctcttgcaggtccaccagcctcctgagagtccacctgcagaccctgacgaggcaccggctccggtagttgagcctctcaaatgcgcaccgaagactttctgggtgaatgaaggaaaacacgctaagtttcggtgctacgtgatgggaaagcccgaaccagaaatcgaatggcattgggaggggcggccactactgccggaccggcggcggctgatgtatagagacagagatggcgggttcgttttgaaagtgctgtactgtcaggcaaaggaccgggggctgtacgtttgtgccgcccgtaacagcgctggccagaccctgagtgccgtccaacttcacgtgaaggagcctcgactgaggtttactaggcccctgcaagatgtcgagggcagggaacatggaatagccgtgctcgagtgcaaagtccccaattcccgcatacccacagcatggtttagagaagaccagcgtctgctgccctgtaggaagtacgagcagattgaggaagggacggttagacggctaattattcacagactgaaggccgacgatgacgggatctatctgtgtgagatgcggggacgagtccggactgtggctaatgtgacagtaaagggcccgattctaaaacgcctaccacgcaagctggatgtgttagagggagagaatgctgttcttcttgtggagacccttgaggcaggagtcgagggaaggtggtccagggatggtgaggagctccctgtgatatgccagtccagctccggacacatgcatgccctggtgcttcctggcgtgacacgggaggatgccggcgaggtcaccttctctctcgggaactcccgaaccactaccttactgagggtcaaatgcgtcaagcattccccccccggtcccccaattctggccgagatgtttaagggacacaagaataccgttctcctgacctggaagccacccgagcccgcgcctgagaccccctttatttacagacttgaacgacaggaagtaggttcagaggattggattcagtgtttctcaatcgaaaaagccggagctgttgaggtaccaggtgattgcgtcccctccgagggtgactaccgcttccgtatctgcactgtgtctgggcacggcaggtcccctcacgtggtgttccatggatctgcccacttagtgccgaccgcccgactggtggctggtctggaagacgtccaggtgtatgacggcgaagatgctgttttctcgttggatcttagtacaatcatccagggtacatggttcctgaatggggaagaactgaaatccaacgaaccagaaggccaggtggagcccggcgctcttcgctatagaatcgaacagaagggcctgcaacatcgcttaatactgcacgccgttaaacatcaggactctggtgccctcgtgggcttttcatgtcctggtgttcaggatagcgccgcattaaccattcaagagtcccccgtgcacattttgtctccccaggatcgcgtcagcctgacctttacaacaagtgagcgggttgttctcacttgcgagctctctcgagtggacttccccgctacctggtacaaagacggccagaaggttgaggaatctgagctcttagtcgtgaaaatggacggaaggaaacaccgcctcatactgccagaagccaaagttcaggattccggtgagtttgagtgtagaactgaaggcgtcagcgccttcttcggtgtaaccgtgcaagatccccccgtccacatcgtggatccaagggagcatgtctttgttcacgcaattacttcagagtgcgtgatgttggcttgtgaggtcgatcgcgaggatgctcccgtgaggtggtacaaggatggacaggaggttgaagagagcgattttgtagtgctggagaatgaaggaccccaccgtagactggttctgccagctacacagccttctgacggaggggagttccagtgcgtggctggagatgagtgcgcatacttcacagttacaatcacagacgtaagcagctggatcgtgtaccctagcggaaaggtctatgtagctgctgtgagactggagagagttgtgctgacatgcgagctatgtaggccatgggccgaggtgcgctggacaaaggacggggaggaggtggtcgaatcacccgccctgttgctgcagaaggaagacactgtgaggcgcctcgtgctccctgcggtccagctggaggacagtggcgagtacctctgcgagattgacgacgagtccgccagttttactgtgacagtgacagagcctcccgtgaggatcatctatccacgtgacgaggtgacgctgatcgccgtcactttggagtgcgtggtcctgatgtgcgagttaagcagggaagacgccccagtgcggtggtataaggacggtctggaggtagaggagagcgaagctctggtgcttgagcgagatggtccacgatgtcgccttgtgctccccgcagctcaaccggaggatggaggggagttcgtctgcgacgctggagatgactccgcctttttcacggtcacagttacagaaccacccgtgcagttcctcgcactggaaacaaccccatcccctctgtgcgtggcaccaggggagcctgtagtgctgtcctgcgaactgagtagggctggagcaccagttgtgtggagccacaacgggcggccagtccaggagggggagggactcgagctgcatgccgagggacccaggagagtattatgcattcaggctgctggtccagcacacgctggactatacacctgccagtccggggccgcaccaggagcccccagccttagcttcactgttcaggtggcggaaccaccggtcagagttgtcgctcctgaggccgctcaaactagggtacggagtacacctgggggggacttagagctggttgtccatctatcaggacccggggggcctgtccgatggtataaggatggggaaaggctcgctagccagggtcgagtccagctggaacaagctggagctagacaggtgctccgtgtgcagggggcccgctccggcgatgcaggggagtacctgtgtgacgcacctcaagacagcagaattttcctcgtgtcagtggaggagccactcctcgtcaagctggtaagcgagctgacaccgctgacagttcacgaaggagacgatgctacgttccggtgcgaagtcagcccgccagacgccgatgtcacttggctcaggaacggggcggtggtcactcctggccctcaacgccagtcatgctgctcatatggagggtgtaggatgtgtggccagcggaaagcccggatgtgcgtaagtaagtggcgacaagcagaatgggtgcaaagaggaccctgtgcagggtgcgaagtaggttctccctgtccaactaccttggcttgcccctggcccagaatgggaacctctacagcttcctcctcgatggtgtcttattggcccactcgcgcccctacagcagcccgcgccaccactatcgcgccttggccggggagcgcttag

SEQ ID NO: 127264 - DNA, 3078 bp, Artificial Sequence
  Description of Artificial Sequence: Synthetic coding sequence
atgaaggcttccagtggtgatcagggcagcccaccctgcttcctccgatttccgagaccagtcagagtggtctcaggagccgaagctgagttaaagtgcgtcgtcctgggtgaacccccccctgtggtggtatgggagaagggagggcagcagctggccgcatctgaacggctcagcttccccgcagacggcgctgagcacggtctgctactgacagctgccctgcccacagatgctggagtgtacgtgtgccgtgcacgcaacgctgccggcgaagcgtacgccgcggcagcagtaacagtcctggaaccgcccgcttccgaccctgagctccagcctgccgaacggccattaccgagcccagggtcaggtgaaggagcccccgtgttcctgacaggccctcgtagccagtgggtgctgcgcggcgccgaggtcgtccttacgtgtcgggctgggggcctacctgagccaacgctgtactgggagaaagatgggatggcacttgacgaggtatgggattccagccatttcgctttacagcccgggagggccgaggacggacccggtgcttcattagcgctgcggatcctggcagcaagactccccgattccggcgtgtacgtatgccacgcgcggaacgctcacggccacgctcaggccggggcgctgctacaggtacatcaacccccggagtctccgcccgctgatccagacgaggccccagcccctgttgtcgaaccattgaagtgcgcccctaagaccttctgggtgaacgaaggtaagcatgccaagttcaggtgctacgtgatggggaagccagagccagagattgaatggcattgggaggggcgccccctgctgccagatagacgccgcttgatgtacagggatagggatggcggcttcgtgctgaaggttctctactgtcaagccaaggaccgggggctctacgtgtgtgctgcaaggaactctgccggccagaccctgagtgctgtgcaacttcatgtgaaggagcctcgccttaggtttacacgtccccttcaggatgtcgagggccgcgagcatggaattgccgttctagagtgcaaggtaccgaactcccggattccaaccgcctggtttagggaggatcagagactgctcccctgccgcaaatacgaacagatcgaggagggtaccgtcaggagattgatcatccaccggctcaaagccgatgatgacggcatttatctttgcgaaatgagaggccgtgtccgcaccgtggccaacgtgactgtgaagggaccaattctgaaaagacttcccagaaaattggatgttctggagggagaaaacgccgtgctgctggtagaaaccctcgaggccggcgtcgaggggcggtggagtagggatggcgaggagttaccagtgatctgtcaatcatccagcggccatatgcacgctcttgtactgccaggagttaccagagaggatgcgggagaagtcacgtttagtctgggcaactcgcgaactacaacactgctccgcgtcaagtgtgtgaaacattctccacccggccctccaattcttgcagagatgttcaagggccacaagaatacagtgctcctcacctggaagccacctgagcctgcccctgaaaccccattcatttatagactggagcgacaagaagtgggaagtgaagactggatacaatgcttttccattgagaaggccggggccgtggaagtccccggggactgtgttcccagtgaaggcgactacaggtttcgtatttgtacagtgagcggtcacggacgcagcccgcacgtggttttccacggcagcgcccatttggttcctacagcacggctggtggctggcctagaggacgtgcaagtgtatgatggtgaggatgcggtttttagcctcgatctgtcaactattattcagggtacctggtttttgaatggcgaggaactgaaatcgaatgagccagaagggcaggtcgaacccggggcactgagatataggatcgagcagaagggcctccaacaccggctgatccttcacgccgttaagcaccaggattctggggctctcgtggggttttcatgtccgggcgttcaggacagcgccgccctgaccattcaagaatcccccgtccacatcctctcccctcaagatcgggtgagcctgactttcactacaagcgaacgagtagtactcacttgtgagctttccagagtggactttcctgccacatggtacaaggacgggcagaaggtagaagagtcagagctgctggtggtgaaaatggacggcagaaaacaccggctaatactgccagaagcaaaagtgcaggactccggtgaattcgagtgcagaacagaaggtgtgagcgccttcttcggtgtgaccgtccaggacccccccgtccatattgtagatccccgcgagcatgtgtttgtgcatgcgataacctctgagtgcgtgatgctggcttgcgaagtggacagggaagacgcgcccgttcgttggtacaaggacggccaggaggtcgaggaatcagactttgttgtactcgagaacgaagggcctcatcgacgattggttcttcctgccactcagccctctgacgggggcgaatttcagtgcgtcgcgggagacgaatgcgcctacttcacggtgacaataaccgacgtgtccagttggattgtgtacccttccgggaaagtgtatgtagccgcagtgcgcctcgagcgcgttgtcctcacttgcgagctgtgcagaccttgggcagaggttagatggacgaaagatggcgaggaggttgtagagagcccagccctgttactgcagaaagaagacactgtgcggcgattggttttgcctgccgtgcagcttgaggattccggtgagtatctatgtgagatcgacgatgaatctgctagtttcacagtcaccgtcaccgaaagctaccaaagccaggactctagtaacaacaatccagaactatgtgtcctacttaaaaagccaaagacccggcggctctggtcaagattcccgccttggagaaggaccgctggcacagaatag

SEQ ID NO: 127265 - DNA, 5691 bp, Artificial Sequence
  Description of Artificial Sequence: Synthetic coding sequence
atgaaagccagctcgggtgatcaaggttctcctccctgttttctgcgattcccacggccggttcgggttgtttccggggccgaggctgagctaaagtgtgtggtgcttggcgagcccccccctgttgtcgtgtgggagaaagggggacagcaactcgctgcctctgagcgcctctccttcccggctgacggcgccgagcacggcctactgctgactgctgctctgcccacagatgctggagtatacgtgtgtcgcgcccggaatgccgccggtgaagcatacgcggctgccgcagtgaccgtcttagagccacccgctagtgatcccgagctgcagccagctgaaagacccttgccctcccctggatctggcgagggggccccggtttttttgaccgggccaaggagtcagtgggtgctgcggggcgcggaggtggttctaacgtgtcgggccggaggactcccagagccgaccctctattgggaaaaggacggtatggcactggacgaggtctgggactcttcgcacttcgccctgcagcccggaagggctgaagatgggcctggcgcgtccctggcgctcagaattttggccgcgaggctccccgatagtggtgtgtatgtgtgtcacgctcgaaacgctcacggccacgcacaggcaggtgccctcttacaggtacaccagcctccggaatctccacccgctgatcctgatgaggcacccgcccctgtcgtggaacctctaaaatgcgccccgaaaactttctgggtgaacgaaggtaagcacgctaaattccgctgttatgtgatgggcaaacccgaacctgagattgagtggcactgggaaggtaggccactgctccctgatcgacgaagattaatgtatagagacagggatggcggtttcgtcctaaaagtcctctattgtcaggccaaagatcgaggattgtacgtgtgtgccgctcgcaacagcgctggccagactctgtccgccgttcagctgcacgtgaaggagcctaggcttcgctttactcggcctctccaggacgtggaaggcagagagcacggcatcgccgtgctggagtgtaaggtgccaaattccagaattcctacggcatggttccgagaggaccagcggctccttccttgcaggaagtacgagcagatagaggaggggactgtcaggcgcctgataatccacagactaaaggctgacgacgatgggatttacctttgtgaaatgagaggtcgcgtcagaaccgtggcaaacgtgactgtcaaaggccctattctgaaaagactacctcgcaagcttgacgtgttagagggagaaaacgccgtgctgttagttgagaccttagaggcgggtgttgagggcaggtggtcaagagatggcgaagagcttcccgtgatctgtcagtcctcctccggccatatgcacgcccttgttctacctggagtcacaagagaggacgccggcgaggtgactttttccttgggaaattctcgcacaaccacccttctgagagtcaaatgcgttaagcattcccctcctgggcccccaattctcgccgagatgttcaaagggcacaaaaatactgtgctgttaacctggaagccgcctgaaccagcccctgagactccctttatttatcgcttggaacgacaggaagtagggtcggaagattggatccagtgcttctcaatcgagaaggccggcgcagttgaggtgcccggcgactgtgttccttccgaaggggactatcggtttcggatatgtactgtgtcaggccacggacgttcaccacacgtggtgtttcacgggtcagcccatcttgtgcctactgccagactcgtggcaggattggaggacgtacaagtttacgacggcgaggacgctgttttttctctggatttgagcaccatcatccagggcacatggtttctgaacggtgaggagctgaagagcaacgagccagagggacaggtcgagccaggcgctctgcggtaccggatcgagcagaagggtctacagcaccgcctgatcttgcacgcagtcaaacatcaggactctggcgcgttagtcggattttcgtgtcccggagtgcaggattccgcagccctgactattcaggagtcaccagtccatatcctgtctccgcaggacagggtttccctcacttttactacatcagaaagagttgtattgacctgcgaattgagtcgcgtggatttccctgccacttggtataaggacggccagaaagtcgaggaatctgaacttctggttgtcaagatggatgggaggaaacataggttgattctgcccgaagcaaaggtccaagattctggcgaatttgaatgccgcactgagggagtgagtgcatttttcggggtcaccgtccaggatccacctgtgcatatcgtcgacccccgggagcacgtttttgttcatgcaattacaagcgagtgtgtaatgttagcctgcgaagtagaccgcgaggatgcccccgtcagatggtataaagacggacaagaagtcgaggaatccgattttgttgtactggaaaatgagggcccacaccgccgtcttgtgctgcctgctactcagccatccgacgggggggagtttcagtgcgtggcgggtgacgagtgcgcttatttcaccgttacgattaccgatgtgagttcttggatcgtctatccctccgggaaagtgtacgtagcagccgttagactggagcgggtggtccttacctgtgaactttgtagaccatgggctgaagtgcggtggactaaggatggggaggaggtggtcgagtcacctgccctccttctccagaaggaggataccgtgagacggctcgttttgcccgccgttcagctagaggatagcggtgagtacctctgtgaaatcgatgacgagtccgcctccttcactgtcactgtgactgaacctccggtaagaatcatctaccctcgcgatgaggtgactctgattgctgtcacattggagtgcgttgtgttgatgtgtgagctgtccagagaagacgcgcccgtacggtggtacaaagacggcctagaagtcgaggaatcagaagccttggtgctggaacgagacggccccagatgccggctggttctgccagcggctcagccagaggatggaggcgagttcgtctgcgatgccggtgatgatagcgctttttttactgttacggttacggccccaccagaacgaattgtgcatcccgccgcacgctccctggacctgcacttcggggcccctggacgggtggaattgcgatgcgaagtggctccagccggctctcaagtaagatggtacaaagatggcttagaagtggaggccagcgatgccttgcagctgggcgccgaaggccccacgagaacgttgacgctgccacatgcccaacctgaggatgctggagagtacgtatgtgagacaaggcatgaggccatcacctttaacgtcatcctagccgaacccccagtgcaattcttggcactcgagactactccctcccctctctgtgtagcacccggcgagcccgtggttctcagttgtgagctgtcacgggctggggctcctgtcgtgtggtctcacaacgggcgcccggtgcaggagggtgaaggtctcgaattgcacgcagagggcccaaggagagtcctgtgtatccaagctgctggcccagcgcatgctggtctgtatacttgtcagtccggtgcagcccctggcgccccatctctatccttcacagtgcaggtggcggaacctcctgtcagagtagtggcccccgaagcagcgcagactcgggtgcgcagtacgccgggaggggatttggaactggtggtgcacttgagcgggcccggcggaccagttcgctggtacaaggacggcgaacgcctcgccagtcaagggcgtgtgcagctagagcaggcaggtgcccgacaagtcctgagagttcagggcgctcggtccggggacgccggggaatacttgtgtgatgctccccaggattcaaggatattccttgtaagcgttgaagagcccctgcttgtcaagctcgtttccgagctgacaccactcaccgtacatgagggggacgatgcaactttccggtgtgaggtgagcccccctgatgcagacgttacatggctgaggaatggtgcggtggtgacacctggtccccaagttgagatggctcagaatggttctagccgaatattgaccctgcggggctgccaactgggcgatgcaggcacagtgacgcttcgagctggatctacagcaacttccgctagattgcatgtgcgtgaaaccgaactgctgttcctacgcaggctccaagatgttcgggccgaagaggggcaagacgtgtgcctcgaggtcgaaactggaagggtgggcgctgcaggtgccgttaggtgggtgagaggtggacagcctctgccccatgacagtagactaagcatggctcaggacggccatatacaccgcctctttattcacggagtgatcctggccgaccagggcacttacggctgcgaaagccatcatgatcgcactctggcgcgcctgagcgtgcgccctagacagctcagagtcctgcgtccactcgaagacgtgaccatctcagaaggtggtagtgctacctttcaactggagttaagtcaggagggcgtcaccggggagtgggccagaggcggcgttcagctttacccagggcctaagtgtcacatccatagtgacggccaccgccatcgtctggtgctaaacggactaggactggctgactctggatgtgtatcgttcaccgctgacagccttcggtgcgccgctcgcctgatagtgcgtgaagtccccgtcactatcgtccgaggacctcacgacctggaagtgaccgagggggacaccgcaacatttgaatgcgagctgtcccaggccctggcggatgtcacctgggaaaaagatggtaatgccctgacaccatcaccccgtctgcgactgcaagcacttggtactaggcggttgttgcaattgagacggtgtgggccttcagacgcaggcacttattcatgtgccgttgggaccgctcgggccggccctgtgaggttaacagtgcgagaacgaaccgtcgcggtgctcagcgagcttagatccgtctccgcgcgggaaggagatggtgctacattcgaatgtactgtgagtgaagtggagactacagggcggtgggagcttggcggcagaccactgcgtccaggtgccagggtaagaatccggcaggaagggaagaagcacatattagtgctgtccgagctccgagctgaggacgctggggaagtgcggttccaggccggaccagcacaatcactggcacttctggaagttgaggcgcttcccctgcagatgtgtcgccaccctcctcgggagaagacagtcctggttggtcgacgggccgtgttggaggtcacagtctcacgatctggcggacatgtgtgctggctgcgtgaaggcgccgaattgtgcccaggagacaagtatgagatgcgatcccatggtcctactcactcgctggtcattcatgacgtgagacctgaggaccaggggacctactgctgccaagcgggacaagactcaacacatactcgactgctggtagagggcaattag

SEQ ID NO: 127266 - DNA, 2682 bp, Artificial Sequence
  Description of Artificial Sequence: Synthetic coding sequence
atggagccaccactgcccgtgggtgcacagcccctggccaccgtggagggcatggaaatgaagggtccacttagggaaccttgtgctttaactctggctcagcggaacggccagtacgagctgataattcaattgcatgaaaaagagcagcacgtgcaggacattatccccatcaatagccactttcgatgcgtgcaggaagccgaagagaccttactcatcgatatcgcctcaaactctggctgtaagatccgtgtccaaggcgactggatcagggaacgtcggtttgagattcccgatgaggagcactgtcttaaattcctgtccgctgtgttagcagctcagaaagctcaatcccagctgctcgtcccagaacaaaaggattcctcctcatggtaccagaaactggacacaaaagataaaccttccgtgttcagcggactgttggggttcgaggataatttcagctccatgaatcttgacaagaaaattaattcacagaaccagccaacgggcatccaccgggagcctccccccccccctttttctgtaaacaagatgctgcctagagagaaagaagcatccaacaaagaacagcctaaggtaactaacaccatgcgcaaactctttgtgccaaacacacaaagcggtcagagggagggtctgattaagcacatactcgccaagcgcgaaaaggagtacgtgaacatccagaccttccggttcttcgtgggaacgtggaacgtgaatggtcaaagcccagattcgggccttgagccctggttgaactgcgatcctaatcccccagatatctactgcataggatttcaggaactggacctcagcaccgaggccttcttttactttgagtctgtgaaggagcaggaatggagcatggcagttgagcgtgggctccactcaaaagcgaaatataagaaggtacagttggtgcgcctggtaggcatgatgcttctgattttcgcccgcaaggaccagtgtaggtatattagggatatagccaccgagacagtcggaaccggcatcatggggaagatgggtaacaaaggcggcgtggctgtcagatttgtattccacaacacaacattttgcatagtgaacagtcacttggccgcccacgttgaagactttgagcgtcgaaaccaggactacaaagacatctgcgcgaggatgagcttcgtcgtgcctaaccaaactctcccgcagctgaacataatgaagcatgaggtggtgatctggctgggagacttgaattaccgcctatgcatgcccgatgcaaatgaggtgaaatcactgatcaacaaaaaggatctgcaaaggcttctcaaattcgatcagttgaatattcaacgaactcagaagaaggccttcgtagacttcaatgaaggcgaaattaagttcatacccacgtataagtacgacagcaaaaccgatcggtgggatagtagtggcaagtgccgggttccagcttggtgcgatagaatcctgtggcgcgggaccaatgtaaaccagctcaattatcgatcccacatggaactgaagacctctgatcacaaacccgtttctgctttgtttcacatcggggtgaaagtggtcgacgaacgacgctaccgcaaggtgtttgaggacagcgtgagaattatggatcggatggaaaacgactttctgccaagccttgagttatccaggcgtgagttcgtgtttgaaaatgttaaatttagacagttacagaaagaaaaatttcagatctctaacaacggacaggtaccctgccacttctcctttattcctaagctgaatgactctcagtattgcaaaccatggttgcgagctgagccatttgaaggctatctagagccgaacgaaacggtggacatcagtttggacgtttatgtgtcaaaggattccgttaccatcctcaactcaggggaagacaagatagaggatattctggtgctgcatttagaccgcggaaaagactattttctgaccattagcggcaattatctaccaagctgcttcggaacgagtctcgaggccctgtgcaggatgaagaggccaatccgggaagtgcctgtgacgaagctgatcgatctggagaaatccttacttcagatggtacctttggacgagggtgccagcgaaaggcctttacaggtccccaaggagatttggttattggttgatcacctgttcaaatatgcttgtcatcaggaggacttatttcaaacccctggcatgcaggaggaactccagcagattattgactgcctggacaccagtatcccagaaacgatacccggaagtaaccactccgtagcagaggctcttctgatctttctggaagcactcccagagccagtcatatgctacgaactgtaccagagatgtctggacagtgcttacgacccgagaatctgtcgtcaggttataagtcagctgccaagatgtcataggaatgtatttaggtacctgatggcatttttacgcgagttactgaagttctccgaatacaatagcgtcaatgcaaatatgattgctacactgttcacgtctctgctgctcagacctcctccgaacctgatggccaggcagacacctagcgaccggcagcgcgctatccagtttctcctgggctttctgttggggagcgaggaggattag

SEQ ID NO: 127267 - DNA, 2706 bp, Artificial Sequence
  Description of Artificial Sequence: Synthetic coding sequence
atggaaccgcctctgcctgttggcgctcagcctttggctacagtggagggcatggagatgaaggggcccctgcgagaaccttgtgccctgaccctggcgcagcgcaatggtcaatatgagcttattatccagcttcacgaaaaggaacaacacgtgcaagacattatccctattaatagccacttccggtgcgtccaggaggcagaggagaccttactgatcgatattgcctctaacagcgggtgcaaaataagggtccagggcgattggatacgggagcgtcgcttcgagatcccagacgaagagcactgccttaaattccttagcgcggttttagccgcacagaaggctcagagccaactgctcgtgcctgagcagaaagacagctctagctggtaccaaaagttggacactaaagataaacctagcgtcttcagcgggctgctgggctttgaggacaatttttctagcatgaatctcgataagaaaataaattcccaaaatcagcctaccggcatccatagagagcccccaccaccaccctttagcgtcaacaaaatgctgccaagagagaaggaagcttccaacaaggaacagcccaaggtgaccaacactatgaggaaactgttcgtgccgaacacacagagcggacagcgagaaggcctgataaaacatatactcgccaagcgtgaaaaagagtacgtgaatatccagacctttcggttctttgttgggacatggaacgtcaatggacagtcacccgatagcggattagaaccttggcttaattgtgatccaaatccaccagacatatactgtatcggcttccaggaactggacctttctaccgaagcatttttctattttgaaagcgtgaaggagcaagaatggtccatggccgtcgaaagaggtctccactccaaggcgaagtacaagaaggtacagttagttaggttggtggggatgatgctgctgatttttgcaagaaaagatcagtgcaggtacattagggacatcgcgactgagacggtgggtacaggcatcatgggtaagatggggaacaagggcggtgtcgctgtgcgatttgtgtttcacaacacgactttctgcattgtgaatagccacctggcggcccatgtggaggattttgaacggaggaatcaggattataaagacatttgtgcccgcatgtccttcgtggtccctaatcaaacattgcctcagttaaatatcatgaagcacgaagtggtgatatggcttggggacttgaattaccgcctgtgcatgcccgatgccaatgaagtgaaatctctgattaataagaaggatctccagagactcctcaaattcgaccaactcaacatccagcgaacccagaaaaaggccttcgtcgatttcaacgagggagaaattaagttcatcccgacgtataaatatgatagtaaaaccgataggtgggatagttccggtaaatgccgtgtgcccgcatggtgcgatagaattttatggagggggacaaatgttaatcagctcaactaccgatcacatatggaactgaagacgtctgaccataagcctgtttccgcactattccacatcggtgtgaaggtagttgacgaacgaaggtaccgtaaggtatttgaagattctgtccgcattatggaccggatggagaatgattttctgccttcattggagctctctaggagggagttcgtgtttgagaatgtgaaattcaggcagctgcagaaagagaagtttcagattagtaacaatggacaggtcccgtgccacttctccttcatacctaaactgaatgactcccagtattgcaaaccttggctacgtgccgagccattcgaggggtacctcgaacctaatgagactgtggatatcagcctcgatgtttacgtgagcaaagatagtgttacaatcttgaatagcggtgaggacaaaatcgaggacatcttggttctgcatctggataggggcaaagactatttcctcacgatttctggcaattaccttcccagctgctttggtacctcgctggaggccttgtgccggatgaagagacccatccgggaagtgcctgtgacaaagcttattgacctcgaagaggatagttttctggaaaaggaaaaaagtctgctccagatggtccctctggatgagggcgcatcggagagacccctacaagtccccaaggaaatctggttgctggtagaccacctgtttaagtacgcctgccaccaggaagacctgtttcagacgccaggcatgcaggaggagctccagcagattatagattgcctggatacttctattccagagaccatcccgggctccaatcattccgtcgcagaagccttgctcatcttcctggaagctctgcctgaacccgtcatctgttatgagctttatcagcgctgcctggattccgcctacgatccaagaatctgtcgacaagtcatatcacagctgcccagatgccacagaaatgtctttcggtatctcatggccttcctgcgagagctcctcaagttcagcgaatataatagcgtgaatgccaacatgattgccacactcttcacctcactgcttctcagaccacctccgaatctcatggctagacaaactcctagcgaccggcaacgcgccatccaattcctgctgggctttttactcgggagcgaagaagattag

SEQ ID NO: 127268 - DNA, 2445 bp, Artificial Sequence
  Description of Artificial Sequence: Synthetic coding sequence
atgcaccttgaaggaagagatgggcggaggtatcccggcgcacctgctgttgaactgcttcagacgtccgtgccttcaggcttggctgaattagtcgctggaaagcgacggctccctcgtggggcgggaggtgctgacccttcacacagttgcccaagaggagccgccgggcagtcgtcttgggcaccagccggtcaggagttcgccagtttccttacaaagggcagaagtcactcctccctacctcagatgagctcttcccggagcaaagattcctgctttactgaaaacactcccctcttgagaaattcgctgcaggagaaagggagtagatgcatcccagtatatcacccagagtttattacagcagaagagtcatgggaggactcatctgccgactgggagcggcgatatctgctttcaagagaagtgagtggtctttcagcctccgccagcagtgaaaagggagacctgctggatagcccccacatccgactgcgcctaagcaaactgcgtcgctgcgtccaatggcttaaggtgatgggcctctttgcctttgtagtgttgtgctctattttgttctcactctaccctgaccagggcaagctatggcaacttctggccctgagcccacttgagaactactcagtaaacctgtctagccacgtcgattctactctgctccaggtagacttggctggggccctggtcgcaagcggtccttccagaccagggcgggaagagcacattgtggtggaactgacccaggctgatgcactcgggtccaggtggcggagacctcagcaggttactcacaattggactgtttatctgaacccacggcgcagtgagcactctgttatgagtcgaacattcgaagtgcttacccgagagactgtgtcaatttctatcagagcctctttgcaacagactcaagctgtccctcttctgatggcccaccaatacctgcggggctccgttgaaacccaggtcacgatcgctaccgcaatcctggctggagtgtacgctctgatcatttttgaaagaccaagcctgactcatgtagtggagtggattgacttcgagacgctggcactgctctttggtatgatgatcctggtggccatcttcagtgaaactggatttttcgactactgcgccgtcaaggcttatagactgagtagaggacgagtctgggccatgatcattatgctgtgtctcatcgccgcggttctgagcgcatttttagacaatgtgacgacaatgctgttatttactcccgtcaccattcgcctatgcgaagtgctcaatctggatccccgacaggttctgattgcagaggtgattttcaccaacatcgggggggccgcaacagccatcggggatccaccaaacgtaatcatcgtatcaaaccaggaactacgcaaaatgggcctagactttgctggatttacagcccacatgttcatcgggatctgcctggtgctgctggtctgttttcctttgctgagattattatattggaatagaaagttgtacaataaggaaccaagcgagatagttgagctgaagcatgagattcacgtgtggagattaactgcgcaacggatctcccccgcttctcgtgaagaaaccgcagtccgaagactgctgctgggcaaagtgctggctttggagcatctgcttgcgagacgtttgcacacattccaccgccagatcagtcaagaggataaaaactgggaaaccaatattcaggagctgcagaaaaagcataggatttcagacgggattctcctcgccaagtgcctaaccgttctcgggttcgtgatttttatgtttttcctgaactcctttgtcccagggattcaccttgacctggggtggattgccatcttgggggccatttggttgctaatcctggccgacatccacgactttgaaatcatcctacaccgtgtggaatgggcaacactattattttttgcagccctgtttgtactgatggaagccctggctcacttgcacctcatcgagtacgtgggggagcagacggccctgctgatcaagatggtccccgaagagcagaggctgattgccgcaattgtgttagtcgtgtgggtgtcagcgttagcgtcatccctcatcgacaatatcccctttactgctaccatgatcccagtgcttctgaatttaagccatgacccagaagtcggcctgcccgcacctcccctaatgtatgccctggcctttggagcatgcttaggtggaaacggaaccctaatcggggccagtgccaacgttgtctgcgccggcattgccgaacagcatggctatgggttttccttcatggagttttttcgtctgggatttcctatgatggtggtgagctgtacagtcggtatgtgttatctgctggtggcacacgtagtcgtcggatggaattag

SEQ ID NO: 127269 - DNA, 2517 bp, Artificial Sequence
  Description of Artificial Sequence: Synthetic coding sequence
atgcacctggaaggccgcgatggccgcaggtatcccggggcccccgcggtcgaattgctgcagacaagcgtgccatctgggctggctgagctggtggctgggaagaggaggctgcccaggggagctggcggagccgatccgtctcactcctgcccaagaggtgcggctgggcagtcaagctgggccccagccggacaggagtttgcctcttttctgaccaagggtaggagccattccagcctgcctcagatgtcgtcttcccgtagcaaagattcctgttttaccgagaatacccccttgcttcgcaacagcctgcaggagaaaggatctagatgcattccggtttatcacccagaattcatcactgccgaagaaagctgggaggacagtagcgctgactgggagcggcgctatctgctcagtcgtgaggtatccggtttatctgcgtctgcttccagtgagaagggggacctactggactcccctcatattcgcctgagactcagtaagctccgtaggtgcgtgcaatggctcaaagtgatgggactcttcgcattcgtcgtgctgtgttcaatccttttcagcttgtatccagatcagggaaagctgtggcagcttttggcactgtccccactggagaattactcagtcaatctgtcatcacacgtagactcgactcttctgcaggttgacctcgccggcgcactcgtggcaagtggcccctcaaggccaggtagagaggaacacattgtggttgagttgacacaggccgacgctctagggtccagatggaggcggccgcaacaagtgacccataactggactgtctatctgaatccaagacgttcagagcacagcgtcatgagccggacatttgaggtgcttacccgcgaaaccgtaagcatttccatacgggcttctctccaacagacacaagccgtgccccttctgatggcccaccagtacctgagaggatccgtggagacacaggtaacgatcgcaaccgcaattttggccggcgtgtatgctctgatcattttcgagatcgtgcataggaccctcgctgccatgctagggtctctggccgcccttgctgcactggccgtaatcggcgaccggccatcactgacgcatgtggtcgagtggatcgattttgagaccttggccctgcttttcggtatgatgatcctggtggcaattttttccgaaacaggctttttcgactactgtgctgtcaaggcttacagactgagccgaggccgcgtgtgggcaatgataattatgttatgcctgattgccgctgtgttgagcgctttccttgataacgtgaccaccatgttgctcttcacacctgtcacgatccggctgtgcgaagtgttgaatttagatccgcgccaagtgctcatcgcagaggtgatctttaccaatattggcggagccgctaccgccataggcgaccctcccaacgtcatcattgtctctaatcaagagctccgtaaaatgggactggactttgctggcttcactgcacacatgttcatagggatctgcttggtcctcctggtgtgttttcctcttcttcggttgctctactggaataggaaactgtacaacaaggagccgtctgagattgtggagctcaagcacgaaatccatgtatggcgccttaccgctcagagaatctcccccgcttcacgcgaggagaccgccgttcgtcgcctgttgttaggtaaagtgctagcgctggagcatctattagcacgcaggctgcacacattccaccgccagatttcacaggaggacaagaactgggagaccaatatccaagagctacagaaaaaacatcgtatcagcgacggaattctgctcgccaagtgtctgacagtactcggattcgtgattttcatgtttttcctgaattcatttgttcctggaatccatttagatttgggatggatagcaatccttggcgctatttggcttctgattctagccgacatccacgactttgagattatcctccacagagtggagtgggctactttactgttcttcgcagccttattcgtactgatggaggccctggcgcacttacacctcatcgagtacgtgggggaacagactgcccttctgattaagatggtgccagaggaacagaggctcattgcagccatcgtgctcgttgtgtgggtgtctgccttggccagcagtttaattgataatattccctttacggccactatgattcccgtgcttctgaacttgagtcatgatcctgaagtcggactgcctgctccaccactcatgtatgcactggcctttggggcctgcttgggggggaacgggacactaatcggtgcttccgcaaacgtggtatgcgcagggatagccgaacagcacggctatggtttctcctttatggaattctttcgactgggattccctatgatggtcgtgtcctgtacagtcggcatgtgttacctgctcgtggcgcacgtcgtggtcggttggaattag

SEQ ID NO: 127270 - DNA, 2007 bp, Artificial Sequence
  Description of Artificial Sequence: Synthetic coding sequence
atgcacctcgagggcagagacggccgtaggtatccaggcgcaccggctgtagaacttctgcagacttccgtgccttcgggcttagcagagcttgtggcagggaaaaggcgtctgcctagaggggccggcggggcagatccaagtcactcatgccctagaggggccgctggtcagtccagctgggcacccgctgggcaggagttcgccagcttcctcaccaaaggaaggtcccatagcagtctgcctcagatgtctagctcccgtagtaaagacagttgcttcaccgaaaatacccccttgctaaggaatagcttgcaagagaaaggcagccggtgtatcccagtgtaccatcctgaattcataaccgctgaggagtcctgggaagatagttccgctgattgggagaggcggtacttattgagcagggaggtcagcggcctgagcgcatctgcttcctcagagaagggggaccttctcgatagcccccacatccgcctcaggctgagtaagcttaggaggtgcgtacagtggctcaaagtaatgggcttgttcgcatttgttgtgctctgtagcatcttgttttccctttaccccgatcagggcaaactgtggcagctattggctctgagccctctagagaactatagcgtgaacctatcaagccacgtggacagtaccctcctgcaggtggacctggccggtgcactggtcgcgagcggaccgagccgccctggccgtgaagagcacatagtcgttgagttgacccaggccgatgcgttgggatcccggtggagacgaccccaacaggtaactcataattggacagtgtatttgaaccctcgcagaagtgagcactctgtgatgagtcgcaccttcgaggttctaacccgggagactgtgtctatcagcatccgggcttctttgcagcagacacaggcggtgccccttttaatggcacaccaatatctgagggggtcggtggagacacaggtcactatagccacagctattttagcgggagtctatgccctcattatcttcgagattgttcataggacgctggctgcaatgctgggcagccttgccgctttggctgcgctagcggtcataggcgacaggccttcactcacccatgtggtcgagtggattgacttcgagactctggccctcctgttcggtatgatgatcctggttgccatctttagcgagactgggttcttcgactactgtgctgttaaggcatatcgactgtcacgcggtagggtctgggctatgattattatgttgtgcctcatcgccgcggtgctttccgcctttttagacaacgttacaaccatgctactgtttactccagtgaccatcagactttgcgaggtgctaaatctggatcctcgacaggtgttgatcgccgaagtcatctttactaacatcggaggcgcggccacagctattggcgaccccccgaacgtgatcatcgtgtctaaccaggagctgcgcaaaatggggcttgactttgccggatttacagcgcatatgtttattgggatctgcctggtgctactggtgtgcttccctttgctgcgtttgctgtattggaatagaaagctgtacaacaaggaaccatccgagatcgtagagctgaagcatgaaatccacgtatggagacttacggcgcagcgcatttccccagcttcgcgcgaggaaaccgccgtgcgcagacttttactgggcaaggtcctggctctcgagcacctcctggcccgacggttgcataccttccaccgacagatcagccaggaggacaaaaattgggaaactaacatccaagagctccagaaaaaacaccgcatatcagatgggattctgttggccaaatgccttactgttttgggcttcgtgatatttatgtttttcctgaactcttttgtccccggtatccacctcgatctgggtggcctggggctcgtgcaggcggggaggtactacctgtcaactcctgaaagctag

SEQ ID NO: 127271 - DNA, 795 bp, Artificial Sequence
  Description of Artificial Sequence: Synthetic coding sequence
atgcacctggaaggtcgagacggacgccgctatcctggcgcgccggccgtggaactgctgcaaacatccgtcccttcaggcctcgccgagctggttgccggaaaacggagattaccgcgaggcgccggcggagctgatccttcccatagctgcccacgaggcgccgcggggcagagctcttgggcccctgcggggcaggaattcgcttctttcctcacaaaggggaggagtcatagctctctcccccaaatgtcatcttcacgctctaaggatagctgctttactgagaacacaccactgctgcgaaactcactgcaagaaaaaggttcacgttgcatacctgtttaccatcccgaatttataaccgccgaggagtcctgggaggattctagtgcagactgggagagacgctacctgctgtctagagaagtgtcaggactttccgcctcagcaagcagtgagaaaggagatcttctggacagcccccacattagattgcggttatctaagctccggcggtgtgtccagtggctgaaggtgatgggtcttttcgcttttgtcgtattgtgtagcatactgttcagtctgtatcccgaccagggcaagttatggcagcttctagccttgagcccactcgagaattactcagtcaacctgtcctcccatgtagactctactttattgcaggtcgacctggccggcgccttggtggcttcaggaccaagcaggccagggcgtgaggaacatatcgtcgtggagctcacacaagcagatgctctggggtcccgctggtag

SEQ ID NO: 127272 - DNA, 657 bp, Artificial Sequence
  Description of Artificial Sequence: Synthetic coding sequence
atgcacctcgaaggtagagatggccggcgataccctggagctcccgcagttgagctgttacagaccagcgtgccatcagggcttgcagagttggttgctggcaaacgcaggctcccccggggagcaggaggggccgatccctcacacagttgtccacgaggggcagctggtcaaagctcttgggcccccgcgggacaggagtttgcctccttcctgacaaaaggcaggtcgcattctagtctacctcaaatgtcatcttcacgatccaaagattcctgtttcacagagaacacccctttattgagaaattccctgcaggaaaaaggaagtagatgtatcccagtgtaccatcccgagttcatcacagccgaagagtcctgggaagactcctcagccgactgggagagacgttatctactgagtcgcgaggtcagcggactaagcgcatctgctagctcagaaaagggtgacctactcgattctcctcatatccgactgaggttgtccaaactgcgaaggtgcgtccagtggctcaaggtcatgggactgtttgcttttgtggtgctttgcagcgtgacacacaattggactgtgtatctaaatcctagacggtcggaacattctgtcatgtcaagaacattcgaagtgttgacatag

SEQ ID NO: 127273 - DNA, 801 bp, Artificial Sequence
  Description of Artificial Sequence: Synthetic coding sequence
atgggcagcaaaacactccccgcccccgtacctattcaccctagcctgcagctgaccaattatagcttcctccaggccgtaaacgggctgccaactgtgccttccgatcacctgccaaacctttacgggttcagtgcactacatgctgtgcatcttcaccagtggacgttgggatatcccgccatgcatctgcccagatcgtccttcagtaaggtaccgggtactgtttcttctctcgttgatgcacgcttccagctgcctgcatttccgtggttcccccatgtcatacaacctaagccagagatcacagcagggggaagcgtgcctgcccttaagaccaaaccaagatttgactttgcaaaccttgcccttgccgcaacccaggaggatcccgccaaactcgggaggggggaaggtcctggatccccagcagggggtctgggagcactgctcgatgtcacaaaactcagccctgaaaagaaaccgacgcgggggcggctgccttccaaaacaaagaaggagttcgtctgtaagttttgcggccggcactttaccaagtcttataatctgctgatacacgaacgcacccatacagatgagaggccatatacttgcgatatttgtcacaaggcctttaggcgccaggatcatctcagagaccaccggtacattcacagcaaggagaaacccttcaaatgtcaagaatgcggcaagggcttttgtcaaagccgcacgctggcagtgcacaaaacccttcatagtcaagttaaggagcttaaaacgtccaagattaaatgttag

SEQ ID NO: 127274 - DNA, 801 bp, Artificial Sequence
  Description of Artificial Sequence: Synthetic coding sequence
atgggatccaagactctacccgctcccgtcccgatccacccctctttacagctgaccaattattcttttttacaggccgtcaatggactgcccacagtcccgtcagaccacctgcccaacttgtatgggttcagcgccttacacgccgtgcatctgcatcagtggacgctgggataccccgctatgcacctcccacggtccagtttcagtaaagttccaggcactgtcagttcattggtagacgctcggttccagctgccagctttcccatggtttccccacgtcattcagcccaaacccgaaataacggctggaggatcagtacctgctctgaaaacgaaaccccgattcgacttcgccaatctggcgctcgctgccacacaagaggacccagcaaaactcggtcgcggcgaagggccagggagcccagccggcgggctgggggctttactggacgtcaccaagctctctcccgaaaagaaaccaacccgcggcagactcccatctaaaactaaaaaagagttcgtctgcaagttttgtggtcggcactttaccaagtcctataacctgcttatccatgagaggacgcatacagatgaacgtccgtatacatgcgacatctgccacaaggccttcagaagacaagatcacctgcgggaccataggtacatccattccaaggaaaagccttttaagtgccaggagtgtggaaagggcttttgccagtctaggactcttgcagtgcacaagaccctgcattcacaggtgaaggaattgaagaccagtaaaattaagtgttag

SEQ ID NO: 127275 - DNA, 939 bp, Artificial Sequence
  Description of Artificial Sequence: Synthetic coding sequence
atgggcagtaaggctttgcctgctccaatacctctgcatccctccctgcagctgaccaactacagcttcctccaggcagtgaatacatttcccgccactgtggatcatttgcaagggctctatggtttgtctgcagttcagaccatgcatatgaatcactggaccttagggtatcccaatgtgcatgaaataacccgctcgacaataaccgagatggctgcagcacagggactggtagatgctcgatttccttttccagccctgccctttacaacccacttgttccaccccaaacagggcgcgatcgcacacgttctgcccgctcttcacaaggacagacccagatttgattttgctaatcttgccgttgcagccactcaggaagaccccccaaaaatgggggacctgagtaagcttagtcctggtcttgggtcacctattagtggccttagcaagcttacaccagaccgaaagccctccaggggacggctgccttctaagaccaaaaaggaattcatttgtaaattttgcggacggcattttacaaagtcctataacctcctcattcacgagcgcacgcatacagatgaacgtccatacacctgcgatatatgtcacaaggccttccgccggcaggaccacctgcgggaccatcgatatatccacagcaaggagaagccctttaaatgtcaggaatgtggaaaagggttttgtcagtcacgcacgcttgccgtgcataaaaccctgcacatgcaggaatctccccacaagtgtcctacatgtggcagaacatttaaccagcgatcaaatctaaagacacatttgctcacccacacagacatcaaaccctactcatgtgaacagtgcggcaaggtgtttcgcagaaactgcgatctgaggaggcactccctgacacacaccccccggcaggatttttag

SEQ ID NO: 127276 - DNA, 831 bp, Artificial Sequence
  Description of Artificial Sequence: Synthetic coding sequence
atgggtagtaaggccttgccagccccgatcccgttgcaccccagtcttcagcttaccaattatagtttcctccaggccgtcaatacattccctgccactgttgaccatttacaggggttgtatggactatcggccgtgcagaccatgcacatgaaccactggaccctgggatatccaaacgtgcacgaaataacccgctcaacaattaccgaaatggccgctgctcaaggactggtcgatgcccgcttcccatttcctgccttgccatttaccacccatttgttccaccccaagcagggggctatagctcacgtgttgcctgcattgcataaagacagaccgcggttcgatttcgcaaatctggctgtggctgcaactcaggaagatcccccgaaaatgggggatctgtcaaaacttagtcctggactgggttcccccatcagcgggctgtcgaaacttacaccagataggaagccttctcgaggccgtctgccaagtaaaactaaaaaagaatttatctgtaaattttgcggcaggcatttcaccaagagttataatctgttgatccatgaaagaacccacacggatgagcgcccttacacctgtgacatatgccacaaggctttcaggaggcaggatcacctgagggatcatagatacatacatagcaaggaaaagccgttcaaatgtcaagagtgtgggaaaggcttctgtcagagtcgaactctggctgtccataagactttgcacatgcaaacctcttcgcccaccgccgccagcagcgctgcaaagtgcagcggggaaacggtgatctgcgggggaactgcctag

SEQ ID NO: 127277 - DNA, 1302 bp, Artificial Sequence
  Description of Artificial Sequence: Synthetic coding sequence
atggggctgagagctgaagaaggcaaacggaaaccccctaggtcagtaaggggggaagtcagtccctctcaaggaccgctggctcaagaggatgaagccagaagactgcggagctgcacaccggcttgccaccctggaaaaagaggcaaaggcggccaccgggctcgacggcagcgctctgcttgggacctcacgacccaccccctgactcaccgcagccaggagctgcgaggagccgctgcaactgagggatttttgtacgtacttcttagccattgggtcttcgtgggcgcgccccgaccccccgcatccgattcatggaagaagggtctcgtccctagcgcacctcccgcatcacgtaaaatgggttccaaagcattaccagctccaatcccactccacccgagcctgcagctgacaaattatagcttcttacaggcggtcaataccttccccgccactgtggaccacctccaggggttgtatggcctgagcgccgttcaaaccatgcacatgaatcattggaccctcggttaccctaacgtacacgaaatcactcgatccacaatcactgaaatggccgctgcccaaggcctggtggatgctcggtttccatttcccgcccttccatttactacgcatctgtttcatcctaaacagggagcgattgcccatgtcttacctgccctgcataaggataggcctcgattcgatttcgccaatctggccgtggccgctacacaggaagacccccccaaaatgggggacctgagcaagctgtcgccagggctgggctcacctatatcaggcttgtcaaaactgacacccgaccgtaagccttcacgaggcaggctgccttccaaaacgaaaaaagagttcatctgcaagttttgtggccgtcactttacaaaatcatacaacttgcttatccatgaaaggactcacacagatgagcgaccctacacatgtgatatctgccacaaggctttccgtcgccaagatcatctcagagatcatcggtatattcacagcaaggaaaagccctttaagtgtcaggaatgcgggaaaggattttgtcagtctaggacactcgcagtgcataaaacattgcacatgcaggaatctccccacaaatgccccacgtgcggtcgcacattcaaccagcggtcaaatcttaagactcacctcttgacacatacggacatcaaaccttacagctgcgaacagtgcgggaaagtctttcgccgcaactgtgacctccggcgccactcattaacccatacccccagacaagatttttag

SEQ ID NO: 127278 - DNA, 642 bp, Artificial Sequence
  Description of Artificial Sequence: Synthetic coding sequence
atgggcagcaaagccctgcccgcccccatccctctgcacccgtctctgcagctgacaaactactcctttttgcaagctgtcaacactttcccagccacagtcgaccacctccagggactgtatggcctgtccgccgtccagactatgcatatgaatcactggactctgggatatcctaacgtacatgaaattactcgcagtaccattacagagatggccgccgcccagggtctggtcgacgcaagattcccttttcctgccctgcctttcacgactcaccttttccaccccaaacagggcgcaatcgcccatgtgcttcctgctttacacaaggacagacctagatttgattttgctaacctggccgtggccgctactcaggaggatcccccaaagatgggagatctcagcaaactgtcccccggactgggatctccaatatccggcctctcaaagcttaccccagatcgcaaaccatctcgcgggcggctcccttcgaagaccaagaaagaatttatttgcaagttctgtggaagacactttactaaaagttataacctcctaattcacgaaaggacccacacagatgaaaggccttatacatgcgacatatgtcacaaggcctttcgaaggcaggactag

SEQ ID NO: 127279 - DNA, 939 bp, Artificial Sequence
  Description of Artificial Sequence: Synthetic coding sequence
atgggaagcaaggccctgccagcacccatacctctccatcccagcctgcagttgacaaattacagttttctgcaggccgtgaataccttccctgccaccgtggaccacctgcagggcctttacggcctgagcgctgtacagactatgcatatgaatcattggacgttgggttaccctaatgttcatgagattacaaggtcaacaatcactgagatggcagcagcacaggggctcgtggacgctcgctttcccttccctgccctcccttttaccactcatctctttcacccgaaacagggagcaatcgcgcatgttctgcccgccctgcataaagaccgccccagattcgatttcgccaacctagccgttgcagcaacacaggaggatcctccaaaaatgggggacttgtctaagttgtcccctggcctcggctctcctatctctgggctaagcaagctcacccctgatcggaagccttcgcggggacggttgccttcaaagaccaaaaaagagtttatatgtaaattttgcgggcgacacttcactaaaagttataacctcctgattcacgaaaggacacatactgacgaacgcccttacacctgtgacatatgtcacaaagcgttcagaagacaggatcacttgcgcgaccatcggtatatacactccaaagaaaaaccctttaagtgccaggagtgtggtaagggattttgccaatctcgcacattggcagttcacaagacactgcacatgcaggagtctcctcacaagtgccctacatgtgggcgaacttttaatcagagatccaatttaaaaacccacctactgacccatacagacattaagccctatagctgtgagcagtgcggcaaggtttttcgccgaaactgcgatctccgacgccattccctaacgcacacaccacgccaggatttctag

SEQ ID NO: 127280 - DNA, 687 bp, Artificial Sequence
  Description of Artificial Sequence: Synthetic coding sequence
atgaagacactatttctgggggtaactcttggtctggcggccgcgttaagcttcacccttgaggaagaggacattaccgggacctggtatgtgaaagcaatggtagttgacaaagactttcctgaggatcgtagaccccgtaaagtatctccggtaaaggtcacggcgctgggaggcggtaatctggaagccactttcacctttatgagagaagacaggtgtattcagaaaaagatcctgatgcgtaaaactgaggaaccaggcaaattctccgcatacgggggcaggaagttgatctacctccaggaactgcctggcactgacgattatgtgttctactgtaaggaccagcgccgtggcgggcttcggtatatgggtaagctggtggcatctgccccgtgtagagcagtcccgctgtctcccccttggctcacatggccaccacacctacaggtagggatccttattcctacctggcggccctggaaaaatctgaggaattggtgtagtaccagggattcaagacgtcgaaccttcagttgcccctgccggagagaggcagcctttagcaatacacgccagccaccgggcctgcacctgcagtcacccccttaccatcagactcagagccccgaccatcttgacttgccatccagccacgacccttccttgctgcctcccacgtag

SEQ ID NO: 127281 - DNA, 444 bp, Artificial Sequence
  Description of Artificial Sequence: Synthetic coding sequence
atgaagactttgttcctgggggtaacattgggcttggcagccgctctttcatttacgcttgaggaggaggatgagggcggttccgtgcacccagaagagaaccctgatgcagaagatggaggagcctggcagattcagagactgtggggccaggaagcacatatccctgcaggagccgctagggatgggcggcttcggttactgctgcagcgacccgccccctggggacccgcgctccatggtaaggcctgcgggatttgttctttgcaggggagggccgcggtccctactcttgcccatctggcaacttcaccggctggcagaaaccccaatacaaacctggaagcacttgaggaatttaagaagctggtgcagcataaggggctgagcgaagaggatattttcatgcccctgcagactgggtcttgtgtgcttgagcattag

SEQ ID NO: 127282 - DNA, 513 bp, Artificial Sequence
  Description of Artificial Sequence: Synthetic coding sequence
atgaagactttgtttctgggcgttaccttggggctggctgcggccctctcgttcaccctcgaagaggaggatattaccggaacatggtatgtaaaggctatggtggtcgacaaagacttcccagaagatcgacggccacgtaaggtcagtcctgtcaaagtaactgcccttgggggaggcaacttagaagctacatttacgtttatgagagaggaccgatgcattcagaaaaaaatccttatgcgcaagaccgaggagcctggtaagttcagtgcctacgggggaagaaaactgatctatttgcaggaactacctggcacggacgactatgttttttattgtaaggaccagaggcgaggcggtctccgctatatgggcaagcttgtggggcggaatccaaatacgaatcttgaagccctagaggagtttaaaaaactcgtacaacacaagggcctatctgaggaggacatttttatgcctttgcaaacagggtcctgtgtgctggagcactag

SEQ ID NO: 127283 - DNA, 513 bp, Artificial Sequence
  Description of Artificial Sequence: Synthetic coding sequence
atgaagaccctgttcctcggggttacactgggccttgctgctgccctgagttttactctcgaggaggaagacattactgggacctggtacgtgaaggcaatggtggttgataaagactttcccgaagacagaaggcctcgcaaggttagcccggtgaaagtgactgcactgggtggtggaaacttggaggccacctttacctttatgcgggaggatcgatgcattcagaagaagattcttatgcggaagacggaggaacctggcaagttcagcgcctacggtggacgaaaactaatctacctgcaagagctgccaggaaccgacgactacgtgttctattgtaaggatcagagacgcggcggcctccgctatatgggcaagcttgttggccggaatccgaacacaaacctcgaagccctggaggaatttaagaaactcgtgcaacacaaggggctgagcgaggaagacattttcatgccactacagacagggagctgcgtgttagagcactag

SEQ ID NO: 127284 - DNA, 258 bp, Artificial Sequence
  Description of Artificial Sequence: Synthetic coding sequence
atgaagacactctttctcggcgtcaccttaggattggccgccgccctctcatttaccctggaggaggaagacgatggcccatgggtccaccccgaggagaacccagatgctgaagacggaggcgcctggcagattcagcgtctttggggacaggaggcccacgtccccgccggagcggcccaggaaggtcctcttcatttgctgctgcagcgaccggccccttggggcccggcccctcatgggaaggcctgtggatag

SEQ ID NO: 127285 - DNA, 513 bp, Artificial Sequence
  Description of Artificial Sequence: Synthetic coding sequence
atgaagactctgttcctgggggtgaccctggggttggccgctgccctcagttttacgttggaggaggaagacatcacgggtacctggtacgttaaggccatggttgtggacaaagacttcccagaagatcggcggccacgtaaggtcagccctgttaaagtgaccgcactcggaggtggcaaacttgaggctacttttacctttatgagagaggatcggtgcattcaaaagaagattttaatgcggaaaacggaggagccaggaaaatattctgcctacggggggcgcaagctcatgtacttgcaggagctgccaagaagggatcactacatattttattgtaaagatcagcatcacggtggtctgctgcatatgggcaagctggtgggccgcaattccgataccaaccgcgaggccttagaggagtttaagaagttagtgcagagaaaaggactgtccgaggaagatatctttaccccactccagaccggatcctgcgtgcctgagcactag

SEQ ID NO: 127286 - DNA, 8310 bp, Artificial Sequence
  Description of Artificial Sequence: Synthetic coding sequence
atggatgtgaaagaacgtaaaccttaccgcagtctgactcgacgccgagacgccgagcgaagatatacatcgtctagtgcagacagcgaggagggcaaggctcctcagaaatcatatagcagctcagagacacttaaagcatatgatcaggatgcccgcctcgcctatggaagccgggtaaaggacattgtcccccaggaagcggaggagttctgtagaactggggctaatttcaccctgagggagcttggtttagaggaagtgaccccacctcatggaacattgtatcggacggacatcggcctcccccactgcgggtactctatgggcgctggcagtgacgctgacatggaggcggacaccgtgctatcacctgagcatcccgtccgcctgtggggacgctctacacgtagtggcaggtccagctgcctgtccagcagagcaaacagcaacttgacgctcaccgataccgaacacgaaaacaccgaaaccgaccacccgggagggctacagaaccacgctaggctaaggacacctccccccccactctcgcatgcacatacccctaaccagcaccacgcagccagcattaacagcctgaatcgcggaaacttcactccaagatctaacccatctccagctccgactgatcatagcctgagtggagagcctccggcggggggcgctcaggagccagcccatgcacaagagaactggctgcttaatagcaatattcctctggagacccgtaacctcggaaagcagccgtttcttgggactcttcaagacaatttgattgaaatggacatattaggcgctagcaggcacgacggcgcttatagtgacggccattttctatttaaaccgggaggcacatctccactgttctgcaccacctcccccggctaccctctgacaagttccacagtatattccccgcccccccgcccactgccaaggtctaccttcgcccgacccgcctttaacctcaaaaaaccttccaagtactgtaattggaaatgtgccgctctctccgcaatcgtcatcagcgccacactggtgattctcctggcatacttcgtggcgatgcatctgttcggactgaactggcatttacagccaatggagggacagatgtacgagatcacggaggataccgcatcttcctggcctgttcccaccgacgtatctctgtacccttcggggggcactgggctggaaactccagacaggaaggggaagggcacgaccgagggtaaaccatcctccttcttccctgaagactcgtttattgactcaggcgaaatcgatgttgggcgtagggcgagccagaagatcccacctggcactttctggcggagccaggtctttatagatcaccctgtgcatctgaaattcaatgtatcacttggaaaagccgcgctggtgggcatctatggcagaaaagggctaccaccgagtcatacacagttcgactttgtggaactcctcgatgggaggagactgttgacacaggaggcacgaagtttggagggcaccccacgtcagtctcgcggaactgttccaccgtcttcgcatgagaccgggttcatccaatacctggattctggcatttggcacctggctttttacaacgatggcaaagagtcagaagttgtgagctttctgaccaccgccattgagtcggtggacaactgtccctcaaattgctacgggaacggtgactgtatcagcggtacctgccattgcttccttggttttcttgggcccgactgtggacgcgcctcatgcccggtgctttgtagcggcaatggacagtacatgaaagggagatgtctatgccactccggttggaagggggctgagtgcgacgtccccacaaaccagtgtatagacgtagcatgctcaaaccatggaacatgtattacagggacctgcatctgtaaccctgggtataaaggggagagctgcgaggaggtcgattgcatggacccaacttgttctggccggggggtgtgtgtgagaggcgagtgtcactgcagtgtggggtggggagggaccaattgtgaaactccacgggccacatgtctcgatcagtgctctgggcacgggaccttcctccctgacacagggttatgttcctgtgacccctcatggacaggccacgattgctctatagaaatctgtgcagccgattgcggaggccacggtgtttgcgtagggggcacttgtcgctgcgaggacggctggatgggtgccgcctgtgatcagcgggcctgccacccccgctgcgcagagcacggaacctgcagggatgggaaatgcgagtgctcaccaggatggaacggagaacactgcactattgcccactatctggatcgagtcgtaaaggagggctgcccaggtctgtgcaatgggaacgggcgatgcacactggatctcaacgggtggcattgtgtatgccaactcggctggcggggcgccggatgcgacaccagtatggaaacagcttgtggggatagtaaggacaacgatggggacggtctggtcgattgtatggatccagattgttgtcttcagccactgtgccatataaaccctctgtgtctaggaagcccgaatcctctggacatcattcaggaaacccaggtccctgttagccagcagaatctgcacagcttctacgatcgtataaagttcctcgtggggagggactccacgcacattatccctggcgaaaatccatttgacggggggcatgcgtgcgtcatacgggggcaggtgatgacaagcgacggcaccccgctggttggcgttaacatcagtttcgttaacaaccctctctttggatacacgatctccagacaagacggttccttcgatctggtcacaaacggcggaataagcataattttacgttttgagcgggccccatttataactcaggagcataccctgtggctgccatgggacagattttttgtgatggagacaattataatgcggcatgaggagaacgagatccctagctgtgacctctctaacttcgctcggccgaatccagttgtctccccatctcctctaaccagctttgcatcctcctgtgccgagaagggtccaatcgtccccgaaatccaggcacttcaggaagagatctctattagtgggtgtaagatgcggctctcttacctttcatcacgcacacctgggtataaatccgtgcttaggatctcccttacgcacccgactattccatttaatctgatgaaggtgcacctcatggtcgccgtggaaggccggctctttagaaagtggttcgctgctgcgcctgacctctcatattatttcatttgggacaagactgacgtgtacaaccaaaaggtgtttggtctctccgaggcttttgtcagcgtggggtatgagtacgaatcttgccccgatctgatactttgggagaaaagaaccacggtgctgcaaggctatgaaatcgatgcaagtaagctggggggttggtcgttggacaagcatcatgccttgaatattcagtctggcatcttgcacaaagggaatggagaaaatcagttcgtctcacagcagccaccagtcataggatcaatcatgggaaatgggcgtcgtagatcaataagttgtcctagttgcaatggcctggctgatggaaacaaactgctggctccagtggctttgacgtgtggctctgacggaagtctgtacgtcggcgacttcaactacatccgtaggatttttccctcaggcaacgtgaccaatatcctggagctccggaataaggatttccgccatagccattctccagcgcataaatactacctggccaccgacccaatgtccggggccgtttttttgtctgatagcaactcaagacgggtctttaagatcaagagcactgttgtggtcaaggatttggtaaaaaatagcgaggtggtggccgggaccggcgatcaatgtcttccttttgacgacactcgatgtggggatggtgggaaggctacggaagcaactttgaccaatcctcgggggattacagtcgataagttcgggctaatctattttgtagatggaaccatgattcggcgcatcgaccagaacggcattatatctacactcctcggctccaacgacctcacttcggctcgtccactatcatgcgattccgtcatggatatctcccaagtccacctggagtggccaacggacctcgccataaatcctatggacaattctctgtatgttttggataacaacgtggtactacagatcagtgaaaatcatcaggtgagaatcgtggcagggagacccatgcattgtcaagtcccggggatcgaccatttcttgttgagcaaagtggccatccacgcaacactggagtccgctactgccctggctgtgtctcacaacggagtgctgtatattgctgagacagatgagaaaaagataaataggatccgtcaggttactacctctggtgagatctctctggtggctggagcccctagtggatgtgactgcaaaaatgatgcgaattgcgactgcttctctggcgacgacgggtatgctaaggacgcaaaactcaataccccatccagtttggccgtttgtgccgacggagagctgtatgtcgccgacttgggaaatattaggatcaggttcatccgcaagaataagccattcctcaacacccagaacatgtatgaactgtcttccccaattgatcaggagttgtacctgtttgatacaactggcaagcatctttacacacagagtctgccaacgggggactacctatacaattttacatataccggtgacggagacattacactaattacggacaataatgggaatatggtgaatgttaggagagatagtactgggatgcctttgtggctggtggtgccggatggccaggtttactgggttactatggggacaaactcggcactaaaaagtgtgacaacacagggacacgagctagccatgatgacataccacggaaatagtgggctgcttgcaaccaagtccaatgaaaacgggtggacaaccttttatgagtacgactcctttggccgattgacaaacgttacatttcctactggacaggtcagctccttcaggagtgatactgattcttccgttcatgtgcaagtagaaacatcttcgaaagacgatgtgacgatcaccactaacttatctgccagcggcgccttctacaccctcctgcaggaccaggtgcgcaattcttattacataggcgctgacgggagtctgcggctccttctcgctaatggcatggaagtcgccttacaaactgaaccgcatttgctcgccggcaccgttaatcccaccgtgggaaagcgcaatgtgacattacccatagataacggccttaacctggtggaatggagacagcggaaggaacaggcgcgaggccaggtaaccgtttttgggaggcggctccgggtccacaacaggaatctattgtccctggactttgatcgggtcactcggacagagaaaatctatgatgaccaccgaaagttcacattgaggattctgtatgatcaggccggacgcccctcgctgtggagcccgagttctcgtctgaacggtgtcaacgtaacctattcaccgggcggatacattgctggaatccagaggggtatcatgagtgagcgaatggagtacgaccaggccgggcgcatcaccagtcggatctttgctgacgggaagacatggtcctacacgtatttagagaagagtatggtgctgctgttgcactcacagaggcaatacatatttgagtttgataagaatgaccggctgtcttctgtcacgatgcccaatgtggcaagacagactctggagacaattcgaagtgtaggatattataggaatatctatcagcccccagagggtaatgccagtgtgatccaggatttcactgaggacggacatctgctgcatacgttctatctgggcacgggccgtcgcgtgatttataaatacggtaaactatcaaagttggccgagactttgtatgataccaccaaagtctcatttacctacgacgaaactgcgggtatgctaaagaccatcaacctccagaatgagggtttcacatgtacaatccgctaccggcagatcggtccgttaatcgacagacaaatcttccgctttaccgaagagggaatggtgaacgcccgttttgattataactacgataattccttccgagttacaagcatgcaggctgtaatcaatgaaacgcccctgccaattgacctgtaccggtacgacgatgtctcaggcaagacagagcagttcggcaaattcggtgttatctactacgacattaaccagataatcactacagcagtgatgacgcacacgaagcactttgatgcctatgggcggatgaaagaagtgcagtacgaaattttcagatccctgatgtactggatgacagtccaatatgataacatggggcgagtcgtgaagaaggagctgaaagttggaccatatgcgaacactactcgctatagctacgagtacgatgctgatggtcagcttcagactgtcagcattaacgataaacccctctggcggtattcttacgatctcaacggcaatttacacctcttgagtcctggaaatagtgcccggctcaccccgttacgctacgacatccgagatcgtataacacgcctcggagacgtacaatacaaaatggacgaagacggcttcctgcggcagcgcggcggcgacatctttgagtacaattccgctggactgttgatcaaggcctacaatcgggccggctcctggagtgtgcggtaccggtacgacggtctgggaaggcgtgtgtctagcaagtcgagccactcccatcacctacagttcttttatgcagacctgaccaatccaactaaagtcacacacctatacaatcattcaagtagtgagatcaccagtttatactacgacctgcaaggtcacctgttcgctatggagctatcatccggggatgagttctacatcgcctgcgacaacatcggcaccccactcgccgttttctccgggactgggctgatgatcaagcagatcttatacactgcgtatggtgaaatatacatggacaccaatccgaatttccagattataatcggataccacggcggactctatgacccattaaccaagctggttcacatggggcgcagagactatgacgtcctggcgggccgttggacaagccctgatcatgaattgtggaaacatctgagttcttccaatgtgatgcccttcaacctgtatatgttcaaaaacaacaatcccatatcaaattcacaggatattaagtgtttcatgaccgacgtcaatagctggctgcttacattcgggtttcagctccacaacgtaattcccggctacccaaaaccagatatggatgccatggagcccagctatgagctgatccatacacagatgaaaacccaagaatgggataactccaaaagtatcctcggcgtgcaatgcgaggtgcagaaacaactgaaagcttttgtgacactggaacgcttcgaccagctatacggtagcaccattacaagttgtcaacaggctccaaagaccaagaaatttgcctcttccgggtcagtgttcggcaagggggtgaaattcgctttgaaagacggtcgggtgaccactgacataattagtgtggctaacgaggatggccgacgagtggccgccatcctgaaccatgcacattacctggagaatttgcattttacgatagatggagtggacacccactattttgttaagcctgggccaagtgagggtgacctggcaatcctgggcctgagcggcggccgccgaacccttgaaaacggcgttaacgtgacagtgtcacaaattaataccgtgctgaacggcagaacccgcaggtataccgatatccagctgcaatacggggccctctgtctgaatacacgctacggtaccactctggatgaagagaaagcccgagtgctggagctggccaggcagcgagctgtgcgccaggcctgggctcgggagcagcaaagattgagggaaggggaagaaggcttgagagcctggactgagggtgagaaacagcaggtgctctcgaccggccgggtccaaggatacgatgggttttttgtgatcagcgtggagcagtacccagaactgtccgacagtgctaataacattcatttcatgcgccagtcagaaatgggccgccgttag

SEQ ID NO: 127287 - DNA, 6 bp, Artificial Sequence
  Description of Artificial Sequence: Synthetic coding sequence
atgtag

SEQ ID NO: 127288 - DNA, 1404 bp, Artificial Sequence
  Description of Artificial Sequence: Synthetic coding sequence
atgccgggccgatggaggtggcaaagagacatgcatcccgcccgaaaactgctatctttgttatttctgattctgatgggaaccgaactcactcaagtattgccaacaaatcccgaggagtcttggcaggtttatagtagcgctcaagactctgagggcagatgcatttgcacagtggtagctccacagcagactatgtgcagtagagacgccagaaccaagcagcttcggcagctcttagaaaaggtccagaatatgtcccagtctattgaggtcctcgatagaagaactcagcgcgatctacagtacgtggaaaaaatggaaaaccagatgaaggggctggagagcaaattcaaacaggttgaggagagccacaagcagcacttggcaagacagtttaaggcgatcaaggctaaaatggatgagcttcgaccattaatccccgtgctcgaggagtacaaggcagacgctaaactcgtgctccagtttaaagaggaggtacaaaacctgactagcgtgctcaacgaactccaggaagagatcggggcgtatgactacgacgagctgcaaagccgagtgagcaatttagaggaaaggcttagagcttgcatgcaaaaactggcctgcggcaagcttactgggatatccgaccccgtgactgtcaagacctccggctccagatttgggtcatggatgaccgaccccctggcacccgaaggggataatcgcgtttggtatatggatggctatcacaataaccgctttgtgcgcgagtacaagagtatggtcgactttatgaacactgacaatttcacaagccacagactccctcacccctggtcagggacaggacaggtggtctacaacgggtccatctatttcaacaagttccagtcgcacatcataattcgctttgatctcaagacggagactatcctaaagacccgcagcttggactacgccgggtataacaatatgtatcattatgcctgggggggccattcggacattgatcttatggtggatgaaagtggcctttgggcagtttacgctacaaatcaaaacgccgggaatatcgtagtttctagattggaccctgtgtctctgcagaccttgcagacctggaataccagttatcccaaaagatccgcaggcgaagcgtttataatctgtggcaccctatacgtgacgaatggatattctggcggcacaaaagttcactatgcttaccagactaatgcgagtacctatgaatacatcgatattcccttccagaacaagtatagtcatataagcatgctcgactacaaccctaaggatagggctctctacgcctggaacaatgggcaccaaattttgtacaatgtaacacttttccatgtaatccggagcgacgagttatag

SEQ ID NO: 127289 - DNA, 408 bp, Artificial Sequence
  Description of Artificial Sequence: Synthetic coding sequence
atgcccggtagatggcgttggcagcgggacatgcacccagcccgaaaactcctgtcacttttgtttctcatcctcatgggcaccgagctcacacaagtgctgccaacgaaccctgaggaatcttggcaggtttattcaagtgcccaggacagtgaggggcgatgtatctgcactgttgtggcgccccagcagacaatgtgttccagggacgctagaaccaagcagctgagacaactgttggagaaggtgcagaacatgtctcaatcaattgaagtccttgaccggcgcacgcaacgtgaccttcaatatgtcgaaaaaatggagaaccaaatgaaaggtcttgagagcaagtttaagcaggttgaggaaagccacaaacagcacctggcgcggcagtttaaaggatag

SEQ ID NO: 127290 - DNA, 1458 bp, Artificial Sequence
  Description of Artificial Sequence: Synthetic coding sequence
atgagtgtgcccctactcaagattggcgtggttttatctaccatggccatgatcacaaactggatgagccagactctgccaagcttggtgggtttgaataccacgaagctttccgcggcggggggtggcacgctcgatcgaagcactggagtccttcctactaacccagaagagtcctggcaggtgtatagctctgcacaggactccgaaggccgttgtatttgtaccgtggtggcgcctcaacagacgatgtgcagccgcgacgcaagaacaaagcaactgcgacagctcttggaaaaagttcagaacatgagccagagcatagaagtcctcgataggcggactcagcgcgatcttcagtacgtcgagaagatggagaaccagatgaaaggactagagtccaagttcaagcaagtagaggaatcgcataaacagcacctggcccggcagttcaaggccattaaagctaaaatggatgagctgcgtcctttgatacccgtgctggaggaatacaaagccgacgccaaacttgtgctccagttcaaagaagaggttcagaatctgacatccgtgctgaacgagcttcaggaagagataggtgcctacgactacgatgagttacaatcccgagtgtctaatttggaggagagactgagagcctgcatgcagaaactggcttgcggtaaactaacgggcatatcggatcccgtgactgtgaagacctctggaagccgctttgggtcctggatgactgatccactggccccagagggcgacaatcgtgtgtggtacatggacggataccacaataacagattcgtgagagagtacaagagcatggtggatttcatgaataccgacaattttactagtcacagactccctcacccttggagcgggaccgggcaggtggtgtataacggctccatttatttcaataaattccaaagccacatcattattagattcgacctgaagacagagactatcttaaaaacacggagcctggactatgctggctacaataacatgtatcactatgcatggggagggcactctgatattgacctgatggtggacgagagtggtctgtgggctgtctatgcaaccaatcagaatgcaggcaacatcgtggtttcccgtctagaccccgtctcgctccagaccctgcagacttggaacacatcctaccccaagcggtcggctggggaagcattcattatatgtggtactctctatgtgacaaatgggtacagtggcggcacaaaggtgcattatgcgtaccaaactaacgcttcaacctacgaatacatcgacatccctttccagaataagtactcccacatctcaatgctggattacaatccaaaagaccgggccctatacgcctggaacaacggacatcagattctatacaacgtgaccctgtttcacgtgatcagatcagacgaactatag

SEQ ID NO: 127291 - DNA, 1377 bp, Artificial Sequence
  Description of Artificial Sequence: Synthetic coding sequence
atgggagaagccccagggagagaagggagagggccctgcccgcaacttgagagtcctcgtcgccgtcgcgtgctgcccacaaaccccgaggagagttggcaagtttactcgtccgcgcaagactcggagggacggtgcatttgtactgtggtcgctcctcagcagacaatgtgcagtcgggacgcgcgaacgaaacaactgagacagttgctggagaaggtgcaaaacatgtcccagagcattgaagtgctggacagaaggacgcagagggatctacaatacgtggaaaaaatggagaaccagatgaaaggcttagagtccaagttcaagcaggtggaggaatcacataagcagcacctcgcaaggcaattcaaggccatcaaagcgaagatggatgagctgcgccccctcatacctgtgcttgaagaatataaagccgacgcaaagttagtgctccagttcaaggaggaagtccagaacctgacttccgtcctaaatgagctccaggaggagatcggcgcatatgactatgatgagctgcagtctcgagtgtctaatctcgaggagcgcctgcgcgcctgcatgcagaagttggcctgtgggaagctcaccggaatttctgatccggttaccgtaaagacttctgggagccgatttggctcctggatgacggaccccctggcaccagaaggtgataatagagtgtggtacatggatggctatcacaataacaggtttgtgcgcgagtataagtccatggtggattttatgaataccgacaactttaccagtcaccggctgccgcatccatggtctggtacaggtcaggtggtgtataacgggagtatttattttaataaattccagtcccatatcattatccggttcgacctcaaaacagaaaccattctcaaaactcggtctctggattatgccggctataataacatgtatcactatgcttggggcgggcattctgacattgacctcatggtggacgaatccggcctttgggctgtgtatgcaacaaatcaaaacgccggaaatatagtcgtcagccgactggacccagtcagcttgcagaccttgcagacatggaacacttcctacccgaagaggtccgcgggcgaagcttttattatttgtggaactctttatgtgaccaacggttactcaggcggcacaaaagttcattatgcttatcagactaatgcctccacctatgaatacattgacattcctttccagaataagtacagccacatttccatgctcgactacaaccccaaagatagggcgctctatgcctggaacaatggtcatcaaatcctatacaatgtaaccttgttccatgtgattcgcagcgatgagttatag

SEQ ID NO: 127292 - DNA, 462 bp, Artificial Sequence
  Description of Artificial Sequence: Synthetic coding sequence
atgtcggttcccctgctcaagatcggcgtggtcctgtccacgatggcgatgatcacaaattggatgagccagacccttccatcactggtgggcctcaatacaacgaagctgagcgccgcggggggtggaaccttagataggtctaccggtgtcctgcctactaaccctgaggaatcgtggcaggtgtattcttcggcacaggatagcgaaggccggtgtatctgcacagtggtggctccacagcagacaatgtgttcacgcgacgcacggacgaagcagctgcgacaactccttgaaaaggtacaaaatatgtctcagagtatagaggtactggaccggcgcacacaacgagacctgcagtatgttgagaagatggagaatcagatgaaaggtctggagtcaaagttcaagcaagtggaagagtcacataagcagcacttagcccgccagttcaagggctag

SEQ ID NO: 127293 - DNA, 729 bp, Artificial Sequence
  Description of Artificial Sequence: Synthetic coding sequence
atgaacctgcatgtgaagacactctcattgatgacatggaggtcgcgctttctggaagaaagtttttggagcctggaggagaccgccgccttagcaaagcagctgcctctgaaaagtccctccgagaacatcttcctccacattgtggacctgtccgatcccaagcaaatttggaaattcgtggagaattttaaacaggagcacaagctgcacgttcttatcaataacgcaggctgcatggtgaacaagagagaactaaccgaggacggcctggagaaaaatttcgctgccaacacgctcggcgtttacatcctgacaaccggactaatcccagttcttgaaaaggagcacgacccccgtgttatcaccgtatcttctggagggatgctcgtgcaaaaactaaatacaaacgatctgcaaagcgagagaacacccttcgacggcactatggtctacgcccaaaacaagcgacagcaagtcgttctgaccgaacgatgggctcagggccaccctgccatccacttcagttcaatgcaccctggttgggccgacactcccggagttcggcaggcaatgccagggtttcatgcgaggttcggggatcggctacgttccgaagctcagggggccgacaccatgttgtggctagccctaagctcagcggccgccgcgcagccaagcggtaggttctttcagggggatttcctccctgggtgtgagggctcatag

SEQ ID NO: 127294 - DNA, 492 bp, Artificial Sequence
  Description of Artificial Sequence: Synthetic coding sequence
atggccgaagatcggccacagcaaccgcagctagacatgccattggtgcttgatcagggcctcactcgccagatgcggctgcgcgtggaatcactgaagcagcgaggtgagaaacggcaagatggggagaagcttctgcaaccagccgagagtgtgtatcggctaaactttacccagcagcaaagattgcagtttgaacggtggaatgtggtcctggacaagcccggtaaggtgactataaccggaacgagccagaactggactcccgacttgaccaacttaatgacgagacagctcctggaccccacggctatattctggcgcaaggaggattccgacgctatagactggaacgaggctgacgctcttgaatttggggagaggctctcggatttagctaagattcggaaagttatgtattttcttgtcacttttggagaaggagttgaaccggccaaccttaaagcatctgttgttttcaaccagctgtag

SEQ ID NO: 127295 - DNA, 939 bp, Artificial Sequence
  Description of Artificial Sequence: Synthetic coding sequence
atggatggggggaatcagagcgagggcagcgagttcttgctgctcggaatgtccgagtcacctgagcagcagcggatcctattctggatgtttctgtccatgtatcttgtgaccgtcgttgggaacgttttgatcattctggccatttcatccgatagccgcctgcacacccccgtgtacttcttcctcgctaacctgtcattcaccgatctgttttttgttacaaacaccatccctaaaatgctggtgaacctgcagtcacacaataaggccattagttacgctggatgtctaacacagttgtactttttggtctcgttagtggccctagacaacctgatactggcggtcatggcgtacgatcgctatgtggccatatgctgcccattacattatactactgcaatgtcgcccaagctctgcattctgttattgtcactgtgttgggttctcagcgttctgtacggactgattcatacccttctgatgactagagtcactttctgcggttcacgaaagatacattacatcttttgtgagatgtatgtgttgctgcggatggcatgttcgaacatacagatcaatcacactgtactgattgcaaccgggtgtttcattttcctgataccttttggatttgttattatctcatacgtgctcattatacgtgcaattctccgcatcccatccgtgagtaaaaaatacaaagctttttcgacctgcgcttcacacttaggagccgttagcttattttatggaacactttgtatggtgtacctgaagcctctccacacttactctgtgaaagactctgtggccacggtcatgtacgcggttgtcaccccaatgatgaatcccttcatctattcactgcgcaataaggacatgcatggggcactcggacggctgttggataaacattttaagcggctgacctag

SEQ ID NO: 127296 - DNA, 939 bp, Artificial Sequence
  Description of Artificial Sequence: Synthetic coding sequence
atgagtggtactaatcagtcctcggtttccgaattcctgctgctcggactttcccgacagccacagcagcagcacctcttgtttgtttttttcctgtccatgtatctcgcgaccgtcctgggcaatctcttgattatcctgtccgttagtattgatagttgtctgcatacccccatgtatttcttcctgtcaaacctgagctttgtcgacatttgtttctcctttaccacagttcccaaaatgttggcaaatcacattcttgagacgcaaaccatctcattctgcggctgcctgacacagatgtacttcgtctttatgtttgtggatatggacaatttccttctagctgtcatggcctacgaccactttgtcgcagtatgtcacccactgcactataccgcaaagatgactcaccagctctgcgcacttctggtagcaggactgtgggtcgtggctaacctcaacgtgttgctccatactctgttgatggcaccgctcagcttctgtgcagacaatgcaattactcattttttctgtgacgtgactccactgctgaaactaagctgttcagatacacacctcaatgaggtcatcattttgagcgaaggagcccttgttatgattaccccttttctttgtatcctcgccagctacatgcacattacctgcaccgtgctgaaagtaccgtcaaccaaaggacggtggaaggcatttagcacctgtgggtcgcatctggccgtcgtcttgttgttttatagcacaattatcgccgtttattttaacccactgagcagccatagtgcagagaaggatacaatggctactgtcctttatacagtggttactccaatgctcaatcccttcatatattcattacgcaacaggtacctcaaaggtgccctcaaaaaagttgtcggccgagtggtctttagcgtctag

SEQ ID NO: 127297 - DNA, 924 bp, Artificial Sequence
  Description of Artificial Sequence: Synthetic coding sequence
atgaaccattccgtcgtgacagaatttatcatcttggggctgaccaaaaagccggaacttcagggcatcattttcctgttctttcttatcgtatacctggtagcatttctgggcaacatgttgattatcattgcaaagatctataataataccctccacacacccatgtatgtctttcttcttaccctggccgtggtggacatcatctgcacaacaagtattatccctaagatgttgggcactatgctcacctccgaaaatacaatctcctacgcgggttgcatgtcacagctatttttgttcacttggagtctcggagcagaaatggtcctttttaccaccatggcgtacgataggtacgttgcaatctgtttccctcttcattactcaaccatcatgaaccaccacatgtgcgtggctctccttagcatggttatggctattgcggtcaccaatagctgggtacatacggcccttattatgagactaactttctgtgggcccaataccatcgaccatttcttttgtgagatccctcccctgttggccctgtcctgctcccccgtcaggatcaacgaggtcatggtgtacgtagccgacattaccttggccatcggcgattttatcctgacctgcattagttacggctttatcatcgtggccatcctgcggattaggacggttgagggcaagcggaaggcattcagtacttgttcatcacacctgaccgtggttacactgtattattccccggttatctatacctacattcgtcccgcatcctcctacacctttgaacgtgacaaggtggtggctgccctatataccctcgtgacgcccacgcttaatcccatggtgtactcttttcagaaccgtgaaatgcaggccggaatccgcaaggtttttgccttcctgaaacactag

SEQ ID NO: 127298 - DNA, 930 bp, Artificial Sequence
  Description of Artificial Sequence: Synthetic coding sequence
atggaaaatcgcaacaatatgacagagtttgtgctcctgggccttacagaaaatcccaaaatgcagaagataattttcgtagtattctttgtgatctacatcataacggtggtaggctacgtgctgattgtggtaacaataacagcatcaccttctttgggttctcctatgtacttatctttggcttacctgtccttcatcgatgcatgttactcaagcgtaaatacgccaaatctcatcactcactcactgtatggaaaaaaagcaatcctgtttaacgggtgcatgacccaggtattcggcgagcattttttcggaggtgctgagggaatcttgctgacagtgatggcctatgaccattacgtggccatctgtaaaccactgcactatatgaccattatgaaccagtgcgtctgtgcgctgcttatgggagtagtctggatgggcggattcctgcatgccacaatccagatcctgttcatttttcaactgcccttctgtggccctaacgtgatcgatcattttatgtgcgacttgaaccccctattgaatctcgcctgcacggacacacacatgttggaactgtttatcgccgcaaacagcgggtttatctgtcttctcaattttgctctgctgcttgtgagctatgtcgtgattctgtgttccctgcgcacccattcactggaagcccgccacaaagctctttccacctgcgtctctcatatcaccgtcgttatactattctttgtcccctgtattttcgtgtacatgcgccctgctgccacccttccaattgacaaggctgtggcgattttctacaccatgataacacccatgcttaaccctctcatttatacgctaaagaatgcgcagatgaagaatgctatccggaaattatgttcacgaaaggatatttccggagataagtag

SEQ ID NO: 127299 - DNA, 978 bp, Artificial Sequence
  Description of Artificial Sequence: Synthetic coding sequence
atgttcctgtatttgtgtttcatctttcagcgaacgtgctccgaagagatggaagaagaaaacgcgaccttattaacagagttcgtgctcactgggtttcttcaccagcccgattgcaaaattccattattcctggccttcctggtaatctatcttatcactattatgggaaatcttggcctgattgtgttaatctggaaggaccctcatttacacatccctatgtatctgttcctgggaagcctggcattcgtcgatgcctccctctcatccaccgtgacgcccaaaatgctcatcaactttttagccaaaagcaagatgatttctctgtccgagtgcatggtacaattcttttcgctggtgacaaccgtcacgactgagtgttttctgctggcaacaatggcctatgacagatatgttgcaatttgcaaggctctcctatacccggtgattatgactaatgagctgtgtatccagcttttagtgctgagttttattggaggactccttcacgccctgattcacgaggctttttcttttcgccttactttttgtaactccaatatcattcagcatttctattgtgacatcattccgctgctcaagattagctgtaccgacagcagtataaatttcctgatggtctttatcttcgcagggagcgtgcaggtcttcacaatcgggaccattctgatatcctataccattatccttttcacaatcctggaaaagaaatcaatcaaaggcattcgtaaggccgtgtcgacgtgtggagcacacttattgtcggtttccctctattatgggccgttaacatttaagtatcttgggtcagcctccccccaggccgatgatcaggatatgatggaatcacttttctacaccgtgatagtgccgttgttgaatcccatgatttatagcctgaggaacaaacaggttatcgcgtctttcacaaagatgtttaagtcgaacgtctag

SEQ ID NO: 127300 - DNA, 963 bp, Artificial Sequence
  Description of Artificial Sequence: Synthetic coding sequence
atggaaacaggtaaccagacccatgcccaagagtttctgctactcggattttccgccacatcagaaatacagttcatactcttcggcctgttccttagtatgtacctcgttacctttacgggcaatttgctgattattctcgcaatttgttcagattcacacctccatacacctatgtacttcttcctctccaacctgagtttcgccgatctctgctttactagcacgaccgtcccaaaaatgcttttgaatattctcactcagaacaaatttatcacctatgcaggatgcctgtcgcagatattcttcttcacgagttttggctgtttggataatcttctactgacagtgatggcttacgaccgatttgtcgcagtgtgtcatcctctccattatactgtgattatgaacccccagctgtgcgggctgctcgtgctaggctcttggtgtatctcggtcatgggatccctactggagaccctgaccgtgcttcgtctcagcttttgcacggagatggagatcccacattttttttgtgacctgctcgaagtgctcaaattagcctgcagtgatacttttataaacaacgtggtgatctactttgcgacgggggtactgggcgtgatcagcttcacgggtatctttttttcgtattacaagatcgtttttagcattctgagaatttcttccgccggccgtaaacacaaagccttttctacatgcgggtcccacttgtccgttgtgacgttattctatgggacaggattcggcgtgtatctgtcctccgctgccacaccaagctcacggacttctcttgtggccagcgtaatgtacacgatggttacacccatgttgaatccttttatctacagtttacgcaataccgacatgaagagggcactgggcagactgctgtctagagctacattttttaatggtgacattacagccgggctctcttag

SEQ ID NO: 127301 - DNA, 960 bp, Artificial Sequence
  Description of Artificial Sequence: Synthetic coding sequence
atggagcgtggcaatcagacggaagttgggaactttctcttgcttggattcgccgaggacagcgacatgcagctacttttacacggactgttcctaagtatgtaccttgtgacaattatcggcaacttgcttatcatcctgacaataagctcagactcccacttgcacactcctatgtactttttcctgtccaatctgtctttcgccgacatttgctttacctccacaactgtgcctaaaatgcttgtgaatatccagacacaatcaaaaatgataacgtttgcggggtgcctgacacagatttttttcttcatcgcttttggatgcctggataatctgctgctaacgatgactgcctatgatagatttgtagcaatctgttaccccctgcactacactgtcattatgaaccctcgcttgtgcggtctgcttgttctgggcagctggtgcattagcgtgatggggtcactgcttgagaccttgaccattctgaggctttcattttgcaccaatatggaaatcccccatttcttctgtgacccatctgaagttttaaaacttgcttgtagcgatacatttattaacaacatcgtgatgtactttgtgactatcgtgctaggggtgtttccgctgtgtggaatactgtttagttacagccagattttctcttcagtgctgcgggtttccgctcgtggccagcataaagcgtttagtacgtgtgggagccatctgtctgtggtgtccctgttttatggcacaggtctgggggtttatcttagcagcgcagtgacacccccctccagaacaagcctcgccgccagcgtcatgtacactatggtaacccccatgctgaacccttttatttatagcctgaggaacaaagacatgaaaggttccttgggcagactgctgctccgggcaacatccttaaaggagggaacaatcgctaagctctcatag

SEQ ID NO: 127302 - DNA, 939 bp, Artificial Sequence
  Description of Artificial Sequence: Synthetic coding sequence
atggaagccgagaatttgactgagttgtctaagttcctgctgttggggctatcagacgaccccgagctgcagcctgtgctgtttggattattcctctctatgtacctggttacagttttggggaatctgctgataatccttgcagtgtcctctgattcacatctgcacaccccaatgtatttcttcctctctaatctgagcttcgtcgatatctgttttattagcacaacagttcctaagatgctggtgtcaattcaagcccggtcaaaggacatcagctacatgggctgccttacgcaggtgtacttcctgatgatgtttgctgggatggatacattcctcttggccgtgatggcgtacgatagattcgtagcgatctgtcaccctttacactatacggttattatgaatccatgcctttgtggcctcttggtgctcgcaagttggttcattatattctggttcagccttgtacatatcttgctaatgaaacggctcacattcagtaccggcaccgagatccctcatttcttctgcgaacctgcacaagtgctgaaggttgcttgctcgaacactctgctcaataacattgtgctttacgtggccaccgcactcttaggcgtcttccccgtcgccggcatcttgtttagctatagtcagatcgtgagtagcctcatggggatgtcctcaacgaagggcaagtacaaagccttctcgacttgcggctctcatctatgtgtggtgagcctgttctacggtaccggtcttggagtgtatctaagtagtgccgtgactcatagctcccagagttccagcaccgcctctgtcatgtacgccatggtgacccccatgttgaatccgttcatttacagtctgagaaacaaggatgtgaagggtgcacttgagaggctcttatcccgggctgattcctgcccatag

SEQ ID NO: 127303 - DNA, 972 bp, Artificial Sequence
  Description of Artificial Sequence: Synthetic coding sequence
atggactcggatgcttccctggtctcatccaggcccagctctccggaacccgacgacctcttcctgcctgcccgcagcaagggtagtagcggaagcgctttcaccggaggcaccgtgtcctcctccacccccagcgattgtccaccggagctgtctgccgaacttcgcggagccatgggatctgccggcgcccatcctggggacaaactgggaggaagtggatttaagtcgagtagctcttccaccagctctagtacgagctccgcggccgccagtagtacaaaaaaggataagaagcaaatgacggagcctgaactgcaacagcttcgcctgaagatcaatagccgcgaaaggaagaggatgcatgacttgaatatcgccatggacgggttgcgcgaagtaatgccgtatgcccatgggccgagtgtccggaaactctcaaagatagctacactgctgctggcacgaaactatattctgatgcttactaacagcttagaggagatgaagaggctggtgtcagaaatctatggaggtcaccacgccggattccatcccagtgcctgcggaggactcgctcacagtgctcccctgcctgccgcaaccgctcatccggcagccgcggcccatgccgcccaccacccagcagtccatcacccaatcctgcctcccgctgctgccgctgccgccgccgccgccgccgctgcagcggtgtctagcgccagtctgcccgggagtggccttccttcagtggggagcatcaggcccccacacgggctcctcaaaagtccaagtgccgcagccgccgctccactgggcggcggcgggggaggcagtggggcctctggagggttccaacactgggggggaatgccgtgtccttgctcgatgtgccaggttccaccccctcaccaccacgtctctgctatgggagcagggtcgctgcccaggctgactagcgacgctaaatag

SEQ ID NO: 127304 - DNA, 972 bp, Artificial Sequence
  Description of Artificial Sequence: Synthetic coding sequence
atggatagcgatgcttccttggtcagtagccgcccctcgagccccgaacctgatgacctcttcctgcccgccaggagcaagggctcgagcggctcagcctttaccggcggaacagtctcatcttccacgccaagcgactgcccacccgaattgtcagctgagctccgcggggcgatgggatcagcaggtgcccaccctggggataagctgggaggaagtggcttcaagtctagctcctcctcaacctcaagcagtacatccagtgcagctgcgagtagcaccaagaaggacaaaaagcagatgacagaacccgagctgcagcagttgagactgaaaattaactcaagagaacgcaaacggatgcacgatctgaatatcgcaatggatggcctcagagaagtgatgccatatgctcacggcccgagtgtaaggaaattgagtaaaatcgcaaccttattgttggccaggaattatatcctcatgctgacaaactcattggaggagatgaaaaggctggtgtcagagatttacggaggccaccacgctggcttccaccccagcgcgtgtggcggactggcgcactccgctcccttgcccgctgccactgcccacccagccgcagcagcgcatgcagctcaccatcccgccgtacaccatccaattctcccaccagctgcagccgcggccgcagcagcagctgccgccgcagcagtgtcatcagcctccctcccaggatccgggctgccctctgttggtagcattcgaccacctcatgggcttttgaagagtcctagcgctgccgccgcagccccgctggggggagggggcggggggagcggggcgtcaggaggctttcaacattggggaggaatgccctgtccttgctccatgtgccaggtgccgccgcctcatcatcatgtctccgccatgggtgcgggatccttaccccgtttaacctccgatgctaagtag

SEQ ID NO: 127305 - DNA, 189 bp, Artificial Sequence
  Description of Artificial Sequence: Synthetic coding sequence
atggattccgatgcaagcctcgttagctcaaggcctagctctccagaaccagatgatttgtttcttcctgctagaagtaaggggagcagtggaagtgcattcactggagggacagtgtcaagtagcaccccatcagactgcccacctgaactcagtgcagaactgagaggtgccatgggatccgcctag

SEQ ID NO: 127306 - DNA, 1323 bp, Artificial Sequence
  Description of Artificial Sequence: Synthetic coding sequence
atggagtaccagatcctcaaaatgagcctgtgtctcttcattctactgttcctgacgccagggatactttgtatttgccccttgcagtgcatatgcacagagcgacatcgccatgtcgattgtagcggcaggaacctgtccacgttgccttccggtctgcaagagaacatcatccatttgaatttgtcctataatcacttcaccgatcttcacaaccaactgacgcagtacaccaatctacgcactctcgatatatctaataaccgcctggaaagcctacctgcccacctgcctagatctttgtggaatatgtccgctgctaacaataacatcaaactgctggacaagagcgatactgcttaccagtggaatctgaagtatttggacgtgagtaagaatatgttggaaaaagtggtcctgatcaaaaatacactgcggtctctcgaggtcctcaatctgagcagcaataaactgtggacagtgcctacgaatatgccgtctaagctgcacatcgtggatctgtctaataacagtctcacccagatacttcccgggacactgatcaatttgaccaatctcacacatttatacttgcacaataacaagtttacattcatacctgatcaatcatttgaccagctgttccagctccaggaaatcacgctgtacaacaataggtggtcgtgcgaccacaaacagaacatcacgtatttgttaaagtggatgatggagacaaaggcccatgttatcggcactccatgtagcacacagataagcagcctcaaggagcataacatgtatccgactccctccggattcacttcttccctgttcaccgtgtccggtatgcaaacagtggatacaatcaacagcctgtcagtggttacccagccaaaagtcactaagattcccaaacagtatcggactaaggagacaacattcggagccaccctctccaaggacacaacattcacaagtacagacaaggcatttgtgccctaccccgaagatacttccacagagaccatcaactctcatgaggctgcagcagctacactaacaatccacctgcaagacggtatggtaacgaacacttctcttacatcctccaccaagtctagcccaacacccatgacgttgagcatcacttcaggcatgccgaataatttttctgaaatgcctcagcagagcaccactctgaatttgtggcgagaagaaactacaacgaatgtcaagacccctcttccttctgtcgcaaatgcctggaaggtcaacgcctcattcctactgcttctcaatgtggtagtgatgctagccgtctag

SEQ ID NO: 127307 - DNA, 819 bp, Artificial Sequence
  Description of Artificial Sequence: Synthetic coding sequence
atgaactctgacagctccagcgtgagttctagagcctcatctcccgacatggatgagatgtatttgcgcgaccaccaccaccggcatcaccaccatcaagagtcccgcctgaactctgtgtcgtcaactcagggagatatgatgcaaaagatgcctggcgaatcattgagcagagcaggagctaaagccgccggcgagtcttctaaatacaagatcaagaagcagttgtctgaacaagacctccagcagctccggctgaagattaacggtcgggagaggaaaaggatgcacgacttgaatctcgcaatggatggcctgagggaggtcatgccctacgcccacggcccatcagttagaaaactgtcgaagattgctacattgttactggctagaaattacattcttatgctcacttcctccctggaggagatgaaacggcttgtgggagaaatttatggcggccaccattctgcctttcattgcggtaccgtggggcacagtgccggccaccccgcgcatgccgccaattcagtacaccctgttcaccctattcttggcggagccttaagctcaggcaacgcaagctctccgctaagtgctgcctctctgcctgcgatcggcacaattcgacccccccattcactgctgaaagctccctcaaccccacctgcgctgcagctcggatcagggttccagcactgggcgggactcccttgtccttgtactatttgtcagatgcctcctccaccgcacttgtctgctctttccacagctaacatggccagactctccgcagagtcaaaagacctcctgaaatag

SEQ ID NO: 127308 - DNA, 375 bp, Artificial Sequence
  Description of Artificial Sequence: Synthetic coding sequence
atgtggaagggctgcttaaccctttataccggaagggggggcgaactgcagaagattggggagttctgtatggtgtacagcgaagtgccaaactttagtgagcccaacccggactatcggggccagcagaataaaggagcgcagagcgagcagaaaaataattcaatgaattctaacatgggaactgggacttttggaccggtcggaaatggcgtgcacaccgggccagagtccagagaacaccagttctcgcacgccggccgaagcaacggccgtggtctcattaacccacagctgcagggaactgccagtaaccaaacagtgatgactaccatttctaacggacgggatccgcggagagccttcaagcgctag

SEQ ID NO: 127309 - DNA, 375 bp, Artificial Sequence
  Description of Artificial Sequence: Synthetic coding sequence
atgtggaaaggatgtttgacactgtataccggacgcggtggcgaactgcagaaaattggggagttctgtatggtttatagcgaggtgccaaacttcagcgagccaaatcccgattaccgcggccagcagaataagggggcccagagcgaacagaaaaataactctatgaacagtaatatgggcactgggacatttggccctgtgggcaacggtgtccataccggacccgagagccgggaacaccagtttagtcatgccgggcggagtaacggccgggggctcattaatccccagttgcaaggaactgcgtccaatcagacagtcatgaccacaatcagtaacggtagggaccctagacgagcttttaagaggtag

SEQ ID NO: 127310 - DNA, 615 bp, Artificial Sequence
  Description of Artificial Sequence: Synthetic coding sequence
atgaaccgggtgaatgacccacttatttttatccgggatatcaagccaggcttgaagaatctaaatgttgtgttcattgtgctcgaaatcggaagggttactaaaaccaaagacggccatgaagtaagatcatgcaaagtagcagataaaacaggtagcataactatttccgtgtgggacgagattggggggctgatacaaccaggagatatcattcgtctcaccagagggtatgcatcaatgtggaaggggtgtctcaccctgtacactggcaggggcggagagctgcagaaaatcggggagttctgcatggtgtacagtgaagtgccaaatttcagtgagccaaatcctgactacaggggtcagcagaataaaggagcccaatcagagcagaagaacaattccatgaattccaacatgggaaccggaacattcgggccggtcggaaacggggtccataccgggccggagagccgggagcaccaattctcccatgccggccgcagcaatggcaggggcctcatcaacccccagttgcagggtactgcctcaaatcagacagtaatgactaccatatctaacggcagggatccaaggagggcatttaagagatag

SEQ ID NO: 127311 - DNA, 636 bp, Artificial Sequence
  Description of Artificial Sequence: Synthetic coding sequence
atgactacagagacatttgtgaaggatatcaaaccgggcctgaaaaatctaaacctgatcttcatcgtgctggagactgggcgggtgaccaaaacgaaagatgggcatgaagtgcgcacgtgtaaggtagccgacaaaaccggtagcataaatatctcggtgtgggatgacgtgggtaatctcatacaaccgggagatatcatacggctgacaaaggggtatgcctccgttttcaaaggttgtcttaccctttacaccggacgagggggtgatcttcagaagatcggggaattttgtatggtatattctgaagtccccaatttcagtgagccaaatccagaatattctacccagcaggctcccaacaaagcagtgcagaacgacagcaacccatcagcatcccaacccaccaccgggccaagcgccgcgagcccagcgagtgaaaatcagaatggtaatggattgagcgcaccacccggtcccggtggggggcctcaccctccacacactccatcccaccccccctcgaccagaatcacaaggtcgcagcctaaccacactcctgctggccccccggggccaagcagcaatcccgtttccaacggcaaagaaacccgtaggtcaagcaagcggtag

SEQ ID NO: 127312 - DNA, 636 bp, Artificial Sequence
  Description of Artificial Sequence: Synthetic coding sequence
atgacaaccgagacctttgtgaaggacattaagcccggattaaaaaacttgaatctgatcttcattgttctggagaccggacgagtgaccaaaactaaagatgggcacgaggtgagaacatgcaaggtggcagacaagaccggaagtattaatatctcagtctgggatgatgtcgggaatcttatccagccgggggatatcatccggcttacaaagggatatgcttccgtattcaaaggctgcctgaccctgtacactggaaggggtggcgacctacagaaaattggggagttttgtatggtgtacagtgaggtgccaaacttcagtgaaccgaaccctgagtattctactcaacaggccccaaataaagccgtacaaaatgacagcaacccaagcgcttcccagccaaccaccgggccttctgccgcaagtccagcatccgagaaccagaacggcaatggacttagtgccccccccggtccaggaggtggtccccatcctccacatactccctcccaccctccctccacaaggatcacacggagccagcccaaccacacacccgctggtcccccgggtccctcttcgaatccggtctctaatggcaaggaaacaagaaggtcttcaaagagatag

SEQ ID NO: 127313 - DNA, 636 bp, Artificial Sequence
  Description of Artificial Sequence: Synthetic coding sequence
atgacaaccgagacctttgtaaaagacataaaacccggactaaagaacttgaacttgatctttatcgtactggagacaggacgagtgaccaagaccaaggacgggcacgaggtgagaacttgtaaggtcgccgacaaaaccgggagtattaacataagcgtatgggatgatgtgggcaaccttattcagcctggcgacattatacgcctgaccaaaggctacgcaagtgtctttaagggttgcctgacactgtataccggacgtggcggagatctgcaaaagattggggagttttgtatggtgtattcagaagtcccaaatttctctgagcctaaccccgagtattcgacacagcaagcacctaataaggcggtgcagaacgattccaacccatccgccagccagcctacaacgggcccttcggctgcttcaccagcctctgaaaaccaaaacgggaatggactgtcagcccctccaggacctggagggggcccccacccaccccatacaccctcacatccccctagcactaggattaccagatcccagcctaaccacacccccgcaggcccccccggcccgtcaagtaaccccgttagcaacggcaaggaaactaggcggtcttctaagcgatag

SEQ ID NO: 127314 - DNA, 459 bp, Artificial Sequence
  Description of Artificial Sequence: Synthetic coding sequence
atgacaaccgagacattcgtgaaagacatcaaacccggcctgaagaacttgaacctgatcttcattgtgttagaaacggggagggtcacgaaaaccaaagacggccacgaagtgaggacatgtaaggtagcagataaaacagggtcaataaatatttccgtgtgggatgatgtaggtaatcttattcagcctggcgacattattcggttgaccaaaggctacgcctccgtgttcaagggttgcctaacattgtacacagggcgcggcggagatctccagaagatcggtgagttttgtatggtttacagtgaggtgcctaactttagtgagcctaatcctgagtattcaacacaacaggcacccaataaagctgtgcagaacgacagcaaccccagcgccagtcaacccacaacggggcccagcgcagccagtccagcttctgagaatcagaacggctag

SEQ ID NO: 127315 - DNA, 435 bp, Artificial Sequence
  Description of Artificial Sequence: Synthetic coding sequence
atgacgacagaaacattcgtgaaagacatcaagccaggattgaagaatctgaacttgatctttattgtgcttgaaacaggccgcgtgacaaaaaccaaagatggacacgaggtgaggacatgtaaagtggcagacaagacaggctctatcaatattagcgtctgggacgatgtcggaaacttgatccaacccggtgacattatccggctgacaaagggatacgccagcgtctttaagggttgtctgaccttatataccggtcggggaggagacctccagaagataggagaattttgcatggtgtattctgaggtacccaattttagtgagcccaacccagaatactcgactcagcaggcgcccaataaagcagttcagaacgattctaatccctctgcgagccagcccactacgggaccatcggcagccagctag

SEQ ID NO: 127316 - DNA, 2409 bp, Artificial Sequence
  Description of Artificial Sequence: Synthetic coding sequence
atggggcacccgccgctcgagttcagcgactgctacctggattctcccgatttcagggagagactgaagtgctatgagcaggagctggagaggaccaacaaatttatcaaagatgtgatcaaagatggtaacgccttaatcagtgctatgagaaactactccagtgcagtgcagaagttttcgcagacattacagagcttccagtttgactttattggggatactttgaccgacgacgagattaatatcgcagagagctttaaagagtttgccgagctactgaatgaggtggaaaacgagaggatgatgatggtccacaacgcctccgatcttctgataaagcctctcgagaacttccgcaaagagcaaatcggttttacgaaagagcgaaagaagaagttcgagaaggacggcgaaagattttactccttattagacaggcacctgcatctctcctccaaaaagaaagagagccagttgcaggaagcagacctgcaggtggataaagagcgtcataattttttcgagtcctccctggattatgtgtaccaaattcaggaggtccaggaatccaaaaaattcaatattgtggaacccgtgctggcttttctacattcactcttcatttctaactctctgaccgtggagctgacacaggacttcctaccgtataaacaacagttgcaactgtccctccaaaatacaagaaatcacttctcttccaccagggaagagatggaggagctgaagaaacgaatgaaagaagcacctcaaacctgcaagctgcccggacagcctaccatcgagggttacctatacacccaggagaagtgggccttgggaatatcttgggtgaagtattattgccagtatgagaaggaaaccaagacactgacaatgacgccaatggagcagaagcctggcgctaaacaggggccccttgatctgacgctgaagtactgcgtacgcagaaagacagaatcaatcgataaacgattctgctttgatattgaaacgaatgagcggcctggcacaataacgctccaggcactgagcgaggctaaccgcaggttatggatggaagcgatggacggcaaggaaccaatttatcacagtccaatcaccaaacagcaggagatggaactgaacgaagtcggcttcaaattcgttagaaagtgcatcaatatcatcgagacaaaaggcatcaagaccgagggtctataccgcacggtcggaagtaacatacaggtgcagaagctgctgaatgcctttttcgaccccaagtgtcccggcgatgtggatttccataatagcgattgggatatcaagaccatcactagctctttgaagttttacctccgtaacttaagcgaaccagttatgacatatcggctgcataaagagcttgtaagcgcggctaagagcgataacctggattatcggctaggtgctattcactctctggtctataaactgccagagaaaaatcgggaaatgttggaattattgattaggcacttagttaatgtttgtgagcattccaaggaaaatctgatgacacctagtaatatgggcgtcatattcgggccgaccctgatgagggcgcaagaagatacagttgcagcaatgatgaacattaagttccagaatattgttgtggaaatactaatcgaacatttcggcaaaatttacttgggaccgcccgaggagtccgccgcaccacctgtaccacctcccagggttaccgcacgacgccataagccaattacaatatcaaagcggttgttgagagaaaggaccgtgttttatacgtcttctctggacgagtcagaggacgaaatccaacaccagactccgaacgggacgataacttctagcatagagcctcccaagccaccacagcatccgaaacttcctattcagcgctcaggggaaacggatcctgggagaaagagtccaagtcggcctattctcgatgggaagctggaaccttgtcccgaggtggatgttggaaaactggtgagccggctccaggacggggggacaaagataactcctaaagcaactaatggacctatgccgggcagcgggcccaccaaaacgccaagtttccacatcaagcggcctgcccctcggccacttgcacaccacaaggaaggagatgccgacagtttttctaaggttcggccaccaggggaaaagcccaccattatccggcctcccgtacgcccccctgaccccccctgtcgcgctgccacccctcagaagcccgaaccaaagcccgatatagtagcaggaaacgcaggagagatcacatcaagtgtggtggcatctcgcacccgattcttcgaaacagcttcacggaagacaggctctagccaggggcgcttgcctggcgatgaaagttag

SEQ ID NO: 127317 - DNA, 2085 bp, Artificial Sequence
  Description of Artificial Sequence: Synthetic coding sequence
atgggccaccccccactggaatttagcgactgctatttagactcacccgatttcagagaaaggctgaagtgctacgaacaggagctagagaggacgaacaagtttatcaaggatgttattaaggatggtaacgcactgattagcgccatgagaaactacagtagcgccgtacagaagtttagtcaaaccctccaatcgtttcaattcgacttcattggcgatacacttaccgatgatgagatcaatatcgcagagtctttcaaggaattcgcagagctcttgaatgaggtggagaacgagcgaatgatgatggtacacaatgcttccgatctcctgattaagcctctggagaatttccgcaaggaacagattggtttcaccaaagagaggaaaaagaaatttgaaaaagatggggaacggttctacagcctgctggatagacatctccatttaagttcgaagaagaaagagtctcagctccaagaggctgatcttcaggtcgacaaagaacgacacaattttttcgagtcctccctcgactatgtgtaccaaatccaagaagtacaggagtcaaagaaattcaacatcgtggaacctgtgttggcctttctacacagcttgtttattagcaactccctgaccgtggaactaacccaggacttcctgccatataagcagcaattgcagctcagcctgcagaataccaggaatcactttagctccacaagggaggagatggaggagctgaaaaagcgaatgaaggaagctcctcagacctgtaagctgccggggcagcccacaattgagggttacctttacacccaagaaaagtgggctctcggtatctcttgggtcaaatactattgtcagtacgagaaggagactaagactttgacgatgactcctatggagcagaagccgggcgctaaacaggggccactggacctgaccctgaagtactgtgtgaggcgcaaaactgaatccatagataagagattttgtttcgacattgaaactaatgagaggccgggcactatcactcttcaggccctcagcgaagcgaatagaagactttggatggaagctatggacggtaaggagcccatatatcatagcccaataactaagcagcaagagatggagttaaacgaggttgggtttaaatttgtgaggaaatgcattaacattatcgaaaccaagggaatcaaaacggagggtctttatcgcactgtggggtctaacatccaggtgcagaaactgctgaacgcgtttttcgaccccaaatgtccgggagacgtcgatttccacaacagtgactgggacatcaaaaccattactagtagccttaagttttacctgcgcaatctgagtgagccagtgatgacttatagactccataaggaattggtctccgcagccaaatctgacaatcttgactatcgactgggagccatacattcattggtgtataagctgccggaaaagaaccgtgagatgctcgagctcctcatccgacacctggtgaatgtttgcgaacactcaaaggaaaacttgatgacgccatctaacatgggtgtcatcttcggacctactcttatgagagctcaggaggacacagtggctgcgatgatgaatatcaagtttcagaacatcgtggttgagatactgattgaacacttcggaaagatctacttagggccaccggaggaatctgccgccccacccgtgccgccaccgcgcgtgaccgcccggcgccacaaaccaatcactatctcaaaaagactccttcgggaacggactgtgttttataccagtagtctggacgagtccgaaggggatgcggattccttttccaaggtgaggccccccggcgaaaagccaactatcatccggccccctgtgcgccccccagaccccccctgtcgcgccgcgacacctcaaaagccggagccgaaaccagacattgtggctggcaacgccggagagatcacctcctccgtcgtggctagcagaaccagattcttcgaaacagcttctcggaaaacgggatcaagtcaggggcgcttgccgggcgacgagtcctag

SEQ ID NO: 127318 - DNA, 225 bp, Artificial Sequence
  Description of Artificial Sequence: Synthetic coding sequence
atgctagagctcctgatacgccatctcgtgaacgtttgcgaacatagcaaggagaatctgatgaccccttcaaatatgggcgtgatcttcggccctactcttatgcgtgcccaagaagacacggtggccgctatgatgaacattaagtttcagaacatcgtggtggaaatcctgatcgagcactttggcaaaatttcttcatttttcttgcacaggtcgatttag

SEQ ID NO: 127319 - DNA, 3111 bp, Artificial Sequence
  Description of Artificial Sequence: Synthetic coding sequence
atggcatccagtgtgggcaacgttgcagattcaactgggctggccgaattagcacaccgagaataccaggccggtgactttgaggctgcagagcggcactgcatgcagctatggaggcaagagcctgataatacaggtgtgctgctgctcctgagcagcatacacttccagtgcaggcgactagacagatcggctcacttcagcacgttagccattaaacagaaccctctgctggccgaggcctattctaatctaggaaatgtttataaagaacgtggacaacttcaagaggccatcgaacattacagacacgccctacgtttgaaaccagatttcattgacgggtatattaacctggcagcagccctcgttgccgctggagatatggaaggagcagttcaagcctatgtgagcgctctacagtacaatcccgacttatattgcgtcagatcagatctcggaaacttgctgaaagcacttggacggctagaagaagcaaaggcttgctaccttaaagccatcgagacccaacctaatttcgccgtggcttggtctaacctggggtgcgtgttcaacgcccagggggagatttggctggcaattcaccacttcgaaaaggccgtcaccctggacccaaattttttggacgcctatatcaatctaggaaatgtgcttaaggaggcaaggatctttgacagggccgtagcagcatatctgagggcactctctcttagtccgaatcacgccgttgttcacggcaaccttgcatgtgtatactacgagcaaggtctaattgatcttgcaatcgacacatacagacgtgctatagagcttcaacctcacttccctgatgcgtattgtaacttggccaacgctctgaaagagaaaggctccgtggccgaagccgaagattgttacaacacggcgctaagactttgccctacccacgcagacagtctcaataatttagccaacattaaacgagagcaaggcaatatagaagaggctgtacgactctaccggaaagcgctggaagtgttcccggagtttgccgcagcgcactccaatctcgcgagcgttcttcagcagcagggtaagcttcaggaggccctcatgcattataaggaggctatcaggataagcccaacgttcgcggatgcctattctaacatgggtaacacactgaaggagatgcaggatgtccagggagctttacaatgctatactagggctattcagattaaccctgcgtttgcggacgcgcactcaaacttggccagcatccacaaagatagtggtaacatccctgaagctatagctagctatcgtacggcgcttaagctcaaacccgatttcccagatgcctactgcaatctcgcccattgtcttcagatcgtttgcgattggacagattatgacgagaggatgaaaaaattagtgtctattgtggcagaccagctcgagaaaaataggctcccctcagtccatccccaccatagcatgctgtatcctctgagccatgggtttagaaaggcaatagctgagcggcacgggaacttgtgtctagacaaaatcaacgtcttgcataaacccccctacgaacatcctaaggatcttaagctctcagatggccgcctgagggtaggctatgtgtcctcggacttcggaaatcacccaacatcccacctcatgcagtcaatccccggcatgcacaacccagacaaattcgaggtgttttgttatgccctgtccccagacgatgggacaaacttcagagtgaaagtgatggcagaggctaaccattttatagacctaagtcagatcccctgcaacgggaaagccgcggatcggatccaccaggacggcatccacatcctcgtgaacatgaacgggtacacaaaaggggcacgcaacgagctctttgcactcaggcccgcccctattcaggcgatgtggctcggttatcctggaacctctggcgcactgttcatggactacattattaccgaccaagagacctcaccagcagaagtcgctgagcagtatagtgaaaagctcgcatatatgccccacactttcttcattggggatcatgctaatatgttccctcacctcaaaaaaaaggccgtcattgactttaagagtaatggacacatttatgacaacagaattgttttgaacggcattgatctgaaagcctttctggactctctccccgatgtgaagatcgtcaaaatgaaatgtccggatgggggggataatgctgattcttcaaatactgccctgaatatgccagtaataccgatgaacactatcgccgaagccgtgatagaaatgatcaacagggggcagatacagattactatcaatggattttctatctctaatggactcgccactacacagattaataacaaggctgcaaccggtgaggaagtgccaaggactatcatagttactactaggagtcagtacggtctccccgaagacgcgatcgtatattgcaattttaatcaactttacaagatcgatccttccactctgcagatgtgggcaaatatcttgaaaagggtgcccaacagtgtactgtggctgcttaggttcccagcagtgggcgaacccaatattcagcagtacgctcaaaacatgggtctaccccagaacaggattatcttctcccctgtggcccctaaggaggagcatgtgaggaggggacagctagccgacgtgtgcctcgacacaccgctgtgtaacggacatactaccgggatggacgttttgtgggccggcacccctatggtgactatgcctggggagactctcgcttcccgcgtggccgcttcccagcttacttgcctcggatgcctagagctaattgccaagaataggcaggagtacgaggacatcgcggttaaactcggcaccgatttggagtacttgaagaaggtgcgggggaaggtgtggaagcagcgtatatctagtcctcttttcaacacaaaacagtatacgatggagttggagaggctttacttgcagatgtgggagcattacgccgcaggtaacaaacctgaccacatgatcaaacccgtggaagtaaccgagagcgcttag

SEQ ID NO: 127320 - DNA, 3141 bp, Artificial Sequence
  Description of Artificial Sequence: Synthetic coding sequence
atggccagtagtgtggggaatgtggcagatagcacagagccaacaaagcgcatgctctcatttcaggggttggcagagctggcccatcgcgaataccaggcaggcgacttcgaagctgctgaacgccattgcatgcaactctggcgtcaggagcccgacaataccggagtgctgctcttgctcagttccattcacttccagtgccgcagactggatcgttctgcccacttctctaccctggctatcaagcagaatccactcctggccgaggcctatagtaatctgggaaatgtgtacaaggaacgcggtcagcttcaggaggccatcgagcactacagacatgcgctgagactgaagccagacttcatcgacgggtacatcaatctggccgccgctcttgtagcagccggtgatatggaaggggcagtacaggcctatgtgagtgctctgcagtacaatcctgatctctattgcgtgcggtctgacttgggcaatttgcttaaggcactgggacgcctagaggaggccaaagcatgttatctcaaggctatcgagacccagccaaacttcgcagtggcttggtcaaacctggggtgtgtgtttaacgcccagggcgagatctggcttgcgatccatcactttgagaaagcggtgaccctcgatcctaattttctggacgcctatattaaccttggaaacgttctcaaagaggctcggattttcgatagggcagtggccgcctacctgcgggccctgtccctgagccccaatcatgccgtcgtgcacggaaatctggcttgcgtgtactacgaacagggactgatcgacctcgccatagacacctatagacgggcaattgaacttcagccgcacttccccgacgcctactgcaatctggccaacgctcttaaggaaaagggctcagtggctgaagctgaagattgctacaatactgcccttcgtttgtgccccacccacgcagacagtctgaacaatctggccaatataaaaagggagcaaggcaatatcgaggaggctgtacgcctgtaccgcaaagcactggaggtcttccccgaatttgctgcggcccacagcaatcttgcaagcgtgctgcaacagcaggggaagcttcaggaggctcttatgcactacaaggaggctataaggattagccccactttcgcagatgcatatagcaacatgggtaacacactgaaggaaatgcaggacgtgcagggtgcccttcagtgttacactagggcaatacagatcaaccccgcttttgccgacgctcactcaaacttggcatcaatccataaggatagcgggaatattcccgaggccattgcgagttatagaaccgccctgaagctcaaacctgacttcccagatgcatattgtaacctcgcgcattgcctgcagattgtctgtgattggaccgattacgacgaaaggatgaagaaactcgtcagcattgtggcagaccagctggagaagaacagattaccttccgttcatccccaccattccatgctgtaccctctctcccatggatttcgaaaggccatcgcagagaggcatgggaacctttgcctggacaagatcaacgtactgcacaaacccccatacgagcatcctaaggatctcaagctctcagacggtaggctcagggtcggttacgtatcgtctgattttggcaaccacccaacaagccacttaatgcagagcatcccgggtatgcacaaccctgacaagttcgaggtgttttgttatgcgctgtcacccgacgatggaacgaatttccgggtgaaggtcatggctgaggccaaccatttcatcgacctgtcacagattccctgtaacggtaaagccgcggacaggatacaccaggacggcatccatatcctcgtgaatatgaacggctataccaagggagcccggaacgagttatttgcactgaggcctgcgcccattcaagccatgtggttggggtaccccggcacatccggagccttatttatggactacattattacggaccaggagacctctcccgccgaagtagccgaacagtactctgagaagttagcatatatgcctcatacctttttcatcggagaccatgccaacatgttcccacacctgaagaagaaagccgttattgactttaagtccaacggccacatctatgataatcgtattgtcctgaacggcatcgacttgaaagctttcctggattcattgcctgatgtgaaaattgtgaagatgaaatgcccggatggaggagataatgccgacagctccaacaccgcactgaacatgccagttatccccatgaacacaatagccgaggccgtgatagaaatgatcaaccgtggccagatacaaatcactatcaacggtttctctatcagcaatggactggctaccacccagattaataacaaggccgccaccggagaggaggtgccacggaccattatcgtgacaacaagaagccagtacggtctgcctgaggacgccatagtctactgcaacttcaatcagctgtacaaaattgatccaagtaccctgcagatgtgggccaacatcttaaagcgcgtccctaactcagtcctttggttgctgcggttccccgccgtcggtgagcctaatatccagcaatatgcacagaatatgggtctgcctcagaatcgtatcatattttcacctgttgcccctaaagaggaacatgtgaggagaggtcaactggcagacgtctgcttggatacccctttgtgtaacggacatactaccgggatggatgtgctgtgggccgggacccccatggtgacaatgcctggggaaaccctggcaagccgagtggccgcatcccagctgacctgtctgggatgcttagaactgatcgccaaaaataggcaagagtacgaagacatcgcagtaaaattgggcacagacctagagtatttaaagaaagtccgtgggaaagtttggaaacagaggataagctccccactttttaatacaaagcagtacacaatggagctcgagagactctacctgcagatgtgggagcactacgccgctggaaataagcccgatcatatgattaagcccgtcgaggtgacagagtcagcgtag

SEQ ID NO: 127321 - DNA, 330 bp, Artificial Sequence
  Description of Artificial Sequence: Synthetic coding sequence
atgagtatcactgacgttctgtcagcagatgacatcgcagccgcccttcaggagtgtagggacccagacaccttcgagccccaaaaatttttccaaacctctggactgtccaagatgagcgctaatcaagtcaaagacgtcttccggttcattgataacgaccagagtggctaccttgacgaagaggaactaaagttctttctgcaaaagtttgaatctggcgcccgagagctgacggagtctgagaccaaatcccttatggctgctgcagataacgacggagatgggaagatcggtgccgaggaatttcaggagatggtccactcttag

SEQ ID NO: 127322 - DNA, 330 bp, Artificial Sequence
  Description of Artificial Sequence: Synthetic coding sequence
atgtcaattacagacgttctctctgctgacgacatcgctgctgccctgcaggagtgtagggatcctgatacattcgaacctcagaaattctttcagacgagcggacttagtaaaatgagcgccaatcaggtgaaggatgtgttccggttcattgataatgaccagagcgggtatttggacgaagaggagcttaagtttttcttgcagaaatttgagtcgggggcccgggaactaactgaatccgagaccaagtcactaatggcagccgctgacaacgacggggatgggaagatcggcgcagaggagttccaggaaatggtgcattcttag

SEQ ID NO: 127323 - DNA, 1638 bp, Artificial Sequence
  Description of Artificial Sequence: Synthetic coding sequence
atgccaccgtttctgcttctcacctgcctattcatcaccggtacctctgtaagccccgtggcactggacccctgcagcgcctacatcagtttaaacgagccatggcgcaacactgaccaccagctagacgaaagccagggcccccctttgtgcgacaatcatgtaaatggagaatggtaccactttactggcatggccggcgatgccatgccaaccttttgtattccagaaaaccactgtgggactcacgctccagtctggctgaacgggagccaccctctggaaggggatggaattgtccaaaggcaggcttgcgctagtttcaacggcaactgctgcctttggaacactacagtggaagtaaaagcttgtcctggaggctactatgtataccggttgacgaaaccttcggtgtgctttcacgtttactgtggccacttttacgatatttgcgacgaggactgtcacggatcctgtagtgacactagcgaatgtacatgcgctccgggtaccgtactgggacccgaccgtcagacatgctttgacgaaaacgagtgtgaacaaaacaacggcggctgctctgaaatttgtgtgaacctgaagaatagttaccgctgcgaatgcggagtaggacgagttttgagaagcgatggtaagacttgcgaagacgtggaaggctgtcacaataataacggaggatgtagccacagctgcctgggcagtgagaaggggtaccagtgcgagtgccctagagggttggtcctgagtgaagataatcacacttgtcaggtacctgtgttatgcaaatctaacgctattgaggtgaacatcccaagagagctggtaggtggactggaactgtttctcactaacacaagctgccggggcgttagcaatggtacacacgtgaacatcctcttttccctgaaaacatgtgggactgttgttgatgtggtgaatgataagatagtggcatcaaacctggtgaccggcctgccaaagcagacccccgggtcatctggcgacttcattatcagaacatctaagttgcttattccggtcacctgtgaatttccccgcctgtatactatcagtgaggggtacgtgccaaacctaagaaactccccactggagataatgagccggaatcatggcatattccctttcaccctagagattttcaaggacaatgagttcgaagagccttatcgcgaggctctgccaacacttaagctcagagactccctgtatttcggaattgaaccggtcgtacatgtctcagggctagaaagcctggttgaaagttgtttcgccacccccacatccaaaatcgacgaggtcctaaagtattatctgatcagggacgggtgtgtgtccgacgactctgtcaagcagtatacatctcgcgaccatctagcaaagcattttcaggttccggttttcaagttcgtgggaaaggatcataaggaggtgttcttgcattgtagagtccttgtgtgcggtgtgttggacgaacgcagcaggtgcgcgcaggggtgtcaccggcgaatgcgacggggcgccggtggagaagatagcgcaggcctgcagggacagaccttgaccggcggccccattcggatagattgggaggattag

SEQ ID NO: 127324 - DNA, 966 bp, Artificial Sequence
  Description of Artificial Sequence: Synthetic coding sequence
atgcctcccttcttgcttctgacatgtttattcattaccggaacatctgtgagtcctgtggccctagatccctgctccgcatatatctctctcaatgagccatggcgaaacaccgaccaccagctagatgaaagtcagggcccacctctgtgtgataatcatgtaaatggggagtggtaccattttaccgggatggccggcgatgcaatgccaacgttttgcatccctgagaaccattgtggtacacacgctcctgtttggctaaatgggtctcatccactcgagggtgatgggattgtccagcgtcaggcctgcgctagttttaatggcaattgctgtctgtggaacaccacggtcgaagtaaaagcctgtccgggcggttattatgtttaccgcctcactaaaccctcagtgtgcttccacgtatattgtgggcatttttatgatatatgtgacgaagactgccacgggtcttgttccgatacttccgagtgcacttgcgcacctgggaccgtgctcgggcccgatcggcagacctgttttgatgaaaacgaatgcgaacagaataatggaggctgtagcgaaatatgtgtgaacctgaagaattcttaccgctgcgagtgcggagtgggtcgtgtcctgagaagcgacggcaagacatgtgaggacgtggagggatgccataacaacaatggcggttgcagtcactcctgtcttggaagcgagaagggttaccagtgtgagtgtccaagggggctagtgctgagtgaggataatcacacttgtcaggtgcctgttctttgcaaaagtaacgccattgaggtcaacataccaagggaacttgttgggggcctggagctgtttctcacgaacaccagctgccgaggagtctccaatggtacacacgtgaatattttgttctcccttaagacgtgtgggaccgtcgttgacagctgttttcagtag

SEQ ID NO: 127325 - DNA, 735 bp, Artificial Sequence
  Description of Artificial Sequence: Synthetic coding sequence
atggggctagaattatttctagatctggtcagccagccctcccgcgccgtctacatctttgctaagaagaacggaatccctctcgaactgcggactgtggatctagttaaaggacagcacaaaagtaaggaattcttacaaatcaatagcctgggaaagctgcctactttgaaggacggagatttcattctcacagaatctagtgctattctgatataccttagctgcaagtatcagacacccgatcactggtacccgtctgacttacaggcacgagccagagttcacgagtatttaggatggcatgccgattgcattcgcggcacattcggcatcccgttgtgggttcaggtcctaggccctttaatcggagttcaagtacccaaagaaaaggtggaacggaaccgtacagctatggaccaggcattgcagtggctggaggacaaatttctgggggatcggccgtttctggcggggcaacaggtgaccctcgccgacctgatggccctggaggaacttatgcagcctgtggcccttggttacgagctcttcgaagggcggcctcggctagctgcttggcggggacgcgttgaagcttttctcggagccgaattgtgtcaggaggctcacagtatcatacttagcatcctggaacaggcagccaagaagaccttgcccaccccctcaccggaagcttaccaagccatgcttttaagaattgcccgtatcccatag

SEQ ID NO: 127326 - DNA, 696 bp, Artificial Sequence
  Description of Artificial Sequence: Synthetic coding sequence
atggcttcgatggcagcgatcggaagttgctctaaggagtacagagtgctgctgggtcagcttcaaaagcagacagatctgatgcaggacacctcacgtctcctcgatccttatatcaggatacagggactggacgtccccaagctgcgggaacactgtcgggagaggcccggggcctttcctagtgaagagacactcaggggtctggggcgacgcggtttcctgcagaccttgaatgctactctgggttgtgtgttgcaccggttggccgatctcgaacagcgtctgccaaaggcccaggatctagagcggtccggcttaaatatcgaagacttggagaagctgcagatggctcgccccaacatactgggattgaggaataacatctattgcatggcacaactcctcgataattcggacactgccgagccaactaaggccggccgtggagccagtcagccacctaccccgacacctgcttcagacgcttttcagcgtaaactggaagggtgcagatttctacacggctaccaccgcttcatgcattccgttgggagggtttttagtaaatggggggagagtcccaaccgtagtcggaggcactcccctcaccaggccctgaggaagggcgtgcgcagaaccaggccctcgcgtaaaggtaagagattaatgacccgcggccagttacccaggtag

SEQ ID NO: 127327 - DNA, 2940 bp, Artificial Sequence
  Description of Artificial Sequence: Synthetic coding sequence
atggccctgttcgctgtgttccaaacgacatttttcctcaccctcctgtcgctgagaacttaccagtccgaggttctggctgagcgtctgcccctcactccggtgagccttaaggtgagcaccaacagcacgaggcagagcctccacctgcagtggactgtgcacaatctcccctaccatcaagaactgaagatggtcttccaaatacagatctccaggattgaaacttcaaacgtaatttgggttggtaactattctacaactgtgaaatggaaccaagtcctccattggtcatgggagtccgagctgcccctggaatgtgctactcatttcgtaagaatcaaatccctggtggatgatgctaagtttcctgaaccaaatttctggtcaaactggtctagttgggaggaagtctccgtgcaggacagcaccgggcaggacatactgtttgtttttccaaaggacaagctggtggaagagggcaccaatgtgactatctgctacgtgtcacgtaacatacaaaacaatgtttcttgttacctggaaggcaagcaaatccacggcgagcagctggacccacatgtcactgcctttaatcttaacagcgttccttttatacggaacaaaggcacgaatatttattgtgaagcctcacaaggtaatgtttcggaaggtatgaagggaatagtgctgtttgtgagtaaagttctggaggagccaaaggatttttcttgtgaaactgaagactttaagactctgcattgcacatgggatcctggcactgacactgcattgggttggtccaaacaaccctcccagtcttataccttgttcgagtcattctccggcgaaaaaaagctctgcacccacaagaattggtgtaattggcagataactcaggatagccaggagacctacaattttacgttgatcgccgagaattacctaagaaaaagatccgttaatatcttgttcaaccttactcaccgggtttatttgatgaacccctttagcgtcaatttcgagaacgtaaacgctacaaacgccatcatgacttggaaagtgcatagcatccggaataattttacatatctgtgccagatcgagctgcatggagaaggaaagatgatgcagtacaacgtctctattaaagtgaatggagagtatttcctgtccgaactggaacccgcgacagaatacatggctcgagtacgctgcgcagatgcttcacacttctggaaatggtcagagtggtccgggcagaatttcaccaccctcgaggcagcaccttctgaggctccggacgtgtggcgaatagtttctctggagcccgggaaccatacggtgaccctcttctggaagcccctcagcaaacttcacgcgaacggaaagatcctcttctacaacgtggtcgtggagaatctggataaaccaagttcctctgagctacattctatccctgcccctgcgaacagcacaaagctcattctggacagatgttcctaccagatctgcgtcatagcaaacaacagtgtcggcgcttctcctgccagtgtgattgtgatttcagccgatcctgaaaacaaggaggtagaagaagaaagaatcgccggaacagaagggggcttttcactgtcctggaagccccaacccggggatgttattgggtatgtagtggactggtgcgaccacacacaggatgtcctgggagactttcagtggaaaaatgtagggccaaacaccacttctacagtgatttcaacagacgccttccgacccggtgtgaggtacgactttaggatatacgggctgagcacgaagcgaatagcttgtctgctcgaaaaaaaaactgggtactcacaagaactagccccttccgacaatccccatgtgctggtcgacaccctcacatcacattcattcacactgtcttggaaggactactcaactgagtcacagcctggttttatccaaggctaccatgtttacctcaaatcaaaggcgcgacagtgtcacccccgttttgagaaggcagtgctgagcgacggttctgaatgctgcaagtacaaaatcgataaccccgaagagaaggccctcatcgtggacaacctcaagcccgagagtttttatgaattctttatcaccccatttacatctgccggagagggaccatccgcgacatttacgaaggtcaccacccctgacgagcatagcagcatgcttatccacatcctgctgcccatggtgttctgcgtcctgcttataatggttatgtgctacctaaaatcacagtggattaaggaaacgtgttatcccgacattcccgacccgtataagagtagcatcctgagcctgatcaagttcaaagagaacccccatctcattattatgaacgtctcagactgtatccccgatgcgattgaagtggtgagtaaacccgagggcaccaaaatacagttcttgggcacaaggaagtcccttactgaaacggagctgacgaaacccaattacttgtatcttctgccaaccgagaagaaccatagtggccctggaccttgcatttgctttgagaatctgacctacaaccaggctgcctctgattccgggagttgtgggcacgtccctgtgtcccccaaggccccgagcatgctgggactcatgacttctcccgagaacgtgttgaaggccttggagaagaattacatgaactcactgggggaaataccggccggcgaaacaagcttaaattacgtcagccagctggcgagtcctatgttcggcgacaaagactcattaccaacaaacccagtggaagcaccccactgctccgagtacaaaatgcagatggccgttagtctgcgactggccttgccccccccaacggaaaactctagcctcagctctattaccctgcttgacccaggagaacattactgttag

SEQ ID NO: 127328 - DNA, 1029 bp, Artificial Sequence
  Description of Artificial Sequence: Synthetic coding sequence
atggccctcttcgcggtgtttcagactacattttttctcacactgctgagtcttcgcacctatcagtcagaagtgctggctgaaagacttccactgacacctgtgagtctaaaggtcagcacaaacagtacacgccagagtctgcacctgcagtggaccgttcataatctaccctaccaccaagagctcaagatggtgtttcagatccaaattagccgcatcgagactagcaatgtaatttgggtagggaactactctaccacagtgaagtggaatcaggtgttgcattggtcttgggaaagcgaactgccgcttgagtgtgctacccactttgtcaggattaaatcactcgtggatgatgccaagttcccagaaccaaatttttggtccaactggtcctcctgggaggaggtctctgtccaggattccaccgggcaggatattttattcgtgttccctaaagacaagctggtggaggagggtacgaacgtgactatttgttacgtgtccagaaacatacaaaacaacgtctcctgctacctcgaaggtaaacaaatacacggcgaacagttggacccgcatgttaccgctttcaacttgaattccgtgcccttcatccggaacaagggcacaaatatctactgtgaggcaagtcagggtaacgtgtctgaggggatgaaagggattgtactcttcgttagcaaggtgctggaggagccaaaggatttttcttgcgagacagaggactttaagaccctccattgcacatgggatcccggtaccgacactgccctcggctggtccaagcagccaagtcagtcttataccctatttgaatcattcagcggcgagaagaaactgtgtacacacaaaaattggtgtaactggcagatcacacaggacagccaggaaacctacaatttcaccttaatcgccgaaaactaccttcgcaaacggtctgtcaatattttgttcaacctgacccacaggggcgagacaagagtcgtgaccgcgcatcgtggccattag

SEQ ID NO: 127329 - DNA, 1398 bp, Artificial Sequence
  Description of Artificial Sequence: Synthetic coding sequence
atgaatgcacagctaaccatggaagcaatcggggaactccacggtgtgtcccacgagcctgtcccggcacccgctgatctcctgggcggttctccacacgcgagaagctctgtggcgcatagaggaagtcatttgccccccgcccatccacggtctatggggatggcatcccttctggatggggggtccggaggcggggattaccatcaccaccacagagctccagagcatagtttggccgggcccttgcaccctacaatgaccatggcctgtgaaacaccacctggaatgagtatgcctaccacatatacaacacttactccgctccagcctctgccacccatttccaccgtatccgataagtttcctcatcaccatcatcatcatcaccatcatcaccacccgcatcaccaccagagactcgcaggcaacgtctccggttcattcacactcatgcgtgatgagagaggtcttgcctcgatgaataatctgtacaccccgtatcacaaggacgtggcggggatggggcagtccttaagccctctgagctcatccggacttggatccatccacaacagtcagcagggactgccccattatgcccaccccggcgcagctatgccaacagacaaaatgctcactccaaatggattcgaagcccaccaccctgctatgcttggacggcatggagagcaacacctgacgcctacatccgcagggatggtaccgattaacggactgcctccgcatcacccccacgcccacctcaatgctcagggtcatggacagctgctcggaacagcgagggagcctaatccatcagtgacgggagcacaggtgtcaaacgggtctaacagcggtcagatggaggaaattaatactaaagaggtagctcagcgaatcactactgagcttaagagatatagcatcccccaagcgatctttgcccagcgcgtgctgtgtcggtcacagggcacgttgagcgatctgctccgtaaccctaagccatggtctaaactcaaatccggtcgtgagactttccgccgaatgtggaaatggctacaggagcccgagtttcagcggatgtctgccctgcgcttggccgcatgtaagcggaaggaacaagagcatgggaaagatcgggggaacacgcctaaaaaacctaggttggtgttcacagacgtacagagacgtacacttcatgcgatctttaaggaaaacaagaggccaagtaaagagctgcagataaccatatcccaacagctcggattggagttgtccaccgttagcaatttctttatgaacgcacgaagacgttcactggacaagtggcaggacgaaggttcgagcaatagtgggaactcaagttcatcatcatctacttgtaccaaagcctag

SEQ ID NO: 127330 - DNA, 1515 bp, Artificial Sequence
  Description of Artificial Sequence: Synthetic coding sequence
atgaaagccgcgtataccgcgtatcggtgcttgactaaagatcttgaaggctgcgccatgaaccccgagctgacgatggaatccttgggcacccttcatggaccggccggcggcgggtccggaggtggcggcgggggcggcggcggcggcggaggtggagggcccggtcatgagcaggaattgctggcatctcctagccctcatcatgcagggcggggggcagccggcagtcttaggggacctcctcctccacccacggcgcaccaggaactggggaccgcagccgctgccgccgccgctgccagtaggtctgccatggtcacttctatggcaagtatcttagacggcggggattatcggcccgaactgtccatccctctgcaccacgcaatgtccatgtcatgcgattctagcccccctgggatgggcatgtccaacacctataccaccctcaccccattgcagcccttgccaccgatctctacggtaagcgacaaatttcaccatccccacccacaccatcaccctcatcatcaccatcaccaccatcaccagagactgtccgggaacgtgagcggctcattcactctgatgagagatgaacgcgggctccctgctatgaataacttgtactccccctataaggagatgcccggaatgtcccagtcactgagcccactcgcagctactcccctgggcaacggactgggaggtctgcacaatgcccagcaatccctccctaactacggccccccaggccacgacaaaatgctatcacctaattttgacgcccatcacacagctatgcttactcgaggcgagcagcacctgtctcgcggcctgggtacccccccagccgctatgatgtctcacctgaatggcctccaccaccctgggcatactcagtctcatggccctgtcctggctccatcccgggagagacccccctcctccagctccgggagtcaggtggctacctccgggcagctggaggaaatcaataccaaagaggtcgcacagaggattacagcagagctgaagaggtacagtataccacaagccattttcgctcagagagttctttgtcgcagccaagggactctaagcgatttgttaaggaaccctaagccgtggtcgaagctcaaatcaggccgcgaaacgttcagaaggatgtggaaatggctgcaggagcctgagttccagcgaatgtcggctctgcgacttgcagcgtgcaaacgcaaagagcaagagcctaacaaggatcggaataactcccagaagaagtccagactggtattcaccgacttacagcgaagaacgttgtttgccatatttaaggagaacaagagacccagcaaagagatgcagatcaccatttcccagcagctgggactcgaattgaccacggtcagcaactttttcatgaacgcccggcggcgcagcctggaaaaatggcaggatgacctttcaaccggcggatcgtcatccaccagttctacctgcacgaaggcgtag

SEQ ID NO: 127331 - DNA, 1458 bp, Artificial Sequence
  Description of Artificial Sequence: Synthetic coding sequence
atgaatcccgagcttacaatggagtctctgggcaccctgcacggccccgccgggggagggtcaggtggaggcggcgggggagggggtggaggtggaggcgggggccctgggcacgaacaggaacttttagcctctccttctccacaccatgctggaagaggcgccgccggtagtctcagaggcccccccccccctccgacagctcatcaagagctgggtacggccgctgcggctgcagcggctgctagccgtagtgctatggtgacatctatggcctcaatcctggacggaggcgattaccggccggagttgtcaattccactgcatcacgcaatgtcgatgtcctgtgactcttcacctcccggcatgggcatgtccaacacgtacaccactttgacacccctccagccgctgccccccatttccacagtctctgacaagtttcatcacccacatccgcatcatcatccacaccatcaccatcaccaccaccatcagagactcagcggtaatgtgtccgggagctttaccttgatgcgggacgagcggggtctacctgcgatgaataacttgtactcaccctacaaagaaatgcccggaatgtcgcagagtctgtcccctctggccgccacacctctgggtaacggactgggaggcctgcacaacgcccagcagtccctgcctaactacggcccccccggtcacgacaaaatgctgagtccgaacttcgatgctcatcatactgctatgctcacccgcggggagcagcatttgtcccgtgggttgggaacaccccccgctgccatgatgtcccacttgaatggactgcatcaccccggacatacgcagagccacggccctgttttagccccgtcacgggagagacccccttcctcttcctctggcagccaggtggctacttcagggcagctggaggagatcaacaccaaggaggtggcccagagaattactgccgagttgaagcgttactctatcccccaggcaatcttcgcccagcgagttctgtgcaggtctcaaggcactctctctgatttgcttcgcaatcctaaaccttggtccaaattaaaatcagggagggaaacgttccgtagaatgtggaagtggctgcaggaacccgagtttcagaggatgtcagctctcagactggccgcttgcaaacgaaaagaacaggaacctaacaaggataggaacaatagccagaagaagagcagactggtgtttaccgatctgcagcggcggacattgttcgccatcttcaaagagaacaaacgcccatcgaaggagatgcaaattacaatttcccagcagttggggctggagcttactacggttagcaacttcttcatgaacgcccgccgccgttcccttgaaaaatggcaggatgacctgtcaaccggaggcagttcttctaccagcagcacctgtacaaaagcctag

SEQ ID NO: 127332 - DNA, 450 bp, Artificial Sequence
  Description of Artificial Sequence: Synthetic coding sequence
atggtggatgatgctggcgcggccgaatcccagcgcgggaagcagacccccgcccatagcctcgaacaactgaggagacttccgcttccccctcctcaaattcggatccgaccatggtggttccccgtgcaggagctccgagatccactggtgttttacttggaggcctggctggctgatgagctcttcgggccagaccgggccattatcccagagatggaatggactagtcaagctttgttaacggtcgatatcgtagactccgggaacttggtggaaataaccgtgttcggccggccgcgtgtgcagaaccgggtcaagtctatgctcttatgccttgcttggttccacagggagcatagagctcgggctgagaagatgaagcacctcgaaaaaaatctgaaggcccacgcttcagacccacattctccacaggaccctgtcgcatag

SEQ ID NO: 127333 - DNA, 387 bp, Artificial Sequence
  Description of Artificial Sequence: Synthetic coding sequence
atggcccctgtaaagaagctggtagttaaagggggcaagaagaaaaagcaggtgctcaaattcacgctagactgcacccatcctgtggaggatggtataatggacgcagctaatttcgagcaatttctgcaggagagaatcaaagttaacggcaaggctggtaatcttggcggcggtgtggtcaccattgaacgtagtaagtccaagatcacagttacgtccgaggttcctttttcgaaacggtatttaaaatacttgactaagaaatatctgaagaagaacaacctccgggattggctgcgtgttgtcgctaatagcaaggaaagctacgagttaaggtattttcagatcaatcaggatgaagaagaagaggaagatgaggattag

SEQ ID NO: 127334 - DNA, 975 bp, Artificial Sequence
  Description of Artificial Sequence: Synthetic coding sequence
atggagcccgcccctagcgctggtgcagagctccagccccccctcttcgctaacgcctcagacgcgtaccccagtgcctgtcccagtgccggcgctaatgcttctgggcccccaggggctcgctccgcaagctctctcgcactggccatagcgatcaccgccctgtactccgccgtctgcgcggtgggtcttttgggcaatgtcttggtgatgtttggcattgtgaggtacacgaagatgaagactgccactaatatctacattttcaacttagccttagccgacgcgctggccaccagcacactcccatttcagtccgccaaatatctgatggaaacatggccattcggcgaactgctttgtaaggctgtgctgtctattgactattataacatgttcaccagtatcttcacactcactatgatgagtgtagaccgctatatcgctgtctgtcacccggttaaggctctggattttcgaactccagctaaggccaagctcatcaacatatgtatctgggtcctcgcgagtggtgtaggagtgccgataatggttatggccgtgacgcgcccccgtgacggagctgtcgtgtgtatgctgcagttcccctcaccctcgtggtactgggacactgtcaccaagatctgtgtgttcctattcgcatttgtggtctgctgggcgcccatacatatctttgttatcgtgtggactctcgtcgacattgaccgtcgagacccccttgtggtggcagctttgcacttgtgcatcgcccttggctacgccaattcctccctgaaccccgtattatatgcattccttgatgagaacttcaaacgatgtttccgtcagctctgcagaaagccttgtggtcggccggatccgtccagcttcagcagggccagagaagcaactgcccgggaaagagtcactgcatgtacaccctcagatggtcccggcggcggggccgccgcttag

SEQ ID NO: 127335 - DNA, 1143 bp, Artificial Sequence
  Description of Artificial Sequence: Synthetic coding sequence
atggacagcccaatccaaattttcagaggtgaacccggccctacctgtgcgcccagtgcttgtctaccacccaatagtagcgcctggtttcccgggtgggcggagcctgattcgaatggctccgccggctccgaagacgcacagctcgagccagcccacatcagtcctgctattcctgtcattatcactgccgtgtacagcgtcgtttttgtcgtcggattagtgggcaatagcctcgttatgttcgtgatcattcggtatacaaagatgaagactgccactaatatttacatcttcaatctggctctggccgacgctctggtgaccacgaccatgccatttcagtcaactgtgtatctgatgaatagttggccttttggggacgtgctttgcaagatcgtgatctctattgattattacaacatgttcactagcatctttaccctgactatgatgtccgtggacaggtatattgctgtgtgtcatcctgtgaaggccctggacttccgaaccccattgaaggccaagatcattaacatatgtatttggttgctgtcaagctctgtcggaatttcagctatcgtcctcggggggactaaggtgcgtgaggacgttgacgtgatcgagtgctcgcttcagtttccagatgatgattactcctggtgggacctgtttatgaaaatttgcgtgtttatctttgccttcgtaatccccgtattgattatcatagtgtgctacaccctgatgatcctgcgtctgaaatctgtccgactgctgtctggaagccgcgagaaagacaggaacctccggagaatcactagactcgtcttagttgtggtcgctgtcttcgtggtttgctggacaccaattcatatctttatcctcgtggaagccctcggctccacctcacactctacagctgccctgtcttcatactatttttgcatcgctctgggttatacaaatagcagcctgaacccgatcctgtatgcattcctcgatgaaaacttcaagaggtgttttcgggacttttgcttcccactgaagatgcggatggagcgccaatccactagccgggtccgcaacacagttcaagaccctgcttatcttagagatattgacggtatgaataaacctgtatag

SEQ ID NO: 127336 - DNA, 1101 bp, Artificial Sequence
  Description of Artificial Sequence: Synthetic coding sequence
atggatagcccaattcaaatttttaggggggaacctggtcctacatgtgccccgtccgcttgcctgccccccaacagctccgccgggtccgaagacgctcaactggaacccgcccacatttcgcctgctattcctgtgatcatcaccgcagtttacagtgtggtgtttgtggtcggtttggtgggtaacagtctcgtgatgtttgtcattatccgctacaccaagatgaaaacagccaccaacatttacatattcaatttggccctcgccgacgccttagtgactactacaatgccgttccaatccacggtgtatctcatgaactcctggcccttcggggacgttctgtgtaagatcgttatatctattgactattataacatgtttacttcaattttcacactaaccatgatgtctgtggatcgctatatcgcagtctgccatccggtaaaggctctggacttccggactcccctcaaagctaaaataattaacatatgtatctggctcctttcctcttcggtagggataagcgcaattgtgctgggaggcacgaaagtccgtgaggatgtggatgtgattgaatgctccttacagtttccagacgacgattacagctggtgggatctgttcatgaaaatttgtgtgttcatcttcgccttcgttataccagttctaatcatcatcgtgtgttatacattaatgattctccgcttaaaaagtgttagactgttgtcggggtcccgcgagaaggatagaaatctgcggcgcataactcgcctggttctggtcgtcgtcgctgtgtttgtcgtgtgctggacccctatccacatcttcattttggtagaggccctcgggtctacatcgcacagcacggcagctctcagttcttattatttttgcatcgcacttgggtataccaattcatccttaaaccctattttatacgcgtttctggacgagaatttcaaaagatgcttcagggatttttgctttcctctcaagatgcggatggagcgtcagtccacatctagagttcgaaatacagtgcaggacccagcctatctgcgcgacatcgatggaatgaacaagccagtctag

SEQ ID NO: 127337 - DNA, 1143 bp, Artificial Sequence
  Description of Artificial Sequence: Synthetic coding sequence
atggactctccgatccagatcttcagaggggagcccggacccacatgcgctccctctgcttgcctcccacccaatagcagcgcttggtttccaggctgggccgagcccgattctaatgggagtgcagggagtgaggacgctcagctggagcctgctcacatttcccccgctattccagtgattatcacggcagtctacagtgttgtttttgtagttggtttagttggtaacagcctggttatgttcgtgattatccggtacacaaagatgaaaacagcgacaaacatttatatcttcaatctcgctctcgcagacgctcttgtgaccacgactatgccgtttcaatccaccgtgtacctgatgaattcatggcccttcggggacgtgctgtgtaagatagtgatctcaattgactattacaatatgttcacaagtatctttacgttgaccatgatgtcagtggaccgatacattgcagtttgccatcctgtgaaagccttggatttcaggacccctttgaaagccaagattattaatatttgcatctggcttttgtccagctcagtcggaatcagcgcgattgtgctaggggggactaaggtccgggaagacgtcgatgtcatagagtgtagcctgcagtttccggatgacgattatagctggtgggacctctttatgaagatatgcgtattcatcttcgccttcgttatccccgtgcttattattattgtgtgctacactctgatgattctgcggctcaaaagtgttcgactgctttccggaagtcgtgaaaaggatagaaatctccgaagaattacaaggctggtcctggtggtcgttgcggtgttcgtagtttgttggacccccattcacattttcatattggtagaggctcttggaagcacatcacacagcactgccgccctgtccagctattatttctgcatagccttaggctacaccaatagtagtctcaaccccattctctacgcctttctggatgaaaacttcaagcggtgtttcagagatttctgctttccattaaagatgcggatggagcgccagagcacctccagggtgcgcaacacagtgcaggatcccgcgtaccttagagacatagatggcatgaacaaacctgtctag

SEQ ID NO: 127338 - DNA, 1344 bp, Artificial Sequence
  Description of Artificial Sequence: Synthetic coding sequence
atgtccagacggccctgtagctgtgcactccgccctccccggtgtagctgctcagcatctcccagcgcagtcacagccgccggcagaccgaggcccagtgactcttgcaaagaggaatcaagcacactcagcgtgaagatgaagtgtgactttaactgtaaccacgttcactccggactgaaattggtcaagccagatgacattggaagactcgtgtcctatacccctgcttatctcgagggttcctgtaaggattgtataaaggattacgaacgcctcagctgtattggtagcccaatagtgtccccaaggatcgtgcagctggaaaccgagtcaaagagactgcacaataaggaaaatcaacacgtgcagcagacattgaattctaccaacgagatagaggctctggaaacctcacgactttatgaagacagtgggtactccagcttcagtctgcagagtggtctgagtgaacacgaggaaggatctcttcttgaagaaaatttcggcgactctctccagagttgtctcttacaaattcagagtcctgatcagtatcctaacaagaatttgttacccgtcttgcacttcgaaaaggtggtctgctctacactaaaaaaaaacgccaagcgcaatcccaaagtggacagagaaatgctcaaagaaatcattgcaaggggcaactttcgcttgcagaatatcatcggcagaaagatgggactggagtgcgtggatatactctctgagctcttccgcaggggtctgcgtcatgttctcgccaccatactggcccagttgagcgatatggatctcattaatgttagcaaggtttcgacgacttggaaaaaaattctggaagatgacaagggagcatttcagctttactctaaagctattcagagggttaccgagaacaataacaaattctcaccacacgcaagcacacgagagtacgtcatgttccgcacacccctcgccagcgtccagaagtccgctgcccagacatctttgaagaaggacgcccagaccaagctctctaaccagggggatcagaagggatctacttatagtcgtcataacgagttttccgaagtggcaaagaccctgaaaaaaaatgagagcctgaaagcctgcattagatgtaactcccccgctaagtatgactgctacctccagcgggctacatgcaaacgggaggggtgcggattcgactactgtacaaagtgcctgtgcaattatcatacgacaaaggactgtagtgacgggaagttgctgaaggcctcttgcaagattgggcctctgcccgggaccaaaaagtctaagaaaaatctgcgtagactgtag

SEQ ID NO: 127339 - DNA, 1203 bp, Artificial Sequence
  Description of Artificial Sequence: Synthetic coding sequence
atggattcatctgcggctcccaccaacgctagtaactgcacagatgccctcgcatactcaagctgttcgcccgccccgtcaccaggatcctgggtgaacctatcacacctagacggaaatttgagcgacccctgcggacccaacaggacggatctgggcggccgcgattccttatgcccccctacaggatcacctagtatgattaccgcaattaccattatggccctttactccatcgtttgtgttgtagggctttttgggaattttctggtcatgtacgtgatcgtccggtatacgaaaatgaaaactgcaacgaacatatatatcttcaatctcgcccttgccgacgctcttgccactagcactctgccatttcagagtgtgaactacctgatgggcacatggcctttcggtaccattctgtgtaagatcgtgatctctatcgactactacaatatgttcacctcaatcttcaccctgtgcaccatgagcgtcgatcggtatattgctgtgtgtcatcctgtgaaggcgctcgacttccgcacgccccggaacgccaaaattatcaacgtgtgcaactggattttgagtagcgcaatcgggctgcccgttatgttcatggctaccacgaaatatcgtcaggggtctatcgactgtacccttacattcagccaccctacttggtattgggagaatctcctgaaaatatgcgtgttcattttcgcgttcattatgccagtgctcattatcaccgtgtgttatggcctgatgatcctgagactgaagtcagttcggatgctttctggcagcaaggagaaagatcggaacctgagacgcatcaccagaatggtgctcgtcgttgtggcagtgttcatcgtctgttggacgccaatccatatctatgtaataattaaggcccttgtcactattccggaaaccacctttcagaccgttagttggcatttctgtattgctttggggtataccaatagctgtctaaatcccgtactgtatgcgtttcttgatgagaacttcaagagatgcttccgagaattctgcattcctaccagttcaaatattgagcaacagaacagcacaagaattaggcagaatacaagggaccacccttctactgcaaacaccgtcgaccgaacaaaccaccaactcgaaaatcttgaggccgaaacagctccactcccttag

SEQ ID NO: 127340 - DNA, 1257 bp, Artificial Sequence
  Description of Artificial Sequence: Synthetic coding sequence
atggactcctccgccgcacctactaatgcatccaattgcacagatgccctcgcctatagttcctgcagccctgcccctagcccagggtcctgggtgaacctgtcacatctcgacgggaacttaagcgacccttgcggccctaatcggaccgacttgggggggcgtgatagcctgtgccccccaactgggtctccttcgatgatcaccgctattactatcatggcactgtattccatcgtgtgtgtggttggtctgtttgggaacttcctggttatgtatgtcatagttagatatactaaaatgaaaaccgccacaaatatttacatctttaatctggcgctcgcagacgctctagcgactagcacgcttcctttccagtccgtgaactatctgatgggtacctggccatttggaacaattctatgcaagatcgtgatatccatcgactactacaatatgtttacttcaatctttacgctctgcaccatgtcagtggatcgctacatagccgtttgccatccagtcaaggcactggactttagaacaccccgcaatgccaagattataaacgtgtgcaactggatcctgtcttccgcaattggactccccgtcatgttcatggccacgacaaagtaccggcagggttcaatagattgcacccttaccttctctcatccaacctggtattgggaaaacttgttaaagatttgtgtatttatatttgctttcatcatgcctgtgctaattataacagtgtgctacggactcatgatcctccggctcaagagtgtgcgcatgctcagtggctcaaaggagaaagaccgcaacctgagacggataactaggatggtgttagtggtggtggcagtgttcatagtgtgctggaccccaatccacatttacgttattattaaggctttggtaactattcctgagacgacattccagaccgtctcatggcacttttgtatagcccttggatacacaaattcctgcctgaatcccgtgctgtatgcctttctagatgagaatttcaagcgttgtttccgggagttttgcatccccacgagcagtaatatcgaacagcaaaactccactcgaatcaggcagaatacacgcgatcatccctctactgccaatacagtcgaccgcaccaatcaccagccccctctggctgtgtccatggctcaaatattcactagatacccacctccaacgcaccgggaaaagacttgtaatgattatatgaagcgttag

SEQ ID NO: 127341 - DNA, 1209 bp, Artificial Sequence
  Description of Artificial Sequence: Synthetic coding sequence
atggattcatccgccgctcccacgaatgcgtccaattgcaccgacgcgctggcttactcctcatgttcccctgcaccatcccctgggagttgggtgaatttatcccacttggacggtaatttaagcgacccttgtggaccaaaccgtacagacctgggaggcagggattccttgtgcccgccaacaggtagtccatctatgattactgccataaccataatggccctgtactcaatcgtgtgcgtggtgggtctgtttggaaacttcctggtgatgtatgtaatcgtgcgctacacaaaaatgaagaccgcgaccaacatttatattttcaaccttgcacttgcggacgcactggcaactagcactctgccttttcaaagtgtgaattacctgatgggaacatggcctttcggcacaatcctctgtaaaattgtgatttctatcgactattacaacatgttcacatccatcttcacgttgtgcacaatgtctgtagaccgctatattgcagtgtgtcatccagtgaaggccctggacttcagaacaccccggaacgcaaaaattatcaacgtgtgcaattggattttaagtagcgccatcggcctgcctgtaatgtttatggcaactactaagtatcggcaaggctctattgattgcaccctgacattctctcaccccacatggtactgggagaacttgctcaaaatttgtgtcttcattttcgctttcatcatgccagtgctcatcattaccgtgtgctatggattgatgatactcagactgaagtcagtgcgaatgctcagcggaagtaaagagaaagatagaaatctaaggagaatcacacgcatggtcctggtcgtggtggccgtgtttatagtttgctggacgccaattcatatctatgtgattataaaagctctcgtgacaattcctgaaactactttccagacggtgtcttggcacttctgtatcgctctgggctacacaaactcatgccttaacccagttctctacgccttcctggacgagaatttcaagagatgtttcagagagttttgtattcctacctcttcaaacatcgagcagcagaattcaactcgaatacggcagaatacccgtgaccatcctagtactgctaatactgtagaccgtacaaaccaccaaatccgcgatccaatcagcaatctgccccgggtgtccgtcttctag

SEQ ID NO: 127342 - DNA, 1212 bp, Artificial Sequence
  Description of Artificial Sequence: Synthetic coding sequence
atggattctagcgctgcacccactaacgctagtaactgtacggacgctctcgcctacagctcttgctcccccgccccttccccaggctcctgggtaaaccttagtcatcttgacggcaacttgtcagacccctgtggtcccaatcgaacagatttgggagggagggattcgctatgcccacccacgggatcccctagcatgatcacagccattacgatcatggccctctacagtattgtgtgcgtggtgggacttttcggaaatttcttggtgatgtacgtgatagtacgatataccaagatgaagacggccactaacatctacatctttaatctggctctggccgacgctctggcaacctctaccctgcctttccagagtgttaactacttgatgggaacttggccattcggcaccattctttgcaagatcgtaatctccatcgactactataatatgttcacgtccatctttactctctgcactatgagcgtcgataggtatattgcagtgtgccaccctgttaaagcactggactttcggacccctcgaaacgcgaagatcatcaatgtctgtaattggatcctgtcatccgcaattggcctccctgtgatgttcatggctactaccaaataccgccagggctcaatcgactgtaccctgaccttttcccaccccacctggtactgggagaacctgttgaaaatctgcgtcttcatctttgctttcattatgccggtgctgattattacagtttgttacggcttgatgatcctacggcttaagtctgtgagaatgctgtctggaagcaaggaaaaagaccgtaatctccggcggataacgcggatggtgctcgtcgttgtggccgtgtttattgtgtgctggacaccgattcatatatacgttatcattaaagctctggtgaccataccggaaactacctttcagacagtaagctggcatttttgcattgcgcttggctacaccaattcttgtttgaatcccgtactctatgcttttctcgacgagaacttcaagagatgtttccgcgaattctgcattccaacttcatccaacattgagcaacagaactctacccgaataaggcaaaacacccgagatcatccctctaccgccaataccgtggataggacaaaccatcagggtccgccagccaagtttgtcgccgatcagttggcgggaagttcctag

SEQ ID NO: 127343 - DNA, 1263 bp, Artificial Sequence
  Description of Artificial Sequence: Synthetic coding sequence
atggatagtagcgctgcacccaccaatgcatctaattgcactgatgccttggcctactcatcatgcagcccagccccatcaccaggctcctgggtaaacttatcacacctggatggcaatctcagcgatccttgcgggcctaaccgaactgacctgggcggccgtgactctttgtgtcccccaaccgggagcccctccatgattacagctatcaccataatggctctgtactcgatcgtttgtgttgtcggtctgttcgggaactttctcgtcatgtacgttatcgtgagatacacaaaaatgaagaccgccaccaatatttatatctttaatctggcccttgccgatgccctggctactagcaccttgcctttccagagcgtcaattatctcatggggacctggccttttggtaccatcctgtgtaagattgttatctctatagactactacaacatgtttacttctatttttacactgtgtacgatgtccgtggataggtacattgcagtgtgccacccagtaaaggcgcttgattttcggacacctagaaatgcgaagatcatcaatgtctgtaattggatcctgagctcagccatcggactgcccgtgatgttcatggccacaacgaaatataggcaagggtctattgattgtacattaaccttcagccatcctacctggtactgggaaaacctgctgaagatatgcgtattcatattcgccttcatcatgcctgtactgatcatcaccgtgtgctatgggctgatgatacttcgcctgaagtcagtacggatgttgtctggatccaaagaaaaggaccgcaatctcaggcggattacaaggatggttctcgtggttgtggcagtgttcatcgtgtgttggactcctatccatatttacgttattatcaaggcccttgtgaccatacctgaaaccacattccagaccgtctcgtggcacttttgtatagctcttggatatacaaactcttgtctcaatcctgtcttatatgccttcctcgatgaaaattttaagagatgctttcgggaattctgcatccctacatcctccaacatcgagcagcagaattccacccggatccgccagaataccagggatcatccaagcacggctaatacagtagacaggacaaaccatcaggtggaattgaacttggattgccattgcgaaaatgcaaagccctggccgctgagttacaacgctggccagagtcctttcccttttcccggccgggtctag

SEQ ID NO: 127344 - DNA, 1179 bp, Artificial Sequence
  Description of Artificial Sequence: Synthetic coding sequence
atggactccagcgccgcccctaccaatgcatccaactgtactgatgcccttgcctattcgtcctgctctcctgctccaagcccagggtcctgggtgaatttatcccacctcgacggaaatctttccgacccatgtggcccaaataggacagatcttggaggtcgggattctctgtgtcctccaaccgggtctccatcgatgataaccgcaattaccattatggccctgtattctattgtttgcgtggtgggactgtttggtaattttctggtcatgtacgtgattgtcagatatactaagatgaaaacagccacgaatatatacatttttaacttagcactggccgacgctctggcaacgtcaaccttaccctttcagtccgtgaattacttgatggggacctggccttttggaacaatcttgtgtaagatcgttatctccatcgattactataatatgtttacatccatttttaccctctgcaccatgtcagtggatagatacattgcggtatgccacccggttaaagctcttgactttcgtacccctcggaacgcaaaaattattaatgtgtgcaattggattctgtctagcgccattgggctgcctgtgatgttcatggcaaccacgaagtaccggcagggcagtattgactgtacactcaccttctcccacccaacttggtactgggaaaatctattgaaaatttgtgtattcattttcgcgtttatcatgccggtgctgatcatcaccgtatgctatggactgatgatcctcagactcaagtccgtaaggatgctgtccgggtctaaagagaaagaccggaaccttcggagaattaccagaatggtgctcgtcgtcgtggccgtattcattgtgtgttggacgcctatccacatttacgtcattatcaaagctctcgtgaccatcccagaaaccacatttcagacagtatcttggcatttctgtatcgctctgggatataccaactcctgtctgaatcccgtgctctacgcatttttagacgagaattttaagaggtgcttcagagagttctgcattccaacctcatccaacatcgagcagcagaactcaactcgtattcgccagaatactcgcgaccacccgagtactgcgaacaccgtggaccggaccaaccatcaggttcgtagcctgtag

SEQ ID NO: 127345 - DNA, 1482 bp, Artificial Sequence
  Description of Artificial Sequence: Synthetic coding sequence
atgtgtcttcataggagagtgcccagcgaggaaacctacagcctggatcgtttcgctcagaacccccccctatttcctccaccatccctccccgcgagcgaaagccgtatggctcacgcgccattgctgcagcggtgcggggctgcccggacaggtttttgcaagaaacaacaggaactgtggcagaggagaaaggaagcagccgaagcacttggaacgagaaaagtgagtgttctgctcgcaacctcccatagcggagcacggcccgctgttagcactatggattctagcgcagcacctacaaatgccagtaattgcacagacgccctggcatacagctcctgctctccagcccctagtccaggctcatgggttaacctttcacatttggatggcaacctcagcgatccttgcgggcccaacaggaccgatttaggcggtcgagactccctgtgcccaccgaccggttctccgtccatgataaccgcaatcaccattatggcgctttatagcattgtgtgtgtggtgggtctgtttggcaatttcctcgttatgtatgtcatcgtaagatataccaagatgaaaaccgcaactaatatctacatcttcaacctggccctggccgatgctctggccacctcaacattgccttttcagtccgtcaactatttgatgggcacctggcctttcggcacaattctgtgtaaaattgtgatctctattgattattacaacatgtttacctccatttttaccctgtgcacaatgtcagtggaccggtatatcgctgtctgtcaccctgtgaaagccctggatttcagaacgcctcgtaatgctaagattatcaatgtgtgtaactggatactctcgtcagccattggactgcccgttatgtttatggccaccacaaagtacaggcaaggctcaatcgattgcacactgacattttcacacccaacatggtattgggagaatctgctgaagatttgtgtgtttatcttcgcattcatcatgcccgtgctaatcatcaccgtttgctatggactgatgatcctccgactcaagagtgttaggatgctctctggctcaaaggaaaaagacaggaacctcagacggatcacaagaatggtactggtggtagttgccgtgttcatcgtctgctggacacctattcacatctatgtcataataaaagcccttgtaaccattcctgagacgacattccagacagtgtcatggcacttttgtatagctctcggttatactaattcgtgcttaaaccccgtcctctatgccttcctggatgaaaacttcaagcggtgcttcagagagttttgtatccccacctcctccaatatagagcaacagaactcaaccaggatacgccagaacacgcgggatcacccttcgacagccaatactgttgacaggacaaaccatcaactggagaatctcgaggctgagaccgcaccgctcccgtag

SEQ ID NO: 127346 - DNA, 1194 bp, Artificial Sequence
  Description of Artificial Sequence: Synthetic coding sequence
atggattccagtgcagctccaactaatgcatcgaattgtactgatgcgcttgcctactcctcttgcagccctgcacctagccccggcagttgggttaatctgagccacctggatggcaatctgtctgacccgtgcggtccaaatagaactgacctgggtggaagagattcgctttgtccaccaaccggctcccccagtatgatcactgctatcaccattatggctctctattctatcgtttgtgtagtaggcctcttcggtaactttctggtgatgtacgtgatagtacggtataccaagatgaagaccgccacaaatatctatattttcaatctggctctcgctgacgctctggccaccagcacactgcctttccagtctgtgaattacctgatgggcacatggccatttggtacaattctttgtaagatagtaatttctatcgactattacaatatgtttacaagtatcttcactctgtgcactatgtcagtggaccgctatattgcagtctgccatcccgtgaaggcacttgactttagaacaccaaggaatgcgaaaattatcaacgtgtgcaattggatactgtcctcagcgatcggtctgcccgtgatgtttatggctaccaccaaataccgacaagggagcatcgactgcacattgaccttcagtcatcccacttggtactgggaaaacctcctgaagatatgtgtgttcattttcgccttcatcatgccagtcctcatcattacagtgtgttacgggcttatgatcctccgtctgaaatccgttcgaatgctttccggctctaaggagaaggatcgcaatctgcgacgcatcacccgaatggttctcgtcgtggtggcggtcttcattgtgtgctggacccccatccatatttatgttattattaaggctctggttacaattcccgagacaacatttcagacagtctcctggcacttctgcattgcgctgggctacaccaacagctgcctcaatcccgtcctctatgcgtttcttgatgaaaacttcaagcggtgcttcagggagttttgcattccaacttcttccaatattgaacagcagaattctaccagaattcgacagaataccagagaccacccctccactgctaataccgttgacaggacaaaccaccagagagaaaggagacagaaatccgactggtag

SEQ ID NO: 127347 - DNA, 1221 bp, Artificial Sequence
  Description of Artificial Sequence: Synthetic coding sequence
atggactccagtgcagctcctactaacgcttccaattgcaccgatgctctggcttactcaagctgctccccagcaccgtctcctggtagctgggtcaacctctcacacctagacggtaatctgagcgacccatgtggcccaaatagaacggacttaggcgggcgggattccctgtgtcccccaacaggatcaccatcaatgattacggctattacaataatggctctatatagcatcgtgtgtgtcgtagggctctttggcaacttcctcgtgatgtacgtaatcgtgcgttacacaaagatgaaaacagcaacaaacatttacatcttcaatctcgctctggccgatgctcttgcgacaagcacacttccattccaatccgtaaactacctaatggggacatggcccttcggcaccatcttgtgtaaaattgtgatttctatcgactattacaacatgtttacgagtatcttcactctttgtacaatgtctgtcgaccgatacatcgccgtgtgccatccggtgaaagccctcgacttccgcactcctcgcaacgctaaaatcatcaacgtgtgtaattggattcttagcagcgcaatcggtctgcctgtgatgtttatggccacaaccaagtatagacagggaagcatcgattgcacactcactttttctcaccctacatggtactgggaaaatctgttgaaaatctgcgttttcatcttcgccttcatcatgcccgtattgatcatcacagtctgctacggtcttatgattttgcgacttaaatccgtccggatgctttctggctcaaaagagaaggaccgcaacttaagacggattaccaggatggttcttgtggtggtagccgtgttcattgtgtgctggacacccattcacatctacgtcatcattaaagcattggtgaccattcctgagacgaccttccaaactgttagctggcacttttgtattgctctcggttacactaattcctgtctgaacccagtgctgtacgcattcctcgatgagaactttaaacgatgtttccgggaattttgtattcctactagcagcaacattgaacagcagaactctactagaatccggcagaatacaagagaccacccctcaactgccaataccgtcgatagaaccaatcaccaaaagattgatctctttcagaaatcaagcctactgaactgtgagcacaccaaggggtag

SEQ ID NO: 127348 - DNA, 960 bp, Artificial Sequence
  Description of Artificial Sequence: Synthetic coding sequence
atgatgagagcaaaaagcattagcactaaggcggggaaaccgtcaaggtacactaagatgaaaacagcgaccaatatatacatctttaatctggccctggctgacgcactcgcgacctcgactttaccattccagagtgtaaattacctgatgggaacctggcccttcggcacaattctctgcaagattgtgatctccatcgattactataacatgttcaccagcatctttacattgtgcacgatgtcagttgataggtacatcgccgtgtgccacccagtgaaggctctggactttcggacgccccgaaatgccaagatcattaacgtgtgcaattggattctatccagtgccatcggcctccctgttatgttcatggccacaacaaaatatcgccaaggctctattgattgtaccctgaccttctctcatccaacgtggtactgggaaaacctgttgaagatttgtgtgtttatcttcgcctttattatgccagtactcattatcactgtttgctatggtttaatgatcctgcggctgaagagcgtgagaatgctgagtggcagcaaggaaaaagatcggaacttgcggaggattacccggatggtgcttgtagtcgtggctgtcttcattgtgtgttggaccccaatccacatctacgtcatcatcaaagccctggtcaccatccccgaaactacattccagaccgtatcatggcacttttgcatcgcgctcggatacaccaactcctgcctcaacccggtcctctatgcattcctggacgagaatttcaaacggtgctttagggagttctgcatcccaacatcgagcaacatcgagcagcagaacagtacacgtataagacagaacacaagagaccacccatcaacggcaaataccgtcgaccgtactaatcaccaactggaaaatctggaagccgagactgcgcccctcccatag

SEQ ID NO: 127349 - DNA, 1209 bp, Artificial Sequence
  Description of Artificial Sequence: Synthetic coding sequence
atggattccagtgcggcacctacaaatgcatcgaactgcactgatgcccttgcatactcgagttgtagccccgcacctagcccaggatcctgggttaatctttctcacctggacggcaacttaagtgacccatgtggaccaaacagaacagatctcggaggcagggattctctctgccctcccactgggtctccctccatgatcacagccatcaccatcatggccctgtattccatcgtttgcgtggtcggattgtttggaaattttctggtcatgtacgtgatcgttcgttatacaaagatgaagactgcaactaacatttacattttcaacctagccttggcagatgccctcgcaacctcaacccttcccttccagtcggtcaactatctcatgggtacctggccttttggaacaattttatgcaagatagtgatatccattgactactacaatatgtttacatcgatttttacattgtgcactatgtcagtcgatcggtatattgccgtgtgccaccccgtcaaagcactggacttcaggaccccacgaaatgctaaaattatcaacgtctgtaattggattttaagtagtgccatcggattgcctgtgatgttcatggctaccacaaaataccgacagggatccatcgactgcacactgactttttctcacccgacctggtattgggagaatctcctcaagatttgtgtatttatatttgccttcatcatgcccgtgcttattattactgtgtgctacgggctgatgatcttacgtcttaagagcgtgcgcatgctgagcgggtctaaagagaaagataggaacttacgccgaatcacacgtatggtccttgtggttgttgctgtgttcatcgtgtgttggactcccatccacatttacgttataatcaaggcccttgtgaccatcccagaaactacctttcagactgtatcctggcatttctgtattgctcttggctacacaaactcttgcttgaatccagtgctctacgccttcctggatgaaaattttaaacggtgcttcagagagttttgcattccaacgagtagcaacatcgagcagcaaaattccaccagaattcgacagaacacccgtgatcaccccagtaccgctaacaccgtggatcggaccaatcatcagatcagagatccgataagcaacctcccgagggtgtccgtattctag

SEQ ID NO: 127350 - DNA, 492 bp, Artificial Sequence
  Description of Artificial Sequence: Synthetic coding sequence
atggtgcaagcgcgaactggcttttgtaagaaacaacaggaactgtggcaaagacgaaaagaggccgctgaggcactaggcacccgcaaggtgtccgtgctgctggccaccagtcattcaggggctaggcctgccgtttcaaccatggatagttcagccgctccgaccaacgcctccaactgcaccgatgcactggcatacagtagctgttcgcccgctcctagcccaggttcctgggtgaatctgagccacctagacggcaatctgtcagatccgtgcgggcccaacagaaccgacctgggaggacgcgatagtttgtgccctcccaccggcagtcccagtatgattactgccattactataatggctctgtattctattgtgtgtgtcgtgggactctttggtaactttttagtcatgtatgttatcgtgcgctacacaaaaatgaaaactgcgactaatatttatatttttaacttggctctggcgtag

SEQ ID NO: 127351 - DNA, 903 bp, Artificial Sequence
  Description of Artificial Sequence: Synthetic coding sequence
atgaagacagccactaacatttatattttcaacctggccctggccgacgcactcgctacctctacactccccttccagagtgtgaactatctcatgggaacttggccctttggcaccatcctgtgtaaaattgtgatctccatcgattattacaacatgttcacatctattttcactctgtgcacgatgagcgtggacagatacattgcagtttgccatcccgtgaaagccctcgactttcgcaccccgcgtaacgctaagataatcaacgtctgtaactggattctaagttctgccattggcctacccgttatgtttatggccacaactaaataccgacagggctccatcgactgtacgcttacatttagtcacccgacttggtactgggagaatctgctcaaaatttgcgttttcatatttgcattcattatgccggtactcattatcacggtttgttacgggctgatgatcctaagattgaagagcgtccgcatgttatctggtagcaaagagaaggacagaaatctgcgtagaattactagaatggtgctggtcgtggttgcagtatttattgtgtgttggacacccatccatatctatgtaatcatcaaagcactggttaccattccagagactacctttcaaaccgttagttggcatttctgtatagcactcggctacacgaactcgtgcttgaacccggtgctttacgccttcctggacgagaattttaagcggtgctttcgggaattttgtataccaacgagttctaatatcgaacagcagaacagtactcgcattaggcagaatacaagggaccaccctagtactgccaacaccgtcgaccgcacaaaccaccagttagagaatctagaggcagaaacagcacctctgccatag

SEQ ID NO: 127352 - DNA, 903 bp, Artificial Sequence
  Description of Artificial Sequence: Synthetic coding sequence
atgaagacggctaccaacatttacatttttaacctcgccttggcagacgccctggctacatccactctgccatttcagagtgtcaattatctcatgggcacctggccatttgggaccatcttgtgtaaaatagtgatcagtatagattattacaacatgttcactagcatcttcactctgtgcaccatgtccgttgataggtacattgctgtttgtcatcccgtcaaggctctagatttcaggaccccgaggaacgctaaaatcatcaacgtttgtaactggattctgtcatctgccataggcttgcccgtcatgtttatggctacgaccaagtatagacaggggtccatcgattgtacccttaccttcagccatcccacatggtattgggagaatttactgaaaatctgcgtgttcattttcgcattcattatgcctgtgctcatcatcacagtgtgttacggactcatgatattacggctgaaaagcgtgcgcatgctcagcggttccaaagagaaggaccgcaatctgagaagaatcacccggatggtgttggtggtggtggccgtctttatagtttgttggacacccatccacatttacgtgataatcaaagcactcgtcactatccctgagacaacttttcagactgtgtcatggcacttctgtattgcactgggctacactaattcttgtttaaaccccgtactttacgcttttttagacgaaaatttcaagagatgttttcgggagttttgtatccccacaagttctaacatcgagcagcaaaatagcaccaggattaggcagaatacaagagaccaccccagtaccgccaacactgtggaccgaactaatcatcaactggaaaacctagaggccgaaaccgctccactgccatag

SEQ ID NO: 127353 - DNA, 903 bp, Artificial Sequence
  Description of Artificial Sequence: Synthetic coding sequence
atgaagactgcgaccaacatctacatcttcaatctggctctcgccgatgctctcgcgaccagtactttgccattccaaagcgtgaattacttaatggggacctggcccttcggcacaattctgtgcaagattgtgatttccatagattactataacatgttcactagcatattcacgctctgtacaatgagtgttgacagatatattgccgtatgtcaccccgtgaaggcactcgactttcggaccccccgaaacgctaagatcatcaacgtttgtaattggatcctcagctcagcaatcgggctccccgtgatgtttatggctactaccaagtatcgccaggggtctatcgactgcacactgaccttttcccatccaacttggtattgggaaaatctcctgaagatttgtgtgtttatcttcgccttcatcatgccagtcctcatcatcacagtctgctacggtctgatgatcctccgccttaaaagtgtacgcatgctgtccgggtctaaagagaaagatagaaatctgaggcgaataacaagaatggtcctggtagtggtggcagtctttattgtgtgctggaccccgatccatatttacgtgattattaaagcgttggttaccatccctgaaacaaccttccagacagtgtcttggcacttctgcattgccctgggctatactaacagttgcctgaatccagtactctatgcctttttggacgagaactttaagaggtgttttcgggagttctgtatccccacaagcagcaacatcgagcagcagaactctaccagaatccgccaaaacacacgggatcatccaagtacggctaacaccgtggaccgaactaatcaccagctagagaatctggaagccgaaaccgcccccctgccatag

SEQ ID NO: 127354 - DNA, 1209 bp, Artificial Sequence
  Description of Artificial Sequence: Synthetic coding sequence
atggattcctcggccgccccgaccaacgcctccaactgtaccgatgctctagcctactcctcctgcagtccagctccatctccaggctcctgggttaatttgagccatctagacggcaatttgagcgatccctgcggccctaatcggaccgatctgggaggacgtgactcactgtgtccaccaacagggtccccatctatgataaccgctattaccataatggccctctacagcatcgtttgcgttgttgggcttttcggaaactttctcgttatgtatgtgattgtgcggtatactaagatgaagaccgcaaccaatatatacattttcaatttggcactggctgacgcgttagccacttcaacactcccgttccagtccgtcaactaccttatgggaacatggccgtttggaaccattctgtgtaagatagtgatatccatcgactactacaacatgtttacttctatcttcaccctgtgcactatgtctgtagatcggtacatagcagtgtgtcaccccgtgaaagcactggacttcaggaccccaagaaacgcgaagatcatcaatgtttgcaactggatactgtcgagcgcgataggcctgcccgtcatgttcatggccaccaccaaataccgccagggctcgatcgactgtacactcactttctcacaccctacttggtactgggagaatctcctgaaaatttgcgtgtttatcttcgccttcataatgccagtcctcattataaccgtgtgttatggcctgatgatcctgaggttgaagagtgtcagaatgctttccgggtcaaaggagaaagataggaatctgaggagaattacccggatggtcctggtggtcgtggcggtgttcattgtctgttggacacccatccacatctatgtcatcattaaggcactggtgaccattcccgaaactacctttcagaccgtttcctggcacttctgtatcgctctaggctacactaactcttgtctgaaccccgtgttgtacgcattcctggacgagaactttaaacgttgctttcgcgaattttgtattcccacgtctagtaacattgagcagcagaacagtacacggatccgccagaatacccgcgaccatccatctactgccaatacagtggatcgcaccaatcatcagatccgagatcccattagcaacctgccgcgagtgtctgtcttctag

SEQ ID NO: 127355 - DNA, 561 bp, Artificial Sequence
  Description of Artificial Sequence: Synthetic coding sequence
atggattcatctgcagctccgactaatgctagtaactgcacagacgctctagcctattcaagttgctctccagcgccttctcccggatcatgggttaatctgagccaccttgatggcaacttgtctgacccttgtggaccgaaccgtacggaccttggagggagggattcattgtgtccccccacaggcagtccctcaatgataactgctatcaccataatggccctatatagcatcgtttgtgttgttgggcttttcggtaactttcttgtgatgtacgtcattgtaaggtttcaccgactgtacactaacatcttgtctagcaaccttgtgctgggcaaacccgctgaagatctgtgtttccatttacgtctgcactatgctagcgcacaccattatagggtgctctggactgatgacctggctccccaggaatgccctcacgccctctggctgcagcgcaaagggcaggaatcatcaaaagaccatcaggatggcgcaggcggaggggggtgtgtgcacaggctcctcgactcgcattcgcatttgcgacaccattag

SEQ ID NO: 127356 - DNA, 1170 bp, Artificial Sequence
  Description of Artificial Sequence: Synthetic coding sequence
atggactcttcggctgctcccactaacgcgagtaactgtacagacgccttagcatactcttcttgtagcccggctccttccccggggtcctgggtaaatctgtcccatttggacgggaacttaagcgacccttgcggacctaatcgcacagatctggggggacgcgatagtctgtgccccccaaccggaagtcctagtatgattaccgccatcactatcatggcactgtactcaatagtctgtgtggtcgggctgtttgggaactttcttgtgatgtatgtaattgttagatacaccaagatgaaaacagcaaccaacatctatatttttaacttggcactggccgacgcgcttgctaccagcacactcccttttcagtccgtcaactatcttatggggacctggccttttggcaccatattatgtaagattgtgattagtatcgattattataatatgtttaccagtatattcactctgtgtaccatgtcagtcgacaggtatatcgcagtgtgccatccagtaaaggccctggacttccggacaccccgtaacgcaaagatcattaatgtttgcaattggatcttgagcagtgctattgggttgcccgtcatgttcatggctactaccaaatacaggcagggaagcattgattgcactcttactttcagccatccaacctggtactgggagaatctgcttaaaatctgcgtgttcatcttcgccttcatcatgcccgtgctaattattaccgtgtgttatggtcttatgatcctccggcttaaaagcgttcggatgctgtccgggagcaaggagaaggaccggaatcttcgtaggatcactaggatggtcctggtggtagtcgcggtgtttattgtctgttggaccccaatccacatctacgtgattattaaagccctggttacgattcccgagactacattccagacagtgtcttggcatttttgtattgcacttggttatacaaacagctgcctcaaccccgtgctctacgcattcctagacgaaaattttaaacgttgttttagggagttttgtatacccacttcaagcaatattgagcagcaaaatagcacaaggattcgccagaacacccgggatcatcccagcactgcgaacacagtcgataggaccaatcatcagtcctag

SEQ ID NO: 127357 - DNA, 1095 bp, Artificial Sequence
  Description of Artificial Sequence: Synthetic coding sequence
atggcccaacagtggagtctgcagcgactcgctggacggcacccacaggatagctacgaagacagcacccagagtagcatcttcacttatactaactcaaactcaacgagaggtcctttcgaggggccaaactatcacatcgcccctcggtgggtgtaccacctgaccagtgtttggatgatctttgttgttactgcctcagtatttactaatgggctagtcctagcggctacaatgaagtttaagaaactaaggcatcccctaaattggatactcgtcaacctcgccgtggctgacttagcagagacagtaatcgctagcactatcagcattgttaatcaggtgagcggatatttcgtgttggggcatcctatgtgtgttttagaaggttacactgtttctttatgcggaataacagggctgtggagtttggccatcatatcatgggaacggtggctggtggtgtgcaagccgttcggcaatgttcgctttgacgccaagttggccatcgtgggaatcgctttcagctggatttggtctgccgtgtggactgccccacctatttttggctggtctaggtattggccccatgggttaaagacttcttgcggacccgacgtctttagcggtagttcgtatccaggagtacaatcctacatgatcgtgctcatggtcacctgctgcattatacctctcgcaattatcatgctgtgctacctgcaggtgtggctggctatccgggccgtggcaaaacaacagaaggaatcagagtccactcagaaagccgagaaggaagtgacccggatggtggtggtcatgatttttgcttactgtgtatgctggggaccatacactttcttcgcgtgttttgccgctgctaacccaggctatgctttccaccccctcatggcagcgctgcccgcctactttgccaaatctgccacgatctataacccagtcatttatgtgtttatgaatcggcagtttcgcaattgcattctgcagttatttgggaagaaggtagacgacggctccgagctgtcttccgcaagtaagacggaggtttcctctgtttcatccgtgtcacccgcctag

SEQ ID NO: 127358 - DNA, 1095 bp, Artificial Sequence
  Description of Artificial Sequence: Synthetic coding sequence
atggcacagcagtggtcattgcaaagactcgcaggcaggcacccacaggacagctatgaggattccactcagtctagtatatttacctacacaaattctaattcaacacgcggccctttcgagggcccaaattatcatatcgcgcctaggtgggtgtaccatctaacatcggtctggatgatcttcgtcgtgattgcttccgtcttcactaatggcctcgtactcgctgccacgatgaagtttaaaaaactccggcaccccctgaattggattctggtcaaccttgctgtagctgacttagcagaaactgttatcgccagcaccattagcgtagtcaatcaggtgtatggctacttcgtgctggggcatccgatgtgtgtactggaaggctataccgttagcttatgtggaatcacggggctgtggtccctggccattatttcttgggaacgctggatggttgtgtgtaagccgttcggaaacgtcaggtttgacgccaaattggccatagtcggcattgctttttcttggatctgggctgctgtatggacggccccacccattttcggctggtctcgttattggcctcacggactgaagacttcctgtggccccgacgtgtttagcgggtcttcatacccaggcgtgcagagctacatgattgttctcatggttacttgctgcataacccccctgtccataatcgttttgtgctatctgcaggtctggctggcgatccgcgcagtggctaagcagcagaaggaatctgagtccacccagaaggccgagaaagaggtgaccagaatggtcgtagtcatggtgctcgccttttgcttctgctggggcccttacgctttcttcgcatgttttgccgccgccaatccgggttacccttttcatcccctgatggcagcccttcctgcattctttgctaaatccgccaccatttacaatccagtcatctacgtcttcatgaaccgacagttcaggaactgcatcctacaattgtttggcaaaaaggtcgacgatggatccgaactttcttcagcatctaaaacggaggttagctccgtttcctccgtgtcacccgcctag

SEQ ID NO: 127359 - DNA, 1047 bp, Artificial Sequence
  Description of Artificial Sequence: Synthetic coding sequence
atgagaaagatgagcgaggaagaattctatctgttcaaaaacatatcctctgtgggtccttgggacggcccgcaataccacatcgctcctgtttgggccttctatctccaggccgccttcatggggacggttttcctgatcggattcccactgaatgccatggttctggtggcaacacttcggtataagaagcttcggcaacccttaaattacattcttgtgaatgtctcattcggcggctttcttctgtgtatattctctgtcttccctgtattcgtggcctcttgtaatggctacttcgtgtttggcagacatgtctgcgctctggagggttttttagggactgtagctgggctggttaccggttggtccctggctttcctggccttcgagagatatatcgtgatctgcaaaccctttggcaatttccggttctcctctaaacatgccctaacagtcgttttggctacgtggacaatcggcatcggggtgtccatacctcccttttttggttggagccggtttatccccgagggcctacagtgtagctgtggaccggattggtataccgtcggtacaaagtacaggagcgagtcctatacctggtttttgtttattttttgttttatcgtcccactgagcttgatctgcttttcatacactcaactgctccgtgcactcaaggcagtggccgcccaacagcaggaaagcgcgacaacgcaaaaggcggagcgcgaggtttcacgcatggtggtggtgatggttggcagcttctgtgtttgctacgttccctacgctgcctttgctatgtacatggtgaacaatagaaaccatgggctggacctgcgactggtgacaatcccgtcctttttcagcaagagcgcctgtatttacaatccaattatctactgtttcatgaacaagcagttccaggcatgtattatgaaaatggtctgcggcaaagccatgacggacgagagcgatacctgcagctctcagaaaaccgaggttagcactgtttcaagtacccaagtggggcccaattag

SEQ ID NO: 127360 - DNA, 972 bp, Artificial Sequence
  Description of Artificial Sequence: Synthetic coding sequence
atgtactcagggaatcgtagtggaggtcatggatactgggacggcggcggcgccgccggcgctgaagggcccgcacctgccggcaccttgtcccccgccccactcttctcacctggcacctacgagagactagccctgctgctcggctccatcggcttacttggagtgggaaacaacctactagttttggtgttatattacaaatttcagcgcctgagaacccctacccacttgctcctcgtgaatatcagtttgagtgacctgctcgtgagcttattcggagttacatttacatttgtgtcttgccttcggaacggatgggtctgggacacagtgggatgcgtatgggacggctttagcggctcactgtttgggtggatctcgcagttacaagccgctacgcgcgaggcgagggcttctatggggcctgtgcagcagggtacaatctgtatgcagttgcgctgcgtggaggacctgcagactattcaggtgatcaagatcctcaaatacgagaaaaagctggccaaaatgtgtttcctgatgatatttactttcttagtctgctggatgccctatattgtgatctgttttctggtcgtaaacggccatggacacctggtcacccctaccataagtatcgtatcctatttgttcgctaaatcaaacaccgtgtataacccagtgatctatgtgtttatgatcagaaaatttagacggtctctcctgcagttgctctgtctaaggctgttaaggtgccaaaggcccgcaaaggatctcccagccgccgggtctgaaatgcagatacgcccaatagtaatgagccagaaagacggggacaggccaaagaaaaaggtgacttttaacagttcttccatcattttcataataacatccgacgaaagcctcagcgtggacgatagcgacaagaccaacggcagtaaggtggatgtgatccaggtgcggcccctgtag

SEQ ID NO: 127361 - DNA, 1209 bp, Artificial Sequence
  Description of Artificial Sequence: Synthetic coding sequence
atgtacagtggaaacaggtcgggaggccacggctattgggacggcggtggtgccgctggggccgagggcccagctcctgcaggcacattgtctcctgctcccctcttctcccccggtacgtatgaacggctggcccttcttctggggagcatcggattactgggagtcggcaacaacctgctcgttttagtgctctattacaagtttcaacggctccgaacgcctactcacctgctgttagttaatatcagcctgtccgatctgcttgtctcattattcggtgtcacgttcacatttgtctcttgtctgagaaacggctgggtgtgggataccgtcggctgcgtgtgggacggattcagcggcagtctttttggcatagtgtccattgcgacacttacagtgctggcatacgagagatatatccgggttgtccacgctcgcgtcataaactttagctgggcctggcgggccataacttacatttggctgtattccctcgcctgggctggagctcccttattggggtggaatcgctatatcctggatgttcacggtttgggatgtactgtcgactggaaatcaaaagacgccaacgatagctctttcgtcttgtttcttttcctgggctgcctggtcgtccccctgggcgtaattgcacattgttatggccatattctctattctattcggatgcttcgctgtgtggaggacctgcaaaccatacaggtcatcaagatcctaaaatatgaaaagaaactagccaaaatgtgttttcttatgattttcacgtttcttgtgtgctggatgccgtacatcgtaatctgctttctggtggtgaatggccatggccatttggttaccccaaccatatccattgtgtcttacctgttcgccaagagcaatactgtttacaatccggttatctacgtgttcatgataagaaagttccgacgcagtctgctgcaactcctgtgtttacgactgctccggtgtcaaaggcccgcgaaggatcttccagctgcaggtagcgagatgcagatccgccccattgtgatgagccagaaagatggcgaccggcctaagaaaaaagtcaccttcaattcaagcagcatcatctttatcatcacatctgacgaaagtctgtctgtcgacgattcggataaaactaatggctctaaggtggacgtgatccaggttcggcctctctag

SEQ ID NO: 127362 - DNA, 2886 bp, Artificial Sequence
  Description of Artificial Sequence: Synthetic coding sequence
atgtggaggcttcgccgcgccgccgtggcatgtgaagtgtgtcagagtcttgtcaaacatagttcaggtataaagggctccctgccgctccagaagctgcacttagtatcccggtcaatctatcattcacaccaccctacgctgaagttacagcgccctcaacttcggacatcttttcagcagttcagttctctcacaaaccttccgttgcggaagctgaagttttcgccgattaagtatgggtaccagcccaggagaaatttctggccggcacgcttagccacccggctgttgaaattgagatacctgatcctaggatcggccgttggtggcgggtacactgcgaagaaaacgtttgatcagtggaaagatatgattcccgatttgagcgagtataaatggatcgttcctgacattgtgtgggagatcgacgaatatattgatttcggaagtccggaggaaacagcatttcgagcaactgaccggggctctgagagcgataaacactttaggaaaggactcctaggcgagcttatccttttgcagcagcaaattcaagaacacgaagaggaagcgcgtcgggctgctggacaatactcgacatcctatgcccagcagaagaggaaggtgtccgataaggaaaaaatagaccagctgcaggaggaactgttacatacacagctcaagtatcaacggatactcgagaggctagagaaggagaacaaagaattgcggaaacttgtgctgcaaaaggacgacaaggggatccaccatcgaaaactgaaaaaatcactcatcgatatgtattcggaagtgctggacgtgctgtctgactacgatgcatcatacaatacacaggaccatctcccacgggttgtggtggtgggcgatcagtcagccgggaaaacttctgtcctcgaaatgatcgctcaggcccgcatcttccctaggggtagcggggaaatgatgacccgatcacccgtgaaagtgactctcagtgaaggtccgcaccacgtagcactttttaaagattcgtcacgcgaattcgatttgacaaaagaggaagacttggccgccttaagacacgagatcgaactgcggatgagaaaaaatgtcaaggaaggctgtactgtcagtccagagactatcagtctgaacgtgaagggccccggcttgcagagaatggtgctggtggatcttccgggggtgattaacaccgtcacatcagggatggcccctgatacaaaagagaccatcttctcgatctccaaagcatacatgcagaaccctaatgctatcattctatgtatccaggacggctccgtcgatgccgagcgatccatagtcactgatttggttagccagatggacccccacggccgaagaaccatttttgtgttaaccaaagtggacctggctgaaaagaatgtggcatcgccgtcacgaatccaacaaattatcgaagggaagttgttccccatgaaggccctgggctactttgccgtcgtgactggcaaagggaatagctccgagtcgatcgaagctatccgggagtacgaggaggagttctttcagaattcaaaattactgaagacatctatgttgaaggctcaccaggtgaccactaggaatttatctctcgcagtgagcgattgtttctggaagatggtcagagagagcgtagaacagcaggccgattcttttaaagctactagattcaacctggagacggaatggaaaaacaattacccaagacttagggaactagatcgaaacgaactcttcgaaaaggcaaagaacgagattctggacgaagtcattagcctgtctcaagtgacccccaaacattgggaggagatcctccagcagtctttatgggaaagggtgtcaactcacgtaattgagaacatctatctcccagcggcccaaacaatgaattctggcactttcaacaccacggtggatatcaagcttaaacagtggactgacaagcaattaccaaataaagccgtcgaagtcgcgtgggaaactctgcaggaagagttcagcagatttatgaccgagcccaaagggaaggagcacgatgacattttcgacaaattaaaggaagccgttaaggaagaatccattaaacgccataaatggaatgactttgcggaggactcccttagggtcatccaacacaacgctctcgaggatcggtctatttccgacaaacagcagtgggatgccgccatctattttatggaggaagccctgcaagcccggctcaaagatactgaaaatgcgattgagaatatggttggaccagactggaagaagaggtggctgtactggaaaaatcgaacacaggaacagtgcgtgcacaacgagaccaagaacgaattagaaaagatgttgaagtgcaacgaggaacatcctgcctacttggcctctgatgagattaccacggtccgcaaaaatctggagtctcggggcgtagaggttgacccttctcttatcaaagatacctggcaccaggtttatcgccggcacttcttgaaaactgctctgaatcattgtaatctgtgcagaaggggcttctattattatcaacgccatttcgtggattccgaacttgagtgtaacgatgtggtgctgttctggaggatacagcggatgctggcaataactgctaataccctgaggcagcagctgaccaatacagaggtccgccggctggaaaagaatgtgaaagaggttctggaggactttgccgaagatggagagaaaaaaattaaactattgacagggaagagagtgcaactagccgaagatctgaagaaagttagggagatccaggagaaactggatgccttcattgaggctttgcaccaagaaaaatag

SEQ ID NO: 127363 - DNA, 3048 bp, Artificial Sequence
  Description of Artificial Sequence: Synthetic coding sequence
atgtggcggctgaggcgcgcagcagtggcctgtgaagtgtgtcagtctctagtgaagcattcttcggggattaagggttcattaccactgcaaaaactgcatctggtcagccggtccatatatcactcacatcatcctactttgaagctgcagcgcccccaactgagaacctcatttcaacagttctcttccctcacaaacctgcccctgcgtaaacttaaattcagtccaattaaatacgggtatcagccacgacgtaatttctggcccgcccgcttggctactcgtttgctgaaactgcggtaccttatccttggctcagctgtcgggggcgggtacacggccaagaagaccttcgaccagtggaaagacatgatcccggacctgagcgagtacaaatggatcgtgccggacatcgtgtgggagatcgacgagtatatcgactttgagaagattaggaaggctctaccctccagcgaggacctggtcaagctcgcacctgacttcgacaagatcgtcgagtccctttcactgctcaaggatttcttcacaagcggtcataaattggtgagcgaagtcattggagcatctgatctcctgctcctcctgggatcccccgaggagacagcctttagagctaccgaccgcgggagtgaatctgataaacactttcgaaaaggcctactcggcgagttgatcttgctacagcagcagatacaagaacatgaggaggaagcccggcgcgctgctggacagtatagcaccagctacgcacagcagaaacgtaaagtgagcgacaaagagaaaatcgatcagttacaagaagagctgctgcatacccagctgaagtatcagcgcatcctggaaaggttagaaaaagagaataaggaactgaggaaactggtactccagaaagatgacaaaggcattcaccatcgcaaactcaagaagtccctcatagatatgtattctgaggtcctggatgtcctgagcgactatgatgcctcttataacacccaggaccaccttccgcgcgttgtcgtggtgggagatcagtccgcaggcaaaactagcgttctcgagatgattgcacaggcacggatattcccccgcggcagcggcgaaatgatgacaagatcccccgtgaaggtaactctgtccgaaggtccccaccacgtcgcgctgtttaaagattcttctcgggaattcgacttgaccaaggaggaagatctcgctgccctccggcacgaaatcgaactcagaatgaggaagaacgtaaaggagggctgtactgtgtcaccagaaaccatttcgctgaacgtgaaaggccccgggctacagcggatggttttggtagacctccccggggttataaacaccgtgaccagcggaatggcaccagacactaaagagacaattttctccatctccaaagcctatatgcagaatccaaatgctataattctgtgtattcaagatgggagcgttgacgccgagcgttccatcgtgacagacttggtgagccaaatggacccccatggaagacgcacaatctttgtgctcacaaaggtagacctggctgaaaaaaacgtggccagtcctagcaggatccagcagattatcgagggtaagctctttcctatgaaagctttagggtactttgctgtggtgaccggcaagggaaacagttctgagtcgattgaagccatccgagagtacgaagaggaatttttccagaattcaaaactcctaaaaactagtatgctgaaggcccaccaggtgaccacccggaatctgtcactcgcagttagcgattgtttctggaaaatggtgcgtgagagtgtagagcaacaagctgactcgttcaaagccactcgttttaatcttgagactgagtggaagaacaattaccccagattgagggagcttgataggaacgagttatttgagaaggccaaaaacgagatcctggacgaggtgattagcttgagccaggtcactccaaagcattgggaggaaatcctgcagcagtccctgtgggagcgcgtgtcaacacacgttatagagaatatttacctaccagccgcccagaccatgaattccgggacattcaataccaccgtggatattaaactcaagcaatggacagataagcagctgcccaataaggccgttgaggtcgcctgggagactctacaagaggagttctcgagatttatgaccgaacctaaaggcaaggaacatgacgatatttttgataagctgaaggaggctgtgaaagaggaatccattaagcgccataaatggaatgatttcgccgaggactctctgcgtgtcattcagcacaacgcactcgaagacaggtcaataagtgacaagcagcaatgggacgcagctatatactttatggaggaggccttacaagctcggctgaaggacacagaaaatgctatagaaaatatggtcggcccagattggaagaagaggtggctctattggaagaaccgaacccaagaacaatgtgtgcataacgagactaaaaatgaattggaaaagatgctaaagtgtaatgaggaacaccctgcctacctcgcaagcgacgagatcacgactgttcgaaagaatctagagtctcgaggtgtggaggtcgaccctagcctcataaaggacacttggcatcaggtgtatagaagacatttcttaaagaccgctctgaatcattgtaatctgtgtcgcaggggtttttattactaccagcgacattttgtggactctgagttggagtgcaacgatgttgttctgttctggcggatccagcgtatgctagcaataactgccaataccctgcgccagcagttaacaaataccgaggtaagaaggctggaaaagaatgtcaaggaggtcctggaggatttcgctgaagacggggagaaaaaaatcaagctgctgacaggtaaacgggtacaactggcagaggatctcaagaaggtcagggagattcaggaaaaattggatgcctttatcgaagctctacaccaggagaaatag

SEQ ID NO: 127364 - DNA, 2940 bp, Artificial Sequence
  Description of Artificial Sequence: Synthetic coding sequence
atgtggcggctaaggagggctgctgtggcctgtgaggtgtgtcagagtctggtgaaacatagttccggaatcaaaggatctttgccactccagaagttgcacttggtgtccagaagtatctaccactcccatcatccgacccttaaacttcaacgaccccagctcaggaccagttttcaacagttcagtagccttacaaatctccccctcaggaaactcaaattttctcctataaagtatggttatcagcctcgtcggaatttctggcctgcccgtctggcaacacgtctgttaaagctgagatacctgatcctgggctctgccgtgggtggggggtacaccgctaaaaaaacctttgatcaatggaaagacatgatcccagatctgagtgaatacaaatggattgtgccggatatcgtttgggaaattgacgaatacattgattttggccataaactcgtgtctgaagtgatcggcgcctcagacctgctgttgctgctgggatctccagaagagaccgcttttagagctactgataggggaagcgagtcagacaaacacttcaggaagggcttgctgggggagctgattctgttgcagcagcaaatccaggagcatgaggaagaagctcgccgcgctgccggacagtacagtacgagctacgcacagcagaaacgaaaagtttccgataaagagaagatcgatcaattacaggaggaactcctccacactcagttgaaataccagaggatccttgagcgcctcgaaaaggagaacaaggagttgcgtaaactggtgctgcagaaggacgacaaggggattcatcatagaaagctgaagaagtctctaattgacatgtattcggaagtcctggacgtcctttctgactacgatgccagctataacacacaggaccacttgccacgggtcgtagtcgtcggagatcagagcgccgggaaaacatccgtgctcgagatgatagcccaggcgcgcatcttccctcggggcagcggtgagatgatgacacggtcaccggttaaggtgacactctccgaggggccccaccatgtagcactgtttaaggattcctctcgcgagttcgatctgaccaaggaggaggatctggcagctctgcgccacgaaatcgaactacggatgagaaagaatgtgaaagaaggctgtacagtgtctcccgagaccattagtctgaatgtaaagggccctggtctgcagcgaatggttctggtggacctgcccggagtcatcaacactgtaacctccggaatggctcctgacactaaagagaccatcttttcaatctctaaggcatacatgcagaaccccaatgctatcatactatgcatccaggatggctcagtggacgccgagaggtcgatcgtcacagatttagtgtcccagatggatccccatggtaggcgcactattttcgttctgacgaaggtcgatcttgctgagaagaatgtggcttcaccctctagaatccagcagatcattgagggaaagttattcccaatgaaggccttaggttatttcgccgttgtcactggtaagggtaactccagcgaaagcatcgaagctatacgtgagtatgaagaggaatttttccaaaattctaagctgttgaaaacttctatgctgaaggctcatcaggttacaaccaggaatctgagtctcgccgtttcagattgcttttggaagatggtccgagaatccgtggaacagcaggctgatagtttcaaagccacccgctttaacttggaaacagagtggaagaataactaccccagacttcgcgagttggatcgcaacgaactctttgaaaaggcaaagaacgagattctggacgaagtcatcagcttgtcacaggttacccccaaacactgggaagaaatcttacaacagtctctgtgggagagggtttctacgcatgttattgagaacatttaccttcccgcagcacagacaatgaattccggcacctttaacacaactgttgacatcaagctgaaacagtggaccgacaagcagcttcctaataaggcagttgaggtggcttgggaaaccctccaggaagagttttcccgtttcatgaccgagcccaaggggaaggaacacgatgacatctttgacaaattaaaggaggcagttaaggaggagagcattaagaggcataagtggaatgactttgcggaggattcactaagggtaattcagcataacgccctggaagatcgctcgatcagcgacaagcaacagtgggatgccgccatttattttatggaggaagcactgcaagcccgactcaaggataccgaaaacgctatagaaaacatggtcggtccagattggaaaaagcgctggctgtattggaaaaatcgaacgcaggaacagtgcgtgcataacgaaaccaagaatgagctggagaaaatgctcaagtgcaacgaagagcatccagcatatctggcatcagatgagattactacagtgaggaagaatctagaatcgcgtggggttgaggtagaccctagcctgattaaagacacttggcaccaggtctatcgccgtcacttcctgaagactgcgctcaaccactgtaacctgtgccgtagaggattctattactatcagcgacactttgtggactcagagttagagtgcaacgacgtcgtcttattttggcgcatccagcgcatgctcgcgataacagcaaacaccttacgccagcagcttaccaacaccgaggtccgcagattggaaaagaatgtgaaagaggttttagaggattttgccgaggacggggagaagaaaataaaactactcaccggcaaaagggttcaactggctgaggatctgaaaaaggtgcgggagattcaggaaaagctcgacgcttttatcgaagcactgcatcaggagaaatag

SEQ ID NO: 127365 - DNA, 2937 bp, Artificial Sequence
  Description of Artificial Sequence: Synthetic coding sequence
atgtggcggcttcggagagccgcggtggcctgtgaggtctgccagtccctggttaagcattctagcgggatcaagggcagcctgcccctgcagaaactgcacctagtgtctaggagcatataccactcacatcacccaactcttaaactgcaacggccacaactgcgcacatccttccagcagtttagcagtttaactaatctgccactgcggaagctgaaattctctcctatcaagtacggctaccagcctagacgcaatttttggcccgcgcgattagctacacgcctcttgaagctgagataccttattctgggcagtgcagtcggtgggggctacacggctaaaaaaacatttgaccagtggaaagacatgatcccggaccttagcgaatataagtggatcgtccctgacatagtctgggaaatcgatgagtatattgactttgaaaaaatccgtaaagcattgccatcctccgaagatttagtcaagttagctcccgacttcgataagatcgtggagtctctcagccttctgaaagacttttttacaagcggccacaagctcgtctccgaggttatcggtgcttcagacctgctcctgctgctgggaagccctgaggagaccgcatttcgggcaacggatcggggctctgagagtgataagcacttccggaaagtctcagacaaggagaaaatcgatcagctccaggaagaactattacatactcagctgaagtaccagcgcatcctcgagcgcctggagaaggaaaataaggagctgaggaagctggtccttcaaaaggacgataaagggatccatcacagaaagctgaaaaaatcccttatagacatgtactccgaagtacttgacgtgctttcagactatgatgccagttacaacacacaagatcacctcccacgcgtggtggtggtcggcgaccaatccgccgggaaaacatctgtgctagagatgatcgcacaagcacgcattttcccacgtggcagcggggaaatgatgactaggagcccagtcaaggtgactctgagcgagggtcctcaccatgttgctttgtttaaggacagtagccgtgaattcgacttaactaaggaggaggatctagcagccctgcgtcacgaaatagagctccggatgcgtaagaatgtgaaggaaggctgtactgtgtcccccgagaccatcagtctcaatgtaaaggggcctggactgcaacgtatggtcctggttgatctccctggggtgattaacacagtgacatccggtatggctccagatactaaagaaactattttttcgattagcaaagcctatatgcagaaccccaacgccattatcctgtgcatacaggacggttctgtggacgcggagcgctctattgtgactgatttggtctcccagatggaccctcacggccgtcggactatcttcgtgctgactaaagtcgacttagcagaaaaaaatgtggcctccccctccaggatacagcagattatagaggggaaactctttccaatgaaagcgttggggtatttcgccgtggtgacgggtaaaggcaactcgagcgagagcatcgaagcaattagggagtacgaagaggagtttttccagaatagtaagctgcttaagacctctatgctgaaggcacaccaggtaacgacacgaaacctgagtttggctgtctctgactgtttttggaagatggtccgggagtcggtggaacagcaggctgactcattcaaggctacgcgattcaacctagagacagagtggaagaacaactacccgcgcctgagagagctggatcggaatgagctgttcgaaaaagccaagaatgagatccttgacgaggtgatctctctgtcacaggtcaccccaaagcactgggaggaaatcctgcaacaatcactgtgggaacgggtatctacacatgtcattgagaatatctatttgccagcggcccagaccatgaactcaggcactttcaacaccaccgtcgacataaaactcaagcagtggaccgacaagcagcttcccaacaaagctgtagaagttgcctgggagaccttgcaggaagagttctcccgttttatgaccgaacctaaaggcaaagagcatgatgacatcttcgataaactgaaggaggcggttaaggaagaatcgatcaagagacacaaatggaatgacttcgctgaggactccctgcgcgtcatacagcacaacgcactggaggacagatcaatttctgacaagcagcagtgggatgcagccatctatttcatggaggaagcactccaggcccggctgaaagacaccgaaaatgccattgagaatatggtcggaccagactggaagaagcggtggctctattggaagaaccgtacacaagaacagtgcgttcacaatgagacaaagaacgagttggaaaagatgctgaagtgcaatgaggagcaccctgcttacctggcttctgacgagattacaacagttcgaaaaaatttggagagtcggggcgtggaggtggatcccagtttgattaaagacacatggcaccaggtgtaccggcggcatttcctcaaaaccgccttgaaccactgcaacctgtgcagacggggattctattactaccaacgccatttcgtcgattccgaattggagtgcaacgacgtcgtgctgttttggagaattcagaggatgctcgccatcacagctaatacactgcgtcaacaactgacgaacacggaggttagacgactggagaagaacgtgaaagaagtgttggaagattttgcagaggacggcgaaaaaaaaatcaaattgcttaccggcaagcgcgtccagcttgctgaggacctgaaaaaggtacgcgagatacaggaaaaattagatgccttcattgaggccttacaccaggaaaaatag

SEQ ID NO: 127366 - DNA, 2994 bp, Artificial Sequence
  Description of Artificial Sequence: Synthetic coding sequence
atgtggagactgagaagggcagctgtggcctgcgaagtgtgtcagtctttggtgaaacattcgtccggcatcaagggttccttgcccctgcagaaactgcacctggtgtcacggtcgatctatcactctcaccaccctacattgaaactccagcggccacagctgaggacatcatttcaacagtttagttctctaactaatctgcctttgagaaagttaaaatttagtcctattaagtacgggtaccaaccccgccgtaatttttggcctgcccgtctagcaactaggctgctgaaactccgctacttaattttggggtccgccgtgggcggtgggtatacagcaaagaaaacttttgaccagtggaaggacatgataccagacctctcagaatacaagtggatcgtgcccgatatcgtctgggaaattgacgaatatatcgatttcgagaagattaggaaggctttacctagttctgaagatctggtgaagctggcccccgacttcgacaagattgtggaatcactttccctgctaaaagattttttcacaagcgggtccccggaagagacagcatttcgagccacagacagagggtcagaatcggacaaacacttccgtaagggtctgttgggcgaactgattctgctgcagcagcagatccaggagcacgaggaagaagcccggcgggcggcggggcaatacagtacttcttatgcacagcaaaaacggaaagtgagtgataaagagaaaatcgatcaattgcaagaggaactgttgcacacccagttgaaataccagaggatacttgagagactggaaaaagaaaataaagaacttagaaaactagtattgcaaaaagacgataagggcattcaccatcgcaagctgaagaaatctctcatcgatatgtactcggaagtgttggacgtgctttccgactacgacgcatcctacaatactcaagatcatctccccagagtagtggtcgtcggtgatcagagcgcaggtaaaacctcagtattggaaatgattgctcaggcaagaatttttccaaggggatccggggagatgatgactcgctctcctgttaaggtcactctgtcggaggggcctcatcatgtggctctgttcaaggattcctccagagagtttgatctgacaaaggaggaggacttagctgccctgcggcatgagatcgagctgcgcatgagaaaaaacgtaaaagaaggatgcaccgtctcacctgagactatatccctcaatgtgaaaggaccgggactccagcgcatggtgctggtcgacctcccaggcgtgattaacactgtgacgtcaggcatggctcctgatactaaagagacaatcttcagcatatccaaagcctacatgcagaatccaaatgctattatactctgtatccaagatggcagcgtcgacgctgaacgatcgatcgttactgacctggtctcccagatggatccgcatggacgccggaccatatttgttttaactaaggtcgatctggctgagaagaacgtggcaagcccttctagaatacagcaaattatagaggggaaactgtttcctatgaaagctctggggtactttgccgtggtaaccggtaaggggaattcatccgagtccattgaagctattcgtgaatatgaggaggagttctttcaaaatagcaagctgctgaaaacatccatgctgaaagcccaccaagtaacaacccgcaatctcagtctggccgtctctgattgtttctggaaaatggtgcgagaatctgtggagcaacaggcagactccttcaaagcaaccaggttcaacttggaaaccgaatggaaaaataattatccccggttgcgcgaactggaccgcaacgagttgttcgaaaaagcaaaaaatgagatactcgatgaagttatctcactttcacaggtgaccccaaagcactgggaggaaatactgcaacagagcctctgggaaagagtgtcaacccatgtgatagaaaacatctatcttcctgcagctcagactatgaattcaggtacctttaataccaccgtcgacattaagctcaaacagtggacagataaacagcttccaaacaaggccgttgaggtggcttgggagactttacaggaagagttctcaaggtttatgacagagcccaaggggaaggagcacgatgacatattcgacaaactgaaagaggctgttaaggaggaaagcatcaagcggcataaatggaatgacttcgctgaagactcgctgagagtgattcaacacaacgccttagaagatcgcagcatttctgacaagcagcagtgggacgctgccatttatttcatggaagaggcgctgcaggcaagacttaaagacaccgagaatgcaatcgagaatatggtgggcccggattggaagaagcgctggctctactggaagaatagaacccaggaacaatgtgtgcataatgagacaaagaatgaactggaaaagatgttaaaatgcaatgaggaacatcccgcatacttggcctctgacgagattaccacagttagaaagaatctggagtcacggggggtggaagtagatccaagcctcatcaaagatacatggcatcaggtttatcgccgccatttccttaaaacagccctcaaccactgtaacttgtgtaggagagggttctactactaccagagacacttcgttgatagcgaactcgaatgcaatgacgtggtcctcttctggcgaattcagagaatgttagccataactgccaatactcttcgacagcaactgacgaacaccgaagttcgcaggctcgaaaagaacgttaaagaggtgctcgaagacttcgcagaagatggtgaaaaaaagataaaactgctgacagggaaaagagtgcagctggcggaagacctaaaaaaggttcgggagattcaggagaagttggacgccttcattgaagcactgcaccaagaaaagtag

SEQ ID NO: 127367 - DNA, 501 bp, Artificial Sequence
  Description of Artificial Sequence: Synthetic coding sequence
atgtggcgcctgcggagagctgctgtcgcatgcgaggtgtgccagagtcttgtgaaacatagcagcgggatcaagggatcattacctttgcagaagctgcatctggtatctcgcagcatttaccattcgcaccaccctacgctgaagttgcagcgcccacaacttaggacatcatttcagcagttctcctccctgactaacctgcctcttaggaaactgaagttcagtcctataaagtatggctaccaacctcgacggaacttctggccagcacgtcttgctacaagactgctaaagctacgatatctgatcttgggctcagcggtaggtgggggttatactgctaagaaaacttttgaccagtggaaggatatgataccagatctgtccgagtataaatggatcgtgccagacatagtctgggaaatcgacgagtatatcgacttcggatctccagaggagaccgcatttcgggctactgatagaggcagcgagtcctag

SEQ ID NO: 127368 - DNA, 2883 bp, Artificial Sequence
  Description of Artificial Sequence: Synthetic coding sequence
atgtggcgcctgcgccgggcggctgtggcatgtgaggtctgccagtctctcgtgaagcattcctctggtatcaagggctctcttccgttacagaaattgcatctcgtgtccagatccatttatcacagccatcatccaaccctgaagttacagagaccgcaactcagaacctccttccaacagtttagcagtctaacaaatctaccactccggaaactgaaattctctcccattaagtacggctaccagccccgaagaaatttttggcccgccagactcgctacacgtctgctcaaactgagatatctgatcctaggctcagcagttggcggtggatacacagccaaaaagacatttgaccagtggaaagatatgatccccgatctgtccgagtataaatggatagtgcctgacatcgtctgggaaattgatgagtatattgacttcgaaaagataagaaaggcgctcccttcttctgaagatctggtgaagttagccccggacttcgataaaatcgtagagtctctgtcgctgttgaaggacttcttcaccagtgggagccctgaggagacagcgttccgcgcgaccgaccgtggcagcgaatcagataagcacttcaggaaggttagtgataaggagaagattgaccaattgcaagaagagctgctgcacacccagctcaaatatcagagaatattagagagactggaaaaggagaacaaggagctgcgtaagttagttctccagaaagatgataagggcatccaccacaggaaattgaagaagagtttaattgatatgtactcggaagtgctagatgtgctcagtgattacgacgcatcttataatacgcaagaccatctgcctagagtagtcgttgtcggggaccagagtgccggaaagacatctgtattagaaatgatcgctcaggcgcgcatttttccgagaggctctggcgagatgatgactcgatctcctgtcaaggtcacactcagtgagggcccccaccatgtagcactgtttaaagactcatccagggagttcgacctgaccaaagaggaagacctcgccgccctgcggcatgaaatagaactccgaatgcgcaaaaacgtcaaggagggttgcacagtttccccagaaacaatcagcctcaatgtaaagggccccgggctacagagaatggtccttgtggacctgcccggggtaattaatactgtaacatccggtatggcccccgatactaaagaaacaatcttctctatcagtaaggcttacatgcagaaccccaatgccataattctctgcattcaagatggaagcgtggacgcagagagaagtatagtgacagaccttgtgtcacagatggatccgcacggcagaaggactatctttgtgcttaccaaagtcgatctcgccgaaaagaacgttgcctctccttcgcgcattcaacagatcattgagggcaaactctttccaatgaaggctcttggttacttcgccgtcgtcaccggcaagggcaattcaagcgagagcattgaggctatccgtgagtacgaggaagagttcttccagaattctaagctgctgaagacatcaatgctgaaggctcaccaggtgactacccgtaatctatcccttgctgtgtccgattgtttttggaaaatggtgcgggaatccgttgagcagcaggcagactcctttaaggccacccggttcaatctggagacagagtggaaaaataattaccctcgcctgcgcgagctcgatcgcaacgaactgttcgagaaagctaagaatgagatcttggatgaagtgatttccctttcccaggtgacacccaaacactgggaagagatcctgcagcaaagcctttgggaaagggtgagtacccacgtcattgagaatatttacttgcccgcagctcagacaatgaattcaggcaccttcaacacaacagttgatataaaactcaagcaatggaccgacaagcagctccctaataaggcggtggaggtggcatgggagacgctgcaggaagagttttcacgcttcatgactgaaccaaagggtaaggagcacgatgacatttttgataagcttaaagaggcagtcaaagaggagtcaatcaaaaggcataagtggaacgatttcgccgaggacagtctgagagttatacaacacaatgcactcgaggacagatccattagtgacaagcaacagtgggatgcagctatttattttatggaggaggccctgcaggccagattaaaagacactgagaatgctatcgaaaatatggtgggaccagactggaaaaaaagatggttgtattggaaaaaccgcacccaggagcagtgcgtccacaacgagactaagaacgaactagagaaaatgctcaagtgcaacgaggagcaccctgcttacctggctagcgacgagatcacaaccgttagaaaaaatttagaatccagaggcgtggaagtggatcccagtctcattaaggacacgtggcaccaggtctatcgtaggcacttcctcaaaacagcactcaaccattgtaatttatgccgccgaggattctactactatcagcgccatttcgtggacagcgagttggaatgtaacgacgtcgtgctattttggcgaatacagcggatgctggctatcactgcgaacactttgcgacagcagctgactaatacagaggtaagaaggcttgagaaaaacgtgaaggaagtgctcgaggatttcgcggaggacggggaaaaaaaaataaagctgctcaccggaaaaagagttcagctcgctgaagatcttaaaaaggtccgggagattcaggagaagttagacgcttttatagaagccctccatcaggaaaagtag

SEQ ID NO: 127369 - DNA, 558 bp, Artificial Sequence
  Description of Artificial Sequence: Synthetic coding sequence
tgatatctgatcctggggagtgcagttgggggggggtacacagccaagaaaacttttgaccaatggaaggacatgatccccgatctgagcgaatataagtggatcgtcccggacatcgtctgggagattgatgagtatatcgacttcgagaagatcaggaaggcgctgccctccagtgaggacttggttaagctggctcccgacttcgataagatcgtcgagtcactctctctcctgaaagacttttttacgtctggacataagctagtttccgaagtaatcggcgccagtgatctccttttgttgttgggctcaccggaagaaactgcatttcgcgcaaccgatcgcggatctgagtccgacaagcactttcgcaaggttagcgacaaagaaaagattgatcagctgcaagaggagctgctccacactcaactgaagtaccagcgtatactggaaaggttggaaaaagaaaacaaagaattgcggaaactggtgctgcagaaagacgacaaaggaatacatcatcggaagctcaagaagtcactgatcgacatgtag

SEQ ID NO: 127370 - DNA, 540 bp, Artificial Sequence
  Description of Artificial Sequence: Synthetic coding sequence
atggtggtgggtgctttcccaatggccaagctgctgtacctgggcattcgccaggtgtccaagcccctggccaaccggatcaaggaggcggcgaggaggtctgagttctttaaaacctatatctgcctgccccctgcacagctctaccactgggtcgagatgaggactaaaatgcggatcatgggctttcggggaacagtgatcaagcctttgaatgaggaagcggccgccgagctgggggctgagctgcttggcgaagccactatattcatagtgggcgggggatgtctagtgctggaatactggcgacaccaggcccagcagagacacaaggaagaggagcagagagccgcttggaatgctttgagggatgaggtcggacacctcgcgttggctttggaagccctgcaggctcaggtacaggcggctcctccccagggcgctttggaagaactcagaaccgagttgcaggaagtgcgggcacagctctgcaacccagggagatcggcatcccatgcagtacccgcctcaaaaaagtag

SEQ ID NO: 127371 - DNA, 543 bp, Artificial Sequence
  Description of Artificial Sequence: Synthetic coding sequence
atggttgtgggagcctttccgatggcaaaactgctctaccttggaatccgccaagtctccaagcccctcgccaaccgaataaaggaagcggctcggcggtccgaatttttcaaaacctatatttgcctcccaccagcacagctgtatcactggttagagatgagaaccaaaatgagaataatgggatttaatgctgccgctattaaaccgctgaacgaaggcgctgcagctgaactgggggccgaactcctaggcgaaggaatcatcttcattacagcctgttcctgcctcatgctggagtattggaggcatcagctgcagcaacggcgcaaagaaaaggaacgcagagtggctcgggaggctttacgaggggaagtgggtcaccttggcctggcactagaagaattacaagcacaagtacaggcgaccagtactcagcttgccctcgaggagctccgggcccagctgcaggaggtgagagcccatctctgcttacgggacccaccacccgccccacctgttgcacccgcgagcgaaaagtag

SEQ ID NO: 127372 - DNA, 381 bp, Artificial Sequence
  Description of Artificial Sequence: Synthetic coding sequence
atgagaactaagatgcggattatgggattccggggtactgtgatcaaacctctgaacgaggaggctgccgctgagctgggcgccgaactgctgggtgaggcgacaatatttatcgtgggcggcggctgtctcgttctagaatattggcggcatcaggcacagcagagacataaggaagaagaacagcgcgccgcctggaacgctttacgcgatgaggtgggtcaccttgctctggccttagaagctctgcaagcacaggtacaggccgctcctcctcagggagccctggaggagctgcgtactgaactgcaggaggttcgagctcagctctgcaatcccggacgcagcgccagccacgccgtacctgctagcaagaagtag

SEQ ID NO: 127373 - DNA, 1734 bp, Artificial Sequence
  Description of Artificial Sequence: Synthetic coding sequence
atgagtcatcagcctttatcatgcttaactgagaaagaggattcgccctccgaaagcacaggcaatggtccacctcatcttgcccaccccaacctggacacctttactcccgaggagctcctgcagcagatgaaggagttacttacagagaaccatcagctgaaggaagctatgaagcttaacaaccaggcgatgaaagggcgcttcgaagaactgagtgcgtggaccgagaagcagaaagaggaacgtcagttctttgagatccaatcaaaggaagcaaaggaacgtctgatggctctttctcacgaaaatgaaaagttaaaggaagaattggggaaattgaaggggaagagcgagagaagttccgaagatcccacagatgacagtcgactgccacgggccgaagccgagcaggaaaaggaccagcttagaacgcaagtagttcggcttcaggccgagaaagccgacctcctaggaatcgttagtgaactacagctgaaactgaacagttctgggagttccgaagattctttcgttgagattcgcatggcagaaggggaggccgagggctcagtaaaagaaatcaagcactctccagggccaacacggactgtgtccaccggaacggctttgtccaaatacagatcacgcagcgctgacggggccaagaattatttcgaacacgaagagctgactgtgtctcagcttttgttgtgcctgcgcgagggtaaccagaaggtcgagcgccttgaagttgctctgaaggaggccaaagagagagtctctgactttgagaagaaaacaagcaacagaagtgaaatcgagactcagaccgagggcagcaccgagaaagagaacgatgaggagaaaggccctgaaacagtcggcagcgaagtagaggctttgaatctgcaggtgacatccctctttaaggagctccaagaggctcacacaaagctgtcgaaggctgaactgatgaaaaaacgcctgcaggaaaagtgccaggccttggaaagaaaaaactccgcgattccgtcagagctgaatgaaaaacaggagctcgtctacaccaacaagaaactggagctccaagttgagagcatgttgtctgaaattaaaatggagcaggctaagacagaggacgagaagtcgaagttaacagttcttcaaatgacccataacaaattactccaggagcacaacaatgctctcaaaaccattgaggaacttacaagaaaagaatccgagaaggtggaccgggcggtgctcaaagaactttccgagaagctggagcttgccgaaaaagctctggcctccaagcagctccagatggacgagatgaagcaaactattgcaaagcaggaagaagacttggaaactatgactattctgagggctcagatggaagtttattgtagtgactttcatgccgaacgagcggccagagagaagatccatgaggaaaaggagcagctggcactacagctggccgtgctgcttaaggagaatgatgcctttgaagatgggggacgccagtccttaatggaaatgcagtctaggcacggcgcaaggacttctgattctgatcagcaggcttatttagtgcagaggggagctgaggatcgtgattggaggcagcagcgaaacatccccatccacagctgcccaaaatgcggtgaggtactccctgatatagataccctgcaaattcatgtgatggactgcataatctag

SEQ ID NO: 127374 - DNA, 1734 bp, Artificial Sequence
  Description of Artificial Sequence: Synthetic coding sequence
atgtcacatcagcctctttcctgccttactgaaaaagaagactctccatccgaatctactggaaacgggccccctcatttagcccaccccaatctcgacacttttactccagaggagctcctacaacagatgaaagagcttctcactgaaaatcatcagctcaaagaggccatgaaactgaataaccaggctatgaagggaaggttcgaggaactttccgcgtggacagaaaaacaaaaggaggaaagacagttctttgagatccagtcaaaagaagctaaggagcgccttatggccctcagtcacgaaaatgaaaagttgaaggaagagctgggtaaattgaagggtaaatccgagcggtctagtgaggatcccaccgatgactccaggctgccacgggccgaggcagaacaggaaaaagaccagctccgaacacaagtcgtacgccttcaagctgagaaagccgacctattggggatcgtttccgaactccaattgaagctaaacagctctggcagctcagaggactcctttgttgagattcgaatggccgaaggggaagccgagggctcagtcaaggagatcaagcactcccctggacctacgaggacagtatccactggaaccgcactgtcaaaatatagatctcggtcagccgacggggcaaaaaattattttgagcacgaggagctgactgtctctcagctgcttttgtgccttcgtgagggaaatcagaaagtggagagactggaagtggcgcttaaagaggccaaagagagggtatccgattttgagaagaaaaccagcaaccggtccgagattgagacccagactgagggtagcaccgagaaggagaacgacgaagagaaagggccagaaaccgtgggtagcgaagtggaggccctgaacttacaggtcacgtcattatttaaagaactgcaagaggcgcatactaaactctcaaaggccgagctgatgaaaaagcgattacaggaaaagtgccaagccctcgaaagaaaaaacagcgccattcctagcgagctgaatgaaaaacaagagttagtctatacaaacaaaaaactagagttgcaggtagagtccatgctatcggaaatcaagatggagcaggccaaaactgaggacgagaagagtaagctgaccgttctccagatgacacataacaagctgctgcaggaacacaataacgccctgaagacgatcgaggagctgacgagaaaagagagcgagaaggttgatcgggccgtgctgaaggagctttcagagaagctagagctggcggaaaaagcgttggcaagcaagcagcttcaaatggatgaaatgaagcagacaattgccaagcaggaagaagatttagaaactatgacaattctgcgtgcccaaatggaggtgtactgttcagactttcatgcagagagagcagctcgcgagaaaattcatgaggagaaggaacagctggctctgcagttagctgtactgctgaaggagaatgacgcctttgaggacggcggacgacagtcactgatggaaatgcagtcccggcacggcgcgcgcactagcgactccgaccaacaggcataccttgttcagagaggagctgaggatcgtgactggcgccagcagcgtaacataccaatacacagctgcccaaagtgcggcgaagtgttacctgacatcgacacactgcagatacacgtaatggactgcattatttag

SEQ ID NO: 127375 - DNA, 1734 bp, Artificial Sequence
  Description of Artificial Sequence: Synthetic coding sequence
atgtcccatcagccgctgtcatgcctgacagagaaggaagactcccccagcgaatccacaggaaacggacctccgcacctggcacaccctaatctggacacattcacccccgaagagcttctccaacagatgaaggagctgctgacagagaaccatcagctaaaggaagctatgaagttaaacaaccaagcgatgaaggggcgcttcgaggagctgtctgcctggaccgagaaacagaaagaagaacggcagttctttgaaattcagtcgaaggaagcaaaggagcggctgatggctctgagccatgaaaatgaaaagctgaaagaagagctgggcaagttaaaagggaaatccgagcgtagttctgaagaccctactgatgatagccgcctgccaagagctgaagcagagcaggagaaagatcagcttagaactcaggtggtgcggttgcaggccgaaaaggccgatcttctcgggattgtttcggagctgcagctgaagcttaactcatctggctcatcagaagattcgttcgtggagattagaatggcggagggggaagccgaaggtagtgttaaggaaatcaaacactcgcccggaccaacaagaacagtatctacgggaactgcgttgtcaaagtatagatcccgcagcgctgatggcgctaagaactattttgaacacgaagaactgacggtctcccagctgctgctttgcctccgtgaaggtaaccagaaggtagagcggctggaagtggccctgaaggaggccaaggagagagtgagcgattttgaaaagaaaactagcaataggagtgagatcgagactcagacagaaggcagcacagaaaaggaaaacgatgaagagaagggcccggagacggttggctctgaggtggaggccctgaatctgcaggtcacttcgctctttaaagagctccaagaggcccacacgaagttgtccaaagctgagctcatgaaaaagcgcctgcaggagaagtgtcaggctctcgaacgaaaaaattctgccatcccgagcgagctaaatgaaaaacaagagctcgtttataccaacaagaaacttgaactccaggtggagtccatgctctccgaaattaaaatggagcaggctaagacagaagatgagaaatctaagctcactgtgcttcaaatgacccacaacaagctgttacaggaacacaataatgcacttaagacaattgaggagctgaccaggaaggagagcgagaaggtggatcgggcggtattgaaagaactatcagagaagttagaactcgctgaaaaagctttagcgtcaaaacaattgcagatggatgaaatgaagcagaccatcgctaagcaggaagaagacttagaaaccatgacgatcctcagggcacagatggaggtgtactgcagtgattttcacgctgagagagctgcacgggaaaaaattcatgaagaaaaggagcagctggcattgcagctcgctgtcctgcttaaagagaacgacgccttcgaggatggcggtcggcaaagcctgatggagatgcaatcacgccatggggcccgtacttccgactctgatcagcaggcttatttggtgcaacgcggcgcagaggatcgggattggcgacagcaaagaaatattcccatccattcctgtcccaagtgcggcgaggtattgcccgatatcgataccctgcagattcatgtgatggattgcatcatatag

SEQ ID NO: 127376 - DNA, 1716 bp, Artificial Sequence
  Description of Artificial Sequence: Synthetic coding sequence
atgagccatcaacctcttagctgtctgactgagaaggaggattcaccttcagaaagcacaggtaacggcccaccacaccttgcacatccaaatctagatacatttacacccgaagagctgctgcagcagatgaaagagctactgactgaaaatcaccaactgaaagaggctatgaagctgaacaaccaggcaatgaaagggcgattcgaggaactgagcgcctggacagaaaagcagaaggaggagaggcagttctttgagatacagagtaaagaggccaaagagagacttatggccctcagtcacgaaaacgaaaaactcaaagaggagctgggcaagctcaaaggcaagtctgagcggtcatctgaggatccaactgatgatagcagactaccacgggcagaagcggagcaggagaaagatcaactcagaacccaggtagttcgccttcaggcggagaaagcagacctgctcggtattgttagcgaactacagctgaagctgaatagttccgggtcatccgaggactccttcgttgaaatccgaatggctgagggggaggccgagggctcagtgaaggaaattaaacactctcctggacccacccgcactgtcagcacggggacaagcagatcggctgatggagccaaaaactattttgagcatgaagagctgaccgtctctcagctgctgctttgccttcgcgaagggaatcaaaaagtggagagattagaggtggccttaaaagaggcaaaagaaagagtatccgatttcgaaaaaaagacctcgaacaggtcagaaatcgagactcagacggaggggagcaccgagaaagagaatgatgaggagaaagggcccgaaacagtcggaagtgaggttgaagccttaaatcttcaagttacgtccctgttcaaggagcttcaggaggcccacactaagttgtcgaaggctgagctcatgaagaaaaggcttcaggagaaatgtcaggctctggagcgtaaaaactccgccattccgtcagagcttaacgaaaaacaggaactagtgtacacgaacaaaaagctggagttgcaggtagagtcgatgttgtccgagatcaaaatggagcaggctaagacagaagacgagaaatccaaactgacagttttacaaatgacacataacaaactgctccaggagcataacaacgccctgaaaacaatagaagaactgacgcgtaaagagtcagaaaaggtggaccgggccgtgctgaaagagctttccgagaagctggaactggcagagaaagccctggcctctaagcagctgcaaatggacgaaatgaaacagaccatcgcgaagcaagaggaggatctcgagacaatgaccatcctgcgcgctcagatggaggtatattgctcagacttccatgcagagcgggctgcccgggagaagatacacgaagagaaggagcaactagccttgcagttggccgtgttactcaaggagaatgacgcattcgaggatggaggccgccagtccctcatggagatgcagtccaggcatggagcccggacatccgacagcgaccagcaggcttacctggtgcagagaggggctgaagaccgggattggcgtcagcagcggaacattcccatccactcctgccccaagtgtggagaagtgttgcccgacatcgacactctgcagatacacgtcatggattgcattatttag

SEQ ID NO: 127377 - DNA, 1734 bp, Artificial Sequence
  Description of Artificial Sequence: Synthetic coding sequence
atgtcccatcaaccactttcctgtctgactgaaaaggaagatagtccttcagaaagcacagggaatgggccaccacaccttgctcatcccaatctggatactttcacccccgaagagctgctgcaacagatgaaagagctgttgaccgagaatcaccagcttaaggaggctatgaagctgaacaatcaggcaatgaaagggcgtttcgaggaactctccgcttggaccgagaagcagaaggaggagcggcaatttttcgagattcagtcaaaggaggctaaagagcggctcatggcgttgtcccacgaaaatgagaagttgaaggaagagttagggaagctcaagggaaagagcgagagatcaagcgaagacccaactgacgattcaagattacccagagccgaggctgaacaagagaaggaccagctaagaacacaggtagtgcggctgcaggcagaaaaagcggatcttctggggatcgtttcggagctgcaattaaaattaaactcatctggtagcagtgaggactcgttcgtagagatccggatggccgaaggagaagccgagggctccgtaaaagaaattaaacactctcccggtcccacccggacagtgtccacaggcacggctctatcaaaataccgaagcaggagcgccgatggcgccaagaattacttcgagcacgaggagctgactgtgtcgcagttactgctgtgccttagagaaggcaatcagaaagttgagcgcctggaggtggcacttaaggaagcaaaggaacgcgtttccgactttgaaaaaaagacttcaaatcgatcagaaatcgagacacagacagaaggctcaaccgaaaaggagaacgatgaggaaaaaggtcctgaaactgtgggctctgaggtggaagcccttaacctacaggtaacttccctttttaaggagctgcaagaggcccataccaagctgagtaaggccgaactgatgaagaaacggctccaggaaaagtgtcaggccctcgaaagaaagaactctgccattcccagtgaactgaatgagaaacaagagctggtttataccaataagaagctggaacttcaggtagagagtatgctgtctgagattaagatggagcaggcaaagaccgaggatgaaaaatccaaactgaccgtcttgcagatgacccacaataaactattacaggagcacaataatgcactgaagacaatagaggaattgacaaggaaggaaagcgaaaaggttgatagagcagtgcttaaagagctttcggagaagctggaattggccgaaaaagcgctcgcgtccaaacagctccagatggacgaaatgaaacagaccatagcaaaacaagaagaggatttggagaccatgacaattcttagggcccagatggaggtttactgctcagatttccacgccgagcgtgccgccagggaaaaaatacacgaagagaaggaacaactcgcactccaacttgctgtcctcctgaaggaaaatgatgcttttgaggatggcggacgacagtccctcatggagatgcagtcgcgccatggcgctcgcacatctgattccgatcagcaggcatatctggtgcagagaggcgcggaagatagggactggagacagcagcggaacatccccattcactcctgcccaaaatgtggcgaagtccttcctgacatcgacaccctgcagatccacgttatggattgtatcatctag

SEQ ID NO: 127378 - DNA, 1716 bp, Artificial Sequence
  Description of Artificial Sequence: Synthetic coding sequence
atgtcccaccagccattgagctgcctcactgagaaggaggacagtccatccgaatcgaccggcaatggcccgcctcacctcgcccatcctaatctcgacacattcacgcccgaggagctgctgcaacaaatgaaggagctgttaacagagaaccatcagctgaaagaggcaatgaaattgaacaaccaagccatgaaagggaggttcgaagaacttagtgcgtggacagagaagcagaaggaggagcggcagtttttcgagatccaaagtaaggaggccaaggagagactgatggcactgagccacgagaatgagaaactgaaggaagagcttggaaaattaaaaggcaagagcgaacggagtagcgaggaccctaccgacgattcaagacttcctagggccgaggcagaacaggagaaagaccagcttaggacccaggtcgtgcgcctgcaggctgagaaagccgatctgttaggcattgtctctgagctgcagctcaaactgaacagctcggggtccagcgaagatagttttgtagagattagaatggctgagggggaggctgaaggcagtgtgaaagaaatcaaacatagccctggaccgacacgcacggtgagcacaggaacatcccgaagcgcagacggagcaaagaactatttcgagcatgaggagctgaccgtgtcccaacttctactatgtctccgtgaaggaaatcagaaggtggaaaggcttgaggtggcactgaaggaagcaaaggagcgagttagcgatttcgagaagaagacatcaaaccggagtgaaatagaaactcaaacagaggggagcactgagaaagagaacgatgaggagaaagggccggaaacagtgggatcagaggtcgaggcactcaatcttcaggttacatctctcttcaaagaactgcaggaagcgcacactaaactctctaaagctgagctgatgaagaaacggttgcaggagaagtgtcaggctctggagcgtaaaaattcagcgatcccctccgagctcaacgagaaacaggagctggtgtatactaataaaaaattagagctgcaggtggaaagtatgctttccgagatcaaaatggagcaggccaagacagaggacgagaaatctaagctgacggtgttacagatgacacacaataagctgctgcaagaacacaacaatgccctgaagaccattgaagaattgacacggaaggaaagtgagaaagtggaccgcgccgtactaaaagagctgagcgagaagcttgaattggccgaaaaggccctcgcttccaaacagctccaaatggatgaaatgaaacagactatcgctaagcaagaggaggacctggagaccatgactatactacgggcccaaatggaagtgtactgttccgactttcacgccgaaagggccgcacgggagaaaatccatgaggaaaaggagcagctcgctctccaacttgcagtcctcttaaaagagaacgatgcctttgaggacggtggacggcagagcctgatggagatgcagagcagacatggggcacgtaccagcgactctgatcagcaggcctacctcgtgcagaggggtgccgaggaccgcgattggcgtcaacagcgcaatatccctatccactcttgtccgaaatgtggcgaggtcctgccagacattgacacactgcagatccatgtgatggactgtatcatttag

SEQ ID NO: 127379 - DNA, 381 bp, Artificial Sequence
  Description of Artificial Sequence: Synthetic coding sequence
tgaggtgaggctgagggcagtgtgaaggaaatcaaacacagcccaggacctactaggacagtgtccaccggaacagctttgagtaaatacaggagccgcagcgccgatggggctaagaactactttgaacatgaggagcttacagtgtctcagctgctgctgtgccttcgggaagggaatcagaaggtggagaggctagaggtcgccctgaaagaggccaaggagcgggtgtccgattttgagaagaagacatccaacagaagcgagatcgagacccagacagaagggtcaacagaaaaagagaatgatgaagaaaaaggccctgaaacaaccggcttccatcatgttgggcaggatggactggatcttttaaccagctag

SEQ ID NO: 127380 - DNA, 444 bp, Artificial Sequence
  Description of Artificial Sequence: Synthetic coding sequence
atgaagcttaacaaccaggccatgaagggccgcttcgaggagctgtcagcctggactgaaaagcagaaggaagagcgccagtttttcgagattcaaagcaaggaagccaaggaaagactcatggcactctcgcatgagaacgagaagctgaaagaggaactggggaaactcaaagggaagagcgaacggtcttcagaagatcctacagacgacagcagactgccgcgcgccgaggcagagcaagagaaggaccagctcagaactcaagtggtccggctgcaggctgagaaagcagacctgctgggtatcgtttctgaattgcagctcaaactaaactcctccggcagtagtgaagattctttcgttgaaatcagaatggccgagggagaggctgaaggtagtgttaaggaaattaagcactcacccggcccaacccgaacttag

SEQ ID NO: 127381 - DNA, 912 bp, Artificial Sequence
  Description of Artificial Sequence: Synthetic coding sequence
atgcaccccgaaccagcacctcccccatcaaggtcctcccccgagctccctccaagcggcggctcaaccacctctggcagccgcaggtctcgaagacgttcaggggacggcgaacctccgggcgcacctcccccacccccgccaccctcagcggtgacctaccccgattggatcgggcaaagttacagcgaagttatgtccctaaacgagcatagcatgcaggccctatcttggagaaagctgtatctgagtcgcgctaagttgaaggcctcaagtcggacttcggcactgctgtccggattcgccatggtcgcgatggtcgaagtgcagctcgacgccgaccacgactaccccccaggtctgctgatcgcttttagtgcctgcacgacggtactggtggcggttcacctgtttgcgctgatgataagcacttgtattctgcccaatatcgaagcagtgtcaaatgtgcataatcttaatagcgtgaaggaatcacctcatgaaaggatgcatcgccacatagagctggcatgggccttttccactgttatagggaccctcctgttcctcgccgaggtcgttctcttgtgctgggtcaaatttctacctctgaaaaagcaacccggacaaccaaggcccacatcaaagccccccgcttccggcgctgctgccaatgtcagtacatccgggataactccagggcaggcagcggccatcgcttctacaacaataatggtgcccttcggtctgatctttatagtatttgcagtgcatttctatagaagtttagtgtcccacaaaaccgacagacagttccaggaactaaatgaactggcagagttcgctaggctgcaggatcaattggaccatagaggcgaccacccgctaacacccgggtcccattatgcatag

SEQ ID NO: 127382 - DNA, 765 bp, Artificial Sequence
  Description of Artificial Sequence: Synthetic coding sequence
atgtccgccgagctaaatgttccgatcgaccctagtgccccagcttgccccgagcctggacataaggggatggattatagagactgggtgcgaagatcatatcttgagcttgttaccagtaaccaccacagcgttcaagccctgtcatggcgcaagctgtacttgagccgggcgaaactgaaggcgtccagtaggactagtgccctgcttagcggctttgcgatggtagctatggtggaggtgcagttagagactcaatatcaataccctagacctctgttgatcgccttttccgcctgcaccactgtgctggtggctgtgcacctgttcgcgctgctcatctctacctgtatcctacctaacgtggaggccgtttctaatatccacaacctgaattcaatttctgagagtcctcatgagagaatgcacccatatatagaactggcttggggattcagcactgtgctgggcatcctcctgttcctggcagaggtggtactcctgtgctggatcaagtttctccctgtagatgctcgaaggcaacctggtcctcctccaggacccggaagtcataccggatggcaggcagccctcgtgagcaccattatcatggtgcccgtgggattgattttcgtggttttcaccatacatttttatagaagcctggttaggcataaaaccgaaaggcacaatcgagaaatagaggagctccacaagctgaaggtgcagctggacggccacgaacgatccctgcaggtgctatag

SEQ ID NO: 127383 - DNA, 765 bp, Artificial Sequence
  Description of Artificial Sequence: Synthetic coding sequence
atgagcgctgagttaaacgtgcctatcgacccctccgccccggcctgtcctgaaccaggccataagggtatggattatcgcgactgggtccgccgctcttacctagagttggtgacaagcaatcaccacagcgtgcaggcgctaagctggcgaaagctatacttgtcaagagcgaaactgaaggcctcttcaagaacttccgccctcctgtccggattcgctatggtggcgatggtggaagtgcagctagagacacagtatcaatatcccaggcctctgcttatagcattttcagcttgtacgaccgtgctcgtggctgtgcacctcttcgcgctgttgatctccacctgcatccttccaaacgtggaggccgtgtctaatatccacaaccttaactctattagcgaatctccccacgagcggatgcacccttatattgaacttgcctggggattctccactgtcctaggcatcctgttgttcctcgcggaggtggtgttattatgttggattaagttcttacctgtcgatgcccggcgtcaaccggggcctccacctggtcctggcagccacaccgggtggcaggccgctctggtcagcaccattatcatggtgcccgtggggttaatctttgtagtttttacaatccatttctatcgctctctggttaggcacaaaacggagcgccataatcgggagatcgaggaattgcataagcttaaagtgcagctggatggacatgaacggtcactccaggtgctctag

SEQ ID NO: 127384 - DNA, 639 bp, Artificial Sequence
  Description of Artificial Sequence: Synthetic coding sequence
atgagtgccgaactgaacgttcctatcgacccttctgcacccgcctgtcctgagccaggtcacaaggggatggactaccgggactgggtgaggcgaagctatttagaactggtcacatcgaatcatcactctgtgcaggccttatcttggcgtaaattatatctttcaagggccaaactaaaagcttccagcagaacctctgcgttgctgtccggctttgcgatggtggcaatggtggaagtgcagctggagacacagtaccagtatcctcgacccctcctaattgccttttctgcttgcactacagtcctggtggcggttcacctcttcgcgctactgatctcaacgtgcattctgcctaatgttgaggccgtctccaatatccataacttgaattccatatctgaatccccccatgagcgtatgcatccctacatcgagctcgcctggggctttagtacagtgctgggaattttactcttcctcgccgaagtggttctgctctgctggatcaaattcttacccgtggatgccagacggcaacccgggccaccaccaggacccggctcccacacaggctggcaggctgctttggtatctactattattatggttcctgtgggcctgatcttcgtttag

SEQ ID NO: 127385 - DNA, 765 bp, Artificial Sequence
  Description of Artificial Sequence: Synthetic coding sequence
atgagcgccgagctgaatgttcccatagatccatcagccccggcatgccctgagccaggtcacaagggaatggattaccgagattgggtgcgccgctcttacctagaactggttacgagtaatcatcacagcgtccaagcgctttcgtggcgaaaactctacttgagcagggccaagcttaaagcttcttcgcgaacgtctgcattgctgagtggtttcgcgatggtggcaatggtggaagtccagcttgaaacccagtaccaatacccacgacctctgctgatagcattttcagcatgtacgactgttttggtcgccgtgcacctgttcgcactgctgatttctacatgcattttacccaatgtggaggcggtgagcaatattcacaacttgaactccatcagcgagagtccccacgaaaggatgcacccatacatcgagttggcttgggggtttagtacagtgctcggaattcttctgttcttagccgaggttgtgcttctctgttggattaagttcctgcccgtcgacgcccgaaggcagccgggtcccccccctggaccaggatctcacactggctggcaggccgctctggtcagtaccattatcatggtccctgttggactcatcttcgtcgtattcaccattcacttttataggtcgctagtgcggcacaagacagagcgacacaacagagagatcgaggaactgcataaactgaaggtgcagctggatggccatgagcggtctttgcaggtgctctag

SEQ ID NO: 127386 - DNA, 765 bp, Artificial Sequence
  Description of Artificial Sequence: Synthetic coding sequence
atgagcgccgagctcaacgtccccatcgatcccagtgccccagcatgtcctgagcctgggcataaaggtatggattaccgagactgggtgagaaggtcctatcttgagcttgttacatctaaccaccacagcgtccaggcactgtcctggcgaaaactgtacctttctagagccaagctgaaagcatcatctcgcaccagcgccttactttcaggctttgccatggttgcaatggtggaagtgcaattggagacccagtaccagtaccctcggccgctgctgatcgccttctccgcttgcacgaccgttctggtagcagttcatctctttgctttgctcattagcacatgcatccttccgaatgtcgaggctgtctccaacatccataacctgaactctatctctgagtcaccccacgaacgcatgcatccctacattgagctggcatggggtttctctaccgtcctgggtattctcctcttcctggcagaggtggtgttactgtgctggatcaagttccttcctgtggacgcacggcggcagccaggcccccccccagggcctgggtctcacactggatggcaggctgcactcgtgtccaccataatcatggttcctgtgggtctgatcttcgtggtattcactatccacttctatcggtcattggtgcgacataaaacagagcgtcataacagagagatcgaggaactgcacaagctgaaggtgcaacttgatggacacgagcgctcattacaagttctgtag

SEQ ID NO: 127387 - DNA, 93 bp, Artificial Sequence
  Description of Artificial Sequence: Synthetic coding sequence
atgtctgctgaactgaatgtgcccatagacccctccgcccccgcttgcccagagcccgggcataaggggatggattatcgcgactgggtttag

SEQ ID NO: 127388 - DNA, 690 bp, Artificial Sequence
  Description of Artificial Sequence: Synthetic coding sequence
atgagtgcagagctgaatgtgcccattgatccaagcgctccagcttgccccgagccgggccataagggcatggattatagggactgggtcaggcgtagctatctcgagcttgttaccagcaaccaccacagtgtgcaggctctaagctggcgcaagctctatttaagcagggccaagcttaaagcatctagtcggacaagcgcgctcctgagtgggttcgcaatggttgctatggtggaggtgcagctggaaacgcagtaccagtatccaaggccattactgatcgccttttccgcttgtactaccgtcctggtcgccgtgcatctgttcgctctactcatatcgacctgcatcttaccaaacgttgaagcggtgtcaaatattcataacctgaacagtatttccgagtccccccatgagaggatgcatccttacatagagttggcatggggattcagtacggtcctgggaattctacttttcctagccgaggtggttcttctgtgctggatcaagtttctgccagttgatgcgaggcgccagccgggtcccccacctgggccagggagccacacgggctggcaagccgcactggtctcaacaatcatcatggtgccagtgggccttatctttgtcgtttttactatccacttttaccgatcactggtgaggcacaagacagagcgctag

SEQ ID NO: 127389 - DNA, 294 bp, Artificial Sequence
  Description of Artificial Sequence: Synthetic coding sequence
atgagcgctgaactcaacgttcccatagacccttcagcccctgcttgcccggagcccggccataagggcatggactaccgcgactgggtccgtaggagctacctggagctggtcacaagcaatcatcattcagtccaagccctgagctggcggaagctttatctgagtcgcgcgaagctgaaggcgtcatcaaggacatctgcactcctctcaggcttcgcaatggtagcgatggttgaggtacagttagagacccagtatcagtacccccgaccactgctcattgctttctag

SEQ ID NO: 127390 - DNA, 888 bp, Artificial Sequence
  Description of Artificial Sequence: Synthetic coding sequence
atgaagggtggcgaaggcgatgcaggagagcaggcacccctgaatcctgagggcgagtcaccagcaggtagcgccacttatagggaattcgtccatagagggtacctggacctgatgggcgcaagtcagcatagtctgagggctctctcctggaggcgcctctacctgtcacgcgccaagttaaaggcatcgtcacgcacctcagctctgctctccggtttcgcgatggttgctatggtggaagtgcagttagaatcagatcacgaatatccgcccggactgctcgtagctttcagtgcctgcactaccgttctagtggctgtccatctcttcgctcttatggtgtccacttgcttgctaccacatatcgaagctgttagtaacatccacaatctgaattctgtgcatcagtctcctcaccaacggctacatagatatgtcgagcttgcatggggcttcagtacagcacttggcacctttttgtttctggccgaggtcgtcctagttggttgggtaaaattcgtgccaataggcgcacccttggacactcctacacccatggtgcctactagtagggtgccgggtactcttgcccctgtcgccacctccttgtcccctgcctcaaatcttccccgtagctccgcttccgctgcaccttcacaggccgagccggcttgtccacccaggcaggcctgcggggggggaggagctcacggaccaggatggcaggccgcgatggcttcgacagcaataatggttcccgtcggactggttttcgtggcgtttgcgttgcacttttatcggagccttgttgctcacaaaaccgacagatataaacaggagctggaagaactgaaccgccttcaaggagagctccaagccgtgtag

SEQ ID NO: 127391 - DNA, 822 bp, Artificial Sequence
  Description of Artificial Sequence: Synthetic coding sequence
atgaaaggcggtgagggcgatgccggagaacaagctcctctgaacccggagggtgagtctcctgctggttcggccacttacagagagttcgttcacaggggctatctcgatctgatgggagctagccagcattccctgcgggctctctcatggcgaagactttacttgagccgggccaagctcaaggcatctagcagaacaagtgcacttttatcaggattcgcaatggtcgcgatggtcgaagtgcagctggaatctgaccacgagtacccaccagggctgctggtggctttttctgcctgtaccaccgtccttgttgccgtgcacctctttgccctcatggtgagcacatgcttactgccccacatcgaagcagtgtcgaatatccacaatttgaatagcgtgcatcagtcgcctcatcagagactccacaggtacgtggagcttgcctgggggttttcaaccgccttgggcactttcctatttctcgctgaggtagtcctcgtcggctgggtgaaatttgttccaatcggtgcacctctggatacacccacacctatggtgcccacgtccagggttcctgggaccctcgccccagtcgccactagccttagtccagcctctaatctccctcgtagctcagcatccgcagctccaagccaggcagagccagcctgcccccccaggcaggcttgtggaggtggcggggcccacgggcctggatggcaagccgcaatggcttctacattccccggcattttcccaatcagcctttcgttagggttctgtaaattgttatgcacttgggctggcctgtcctag

SEQ ID NO: 127392 - DNA, 414 bp, Artificial Sequence
  Description of Artificial Sequence: Synthetic coding sequence
atggccggatcgcaggacatctttgacgcaattgtgatggcggacgagcgttttcacggggagggatacagagagggctacgaggagggctctagcctcggggtgatggaaggcaggcagcacgggacattgcacggggccaaaatcggtagtgaaataggctgttatcaaggattcgctttcgcttggaaatgcctccttcattcatgcacaaccgagaaggactcacggaagatgaaggtgctcgaatccctcataggaatgattcagaagtttccatatgacgacccaacctacgataagctccacgaagacctcgacaagatcaggggcaagtttaaacagttctgttcattgctcaacgtgcaaccagattttaagatcagtgcagagggatccggcttaagtttttag

SEQ ID NO: 127393 - DNA, 666 bp, Artificial Sequence
  Description of Artificial Sequence: Synthetic coding sequence
atggccgggtctcaagatatcttcgatgccattgtcatggctgacgaaaggtttcatggggagggttatagggaaggctacgaggaaggcagctcactgggagtgatggagggaaggcaacacggcacactccacggagcaaagatcggtagcgagatcggctgctaccagggatttgcattcgcttggaaatgcctactccacagctgtacaaccgaaaaagatagccgaaaaatgaaggttctggaatcgcttatcgggatgattcagaaattcccctatgacgaccctacctacgataaactccacgaagacctcgataaaatacgagggaaatttaagcaaacaggcctcagcccgagtgcagtgatggtgcgtcctccctcatacgtggagcttccagtaacctgctggtgctgggaagcaccacgctgcaatcagaagtgcacagatcctgcagctagacgtccagatcctcagacatgcgcatcccaagatcgcttaagatgcgccccctgtacatgccatcagcccttagcaagccggtacacccaacaccccggcctcgttccactcccccatcatgatagacagtcagtcccgcagggtcccagggtggtccagaccgacgctgcggcccgaatggttgagcagcaaacaatgtag

SEQ ID NO: 127394 - DNA, 414 bp, Artificial Sequence
  Description of Artificial Sequence: Synthetic coding sequence
atggctggtagccaggatatatttgacgccattgttatggcggatgaacggtttcatggcgaggggtatcgtgagggttacgaagagggtagttcgttgggggtgatggagggtagacagcatggcaccctgcacggagccaagatagggtcagaaattggttgctatcagggcttcgcttttgcctggaaatgtctgctacattcatgcacaacagaaaaggattctcgcaagatgaaggtcttagagagtctaatcggtatgattcaaaagtttccttacgatgatcctacgtacgacaagttgcacgaagacttagataagatacgcggcaagttcaaacaattctgctcccttctcaacgtgcagcccgattttaagatttcagctgagggcagcggactctccttttag

SEQ ID NO: 127395 - DNA, 237 bp, Artificial Sequence
  Description of Artificial Sequence: Synthetic coding sequence
atggccgggagtcaggatattttcgatgccattgtaatggccgacgaatctagaaagatgaaagtattagagtcactgatcggcatgatacagaagtttccttatgatgacccgacttacgacaagttgcacgaagacttggacaaaatcagaggaaaatttaagcagttctgcagtttattgaatgtgcagccagactttaagatttccgcggagggttcagggctcagcttctag

SEQ ID NO: 127396 - DNA, 3039 bp, Artificial Sequence
  Description of Artificial Sequence: Synthetic coding sequence
atgatggcccaatcgaatatgtttactgtggccgatgtactctcgcaagatgagctgaggaaaaaactgtatcaaaccttcaaagataggggcattctggatacccttaaaacgcaacttcggaaccagctcattcacgaactgatgcaccctgtactctccggggagctccaaccccgctccatttctgttgaggggtcttcccttttgattggcgccagcaactccttggtggctgatcatctccaaagatgcgggtatgagtattccttgtctgtttttttccccgaatccggtctggcgaaggaaaaagtgttcactatgcaggatctgcttcagcttatcaagatcaacccaacttcaagtctatacaaaagcctggtgtccggatccgacaaggagaaccagaaggggtttctgatgcatttcttgaaggaactggccgaataccatcaagcaaaagaatcttgcaatatggagacccagacctcttctacctttaatcgggattcactcgctgagaaacttcagctgatcgacgatcaattcgccgatgcatacccccaaagaattaaatttgagagcctcgaaatcaagttaaacgaatacaagcgcgagatagaagagcagttacgggccgagatgtgtcagaaactgaaatttttcaaagatacagaaattgccaaaatcaagatggaagctaagaagaagtacgagaaagagctcaccatgtttcagaacgattttgagaaagcatgccaagccaagtccgaggcactggtgctgcgcgagaaatccactctcgagcgcattcacaagcaccaagagatcgagacaaaggaaatatacgcacagcggcagttgctgttgaaggatatggacctcctgagagggagagaagcagagttgaaacagagggtcgaggcttttgagttgaaccagaagctgcaagaagaaaagcataagtctatcacagaggcactacgaaggcaggagcagaatatcaaatcgtttgaggagacctacgatcggaaattgaaaaatgagctgcttaaatatcaactcgagctaaaggacgactatatcattcgcaccaaccgccttatcgaggacgagcgcaagaacaaggaaaaggcagttcacctacaggaggagctaatcgccataaattcaaaaaaggaggagttaaatcagagtgtgaatagagtaaaggagcttgagctggagctggaatctgtaaaagcccaatcgctggcgatcacaaagcagaatcatatgctcaatgagaaagtcaaggaaatgtcagattacagcctgctgaaggaggaaaaactagaactcctcgcccagaataaactccttaagcagcaactggaggagagcaggaatgagaacctacgcctcctgaatcgactggcccagcccgcccccgagctggcagtgttccagaaggaattgcgcaaagctgagaaagcgatcgtagtggaacatgaagagtttgagtcttgccgtcaggcactccataagcagctgcaagatgagatcgagcatagtgcccagctgaaggcacagatcctgggctacaaggccagcgtcaaatctttgaccacacaggtggcggaccttaagcttcagctgaaacagacccaaaccgcgctggagaatgaggtgtactgtaatcctaagcagtccgtcatcgacaggtctgtaaatggcctgattaacgggaatgtggtgccttgtaatggggaaatcagtggggatttcctgaacaaccccttcaagcaggaaaatgttctggcccgaatggtggctagcaggataactaactatcccacagcctgggtggaggggtcaagccccgatagcgatctggagtttgtggccaataccaaagctcgggtaaaggagctccagcaggaggcagagcgccttgagaaggccttccgctcatatcaccgccgcgtcatcaaaaacagtgctaaaagccccttggctgctaaaagtccaccaagtttgcatctgctcgaggcctttaaaaacatcacttcctccagccctgagagacacattttcggtgaggacagggtggtgtccgaacagccacaggtgggaacgctggaagaaagaaatgacgtagtggaagcgctgaccggcagcgcagcctccaggttacggggcggaaccagctcaagacgactatcctcaactcccctgcccaaggccaaacgaagcctggaaagcgaaatgtatctggagggacttggccgctctcacatcgcttcgcctagcccttgccctgatcgaatgcccctgcctagcccaacagagtcgaggcacagcctgtctatcccgcccgtgtcttccccccccgagcagaaggtgggcctctaccgcaggcagacggaattacaggataagtccgaattttcagacgtcgataaacttgcttttaaggacaacgaagagtttgaaagctcttttgagagtgctgggaatatgccccgccagttagaaatgggtggacttagccccgccggagacatgtcacacgtggacgccgctgcagcagccgtacccctaagctatcagcatccgtccgtggaccagaagcaaatagaggagcagaaagaagaggaaaaaattcgtgagcaacaggtcaaagaacgtcgccaacgggaggaacgcaggcaaagcaatttacaggaggttttagagagggagaggagggaactggagaaattgtaccaggagaggaaaatgatcgaggagtcactgaaaattaaaataaaaaaggagcttgaaatggaaaacgagctggaaatgagtaaccaggaaattaaggataagtctgcacatagtgagaatccactcgagaaatacatgaaaatcatccagcaggaacaggaccaggagtccgcagataagagctcaaaaaaaatggtgcaagagggatccctggtcgatacacttcaatcctccgacaaggtagagagtcttacgggcttttcacatgaagagctagacgactcttggtag

SEQ ID NO: 127397 - DNA, 2919 bp, Artificial Sequence
  Description of Artificial Sequence: Synthetic coding sequence
atgatggcccagagcaacatgtttaccgtagcagacgtgcttagccaggacgagttacgaaaaaaattgtatcagacattcaaagatcggggcattctcgacaccctgaagacccagctgcggaatcagcttatacacgagcttatgcaccctgtgttgagtggcgagctgcaacctaggtcaatctctgtcgaaggatccagtctgctgattggcgcctccaatagcctcgtcgcagaccacttgcaacgctgcggatatgaatatagtttgagtgttttttttccggaatcagggctcgcgaaagagaaagtcttcaccatgcaggacctccttcagcttattaaaatcaaccctacgagtagcttgtacaagtctctggtcagtggttcggacaaggagaaccaaaaggggttcctaatgcacttcctgaaggagctggctgaataccatcaggccaaagaaagctgtaacatggaaacgcagacttcctccactttcaaccgtgattcattggctgaaaagctgcaactcatcgacgatcagtttgctgatgcctatccacaaaggattaaatttgagtccctcgagatcaagctgaatgagtacaaaagggagatcgaggaacagctcagggccgagatgtgtcaaaagctgaagtttttcaaggataccgagatcgccaagataaagatggaggccaagaagaagtacgagaaagagctgaccatgtttcaaaatgacttcgagaaggcctgtcaggctaaatctgaagcacttgtactgcgcgagaagagcacccttgagcgaatccataagcaccaggaaatcgaaaccaaagagatctatgcccaaagacagctgttgttaaaggatatggatttgttaagagggcgggaagcagagctgaagcagcgcgtggaggcgtttgagctataccaattggagctaaaggatgactacatcatccgcaccaacaggctaattgaggacgagcgcaagaataaggaaaaggctgtgcacctacaggaagagttgatagcaattaattcaaaaaaggaggagctaaatcaaagtgtaaatcgtgtaaaagaattggagctggagttggaatcagtgaaagcacagtctctcgccataaccaagcagaaccacatgttaaatgagaaagtgaaggagatgtccgactattcccttctgaaggaagagaagctggagctcctggcgcagaacaagctgctgaagcagcagctggaggagagcagaaacgagaacctccgactgttgaataggctcgcccaacctgcccctgaactagcggtgtttcagaaagagctgaggaaggcagagaaggcgatcgtggtcgaacacgaggaatttgagagctgccggcaggccttacacaagcagcttcaagacgaaatcgaacattctgcacagctcaaagctcagatcctgggatacaaagcttcagttaagtccctcacaacccaagtggctgacctcaaactccagctgaaacagacccagaccgcactggagaacgaggtctattgtaatcccaagcagagcgtgatcgatagaagtgtgaatggtttaatcaatggtaatgttgtcccttgcaatggtgagatctcaggagattttcttaataaccccttcaagcaggaaaatgtcttggccaggatggtcgcctctcgaattaccaattaccccactgcctgggtggaggggtcctcacccgactcagacttagaattcgtggcaaatacgaaagctcgcgtcaaagagttgcagcaggaagccgaaaggctggaaaaagccttccggtcataccaccggcgcgttattaaaaattccgccaaatctccactggctgcaaaatctccgccgtcattgcacttattggaggcttttaagaacattacctctagctcccctgaacgtcacatcttcggcgaggaccgtgtcgttagcgagcagccacaagtgggcacgttggaagaacggaatgatgttgtggaagctttgaccgggtctgccgctagtcggctgcgcggcggtaccagtagccgccgcctaagctcgacccctctccccaaggcgaaacgcagtctcgagagcgagatgtatctggagggactgggacgttctcatatcgcttctccatctccgtgccccgataggatgcccctgcccagtccgactgagagccggcacagcctgtctatccctcctgtgtcttccccccccgagcagaaggtcggcctctacaggaggcagacggagcttcaggacaaatccgagttcagcgacgttgataaactcgccttcaaggacaatgaggaattcgagagtagctttgagtctgcggggaacatgccacgccagctagagatgggaggtctgtctcctgctggcgatatgtctcatgtggatgccgcagcggccgctgtgcccctgtcataccagcatcctagcgtcgatcagaaacagattgaggagcaaaaggaggaggagaaaattcgcgagcagcaggtcaaggagcggagacagcgagaggaacggcggcagagcaaccttcaggaagtcttggaaagagagagacgggaactggaaaaactctatcaggaaaggaaaatgatagaagaatctttgaaaatcaagataaagaaggagctggagatggaaaatgagttagagatgtccaatcaggaaattaaggataaatccgcccatagcgaaaatcccctggaaaagtatatgaaaatcatacagcaggagcaggaccaagagagcgccgataagtcttctaagaagatggtgcaggagggatccctggtcgatactctgcagagcagcgataaagtagaatccttgacaggtttctcacacgaagaacttgacgacagttggtag

SEQ ID NO: 127398 - DNA, 2619 bp, Artificial Sequence
  Description of Artificial Sequence: Synthetic coding sequence
atgcacttcctcaaggagctcgctgagtaccatcaggccaaagaatcgtgtaatatggaaacacagacatcttctactttcaacagggattcgctcgcagagaagctgcagttgattgacgaccagtttgccgatgcatacccccaaagaatcaagttcgagagcctggagattaagttaaacgaatacaaaagagagatcgaggagcagcttagagctgaaatgtgtcagaaattaaagttctttaaagatactgaaatcgccaagataaagatggaggccaagaagaagtatgaaaaggagctaacaatgtttcagaacgattttgagaaagcctgccaggctaaatccgaagcgcttgtcctgagagaaaaaagtaccctggaacgaatccataaacatcaagaaatagagaccaaagaaatctatgctcagcgacagctgcttctgaaagatatggatctgttaagggggagagaagccgagttgaagcaacgagtcgaggcattcgagttaaatcaaaaactgcaggaagagaaacataagagcattaccgaggccctgagacggcaagaacagaatattaaatctttcgaggaaacatatgaccgtaagctgaagaacgagttactgaagtatcagctggagttgaaggacgactatatcattagaactaataggcttattgaagatgagagaaagaacaaagagaaggccgtgcaccttcaggaggagctgatcgctataaattccaaaaaggaggaactaaaccagtcagtgaatagggtgaaggagttagagctcgaattagagtctgtcaaggcccaatccctggccatcactaaacagaatcacatgctgaatgaaaaggtgaaagaaatgagcgactattctttgctgaaggaggagaaactggaattgctagcccagaataagctcctaaagcaacagcttgaggagagcaggaacgagaacctaagattgttaaatcgactagctcagcctgcgccggagctggcggtgtttcagaaggagctgaggaaggccgagaaagccatcgttgtggaacacgaggagttcgagagctgtcgccaagccctgcacaagcagttacaagatgagattgagcactctgcccagctgaaagcgcagatcctcgggtacaaagcctcagtcaagtctctgacaactcaagttgctgacctaaagctccaactgaagcagacccagaccgccctggaaaacgaggtgtactgtaatccaaagcagagtgtgatcgacagatctgtaaacggccttatcaatggcaatgtggtgccctgcaacggtgagattagcggtgattttctaaataatccctttaaacaggaaaacgtccttgccaggatggtggccagccggatcacaaattaccctaccgcctgggttgagggatctagcccggacagcgacttggagtttgtggcaaacactaaggcaagggtcaaggaactgcagcaggaggccgagcgccttgagaaggcattccggagttaccaccgtcgcgtgatcaagaactccgcaaagagccccctggcagccaagagccccccttcacttcacctgctggaagcctttaagaacattacctcctcttctcctgaaaggcacatatttggcgaagatcgcgtggtgtcagaacaaccccaggtcggcactctcgaggaaagaaacgatgttgtagaagcactgacgggaagcgctgctagccgactccgcgggggaacgagctcgcgacggctttcctccacacctcttccaaaagcaaagcgaagcctggagtcagagatgtaccttgagggcttgggtaggtcacatattgcttctccatcaccctgtcctgaccgcatgccccttccaagcccaaccgaaagccgccattctctatcaattccgcccgtaagctcaccaccggaacagaaggtcgggctatatagacgacagacggagctacaggataaaagtgagttcagcgatgtggacaagctagcctttaaggacaatgaggagtttgaatcctccttcgagagcgccggaaatatgccccgccagcttgagatgggtgggctatcacccgccggagacatgagccacgtggacgccgccgcagctgcggttccgttgtcctaccaacacccatccgtcgaccagaagcaaatagaagaacagaaagaggaagagaagatcagagagcagcaggtgaaggagcgcagacagagggaggaacgacgtcagagcaacttgcaggaggtgctcgagagggagcggagggaactggagaaactttaccaagagaggaaaatgattgaagaatccctgaagataaagatcaaaaaagagctcgagatggaaaacgagctggagatgtcaaatcaggagattaaagacaagtcagcccacagtgagaaccccctcgaaaaatacatgaagattatccagcaagaacaggatcaggaatctgctgacaaatctagtaagaaaatggtgcaggaaggatctctggtagacactttgcagtcgtctgataaggtcgagagcctcactggattttcacacgaggagttagacgactcttggtag

SEQ ID NO: 127399 - DNA, 1104 bp, Artificial Sequence
  Description of Artificial Sequence: Synthetic coding sequence
atgatggcccaaagcaatatgtttaccgtggctgacgtgctttcccaagacgagctcaggaaaaagctgtatcagacattcaaagacaggggcatcctggacacactgaaaactcaattgcgcaaccagcttatacatgagctgatgcaccctgtgctgagcggcgagctgcaaccgcgaagcatctctgtggagggcagcagcttgttgattggcgcatctaactctctggtcgccgaccaccttcagcggtgcggttatgagtacagtttgagcgtgttttttcctgagagcggtcttgctaaggaaaaggtgtttacaatgcaggatctgcttcagctcattaagattaatcccaccagctctttatataagagtctggtcagcgggtctgacaaagagaatcagaaaggatttttaatgcatttcctgaaggagcttgcagagtaccaccaagcgaaggaaagctgcaatatggaaacacagacaagctctaccttcaatcgcgactctcttgctgaaaaactacagctcattgatgaccaattcgcagatgcttatccacagcggataaagttcgagtcacttgagattaagctgaatgagtataaacgagaaatcgaagaacaacttcgggcagagatgtgtcagaagctgaaattttttaaggacaccgagatcgcaaagatcaagatggaagccaaaaagaagtacgaaaaagagttgacaatgtttcagaatgatttcgagaaggcatgccaggctaaatcagaggcattagtcctgcgtgaaaagagtacactggagaggattcacaagcatcaggagatagaaacaaaggagatctatgcacagagacagctcctactcaaggacatggacctgttacgggggcgggaggccgagttaaagcaacgggtggaggccttcgaactgaatcagaagctgcaggaagaaaagcacaagtctatcacggaagctctccggagacaggaacagaatattaaatcattcgaggaaacctatgaccgtaagctcaaaaacgagctcctgaacttccaccgtttgcacggagtgtgtctggctctgggtattctgatctag

SEQ ID NO: 127400 - DNA, 1017 bp, Artificial Sequence
  Description of Artificial Sequence: Synthetic coding sequence
atggtctttttgtgtatcttcaaggagctggccgaataccaccaagccaaggaatcgtgtaacatggaaacacagacaagctctaccttcaaccgggacagcctcgccgagaagctccagctcatcgatgaccagttcgctgacgcctaccctcagaggatcaagttcgagtctctggagatcaagttaaacgagtacaagagagaaatcgaggaacaactgcgtgctgaaatgtgccagaagctcaaattcttcaaggacacagaaatcgcaaaaatcaagatggaggctaaaaaaaagtatgagaaagaactgaccatgttccagaatgactttgaaaaagcttgccaggcaaaatccgaggctttggttcttcgcgagaagagcactttagagagaatccataaacatcaggagattgaaactaaagagatctacgcccagcggcaacttctgctcaaggacatggacctcctcagaggtcgcgaggcagaactgaagcaaagggtggaagccttcgagctgtatcagctggaactcaaggacgattacatcatccgcacaaaccgcctcattgaggacgagaggaagaacaaggagaaggcggtccacctgcaggaggagctcattgccattaactcaaagaaggaggaactcaatcagtcagtgaatcgtgttaaggagctggaactagagctcgaatccgtcaaagcccaatctctcgccatcaccaagcagaatcatatgctcaacgagaaggtcaaggagatgagcgactattcattgctgaaagaagaaaagctggagttactggcacagaataaactgctgaagcagcaactggaggaatccaggaacgagaacctgcggctgctaaatcggctggcacagcccgcccccgagcttgccgtttttcagaaagagctgcggaaggcagaaaaggcgattgtggtggagcacgaagaattcgaaagttgccgtcaggcattgcataaacaacttcaagacgagccctag

SEQ ID NO: 127401 - DNA, 2586 bp, Artificial Sequence
  Description of Artificial Sequence: Synthetic coding sequence
atggctcattacccgacccgactcaaaactaggaagacttatagttgggtgggcagacccctgctcgaccgcaagctacactaccagacctatcgcgagatgtgcgtcaagactgaaggatgctctacagagatccacattcagatcggtcagttcgtccttatagaaggcgatgacgatgaaaacccctacgttgccaagcttctcgagttgttcgaagatgatagcgatccccctccgaaaaagcgtgcccgggtccagtggttcgtacggttctgcgaagtgccggcgtgcaagcgccatctgctgggcaggaaacctggggcccaagaaatattttggtacgactatccagcctgtgacagtaatattaacgctgaaaccatcattgggctcgtgagggtgatcccgctggctcctaaagacgtggttccgacaaacttaaaaaacgagaaaaccctgtttgttaaactgagctggaacgaaaagaagtttcggcctctctctagtgagctcttcgccgagctgaacaaaccccaggagagcgcagccaaatgccaaaaaccagtgcgggcgaaatccaaaagcgccgagagcccgtcctggactcccgccgaacacgtcgctaagagaattgaaagccgccatagtgcttccaaaagccgacagacacctacacacccattgacaccccgcgccagaaagcggcttgagttggggaatctgggcaatccccagatgagccagcagaccagctgcgcttccctcgatagcccaggccggatcaaaagaaaggtcgccttttccgagattacctccccaagtaaaagatcccagcctgacaaactccagaccctgagccccgcacttaaggccccagagaagacaagagaaaccgggctgagctacaccgaagatgataaaaaggcatcccctgaacaccgcatcattcttcgaacacgtattgctgccagcaaaactattgatatacgggaagagaggacactcacaccgatcagtggaggccagaggagctctgtggtgccctccgttatcttgaagcctgaaaacatcaagaagcgggacgcaaaggaagccaaggctcagaacgaggcaacctccactccccacagaattcgtcgtaagtcctctgtactgacgatgaaccgcatacgtcaacagctgaggttcctcggcaacagtaaaagcgatcaagaggagaaggagatccttccagctgctgagatctctgattcaagcagcgatgaagaagaggcttcaaccccccccctgccaagaagagctccgcgcactgtgtcacgaaatctgagatcctcgttaaagtcctctctgcacacattgactaaggtgccgaagaaatcactcaagccacgcacgccccgctgtgccgccccgcagattaggagcagatctctggcagcacaggagcctgctagtgtgctcgaggaggctcggctcagattacatgtaagtgccgtgcctgaaagcctgccctgtcgggaacaggaatttcaggatatttacaatttcgtagagtccaagctgttagatcacaccggggggtgtatgtatataagcggggtgcccggtactggtaaaaccgcaactgtccatgaagtcattaggtgtctgcaacaggcggcccaggccaatgatgtgcccccctttcagtacatcgaggtcaatggcatgaaactgacagaaccacaccaggtgtatgtgcaaatcctccagaaactcacgggccagaaagcaactgccaaccatgcagctgaactcttggccaagcaattttgcacccgcgggagtccacaggagacaaccgtcctgctcgtcgatgagctcgatctgttatggacacataaacaagatataatgtacaatctcttcgattggcccactcacaaagaggcccgactcgtggtcctggctatcgctaatactatggacctgcctgagaggattatgatgaatagagtctctagcaggttgggtctgacaaggatgtgctttcagccctatacttacagccagctacagcagattctgcgaagtagacttaagcatctgaaagccttcgaggatgatgcaatccagttagtggcccggaaggtcgccgcgctgagcggcgatgcgaggagatgcttggacatctgcagacgggcgacggagatttgcgagttttcgcagcaaaagcccgattcacccggcctcgtaacgattgcccactctatggaagcagtggacgagatgttcagttcttcatacatcaccgccattaagaattcgagcgtactagagcagtctttcctccgtgccatccttgctgagttccgtcggtctgggcttgaggaagccacgtttcagcagatatacagccaacatgtcgccctgtgtcgcatggaaggattgccatatcctacaatgtcagagaccatggccgtctgctctcacttaggttcttgtagattgctcctggtcgaacctagtcgaaacgatctgctgctgcgggtgaggttgaacgtgtcccaggatgatgttctgtacgcacttaaggacgagtag

SEQ ID NO: 127402 - DNA, 2586 bp, Artificial Sequence
  Description of Artificial Sequence: Synthetic coding sequence
atggctcattaccctacccgcctgaagacccgaaagacttatagttgggtaggtcgccctttattagatagaaagcttcactaccagacctatagagagatgtgtgtcaagaccgaggggtgtagcacagagattcatatacagatcgggcagtttgtcttgatagaaggcgatgacgacgagaatccatatgtagcgaagctactggaattgtttgaggatgattccgaccctccacccaaaaagcgggctcgtgttcaatggtttgttcgcttctgcgaggtacctgcctgtaagagacacttgctaggtaggaagcctggcgcccaagagattttttggtatgattatcctgcctgcgacagcaatatcaacgcagaaacgattattggcctggtcagagtgattcccctcgctccaaaagacgtggtacccacaaatctgaagaacgaaaaaacactctttgtcaagctgagctggaacgaaaagaaatttagacccctgtccagtgaactgtttgccgagcttaataaaccgcaggaaagtgccgctaaatgccagaagcctgtacgcgcgaagagtaagagtgcagagtcaccatcttggacccccgctgagcacgtggctaaaagaattgagtcgcgacacagcgcttctaaatcgaggcagactcctacccacccactgactcctcgggcgcgcaaacgtctggaactgggcaaccttggtaatccacaaatgtcgcagcagacatcctgtgcttccctcgactctcctggaagaatcaaaaggaaggtggccttttctgagattacttcaccatccaaacgctcgcagcctgacaagttacagaccctctctccagctctaaaggcgcctgaaaagaccagggagacaggacttagctatacagaagatgacaaaaaggcttcaccggaacacaggatcatactcagaactcggatcgccgcttcgaagaccatcgacatccgcgaggagcgaaccttgactcctatcagtggggggcagcgctcaagcgtggtgccgtccgtgatattgaaaccagaaaatattaagaaaagagatgctaaggaggcaaaagcccagaatgaggcgacctctacaccccacagaatccgcaggaaaagctctgtcctgacaatgaatcggattcggcagcagcttcgctttcttggaaactcaaagtcagaccaggaagagaaggagattctgcctgctgcagaaatttccgacagcagctcagatgaggaagaggcatctactccccctctcccgaggcgggcaccacggacggtgagtagaaatttgcgaagctctttaaagagcagcctgcacaccctgactaaggtccctaagaagtccttaaagccaaggaccccaaggtgtgcggcccctcagattcgctcccggagcctggccgctcaggagccagcaagcgtgttggaggaggctaggcttcgcctgcatgtgtcggccgtgccggagtcactgccatgtcgagagcaggagttccaggatatctacaattttgtggaaagtaagttgttggaccacacaggcggctgtatgtatatcagtggagtgcctggtacggggaaaactgccaccgtgcacgaagtgatacggtgtctccagcaggccgcacaagcaaacgacgtgcccccctttcagtatattgaggttaacggcatgaaactgaccgagccacaccaggtctatgttcagatactacaaaaactgacgggacagaaagctaccgccaaccacgcagctgaactgctggcgaaacaattttgcactagaggtagtccacaggaaaccaccgtgctgctggtcgatgagctggacctgctctggactcataagcaggatattatgtacaatctgtttgactggccaacacacaaagaggcccgtctggtggtgctcgccatcgcaaacacgatggatctgccagaacgaattatgatgaatagagtgtcaagtcgccttggactgactagaatgtgtttccagccgtatacttactctcagttgcagcagattctgagatccaggctcaagcacttgaaggcatttgaagacgacgccattcagctagtggctcggaaggtggctgctctgtccggcgacgctcggcgctgcctggacatatgtagacgtgcaaccgaaatctgtgagttcagccaacaaaagccggattccccggggctggtaacgatagcccacagtatggaagctgtggatgagatgtttagctctagctacattactgccattaaaaacagctctgtattagaacagtcctttctaagggctatccttgcggaattcaggcgctcagggttggaggaagccactttccaacagatttactctcaacatgtggcactgtgtaggatggaaggcctcccttacccaaccatgtcagaaacgatggccgtctgttcacatctgggaagctgtcgactactgctcgttgagccctcccggaatgatctgctactgcgagtccgactgaacgtctctcaggatgatgtcctttacgcactgaaagatgaatag

SEQ ID NO: 127403 - DNA, 1599 bp, Artificial Sequence
  Description of Artificial Sequence: Synthetic coding sequence
atggagaagtctaacgaaacgaacggctatttggatagcgcccaagctggccctgccgccggcccaggagcccccggcaccgctgccggaagggccagacgctgcgcaggattcctgcgaaggcaagccctggtgttacttactgtttctggcgtgttggcaggtgcaggcttgggggccgccctcagaggtctgtcgctctccaggacacaggtcacatacctcgcctttcccggggaaatgttactgcggatgctaagaatgatcattcttcctcttgttgtgtgttcactagtgtctggggcagccagtttggatgcgtcctgtcttgggagactcggtgggattgcagttgcgtacttcggcctcaccacactgagtgcatccgccctcgccgtggccctcgcttttatcatcaagcccggctctggcgctcagaccctgcagagtagcgacctgggattggaggactccggtccgccgccagtgcccaaagaaacagtggactctttccttgacttggcccggaatctttttccatccaatctggtcgttgccgccttccgaacctacgctactgattataaggtggtgacacagaactccagtagcggcaatgtgactcatgaaaagattcccataggcaccgagatcgaaggaatgaatattttaggattggtcctcttcgccctggtgttaggcgtcgccctgaagaagctggggagcgagggggaagacttaataaggttctttaacagcctgaacgaagcaactatggtgctcgtctcatggataatgtggtacgtccccgtaggtatcatgttcctcgtggggtcaaaaatagtagaaatgaaagacatcattgtgttagtgacttcattgggcaaatatatattcgctagtattctagggcatgtcatccatggaggcatcgttcttccattgatctacttcgtcttcacaaggaaaaaccctttccggtttctgctgggccttctcgccccctttgccacagcattcgcaacctgttctagttctgccaccctgccttcaatgatgaagtgtatcgaagaaaacaatggtgttgataagcggatttctcgcttcattctgccgataggggccactgtaaacatggacggcgcagcgatcttccagtgcgtcgcagctgtctttattgcgcaactgaacaatgttgaattgaatgctggacagattttcacgattctggtgaccgccacggcctcatcagtaggcgcagctggagtcccagcaggtggggtcctgacgattgcaatcattcttgaagcaataggcttgccgacccacgacttacccctcatccttgctgttgattggatcgtggaccgtacaaccaccgtggtaaatgtggagggggatgccctaggtgcaggaattctacaccaccttaaccagaaagccaccaagaagggggaacaggagctggcggaagtaaaggtggaggccatccctaactgtaagtctgaagaggagacgtcacctctggtgacccaccagaatccagcgggcccggttgcatccgcccccgagttggaatctaaggagtctgtgctctag

SEQ ID NO: 127404 - DNA, 330 bp, Artificial Sequence
  Description of Artificial Sequence: Synthetic coding sequence
atgagcaagcccgaacttaaggaggacaaaatgctcgaagttcatttcgtcggcgatgatgacgttcttaaccatattctggatcgggaggggggcgcgaagctgaaaaaggaacgggctcagctgctggttaacccaaaaaaaatcataaaaaagcctgagtacgacctggaggaggacgaccaggaagtgctaaaggatcagaactatgtggaaataatggggagagacgtgcaagaatcactcaaaaacggatctgcgacgggcggaggcaataaggtgtactccttccaaaaccggaagcacagcgaaaagatggccaaactgtag

SEQ ID NO: 127405 - DNA, 219 bp, Artificial Sequence
  Description of Artificial Sequence: Synthetic coding sequence
atgagtaaacctgagcttaaggaagacaagatgcttgaggtacacttcgttggcgatgacgatgtattaaaccatatcctcgatagggagggcggcgctaaattgaagaaggagcgagcacagcttctggtgaatcccaagaaaatcattaagaagccagagtatgatctggaggaagacgatcaggaggttctgaaagatcagaactatgttgagtag

SEQ ID NO: 127406 - DNA, 2139 bp, Artificial Sequence
  Description of Artificial Sequence: Synthetic coding sequence
atggctacgagtagcatgagcaaaggctgcttcgtgtttaagcctaatagcaagaagagaaaaatcagcctccctatagaggactattttaacaagggaaagaacgaacccgaagattcaaagctgagatttgaaacatatcagctcatctggcagcagatgaaatcggaaaatgagcggctgcaggaagaactgaataagaatctgttcgacaacttgatcgagtttctccagaagtcccactcagggtttcagaagaactctcgagaccttggcgggcagattaaactgagagaaatcccaacagctgcgctggtgctcggcgtcaatgtgacagaccatgatctgacatttgggagtcttacagaggctctccaaaacaatgttactccatacgttgtgagcctgcaggccaaagattgccctgatatgaagcactttctgcagaaactgatctcacagctgatggactgttgtgtcgacattaagtcaaaagaggaagagtctgtgcacgtgacacagcgtaagacccactacagcatggattcactctcatcttggtacatgaccgtgacccagaaaactgaccccaagatgctgtccaaaaagaggacaacctcctcacagtggcagtccccccccgttgtggtcatattgaaggacatggaatcgtttgccacaaaggtgttgcaagactttataattatctcctctcagcacctgcacgaatttcctctcattcttatattcggcatcgcaaccagtccaatcatcatccatcgcctgctcccccatgctgtgagctctctgctgtgtatagagctcttccaaagtctttcttgtaaagagcacctgactactgtgctggacaaactgttgcttacgacccagtttccattcaagatcaacgaaaaagtgctccaggtcctgacgaatatctttctgtaccatgacttctcggtccagaatttcatcaaaggcttgcagctgagcctgctcgagcacttttacagtcagccactctctgtactgtgttgtaatctacccgaggcaaagcggcggatcaacttcctatctaacaaccagtgcgagaatatccggagattgccatctttccggcgttacgtggagaagcaagcttctgagaagcaggtggctcttcttaccaacgagcggtatctaaaggaggagacacaactattgctggagaatcttcatgtgtatcacatgaactattttctggtgcttcgctgtttgcataagtttacctcttccctgccaaaatatcctctgggaaggcagatacgcgagctgtattgtacttgcctcgaaaaaaacatatgggattccgaagagtacgcctccgtgctgcagttactgcgcatgctcgcgaaggacgaactgatgactattctcgagaagtgtttcaaagtgttcaaaagctactgcgagaaccacctcgggagcacggccaaaaggatcgaggagttcttagctcagtttcagtcactcgacgccgaaaccaaggaagaggaagacgcctccggctctcagcctaagggactgcagaagaccgacctgtaccatctgcagaagtcccttctggagatgaaggagctgagaagatccaagaaacagaccaaatttgaagtgctgcgggagaatgttgtcaattttattgattgtctcgtccgggagtatctcctgccaccagagactcagcctctccatgaggtggtttacttctcagcagcccacgccctgcgggaacacctgaatgcggcccccagaatagcgcttcacacggccctgaataacccctactactatctcaagaacgaagcccttaaatccgaagagggctgcatcccaaatatcgcacctgatatctgcattgcgtacaagttgcacctcgagtgttctagactgattaatctagtcgattggagtgaagcttttgcaacggtagttaccgcagcggaaaaaatggatgcaaatagtgccacttctgaagagatgaacgagattatccatgcaagatttattcgggctgtgagcgagctcgagctcctgggcttcattaaacctaccaagcaaaaaacagaccacgtggctagactgacttggggaggttgctag

SEQ ID NO: 127407 - DNA, 2136 bp, Artificial Sequence
  Description of Artificial Sequence: Synthetic coding sequence
atggcgacatcttctatgagcaaaggttgcttcgtattcaagcctaacagtaagaagagaaaaatctcccttcctattgaggattattttaacaaaggaaaaaacgaacccgaggattctaaacttaggttcgagacgtaccagcttatttggcagcagatgaaatccgaaaatgaacggctgcaagaagagctgaacaaaaacttgttcgataacctcatcgagtttctgcagaaaagccattccgggtttcagaagaactcccgggaccttggaggtcagattaaattacgagagattcctactgcggctttagtactcggagtgaacgttacagaccatgatcttacgtttggttctcttaccgaagccctccagaataatgttacaccctacgtcgtgtccctgcaggctaaggactgtccagacatgaagcattttctgcagaagctcatatcccagctgatggattgctgcgtcgacattaaaagcaaagaggaagagagtgtgcacgttacgcagaggaagacacattattccatggacagtctttcaagttggtatatgacggtaacccagaaaaccgaccccaagatgttgtccaagaagcgtacaacatcaagccaatggcagtcaccccctgttgtagtcattttgaaagacatggagagcttcgccaccaaggttttacaggactttataatcatctcgtcccagcaccttcacgaattcccactgatattaatcttcgggatcgccaccagccccatcatcatccatcgcttgctgccccatgcagtttcctctctgctgtgcattgaactgttccaaagcctttcttgcaaggagcatctgacaactgtcctggataaactcttactgactacacagtttccctttaagatcaatgagaaggtcttacaggtgttgacaaatatttttctgtatcatgactttagcgtgcagaactttatcaaagggctccagttgtctctcctcgaacatttttacagccagcccctgtctgttttgtgctgtaatctcccagaagctaaacggcgtatcaacttcttatccaataaccagtgcgaaaacattcgaaggcttcccagcttccgcagatatgtagagaaacaggcctccgagaagcaggtggcattactgacgaatgagcggtacctgaaggaggagacacagttgctgttggaaaacctgcatgtttaccacatgaactactttctggtgctccgctgtctgcacaagtttacgtcaagccttcctaaatatcctcttggcaggcagatcagggaactgtattgtacctgtctagagaagaacatctgggatagcgaggagtatgcttcagtccttcagctgttacgaatgctcgccaaagatgaactgatgactattctcgaaaagtgtttcaaagtgttcaagtcatactgtgagaatcatctcggcagcacggctaaacgcatcgaagaatttctggctcagtttcagtctttggacgagaccaaggaggaggaggacgcttctgggtcacagccaaaaggcctgcaaaagactgatttatatcaccttcagaagtccttgttagagatgaaggagcttaggaggtcaaaaaagcagacaaagttcgaggtgctgcgtgagaacgtggtgaactttattgattgtcttgtccgagagtatttgttgccacctgagacccaacctctgcatgaggtcgtgtacttttccgccgcacatgccctccgggagcacctgaacgcggctcctcgcattgctttacataccgccttaaataacccttactactacctgaagaatgaagctctgaaatcagaagaggggtgtattcctaacattgcacccgacatttgtatcgcctacaagctgcacctggagtgtagccgcctgatcaatctggtggattggtctgaggcatttgcaacggtggtcactgcagccgagaagatggacgcaaactcagcgacctctgaggagatgaatgaaattattcatgcccgctttatcagagcggtatcagagcttgagcttttgggctttattaagcccaccaagcagaagaccgaccacgtggcacggctcacatggggcggttgctag

SEQ ID NO: 127408 - DNA, 1335 bp, Artificial Sequence
  Description of Artificial Sequence: Synthetic coding sequence
atgaagtctgagaacgagaggcttcaagaggagcttaacaaaaacttgtttgataacctgatagagtttctgcaaaaatcacacagtggcttccagaagaactcccgcgaccttggaggccagatcaagctgagggagattcctactgcagcacttgtgctgggcgtgaacgtaactgatcatgacctgacctttggatcactgacagaagcgttacagaataatgttaccccctacgttgtctcacttcaggccaaggactgtccggatatgaaacatttcttacagaaactgatcagccagcttatggactgctgtgtcgatattaaatccaaagaggaagaatccgtgcatgtgacacagagaaaaactcactacagcatggattccctgagctcttggtacatgactgtgacacagaagaccgacccaaagatgctctcaaaaaagaggactacatcttcccagtggcagtccccacccgtggttgtgatcctcaaggacatggagtcatttgccaccaaggttctgcaggactttataattatctcaagccagcatctgcatgagtttccgctcatcctaatctttggaattgctacatcgcctatcattatccaccgtctactgccccacgctgtttccagcctcctgtgcattgagctgtttcagtccctaagctgcaaggagcatttgacaactgtgctagacaagttactccttactacccaattccccttcaaaattaacgagaaagtcctacaggtcctaacgaacatctttctttatcacgatttctctgttcagaacttcattaagggcctgcaactctctctactagagcatttttattcacagccactgagcgtgttgtgctgtaacctgccagaggccaagcgcaggatcaactttctcagcaacaatcagtgcgagaatatacgaagactccctagcttcaggagatacgtggagaaacaggccagcgagaaacaggttgcactgctgacaaacgaacgctatctaaaggaggaaactcaactgctcctcgagaaccttcacgtctaccatatgaattacttcctggtgttgcggtgcctgcataaattcacctcttccctgcccaaataccccctcggtaggcaaattcgagagttgtattgcacatgtctggaaaaaaatatatgggacagcgaggaatatgcatctgtgctccagctactgaggctcgggcttgcctttttggacatccagctgttcggtgctcagtctgggcaagaactactgctgcccctatcctgggaggccaacccttctcacgccgctaatctgggatag

SEQ ID NO: 127409 - DNA, 1707 bp, Artificial Sequence
  Description of Artificial Sequence: Synthetic coding sequence
atgaagcacttcctacaaaagctgatctcccagctgatggactgttgcgtggatatcaagagcaaggaggaggaaagtgtccacgtcacgcagcggaagactcattatagcatggactctctgtcaagctggtatatgactgtcacccaaaagaccgatccaaaaatgttgtctaagaaacggacaaccagcagccaatggcaatcacctccagtggtagtgatcctcaaagatatggagtctttcgccacaaaagttctgcaagacttcattattatttcttctcagcaccttcacgaattccctttgattctgatcttcgggatagccacatccccaattatcatacataggctattaccccatgcagtgagttcattattatgcattgagctgttccagtccctgtcttgtaaggaacatctaactacagtgctggacaagctcctgcttacaacccagttcccctttaagattaatgagaaagtgctccaagtgttaactaacattttcctgtatcatgacttttccgtgcagaactttattaaaggccttcagttgtctctgctggaacatttctattcccagcccctcagcgtcctgtgttgcaatttgcctgaggcaaagcgcaggatcaatttcctgagcaataaccagtgtgagaacattagacggctgccttcattccgcaggtatgtggaaaagcaggcatccgaaaaacaagtggccctgctcaccaacgaacggtacctaaaagaagagacacagctgctgctcgaaaacctgcatgtctatcacatgaactattttctggttcttaggtgcctgcataaattcacctcctcgctcccaaagtatccgctgggccgccaaatccgtgagctatattgcacttgccttgagaagaacatatgggacagtgaggaatatgcaagcgtgctgcaactgctccggatgctcgcaaaggacgagcttatgacaatcctggagaaatgcttcaaggtctttaaatcttactgcgagaaccatctaggctccacagcaaagaggatcgaggagttcttagctcagtttcagtcacttgatgaaactaaggaagaggaggatgcctccggcagccagcctaagggcctgcagaaaacagatctataccacctgcagaagtctttactggagatgaaagagttgcgacgatcgaaaaaacagaccaaatttgaggtactccgcgaaaacgtggtgaatttcatcgactgtttggttagggagtacctgcttccacctgagactcagcccctccatgaggtggtttacttcagcgcagcgcacgcactgcgcgagcacctaaacgcggcccctcggattgcactgcatacagccctcaataacccttactattatctcaaaaatgaggccctcaaatccgaggagggttgtatacctaacatcgcccctgatatctgtatcgcatacaagctacacctggagtgttcacggctgataaacctggtcgactggagcgaagctttcgccactgtcgtgactgctgccgagaaaatggacgccaacagcgccacctcagaggaaatgaatgaaatcattcacgctcgttttatcagggctgtgagtgaacttgagctgctggggtttatcaaacccaccaagcaaaaaactgaccacgttgcgaggctcacctggggcggctgttag

SEQ ID NO: 127410 - DNA, 1311 bp, Artificial Sequence
  Description of Artificial Sequence: Synthetic coding sequence
atgtcctccagaaagagcaagtccaatagcctaattcacactgagtgtttatcacaggtccaacggatcctgagggaaaggttctgcagacagtctcctcattcaaacctttttggcgttcaggtccagtataaacatttgtccgagctgttgaaacgtaccgcactacatggagaaagcaacagcgtgttgatcatcggaccccggggaagcggcaagaccatgctgatcaaccatgccctgaaggaattgatggaaatagaggaggtttctgaaaatgtgctgcaagtgcatcttaacggcctcttacaaatcaatgacaaaattgctctgaaagaaataacccggcagttgaatctggagaacgtcgtgggtgacaaagttttcgggtcgttcgccgagaatctgtccttcctcctagaggccttaaagaagggagatcgcacgtctagctgccccgtgatctttattctggacgagtttgacttgtttgcccaccacaagaatcagacactcctgtacaacctatttgatatttcccagagtgcccagacaccaatcgcagtcatcggcttgacttgccgactggatatcttggagctcctggagaaaagagtgaaatcaaggttctcccaccgccagatacatcttatgaactcctttgggtttccacagtatgtgaaaattttcaaagaacaactgagtctccctgcagagttccctgataaagtgttcgccgaaaagtggaatgaaaatgtccaatatctttctgaggaccggagtgtgcaagaagtgcttcaaaagcacttcaacatttccaagaatctgcggagtctgcacatgctcctcatgctcgcattaaacagggtgaccgccagtcacccattcatgacagcagtggaccttatggaggccagccagctctgctctatggacagtaaggccaacattgtgcacggactgtcggtactggagatctgtttgataattgccatgaaacatttaaacgatatatacgaggaggagcctttcaattttcagatggtttacaacgagttccaaaaatttgtgcagagaaaagcacattccgtctacaattttgagaaacccgtggttatgaaggccttcgagcacctgcagcagctggaactcattaagcccatggagcgtacatcgggcaatagccagagagaatatcaactgatgaagcttttgctcgacaatacccagattatgaacgccctgcaaaaataccctaattgtcctacggatgtccgccagtgggctacatcttccttatcttggttgtag

SEQ ID NO: 127411 - DNA, 1311 bp, Artificial Sequence
  Description of Artificial Sequence: Synthetic coding sequence
atgtcatctaggaaatctaaatctaattccctgattcacacagagtgtctctcgcaggtgcaacggattctccgtgaaagattttgtagacaatctcctcatagcaacctgtttggagtccaagttcagtacaaacatctgtctgagctgttgaaacggaccgctctgcatggagagtcaaactccgttctcattattgggccccgcggttctggcaaaaccatgctgattaaccatgctctcaaggaactcatggagatcgaggaggtctctgagaacgtgctgcaggtgcacctgaatggcctcctgcagattaatgataagatcgccctgaaggagatcacccgtcaactcaacctggagaacgttgtaggagacaaggttttcggctcctttgctgaaaacctaagctttctcctggaggcactgaagaagggcgatcgcactagctcatgcccagtcatctttattctagacgagtttgaccttttcgcccatcataaaaatcagactctactgtacaatttatttgatatcagccagtccgcccagacacctatcgccgtcattgggctgacctgtaggctcgacattcttgagctgctcgaaaagagggtgaagtcccggtttagccaccggcagatccatttgatgaactctttcgggtttccgcagtatgtgaagatattcaaagaacaactttctcttccagcagagttccccgacaaggtctttgcggagaaatggaatgaaaacgtacagtacttgtcagaggacaggagtgtccaagaagtactgcagaagcatttcaacatatccaagaacctgcgctccctccacatgctgctgatgctagcactgaacagggtaaccgcatcccatcctttcatgacggcagtggaccttatggaagcaagccagctctgctctatggatagtaaggctaatatcgtgcacggcctgtcggtgttggaaatctgcctgatcattgccatgaagcatctcaatgatatatacgaggaggaacccttcaactttcagatggtctataatgaattccaaaaattcgtccagagaaaggctcactcagtttacaactttgagaagcctgtggtgatgaaggccttcgagcatcttcagcaactagaattaataaagcctatggagaggacctctggtaattctcaacgggaatatcagcttatgaagctgttattggataacacacaaattatgaatgccttgcagaagtacccgaattgccccactgacgtgcggcaatgggctacctcatccctgtcttggctttag

SEQ ID NO: 127412 - DNA, 1311 bp, Artificial Sequence
  Description of Artificial Sequence: Synthetic coding sequence
atgagttctagaaagtccaaaagcaactcactcatccacaccgagtgtctttctcaggtgcaaaggatcctccgcgaacgcttctgcaggcagtcccctcactccaatttgttcggcgtccaggtccagtataaacacctatccgagcttctgaaacgtacggctcttcatggcgagtccaattcggtcctcatcatcgggcctaggggttcaggaaagactatgttaatcaaccacgccttgaaagaactgatggaaatcgaagaggttagcgagaatgtgctgcaggtgcatctgaatggactgcttcagattaatgacaagatcgcccttaaggaaataacgagacagttgaacctggaaaacgtcgtgggagacaaagtcttcggatcttttgctgaaaacctctcattccttctcgaggctctgaagaagggcgacaggacctcatcctgtccagtcatctttatcttagatgaatttgaccttttcgcccaccataaaaaccagaccctgctgtacaacctttttgacatttctcagtccgcacagactcccatcgcggtaatcgggctgacttgccgactcgatatcctggaacttctggagaagcgcgtcaaatcaaggttctcccacaggcagatccatctgatgaactcattcggttttccccagtacgtgaagatctttaaggaacagctgtctctgcctgctgaatttcctgacaaggtattcgctgagaaatggaatgagaatgtgcaatacctgtcagaggaccgctcagtccaggaggtgctccaaaaacattttaatataagtaaaaaccttcggtccctccatatgctgcttatgctggccttgaacagggttactgcttcacaccccttcatgacagccgtggacctcatggaggcaagccagctttgttctatggatagtaaagccaatattgttcatggtttaagcgtgctagagatctgcctcatcattgccatgaaacatctgaacgatatctacgaggaagaaccatttaactttcaaatggtctacaatgaattccagaagtttgttcagcgcaaggcacactctgtatataatttcgaaaaaccagtggtaatgaaggcctttgaacacctacaacagctggaactaataaagcccatggaaaggacttcgggtaactcacagagagaatatcagctcatgaaactgctgttggataatacacaaattatgaacgctctccagaaatacccaaattgtcccaccgacgtcagacaatgggcaacaagcagcctgtcgtggctctag

SEQ ID NO: 127413 - DNA, 438 bp, Artificial Sequence
  Description of Artificial Sequence: Synthetic coding sequence
atgagttcacgcaaatcaaaatctaactcacttattcacacggaatgtctctcccaggtgcaacggatcctccgggagagattctgtcggcagagccctcactccaatctgtttggggtgcaagttcaatacaagcatctgagtgagttgcttaaacggacggccctccacggggagtcgaactctgtgttgatcatcggcccacggggttctggaaaaacaatgttgatcaatcacgccctgaaagagctgatggaaattgaagaggtctcagaaaacgtccttcaggtgcatctaaatgggctcctccagatcaacgacaaaattgcactcaaggagatcactcggcagctcaatttggaaaatgtcgtgggtgacaaagttttcggctcttttgccgaaaacctgagctttttactagaggccttgaagaagtag

SEQ ID NO: 127414 - DNA, 384 bp, Artificial Sequence
  Description of Artificial Sequence: Synthetic coding sequence
atgtcttcccggaagtcaaagtccaattccctgatacatacggagtgcctgtcacaggtgcagcggatcctacgagagagattttgtcgtcagtctccacacagcaacctgttcggcgtgcaagtacagtataaacacctcagcgaacttctgaaacggactgcactgcacggcgaatccaattcggtgttaatcataggacctaggggatctgggaaaaccatgcttatcaatcacgctctgaaagaactgatggagatagaggaggtcagtgagaatgttctccaggtgcatctaaacggcctgttgcagataaacgataaaatagcactcaaggaaatcaccagacaactcaaccttgaaaacgtcgtcggggacaaatag

SEQ ID NO: 127415 - DNA, 387 bp, Artificial Sequence
  Description of Artificial Sequence: Synthetic coding sequence
atgagttcccgcaagtctaagtctaatagcctgatacacacggaatgcctgtcccaggtgcagaggattctgcgagaacgattctgcagacaatccccacattctaacctcttcggtgtccaagtccagtataaacacttgtcagaacttctcaagagaaccgccttgcatggtgagtccaactccgtgcttatcatcggcccaagggggtcagggaagacaatgctcattaaccacgccctgaaggagctgatggagatagaggaggtgtcagagaacgtgcttcaagtgcatcttaacggcttgctacaaatcaacgacaagattgcattgaaagagatcacccggcagctgaatctggagaatgtggtaggcgataaagtgtag

SEQ ID NO: 127416 - DNA, 1311 bp, Artificial Sequence
  Description of Artificial Sequence: Synthetic coding sequence
atgtcatcccgaaagagtaagagcaatagtcttatccataccgagtgtttgagtcaggtccaaagaatccttcgagagagattttgtcgacagagcccacatagcaatctgttcggagtgcaagtgcagtacaaacatctgagtgagttactcaaacgtacagccctccacggcgaatcaaattccgtcctgattataggtcctagaggcagcggtaagaccatgctcataaatcatgccctgaaagagctcatggaaattgaggaagtgtcagagaacgtgctgcaagttcacctgaacggtctgctgcagattaacgacaagatcgctctcaaggagattactagacagctcaacctcgagaacgtcgttggcgataaagttttcggatcctttgccgagaatctgtcgttcctgcttgaagcactgaagaaaggggatcggacctcctcgtgcccagtgatctttatcttagatgagttcgacctctttgcccaccacaaaaaccagacgctcctgtacaacctgttcgacattagccagtccgcacagacacccatcgctgtgatcgggctcacttgccgcttggacattctggagctgttagaaaaaagagtgaagtcacgcttttcgcaccgccagatccacctcatgaacagcttcgggttcccacagtacgtgaagatttttaaggagcaactgtcgcttcccgctgagttccctgacaaggtattcgccgagaaatggaacgaaaacgtccagtatttgtcggaggacaggtcagttcaggaagtgctccaaaaacattttaatatctcaaaaaacttacgctctttgcatatgttgctaatgctcgccctgaaccgtgttaccgcctcacacccatttatgacggctgtcgatctgatggaggctagtcagctgtgtagcatggacagtaaggcgaacatcgtacacgggctgtccgttttggagatttgtcttatcatcgccatgaaacacctgaatgacatctatgaggaggagcctttcaacttccagatggtttacaacgaatttcaaaaatttgtccagcgcaaagcccattctgtatacaattttgaaaaacccgtagtgatgaaagccttcgagcacctgcaacagttagaattgatcaaacccatggagcgtacttccggtaactcacagagggaataccagttaatgaaactgttattggataacacgcaaattatgaacgcgcttcagaagtacccaaactgtcccactgacgtccgtcagtgggctacttccagcctgagctggttatag

SEQ ID NO: 127417 - DNA, 1059 bp, Artificial Sequence
  Description of Artificial Sequence: Synthetic coding sequence
atggaaatcgaggaggtctcagaaaacgttctccaggtgcacctgaatggtttacttcagatcaacgacaaaattgcgctcaaggaaatcacacggcagctgaatctcgagaacgtagttggggataaggttttcggaagtttcgctgagaacctgtcttttttactcgaagccctcaaaaagggcgataggacctctagctgccccgtgattttcatccttgatgagtttgatctgttcgcccatcacaagaaccaaacgctgctctacaatttgtttgatatttcccagagtgcgcagactcccattgcagtcatcggtcttacatgccgcctggacatcctggaattactggaaaaaagggtcaagtcacggtttagtcaccgacagatccacttgatgaacagcttcgggttcccccagtacgttaagatctttaaggaacagcttagcctgcccgcagagttccccgacaaggtttttgcagagaagtggaacgagaacgtgcagtatctttcagaagatagatcagtgcaggaggtgctgcagaagcactttaacatttccaagaatctgcgatccctacacatgctgctcatgctagccctcaaccgcgtgaccgcatcacatccctttatgacagctgtggacctgatggaggcatcgcagctgtgctctatggactcaaaggccaatatcgtgcatggcctgagcgtccttgagatctgtcttatcatcgccatgaagcatctcaacgacatttacgaggaagagccattcaattttcaaatggtgtacaacgagttccagaagttcgtgcagcgtaaggcccattccgtctacaatttcgaaaaaccggtggtgatgaaggccttcgagcacctgcagcaattagagctgatcaaaccgatggagaggacctccgggaattcccagagagaatatcagctgatgaaactgctgttggacaatacccaaattatgaacgcgctccagaaatatcccaattgccccacggatgtgaggcagtgggctacgagttcactgagctggctgtag

SEQ ID NO: 127418 - DNA, 1089 bp, Artificial Sequence
  Description of Artificial Sequence: Synthetic coding sequence
atgctgattaatcatgccctaaaggagctgatggaaatagaagaagtctccgagaatgtgctacaggtgcacttaaatggcttgctccagattaacgacaaaatcgctctgaaagaaatcactagacagctgaacctggaaaacgtggtgggggataaagtctttggtagttttgctgagaatctgagcttccttctcgaggccctcaaaaagggcgataggaccagcagctgcccagtgatattcatcctggacgaattcgacctttttgcccaccataagaatcagacactgctgtacaacttgttcgatatttctcaatccgcacagacccccatcgccgtgattggtctgacatgtcggttggatatcttggaactgttggagaagcgggttaaatcccgcttctcacacagacagatccacctgatgaattctttcggtttcccacaatacgtgaagattttcaaagagcagctgagtctgccagctgaattccctgataaagtcttcgcagaaaaatggaatgagaatgtccaatatctttctgaggatcgatctgtgcaggaggtgcttcagaagcattttaacatctctaaaaatttgagatctctgcatatgctacttatgctagcactcaacagagtgaccgcctcccatcctttcatgacagccgtggatctgatggaagctagtcaactgtgtagtatggattctaaagccaacattgtgcacgggctgagcgtgctggaaatctgcctgatcattgctatgaagcatctgaacgatatctatgaggaagaaccattcaactttcagatggtgtacaatgaatttcagaagttcgtgcagagaaaagctcattcagtttacaactttgagaaacccgttgtcatgaaggctttcgagcacctgcagcagttggagcttatcaagcccatggagcgaacctccggcaacagccagcgggagtaccagctcatgaaactgctcctggataatactcagatcatgaacgcacttcagaaatacccaaactgtccgaccgacgtgagacaatgggcgacatcaagcctgtcctggttgtag

SEQ ID NO: 127419 - DNA, 660 bp, Artificial Sequence
  Description of Artificial Sequence: Synthetic coding sequence
atgaacagcttcgggttcccccaatatgtcaaaatcttcaaagaacaactgagccttccagccgaattccctgataaggtgtttgccgagaaatggaacgagaatgtgcaatatctcagtgaagaccgctctgttcaggaagttctgcagaaacactttaacatctccaaaaatcttaggtccttgcacatgctgctgatgctggccttgaatcgcgtgaccgctagtcatccattcatgactgctgtcgatctgatggaagcatctcagctctgctccatggacagtaaagctaacatagtgcacggcctttcagtcctggagatctgcctgataattgctatgaaacaccttaacgatatctatgaagaagagcctttcaattttcagatggtgtacaacgagttccaaaagttcgtgcagagaaaggcccattcagtatacaactttgagaagcctgtggtgatgaaggccttcgagcacctgcagcagcttgagttgataaaacctatggaacggaccagtgggaactcccaacgagaatatcagctgatgaagctcctcctggataacacccagataatgaacgcactgcagaagtatcctaattgcccaactgatgtgcgtcagtgggcaactagttcattatcatggttgtag

SEQ ID NO: 127420 - DNA, 1308 bp, Artificial Sequence
  Description of Artificial Sequence: Synthetic coding sequence
atgccccatctcgaaaacgtggtgctctgcagggaaagccaggtgagcatcctccagagcttatttggcgaaagacatcacttctcctttccaagcatcttcatttacggccacacagccagcggcaaaacctatgtcacccagaccctcctgaaaaccctcgagcttccgcatgtgttcgtgaactgtgtcgagtgttttactcttcgtctactgctcgagcagatcctgaataagttaaatcatttgtctagcagtgaggacggctgctctactgagattacatgtgaaacctttaatgattttgtgcggctctttaagcaggtcacaaccgcggagaatttaaaggaccagaccgtgtacatcgtgctggacaaggctgagtatctgagagatatggaagcaaacctgctgccagggtttctgcggctgcaggagctggcagaccgaaacgtgactgtcctgtttctcagcgaaatcgtatgggagaaatttaggcctaacacaggatgctttgagccgtttgtcctctacttcccagactactcaatcggaaatctgcagaagatcctgagtcacgaccacccaccagagtacagcgcagacttctacgccgcttacatcaacattctgcttggcgtcttttacaccgtgtgccgcgatctgaaggagcttaggcatcttgcggtgctcaactttccgaaatattgtgaacctgtggttaaaggagaggcgtcagaaagagatacaaggaaactctggcgaaatattgaaccacacctgaaaaaggctatgcagactgtgtatttgcgggaaatctcttcctctcagtgggagaaactccagaaggacgataccgacccaggccagctgaaaggactctccgcgcacacacacgttgagctgccttactatagcaaatttatattgattgccgcctatctggcctcttataaccctgccagaacagacaagcgtttctttctgaagcaccacggcaaaatcaagaagaccaacttcttaaagaagcacgagaagacttctaatcacctcctagggcccaagccctttccattagatagacttctggccattttgtattctatcgtggactcccgcgtggcaccaaccgcgaacatctttagtcaaatcacctctctggtaactctgcagctgctgacactggtcgggcacgacgaccagttggatgggcccaagtataagtgtaccgtgtccctcgattttatccgcgccatagctcggactgtgaactttgacatcattaaatatctgtatgactttctgtag

SEQ ID NO: 127421 - DNA, 975 bp, Artificial Sequence
  Description of Artificial Sequence: Synthetic coding sequence
atgccacatctggagaacgtggtgctctgcagagaaagccaggtaagcatcctccagtccctctttggcgagcgacatcattttagctttcctagcatttttatctacgggcacacagcctccggaaaaacctatgtcacgcagacattgctgaagacactcgaactgccccatgttttcgttaactgtgtggaatgcttcactctcagacttctgctcgagcagatcctgaacaagctgaatcacttgtcatcttcagaagacggttgcagtaccgagatcacctgcgagacattcaatgatttcgttcgacttttcaagcaagttaccacagcagaaaacttgaaggaccagactgtgtacatcgtgctagacaaagctgagtacctccgagacatggaggcgaatctgttacccggattcctccgcctgcaggaactggccgacagaaacgtgaccgttttgttcttgtctgaaattgtgtgggagaagtttaggcccaacacgggctgttttgagccctttgtgctgtacttcccggattactctatcggcaacctgcaaaaaattttatcacacgatcacccccctgagtactctgccgatttctacgccgcctacattaatatcctgctgggggtgttctatacagtatgccgggatttgaaagagttgcgacatctggctgttttgaactttcccaaatattgcgaaccggtggttaaaggcgaggccagtgagcgggacacaagaaagctgtggaggaacatagaaccccacctgaaaaaggcaatgcaaaccgtgtaccttagggaaatctccagtagccaatgggagaagctgcagaaagatgatacagatcccggccagctaaaaggaattcgtggcagtatcgaaaccgtcaccggcgacactagctccgctaattatcaggatacaaaggtgaataccaaggaacactcagtcagaaagtag

SEQ ID NO: 127422 - DNA, 912 bp, Artificial Sequence
  Description of Artificial Sequence: Synthetic coding sequence
atggaagctaatctcctccccggtttcctcaggctacaagaactggctgaccgaaacgtgaccgttttattcctctcagagatcgtctgggaaaaattcaggccaaataccggatgtttcgagccgttcgtactgtacttccccgactactctatcggcaatctgcagaaaatcttgtcccatgaccatccccctgaatattcagccgacttttacgctgcatacatcaacattctattgggtgtattctatacggtgtgtcgggatctgaaggaactccgccatctggcagtactgaatttccctaagtactgtgaacccgtggtgaagggcgaggcatctgaacgcgacacacggaagttatggcgcaacattgagccgcatctaaaaaaggctatgcagactgtgtacctccgagaaatctcgtcgtcccagtgggagaagctgcagaaggacgacactgaccctgggcaactgaaagggttaagcgctcacactcacgtggaactgccctattactcaaaatttatcttaattgcagcctacctggcctcctacaaccctgctcggacagacaagcgcttcttcctgaagcatcacggcaaaataaaaaaaacaaacttcctgaagaagcatgagaaaactagcaaccatttgctcggccctaagccctttcctttagatagactgttggccatcttgtatagtatcgtggattctagggtggcacccacagcaaatatcttctcacaaatcacctccctcgttactctgcagttactcactctcgtgggacacgacgatcagctggatggacccaaatataagtgcacagtgtccctcgatttcatccgggccatcgcgcgaactgtgaacttcgacataataaaatatctctacgacttcctgtag

SEQ ID NO: 127423 - DNA, 1665 bp, Artificial Sequence
  Description of Artificial Sequence: Synthetic coding sequence
atgtctgctgacggcggtgggatccaagacacacaggacaaggagaccccacctgaagttcctgaccgagggcatccccatcaggagatgccctctaaactgggcgaagcggtcccatccggtgacacacaagagagcctccacattaagatggaacccgaagaaccccatagcgagggagcatcacaagaggatggtgcacaaggagcttggggatgggccccactttcccacggttccaaggaaaaggcactgttccttcctgggggagctctgccgagcccccgaatccccgttctgtcccgggagggaaggacccgcgatcggcagatggccgcggcattattgacagcttggagtcagatgcccgtgacgtttgaggatgtggccctctatctatccagggaagagtggggcagactggatcacactcagcagaacttctatcgcgatgtattgcaaaagaagaacggactttccctgggctttcccttctctaggcctttctgggccccgcaggctcacggcaaaggagaggcgagcggaagcagtagacaggctggggacgagaaggagtggcgcggagcgtgcacaggcgccgtcgaggtcggccagagagttcagacctcatcggtggcagctctcggcaacgtgaagccctttcggacacgggccggccgggttcaatggggggtgcctcagtgcgcccaggaagctgcgtgcggacgctcaagcggccccgccaaggactccggccaacccgccgagcccgacaggaccccggacgcggctccgccagatccctcccccacagaaccccaagaatatcgagtgcctgaaaagcccaatgaagaggaaaagggggcgcccgagagtggcgaagaggggcttgccccagactctgaggtaggcaggaaatcttatcgctgtgaacagtgtggcaagggattttcttggcactcccacctggtaactcataggagaacccacacaggggagaaaccttatgcttgcactgactgcggcaagcgattcggaagatcatcccacctcatccagcatcaaatcatccacacgggtgagaagccatacacttgcccagcatgccgcaagagcttcagtcaccacagtacactgatccagcaccagcgcatccacaccggagagaagccatacgtgtgcgaccgctgcgcaaaacgcttcacaaggagaagtgacctggtgacacatcagggcactcataccggggccaagccccacaagtgtccaatatgcgcaaagtgttttacacagtctagcgcactagtgacacatcagcgcacgcacacaggggtgaagccttatccatgccccgagtgcggaaagtgtttttcccaaagatcgaatctgatcgcacacaatcggacccatactggcgagaagccctatcattgcctggattgtggtaagtctttcagtcatagtagtcaccttacagcccaccagaggacgcacagaggcgtgagaccatatgcctgtcctctctgcgggaagagcttcagccgaagatccaacctacaccgccatgagaaaatccacacgacaggcccgaaagccctggcgatgctgatgctcggggctgcagccgccggcgcccttgcgaccccacccccagccccaacctag

SEQ ID NO: 127424 - DNA, 462 bp, Artificial Sequence
  Description of Artificial Sequence: Synthetic coding sequence
atgaatgtgggcgtggctcacagtgaagtcaatccaaatacgagggtgatgaacagccggggcatgtggttgacctatgcactgggcgtgggtctgctccacatagtgctgcttagcataccattcttctctgtaccagtcgcgtggaccctgactaacattattcacaacctggggatgtacgtgttcctgcacgccgtgaaagggacgcccttcgaaaccccggaccaggggaaagcaagacttctgacacactgggaacagctcgactatggcgtacagttcacaagttccaggaagtttttcaccatctctccaatcatactttatttcttggcctcgttttataccaagtatgatccgacgcattttatactgaacactgcatccttgctctcagtgttaattcctaaaatgcctcagctgcatggcgtgcgaatttttggtatcaataagtactag

SEQ ID NO: 127425 - DNA, 462 bp, Artificial Sequence
  Description of Artificial Sequence: Synthetic coding sequence
atgaatgtcggagtggcccattctgaggtgaaccccaacacccgcgtgatgaatagtcgcgggatgtggctcacatacgccctgggagtcggcctcctgcatatcgtcctcttaagtattcctttttttagtgtgccagtcgcttggactcttactaacatcattcataacttgggaatgtatgttttcttgcatgctgtgaaggggactccatttgagactcccgatcaaggaaaagcccgactgctgacccactgggaacagttggattatggcgttcagttcacgtccagcaggaaattttttactataagccccatcatcctgtatttcctggccagcttttataccaaatacgatcccactcactttatccttaacactgcctccctcctgtctgttcttattccaaagatgccacagcttcacggcgttagaattttcggcatcaataaatactag

SEQ ID NO: 127426 - DNA, 462 bp, Artificial Sequence
  Description of Artificial Sequence: Synthetic coding sequence
atgaacgtaggcgtggctcattcagaggtcaaccccaacactcgtgtgatgaatagtcgcggcatgtggttgacatacgctctaggagtgggtctactgcacatagtcctgcttagcattccgttcttctcagttcccgtcgcatggacgcttaccaacatcatccacaacctgggcatgtatgtgttcttacatgctgtgaaagggacccctttcgagaccccagaccagggcaaagctagactgctgacacattgggagcagctggactacggggtccagtttacatcttctagaaaattcttcactatatcccctataattctttacttcctcgcaagcttttacacgaaatatgaccctacccactttatcttgaataccgcatctctcctgagcgtgctcatcccaaagatgccccagcttcacggagtccgaatcttcggtattaacaagtattag

SEQ ID NO: 127427 - DNA, 330 bp, Artificial Sequence
  Description of Artificial Sequence: Synthetic coding sequence
atgaatgtgggagtagcgcatagcgaagtcaatcccaacacgagagttatgaattcccggggcatgtggttaacatatgcactcggtgtggggctgctccacatcgtgctgcttagcattccttttttctcagttcccgtagcttggacgctgaccaatatcatccataatctggggatgtacgtgtttttacatgccgtgaagggtacaccgtttgagacacccgatcagggaaaagcacgtctcctcacacactgggaacagttagattatggtgtgcaatttacttcatcccgaaaattctttacaatttcgcctattatcctttag

SEQ ID NO: 127428 - DNA, 330 bp, Artificial Sequence
  Description of Artificial Sequence: Synthetic coding sequence
atgaacgtgggcgtggcccattccgaggtaaacccgaacaccagagtgatgaacagtagaggcatgtggttgacatatgccctgggagtcggattgttacacatagtgctactttcaatcccctttttttctgtacctgtggcctggacgctgacgaacatcatacataatctggggatgtacgtcttcctgcatgctgtgaagggcacaccttttgagacacccgaccaggggaaagcccgtcttctcactcattgggaacagctggattatggggtgcaattcactagctcccgtaagttcttcacaatcagtccaataattctgtag

SEQ ID NO: 127429 - DNA, 462 bp, Artificial Sequence
  Description of Artificial Sequence: Synthetic coding sequence
atgaatgtgggggtggcacattccgaggtgaatcctaacacgagagtgatgaacagccgtggtatatggctagcatatattatcctggtcggactcctgcacatggttctactctctatcccctttttctcaatcccagtcgtgtggaccctcaccaacgtcatacacaatcttgccacatacgtgtttttgcacaccgtcaaaggaacaccatttgagacccccgatcaaggcaaagcccggcttctgactcactgggagcaaatggattacggactacagttcacgtcctcacgcaaattccttagcatatcgccaatcgtcttatacctcctggccagtttctataccaaatacgacgcagcacattttttgatcaacacagccagcctgctgagcgtgctgctgccaaagctgccacagtttcacggtgtgagagtgttcgggattaataaatattag

SEQ ID NO: 127430 - DNA, 462 bp, Artificial Sequence
  Description of Artificial Sequence: Synthetic coding sequence
atgaatgtcggcgtggcgcattcagaggtcaaccccaacacaagagtcatgaactcgcgcgggatctggctcgcatacatcatattggttggcctcctgcatatggtgctgctatcaatccccttttttagtattcccgtggtctggacattaactaatgttatccacaatctggccacttacgtgttcttgcataccgtgaaaggaactccgttcgagactcccgaccagggtaaagcccgccttctgacgcactgggaacagatggactacggtttgcaatttactagctcccggaaatttctaagcattagtcccatcgtgctctatctgctagccagcttttacactaaatatgatgcggcccactttctcattaatacagcatccttacttagtgttttgcttccaaagttgccccagtttcatggagtaagggtcttcggcattaacaaatactag

SEQ ID NO: 127431 - DNA, 462 bp, Artificial Sequence
  Description of Artificial Sequence: Synthetic coding sequence
atgaatgtgggtacagcccacagcgaggtgaatcccaacaccagggtcatgaacagccggggcatctggctatcctacgtcctggctataggactgctgcacatcgtgctgctgagcattccgtttgtttctgttcccgtcgtgtggaccctgactaatctgatccataatatgggcatgtatatctttctccacacagtcaaagggacaccctttgagacccctgaccaaggcaaagccagattgctgacacattgggaacagatggattatggtgttcagttcacagcttcccgcaagttcctcaccatcactcccatcgtcctgtactttctgacatcattttataccaagtacgatcagattcacttcgtgctgaacaccgttagtctcatgtctgtgttgatacccaaactcccccagctgcatggtgtccgaatctttggcatcaacaaatactag

SEQ ID NO: 127432 - DNA, 462 bp, Artificial Sequence
  Description of Artificial Sequence: Synthetic coding sequence
atgaatgttggcactgcgcatagcgaagtcaaccccaacactcgggttatgaacagcagagggatctggctgtcttatgtcctggctatcggactgctccacatagtcctgcttagcattccctttgtctcggtcccagtggtctggactctcactaaccttatccataatatggggatgtacatttttctccataccgtgaagggaacacccttcgagaccccagatcagggtaaggctcgcctgctgactcactgggaacaaatggattatggcgtccagtttaccgcctctcgtaaatttctgacaatcacacctattgtactgtacttcctgactagcttctacactaagtatgaccagattcattttgtcttgaacaccgtgtccctgatgtccgtgctcatacccaaacttccacagttgcatggcgtccgtatcttcggcattaataagtactag

SEQ ID NO: 127433 - DNA, 1320 bp, Artificial Sequence
  Description of Artificial Sequence: Synthetic coding sequence
atgttctcaaaactcgctcacctgcagagattcgccgtgttaagccggggagtccattcgtcagttgcctccgccacgtccgtagcgacgaaaaagacagtgcagggaccccctacctctgatgatatctttgagcgcgagtacaaatacggcgctcataattaccatcctttgccagtggcactcgaaaggggtaaaggaatctacctttgggacgtcgagggccggaaatattttgatttcctgtcaagttactctgccgtcaatcagggacactgtcatccaaagatcgtgaatgcactcaaatctcaagttgacaagcttacactcacttcacgagccttctataataatgtcttaggagagtacgaagaatacataacaaagctgttcaactaccacaaagttctgccgatgaacacgggcgtggaggcaggtgaaacggcctgcaaacttgcccgcaagtgggggtatacggtaaaggggatccagaagtacaaagccaagattgtcttcgccgctggcaatttctggggacggaccctgtccgccatctcttccagtacagatcccacatcctatgatggcttcggcccatttatgccaggcttcgatatcatcccctataacgacctgcccgcgctcgagagagctcttcaggacccgaatgtggccgcctttatggtcgagccaatacagggcgaagccggggtggtggtgccagatcccggatacttaatgggcgtgagggaattgtgcactcggcaccaagtcctttttattgcggacgagatccagactgggttggctcgcactggccgctggctggctgtagactatgaaaacgttcggccggatattgtgctgctgggaaaagccctcagcggtggtctctaccccgtgtctgctgtgctttgtgacgatgatatcatgcttactatcaaacctggagaacacggatcgacatacgggggtaacccactggggtgtagggtggccatagccgcactggaggttttggaggaagaaaacctcgctgagaatgctgacaaattgggcatcattctgcgcaacgagcttatgaagctgccatcagatgtggtgacagccgtgcgcggaaagggcctcctgaatgccatagtgattaaggagactaaagactgggatgcttggaaggtttgtctgagattacgagataatggcctgcttgcaaagcccactcacggcgacatcatccggttcgcccccccactggtgattaaagaagacgagcttagagagagcatcgagataattaataagacgatactgtctttctag

SEQ ID NO: 127434 - DNA, 906 bp, Artificial Sequence
  Description of Artificial Sequence: Synthetic coding sequence
atgaacacgggagtagaggcaggcgagacagcatgcaagcttgccagaaaatggggctacactgttaagggcattcagaaatacaaggccaagatcgtgttcgccgcaggaaacttttggggccgcactcttagcgctatctcctcgtctacagaccccactagctatgacggttttggaccctttatgccagggttcgatatcatcccttacaacgacttaccagctctggagcgagctctgcaggaccctaatgtggctgcatttatggtggagcccatccaaggggaggctggtgtggtggtgccggaccccggctacctaatgggagtccgcgagctgtgcacgagacaccaagtgctcttcatcgccgatgaaattcaaaccggcttagcccgaaccgggcgatggctagctgttgattacgaaaatgttcgacccgatatcgtgttattaggcaaggctctctccggggggctttatccagtatctgccgtgctgtgcgatgatgacatcatgctaactattaagccaggcgagcacggatccacctatggaggcaatccattgggttgtcgtgtggcgattgctgccttggaggtactggaggaggagaatctcgctgagaatgcagacaagctcggaattatactacgcaacgaactcatgaagctgccttccgatgtggttaccgctgtgcgggggaaaggcctactgaacgcgatcgtcatcaaggaaacaaaagactgggatgcctggaaagtatgtcttcgcctgcgtgacaacggcctcctggccaagcctacccacggcgacataatacgattcgcacctccgctggttattaaagaagatgagctgcgcgaaagcatagaaatcattaataaaaccatactgtcattctag

SEQ ID NO: 127435 - DNA, 405 bp, Artificial Sequence
  Description of Artificial Sequence: Synthetic coding sequence
atgaaagccttctcacccgttagatcagtccgcaagaacagcctgtccgaccactcactcgggataagccgtagcaaaacaccagtggacgacccgatgagcctgctatataatatgaacgattgttattcaaagctcaaggagctcgtcccaagcattccccagaataagaaggtgtctaagatggagattctgcagcacgtcattgattatatcctggatttgcagatcgcattagacagtcaccccactatcgtctccctccaccaccagcgccccggccaaaaccaagcgtcacggacacccttgaccaccttgaacaccgacatctccattcttagtctgcaggcctctgagttcccgagcgagcttatgtccaacgatagcaaagccctgtgcggctag

SEQ ID NO: 127436 - DNA, 1386 bp, Artificial Sequence
  Description of Artificial Sequence: Synthetic coding sequence
atgaataattttgggaatgaagagtttgattgtcacttcctggatgaagggtttacggccaaagacattcttgatcagaagatcaacgaagtttccagcagcgacgataaggatgctttctacgtggctgacttaggagacatccttaaaaaacatcttaggtggctgaaagcactcccccgagtgacacccttctacgccgtcaagtgcaatgactccaaagcaatcgtcaagacgctcgccgctactggaactggcttcgactgcgctagcaagaccgagatccagttggtgcagagcctcggagtccctccggaaagaattatctatgcgaacccctgcaagcaggtgagccagatcaagtacgcagccaacaacggagtgcaaatgatgactttcgacagcgaagtcgagctcatgaaggtcgcccgggcccatccaaaagctaagctggttctgagaatcgctacagacgattccaaggctgtctgtcgcctaagcgtaaaattcggcgccactttacggacatcccggctgctgctcgagagggcaaaagagctcaatatcgacgtggtgggcgtttcatttcacgtaggctcaggctgcactgatcccgagaccttcgtgcaggccattagcgatgcacggtgcgtttttgacatgggtgccgaagtgggctttagcatgtacctgctggacataggcggcgggtttcccggaagcgaggacgtcaaactcaaatttgaagaaataactggtgtaatcaatcctgcactcgacaaatattttccttctgattccggtgtgcggattatcgccgagccaggcagatactacgtggcttccgccttcaccctggcagtcaatataatcgcgaaaaagatagtgctcaaggagcagactgggagcgacgatgaagacgagtctagcgaacagacatttatgtattacgtcaacgacggggtttacggtagcttcaattgcatactgtacgaccacgcccacgtcaagcccctattacagaagaggcccaagcccgacgaaaagtattattcttccagcatatggggacctacgtgcgatggcctggacaggatcgtagagcgatgcgacctgcctgagatgcacgttggagactggatgctgtttgagaacatgggagcctacacagtggccgccgcatcgaccttcaacggcttccagagaccaacgatctattacgttatgtcagggcccgcctggcagctcatgcagcaatttcagaaccctgatttcccccctgaggttgaggagcaggatgcatctactttgcccgtgtcctgcgcatgggaaagtggaatgaagagacacagagccgcatgcgcatctgccagcatcaatgtttag

SEQ ID NO: 127437 - DNA, 207 bp, Artificial Sequence
  Description of Artificial Sequence: Synthetic coding sequence
atgaataattttggcaacgaggagtttgattgtcactttttggacgaaggctttactgcaaaggacatactggaccagaagatcaacgaagtgagctcatctgatgataaggatgccttctatgtcgccgacctgggcgatatcctcaaaaaacatctgagatggttgaaggccctgcccagggttacccctttttacgctgtctag

SEQ ID NO: 127438 - DNA, 927 bp, Artificial Sequence
  Description of Artificial Sequence: Synthetic coding sequence
atgatgactttcgactcagaagtggagctgatgaaagtggctagggcccatccgaaggccaagttagtcctgcgcattgccaccgatgactcgaaggcagtgtgccggctctccgtgaaatttggggcaactctgaggacttcaagattactgctggaaagagcaaaggagttaaacatcgatgtggtgggagtgtcttttcatgtagggtccggttgcactgatcctgagacttttgtgcaggctatttccgacgcaaggtgcgttttcgacatgggcgcagaggtcgggttctccatgtacttgttagacattgggggcgggtttcctggctccgaggacgtgaagctaaagttcgaggagattacaggagtgattaaccccgcactggacaagtatttcccctccgattcgggtgtacggatcatagccgagcccgggaggtattacgtcgcctccgcctttactctggctgtgaatatcatcgcaaagaagatcgttctcaaggagcagacaggctcggatgacgaggacgagagtagcgagcagactttcatgtattatgtcaatgatggcgtgtacggatccttcaattgcatactgtacgaccacgcccatgtaaagccactgctccagaagcgaccaaaacccgatgagaagtattacagcagtagtatatggggccctacctgtgacggtctggacaggatagttgaaaggtgtgacctgccggagatgcatgtcggggattggatgttgtttgagaatatgggcgcatacacagtggctgccgcgtctactttcaatggctttcaacggcccacgatatattacgtaatgagtggccctgcatggcagcttatgcagcagtttcagaatcccgatttccctccctgtctgtgtttagtgcctggccgggtcggctag

SEQ ID NO: 127439 - DNA, 684 bp, Artificial Sequence
  Description of Artificial Sequence: Synthetic coding sequence
atggttaagtcttctctgcagaggattctcaactctcactgtttcgcccgcgaaaaggagggggataaaccttctgctaccatccacgctagccgtacaatgcctctgctcagtctgcacagccggggaggatcatctagcgaatcctcaagagtgagcctgcactgctgtagcaaccccggtcccgggccacggtggtgcgatgccccccaccctccattgaagatccctggtggtagaggcaatagccagcgagaccacaatctgagtgctaatctgttttattctgatgatcgtctgaacgtgaccgaagagctgacgtcaaatgacaagacaaggattcttaatgtgcagagtcgcctcacagacgcaaagagaatcaactggaggactgtgctgagtggcgggtcattgtatatcgaaattccaggcggggccctcccggagggctctaaggactcctttgctgtgctcctggagtttgcagaggagcaactgcgggccgaccacgtgtttatttgcttccacaagaaccgggaagaccgggctgcacttctgcgcaccttttccttcctggggttcgagatcgtgcgcccggggcatcctctggtgccaaagcggccagatgcgtgcttcatggcatacaccttcgagcgagaatcatctggggaagaggaagaatag

SEQ ID NO: 127440 - DNA, 831 bp, Artificial Sequence
  Description of Artificial Sequence: Synthetic coding sequence
atgtggattacgagcctgattacaatgaaagacgaagacatcttcgaccttgcaggcgacccccaagattcgctcatccccggcccgtcccccacccccaaacagaatccagtctgcaacgaagcctttttcggccaccagacattttccctgagagaaaccggcctcaagtcagtgcactgtcagggccaagaggcggagaacatggaaagggaaaagttccagcagaaagccctgaaacagactaagcagaagaaatcgaaatctgccgagtttctcatggtgaaggaagaccgagaggcaacggaggggacaggcaatccagcgttcaacatgtcatcccctgatctgtctgcgtgtcaaactgctgagaagaaggtcatcagacacgatatgcctgacagaactctcgcagcacaccagcagaaattcaggctgcccgctagcgcagagcctaagggtaatgagtacgggcgtaactacttcgatccacttatggatgaagaaatcaatcctaggcagtgcgctacagaagtaagcagggaagacgaaagcggccgcgaagaaacgctgaatagcgaggccccgggctcctctaataagtcccacgaaatacacaaagaagcctccgaggcaactaccgctcacctcgaggagttccagcgcagtcagaagaccattatcctactcggaagcagcccactagaacaggaaatcagatcgacctcactccactgtatggaagacgaaatgtctcacccctggatactgctgttaaaagtaaccgccgtgatcagaagccgacggtactacagggaacagagattctag

SEQ ID NO: 127441 - DNA, 1443 bp, Artificial Sequence
  Description of Artificial Sequence: Synthetic coding sequence
atggaacgagaaaaatttcagcagaaagctttgaaacaaactaaacagaaaaagtccaagtccgctgaatttttgatggtgaaggaggacagggaggccacagagggcactggaaaccccgccttcaatatgagctctcccgatctgtctgcctgccaaactgctgagaaaaaagtgatcaggcatgacatgccagacagaacgctcgctgcccaccagcagaaattccggctccccgctagcgctgaaccaaaaggaaatgaatatgggaggaactactttgatccattgatggatgaggagataaatccccgccagtgtgctacggaggtatcacgggaagtctgtctcatggcaaagggagaaaaggccgaaagcggagttgataacactgccggcctgtcagagaaggagacccaaaagaatccacgcgctcccatggatgaggctgatgtcaagagcgccgctcacagctcgcaaggatccatcccaaaaaagatcggaccttgctctatggattatgaccctaacctcctggaggaagatgacgaactacactcacaaggcgattctttgaccgatcacagcgtcaagggtaaatctaccgtgtggcgtatcggagaagctgaagattattcccaagacatctcttacttggaggagctggaagagcatagattttcagtgtgttgctcctcagtcgccgattccagatatggagacttctttaaacatcttcactttgtgctggtctcagcctcttctgagctgcagctgagtcagtggcagagccaggggttctggtacataattttgctgatgttcttcctgtggttcctcagattatacctgcactatctggggcaatggctatttctccaggctatatctacgcctgtgacaaaattccacttctctcttcacatcgtcgaactctgctacccaacatcatccctgcatatcggagaggagctgcccgttgtggtgatgggaccccttatgctgaatgcaatacttctcctgctcgtgttgataaggtggggctgccagcttctttttgcttcgtgccccgatgtgctttccaagctgatcatcactatggggctatggacgatccttgatcccctggcggttttcatcctagacacccttctggggcgcctgacagacaacgaggagacccccgtggccgacgctgcaaagctatactggatgttcgttagaaccgtccagcctggaatcctgggggtggttatcacggtcctgctttacattttgctgttcgtgattagtagcctgatcctgtacctatattgcctgcgtctgcataatgactcttggatactggacgccttccaacgaattcactccgaagagacaaaattcttcatcccttacgacctggagatatcgaaccaagaattatcatatatcgtgaaatag

SEQ ID NO: 127442 - DNA, 606 bp, Artificial Sequence
  Description of Artificial Sequence: Synthetic coding sequence
atggccctatcctgggtgctgaccgtcctgagcctgctcccgctgttagaagcgcaaatcccactgtgcgccaatttggtgcccgtaccaattacaaatgccactctggatcgcattacgggaaaatggttttacattgcctccgcattcaggaacgaggagtacaacaagagtgtccaggagatccaagctacttttttctatttcacaccaaacaagactgaggatacaatcttcctccgcgagtaccaaacgcgccaagatcagtgcatttataataccacatacttgaacgtccagagagagaatggtactattagtagatacgtgggaggtcaagagcacttcgctcacctgcttatcctaagggacaccaagacatacatgttggcattcgacgtgaatgatgagaagaattggggtttgagcgtctacgccgacaagccagagacgactaaggaacagctgggcgagttttacgaggccctggactgtttaagaatccctaaatctgacgttgtctacacagattggaagaaagacaagtgtgagcccctggagaagcaacatgagaaagagagaaagcaggaagagggcgaaagttag

SEQ ID NO: 127443 - DNA, 585 bp, Artificial Sequence
  Description of Artificial Sequence: Synthetic coding sequence
atggccctgagttgggtcctgacagtcttgagcctgcttccgttactggaggctcagatacccctctgcgcaaatctggtgcccgtgccaataaccaatgccaccctggatcgcgtaagtgcttgggccagccctgttttgtccacttgggctgccgcaagcctgttgtgggccagcctctccctcttggccgttgtgggacccccgcttcccgctctgccttttagcctactgggcccccagggcgaaattcttacatcccctggggactccggcggtaccccgtgcctccaaactcaaaagcctcactgccgtgtgttacatggcggaagattctgcgccgggccaggcggcgccgcttggggcgctatgaccgaccctcagggcgaactcctccacgcccattgccccccaggcgcatcttctccccacttacagaaccagggtgagatatgcctgtctctgttgccagccgactcccaaaggttcagcataaaacctccctcaccagctcccacgttttcccctgaccattggcaggtcgtattgtaccggattggtcttagcaagcgaggcgtccaatag

SEQ ID NO: 127444 - DNA, 585 bp, Artificial Sequence
  Description of Artificial Sequence: Synthetic coding sequence
atggccctgtcatgggtcctgacagtgctgagcctccttcccttgctcgaagcgcagatccctctttgtgccaacctggtgcctgtgccaatcaccaacgctaccctagaccgggtgagcgcgtgggcatctcctgtgttgtccacttgggcggcagcctccctgctctgggcctccctgtatctgttggcggtggtagcgcctccattacccgctttgcctttttcacttctggggccccaaggagaaattctgactagtccaggcgactctgggggcactccatgtctgcaaactcaaaagccacactgcagagtgttgcacggcggccgcttttgcgccggccccggaggggcggcctggggcgcaatgaccgacccccagggcgaactcctccacgcccactgccccccaggtgcaagcagtccacacctgcagaatcaaggtgagatatgcctgtctctcctgcccgctgactcccagaggtttagtatcaagcccccatctcccgcccctcctttcagccctgaccactggcaggttgttctgtaccggatcggattatcaaagagaggcgtccagtag

SEQ ID NO: 127445 - DNA, 606 bp, Artificial Sequence
  Description of Artificial Sequence: Synthetic coding sequence
atggctctgagttgggttctgacagtgctgtccctgctgccactacttgaggcgcagatacctctgtgtgctaacttggtgccggtgccaatcactaatgccaccctcgatcggatcacagggaaatggttctatattgctagtgcttttcggaatgaagagtacaataagtctgtgcaggaaatacaggccacatttttttattttacacccaacaaaacagaagacacgattttcttacgcgagtaccaaacaaggcaaaatcagtgcttttacaacagttcctatctgaacgtgcagagggagaatggcactgtgagcagatacgagggcggtagagagcacgtcgcccatctgctgtttctgagggataccaagaccctgatgttcggcagttacctggatgacgagaaaaattggggtctgagcttctacgccgacaagcccgagactaccaaggaacagctgggagagttttacgaggcactagattgcctgtgtattcctagatctgacgtcatgtataccgattggaaaaaggacaaatgtgagcccctggaaaagcagcacgagaaagaacggaagcaggaggagggagaatcttag

SEQ ID NO: 127446 - DNA, 1065 bp, Artificial Sequence
  Description of Artificial Sequence: Synthetic coding sequence
atgatgagttatttgaagcagccaccttacggcatgaatgggctgggtcttgccgggcctgcaatggatctgcttcaccccagcgtggggtatcccgctactccaagaaagcagcgccgcgagcggaccactttcacccggagtcagttggatgttctggaggccctatttgcaaaaacccgttatcctgatatttttatgcgtgaggaggttgcactgaaaataaatctaccggaaagtcgggtacaggtgtggtttaaaaatcgcagagctaagtgcagacagcaacaacagagcggttccgggacgaaatcccgcccagccaagaaaaaatccagcccagtgcgggagtcctctgggagcgagagttctgggcagtttaccccacctgccgtgagcagttctgcctcttcaagcagtagcgcctcaagctcctctgccaaccccgcagctgccgcagccgccggtctcggcgggaatcccgttgccgcagccagctccctctcaacacccgctgcctctagcatatggtctccggcttccatctccccaggctcggcgcctgcgagtgtctctgtcccggagcccctggctgctcccagtaacacatcctgtatgcaaaggagcgtggcggccggagccgctaccgcagccgccagctatcccatgtcctatgggcaaggcggatcttatgggcaggggtatccaactccctcatcgtcctatttcggtggcgttgactgctcttcttaccttgctcctatgcactcccatcatcacccacaccagctgagccctatggccccttcctctatggccggccaccaccaccaccatcctcacgcacaccatccgctgtcacagagttccggtcaccatcaccaccaccatcaccatcaccatcagggctacggtgggtctggactcgccttcaacagcgccgactgtctggactacaaagaacccggggccgcagcagcgagctcagcctggaagctgaacttcaattcccccgattgcttagactacaaggaccaagcttcatggagattccaggtgttgtag

SEQ ID NO: 127447 - DNA, 1065 bp, Artificial Sequence
  Description of Artificial Sequence: Synthetic coding sequence
atgatgtcctacttaaagcagccaccttacgggatgaacggtttgggtctggcagggccagccatggatctcctgcacccgagcgtcggctatcccgcaaccccccgcaaacagagaagagagcgcacgacctttacaagaagtcagttggatgtgttggaggccctgttcgccaagaccagatatcccgacatttttatgagagaagaggttgctttaaaaattaatctgccggaaagcagggtccaggtttggtttaaaaataggagagccaaatgtcgccagcaacagcaaagtggatcaggaactaagtctcggccagccaaaaagaagagcagtccagtacgtgagagcagtgggtcagagagttccggacagttcacaccacctgcagtctcaagtagcgcttcaagctccagcagcgcaagcagcagcagcgctaaccctgccgctgccgcagccgccggcttaggaggcaaccctgttgccgccgcaagctctctgtcaacccccgccgcctcttctatctggagtccagcttccattagccccgggtccgcccctgcatcggtgtcagtgcccgagccacttgctgcacctagcaacacctcatgtatgcaaaggtcagttgctgccggcgccgccaccgccgccgcttcctaccccatgtcctacggccaaggtggctcctatgggcagggctacccaactcccagttctagctactttggcggggttgactgcagctcgtatttagcccctatgcactcccaccaccacccccatcagctctcccctatggcgcctagttccatggcagggcatcatcatcaccacccacacgcacatcacccattgagtcagtccagtgggcatcatcatcatcatcaccatcaccaccaccaagggtacggcggtagcgggctggcatttaatagcgccgactgcctggactacaaggaacccggggccgccgccgcttctagcgcctggaaattgaacttcaatagccctgattgccttgactataaagatcaagcttcgtggcgctttcaggtgctgtag

SEQ ID NO: 127448 - DNA, 894 bp, Artificial Sequence
  Description of Artificial Sequence: Synthetic coding sequence
atgatgtcatacctcaagcaacctccttatgccgtgaatggccttagcctgactactagcgggatggatcttctccatccgtccgtgggctaccccggaccctgggctagctgccctgcggccactcctagaaagcaacgccgggagagaacaaccttcactagagcccaactcgatgttcttgaagccctgttcgcaaaaacacgctacccagatattttcatgagagaagaggtcgctttgaagattaacctgcctgaaagccgggtccaggtgtggttcaagaatagacgggctaagtgccgccaacagcaacaacaacagcaaaatggcggacagaataaggttcgccctgcaaagaagaaaaccagccccgcaagggaagtgtcttcagagtcaggcacatccggccagtttaccccccccagtagcacatcagtcccaactatcgcgtcctccagcgcacccgtgtcgatctggagccctgcttctatcagccctctctccgaccccctatctaccagcagctcctgcatgcagaggtcctaccccatgacttacacacaggcgtccgggtacagccaggggtacgcaggcagcacaagttacttcggagggatggattgcgggtcttatctcacacccatgcatcatcagctacctggaccaggggcaaccctgagccctatgggcaccaacgcggttaccagtcatctgaatcaatcacctgctagtttatccacccagggctatggagctagttccttaggctttaacagtaccacagactgccttgactataaagaccagaccgcctcatggaagcttaactttaatgccgactgtttggactacaaagatcagactagctcctggaaattccaggtgctctag

SEQ ID NO: 127449 - DNA, 870 bp, Artificial Sequence
  Description of Artificial Sequence: Synthetic coding sequence
atgatgtcctatctcaaacaaccaccctatgcggtgaatggattatcccttaccacatccggcatggatctcctgcacccatccgtcgggtaccccgctacacctcgtaaacagagaagagagcgaaccaccttcaccagagcccagcttgatgtcctcgaggctttatttgctaaaacccgttatcccgacatcttcatgcgtgaagaggtcgctttgaagatcaatctgcctgagtctagagtgcaggtttggtttaagaatcgacgggctaaatgtaggcagcagcagcagcaacaacagaacggtggacaaaacaaggttagaccagctaaaaagaaaacctcaccggcccgtgaagttagcagtgagtcgggaacctctggtcaattcacaccaccatccagcaccagcgtgcctacgatcgcatcctcctctgctccagtttccatctggtctcctgcaagcatttctcccctgagcgacccacttagcacctcaagtagttgtatgcagagatcctacccaatgacatacacacaggcctctgggtatagccagggatatgcaggctctacatcgtactttggtgggatggactgtgggtcttatttaaccccaatgcaccaccaactcccgggtcccggggcaactctttccccgatgggtactaatgctgtgacctcccatctgaatcagagccccgcatcgctgtcaactcaggggtacggggcatcatccctcggcttcaatagcactaccgattgtttagactacaaggaccaaaccgcttcctggaagctgaacttcaacgccgattgtctggattacaaagaccaaaccagcagctggaaatttcaggttctctag

SEQ ID NO: 127450 - DNA, 720 bp, Artificial Sequence
  Description of Artificial Sequence: Synthetic coding sequence
atgatgagctatctcaagcaacctccctatgctgtgaatggactgtcactaacaacctcaggcatggacttgctacaccctagcgttggctaccccggtccttgggcgtcttgccccgccgccacacctcggaaacaacggagagagcgcaccacattcacccgggctcagctggacgttctagaggctctcttcgccaaaacgaggtaccccgacatttttatgagggaggaagtcgccctgaagatcaatctgcccgagtccagagtccaagtgtggtttaagaacagacgggctaaatgcagacagcaacagcagcagcagcagaatggtgggcagaataaagtgagacccgcgaagaagaaaacatcccctgccagagaagtgagcagcgaaagcggcacttctggccagttcaccccgccgtcatctacaagtgtgcccacaattgcctcatccagcgccccagtgagtatatggagtccagcctcaatttcacctctcagcgaccccctctccacaagctctagttgcatgcagagatcctacccaatgacctacactcaggcctctggctatagccagggctacgccgggagcacctcttactttgggggcatggactgcggatcatatttaacgcctatgcatcatcaactccctggccccggcgcaactctgtctcctatgggaactaacgcggtgaccagccatttatag

SEQ ID NO: 127451 - DNA, 870 bp, Artificial Sequence
  Description of Artificial Sequence: Synthetic coding sequence
atgatgtcttacctcaagcaaccgccatacgcagtcaatggtctgtcccttacgaccagcggtatggatttacttcacccatccgttggctacccggctacccctcgcaaacaaaggcgtgaacgcaccaccttcacgagagctcagctcgacgtccttgaagcgctgttcgcgaaaacccggtacccagatatctttatgcgagaagaagtcgcacttaagattaatttgcccgagagcagggtccaggtatggttcaagaaccgaagagcaaagtgccgccaacagcagcagcagcagcagaatggtggacagaataaggttcgcccagctaagaaaaagaccagtcctgcaagagaggtctcttctgagtcagggaccagcggtcaatttacacccccaagcagcactagcgtgcctacaatcgcttcctcatctgcacccgtgtcaatctggtccccggcctcaatctcccccctcagtgacccacttagtacatcatcatcatgcatgcagcgaagctaccccatgacgtatactcaggcgtccggatatagtcaagggtacgcaggtagcaccagctatttcggtgggatggactgtggatcttaccttacccctatgcaccatcagcttccaggccctggtgctactctgtctcctatgggcactaacgctgtgaccagtcacctgaatcaatccccggcttcattgtcgacacagggctacggagctagtagcttaggttttaactccaccacagactgtttagattacaaagatcagaccgcaagctggaaactgaacttcaatgcagattgcttggattacaaagatcagacatcctcctggaagttccaggtgctatag

SEQ ID NO: 127452 - DNA, 492 bp, Artificial Sequence
  Description of Artificial Sequence: Synthetic coding sequence
atgatgagctatctgaaacaacctccgtatgcggtgaatggtctctccctgacgacttccggcatggacttgctacaccccagcgtcgggtacccggcaacacccagaaagcagcgcagggaaaggaccacctttactcgtgcacaactggacgtgctagaagccttgttcgccaagacacggtatcctgatatctttatgcgcgaggaagtcgctctgaaaatcaatttgcccgagtcccgcgtccaagtctggttcaagaaccgccgtgcaaagtgccgccaacagcagcagcagcaacagaatggagggcagaataaagtcaggccagccaagaagaagacttcgcctgcccgggaggtctcatctgagagtggcacaagcggacagttcactccgccaagctcaacatctgtgcccactatcgcctcctcctcggcccctgtaagtatctggtccccagccagcataagtcccctctccgatccatag

SEQ ID NO: 127453 - DNA, 978 bp, Artificial Sequence
  Description of Artificial Sequence: Synthetic coding sequence
atgctatcccacgctgatctcctggacgccagacttggaatgaaggacgctgccgagttactcggacatagagaggccgttaaatgcagactcggcgtaggcggctcagatccaggagggcaccccggggatctcgcccccaactctgacccagtggaaggtgcgacactcttgcctggggaggacattactacggtgggctccacacctgcttctctggcagtgtccgctaaggaccctgacaaacagccagggccacagggtggtcccaacccttcccaggctggacagcagcaagggcagcaaaagcaaaagagacaccgtacgcggtttacaccagctcaactcaatgagctcgaaagatcctttgccaagacacactaccctgacattttcatgagagaagagctcgcactccggatcggcctcactgagagtcgagtgcaggtctggttccaaaatcgtagagcaaagtggaagaaaaggaagaaaaccaccaacgtttttcgcgctcccgggacccttctgcctaccccaggtctgcctcaattcccatccgccgcagctgctgctgccgctgctatgggcgattccctatgttcttttcatgctaacgatactcgctgggctgctgcagcaatgcctggggtttcgcagttgcccctcccaccggccctcggtagacagcaagccatggctcagagcctctctcagtgttccctggctgccgggccacccccgaactctatggggctgtccaacagtctggcggggtccaacggggccggcttgcagagccacctttatcagcccgcttttccaggcatggttccagcgagcctgccaggtccttccaatgtgtccgggagcccacaactgtgcagcagccccgactcttccgacgtgtggaggggaactagtattgcctcgctgcgaagaaaggcgctggaacatactgtctctatgtcttttacttag

SEQ ID NO: 127454 - DNA, 912 bp, Artificial Sequence
  Description of Artificial Sequence: Synthetic coding sequence
atgggaatcgtccagatctgtaaaggggagtacttttggctggaacccaaaaatgcatttgaaaatttccaagagccggatatcggactcgtggcactggccttcctgcaggggtcctttgcctacggagggtggaacttcctcaattacgttacggaagaactcgtggatccttataaaaacctgcctcgggcgatttttatcagcatcccgctcgtcacgttcgtctacgtgttcgccaacgttgcctatgtgacggccatgagtccccaggagctgcttgcttctaatgcggttgctgtgacgtttggcgagaaactgctcggtgtgatggcttggataatgcccataagcgtcgcgctgtccaccttcggcggcgtgaacggatcgctgtttacctcctctcggctgtttttcgccggagcccgtgaggggcacctcccatctgtgctggccatgatacatgtcaagcgctgtacaccgatcccagccctgctctttacatgtattagcacattacttatgctcgttacctcagacatgtacaccctgatcaactacgtcggcttcatcaattatctcttttacggggttacagtggctggccagatagttctgcgatggaagaaaccagatatccctcgccctatcaaaatcaatctcctcttcccaatcatttatctattgttttgggcattcctcctggtgttttcactttggtccgaacctgtcgtgtgtggtatcggcctcgcaattatgctcacgggcgtgccagtttactttctgggtgtgtattggcaacacaagcctaaatgtttttctgatttcatcgagttgcttacactcgtgagtcagaaaatgtgtgttgtggtctatcccgaggtagagggcttaagggacaggggagggtag

SEQ ID NO: 127455 - DNA, 861 bp, Artificial Sequence
  Description of Artificial Sequence: Synthetic coding sequence
atggcgcttgtactcatcctgcagctcctaactctgtggccgttgtgccataccgatatcaccccgtcagtcgctattatcgtgcccccagcctcttaccaccctaagccttggttaggggcccagcccgccaccgtggtcactccaggtgtaaatgtgactctgcggtgccgagcccctcagcctgcatggagatttggcctgttcaagcctggagagattgcacccctgctcttccgcgatgtgagcagcgaactcgccgagttttttctggaagaagtgacaccggcccagggagggatttaccgatgctgttatcgtaggccggattggggacctggagtctggagtcagccatctgacgtcctggagctgctggtcacagaggagctcccgaggccaagcctggtggcactgccagggccagtggtgggcccgggagccaatgtctcgctgcgatgcgccggcaggctccgcaacatgtccttcgtgttgtacagggaaggagtagcggcccctttgcagtacaggcatagtgcccagccatgggcagattttacactgttgggcgcacgcgcgccaggcacatacagctgttactaccatactccatccgccccatatgtgctgtctcagagatctgaggtgttagtcatttcatgggagggggaaggacccgaagccagacctgcaagttctgcccccggaatgcaggccccagggccccctccatccgatcctggagctcaagctcccagcctgtcgtcattcaggccgcggggtctcgtgcttcagcctctgctgccacagactcaggactcctgggatcccgctcccccgccttccgaccccggcgtctag

SEQ ID NO: 127456 - DNA, 849 bp, Artificial Sequence
  Description of Artificial Sequence: Synthetic coding sequence
atggccctggtgctgatccttcagctgcttacattatggcctctgtgccacaccgacatcaccccgagtgtgccccctgcgtcctatcaccctaagccatggctcggcgctcagcctgctaccgtggtgactcctggagtgaacgtgaccctgcgctgtcgggcgccacagcccgcctggaggttcgggctgttcaaacctggggagatcgcccctctgcttttccgggacgtttcctcggaactggcagaattttttctcgaggaggttactcctgctcaaggcgggatatatcgttgttgttacaggaggccagattggggccctggggtatggagccagccttccgatgtcctcgaattacttgtcaccgaggaactgcctcggccatcactggtggcccttcctggccccgtcgtgggccccggggcgaacgtctccctgaggtgtgctggaagattacgaaacatgtctttcgtgctctatcgcgaaggagtcgcagcgccactgcagtatcgacattctgcccagccatgggctgacttcacccttctcggagcacgcgctccaggtacgtattcatgttattaccacacgccgagtgccccttacgtgttgtcacaacgatcagaggtgctggtgatcagttgggagggagagggccctgaagctcgtcctgcctcctcggcccctggtatgcaggctcctggccctcctccttctgacccaggtgctcaggctccgagtcttagctccttccgtcctcgggggctggtccttcagcctctcttgccacagacccaggattcatgggacccagctcctcctccatccgaccctggagtgtag

SEQ ID NO: 127457 - DNA, 759 bp, Artificial Sequence
  Description of Artificial Sequence: Synthetic coding sequence
atggcattagtcttgatcctgcagctgctgacccttttccctccagcctcctaccaccctaagccttggctcggcgcccagcctgctacagtcgtgacccctggcgtgaatgtgactttacggtgtcgggccccccaacccgcttggcggttcggactgtttaaaccaggcgagatcgcccccctgctctttcgggacgtcagcagcgaattggctgagttcttcctggaagaggtgactcccgcccagggtggaatatatcgctgttgctaccgacgccccgactgggggccaggggtgtggtctcagccctcagatgtgcttgagctgctggtgacggaggaactcccaagaccaagcctggttgccttgcctggccccgtggtgggacccggggcaaacgttagcctgcggtgcgccggacggctccgcaatatgtccttcgtcctgtacagggagggcgttgctgcacctctgcaatatcgacactctgcccaaccgtgggccgacttcacactactgggtgccagagctccgggtacctacagctgttattatcacacccccagcgcaccctatgtgctatcccagaggagtgaggtcctggttatctcctgggaagactcgggcagctccgactacacccgggggaacttggtccggctgggcctggcaggtctcgtcctgattagcctgggggcactggtcacgttcgattggaggagtcagaaccgggcaccagccggaattcgcccctag

SEQ ID NO: 127458 - DNA, 804 bp, Artificial Sequence
  Description of Artificial Sequence: Synthetic coding sequence
atggccttggtgctcatcttacagctcttgacattgtggcctctttgccacactgacattaccccaagtgtggcaataatcgtgcctccagcatcttaccaccccaagccctggctgggtgcccagcctgccacggtagtgactccgggcgtcaatgttaccctgaggtgtcgcgcccctcagcccgcttggcgcttcgggctgttcaaacctggggagattgctcctctcctcttcagagatgtttccagtgaattggcagagttctttctggaggaggtgacccccgcccagggtgggatttacaggtgctgttacaggcggccggactggggtccaggcgtgtggtcgcagccaagtgacgttctggaactattggtgacagaggagctgccccggccttcgctggtggcccttcctgggccagtggttggccccggagcgaatgtttctctgcggtgtgccggcaggctgcgcaacatgagctttgtcctttatcgggaaggagttgctgcccctctgcagtacagacattctgcccagccatgggcggacttcacattattgggcgctcgcgctcctggaacttattcctgctattatcacaccccatcggccccctacgtgctgtctcagcggtccgaagtgttggtgatttcctgggaggactctgggtcctcagattacactaggggcaatctcgtcagactcgggctggccggattggtgctgataagcctcggagccctcgtgactttcgactggcgcagtcagaacagggctcctgccgggattcgtccatag

SEQ ID NO: 127459 - DNA, 792 bp, Artificial Sequence
  Description of Artificial Sequence: Synthetic coding sequence
atggcactggtactgatactgcagttgctcactctttggcccctgtgccacacagatataacgccgagtgtgccccccgccagctatcaccctaagccctggttgggcgcccagcctgctacagtagtaacacccggagtaaatgtcacactgcgatgcagagcaccgcagcctgcatggcgttttggactgtttaagccaggcgagatagcccccctgctgttccgcgatgtctccagcgagttggccgagttttttctggaggaggtgacgcccgcccaggggggtatttacagatgttgctaccggcgacccgattggggacccggggtgtggagccagccctccgatgtcctggaactgctggtgaccgaggaactcccccggccttctcttgtggccctgccaggacctgtagttggaccaggagccaatgtttcacttcgatgcgccggaaggctgcggaacatgtccttcgtcctgtacagagagggggtagccgctccattgcagtacaggcattcggcgcaaccatgggccgacttcacactgctgggcgcaagagcccctggcacctatagctgctattaccatacacccagcgccccgtatgtcctgtctcagaggagcgaagtgttggtaatcagttgggaggatagtggcagctccgactacacacgcgggaacctggttaggctcgggctcgccggccttgtgctgataagcttgggcgctctggtgactttcgactggagaagccagaaccgagcccccgctggcatcagaccgtag

SEQ ID NO: 127460 - DNA, 645 bp, Artificial Sequence
  Description of Artificial Sequence: Synthetic coding sequence
atgtcaaaacctccaccgaaaccagtcaaaccaggccaagtcaaggtgtttagagccctgtacaccttcgagccacgaaccccagatgagctgtatttcgaagaaggcgatatcatttacattactgatatgagcgacaccaactggtggaagggcactagcaaggggagaacaggcctgattccaagtaattacgtggccgaacaggccgagagtatagataatccactgcatgaggctgctaaacgagggaatctgtcctggctgagagagtgtttggataatcgagtcggtgtcaatggcctagacaaggctggaagtacagctctgtattgggcttgtcatggcggccacaaagatattgtcgaaatgctgtttactcagccaaacattgagttgaaccaacagaataagctgggggataccgccttgcatgcggcggcatggaagggatatgctgacatagtacagctcctgctggccaagggggcgagaacagatctccggaatattgaaaagaagctcgccttcgacatggctacaaacgccgcttgtgcgtccttactgaagaagaaacagggaactgacgccgtcaggacactgtcaaacgccgaagactatctggacgatgaggacagtgattag

SEQ ID NO: 127461 - DNA, 897 bp, Artificial Sequence
  Description of Artificial Sequence: Synthetic coding sequence
atgaagacattgcagtctaccctgctgctgctgctcctggtgccactcattaaacctgctccaccgacacaacaggattctaggattatctatgattacggtaccgacaacttcgaagaaagcatcttctcacaagactatgaggacaaatatctggatgggaaaaacattaaggaaaaggagacggtcattatccctaatgaaaaatctcttcagttgcagaaggatgaagctataacaccactccctccgaagaaggaaaacgatgaaatgccaacctgcctgttgtgtgtgtgtttatcaggtagcgtgtactgtgaagaagtcgacatcgacgcggtgccgccactgcccaaggagagcgcctatctctacgctcgtttcaacaaaatcaaaaaactgaccgccaaagacttcgccgacataccaaatctccggagattagattttactggcaatctgatagaggatattgaggacggcaccttcagtaaactgagtctgcttgaggaacttagcctggccgaaaatcaactcctgaaattgcctgtgctgccaccaaagctgacccttttcaacgccaagtataacaagataaagtccagaggcattaaggccaacgcctttaagaaactgaataacctgacttttttgtacttggaccataatgctttagagtctgttccattgaatctgcctgaaagccttcgtgtgattcacctgcagttcaacaatattgcctccatcacggacgatactttttgcaaggccaacgacacgtcctatatccgggatcggatcgaagagataaggttggagggaaatcccatcgtactgggcaaacacccaaacagtttcatctgtttaaagagactccccatcgggagttacttttag

SEQ ID NO: 127462 - DNA, 897 bp, Artificial Sequence
  Description of Artificial Sequence: Synthetic coding sequence
atgaaaacgttgcagtccactctgttgttacttttactcgtgcccctgataaagcccgccccaccaactcagcaggactccagaatcatctacgactacgggacagataacttcgaagagtccatcttcagccaagactacgaagataaatatctggacggcaaaaacattaaggaaaaagagaccgtgataattccaaacgagaagtcactgcagttgcagaaggatgaagcgataacacccttacctccaaaaaaagaaaacgacgagatgccaacctgtttgctgtgcgtgtgcttgagtggcagcgtgtactgcgaggaggtcgacatcgacgccgtgcctccattaccaaaagagagcgcatatctgtatgccagattcaacaagatcaaaaaattgactgccaaagactttgccgatataccaaacctcagacggctggatttcactggaaatctgatagaggatatcgaggatggtaccttcagtaagctatcattactggaggagttgtccctggctgagaatcaattgcttaagctcccagttttacctcccaaattgaccctgttcaatgcgaaatacaacaaaattaagtcaagaggaatcaaagcaaacgcctttaagaaactgaataatctgacttttttgtacctagaccataatgcactcgaaagtgttccactgaatttgccagagagtctgagagtaattcatctgcagttcaacaacattgcttccattaccgacgacaccttttgtaaagcaaacgacaccagttatattagggaccggatcgaagaaattcggctggaagggaaccctatcgttctcgggaagcatccaaattcatttatctgcttgaagagactgcctatcggttcttatttttag

SEQ ID NO: 127463 - DNA, 807 bp, Artificial Sequence
  Description of Artificial Sequence: Synthetic coding sequence
atgctggcaaaaattagtactacttggaagctcttcttgaaactccttggcccagagatacttttgagtagccttaagagccgacactctttctcacactccccgtctcacctcgggttaatgcatcggcacgaacacctcttgcgaaagactactaagaacttcaagaccgctactacaactttacagtcaactctactcttgttactccttgtccctctaattaagcctgctcctcccacacaacaggattctaggatcatttacgactatggcaccgacaactttgaggagtcgatcttcagccaggactacgaggataagtatctagatggcaaaaacattaaggagaaggagaccgttattatccctaatgagaagagcctgcaactgcaaaaggatgaggctattacgcccctgccaccaaagaaggaaaacgacgagatgcctacttgcttgttatgcgtttgtctttcaggctcggtatactgtgaagaggttgatatcgatgccgtcccccccttgcccaaagagtctgcatacctgtacgcccgattcaacaagattaagaagttgaccgctaaggactttgctgatatccctaacttgcgccgcctggacttcacaggaaatctcatcgaggatatcgaggatggaaccttttccaaattaagtctcttggaggagttgtctctcgccgagaatcagctcttgaaactgcccgtccttccccccaagctgactctgttcaacgcgaagtataacaagatcaaaagccgtggcatcaaggccaatgcttttaaatag

SEQ ID NO: 127464 - DNA, 1842 bp, Artificial Sequence
  Description of Artificial Sequence: Synthetic coding sequence
atggctgccgaaacgctgctgtcctctctgctgggacttctgctgctcggcttgctcttacctgccagcctgaccggcggggtcggaagccttaatctcgaagaactttctgaaatgcgctatgggattgaaattctgcctctgccagtgatgggtggccagagtcagtcaagcgatgtggtcatcgtaagttcaaagtataagcagcgttacgagtgcagactgcccgccggggctattcattttcagcgtgagagagaggaggaaactccagcctaccagggtccggggattcccgaactcctctccccaatgagagatgcaccctgccttctgaagactaaagattggtggacgtacgaattttgttacgggaggcacattcagcagtaccacatggaagactccgagatcaaaggggaggtcctttatctggggtattaccagagtgccttcgactgggatgatgagacagccaaagcctctaaacagcaccgtttgaaaagataccattcacagacctacggaaacggcagtaagtgtgacctgaacggccgcccccgtgaggctgaagtacgcttcttgtgtgacgaaggcgcaggcatatctggagactatatcgaccgtgtggacgaaccactctcttgcagctatgttttgactatccggactcccaggctgtgcccgcatcccttacttagaccaccgccttccgctgccccccaagccatactctgccacccttcactgcagccagaggagtacatggcttatgttcagcggcaagcagtggactctaagcagtatggcgataagataatcgaggagctacaggatttaggtccacaggtctggagtgagaccaagtcaggagtggcccctcagaaaatggccggagctagccccaccaaggacgattcaaaggattcagacttctggaaaatgttaaacgaaccagaagatcaggccccgggaggagaagaggtgccggccgaagagcaggacccttcccccgaggccgccgacagtgcctccggggcgcctaacgacttccagaacaacgtgcaagtgaaagtcattagatcacctgccgaccttattcgtttcatcgaagagcttaaaggggggaccaagaaaggtaagccaaacattggtcaagaacagcccgtcgatgacgccgcggaggttccccaacgggaaccagaaaaggaacgcggagaccctgagcggcagcgtgagatggaggaggaagaagatgaagacgaagacgaagacgaggatgaagatgagaggcaattactcggagagttcgaaaaagagctggaggggatcttactgccttccgacagagatcgccttcgcagcgaggtgaaggccgggatggaacgggagcttgagaatataatccaagaaacggaaaaggagcttgatccagacggcctcaagaaagaaagcgagagggatagagctatgctggctctgactagcactctaaataagctgatcaagcgcctggaggagaaacagtctccagaactggtgaagaaacacaagaaaaagcgcgtcgtgcccaagaagccaccaccatcacctcaaccaactgggaaaatagagataaagattgtcaggccctgggctgaaggtactgaggagggcgctcggtggttgactgatgaagatacccggaacctaaaggagattttcttcaacattttagttcctggagcagaggaggctcaaaaggagcgacagcgccagaaggaactggaaagtaattatcgtcgcgtgtggggcagccccggaggagagggcaccggagacctcgacgaatttgacttctag

SEQ ID NO: 127465 - DNA, 1959 bp, Artificial Sequence
  Description of Artificial Sequence: Synthetic coding sequence
atggccgccgagacactgctctcctcactgttaggcctgctgctgctcgggctgctgctgccagcctcactgactggtggggtgggatctcttaatctggaggagctgagcgaaatgcgctacggaatagaaatcctacctctcccagtgatggggggtcagagtcagtctagcgacgtggttattgtgagttcaaaatacaaacagcgatacgaatgtaggttgcctgcaggtgccatccacttccaacgggaaagagaggaagagaccccagcctatcagggccccggaatccccgaacttctgagtcctatgcgggacgctccctgcctgttgaaaacaaaagattggtggacatatgagttctgctatggtcgacacattcagcaatatcacatggaggatagcgagatcaaaggagaagtgctttatcttggttactaccagagtgcctttgactgggacgatgagactgctaaagcctccaaacagcatcgactaaagcgttatcattcccagacttatggtaacggaagtaaatgtgacctgaatggcaggccacgagaggccgaagtccggttcttgtgtgacgaaggggccggaatttcaggagattatattgacagggtggatgagcccctgagttgctcatatgtgctcactattcgcaccccccgcctgtgcccgcaccctctgctcagacctccgcctagtgcagccccacaagcaattctgtgccacccttcactacaacctgaagagtatatggcatatgtgcagagacaggcagattctaaacagtacggtgataagatcattgaggagctgcaggacctgggcccgcaggtgtggtctgagaccaaatctggtgtggcaccgcagaagatggcgggagcttcgcccaccaaggacgactccaaggattctgatttctggaaaatgctgaatgagccagaagaccaggctcccgggggagaggaggtgccagctgaggagcaggatcctagtcctgaggcggcagatagcgcgtccggtgccccaaacgacttccagaataacgtccaggtgaaggttattagaagtccggcagatctgatcaggttcattgaagagctcaagggtggcaccaaaaaaggcaaaccgaatatcggacaagagcagccagtcgatgacgccgctgaagttccacagcgggagcccgagaaggaaagaggagaccccgaacggcagcgagagatggaagaagaagaagacgaagacgaggacgaagacgaagacgaggatgaacgccagctgttaggtgaatttgagaaggaattggaaggaattctactccctagcgaccgggaccgactaagaagcgagactgagaaagagctcgatcctgatgggcttaagaaggagtctgaacgagaccgtgccatgctcgccctgacaagtacattgaataagctgatcaaaagattggaggaaaaacaatcccctgaactggttaagaaacacaagaaaaagcgagtggtgcctaagaaaccccctcccagcccccagcccaccgaggaggacccagagcaccgggtgagagtccgtgtgacaaaacttcgtctcggcggtcccaatcaggacctgaccgttttggaaatgaagcgcgagaatccacagctgaaacagatagagggcctggtgaaagagttgctggagcgcgaggggctgaccgctgccggcaaaattgagatcaagatcgtccgaccttgggcggaaggcactgaagagggagcaaggtggcttactgacgaagacacgcggaatctgaaggaaatattttttaatattttggttcccggagctgaggaggcgcagaaagaaaggcagcgtcagaaggagctggagagtaactataggcgggtgtggggttctcctggtggcgaaggtaccggcgacttggatgagttcgatttttag

SEQ ID NO: 127466 - DNA, 1683 bp, Artificial Sequence
  Description of Artificial Sequence: Synthetic coding sequence
atggctgcagaaacactgttatccagcctactcggcctgcttttgctggggctgctgctgccagcttctctgaccggaggagtaggctccttgaacctggaagaactctccgaaatgcgctacggtatcgagatcctgcctttacctgtcatgggcggccagtctcagtcgagcgatgtggttatagtcagcagtaagtataagcaaagatacgaatgccgtctcccagctggcgctattcacttccagagggagagggaggaagagacgcccgcttatcaggggcctgggatccccgaattgttatcgccaatgcgcgacgcaccttgcctcctgaagacaaaggactggtggacttacgagttctgttacggccgtcatatacagcaatatcacatggaagacagcgagattaagggagagtttctttgcgacgaaggcgcggggatctccggggactatattgatcgagtcgacgagccactgagttgcagctatgtgctgacgattcgcactcccagactgtgtccccaccccctgttgcggcccccaccttcggctgcaccacaagcaattctctgccatccctctcttcaacctgaggagtatatggcatacgtccagagacaggccgacagtaaacagtatggcgacaaaataatcgaagagctacaggacctcgggcctcaggtctggtctgagactaaaagcggcgtggctcctcagaaaatggctggcgcttcacccaccaaagacgattccaaagatagtgacttttggaagatgctaaacgagcccgaagaccaggctcctggaggcgaagaagtcccagcagaggaacaggacccatcgccagaggccgccgacagcgcatcaggggctccaaacgatttccagaacaatgtccaagttaaagtaatccgatctcccgccgacctcatcagatttatcgaagagctgaagggaggcactaagaagggaaaacctaacatcggtcaggaacaacctgtggacgatgccgcagaagtgcctcagcgtgaaccagagaaagaacggggcgatcctgagagacagagggaaatggaggaagaggaagatgaggatgaggatgaagacgaggacgaagacgagaggcagttgctgggcgagttcgagaaggagctcgagggcatcctgcttccatcagatcgtgatagactgcggtccgaggtgaaagcagggatggaacgcgagctcgagaacataattcaggagaccgaaaaagagctcgatcctgacggcctgaagaaggaaagcgaaagggacagagctatgttggcattaacctccaccctgaataagttgattaagaggctggaggaaaagcagagcccagagttagtgaagaagcataagaaaaagagggtcgtgcctaaaaagccccctccttcgcctcagccaactggcaaaatcgagattaaaattgtgaggccgtgggcagagggcaccgaggaaggcgcacggtggttgaccgacgaggacaccagaaatctgaaagaaattttcttcaacatcttggttccgggagcagaagaagcccagaaagaacggcaacggcagaaagaattggaaagcaattaccgccgcgtgtggggatcccccggcggcgagggcacaggagatcttgacgaatttgacttttag

SEQ ID NO: 127467 - DNA, 1743 bp, Artificial Sequence
  Description of Artificial Sequence: Synthetic coding sequence
atggctgcagagactctcttgtctagcctcttaggtctgttactgctagggctcttactgccagctagcctgacaggcggtgtgggctctcttaacctagaggagctgagcgagatgcgatacggtattgagattctaccgctgcctgttatgggcggccaaagccagtcgagcgacgtggtaatagtaagtagcaagtacaagcaacgctacgagtgccggttgcccgcaggggccatccactttcagcgtgagcgagaggaggagacgcctgcctatcagggccctgggattccggaattattgagcccaatgagggacgccccttgcctcctgaagaccaaggactggtggacttatgagttctgctatggcaggcacatccagcaataccatatggaggattctgaaatcaagggggaggttctatatttgggttattaccagtctgctttcgactgggacgatgagactgccaaattcctttgtgatgaaggagccgggattagcggcgattacatagacagagtcgatgagcctctgtcgtgttcttacgtgctaacaatcagaactcccaggctctgcccgcaccctctccttaggcctcccccttctgctgccccacaagctattctgtgccacccctctttacagcctgaggagtacatggcctacgtgcaacggcaggccgtcgactcaaagcagtacggagataagattatcgaagaactgcaggatctcggtccccaggtgtggtcagagacaaagtccggcgtagcgccgcagaaaatggccggggctagcccgaccaaggatgattctaaggacagtgatttctggaaaatgttaaatgagccagaggaccaagcccccggaggagaagaagtgccagccgaggagcaggatccctcccctgaagccgcggactcagcctctggcgcgccaaacgattttcagaataatgtgcaagtaaaggtgattcgctcacctgctgacctcatccgttttatcgaggaattgaagggagggaccaagaaaggaaaacctaatattggccaggagcagcctgtggacgacgcggcagaagttccccagcgcgagcccgagaaggagcggggtgaccccgagaggcagcgcgaaatggaagaagaagaggacgaggatgaagacgaagacgaggatgaggacgagcgacagctcctgggggaatttgagaaggagctagaaggaatactgttgccttctgacagggatagattaagatccgaggtcaaggctgggatggagcgcgagttggaaaacatcatacaggagaccgagaaagagctcgaccccgacggactcaagaaggagagtgaaagggatcgggctatgttagctctgactagcacgttgaacaagctgatcaagagactggaggaaaagcaatcccctgagttagttaagaagcataagaagaaaagagtggtgcccaagaagcccccaccttccccccagcctactggcaaaatcgaaatcaaaatagtcaggccctgggctgaagggacagaggagggagcgcggtggctgacggacgaggacacccgcaatctgaaagaaattttctttaatatcctggttcccggcgccgaagaagcacaaaaagagcgccagaggcagaaagaactcgagagcaactaccgacgcgtttggggcagtcctggcggtgagggaacgggcgacctggacgaatttgacttttag

SEQ ID NO: 127468 - DNA, 2004 bp, Artificial Sequence
  Description of Artificial Sequence: Synthetic coding sequence
atggccgcagagaccctgctgagtagcttgttgggattgttactcctgggcctgttactgcccgcatctctgacgggcggagtcggatcccttaacctggaagagttgtctgaaatgaggtatggcattgagattttaccactgcccgtcatgggaggacagtcacagtcctccgacgtggtaatcgtaagtagcaagtataaacagcgatacgaatgccgccttccagcgggtgcaatccattttcagcgagaaagggaagaagaaacgccagcgtaccagggcccaggtatcccagagctcctttcccccatgagagacgccccttgtctactgaaaacaaaggattggtggacctatgaattttgttatgggagacacatacagcaataccatatggaggactcagaaattaagggcgaggtgctctatctgggctactaccagtctgcgttcgactgggatgacgaaaccgctaaggccagcaagcaacaccgactgaagcggtaccactcccagacctatggaaatgggtctaaatgtgacttgaacggtcggcctcgggaggctgaagtgcgctttctgtgcgacgaaggcgccgggatcagcggcgactatattgaccgggtggacgagccactgtcctgtagttacgtattaacaatcagaaccccacgactgtgcccccatcctctcttacgtccccctccgagtgctgccccacaagccatcctttgtcacccaagcctgcagcccgaggaatacatggcctatgtacaaaggcaagccgattctaaacagtacggtgataaaataatcgaagaattgcaggacctggggcctcaagtctggagtgagactaaatccggagtggcccctcagaaaatggcaggcgcctcgcccacaaaagacgactccaaggactccgacttctggaaaatgcttaatgaacctgaggaccaggccccaggcggcgaggaagtaccagccgaagaacaggatccgtcgcccgaggccgctgacagcgcatcaggggcacctaacgacttccagaataatgtgcaagtgaaagtcatccggtcccctgccgatctcatccggtttattgaggagctgaaaggtggcacaaagaagggcaagccaaatatcggccaagagcagccagtggatgacgctgcagaggtgccccagagagagcctgaaaaggagcgtggagatccagagcgtcagagagagatggaggaggaagaggacgaggacgaggatgaagatgaagatgaagacgaacgacaactgctgggtgagttcgagaaagaactggagggcattctcctgccatcagatcgcgaccgtttaaggtccgaggtgaaggccggtatggagagagaattggaaaatatcatccaggagaccgagaaggagcttgatcctgatggcctcaaaaaagaaagtgaaagggatcgcgctatgttggccttaacttccacactgaacaagctgataaagcggctggaggaaaaacaaagtcccgaactcgttaaaaagcacaaaaagaaaagagtggtcccaaagaagccacccccctctccgcagcccacagaggaggacccagagcatcgggtacgcgtgcgagttacaaaattaaggttgggtggaccaaatcaggacttgacagtgttggaaatgaagcgggagaacccacaactgaagcagattgaaggactggtgaaggagctcctggaacgggaggggttaacggctgctggcaaaatcgaaattaagattgtgagaccctgggccgaaggcactgaagagggcgcaaggtggctgaccgacgaggatacccgaaatttaaaagagattttcttcaatattttggtgcctggcgctgaagaagcccagaaagaaaggcagcgccaaaaagaactcgaatctaactatcgccgggtgtggggctcccccgggggggaggggacgggcgacctggacgagttcgatttttag

SEQ ID NO: 127469 - DNA, 1794 bp, Artificial Sequence
  Description of Artificial Sequence: Synthetic coding sequence
atggccgccgagaccctcctcagcagccttcttggccttctcctgctaggcctgctcctgcccgcctcactcactggaggggtcgggagtcttaacctggaagaattgagtgaaatgcggtacggcattgaaatactacctcttcctgttatgggtggccagagtcagtcttctgacgtagtgatcgtcagctccaagtacaaacagaggtacgagtgtcgtttaccagcgggtgccattcacttccaaagggagcgtgaagaggagacccccgcgtaccagggccccggaatccccgagttgctctctcctatgagagatgcaccttgtctacttaagacaaaagactggtggacatacgagttctgttatggacggcacattcagcaatatcatatggaagattccgagattaagggtgaggtcttatacctcgggtactaccagtcggccttcgattgggacgatgagaccgctaaagcaagcaagcagcacagattaaaaagatatcatagccagacatacggaaatggttctaagtgtgacctaaatggcagacctagagaggcagaagtccgcttcctttgcgatgagggcgcaggcatatctggggattacatcgatcgcgtggacgaacccctgtcttgctcctatgtcctgaccatcagaacaccgcgcctgtgtcctcatcctctgttgaggccgcccccctccgctgctcctcaggctattctgtgtcaccctagcctgcagcctgaggagtatatggcctatgtccagcgccaggctgatagcaagcaatacggtgataagataatagaggagttacaggacctgggtccacaagtctggtccgagacaaagtcaggcgtggccccacagaagatggcgggggcctcaccgaccaaagacgattcaaaggattccgatttctggaagatgctgaacgagcccgaagatcaggcccctgggggagaggaagtcccggccgaagagcaggatccctccccagaggccgccgactctgcgtctggggccccaaatgactttcagaacaatgtccaggtgaaggtgatcaggtcacccgccgatttaatcaggtttatcgaagagttaaaaggagggactaagaagggcaaacccaacattggacaagagcaacccgttgatgatgctgctgaggtccctcagagggaaccagaaaaagaacgcggagatcctgagagacaaagggaaatggaggaggaggaggacgaggatgaggatgaggatgaagacgaggatgagaggcagctactcggtgagttcgagaaggaactggagggcatcctgctgccctccgatagagatcgcctgcggagcgagactgaaaaggaactggatcccgacggcctgaagaaagaaagcgagcgcgaccgggccatgctggctttaacttccaccctgaataaactcatcaagaggcttgaagagaagcaatcgcccgagttggttaagaaacataagaagaagagggtggttccaaagaaacccccaccttccccacagcccacaggcaagattgagattaaaattgtgaggccatgggcagagggaactgaggagggcgctaggtggctcacagatgaggacactcgcaatctgaaggaaatcttctttaatatcctggtgcccggggcagaagaagctcaaaaagagcggcagaggcaaaaggagctcgagagtaactaccgacgggtctgggggtctcccggaggggagggcacaggcgatctggatgagttcgacttttag

SEQ ID NO: 127470 - DNA, 1839 bp, Artificial Sequence
  Description of Artificial Sequence: Synthetic coding sequence
atggcagccgagactttattgtcttccctgttgggactacttctgctgggactcctgctcccagccagtctgacaggtggtgtgggaagcctgaatctagaagagttgtctgagatgagatatgggatcgaaatacttcctctacctgttatgggaggtcaatcacagagcagcgatgtggtgatcgtgtcatctaagtataagcagaggtacgagtgcaggcttcctgcaggcgccatccatttccaacgcgagagggaagaggagacccctgcctatcagggtcccggaattccagaacttctctccccaatgagagatgctccttgcctgctgaaaacgaaagactggtggacatacgagttctgctacggccgccacattcagcagtaccatatggaagattctgaaatcaagggagaagtcttgtacctcggatactaccagtccgcattcgactgggatgatgagaccgccaaagcttctaaacagcataggctcaaacgataccacagtcagacctatggcaacggcagtaagtgcgatttgaatggccggccaagggaagccgaggtgaggtttctctgtgacgagggcgctggcatttctggggactatatcgaccgtgtggacgagccactgtcttgctcgtacgtgctcaccattaggacccctagattgtgcccacacccacttcttcggccccctccatcggcagcccctcaagctattctctgccacccatctctgcagcccgaggaatacatggcctacgttcaacgccaggccgactcaaaacagtacggagacaagatcatcgaagagctgcaagacttgggaccccaggtgtggtctgagacgaagtcaggagttgcccctcagaagatggcgggggccagtcctacaaaggacgactccaaggactctgacttttggaaaatgcttaatgagccagaggatcaagccccaggcggcgaggaggtgcctgcagaagaacaggatcccagccctgaggccgccgattccgcgtcgggagctcctaatgacttccagaataatgttcaggtaaaagtgatccgctctcccgcggatcttattagattcatcgaggagctcaaaggaggaactaagaagggcaagccaaacattggtcaggagcagccggttgatgacgctgctgaagtgccccagagggagccagagaaggaaaggggcgacccagaaaggcagcgcgagatggaagaggaggaggacgaagacgaggatgaggatgaagacgaggatgagaggcaactcctaggagaatttgagaaggaactcgaagggattctgctcccatcagatagggacaggctacggagtgaggttaaggccggcatggaaagagaattggagaacatcatccaagaaactgaaaaagagcttgatcctgacggcttgaagaaagaatcagagcgcgatagggcaatgctcgctctgaccagtacactcaataagctgattaagcggctggaagaaaaacaaagtccagaactggtcaagaagcacaaaaaaaaacgggtggtccccaagaagccgcctccatctcctcagcctacggggaaaatagagattaaaatcgtacggccttgggccgaaggaactgaggaaggtgctagatggctcactgacgaagatacccgcaatctgaaggaaatattcttcaatatactggtgcctggtgcagaggaggcccagaaggagcgtcaaaggcagaaggaactggagtccaattatcgacgcgtgtggggctcaccaggtggggaaggtacgggggacttggacgagttcgatttttag

SEQ ID NO: 127471 - DNA, 3462 bp, Artificial Sequence
  Description of Artificial Sequence: Synthetic coding sequence
atgtcacaggagccaaccacctattcactgtttctgtttttatttttgagccatggtgtcagctcctacaccgtaccaaattctaggcaggatctacatcccttgctgcagaatatggccgaggagattatcgacggaagttaccttaatgcccttctggatctgattcaattccagtccagccatgtttggacggacgacttgagccatcgcgtcttggcttacctgaattcaaggaacgtggccttcaccatcccttccctgcaggctgccgtggagaatcacctggaacagcgtctgcatcagccccagaaactcctcgaagaccttcgcaagacagacgcccagcagttccggactgccatgaagtgcctgcttgaggacaaaaaagatggcctggacctgaaagacatcattatcgatctgggagaaattagagagagagcgctccagagccctggtgtgaacagatccctcttcctgattaccctcgaacgatgttttcagatgctcaacagcctggaatgcgtggaaatcctggggaaggtgctgagaggaagctctggctcctttttgcagcccgatattaccgaacgtctgcctcgggatctccgggaggatgcttttaaaaatctcagtgcagtgtttaaagatctatatgataaaacctcggctcactcacagcgcgccctttacagctggatgaccggaatcctccagaccagcagcaacgccaccgatgactcagccagctgggtgagcgcagagcatttatgggtgctgggccggtacatggttcatctcagtttcgaagagatcacgaaaatatctcccatcgaaattgggctatttatctcatacgataacgcaaccaagcagctggatatggtttatgatatcacacctgaacttgcccaggcttttcttgagagaatctcctcaagcaatttcaatatgagaaataccagtaccatacacaggcaggcccatgagctgtgggcactagaaccttttcccaagatgttgggtctgcttgtgtgcttttacaacgatctggagttactcgacgccaccgtggcgcaggtgctactttatcagatgatcaagtgctctcatctgcgcggcttccaggccggagttcagaagctcaaggcggaactgttggacattgctatggaaaatcagacgctaaacgaaaccctaggcagtctcagcgacgccgtggtgggtctgacttacagtcaactagaaagcctctcaccagaagctgttcacggagcaatcagcaccttaaaccaggtcagtggttgggcaaagagccaggtgataattttgtcagccaaatatctggcccacgagaaggtcctgtccttctacaatgtctcacagatgggggccctgctcgcaggagtgagtactcaagccttttgtagcatgaagcggaaagatataagccaagtgctgaggagcgccgtctctcagtacgtgtccgatttaagccctgctcagcaacagggaatactgtccaaaatggtacaagccgaggacactgccccaggcattgtggaaattcagggagcgttcttcaaagaagtcagcttgttcgatctccgaaggcaacctggatttaactccactgtactgaaggacaaagagcttggacggtcccaggcactcttcctctatgaactgctcctcaagactacccggaggcccgaggaacttctgtctgcggggcaacttgttaagggtgtcacctgcagccatattgatgctatgtctaccgacttcttccttgcacacttccaagactttcagaacaattttgcactccttagtccataccaggttaactgtttagcttggaaatattgggaggtgtccaggctgtccatgcccccttttctgctagccgctctgccggctcggtatctggcttcagtccccgcttcccagtgtgtccccttcctcatttccctgggcaagtcatggttggactccctggtcctggattcacacaagaagacctcagtgctgcgcaaagtacagcaatgcctcgatgactctatagcagacgaatacactgtcgatattatgggcaatttgctgtgccatctgccagctgccattatagatagaggcatctcaccacgagcttgggctacagcccttcatggcctacgagactgtccagatctaaatccagagcagaaggcagccgtgagactgaagcttcttggtcagtatggtctgcctcagcactggacagccgagactactaaggatctgggaccttttctcgtgctgttctccggggacgaactatctagcatcgcaaccaaatttcccgaaatcctgctccaggccgcttcaaaaatggcccgtacactccccacaaaggaatttctgtgggctgtctttcagagtgttcggaacagcagtgacaaaataccttcgtatgatccaatgcccggatgccatggagttgtagccccatccagcgacgatatttttaaactggcagaggccaacgcctgctgggcccttgaggacctgaggtgcatggaggaggacacattcatccgaactgtggagctgttgggcgctgtgcaaggattctcccgaccccaattaatgacactgaaagaaaaagccatccaggtctgggacatgccttcctattggcgcgaacaccacatcgtttcgttaggaagaatcgcactggcccttaacgagagtgaactcgagcaactcgatttaagttcaatcgacacagtcgcttccctgtcatggcagactgagtggactcctgggcaggcggagtcaattttacaggggtacttagatgactctggctactcgatacaggacctgaagtccttccacctcgtgggcctcggggccaccctatgtgctatcaatattacagagatccctctgattaagatctcagaatttagagtggtggtagctcgaattggaactctgctatgctctacccacgtgctggccgaatttaaaagaaaagctgaagtggtcttcggcgacccaacagagtggacctcatctgtgctgcaggaactcggaacaattgccgccggcctgacaaaggcagagctgaggatgctggacaaggatcttatgccatattttcagccttcggccatcaagtgtttgcctgacgaaatcttcaaagagctctccgccgagcagatcgccagcctgggccctgagaacgccgcagccgtgacacacgctcagagaagacgcctgtccccactgcagcttcagtcacttcagcaagcactggacggtgccaaaacacatagctggcaggatgcacccgcttccgctggtcccacacgtacatccagtagtcgctcccccgccggtgcgcttcagagctgggggctgtggctgggctgccctctcctcgtgctgatggccaaattactgtggtag

SEQ ID NO: 127472 - DNA, 1647 bp, Artificial Sequence
  Description of Artificial Sequence: Synthetic coding sequence
ccccgagcggtgtgggtggaggcacgagggggcgcccagcaccccacaatgagaagaaccgctcctctacataggggtacttggtctaagatgtctatcattctcagagcccggtatctggcgagtgtgcccgcttctcaatgtgtcccctttttaatcagccttggcaaatcttggttggacagtttagtgttggatagtcataaaaaaacctctgtgctccgaaaggtgcagcagtgtctggatgattctattgccgacgagtacaccgtcgatatcatggggaacctgctttgtcatctacctgcagctattatcgatcgaggtatatccccaagggcttgggcaacagccctgcatggactgagggactgtccagatcttaatcctgaacaaaaagccgctgtgagattgaaactgctgggtcagtacggtctcccccagcactggaccgccgaaacgacaaaagaccttggtcccttcctggtcttatttagcggcgatgaactttcatctatagctacaaagttcccggaaatcctgctgcaggctgcttctaagatggcaaggacattaccaacgaaggaatttctctgggctgtgttccagtccgtgcgtaactcctcagacaaaatcccgagctacgaccccatgcccggttgtcacggcgtggtggcgcccagtagcgatgatatcttcaagttagcagaagctaatgcatgttgggctctggaggacctcagatgtatggaggaggacacctttatcagaacagtggagttgctgggcgcggtgcagggctttagtcgacctcagctcatgacacttaaagagaaggccatccaggtttgggacatgccatcctattggcgggaacatcatatcgtatcattgggtcgaatcgctttggcgctgaacgaatctgagttagaacagctagacctgagtagcattgacacagtagcctctttgagttggcagactgagtggacccccggacaagctgagtctattctgcagggctatctagatgatagcggctatagcatccaggacctcaaatcattccaccttgtaggactgggcgcgactctgtgtgcaataaatattaccgagattcctcttattaagattagcgaattccgtgttgtggtggcaagaatcggcaccctcctgtgttccacccatgtgctggcggaattcaagaggaaggccgaagtggtctttggtgaccccacggagtggacctcaagcgtgctccaggagctgggaacaatagctgcagggttgacgaaagcagagctgcggatgctggacaaggatttgatgccttacttccaaccgtcggccattaaatgcctaccagatgaaatctttaaggaactgagcgcagaacagatagcatccctgggccccgaaaacgcggccgcagtcacacacgcccaaaggagacgattaagtcctctccagttgcagtccctacagcaagctcttgatggcgcaaagacccacagttggcaggatgcccccgcttcagccggtccaacccgtacatcatcttctcgcagccctgccggcgcgctgcaaagttggggcctgtggctgggatgtcccctgttggtccttatggcaaaactgctttggtag

SEQ ID NO: 127473 - DNA, 3183 bp, Artificial Sequence
  Description of Artificial Sequence: Synthetic coding sequence
atgggtaactcgatcacctatagggaccaggcggcagtggaaaaccatctagagcagcggctccaccaaccgcagaagctcctagaggatctgcgcaagacagacgctcagcagtttagaacagcgatgaaatgtctcttggaggacaaaaaagatggcctcgatctaaaagacatcatcatcgatctgggcgagattagagaacgcgctctgcagtcccctggagtcaaccggtctctatttctgataacccttgagcggtgcttccaaatgctgaattccttggagtgtgtagagattctcggcaaagtgctgagggggtcgtctggcagctttttacagcccgacattacagaacgactgccacgagacctcagagaagacgcctttaagaacctgagcgcagtgttcaaagacctgtacgataagacatccgctcattctcaaagagctctgtactcttggatgacggggatcctgcaaacatcatcaaacgccactgacgattcagccagctgggtatccgccgagcatctatgggtgttaggaagatatatggtgcacctgagcttcgaggagataaccaaaatatcacccatcgaaattgggctgttcatatcctatgataatgctactaagcagctggacatggtatatgatattacaccagagttagctcaggcatttctggaacgcatttcttctagtaattttaacatgcggaacacgtctaccatacacagactaggtcttctcgtttgtttctacaacgacctggaattgctcgatgccacagtggctcaggtccttctgtaccaaatgattaaatgcagccacttgaggggttttcaggcgggagtgcagaagctcaaggccgagctactggacattgccatggaaaaccaaactttgaatgagactttagggtccctgtcagacgctgttgtcggtctgacatactcacagcttgagtctctttctcctgaggctgtgcatggggccattagtaccctcaatcaggttagcggatgggccaagtcccaggtgattattttatccgccaagtacttggcccatgaaaaggtgttgagtttctacaatgtgtcgcagatgggagcactcctggcaggggtgagcacacaggcattctgctctatgaaaaggaaggacattagccaggttctccgcagcgccgtctctcagtatgtgtccgacctctcacctgcccagcagcaggggatcctgagcaaaatggtgcaggctgaagataccgctcccggaatagtcgaaatccagggggcctttttcaaggaggtcagcctgttcgacttacggagacagcctggctttaattccacagtgctgaaagataaggagctgggacgcagtcaggcactgtttttatatgagctgctgttgaagaccacccgcaggcctgaggagctcctgtctgctggccagctagtaaaaggggtgacatgctctcatattgacgccatgagtactgatttcttcctagctcactttcaagattttcagaacaactttgccttgctgagcccctatcaagtgaattgcctggcttggaagtattgggaagtgagccgactttccatgccaccattcctgcttgctgccctgccagctaggtatttggcttctgtgcctgccagccagtgtgtccctttcctgataagcctgggaaagagttggctcgatagcctggtgctggactcacacaaaaagacgtccgtgcttaggaaggtacagcaatgtttagacgatagtattgcagatgaatatacagtcgacataatgggcaaccttctgtgccatctgccggctgccatcattgatagggggatctccccacgcgcctgggctacggccctgcatggcttgcgcgactgccctgatctgaatccggagcaaaaagccgctgtaagacttaagctcctcgggcaatatggcctaccccagcactggaccgcagagactaccaaagacctggggccatttctcgtattattttcaggcgatgaactgtcaagtatcgccacaaaattccccgagatcctgcttcaggccgctagcaagatggcccggacccttcccaccaaagagtttctgtgggcggtgtttcagagcgtcaggaacagctccgacaagattcccagttatgaccccatgccgggatgtcacggagtggtggcgccctcctcagacgacatctttaaactggctgaggccaacgcttgttgggctttagaggacctgcgttgtatggaggaggatactttcatcagaaccgtggaacttttaggagcagttcaaggattctctcgcccacagctcatgacccttaaagaaaaagccatccaggtttgggacatgccgtcttattggcgcgagcatcacatcgtgtccctgggcaggatcgcactggcactgaatgagtccgagctggagcagctcgatctgtcgtctatcgatacagtagcatctctgtcttggcagacagagtggacccctggccaggccgaatcaatcctccagggctacttggatgatagcggctattcaatccaggatctcaaatcctttcacctagtaggcttgggtgctacgctgtgcgcaatcaacatcacagagatacctctaattaaaatttcagagtttcgagtggttgtggctaggatcggcacattgctgtgttccacacacgtgctggccgagtttaaaagaaaggcagaagtggtgtttggagatccgaccgagtggacatcatccgtcctccaggaattagggactatcgccgccgggctgacaaaggctgaactcagaatgttagacaaagacctgatgccctattttcagccctccgctatcaagtgcctgccggacgaaatattcaaagaactgtcggccgaacagattgccagcctcggcccagagaatgccgctgccgtgacccatgcccagcgcagaagactcagccccttgcagctgcaaagtctccagcaggccttggatggtgcgaaaacacacagttggcaggatgctccagcctccgccggaccgacgcggacatcgagtagcagaagtcccgctggagccctccagagctggggactatggctggggtgcccactgcttgtcttgatggctaagctgctgtggtag

SEQ ID NO: 127474 - DNA, 2448 bp, Artificial Sequence
  Description of Artificial Sequence: Synthetic coding sequence
atgtttagattgggtctcttggtgtgcttctataatgatctggaactgcttgacgctactgtcgcgcaagtgctgctctaccagatgatcaagtgttcccaccttcgaggtttccaggctggtgtgcagaaacttaaggccgagttgctggatattgccatggaaaaccagaccttaaatgaaactctcgggtctttgtctgacgccgtggtggggttgacatactctcagctggagtccctgagtcccgaggctgtccacggggccatctcaacacttaatcaggtttcaggatgggccaaatcgcaggtgattatcctcagcgcaaaatacctagcgcacgagaaggtgttaagcttctacaacgtttcccaaatgggggctttgctggcaggggtgagcacgcaggctttctgcagtatgaagcgaaaggacatcagccaggtgttacgctcagccgtgagccagtatgtgtcagatctgtctcctgctcagcaacaggggatcttgagtaaaatggtgcaagccgaagatacagcccccggaatagttgaaattcagggcgccttctttaaggaggtgtccctgttcgatctccggagacagcccgggttcaacagcacagttcttaaggacaaagagctgggacgctctcaggccttattcctctatgagctactgcttaagacaaccagaagaccagaggagctgctttcagctggccaactggtgaagggagtgacctgcagccatattgacgccatgagcactgactttttccttgcgcatttccaggattttcagaacaatttcgctctgctcagcccatatcaagtcaactgtcttgcctggaagtactgggaggtaagtaggctgtcaatgcctccctttctgctcgcggctttacccgctcggtacctggctagcgtgccggcttcccagtgcgtgcccttcttgatttcattgggcaaaagctggctcgactccctcgtcttggactctcataagaagaccagcgtgttgagaaaagtgcaacagtgcctcgatgacagtattgccgatgagtacaccgttgatattatgggcaacctgttgtgtcacctgccagcggccattatcgaccgtgggattagtcccagagcctgggctactgccttgcacggtctgcgtgactgtccggacttgaatcctgagcaaaaggcagctgtccggctgaaactgttgggccaatacggcttgccgcagcactggactgcagaaactaccaaggatctgggccctttcctagtcctgttcagtggtgatgaattgagtagcatcgccacaaaattcccagagatcttactgcaagccgccagcaagatggctcggacacttcctactaaagaatttctgtgggccgtttttcagtctgtgcggaatagctccgacaagatccctagctatgacccaatgccgggatgtcacggagtcgtggcccctagctcggacgatattttcaagctggctgaagccaatgcatgttgggcgttagaggatttgagatgtatggaagaggatactttcattaggaccgtggagcttctaggggccgtacagggatttagcaggccccaactgatgactctgaaggaaaaggccattcaggtatgggacatgccttcctattggagggaacaccacatcgttagtctgggaagaattgccctggccctgaatgagagcgagctggagcagctagacttgagctccatagacaccgtggcttcactgtcgtggcagactgaatggacaccaggacaggccgaatccatcctccagggatatttggatgatagcgggtactccattcaagatctgaaatccttccatctagtcggcctgggagctacgctgtgtgcgatcaacattacggagatcccacttatcaagatttccgaattcagggtggtcgtagctcggatcggcacattgctgtgcagtacacacgtcctggccgagtttaagcggaaggctgaagtagtgttcggcgaccccaccgagtggacttccagcgtgttgcaagagctggggaccatcgcagcgggactcaccaaggccgagttgagaatgctggacaaggacctaatgccctactttcagccttcagccatcaagtgcctgcccgatgaaatcttcaaggagctgtcagccgagcagatcgcctccctcggacccgaaaatgccgccgctgtgacccatgcccagcggcgcagattaagtcccctccaactgcagtcccttcagcaggccctcgacggtgctaagacacattcgtggcaggacgcccccgctagtgccggacccaccaggaccagtagctcccggagtcccgccggcgctctgcagtcctggggcctttggcttggatgtccactcctggtcctgatggccaaactcctgtggtag

SEQ ID NO: 127475 - DNA, 3420 bp, Artificial Sequence
  Description of Artificial Sequence: Synthetic coding sequence
atgagccaggaacctacaacctacagcctgtttctcttcctgtttctgtcccacggcgtgagcagttacaccgtacccaactctagacaagacctccaccccttgctccagaatatggctgaagagataattgacggatcatatctgaacgcccttctggatttgattcagtttcaaagttcccacgtgtggactgatgacctgagccatcgcgtactcgcttatttaaattcacgcaatgtggccttcacaataccatctctccaagctgccgtggaaaatcacctagagcagcggttgcaccagcctcagaagttgctggaggatctgagaaagaccgacgcccagcagttcagaaccgccatgaagtgtctgctggaggataagaaagatggcctcgatctgaaggacatcataatagatctgggcgaaattagagaacgcgccttacagagccccggggtgaacagaagcttgttcctgattactctcgaaaggtgcttccagatgttaaactctctggagtgcgtggaaatattaggaaaggtgttgagaggcagtagtggatcgttcctgcagcctgacataaccgagcgccttccacgggatctccgggaggacgctttcaagaatctgtcagcggtgttcaaggatctctacgacaaaacaagtgctcattcccagcgcgctctgtatagttggatgacaggcatcctgcagaccagttctaacgccactgacgactccgcctcttgggtctctgccgaacacttgtgggtgctgggccggtatatggtacatttaagctttgaggagattaccaagatctccccaattgaaatcggactcttcattagctacgataatgccaccaaacagctggacatggtgtacgatatcacgcccgaactcgcccaggccttcctcgaacgcatctccagtagtaacttcaacatgcgcaacacatccactatccaccgtcttggtctgttagtctgtttttacaacgacctggaattgttggacgcgaccgttgcacaggtcctgctgtatcagatgataaaatgctcgcatttgagaggatttcaagcgggagtgcaaaaactcaaggccgagttactagacatagcaatggagaaccagactctaaatgaaaccctggggagtttatccgacgccgtggtgggtctgacatattctcagctagagtctctcagcccagaagctgtacacggcgctataagcactctaaatcaggtttccggatgggccaaatcacaggtgatcatactgtccgccaagtacctcgctcacgagaaagtgctgtccttttataacgtgtctcaaatgggcgcactgctggcgggggtctccactcaggccttctgcagcatgaagaggaaagatatctcccaagtcctgcgcagtgctgtcagccagtacgtttctgacctgagcccagcccagcagcaagggattctcagcaagatggtccaagcagaggatacagcccctgggatcgtagagattcagggcgcgttcttcaaggaagtgagccttttcgatctccgcagacaacccggattcaatagcaccgtacttaaagacaaggaacttggccgctcacaggccctcttcctatacgaacttcttctcaagacaacacggcgtcccgaggaactactctccgcgggccaactggtcaagggcgtgacttgtagccacattgacgccatgtccaccgacttttttctcgcccattttcaggattttcagaataacttcgctctgctatctccttaccaggtaaactgccttgcctggaaatactgggaggtctcacgcctgtctatgccgcccttcttgctcgccgccctgccagccaggtacctggcttcggtgcctgcatcccagtgcgtgccattcctaatcagtctgggtaaaagttggctggacagcttggtgttggactcccataaaaaaacctctgttctcaggaaggtccagcagtgcttggacgacagcatagcggacgagtatacagtggacatcatgggcaacctactctgtcaccttccagctgcaataatcgataggggtatctccccccgagcatgggccacggctcttcacggattacgcgattgtccagacctaaaccccgagcagaaggcggccgtgcggctgaagcttcttgggcagtacggactgcctcagcattggactgccgaaactacgaaggacctcggtcccttcttagttctgttcagcggagatgagctctcatctatcgccacgaagtttcccgagattttacttcaggcagcatcaaaaatggctcggacactgccaacaaaagagtttctgtgggccgtgttccagtccgtacggaattcttctgacaaaatcccatcgtacgatcccatgccgggatgtcatggggtcgttgcgccctcaagtgatgatatctttaagctggcggaagccaacgcctgctgggccctggaggacttacgctgtatggaggaggacaccttcatccgtaccgttgagctgctgggcgctgtacaaggcttttccagacctcagctcatgaccttgaaggagaaagctattcaagtttgggacatgccaagctattggagggaacaccatattgtttcactgggaagaattgctctcgctttaaacgagtcagaactggagcagctggatctctcttctattgacacagtggcttctctctcgtggcaaactgagtggaccccaggccaggcagaatctatcctgcaggggtacctggacgatagcgggtattctatccaggatctgaagagcttccacctcgtcggacttggtgcaacactgtgtgcaatcaatatcacagagatcccgctaattaaaatttcggaattcagagtcgtagtggcccgtatcggcaccttgctgtgctctacccacgtactcgccgagttcaaacgcaaagcggaggtagtgttcggcgacccgacagagtggacgtctagcgtgctgcaagaactgggaactatagctgccggcctgactaaggccgagttgagaatgctggacaaggatttgatgccttacttccagccctctgccattaagtgcctaccagatgagatcttcaaagaactgtcggcagagcagatcgccagtctgggtcctgagaacgccgccgcggtaactcatgcccaacgcagaagactgtcaccgctgcagcttcagagcttgcagcaggcgctggatggagcaaagacacactcgtggcaggatgcccctgcctcagctggcccgacccggacgtcaagcagcaggtctccggccggtgccttgcagagctggggactgtggctggggtgtccactgctagttctgatggcaaagttgctgtggtag

SEQ ID NO: 127476 - DNA, 1434 bp, Artificial Sequence
  Description of Artificial Sequence: Synthetic coding sequence
atgatcgcattcctcctgacatccgtgcttatgatcccccacgccggcggccaccctttagacaccccacacctccctcaggagctgcccccgggcctgccaaataacattaatataacatttttttcagggatgtttaaaaacgttgaatccgtcgcggaaatttttgattgtcttgggcctcatttcacatggctccaggctgtatttaccaatttccccgtgctcatccaatttgtgaacggtatgaaatgtgtcgcgggcctgtgtccccgggattttgaagactatgggtgcacttgccgcttcgaaatggaaggactgcctgttgatgaaagcgacagttgctgcttccagcaccggcggtgttatgaagaagccgccgagatggattgtttgcaggaccccgctaagttgagcaccgaggttaactgcgtgtccaaaaagatcatttgtgagtctaaagacaactgcgaacacctgctttgcacctgcgacaaggctgcaattgaatgcctggccaggtctagtctgaactctagtctgaaccttctggacacttccttttgcctggcccaaacgcccgagacgacaataaaagaagatttgactaccctgctgccgcgagtcgtacctgtggagccaactgacacctcccttacggcgttgagcggcgaggaagctggccatgaccaagagggtgtgggagcagccagagccacttcacctcccggtagcgccgaaatcgtcgccacgagggtcactgccaaaatcgttacgctggtccctgcaggaattaagagtcttggcctagcagtttcctcagtcgaaaacgaccctgaagaaaccacggaaaaagcctgtgacaggtttacgtttctccatctcgggtccggggacaacatgcaagtgatgccccagttgggtgagatgttgttctgcctgactagccgttgtcctgaggagttcgagtcttatggatgttattgtggacaggagggtcgtggtgaacctcgggacgatctcgacaggtgctgtctgagccatcactgctgcctggagcaggtccggcggctaggctgccttctggaacgcttaccttggtctccagtggtgtgtgtggaccatacgcctaaatgcggcggacagtccctgtgcgaaaagctgctgtgcgcctgcgaccagacagctgcagagtgcatgacctctgcctcattcaatcaatctctcaagtcaccaagtcgactggggtgcccgggacaaccagccgcctgcgaggattccctccaccccgtacccgctgcccccacactcggtagtagctctgaggaggattctgaagaagaccctcctcaggaagatctgggcagggcaaagcgatttctgagaaagagcctggggcccctgggcataggaccacttcatggccgatag

SEQ ID NO: 127477 - DNA, 1482 bp, Artificial Sequence
  Description of Artificial Sequence: Synthetic coding sequence
atgattgcatttctgctgacatctgtgctaatgattccgcatgctggaggccaccccctggacaccccacatctgccccaagagctgcctcccgggctacctaataatatcaacattacgttctttagcgggatgttcaaaaacgtggaatcagtggcagagattttcgattgtttggggcctcactttacgtggttgcaggccgttttcaccaattttccagttctgattcagttcgtaaatgggatgaaatgtgttgcgggattgtgcccccgcgatttcgaggattacggttgtacctgtcgctttgaaatggagggtttgcccgtggacgagagtgattcctgttgcttccagcaccggagatgctatgaggaggctgctgaaatggattgcctgcaggacccggcgaagctcagcacagaagtgaattgtgtcagcaagaagatcatttgcgagtccaaggataattgcgagcatctcctgtgtacctgtgacaaggcagccatagagtgcttagcacggtcatcactaaattccagtctgaacctgctggatacttccttttgcttggcacagacacctgagactacgattaaggaagacttaactactctcctacctcgggtggtgcccgtcgagcctacagacacttcgcttacggccttgagtggagaagtggccgccgaaacggaagcagacaggttgatcactttaagcaaaaagaaagctgggcacgaccaagagggggttggcgccgctagagctacctctccccctggctccgcggaaatagtcgccaccagggtgactgcgaagattgtcaccctcgtgccggctgggatcaaatcgctggggttggctgtctctagcgttgagaacgaccccgaggagacgacagagaaggcctgcgaccgcttcacatttcttcatttaggcagcggagacaatatgcaggtcatgccacagttgggggagatgcttttttgtctcactagccgctgccccgaggagtttgaaagttacggttgttactgtgggcaagagggacgcggcgaaccccgcgacgatctggacagatgttgtttatcccatcattgctgtctcgagcaggttcggaggctcggttgcctgcttgagaggttaccctggagcccagttgtgtgtgtcgatcacacccccaagtgcgggggccagtctctctgtgagaaactgctgtgtgcctgtgatcagaccgccgctgaatgcatgactagcgcatcattcaaccagagcctcaagtcaccatcccggctcggctgcccaggccagcctgctgcatgtgaagatagtctgcacccagtacctgctgccccaacattgggctccagcagcgaagaagatagtgaagaggatccaccgcaagaggacctgggtcgcgccaaaaggttcctgcgcaagtccctcgggccattgggcattggccccctgcatggccggtag

SEQ ID NO: 127478 - DNA, 5994 bp, Artificial Sequence
  Description of Artificial Sequence: Synthetic coding sequence
atggcactactgatacacctgaaaaccgtctccgagctgcggggccgcggtgataggattgctaaagtgactttcagaggccagtcattttattcccgagtgttggagaattgtgaggacgttgcagattttgacgagacgttccgatggcccgtagccagtagcatagataggaacgaaatgcttgagattcaagtgttcaattactctaaggtgttttccaataagctgattggcactttcagaatggttctgcagaaagtggtggaggaatcccacgtagaggttacagacacactcattgacgataacaacgctataataaaaacctccttgtgtgtggaagtcaggtatcaggccaccgacggaacagtgggtagctgggatgatggcgattttctcggggacgagtctctgcaggaagaggagaaagactctcaagaaacagacggattgctaccaggttctcgacctagcagccgcccaccaggcgaaaaaagcttccgcagagcggggaggtccgtgttttccgcgatgaaactgggcaaaaaccggagtcataaggaagagccccagcgacccgatgagcctgccgtcttggagatggaggacttggatcatctggccatcaggctcggcgatgggttggatcccgacagtgtctcattggcctccgtgactgctttaaccactaacgtctcaaacaaacggagtaagcctgacataaagatggagcctagtgccggccggccgatggactaccaggtttccataacagtcattgaggcgcggcagctggttggcttaaacatggacccggtggtttgcgtagaagtgggcgacgacaagaaatataccagcatgaaggaatccacgaactgtccctattacaatgaatatttcgtgttcgacttccacgtgtctccagatgtgatgtttgacaaaatcataaaaatttctgtcatccactccaaaaacctactacgatccggaactctggtgggaagttttaagatggacgtaggaactgtttatagtcaacccgaacaccagtttcaccataagtgggcaattctgagcgaccctgacgatatttcatctgggctcaagggctacgtgaagtgcgacgtggcagttgtggggaagggcgataacatcaaaacgccccacaaggccaacgagacggatgaggacgacatcgagggcaacttgctgctacccgagggtgtgccccccgagaggcagtgggcccgcttctacgtcaaaatctaccgggccgaagggcttcctcgaatgaatacctccctaatggccaatgtgaagaaggcttttatcggggagaataaagacctggtcgatccctacgttcaggtttttttcgctggacaaaaaggtaaaacctcagtgcagaaatcaagctatgagccactgtggaacgagcaggtcgtgttcactgacttattcccccccctgtgtaaaagaatgaaggtgcaaataagagattctgataaggtgaatgacgtcgctattggtacccattttatagacctgagaaaaattagcaatgacggagataagggcttcctgcctacattgggccctgcctgggtcaatatgtacgggtccacaagaaattatacacttttagacgaacaccaggacctgaatgagggccttggtgaaggcgtgtctttccgagcaagactactccttggcctggcagttgagatcgttgacacaagtaaccctgagctgacaagtagtaccgaagtgcaggtcgaacaagctactcccataagtgaaagttgtgctgggaaaatggaggagttttttctgtttggagcattcctagaggccagcatgattgatcgacggaatggggataaacctatcaccttcgaagtcactatcggaaactacggaaacgaagttgacggcctctcccggccgcagaggccccgcccacgcaaagagccaggtgatgaggaagaagtcgacctcatccagaatgcctcagacgatgaagccggtgacgcaggcgatctcgcttccgtgagctcgaccccacccatgcgccctcaggttaccgaccggaactactttcatctcccgtacctagagaggaagccttgtatatacatcaagtcttggtggccagatcagcgacgacgactgtataacgcaaacatcatggatcatatcgccgacaagttggaagaaggcttgaatgatatccaggagatgattaaaacagaaaagtcctatcctgagcggaggctacgtggcgtactggaagagctctcctgcgggtgttgccgcttcctgtccctggcagacaaagaccaaggccactccagccgtacaagattggacagagagcggcttaagtcttgtatgcgggaactagaaaatatgggacagcaagcccgtatgctgcgggctcaagttaagcggcacacggtcagggacaaactcagactctgccagaattttctccaaaagttgaggtttcttgcagatgagccccagcactctattcctgacatttttatatggatgatgtctaacaacaaacgggtggcatatgccagagttcctagcaaagatctgctgttttctattgtggaagaggagaccggaaaggattgtgccaaggtgaagaccctattccttaaattacccggcaaacgtggatttggctccgcaggctggactgtacaggctaaggttgaattatacctatggctcggtcttagcaagcagagaaaggagttcctgtgcggcttaccgtgtggatttcaggaggttaaggccgcacagggactgggtctgcacgctttccccccagtatcactcgtttatacgaaaaaacaagcctttcaacttagggcgcatatgtaccaggcccgcagtctatttgcagccgactcaagtggactttccgatccctttgcccgtgtcttcttcatcaatcaatcccagtgtactgaggtgctgaatgaaaccttgtgccctacctgggatcagatgttagtgtttgataatctggagctttacggcgaggcccatgagctgcgcgacgacccacccatcatagtcatcgaaatatacgaccaggactctatgggtaaggccgattttatgggtcgcacattcgcaaaacccctggtcaagatggctgatgaggcatactgtccacccagattccctcctcagttagaatattaccagatctatagaggaaacgcgacagctggtgatcttttggcagcgttcgagctgctccagataggtcctgccggcaaggctgacttgccccccattaatggcccagttgacgtagacaggggccctatcatgcccgtgccaatgggcatacggcccgtcttgtcaaagtaccgcgtggaagttctcttttgggggctcagagaccttaagcgagtgaaccttgcccaggtggaccgccctcgcgttgacatcgaatgcgccggaaagggggtgcagtcctctttgatccacaactacaaaaaaaatccaaacttcaataccctggtgaaatggtttgaggtggacctgccggagaatgaactcctccaccctcctctaaatatcagagtggttgactgtcgcgcgtttggccggtatactctggtgggatcccatgccgtttcaagccttcggcgcttcatttatcgtcccccagaccggtctgccccttcatggaacacaaccgtgcgcctgctacgccgatgtcgggtgctgtgtaatggcggcagctccagtcactccaccggagaggttgtagtgacgatggaacccgaggttcctatcaagaagcttgagacaatggtcaagttggacgccacttccgaagcagtggtgaaagtggatgtggccgaggaagagaaggaaaagaagaagaaaaaaaaggggactgctgaggagcccgaggaggaagaacctgacgagtccatgctggactggtggtcaaagtacttcgcatctattgacacaatgaaagagcaactgagacagcaggaaccttccgggatagaccttgaggagaaggaagaggtggataatactgagggacttaagggctctatgaaaggaaaggagaaggcccgggctgcaaaagaagagaaaaaaaaaaaaactcaatccagtggttccggtcagggttccgaagcacccgagaaaaagaaaccgaaaattgacgaactgaaggtctacccaaaagaactcgaatccgagtttgataatttcgaagactggctgcacacattcaatctgctgagggggaaaactggggacgatgaggacggcagcacggaagaagagcgtattgttggcaggtttaagggatctctctgtgtctataaggtccctctacccgaggacgtcagcagagaagctggatatgacagtacatatggaatgttccagggcatcccctccaacgacccaataaatgtgcttgtgagagtgtacgtcgtgagggccactgatctgcacccagcggacattaacggtaaggcggatccctatatcgctataagactgggtaaaacagatatacgggacaaagagaattatatttccaaacagcttaatcccgtcttcggaaagtccttcgatattgaggccagctttcctatggaatcaatgcttactgtagccgtttatgattgggacttggtgggtacagatgatctgataggagaaacaaagattgatttagagaacagattctattcaaaacaccgggccacctgtggtatagcacagacctacagtacgcatggctataacatctggcgagatcctatgaagccaagccagattttgactcgcctgtgtaaggatgggaaggttgatggccctcactttgggcctccgggccgggtcaaagtggcaaaccgcgtgtttacaggaccctctgagatcgaggacgagaatggacagcgcaagcctacagatgagcacgtggcactattagccctcaggcattgggaagatatccctagggctgggtgtaggctggttccagaacatgtggagacacggcccctgttaaaccctgataaacctgggatcgaacagggtcgtctggagctttgggtcgatatgttccccatggacatgcccgctccgggcaccccactggatatttctccaagaaagcccaagaagtacgaacttcgggtgatcatctggaacaccgacgaagttgtcttagaggatgacgatttttttactggcgagaaaagcagcgatatcttcgtgagagggtggttgaaggggcagcaagaagacaaacaggatactgatgtgcactatcactcattgactggagaaggcaactttaattggaggtacttgttcccattcgactatctcgccgcagaggagaaaatagtaatttctaaaaaagagagcatgttctcatgggacgagaccgagtataaaatccccgcacggctcactctgcaaatctgggatgccgaccacttttcagccgatgacttcctgggcgccattgagctggatttgaatcggtttccgagaggcgccaagaccgcaaaacagtgtacaatggaaatggctacaggggaagtggatgttccactggtgtccatatttaagcagaagcgagtgaagggctggtggccactgctggccaggaacgaaaacgatgaatttgaactcactggaaaggtggaggcagagctgcacctcctcacagccgaggaagcagaaaagaatcctgttggactggcacggaacgagcctgatcccctggaaaagcctaacaggcccgacactagctttatctggttcttgaaccctctgaagtcggcccgttatttcctgtggcatacttatagatggcttctcttgaagctgctcttactcctactgctactgcttctgcttgccttatttctgtattccgttccaggctacctcgtcaagaagatcctgggagcgtag

SEQ ID NO: 127479 - DNA, 3693 bp, Artificial Sequence
  Description of Artificial Sequence: Synthetic coding sequence
atgatcaaaaccgagaagtcctatcccgaaagacgactgcgtggcgtcctcgaagaactatcttgcggctgctgcaggtttctaagtctggccgataaagaccaaggacacagcagtcgcactcggctggacagagaaagacttaaaagctgtatgcgcgagctggaaaatatggggcagcaggcccggatgctgagggcccaggtgaaaagacacaccgtcagggacaagctgcggctgtgtcagaacttcctgcagaagctgagatttcttgctgatgagccacaacattcaatcccggacatcttcatctggatgatgagcaacaataaacgagtggcatatgctagggtgccatcgaaagacctgttattttcgatcgtggaggaagagacggggaaggactgtgccaaggtgaaaactctgttcctcaagctgccagggaaacgtggattcggcagcgctggttggacagtccaggcaaaggtggaactgtatctctggctcggactgtccaagcagcggaaggaatttctgtgcggactcccgtgtggatttcaggaggtcaaggctgcgcaggggctaggccttcacgcttttcctccagtcagcctggtgtacacaaagaagcaggcgtttcagctgagagcccatatgtaccaggcaaggagccttttcgcggcggactcatctggcctgtctgaccccttcgctcgagtgttctttattaatcagagtcagtgtaccgaagtattgaacgagactctctgtcccacttgggatcagatgttggtgttcgataatttggaactatatggggaggcccacgaattgcgcgatgacccgcctattatagtgatcgaaatttatgatcaagatagcatgggaaaagctgatttcatgggccgaacctttgctaagcctcttgttaaaatggcggacgaagcttattgcccgcccagatttccaccccagctagagtactaccagatctataggggaaatgcaacagcgggagaccttctcgctgctttcgaattgctgcagatagggcccgccggcaaggctgatctgccaccaattaatgggccagtggacgtggaccggggccctataatgcctgtaccgatgggaatcagaccggttctgtcaaagtatcgggtggaagtgttgttctggggacttcgggacctcaaacgagttaatttggctcaagttgatcggccccgggttgatattgagtgcgcagggaagggagttcagagctcattaatacataattataagaaaaaccccaacttcaacacccttgtgaaatggttcgaggtagacctacctgaaaatgagctgttacatcctccccttaatataagagtggtggattgccgggcttttggccgctatacacttgtggggagtcatgcagtctccagcctcagaaggttcatttacaggcccccagacaggtctgcccccagttggaatacaactggtgaagtggtggttacaatggagcctgaagtgccgatcaagaaactcgaaacaatggtcaagctggacgccacctcagaggccgtcgtcaaggttgatgtggccgaggaggagaaagagaagaagaagaagaaaaaaggcacggcagaagagcctgaagaggaagaaccagacgaaagtatgctcgattggtggtccaaatatttcgcaagtattgacactatgaaggagcagctgaggcagcaggagccaagcggtattgatctggaagagaaggaagaagtcgacaataccgagggtctcaaaggatctatgaagggcaaagaaaaagctagggcagctaaggaggaaaaaaaaaagaaaacccagtcatcgggcagcgggcagggatctgaggcccctgagaagaaaaaacctaagatagacgagctgaaggtatatcctaaagagctagaatctgagttcgacaacttcgaggattggctgcatactttcaatttactgcggggcaagacaggtgatgatgaagatggtagcacagaagaggaaaggatcgtgggaagatttaagggctcactgtgcgtttataaggtccccttacccgaggatgtctctagagaggctggttatgacagcacttacgggatgttccagggcatccccagcaacgatccgatcaatgtgctggtgcgtgtttacgtggtgagagccaccgacttgcaccctgccgacatcaatggaaaagccgatccttacatcgccatcagattggggaagaccgacataagagataaggaaaactacatttcaaaacagctgaatcctgtgttcggtaagagcttcgacattgaggcatccttcccgatggagagtatgctgacagtcgcggtttacgattgggacttggtggggacagacgaccttatcggcgagacgaaaattgacctggaaaacaggttctattccaaacaccgggccacctgtggaattgcccaaacctattccacacatggatacaacatttggagggacccaatgaagccatcccagatcctgacacgtttgtgcaaggacgggaaagtcgatgggccccactttgggccccccggccgggttaaagtggcaaacagggtttttactggccctagcgaaatcgaagacgaaaacggccaacggaagccaactgatgaacacgtggcactcctagccttaaggcactgggaggacatccctagagcgggatgccgtctcgtacctgaacacgtggaaacaagaccgctcctgaaccctgacaagcccggtattgagcagggccggttggaactgtgggttgatatgtttcctatggatatgccggcccccggaacacctctcgatattagtcccaggaaaccaaagaagtatgagctgagggtcataatttggaacaccgatgaagttgtcttagaagatgatgacttctttactggtgagaagtctagtgacatctttgttagaggttggctgaaaggccagcaggaggacaagcaggacacggatgtgcattatcatagtctgacaggggaaggtaactttaattggcggtatctgttcccgtttgattacctggccgcggaggagaagatagttatctccaagaaagaaagtatgttttcatgggacgaaaccgaatacaagatccccgcaaggctgacactgcaaatctgggacgctgaccatttcagcgccgacgacttcctgggggccatcgagctagatctaaatagatttcctagaggtgctaaaacagccaaacagtgtacaatggagatggctaccggagaggtcgatgtgccgctggtgtcgatctttaagcagaagagagtgaagggctggtggccattacttgcgcgaaatgagaatgacgaattcgaactgacaggcaaagtagaagccgaactgcatctgttgaccgccgaagaagcagagaagaaccccgtaggcttggcacgaaatgaacctgacccactggagaagcccaatcgacccgatacaagctttatttggtttctcaaccctctaaagagcgccaggtatttcctttggcatacctaccggtggttgctcctgaagctgctcctacttctgttgctgctgctgttgctggcactatttctctacagcgtacctgggtatctggtgaaaaagatactgggagcctag

SEQ ID NO: 127480 - DNA, 3693 bp, Artificial Sequence
  Description of Artificial Sequence: Synthetic coding sequence
atgatcaagaccgagaagtcatatccagagcgaagacttcgcggagtgttggaagagttatcttgtggctgttgccgattcctctccctggccgataaggaccaaggtcactcgagccggacccgcctggaccgcgaacgcctgaagagctgcatgcgagagctggagaacatgggacagcaggccagaatgttgcgtgcacaggtaaagagacacaccgtgagggacaaactccgtctgtgccagaattttctccaaaagctccgatttctggctgatgagcctcagcactccattccagatatctttatttggatgatgagtaataataagagggtggcatacgcgcgggtcccatccaaggatctacttttttccatagttgaagaggagacaggtaaagattgcgccaaggtgaagaccctgttcctcaaactgcccggcaagcgagggttcgggagcgcaggatggactgtccaggccaaggtcgaattatatctctggttaggtctcagtaagcaaagaaaggagttcctctgtgggctgccttgcggattccaagaagtgaaggctgcacaggggctgggcctccacgcattcccaccggtgtcactggtgtatactaaaaaacaagcgttccagctccgcgcgcatatgtatcaagctcgatctctgttcgctgccgattcttccggtttgtctgatccttttgctagagtcttcttcataaatcagtcccagtgtaccgaggtacttaatgaaaccctctgccccacctgggatcagatgttggtgttcgacaacctcgaattgtacggagaagctcatgagcttcgagatgatcctccaatcatcgttattgaaatctatgatcaggacagcatgggaaaagctgacttcatgggtaggacctttgcaaagcccttagtaaaaatggcagacgaggcgtattgcccacctcggttcccgccccaactggaatattaccaaatctacaggggcaacgcaaccgccggagacctccttgcagcgtttgagctgttgcaaatcggcccagccggtaaggccgaccttcctcccattaacggtccagtagatgtggatcgcggtccgattatgccagtgcctatgggcatacgccccgtgttgtctaagtatcgtgtcgaggtgctattctgggggttaagggatctgaaacgagtcaacttagcacaggtggatcgcccaagagtggacatcgagtgcgcggggaaaggcgtgcagtcgagcctcatccacaattacaaaaagaaccctaactttaataccctcgtcaaatggttcgaagtcgatctgccagagaacgagcttcttcatccccccttgaacatccgtgtggtggattgtcgggcctttggtaggtatacacttgtcggctcacatgctgtctcctcactgcgccgattcatttacagacccccagataggagcgctccctcctggaatactaccggggaggtggttgttactatggagcctgaagtgcccataaaaaaactggagactatggtaaagcttgacgccacatcagaggcagtggtgaaggtggatgtggcggaggaggaaaaggagaagaagaaaaaaaagaaaggaaccgctgaggaacctgaagaggaggagccggacgaatccatgctggattggtggagcaagtactttgcctctatagacactatgaaagaacaactgcggcagcaggagccatctggcatcgatctcgaggagaaggaagaggtcgataatacagaggggctgaagggcagcatgaaggggaaggaaaaagcacgggccgcaaaagaggaaaaaaagaagaaaactcagtccagtgggagcggccaaggctctgaggcccccgagaaaaaaaagcccaagattgacgagttaaaagtctatccaaaagaacttgaatccgaattcgacaacttcgaggattggctccatactttcaacctactgagaggcaaaactggagacgatgaagacggcagcactgaagaggagaggattgtcgggcggttcaaaggttccctctgcgtgtataaagtaccactgcccgaagacgtatcccgcgaggcaggctacgacagtacatatggcatgtttcagggcataccatccaacgaccccatcaatgtgctggtgagagtgtacgtggtgcgtgcgacagatctgcaccctgccgacattaatggcaaagctgatccttatattgcgatcaggttgggtaaaacagacatccgagacaaggaaaattacatcagtaagcagttaaaccctgtcttcggaaaatcatttgacatcgaggcaagtttcccgatggaatcaatgcttactgtggccgtgtatgattgggacctggtcggaactgatgatctcattggcgagaccaagatcgacctggaaaaccggttttacagcaagcaccgagccacgtgtggaattgcacaaacctactctactcacggttataatatatggcgcgatcctatgaaaccatctcagatcctcaccagactctgcaaggatgggaaggtggacggcccccactttggtcccccaggccgggtcaaagtggccaatcgcgtgtttacgggcccatctgaaatcgaggatgagaacggtcagagaaagccgactgacgagcatgtggctctgcttgccttgagacattgggaggacatcccgagggccgggtgtcggctcgtacccgaacatgtggagacccggcccttgctgaatccagataagccggggatagagcagggcagactagagctgtgggtggatatgtttcccatggacatgcctgctccgggcacaccacttgatataagcccccgcaaaccgaaaaagtatgagctcagagttatcatctggaatacagatgaagtcgtattggaggacgatgacttttttaccggcgaaaagtcgagcgatattttcgtccgggggtggttaaaaggacagcaggaggacaagcaggatacagacgtgcactaccattccctaacaggtgaaggtaatttcaactggcgttacctatttccatttgattacttagctgctgaggaaaagattgtgatctccaaaaaggagtcgatgttctcctgggacgagaccgagtataaaatcccagcccgactgacattgcagatttgggatgccgatcacttcagtgcagatgatttcctgggcgccatcgaattggacttaaataggttcccgcggggggctaagaccgcgaagcagtgcacaatggaaatggctactggcgaagtcgacgtccccttggtgagcattttcaaacagaagcgagtcaaaggatggtggccgctgcttgcaagaaacgagaacgacgagttcgaattgacaggcaaggtggaagccgagcttcatttgcttacagccgaagaggccgagaagaatcccgtcggattggcccgaaatgagcccgacccgctggagaaacccaaccggcctgatactgcgtttgtttggttcttgaacccgctgaaatccataaagtatctgatctgtactcgttacaaatggctcattatcaagattgtcctggccctgttagggctgctgatgttgggcctgtttctctattcgctccccgggtacatggtcaagaagctgttgggagcatag

SEQ ID NO: 127481 - DNA, 234 bp, Artificial Sequence
  Description of Artificial Sequence: Synthetic coding sequence
gaggccgagaaaaatcccgtgggtctcgctaggaatgaacccgatccgttggagaagcctaaccgccccgatactgcatttgtttggtttctgaaccccctgaaaagtatcaagtacctaatttgtacgcgctataaatggctgattattaaaatcgttttagcactgggttgcagctgctggggacccttgcaaccaccgtggctgcacggccagaaggccccatggggctag

SEQ ID NO: 127482 - DNA, 342 bp, Artificial Sequence
  Description of Artificial Sequence: Synthetic coding sequence
gacttcctaggcgacgaatctctgcaggaagaagagaaagattcacaggagacagatggcctgctgcctgggtcacggcccagctctcggccacccggggaaaaaagtttccggagcaagggtagagagaaaacgaagggggggcgggatgatgaacataaggcaggccgtagcgtcttttccgcgatgaaactcgggaagaatcgctcgcataaggaagagccgcagagaccggatgagcccgcggtgctggagatggaagatctggatcatcttgctatacggttgggtgatggactagatcccgacagtgtgtctttagcttctgttactgcactctag

SEQ ID NO: 127483 - DNA, 3924 bp, Artificial Sequence
  Description of Artificial Sequence: Synthetic coding sequence
atgatgaccgatacccaggacggacccagcgaaagcagtcaaattatgcgcagcctgacacctttaatcaatagggaagaagcatttggcgaggctggagaagccggactgtggccgtccattacacacactcctgacagccaggaggaggggctcaacgacatacaggaaatgattaaaaccgagaagtcgtaccctgagcgccgtctacgcggcgtgctggaggagctttcgtgtggatgctgccgctttctgtctctggcagataaagatcagggacactcctctcggaccagactcgatagggaacggttaaaaagctgcatgagagaattggagaatatggggcagcaggctcgtatgctgagagcacaggttaaacgacacactgtgcgcgacaaactgagactctgccagaatttcctccaaaagctgcgtttcttggcggacgagccccagcatagtattcctgatattttcatttggatgatgtccaacaacaagcgggttgcctatgcccgcgtgcctagtaaagacctcctcttctcaatcgtggaagaggaaacaggtaaagattgtgcgaaggttaaaaccttattcctcaagttacccggaaaacgaggctttggatcggctggttggaccgtgcaggccaaagtcgagctctacctctggttggggctgtcaaagcagaggaaagaatttctctgtggtctgccatgcggctttcaggaggtgaaggccgcccagggcctgggtttacatgccttccctccagtcagtcttgtctacactaagaaacaggcatttcaattgcgcgcgcacatgtatcaggccaggtccctctttgccgccgactcatctggtttaagcgatccgtttgctcgggtctttttcatcaatcagtctcagtgcaccgaggtactcaatgagactttatgtcctacatgggatcagatgctcgtgtttgacaatctggaattgtacggcgaggctcatgaacttcgggatgacccaccgataattgtgattgagatatacgatcaggattctatgggaaaagcagacttcatggggcggacgttcgccaagcctctagtgaaaatggcggacgaagcctactgtcccccgagattcccacctcagctggaatactatcagatctaccggggaaacgcaactgctggcgatctcctcgctgccttcgaacttctccagattggcccggctggcaaagcggacctccccccaattaacggaccagtggacgtggatcgcgggcctattatgcccgtgccgatggggatccgccccgtgctgagcaagtatcgagtggaggtgctgttctggggactcagggaccttaaacgggtgaatctggcccaggtggatcggcctcgggttgatattgagtgcgcgggaaaaggcgtgcagagttctttaatccacaattataagaagaatccgaatttcaatacactggttaagtggtttgaggtcgatctgccggagaacgaattgctgcaccccccactgaacatcagggttgtggactgccgtgcgttcggtagatacaccctggttggatcgcacgcagtgtctagtttgcggagattcatatataggccaccagatcgttcagctcccagttggaatactactgtaaggttgcttagaagatgccgggtgctgtgcaacggaggctcgagtagtcattccacaggcgaggttgtggttacgatggaaccagaggtgccaataaagaaactggaaactatggttaagcttgatgccaccagcgaggccgttgtcaaggtggacgttgctgaagaagagaaagagaagaaaaaaaaaaagaaaggaaccgccgaagagcccgaggaggaagaaccagacgaatcgatgctcgactggtggtccaagtatttcgcatctatcgatactatgaaagagcagctaagacagcaggagccttctggtattgacctcgaggaaaaggaagaagtcgacaatacggaagggctgaaggggagtatgaagggcaaggagaaggcccgcgccgccaaagaggagaagaagaaaaagacacagtcctcaggttctggacaggggagtgaggcccccgagaaaaagaagcctaagatcgacgagcttaaagtatatcctaaggagttagagtccgaatttgataacttcgaagactggcttcacacgttcaatcttctgagaggaaagacgggggacgacgaggacggatcgaccgaggaggaaagaatcgtcggccggtttaaaggaagcctttgcgtgtacaaagtgcctctgccagaggatgtctcaagggaagcaggatatgacagcacctacgggatgttccagggaattccgtcaaacgaccccatcaatgtgctcgtaagagtgtatgtggttagggctacggatctacatccagccgatattaatggcaaagccgatccatacatcgccatacggctgggcaagaccgatatcagggataaagagaactacatctccaagcagctgaacccagtattcggtaaatcctttgatatcgaggcatcctttcccatggaatccatgctcaccgtcgctgtgtacgattgggatttagttggtaccgacgatctgataggtgaaacaaagatcgacctggaaaatcggttctattcaaaacatcgcgccacctgcggcattgctcagacttactcaactcatggatacaatatatggcgcgatcctatgaaaccctcccagatcttgacacggctatgcaaagacggaaaggtggatgggcctcactttgggcctccagggcgagtgaaagtggcaaaccgagtctttacgggtccttccgaaatcgaggacgaaaacggccagcggaaacctaccgatgaacatgtcgctctgctcgccctaagacattgggaggacatccccagggctggatgccggctggtccctgagcacgtggagactaggcccctgctcaacccagacaaaccaggaatcgaacaaggccgtctggaactttgggtggacatgtttcccatggacatgccggcaccaggaacacccctggacatctccccacgcaaacctaagaagtatgaactgcgggtgatcatctggaataccgacgaagtcgttcttgaggatgacgatttttttacaggtgaaaaaagctctgatatcttcgtcagaggatggctgaagggacagcaggaggataaacaggacacagatgtgcactatcattctctgacgggcgaaggtaactttaactggaggtacctatttcccttcgattaccttgccgccgaggagaaaatcgttatatcaaaaaaggagtcaatgttctcgtgggacgagactgaatacaagatcccagccaggctcactttgcaaatttgggacgcggatcatttctccgccgatgattttctaggggctattgaactggacctcaataggttcccccgtggcgctaagaccgccaagcagtgcaccatggagatggcaactggagaggtggacgttccccttgtcagcatctttaagcagaagagggtgaagggatggtggcccttgctggcacggaacgaaaatgacgagttcgagttaacaggtaaggtggaggccgagctgcacttgctgaccgcagaagaggctgagaaaaatccggtagggctagcccggaacgagcctgatcctctcgaaaaacctaatagacctgacacctcatttatctggtttctcaatccactaaagtccgcccgttacttcctctggcacacctaccggtggctactgctgaaactgctgctgttgttgcttctacttctcctgctcgccctgtttctttattccgtcccaggatacctggttaagaaaatcctaggggcctag

SEQ ID NO: 127484 - DNA, 4527 bp, Artificial Sequence
  Description of Artificial Sequence: Synthetic coding sequence
atgtttccagccaggggagtgccgctgcacctagaaggggagggggtctttccatggggaccaggggacgtctcactgccgtatttatctaccagtgatgtgtcctttagcgtgattgttgagaacgtgaattgctactctagcggcatgatctgtaggaaatttatatcaatcaatgtgggcaacagcctgatcgtgttcgatgacgacagcggtaacccatctcccgagagctttctggacgataagcaggaagttcatacctggcgggttgggttttttactctcgtacacttccctcaggagcacattacacttctgtgggaccagcgcaccactgtgcatgtgcaggccgggcctcagtggcaaggccagctcgctggcctctgcggcaactttgaccttaagaccatcaatgaaatgcggactccagagaatctcgagctgactaacccccaagagtttggcagcagttgggccgccgtggagtgccccgatacgcttgatcccagggatatgtgcgttctgaaccctctccgggagccgtttgctaagaaggagtgctctatcctcctctccgaagtcttcgaaatatgccaccctgtggtcgatgttacgtggttctactcgaactgcctgaccgatacatgtggctgctcccaaggcggtgattgcgaatgcttttgcgctagtgtgagtgcttacgcacatcagtgctgccagcacggagtggctgtagactggagaacccctaggctgtgcttgctgggtaagggaccataccagctctcaagcctcgctgccggaggggcactagttggtatgaaggccgtgggagacgacatcgtgttagtcagaaccgaggatgttgcaccagccgacattgtgagctttctcctcacagctgccctgtataaggccaaggcccacgatcccgacgtagtctccctggaggcagcagaccgtcctaacttcttcctgcacgtgactgccaatgggagtcttgaacttgccaagtggcaggggagagacactttccaacaacacgcctctttcctcctgcacagaggaacccgacaggccggactggtggctctggagtctctagccaagccgagttcctttctttatgtgtcgggagccgtactcgcactgaggctctacgagcacaccgaagtcttccgccggggaacactgtttcggctgctggatgctaagcctagcggggccgcctatccgatctgtgaatggcgctacgatgcctgtgcgtcaccttgtttccagacttgtcgagatccaagggccgcatcctgccgggacgtgccccgtgtggaaggatgtgtaccagtgtgccctaccccacaggtgctggatgaagtcacccagaggtgtgtatatctcgaagattgcgtggagcccgccgtatgggtgcctactgaggccctcggtaatgaaaccctccccccatctcaggggctccctactccctcggacgaggaaccccaattatcacaggagagtccaagaacacctactcaccgacccgccctgactcctgcagctccccttacaaccgcgctcaaccccccagttaccgctactgaagaacctgtggtttctccaggccccacacagacgactcttcaacaaccactggaactgaccgcatcacagctccccgcgggacctaccgaaagccccgcttcgaagggcgtcacggcctcattgctggcgatcccacacaccccagagagctcttccctgcccgtcgctctgcagactcctactccaggtatggtgtcaggcgctatggaaaccactagagtgactgtaatatttgccggctccccaaacattactgtgtcttcccggtcacccccagctcccaggtttcccctgatgacaaaagccgtcacggtaagggggcatggcagcctccccgttcgtaccacaccgccacaacccagtcttactgccagcccctcctctcggccagtggcctctccgggggcaatttcaaggtcacctaccagttctggctctcacaaagcagtcctcacacccgcagtgactaaggtgatctccagaacaggtgtgcctcagcccacacaggcacagtctgcctccagccctagcacacccctcacagtcgccggaacagccgccgagcaggttcccgtctctcctctcgcgactaggagcctggagattgtcttgagcactgaaaaaggtgaggcgggccacagtcagcccatgggctcccccgcatccccccagccgcacccattaccttcagcgccccccaggccagcccagcatacaacgatggccactcgctcacccgcactcccccctgagacgccagctgctgcctcactctctaccgccacagatggcttggcagccactccttttatgagccttgagagcactaggcccagccaacttctgtcaggcctgccccccgatacgagcctgccactcgccaaggttggcacctctgcccctgtcgccacacccggtcccaaggcatccgtgattacaacacctctgcagcctcaggctactaccctgccagctcagacacttagtcctgtcctgccttttacccctgcagccatgacccaagcacatccacccacccacattgcccctccagcagccggtaccgccccagggctgttattaggagctaccctcccaacctctggggttctgcccgtggccgaaggcacggcttccatggtgtccgtagtccctcggaagtccaccaccggtaaagtggccatactaagcaaacaggtttccctgcctacttccatgtacgggtcagcagagggtgggccaacagaacttacacccgccacatcacacccactcacccccctcgtagctgagccagaaggagctcaggctggaacggctctccctgttcctaccagctacgcactgagccgcgtcagtgcccgaacggcgccccaggatagcatgctggtcctcctgcctcagcttgctgaagcccacggtacatcagctggtccccacctggcagcagagcccgttgatgaagcaactactgagccaagcgggagatccgctcccgccctgagcatcgtggaggggttggcagaggccttggccactactaccgaagctaacacttccactacgtgtgtcccaattgcagagcaggactgtgtgcggcacatttgtctggaaggacagcttattagagtgaaccagtcccagcattgtccccagggggctgctccgccgcggtgtggcatactgggacttgctgttagggttggaggcgaccggtgctgccccctctgggaatgtgcttgcagatgcagtatttttccagatctatccttcgtcacttttgatggaagccacgttgcgctgttcaaagaagcaatctatatcctgagccagagccccgacgagatgctgacagtgcacgtgctggattgcaagagcgctaacttaggccatctgaattggccaccattctgcttggttatgctgaacatgacacacctggcacatcaagtgacgattgacagatttaatagaaaagtaaccgttgatctacaaccagtgtggccgcctgtaagccggtatggcttcaggattgaagacactgggcatatgtatatgatcttgactcccagcgatatccagatccaatggctccattccagcggcttgatgattgtggaggctagcaaaacctccaaggcgcaggggcatggcctgtgtggtatttgcgacggcgacgctgccaacgacctaactctgaaagacggatccgttgtagggggggccgaagatccggccccattcctcgatagttggcaggtgcctagctctctgacaagcgttggccagacaaggtttcgcccagactcatgcgctactaccgattgctccccttgcctgaggatggtgagtaatcgtactttctcagcttgccatcgattcgtgcctccagaatctttttgcgagctgtggatccgtgatacaaagtatgtccaacagccctgtgtcgctctcactgtctatgtcgctatgtgccacaagtttcatgtctgcattgaatggcgcaggtccgactactgtcccttcctgtgcagtagcgactccacataccaggcctgtgtgacggcatgcgagcctccaaagacatgccaggatggaatcctggggccactcgatccggagcactgccaggtgctcggagaagggtgcgtctgttctgagggtacaattctgcacagacgccacagtgccctttgcatcccagaagcaaagtgcgcatgcggcgactgtcccgattctatacctgaatgccaagagggtgaggcactcacggtgcacaggaacacaacggagctgtgctgtccactttatcagtgcgtgtgcgaaaattttcgctgcccacaagttcagtgtggtctgggaaccgcattggtggaagtctggagtcccgacaggtgctgcccctacaagagctgcgggtag

SEQ ID NO: 127485 - DNA, 8778 bp, Artificial Sequence
  Description of Artificial Sequence: Synthetic coding sequence
atgggcgtactggccagcgctttatgttggctcctttgcgtgtggctaccatggggagaacaggccgcagaaagcttgcgagttcagcgcctcggcgagagagtcgttgacagcggcagatccggtgctaggggcatgagaaacgtgaaaggtatgcgcaacggtcccgcccaaacacgtgtctcatcttcttcatcacatcaggaggccacactcgcgatgggcgataaggccactgtagtgggtgggcagcaggcagaggcgccggattctgtcgcaatgagcagttgggaaagacgattgcaccgcgcaaaatgcgccccctcctatctcttttcctgcttcaacggcggagagtgtgttcacccggcattctgtgactgtcggagatttaatgccacggggcctcgatgccagatggtctacaatgctggtccagagcgcgactccatttgcagagcctgggggcagcatcacgtcgaaaccttcgacggtctgtattattacctcagtggaaaagggtcatacactctagtgggacgtcatgaaccggagggtcagtcatttagcatacaggttcacaacgacccacagtgcggatcctcaccttatacttgtagccgggccgtgagtctgttttttgtgggcgaacaggaaattcacctggctaaagaagtaacgcacggcggcatgagggttcagcttccccatgtgatgggctctgcccggcttcagcaactcgcgggctatgtaatcgtgaggcaccagtctgcatttaccttagcctgggacggagcatctgcagtgtacattaagatgtctcctgagcttttgggatggactcacggactgtgtggaaacaataatgccgacccaaaagacgatctggtgacttcttccggcaagctaacggacgatgtggtggaattcgttcactcttggcaagagcaggctcccaaccagccgcccgggccgacaaccagctctctgccgcgcccaccttgcttacagcagaaccccggaacgatgcagggggtatatgaacagtgcgaagccttgttgaggccgccttttgacgcgtgtcatgcctatgtgtctccgttaccattcaccgccagctgcacctcagacttgtgtcagtctatgggtgacgtcgcaacgtggtgtcgggccctagcggaatatgcacgggcctgcgcccaggccgggcggcccttacagggatggaggactcagcttaggcaatgcacagtgcattgcaaagagaaagcgtttacttacaacgagtgtatcgcatgctgccccgctagctgtcatccccgtgcatcatgcgtcgatagcgaaatcgcttgcgtcgacggctgctattgcccgaatggcctcatattcgaagatggcggttgcgttgctcccgctgagtgcccttgcgaattccacgggaccctatatcctcctgggtctgtggtgaaggaagactgtaacacgtgtacttgcacttcgggaaagtgggaatgcagtaccgccgtttgccctgccgaatgttctgtcactggggacatacacttcactacgtttgatggtcgccgctacaccttcccagctacctgccagtatatccttgccaaaagccgttcatctggcacattcacagtcactctccaaaatgcaccgtgtggtcttaatcaggacggcgcttgtgtccaatccgtatccgttatcctgcaccaagacccaaggcgccaggtaacactaacgcaggctggcgacgtgctgctctttgatcagtacaagatcatccccccatacaccgatgatgccttcgaaatcagaaggctctctagcgtgtttctgcgcgtacggacaaatgtaggggtgagggtgttgtacgatcgggaagggcttagactttatcttcaggttgatcaacgctgggtcgaagacaccgtgggactgtgcggaacctttaacggcaacacacaggacgactttctgtctcccgttggcgtgcccgaatcaactccacaactttttggcaatagctggaaaacacttagcgcatgcagccctttggtcagcggttctcctttagacccctgcgatgtccacctgcaagccgccagttactcggtgcaggcctgttcggttctgacaggtgagatgttcgctccgtgcagcgctttccttagccctgtgccctatttcgaacagtgccggcgggacgcgtgtagatgtggccagccctgcctgtgtgccacattggcacactacgctcacctgtgccgccgtcacggattgcccgtggattttagagcgcgactgccggcctgcgccctcagctgtgaagcgtcaaaggaatattccccatgcgtggctccctgcggcagaacctgtcaggacctggcatcccctgaggcctgcggcgtagacggaggagatgacctgtcaagagacgagtgtgtcgaaggatgcgcctgtccccccgatacatacctggacacacaggctgatctgtgcgtgcctaggaatcagtgttcatgtcattttcagggggtggattaccccccaggtgattctgacatcccaagcttagggcattgccactgtaaggatggagtgatgagttgcgattcccgcgctcctgcagcggcatgccctgctggtcaggtgtttgtgaactgttccgatttacacacagatttagagctcagcagagagcggacctgcgaacagcaactgttaaacttgtccgtttctgccaggggtccttgtctcagtggctgcgcctgtccacaggggctgcttcgccatggcgatgcctgctttttgcccgaggaatgcccatgcacatggaagggtaaggagtatttccctggtgaccaggtgatgagcccctgccacacgtgtgtctgtcagaggggtagttttcagtgcacactccatccatgcgcaagtacctgcaccgcttacggcgataggcactaccggacatttgatggactcccatttgacttcgtcggcgcctgcaaagtgcatctcgtcaaatcaacaagtgatgtgtccttcagcgtgatcgtcgaaaacgtgaactgttattcctctgggatgatctgccggaagtttatttctataaatgtaggcaactctctcattgtgtttgacgatgactctggtaatccatcaccagaaagtttcctggatgacaaacaggaggttcacacttggagggtgggattcttcacccttgtgcacttcccccaggagcatatcaccctcctgtgggaccaaaggacaaccgtgcacgttcaagccgggccacaatggcaaggacagcttgccggcctttgtggcaatttcgacctgaagaccattaacgagatgcggacaccagagaacctcgagttgaccaatccccaagagtttggcagttcgtgggctgccgtggagtgccccgatacattggatcctcgagatatgtgcgttttaaatcctctgagagagccatttgccaagaaagagtgctctatcctgctcagcgaagtcttcgagatttgtcaccccgttgttgacgtgacgtggttctacagcaattgtcttactgacacgtgcgggtgcagtcagggtggagattgcgaatgtttctgcgcatctgtgtccgcctacgcccaccagtgttgccagcacggcgtggcggttgactggcggactccccgcctttgcccatatgactgcgactttttcaataaggtgctgggtaagggtccatatcagctatcgagtctggctgccggaggtgctttagtgggaatgaaagcagtgggcgatgacatcgtacttgtgcgcacagaggacgtggcgcctgctgacatcgtgtcttttctcctgactgctgccctctacaaggcgaaggcccacgaccccgatgtcgtctctttggaagcagcagaccggccaaatttttttcttcatgtgactgccaatgggtcattggaattagccaaatggcaggggagagacacgttccagcagcacgcttcatttctgctccaccggggcacacgacaagctggactggtggccctcgagtcacttgccaagccttcatccttcctttatgtctcgggtgccgttctggctcttcgcctgtacgaacatactgaagtctttcgccggggcacgctgttccggttgcttgatgctaaaccttctggagccgcatatccaatttgtgagtggcgctatgatgcgtgtgcatcaccctgtttccaaacctgccgggatccaagagctgcttcttgcagagatgttccaagggttgagggatgtgtacccgtgtgtcccacccctcaggtcctggacgaagtgacccagaggtgcgtatacctggaggattgcgttgagccagccgtgtgggtgcccaccgaggctctgggaaacgaaactctgccgcccagccaagggttacccacccctagtgatgaagaaccgcagttgagccaagagtctccgcgaacccctacccacaggcccgcactcacccctgctgctcccctaactacggcactcaacccgccggttaccgccaccgaggagcccgtcgtgagccccgggcccacgcagaccacactgcagcagccactggagttgaccgccagccagctgcccgcaggccccacggaatcccccgcaagcaagggagtcaccgcaagcctgctggcaatcccacatacgcctgagagttcgagtctgccagtagccctccagactccaacccctgggatggtcagcggcgctatggaaactaccagagtgacagtgatctttgccggctcccctaatatcacagtgtcttcccggtccccgccagcccccaggttccccctcatgacaaaagccgtgacagtccgaggacacggatccctgcccgttagaacgactccgcctcagccatccctgacagcaagcccttctagtagacccgtcgcttctcccggtgccatcagcaggtcccccacttcaagtgggtcccacaaggcagtgctgaccccagccgtcaccaaagtgatatcccgaactggagtgccccagcccacacaggcccagtcggcaagcagcccatccaccccactgactgtcgcaggaactgctgcggaacaagtgcctgtgagccccttagccaccagaagtctggagattgtactctctacagaaaagggcgaggccggacactcccagcccatgggatctccagcatcccctcagccgcaccccttgccgtctgcaccacctcggcccgctcagcataccacaatggctaccagatctccagcactcccacccgaaacgccggccgcagcaagcctctccactgcgaccgatgggttggccgccacccctttcatgtcactcgagtcaaccagaccctcgcagctgttgtccggccttccgcccgatacatctttacctctcgctaaggttggtactagcgcccccgtggccaccccgggacctaaggcatctgtcatcaccacgcccctgcaacctcaggcaaccaccttgccggcccagaccctttcccccgtgttaccatttactcccgctgccatgacgcaggcgcatcctcctacccatatcgcacccccagcggccggaaccgcgccgggactactgcttggagcaacgctgcctacctccggcgtgctcccagttgccgaaggaacagctagcatggtgtcggtggtgccaaggaaatctactactgggaaagtagccatcttgtcaaaacaggtttctttaccaactagcatgtacggctccgctgagggagggcctaccgaactcacgcctgcaacatcacatccattgactccactggtcgctgaaccggagggagcccaggccgggactgcccttcccgttcctactagctacgccctctccagagtctctgcgaggacggctcctcaagactctatgctggtactgctgcctcagttagctgaggcgcacggcacctcggccggacctcatctggctgctgagcccgtggatgaggccacaacagagccatccggtcgctccgcccctgctctgtcgatcgtcgaaggacttgccgaggcgctcgctaccactacagaagcgaacacctcgaccacttgcgtgcccattgccgaacaggattgcgtaaggcatatctgccttgaaggacagctgattcgagtcaatcagtcacagcactgcccacagggagctgcacccccccggtgcggcatcctggggcttgccgtgagagttggcggggaccgatgctgtcccctgtgggagtgtgcttgccgatgctccatttttcccgatttgagttttgtgacctttgatgggtctcatgtggctctcttcaaggaagccatatacattctgtcgcagtccccggacgagatgttgacagttcatgtgcttgactgcaaaagcgccaaccttgggcacctgaattggccccccttttgtcttgtaatgctaaacatgacacatcttgcgcatcaggtcacaatcgaccgcttcaatcggaaagtgacagtggaccttcagccagtttggccccccgtgagcagatatggatttcgaatagaagacacaggacacatgtacatgatattaaccccatcagatatccagatccagtggcttcacagcagcgggctcatgattgttgaggcctcaaagacatcaaaagctcaggggcacggcctttgtggtatctgtgacggcgacgcggccaacgacctgaccctgaaggatggttcagtagtgggaggcgccgaggaccctgcacccttccttgattcctggcaagtgccttcaagtctgacatccgtgggccagactcgattcaggcctgattcttgtgccaccacagactgtagcccttgcctgcgcatggtgtccaaccggactttctccgcgtgtcatagatttgtaccacccgaaagcttctgtgagttatggataagagacaccaagtacgtgcagcaaccttgtgtagcgctgactgtgtacgtcgctatgtgccacaagttccatgtctgcatcgaatggcgtcgtagcgattactgcccatttctgtgcagtagcgactccacctaccaggcctgcgtgaccgcgtgtgaaccgccaaaaacctgtcaggacggcattctcgggcccctcgaccctgagcattgccaggtgcttggcgaaggctgtgtgtgctctgaaggcaccatactgcatagaaggcactctgccttgtgcattccagaagccaaatgtgcatgcaccgacagtatgggtgttcctagagcgcttggtgaaacctggaactccagtctaagcggatgttgccagcaccagtgtcaagcgccagatactattgtgcccgtggatctgggctgcccttcaccaagaccagaatcatgccttaggtttggtgaggtggcgttgctcctgccaactaaagacccctgctgtcttggcaccgtctgcgtctgcaatcagaccttatgcgaagggctggctcccacatgtaggcccggacatcgcctcctgacccatttccaggaagactcttgttgtccgagttattcctgcgagtgtgacccggatctgtgtgaggcagaactggtcccttcttgtcgacaggaccagatcttgattaccggaaggctcggagacagctgttgtacatcgtacttttgcgcttgtggggattgtccagactcaatccccgagtgtcaggagggcgaagccctcaccgtgcacaggaataccacagagctatgttgtcccctgtatcagtgcgtttgcgaaaacttcagatgcccacaggtccagtgcggtctcgggaccgcgctcgtcgaggtttggagccccgatagatgttgcccttataaatcttgcgagtgcgattgcgacaccattcccgtgcccagatgtcacctgtgggaaaagtctcagctcgacgaggaattcatgcatagtgtggaaaatgtgtgtggatgcgcaaaatatgaatgcgtcaaggctccagtctgcctgagccgagagctcggcgtcatgcaaccaggacagacagtggtggagctatctgctgacggggtgtgccatactagcagatgcaccacggtgctggacccccttacaaatttttaccagatcaatactacgtcagtgctgtgcgatattcattgtgaagccaatcaagagtacgagcaccccagggacctcgctgcctgttgcggctcgtgcaggaatgtgagttgcctattcacgttcccgaatggcaccaccagcttattcctccctggggccagctggattgccgactgtgcacggcaccactgtagtagtaccccattgggcgccgtactcgtgaggtcacctatttcatgcccgccacttaatgaaactgagtgtgccaaagtgggaggcagcgtggtaccctcccttgagggctgttgccgaacatgtaaagaggacggtcggagttgtaaaaaggtcacgattcggatgacaattagaaagaatgagtgtaggtccagcacaccagtaaatctggtgtcttgtgatggccggtgccccagtgctagtatctataactataacatcaatacatatgcaagattctgtaaatgctgtcgtgaggtaggcctgcagcggcgctctgtacaattgttctgtgctactaatgccacttgggtaccatacactgtgcaggagcctacggactgcgcctgtcagtggagttag

SEQ ID NO: 127486 - DNA, 387 bp, Artificial Sequence
  Description of Artificial Sequence: Synthetic coding sequence
atggccaggatcctgctcctgtttctgcccggtttggtcgcggtatgcgccgtacacgggatattcatggatcggctcgcgtcgaaaaaactgtgcgcagacgatgagtgtgtgtacactatctcacttgcatcagctcaggaggactacaatgcccccgattgcagattcatcaatgtcaaaaaaggccagcagatttacgtatacagtaaacttgttaaagagaatggggctggcgagttctgggccggtagcgtgtacggggacggccaggacgaaatgggagtagtgggctatttccctcgcaatctggtaaaggagcaaagagtgtaccaggaagccaccaaagaagtgcccacaaccgatatcgattttttttgtgagtag

SEQ ID NO: 127487 - DNA, 1446 bp, Artificial Sequence
  Description of Artificial Sequence: Synthetic coding sequence
atgcaactctatagttcagtgtgtacgcactacccagctggagcacccggcccaacagcagccgcacccgcccctccagccgctgccacaccttttaaagtctctctgcaaccgcccggagccgcaggcgccgctcctgagccggagacgggcgaatgccagccagctgctgctgccgagcaccgcgaggccgcagcggtgccggctgctaaaatgcctgcgttttccagttgctttgaggttgtcagcggcgcagccgccccagccagtgccgcggcggggccaccaggtgcctcctgtaaacccccccttccacctcactacacaagcacggcacagattacggtgagagcgttgggtgcggatagattactgctacacggccctgaccccgtaccaggagccgcggggtccgccgccgcacccaggggccggtgtttgctgctcgccccagcccctgctgccccggtcccccctaggcgcgggtcctcagcttggctccttgaggagctactgagaccagattgccccgagcccgcgggcttggatgccaccagggaaggtcccgatcgtaattttagactctccgaacacagacaagctctggctgcagctaagcaccgaggcccagccgcaaccccaggaagccccgatccggggcccggcccctggggcgaagaacatctcgccgaacgtggtccccgcggctgggaaagaggaggggatagatgtgacgcacctggaggcgatgcagccagaaggcctgatccagaggctgaagcgccacctgctggaagcatcgaggccgctccctcgagcgctgctgagccggtgattgtgtcccgtagtgacccaagggatgagaaactcgcactctacctggccgaggtcgagaagcaggataaatatctgcggcaaaggaataaatacagattccacatcatcccagatggaaattgtctgtacagagcagtcagtaaaacagtgtatggcgaccagagtctccaccgcgagctccgggaacagacagtgcactacatcgccgatcatctggatcacttctctccgttgatcgagggcgacgtaggagagttcatcatcgctgctgctcaagatggcgcctgggctggctatcctgaactgctggcaatgggacagatgctgaatgtgaacatccatctgaccaccggaggacgcctggagtcgcctactgtctccacaatgattcactatttggggccggaagactccctgcgcccatccatctggctcagctggctttcaaacggtcactacgatgctgtattcgaccactcctacccaaacccagaatatgacaattggtgcaagcagacccaagtgcagcggaaaagagacgaggaactcgcaaagtcaatggctatcagcctttctaagatgtatattgaacagaacgcttgctcatag

SEQ ID NO: 127488 - DNA, 1197 bp, Artificial Sequence
  Description of Artificial Sequence: Synthetic coding sequence
atgtccagaaagcaggccgccaagtccaggccgggatctggcagtagaaaagcggaggctgagcgaaagcgagacgagcgcgccgcccgccgagctctcgctaaagaacggcgaaatcgccctgaatcaggaggtggtgggggctgtgaagaggagtttgtttctttcgctaaccagctgcaggccctgggacttaagctgcgggaggttcccggagacggcaactgcctgttccgggcccttggagaccagctcgaggggcactccagaaaccatcttaagcaccggcaggaaaccgtggattacatgattaaacagcgcgaggattttgagccttttgtggaggatgacatcccgtttgaaaaacatgttgcttcacttgctaaacctggtaccttcgcgggtaacgacgctattgtagcctttgccagaaaccaccaactgaacgtcgtcatccatcagttaaatgccccgctgtggcaaatcagagggactgaaaaatcaagcgttagggaactgcacattgcctacagatacggggaacactatgactccgtgcgccgaattaatgacaactccgaagcaccagcccacctacagaccgactttcagatgctgcaccaggatgagtcaaacaagcgagaaaaaataaaaactaagggaatggatagcgaggacgacctacgagatgaggttgaagatgccgtgcaaaaggtctgcaacgcaaccggatgtagtgacttcaacttgattgtccagaatttggaggccgagaactataacattgaatctgcaatcatcgcggtcctgcgcatgaaccagggcaaaagaaataacgccgaagaaaacttggagccttctgggagagtgctcaagcagtgcggccctctgtgggaggagggcggatcgggcgctaggatttttgggaaccagggactgaatgaaggaagaaccgaaaacaacaaagcccaggccagtccctccgaggaaaacaaggccaataagaatcaactcgccaaggttacaaataagcagaggagggagcaacagtggatggaaaagaagaagcgtcaagaggagcggcatcggcataaggcactggagtccaggggctcccacagggacaacaatcggtctgaagcagaagcaaatacccaggtgaccctggtgaagacattcgccgcactgaatatctag

SEQ ID NO: 127489 - DNA, 438 bp, Artificial Sequence
  Description of Artificial Sequence: Synthetic coding sequence
atggcctgcatccactacctgcgggagaatagagagaagtttgaggcattcatcgaggggtctttcgaggaatatctgaaaagacttgagaaccctcaggagtgggtcggccaggtggaaatttccgccctgtccctgatgtacaggaaagatttcatcatttacagagaaccaaatgtgtcaccgtcccaggtaaccgagaacaattttccagagaaagtgcttttgtgttttagcaatggtaatcattatgacatcgtatatccaatcaaatataaggagtcatcagctatgtgtcagagcctgctgtatgagttgctatatgaaaaggtgttcaagacggatgtctccaagatcgtgatggaacttgacaccctagaagtggctgacgaagacaatagcgaaattagcgacagcgaggacgactcttgcaagtag

SEQ ID NO: 127490 - DNA, 3345 bp, Artificial Sequence
  Description of Artificial Sequence: Synthetic coding sequence
atggaggcagccgtgggggtgccagatggtggggatcagggtggcgcggggcctcgggaggacgctacacccatggacgcttatttgcgtaagcttgggctgtatcgcaaactggtggcgaaggatggctcatgcctttttcgggcggtggccgaacaggtcttacactcccagagtagacacgtggaagtgcggatggcttgtatccattatttacgcgagaacagagagaagttcgaagccttcatagagggcagctttgaggagtacctaaaacgccttgaaaacccacaggagtgggtgggacaggtcgagatttccgctctgtcccttatgtatcgcaaagattttattatatatagggagcccaacgtatctccaagtcaggtaaccgagaataactttcccgaaaaagtccttctttgtttctcaaacggtaatcactacgacattgtgtaccctataaaatataaggagtcgagcgccatgtgccagagcctactgtatgaattactgtacgaaaaagtcttcaaaaccgatgttagcaaaattgtcatggagctggatactcttgaggtggctgacgaagacaattccgagatatcggacagtgaagatgactcttgtaagtcaaaaactgcagcggccgctgccgacgtaaacggatttaagcccttaagcggcaatgagcagctgaaaaataacgggaatagtacgagcctccccctgtctcgcaaggttctgaaatctcttaatcccgctgtctataggaatgtggagtacgaaatctggcttaagtccaaacaggcccagcagaagagagactacagtatcgccgcgggcctgcagtacgaggtcggcgacaaatgtcaggtgcgactggaccacaacggcaagttcctgaacgctgacgtacagggaattcactccgaaaatggacctgtccttgtggaggaactgggaaagaaacacacatctaagaacctgaaggctcctcctcctgaatcatggaatacagttagcggtaagaaaatgaagaagccgtccacaagtggacagaactttcattctgacgtggactatcggggtcccaagaatccatctaagcccatcaaggccccgtcagcccttcctcctcgcctgcagcacccttcaggggtgagacagcatgctttttcttcacattccagtggctcacagagtcagaaattcagctccgaacacaaaaatctgtcccggacgccatcccagattatccgaaaacctgaccgagagagagtggaggacttcgaccatacttcacgggaaagtaactatttcgggctgtctcccgaagagcgaagagagaagcaagctatcgaggagagtaggctactgtacgagattcagaaccgcgacgagcaggcattccccgctctctcttcctcttctgttaaccagtccgcctcgcagagctcaaatccatgtgtccagagaaaatcctcccatgtgggagaccgcaaagggagtaggcgccggatggacaccgaagaaagaaaagacaaagattcaatccatggccacagtcaactagataagaggcctgaaccatctactctggaaaacattacggacgataagtacgccacggtgtcatcgccctccaaatctaagaagctggaatgtccgagtccggccgagcagaagcctgcagaacatgttagtctttcaaacccagccccactgctggtgtcaccagaggtgcacctcacccctgctgttccttccctgccggccacggtccccgcatggccgagtgaacccaccacattcggaccgaccggagtccctgcccccattccagttctttctgtcacacagacactgaccaccggtcccgactccgcagtctcgcaagcgcacttgaccccctcccctgtccccgtgtcaatccaggcggtgaaccagccgctcatgccgctcccccagactttgtctctataccaggaccctctttacccaggatttccctgtaatgagaaaggcgatcgtgccatcgtccctccttactcactttgtcagactggagaggacctgcccaaagataaaaatatcctgagattcttttttaatctcggtgtcaaggcttacagctgccctatgtgggcaccgcactcctacctgtacccacttcaccaagcatacttggcagcctgtcggatgtaccctaaagtaccagttccagtgtatcctcacaatccctggttccaggaggcacccgccgcacaaaacgaaagtgattgtacttgtactgatgctcattttccaatgcagactgaggcatccgttaatggacagatgcctcaacctgagatcgggccacccacgttcagctcgccactggtgataccgccctcccaggtgagcgagtcacacgggcagctaagctaccaggccgatctggaatcagagactccaggacaattactgcacgccgattacgaggagagtctcagcgggaaaaatatgtttccccagccctcatttgggccaaatccttttttggggcccgtgccaatagcacccccctttttccctcacgtgtggtatggatacccgttccaaggatttattgagaacccagtaatgagacaaaacattgtactaccgtcagacgagaaaggcgaactggacctctctctagaaaacctggacttgagtaaagattgtggctccgtcagcacggttgatgaattcccagaggctcgcggggaacacgttcactcactgcctgaggcctccgtctcttctaagcccgacgaaggtcgaactgagcagagcagccagactcggaaggctgacacggctctggcttcaatccctcccgtagcagagggaaaagctcaccccccgacccagattctaaatcgggagagagaaaccgtgcccgtcgaactggagccgaagcggacaattcagtcactgaaggaaaagacagagaaagtcaaagaccctaagaccgccgcggatgtcgtcagtcccggagctaactctgtggactcccgcgtccaacgccccaaagaggagagttctgaggatgagaacgaagtgagcaacattcttaggtccggaaggtctaaacagttttataaccagacatatggaagcagaaaatacaagtctgactgggggtatagcggaagaggcggatatcagcacgttaggagcgaggagtcctggaaaggtcagccgtcacggagcagggacgagggctaccagtatcacaggaacgtcagaggtaggcccttcaggggtgaccgtcgccgcagcggcatgggcgatgggcacagaggacagcacacttag

SEQ ID NO: 127491 - DNA, 3150 bp, Artificial Sequence
  Description of Artificial Sequence: Synthetic coding sequence
atggcgtgtattcattatttgagggaaaatcgcgagaaatttgaggccttcattgaaggctcatttgaggagtatctgaagcggcttgagaatcctcaggagtgggttggacaagtagaaatcagcgcactgtcattgatgtacaggaaggactttataatctatcgcgagcccaacgtatcccccagccaggtgacagaaaacaactttccagaaaaggtgttactatgcttttcgaatggaaaccactacgatattgtgtatccaatcaaatataaggagtcaagcgcaatgtgccagtctctgttatacgagctgttgtatgaaaaagtgtttaagaccgacgtgtccaaaatcgtaatggaactggacactctggaagtggccgacgaggataatagcgagatttcagatagtgaggacgattcttgcaaaagcaagacggccgccgcagctgcggatgtcaatggttttaaacctctgtctggcaacgaacagttgaagaataacggcaatagtacatcccttcctcttagtaggaaggtgttgaaatcactgaatccagccgtttatcgtaacgtggagtacgaaatttggctcaaatccaagcaggcccaacagaagagggactatagcattgccgccggcttgcagtacgaagtgggggataagtgtcaagtcagactggatcataacggcaagtttctgaatgcagatgtgcagggcatacactcagagaatggtcccgtcttggtcgaggagctcgggaagaagcatacctctaagaacctgaaggcccccccgcccgagtcctggaacaccgtgagtggaaagaaaatgaagaagccctctactagcggccagaatttccattcggatgttgactaccgaggacctaagaatcccagcaaacccatcaaggccccctcagcactgccgccgcgcttacagcatcccagtggggttaggcagcacgcattctcaagccacagctctggatcacaaagtcagaagttcagttcagagcataagaatctgagcagaaccccttcccagatcatcagaaagccagatagggagcgcgtggaagatttcgaccatacctctcgagagtcaaattacttcgggctatcacccgaagagagaagggagaaacaggcaatagaggagagccggttgttgtacgagatccaaaaccgcgacgaacaagcatttcccgcactgtctagctcgtctgtgaatcaatctgcgtcccagtcatcaaatccatgtgtgcaacgcaaatcttcacacgttggcgatcgcaagggtagccgccggcgcatggatacagaagagcggaaggacaaagatagtatccatggccatagccagctggataaacgaccggaaccttctaccttggagaacattacggatgacaaatatgctacagtgtccagcccctctaagtcgaaaaaattggagtgcccctcaccagccgagcagaagcctgctgagcatgttagcctgagcaacccagcacccttactggtgagccctgaggtacacctcaccccagcagtgcctagtctgcctgccactgttcctgcctggcctagcgaacctacaacttttggtcccaccggagtgcccgcccctatccctgtgttgagtgtaacccaaactctcacaactggtcctgactctgctgtgtcgcaggcccacctgactccctcaccagtaccggtttccatccaagccgtaaaccaacctctgatgcctctgcctcagactctgtcactgtaccaggatccattgtacccaggcttcccttgtaatgaaaagggggatcgcgcaatcgttcctccttatagcctgtgtcagaccggagaagacctccccaaggataaaaatattctccgctttttcttcaacctgggcgttaaagcctactcatgccctatgtgggctccccactcatatttatatcctcttcatcaggcatacctcgcggcgtgtcgaatgtatcccaaagtgccagtccccgtctaccctcacaatccttggttccaggaggctcccgcagctcagaatgagtctgactgtacatgcaccgatgcccactttcccatgcagacagaagcgtcagttaacggccagatgccccagccagagatcgggcctccaaccttctcgagtccattagtgatccctccgtcccaagtgtcagagagccatgggcagctgtcctatcaggccgatctggagagtgagacccctggtcagctgcttcacgcagactacgaagagtcactatccgggaaaaacatgtttccccagcctagctttgggcctaatccctttctcgggcccgtgccaatagcccctccattctttccccacgtttggtacggatatcctttccaggggttcatcgagaaccctgtgatgaggcagaacatcgtactcccaagcgacgagaaaggcgagctagacctttctctggagaatctggacctgagcaaagattgcggcagtgtgtcaacagttgatgagtttcctgaagccagaggagagcacgttcatagcttgcctgaagcttcggtgtcgagtaagcctgatgaggggcggaccgaacagagctcccagacccgcaaagctgacaccgccctggcctctataccacctgtggctgaaggaaaagcccaccccccaacacagatcctcaaccgggagagagaaacagtgcccgttgaattggagccaaaacgaactatccagtctctcaaggagaagaccgaaaaggtgaaggatcccaagaccgcagcagatgtggtatccccaggagctaacagcgtggattcgagagtccagcggccaaaagaagaatcctccgaggacgaaaacgaggtcagtaatatactgaggagcgggcgcagcaaacaattctacaatcagacatacgggtctcgcaagtacaagtctgactgggggtatagtggcaggggcggctaccagcacgttcgttccgaagagtcctggaaaggtcagccaagccgatcaagggacgaaggctaccagtaccaccgaaacgtgcgcggacggccatttcgaggcgaccggcgccggtccgggatgggggatggacaccggggacagcacacctag

SEQ ID NO: 127492 - DNA, 420 bp, Artificial Sequence
  Description of Artificial Sequence: Synthetic coding sequence
atggcgtgcattcattatttgcgcgagaaccgcgagaaattcgaggcttttattgagggttcattcgaagagtatctgaaacggctcgagaacccgcaggagtgggtcggccaggtcgagatctccgccctgagcctgatgtatcgcaaggacttcataatctatcgtgagcccaacgtgtctccatcacaagttaccgagaacaatttccctgagaaagtgcttctttgctttagcaacggcaatcactatgacatcgtctaccctattaaatacaaggaatctagcgctatgtgccaaagcctgttatacgaactcctgtacgagaaagtgttcaagactgatgtctccaagattgtcatggaactggacaccctggaagtggccgatgaagacaattctgagatctccgacagctag

SEQ ID NO: 127493 - DNA, 438 bp, Artificial Sequence
  Description of Artificial Sequence: Synthetic coding sequence
atggcatgcattcactatctcagagagaaccgggaaaaattcgaggctttcatagaggggtccttcgaagagtatctcaagcgactggagaacccgcaggaatgggtgggacaggttgagataagtgcactttccctgatgtaccggaaggatttcatcatctacagggagccgaatgtgtcccccagtcaagttaccgaaaacaatttccctgagaaggtgctcctctgttttagcaacgggaaccactatgacatcgtgtaccctattaaatacaaggagtcaagcgcaatgtgtcagtcgttgctttatgagctcttgtacgagaaggtcttcaagaccgatgtatctaagatcgtaatggagctggacactcttgaggtggctgatgaggataattccgagatcagtgatagcgaagatgacagttgcaagtag

SEQ ID NO: 127494 - DNA, 1716 bp, Artificial Sequence
  Description of Artificial Sequence: Synthetic coding sequence
atgacgattctgccgaagaaaaagcctccacctccagacgccgacccggcgaatgagcccccgccccctggcccaatgcctcctgcgccccgaagaggaggcggagtgggagtaggaggcgggggcaccggggttggaggcggagatcgagaccgtgatagtggtgttgtgggggcaaggccacgggcctcaccccctcctcagggaccactccctggaccgcccggcgccttgcatagatgggcactggctgtgcccccgggggccgtcgccggtcctagaccccagcaggcttctcctccgccctgcggcggtccagggggaccaggtggcggtccgggcgatgcactgggtgctgctgctgctggagtcggagccgcaggcgtggtcgtgggggttggtggcgctgtcggtgtgggcggatgttgctccggccctggccattcgaaacggcggagacaggctccaggcgttggggcagtaggggggggttcacctgagcgcgaggaggttggcgcaggctataatagtgaagacgagtacgaagcggccgccgctcgtattgaggccatggatcctgctacagtcgaacagcaggagcactggtttgaaaaagctctgcgtgataagaagggcttcattatcaagcagatgaaggaggacggagcatgcctttttcgagcagttgctgaccaggtctatggagaccaggatatgcatgaggtggttcggaaacattgtatggattatctgatgaaaaatgcagactattttagcaactacgttacggaagacttcacaacctatatcaaccggaaacgaaagaataactgtcatggtaaccatatcgaaatgcaggcgatggccgagatgtacaaccggcctgtagaagtgtaccagtacagcactggcacctcagccgtggagcccattaatacctttcacggaattcatcagaatgaagacgagcccataagagtgagctaccaccggaacatccactataactccgtggtgaacccaaataaggctaccatcggcgttggcctgggtctcccaagtttcaagcctggctttgcagaacagtctctcatgaagaacgctatcaagaccagcgaggagagttggatagaacagcagatgcttgaggataaaaaaagggcaaccgactgggaagcgacgaacgaagcaattgaagaacaggtggctagagaatcctatctgcagtggctcagagatcaggagaagcaggcgagacaagtgcgcgggccatcgcagccccgcaaagcaagcgctacttgctcatccgccacagccgctgctagctccggtctggaagagtggacttccaggtcgcccaggcagcgcagcagtgcttcaagtcccgagcaccccgaacttcacgccgaattaggaatgaagccaccctctcctggcacagtgttagcactggcaaagcccccatccccttgtgcacccggtaccagtagtcaattttcagctggcgccgaccgcgctacatcaccgctggtttccttataccctgctctcgaatgcagagctctgattcagcagatgagccccagtgcttttgggctgaacgattgggatgacgacgagatactggcttctgttctggccgtgagccagcaagaatacctggactcgatgaagaagaacaaggtgcaccgggacccgcctcccgataagtcctag

SEQ ID NO: 127495 - DNA, 1701 bp, Artificial Sequence
  Description of Artificial Sequence: Synthetic coding sequence
atgaccattctcccaaaaaaaaagccacctcccccggatgctgaccccgccaacgagcctcccccacccgggccaatgcccccagcacctcgccgcggcggcggcgtgggcgtaggtggaggggggaccggggtaggcggcggggacagggaccgtgactccggggtcgtgggagccagaccccgtgcctccccgccaccccagggccctctgcctgggccacccggggcccttcaccgttgggctctagccgttccacccggcgccgtcgctggccccagaccacagcaggcctcccctcctccctgtggtggccctgggggccccggaggtggccccggcgatgcgctgggggcggccgccgcgggagttggagctgcaggagttgtagttggcgtgggaggggccgtgggggtggggggatgctgttccggcccgggccactcgaagagacgtcggcaagcccccggtgttggggctgttggtggcggaagtcccgagagggaagaggttggcgcaggctacaattcagaggatgagtacgaagccgccgcggctagaattgaggctatggatcctgctacggtggagcagcaggagcattggttcgagaaagccttacgtgacaaaaagggttttatcatcaaacaaatgaaggaagatggtgcttgcctgtttcgtgccgtcgccgatcaggtttatggtgatcaggacatgcatgaggttgtgagaaagcattgcatggattacctgatgaagaacgccgattatttttccaactacgtcacagaagattttacaacatacatcaataggaagcggaagaataattgccacggaaatcatatcgagatgcaggccatggcagaaatgtataatcggccagtcgaggtctaccagtactctacagagcccatcaacacctttcatggcattcaccagaacgaggatgaaccaatcagagtgtcctatcatcggaatatccactacaattctgttgtgaacccaaataaggcaaccatcggcgttggcctaggtctgccctccttcaagcccgggttcgctgagcaatctctcatgaaaaacgctattaaaacatctgaggagagttggattgaacagcagatgctcgaagacaagaaacgtgctaccgactgggaggccacgaacgaggccattgaagaacaggtggctcgcgaatcctacctgcagtggcttagggaccaggagaaacaggcccggcaggttcgaggacctagccagccgcgcaaggcatcagccacctgttcttcggcaacagctgctgcctctagcggactggaagagtggacatcccgctcccccaggcaacggagctccgcgtcctctcccgagcaccccgaactgcacgccgaactcggcatgaaacctccaagcccaggcaccgtgctagccttggccaagcctccctccccatgtgcccctggtacctccagccagttctctgcaggagccgatcgcgcaactagcccactggtctcactataccctgcactcgaatgtcgcgccctgattcagcaaatgtctccatctgccttcgggctaaacgactgggatgacgatgagatcctggccagtgtgctcgcggtgtctcagcaagagtacctcgattccatgaaaaagaataaggtgcacagagatcctcccccagacaagtcctag

SEQ ID NO: 127496 - DNA, 1701 bp, Artificial Sequence
  Description of Artificial Sequence: Synthetic coding sequence
atgacaatactccctaagaagaaaccccctcctcctgatgcagacccagcaaatgaacccccgcccccaggacccatgcctcccgcccctagaaggggcggaggtgttggagtgggtggagggggtaccggagtggggggaggggacagggaccgcgacagtggcgtggtgggcgcgagaccccgagcttcgccccccccccaggggcctttacccggcccacctggagcgctgcaccggtgggccctggctgtgcctcccggcgctgtggccggccccaggccccaacaagcctcccccccgccatgcggaggccccggtggacccgggggaggacccggcgatgcattaggcgcggctgcagctggcgttggagcggcgggagtggttgttggcgtcgggggcgccgtgggcgtcggcggatgttgcagtggtcccggacattcaaagaggcgaagacaggcgccaggtgtgggcgccgtgggcgggggtagcccagaacgggaagaggtcggagcagggtacaactctgaggatgaatatgaggcagcagcagctcgcattgaagcgatggatcctgcaaccgtggagcagcaggagcattggtttgaaaaggccctgcgcgacaaaaaaggtttcattattaaacagatgaaagaagacggggcttgtttatttcgggccgtcgcagaccaggtgtacggggaccaagacatgcacgaagttgtccggaagcattgtatggattatctgatgaagaatgccgattacttttcaaactacgtgaccgaggactttactacatatatcaacagaaagcggaagaacaactgtcatggcaaccacatagaaatgcaggccatggccgaaatgtacaatcgcccagtggaagtgtatcagtattctactgagcccatcaacacctttcatggtatccaccagaatgaggacgaacctattagagtgtcctaccataggaacatccattacaactctgtggtcaatcctaacaaggcaaccattggagttgggctcggtctcccatcatttaagcctggcttcgcagagcagagtctgatgaagaacgctattaagacctccgaagaatcctggatcgagcaacagatgctggaggataaaaaacgtgctacggactgggaggcaaccaatgaggccatcgaagaacaggtcgcgagggaatcttacctgcagtggctgagagatcaagagaaacaggctaggcaggttagaggccccagccagcctcgcaaagcatctgctacatgttcaagcgcaacagccgcagcctccagcggactagaggagtggactagcagaagtcctagacaaaggtcttctgcctccagccccgaacacccggaactccacgctgaactcggtatgaagccgcctagtcccgggacggtcttagctctggccaaacctccgtccccatgcgctccgggcactagcagtcagtttagcgccggggccgacagggctaccagccccctagtgagtttgtacccagcccttgagtgccgggctttgattcagcaaatgtcgccgtctgcattcggtctaaatgattgggacgatgacgaaatcctcgccagcgtgctcgccgtgagccagcaggaatatctggatagtatgaagaagaacaaagtgcatcgtgacccacccccggacaaaagctag

SEQ ID NO: 127497 - DNA, 1050 bp, Artificial Sequence
  Description of Artificial Sequence: Synthetic coding sequence
atgaaggaagatggcgcatgtctatttagggcagtggccgatcaagtttacggagatcaggacatgcatgaagtggtccgtaaacactgcatggattatctgatgaaaaacgcagactatttctcaaactacgttaccgaagatttcacaacctacatcaaccgcaaacggaaaaacaattgccatggtaaccacattgaaatgcaggccatggcagagatgtataaccgcccagttgaagtctatcagtactctactgaacccatcaacaccttccacggaatccaccaaaacgaggatgaaccgattcgggtgtcatatcaccgaaatatacactataactccgtggtgaatccaaacaaagcaaccataggtgtgggactgggattaccttcctttaagcccggctttgcagagcagagtctgatgaaaaacgcaatcaagacgagtgaagagagctggatcgagcagcagatgctcgaagacaaaaaacgggcgacagattgggaggccactaatgaggcaatcgaggaacaggtggcgagagaaagctatctgcaatggctccgcgatcaggagaagcaagcgagacaagttagaggaccatcccagcccagaaaggcgtcagccacatgttcttctgcaaccgcagcagccagctctgggcttgaagagtggacctccagatcaccccgccagcgatctagcgcttcctcccctgagcaccctgagcttcacgcagagcttggcatgaagccgccgtctcctggaactgttcttgccttggccaaacctccaagtccttgtgcccctggaacgagctcccaattctctgccggggcagaccgggccacaagcccactggtctctttgtaccccgccctcgaatgccgcgcccttatccagcagatgtcccctagtgcttttgggctgaacgattgggatgatgatgagatacttgcctcagttctcgccgtcagccagcaggagtacctggattctatgaagaaaaataaggttcacagggaccccccccctgacaagagttag

SEQ ID NO: 127498 - DNA, 1629 bp, Artificial Sequence
  Description of Artificial Sequence: Synthetic coding sequence
atgacgattctcccgaagaaaaagccgcctccgcccgatgccgatcctggaggaactggcgtgggcggaggggacagggaccgagactctggggtagtgggggctcggcctcgcgcaagcccccccccacagggcccactgcctgggccacccggggcactgcaccgctgggcgcttgccgttccaccgggggccgtggctggtccccggcctcaacaggcctctcctcccccatgtggggggcctggagggcccggcgggggaccaggcgatgctctcggagccgctgctgccggcgtgggtgctgccggtgtggtggtgggcgtgggaggggctgtcggtgtagggggatgctgcagcggcccaggacattccaagcgccgacgacaggcccccggagtgggagcagtcggaggtggcagtccagagcgggaggaggtgggggcggggtacaactcggaggatgaatatgaggccgcggctgcccgaatcgaggcaatggacccggcaacggtcgagcagcaggaacactggttcgagaaggctcttcgcgacaaaaaggggttcataatcaaacagatgaaagaggacggagcttgtttattcagagctgtggcagaccaagtgtatggcgatcaggacatgcatgaagtcgtgcggaagcactgcatggattatctgatgaagaacgcagactatttttcgaactacgtgacggaggactttactacctatatcaatagaaagcgtaaaaataactgccatggaaatcatatcgaaatgcaggccatggcagaaatgtacaatcgcccggtggaggtttaccagtacagtacagaaccaatcaacacattccatggaatccaccaaaacgaagacgagcccatccgtgtgtcataccacagaaacatccactataacagtgtcgttaatcctaacaaggctactattggtgtcgggctgggtttacctagcttcaaaccaggattcgctgagcagtcgctcatgaaaaacgccatcaagactagtgaagaatcctggattgaacagcaaatgctggaagataaaaagcgagccactgactgggaggccaccaacgaggcaatcgaggagcaggtagcacgagaatcctacctgcagtggttgagagaccaggagaagcaagcgcggcaggttagggggccctcccagccaaggaaagcttcggctacatgttcgtcggccacagcagctgctagtagcggcctggaggagtggacctctagatccccccgtcagcgttcaagcgcttccagtccagagcaccccgaattacacgcagagttagggatgaagcctcctagccccggtaccgtgttggccctggctaagccacccagcccctgtgcacccggtacctcctcacagttttctgcaggtgccgatcgcgcaacttctcctctggtttcactttaccctgctctagagtgtcgagccctgatacaacagatgtctccaagtgccttcggcctaaatgattgggatgatgatgagatcctcgcgtccgtgctcgctgtaagtcagcaggagtacctggattcaatgaagaagaacaaggtgcatcgggaccctccaccggacaaaagttag

SEQ ID NO: 127499 - DNA, 1335 bp, Artificial Sequence
  Description of Artificial Sequence: Synthetic coding sequence
ggtgttgtggtgggggtggggggggctgtgggggtcggaggctgctgcagtggacccggacattccaagcgtagacgccaggcccctggtgtcggggctgttgggggaggctctcccgaaagggaggaagtcggagctggctataactctgaagacgagtatgaagccgccgcggcaaggattgaggccatggacccagcaacggtggaacagcaagagcactggtttgagaaagcactgagggacaaaaaggggttcattatcaagcaaatgaaggaagacggtgcctgcttgtttcgagccgtcgcagaccaggtctatggggatcaggatatgcacgaggtcgtaaggaagcattgtatggactacctgatgaagaatgccgactacttcagcaactatgtcaccgaagactttactacgtacattaaccgaaaaagaaaaaataactgtcacggtaatcatatcgagatgcaggccatggctgagatgtacaatcggccagtggaagtctaccagtacagcacaggtacgagcgccgtcgagcctatcaatactttccatgggatccaccagaatgaggacgaaccgattcgagtgtcctatcacaggaatatccattacaattctgtcgttaaccccaacaaggcgaccattggggtgggattgggtctccccagctttaagcctgggtttgctgaacaatcactcatgaaaaacgccattaagacgtcagaggaatcttggatcgagcagcagatgcttgaggacaaaaaacgggcaacagattgggaggccaccaatgaagctatcgaagagcaggtggctcgagagagctatctgcaatggttaagagaccaggagaagcaagctcggcaggtgagaggccctagccagccgaggaaggcctccgccacttgttccagtgctaccgcggccgcctcttccggattggaagagtggacttcgagaagcccacggcaaaggtccagcgcttccagtccagaacacccagaattgcatgccgaattgggcatgaagccccctagccctggcacagtactggcacttgctaagcccccctctccatgcgcgcccggcacatctagtcagttctctgccggcgccgatagggctacgagccctttggtatcactgtatcccgccctcgaatgccgtgccctcatccagcagatgtccccaagcgcttttggattaaacgattgggacgacgacgagatactggcttcagtgctggctgtgagtcaacaggaatatcttgactctatgaaaaaaaacaaggtgcaccgggatccaccaccagacaagagttag

SEQ ID NO: 127500 - DNA, 867 bp, Artificial Sequence
  Description of Artificial Sequence: Synthetic coding sequence
atggacgatccaaaaagtgaacagcaaaggatcctgcgccgtcaccagcgcgagcgccaggaactgcaggctcagatccgtagcctgaaaaattccgtgcctaaaaccgataagactaaaagaaagcagctcctgcaggatgtggcacggatggaagctgagatggcacagaagcaccgccaagagttagaaaagttccaagatgactcatccatagagtctgttgtcgaagaccttgccaagatgaacctggaaaatcggccaccaagaagcagcaaagcacaccggaaacgggaacgcatggagtcagaggagcgagagcgccaggagtcaatctttcaggcagagatgtcggagcacctagctgggtttaagagagaggaggaagagaaactagcagctatactaggagcccggggactggaaatgaaggcaataccagccgatgggcattgtatgtatagggctatccaggatcagcttgtgttttccgttagcgtggaaatgctcagatgccgaactgcttcatacatgaaaaagcacgtcgatgagttcctgcctttctttagcaaccccgaaacttctgattcctttggctacgatgatttcatgatttattgtgacaatatcgtaaggacaacagcctggggagggcagttagaactgagagctctgtcacacgtcctcaagactcccattgaagtgatacaggccgacagtccaaccctgataataggagaagaatacgtcaagaagccaatcattctggtttacttacggtatgcatattctctgggtgagcattacaacagtgtgacgcctctggaagcgggggcggccggaggcgtgctgccccggcttctgtag

SEQ ID NO: 127501 - DNA, 972 bp, Artificial Sequence
  Description of Artificial Sequence: Synthetic coding sequence
atggaaccgcgcgtccgcgtggaaggctggaaggtgcctacatcgaggtgtcgatttctgctagctagagtcctcgggtacttagtcgttatggaagcagtattgaccgaagagctggatgaggaagaacagttgctgcgccggcatagaaaggagaaaaaggagctgcaggccaagatccagggaatgaaaaacgctgtccctaagaacgataagaaacggcggaagcagctgaccgaagacgttgccaaacttgaaaaagagatggagcagaagcaccgggaagaactggagcaattaaaattaacaaccaaagagaacaagatcgactctgtggcagttaatatttctaacctggtcttagaaaatcagcctccacggatcagcaaggcgcagaagaggagggagaaaaaggctgctctcgagaaggaaagggaggagaggatagctgaagcggagatagagaatcttacaggtgctcgccacatggaatccgagaaactggctcagatcctggcagccagacaattggagatcaaacagatcccttctgacggccactgcatgtataaggcgattgaggaccagctcaaggaaaaggattgtgccctaaccgtcgtggcgcttcggtcccaaactgccgagtacatgcagtcccacgtggaagattttctgccatttctgacgaatcctaatactggagatatgtacactcctgaagaatttcagaagtactgcgaagatatcgtgaacaccgcggcttggggaggacaactggaacttagagccctatcacacattctgcagacgcctatcgaaatcatccaggcagactctccacctatcattgtgggtgaggagtatagcaaaaaaccactgatcttggtgtatatgcggcacgcctatggattaggagaacattacaacagcgtgactaggctcgtgaacatcgtcaccgaaaattgtagttag

SEQ ID NO: 127502 - DNA, 579 bp, Artificial Sequence
  Description of Artificial Sequence: Synthetic coding sequence
atgataagcaaagagaagaaggctgcactcgagaaagaaagggaagagcgaatagccgaggccgagatagaaaatctgaccggcgcccgtcacatggagagcgagaaactggcacagatcttggccgcccggcaactggaaatcaagcagatccctagcgacgggcactgcatgtacaaagctattgaggatcagctgaaggaaaaggactgtgcactgactgtcgtagccctgaggagccagactgctgagtatatgcagtcacatgtggaagacttcttaccttttttgaccaatcccaacaccggcgatatgtacacccccgaagaattccagaaatactgcgaagacattgtaaacaccgcagcgtggggggggcaactggaactacgggcgctttctcacatcttgcagactccaatcgagattatccaggccgattcccctccgattatagtgggagaagagtatagtaagaagcctcttatcctggtttacatgcgacacgcctacggcttgggcgaacattacaactccgtgaccagactggtcaacattgtgactgagaactgttcatag

SEQ ID NO: 127503 - DNA, 2781 bp, Artificial Sequence
  Description of Artificial Sequence: Synthetic coding sequence
atggtgagcagcgtgctgcccaatccgaccagtgccgagtgctgggctgccctcttgcacgaccccatgaccctcgatatggatgccgtccttagtgactttgtgagatccacgggcgccgagccagggcttgctagagacctgttggagggtaaaaattgggatctgaccgctgccttgtcagattatgagcagttgcgtcaggtgcacactgccaacttacctcatgtgttcaatgagggacggggtcccaaacaacctgaaagagaaccacagcccggacataaggtggaaaggccttgtctccagcgccaggacgacatcgcccaggaaaaacgactcagccgcggcatctcccatgctagcagcgccatcgtgtccctggctcgcagccatgtcgcatccgagtgcaacaatgaacaatttcccctggagatgcccatttataccttccagctgccagacctaagcgtgtactccgaggatttcagaagcttcatcgagcgggacctaatagaacaggctaccatggttgcactggagcaggccggacgactcaactggtggtctaccgtctgcacctcatgcaaaagacttttgcccctcgccacaaccggggacggaaactgtctgctccacgcagcatctctgggcatgtggggatttcatgatcgggacctggtgctgcgaaaagcactgtacacaatgatgaggacaggggccgaacgggaagcactgaagcgccgatggcgttggcaacagactcagcaaaacaaggaggaagaatgggagagagagtggacagaattgttaaaactggcaagtagcgagccccgcacacacttttctaaaaatggcgggactggaggaggggtagataatagtgaggatcctgtgtatgaatccctcgaggagttccacgtgttcgtactagcacacatactgcgaagaccaattgtggttgtggctgataccatgcttcgggactccggaggtgaagcatttgcccctatccccttcgggggaatttatctgccgttggaggttccaccaaatagatgccactgctcgccactagtgctagcctatgaccaggcccacttctctgctctagtgagcatggagcagcgcgatcagcagagggagcaggcagtgattccactcactgactccgagcacaaactgcttccgctgcacttcgccgtcgaccctggaaaagattgggagtggggaaaggacgataacgacaatgcacgacttgcccacttgatcctgtctctggaagctaagctcaatcttctgcattcctatatgaatgtcacatggatccggataccaagtgagacccgcgcgccccttgctcagccagagtcccctacagcaagcgctggagaggatgtccagagtttggcggacagcttggattccgacagggacagcgtctgttctaactccaacagtaataatggcaagaatggtaaagataaagagaaggagaagcagcgcaaagagaaggataagacacgggccgatagcgtcgctaataagctgggaagttttagcaaaacccttggaattaagctgaagaagaacatggggggcttgggcggacttgtgcacggcaagatggggagagccaactccgccaatggcaaaaacggggattcagcagagagaggcaaggaaaagaaggccaagtcacgcaaagggagtaaggaggaaagtggcgctagtgcctccactagcccttccgagaaaaccacaccatcccccaccgataaagctgccggcgcctcaccagccgagaaaggtgggggtcctagaggagatgcctggaagtatagcaccgatgtcaagctgagtctgaatattttgagagcagccatgcagggagaaaggaagtttatttttgccgggttgctgttgaccagtcatcggcaccagttccatgaagaaatgatcggatactatctgacttccgctcaggaacggtttagcgccgaacaggaacagagaaggcgggatgcagccaccgccgccgccgcggccgccgctgctgcggccgcaactgccaaaagaccgccaagacggccagagactgaaggtgtgcccgtgccggaacgtgctagcccaggcccccctacccagctagtgctgaaactgaaagaacgcccgtcacctgggccagcagcgggcagggccgctagggctgctgccggggggaccgcctcccccggagggggcgcccggcgcgcctccgcgagcggccctgtgccgggcagaagcccccctgcaccagcacgtcaaagcgttattcatgtgcaggcgtcaggggcacgcgatgaagcttgcgcacctgccgttggagccctacggccctgtgcaacctaccctcaacagaataggtcgctttcctcccagtcttatagtcccgctagggcggccgccctgcgcacagtgaatactgtggaaagcttggccagagccgtcccaggagccctgcctggcgcagcaggcaccgcaggcgcagcagaacataagtcgcaaacctacaccaacggtttcggagctctccgggatgggcttgagttcgctgacgccgatgcacctaccgcccggtcaaatggtgagtgtgggcgcgggggccccgggcctgtgcaacgtcggtgccagagggaaaactgtgctttctacggcagggccgaaaccgaacactattgctcatactgctacagggaagagctacgcaggagacgggaggcccggggggctagaccatag

SEQ ID NO: 127504 - DNA, 2802 bp, Artificial Sequence
  Description of Artificial Sequence: Synthetic coding sequence
atggtctctagcgtgcttcccaaccctacctcggcagagtgctgggcggcacttctccacgacccaatgacacttgatatggatgcagttttaagtgattttgtcaggtccaccggcgccgaacctggtctggctagagatctgctggagggcaagaattgggacctgaccgcagctctgtctgattacgagcagctgagacaggtccacactgctaacctccctcacgtgttcaacgaaggcagaggtccaaagcaacccgaacgtgagccacagcctggccacaaggtcgagcgcccttgcctccagcggcaggatgatatcgcccaggagaagaggctgtctagaggaatttcccatgcctcctcagcgattgtaagtctggcccgctcacacgtcgcttctgaatgcaacaatgagcagttcccattggagatgccgatctacacctttcagcttccggacctgtctgtatattcggaggacttcaggtccttcattgagcgagacctgatagaacaggcaactatggtcgctctggagcaggctggtcgactgaactggtggtccaccgtgtgtacgtcttgtaaaaggctacttcctcttgccacaacaggggacggcaactgcttgttacatgcagcctccttgggcatgtggggatttcatgatcgcgacctagtcctaagaaaagccctgtatacgatgatgaggaccggcgccgagagagaggctctcaagcgacgctggagatggcaacagacccagcagaacaaagagagtgggctcgtttataccgaggaagagtgggagcgagaatggacagagttgctgaaattggcatcttcagaaccacgcacacacttcagcaagaatggagggactggcggtggagtggacaactctgaggatcctgtgtacgagtcacttgaggaattccacgtgttcgtgctggcccacatcttgcgacggccaatagtcgtcgttgccgataccatgctccgagactccggcggcgaggcatttgctcctattcctttcggcggaatttacttgccactggaagtgcctcctaatagatgccattgctcaccactcgtgctggcatatgaccaggctcacttttcagcactggtgtccatggaacagagggaccaacagagagaacaagccgtgattccactgacagacagcgaacacaagcttctgcctcttcacttcgccgtggaccccggcaaagattgggagtgggggaaagacgataacgacaatgccaggctggcgcatcttattttgtccttggaggctaaattgaatctgctccacagctacatgaacgtgacttggatcagaattccctccgaaactagggcccccctggcccagcccgagtccccgacagcatccgcaggtgaggacgtgcagtcactcgcggatagcttagattcagatagggactcagtttgttctaacagcaattccaacaacggaaaaaacggcaaagataaagagaaggagaaacagaggaaggagaaagacaaaaccagggccgattccgtagctaacaagctgggttccttttctaagacgttgggaatcaaactaaaaaaaaatatgggtggcctgggtggacttgtgcatgggaaaatgggcagagccaattcagcaaatgggaagaacggggactctgctgagaggggaaaagagaaaaaagcgaagagccgcaaggggagtaaggaagagagcggagcttcagcttctacctcgccttcagaaaaaaccacacccagtcccaccgataaggcggctggagcttccccagctgaaaagggcgggggccctaggggggatgcttggaaatatagcactgacgtgaaactgagcctcaatatactgagagctgctatgcaaggcgaaagaaaattcatcttcgccgggttgctgttgacatcgcaccggcaccagttccatgaagaaatgatcggctattacctcaccagtgctcaggagaggttctcggccgaacaggagcagcgtcggcgggatgccgctaccgcagctgccgccgcagccgccgctgctgccgctaccgctaagcgcccaccgagacggcccgagacggagggcgttccagtccccgagagggcttccccgggaccgcccacacagttagtgctgaagctgaaggagcggccctcgcccggccccgcggccggacgagccgcaagggctgctgctggcgggaccgcgagccccggtgggggtgccaggcgcgcttccgcatccgggcccgtgcccggtcgaagcccacctgcccctgcccgacagtccgtgatccacgtgcaagcaagtggcgcacgagatgaagcctgcgcacctgccgttggcgccctccgtccctgtgcgacctacccccagcagaacagatcgttgtcatcccagtcttactcccccgctcgggcagccgccctgagaaccgttaatactgtggagtctctagcacgtgctgtgcccggtgctcttcccggggctgctggcacagctggggcggctgaacacaagtctcagacttacaccaacggcttcggagcgttacgcgacgggctggagttcgccgacgccgacgctccaaccgctcgcagtaacggcgaatgtggccgcggcggtcctgggccagtccaaagaagatgccagcgagaaaactgcgccttctacggccgagccgagactgaacactactgttcttattgttatagggaagagctccgacgacgcagagaggcccgtggggcccggccctag

SEQ ID NO: 127505 - DNA, 333 bp, Artificial Sequence
  Description of Artificial Sequence: Synthetic coding sequence
atggtgtccagcgtgttgcctaatccaacgtctgctgagtgctgggccgctctgctccacgatccgatgacactcgacatggacgcggtactgtcagactttgtccgctcaacaggcgccgaacccggcctggccagagacttactcgagggaaaaaactgggatctgacagctgccctgtctgattacgaacagctaaggcaagtgcacactgccaatctacctcacgtgttcaacgaaggcaggggacctaaacagcccgaacgcgagcctcagcccggacacaaggtggaacgtccatgcctgcagaggcaggacgatattgcccaatag

SEQ ID NO: 127506 - DNA, 2532 bp, Artificial Sequence
  Description of Artificial Sequence: Synthetic coding sequence
atgacccttgacatggacgcagtgctgagcgatttcgtcagatctactggagctgagcccggtctggcacgggaccttctagagggcaagaattgggatgtaaacgccgcgctctctgacttcgagcagctccgacaggtccacgccggaaatctccctccaagtttctcggaggggagtggtggttctaggactccagaaaaaggctttagcgatcgggaacctacaaggcccccacgacctattttacagcgccaagacgacatcgtacaggaaaaacggttaagcagaggtatttctcacgcgagctcatccattgtatccttagcccgaagccacgtatctagtaacgggggcggcggcggatccaatgagcatcctctcgagatgcctatatgcgcctttcagttacccgatcttaccgtttataacgaagatttcagatctttcatcgagagagatctgatcgagcagtctatgttggtggccctcgagcaagccggaaggttaaattggtgggttagtgtagatcccacctcacagagactgcttcctctcgctacgaccggcgatggtaactgccttctgcacgccgcgagtctggggatgtgggggtttcatgatcgggatctgatgctacgcaaggcactctatgcgctcatggagaagggcgtcgagaaggaggctctgaagaggcgctggcggtggcagcagacacagcaaaataaggagagtggacttgtgtataccgaagacgaatggcagaaagagtggaatgagctaatcaaactggcgtcgagcgagcccaggatgcacctcggtacaaatggcgctaactgtggtggtgttgagtcctctgaagagcccgtctacgaatccctagaggaatttcatgtgttcgtgctagcacacgtgctcagaaggcctattgtcgtggttgctgatacgatgctccgtgactccggtggcgaagcgttcgcacccatccctttcgggggtatatacctcccactggaggtgccagccagtcagtgtcaccgctctccattggtgttagcatacgaccaggcccatttctcagccctggtgtccatggaacaaaaagaaaacactaaagaacaagctgttatccctttgacagactcagaatacaagttgctccctctgcactttgctgtcgaccccggaaagggatgggagtggggcaaagatgattccgataatgtacgcctggcgtccgtcatcttgtccctggaggtcaaactgcacctcttacacagctatatgaacgttaagtggattccactgagctctgatgcgcaggcccctctcgcccagccagagtcacctaccgcttctgctggagacgagcccagatcaacccccgaatctggtgattctgataaagagtcagtcgggtcttcctccacgagtaatgaggggggacgacggaaggagaagagcaagcgggaccgtgaaaaagataagaaaagagcagacagcgtggccaacaagctggggtcatttggcaagaccttggggagcaaattaaaaaagaacatgggaggactcatgcacagcaaaggttcgaagccgggcggagtgggcactggcctgggtggatcctcgggcacagaaacccttgagaaaaagaagaagaactctctcaagtcctggaagggtggcaaagaagaggctgcaggagacgggcctgtgtctgaaaaaccaccagcagagagtgtagggaatgggggctccaagtatagccaggaggtcatgcagagtctaagcattttgcgtacggcaatgcagggagagggtaagttcattttcgtgggcacacttaagatggggcaccgtcaccagtatcaggaggaaatgatccaacggtatctgagcgacgctgaggagcgctttttagcggagcaaaagcagaaagaggctgagcgcaagattatgaacggaggcatcggcggcgggccaccacccgccaagaaacccgagccagatgctagagaggaacagccaacaggcccacccgccgaatctagagccatggccttttccaccggatatccgggagattttaccatcccccgcccatccggcggaggcgtgcactgccaggagccccgtcgacaattggctggaggcccgtgcgtggggggcctccctccttacgccacgtttccgcggcagtgcccacccgggcgtccttacccccaccaggatagcatccctagccttgagccaggttctcacagtaaagacggacttcatcggggcgcgctgttgccgcctccctaccgagtcgcggacagttactccaatggctacagggaaccccccgaaccggatggctgggccggtggcctccgaggactaccccccacccagacgaagtgtaaacagcccaactgctctttttatgggcacccggaaaccaacaatttctgttcttgctgttacagggaggaactgcggcgacgggagcgagagcctgatggggaacttctcgttcataggttttag

SEQ ID NO: 127507 - DNA, 1284 bp, Artificial Sequence
  Description of Artificial Sequence: Synthetic coding sequence
atgaccttagacatggatgcagttctgagcgattttgtgcgctctactggggccgagcccgggctggccagagacctgctggagggaaaaaactgggacgtaaacgcagctttatccgacttcgaacagctgcgccaggtgcatgctggtaacttgcccccttcattttctgagggatccggggggagtcgaacccccgagaagggcttctcagatcgtgagccaaccagacctccccggccaatcctgcagcgccaggacgacattgtgcaagaaaagagattatctcgtggtatcagtcacgcatctagtagcatagtgagtctcgcaagaagtcatgtcagctctaacggaggcggcggcggcagcaacgagcatcccctggagatgcctatctgcgcctttcaactaccagacctgacggtttataacgaagactttagatctttcattgaacgcgacttaatcgagcaatcaatgctggtcgctttggagcaggccggccgtctaaactggtgggtgagcgttgaccccacgtcccagcgcctcctgcccttagcaacaacaggagatggcaactgtttgctgcacgcggcttcgctggggatgtggggctttcatgatcgtgatctgatgctgaggaaagccctgtacgcactgatggaaaagggtgtagagaaagaggcactcaagaggagatggaggtggcagcagactcaacagaacaaggagtccggcctggtctatactgaagacgagtggcaaaaagagtggaatgagctcatcaaactagcttcatcggagccaaggatgcatctggggacaaacggcgcaaattgtgggggcgtggagtcgtccgaggaacccgtgtacgaatcccttgaggagtttcatgttttcgtgctggctcacgtactgaggcgacctatcgtggttgtggccgacactatgctgcgagacagcggcggcgaggcattcgcacccatccccttcgggggtatttacttgcctctcgaggttcccgccagtcagtgccatcggtcgcctctcgttctggcttacgaccaggcccatttcagcgctctcgtgtccatggaacagaaggaaaacacaaaggagcaagccgttatccccctgaccgatagtgagtacaagcttctgcccttgcatttcgccgtagaccccggcaaaggctgggaatggggcaaggatgacagcgataatgttaggctggctagtgttattctgtcattagaagtcaagttacatcttctgcacagctag

SEQ ID NO: 127508 - DNA, 2445 bp, Artificial Sequence
  Description of Artificial Sequence: Synthetic coding sequence
atgaccctagacatggacgccgtgctctctgatttcgtacgatcaaccggcgctgagccggggttggcaagagaccttctcgaaggcaagaactgggacgtgaatgcagccctttcagactttgaacagctgagacaggtccatgcaggaaacctccctccttcctttagcgagggctcaggcggctccagaacacctgagaagggtttcagtgacagagagcctacaagacccccacgacctattttgcagcgacaggatgacatagtccaggagaagaggctgtctagaggcatttcccatgcctcttccagtatcgtgtctctggcccgttcccatgtgtcatccaacggaggaggcggcggatcaaatgagcaccctctggaaatgccgatctgcgcctttcagctgcctgatcttactgtgtacaacgaggattttcgctctttcatagagcgcgaccttatcgagcagtcaatgcttgtggccttagagcaggcaggacgactcaattggtgggtgtccgtggatcctaccagccaacgccttctgcccctggcaacaacaggggacgggaattgcctgttgcacgccgcttccttggggatgtgggggttccacgatcgggaccttatgctccgaaaagctttgtatgcacttatggagaaaggagtggaaaaagaggcactaaagaggaggtggaggtggcaacaaacgcaacagaataaggaaagtggtctggtgtataccgaggacgaatggcagaaggagtggaacgaattaatcaaactggcttctagtgagccccgaatgcacctcgggacgaacggggctaattgcggaggagtcgagtcaagtgaggaacctgtctacgaatctctggaagagtttcatgtcttcgtgctggcacacgttttacgaagaccgattgtggtagtggccgacacaatgctgcgggactcgggcggtgaagccttcgccccgattcccttcgggggtatctatttacccttagaagttcctgcatcgcaatgccaccgatctcctctggtgctcgcgtacgaccaggcccactttagtgccctggtgtctatggagcagaaggagaatactaaagagcaagccgtgattccactaacagactccgagtacaaactgctgcccttgcacttcgccgtcgatcctgggaaggggtgggagtggggcaaggatgattcagacaacgtgcggctcgccagcgttatactctctttagaggtgaaactgcacctactgcactcgtacatgaatgtcaaatggatccccctatcatccgacgcccaggcccccttggcccagccggaatcaccaactgcgtcagccggagacgaacccaggagcaccccagaaagcggggattctgataaagagagtgttggctcgtcttcgacctctaacgaaggtggccgtcgtaaggagaagtctaagagggaccgggagaaggataagaagagggctgattccgtagctaacaagctggggtccttcggaaaaactctgggctcaaagttgaagaagaatatgggggggctgatgcactcaaagggaagcaagccaggcggagtcggcaccggattaggaggatcttccggcactgagactttagaaaagaaaaagaagaactctcttaagtcctggaagggtggaaaggaggaagccgccggggatgggccggtgtccgaaaaaccaccggccgagagcgtggggaacggaggatccaagtattcgcaagaagtgatgcagtcactgagcattttacgaacagccatgcaaggagaaggtaaattcatttttgtcggaacactcaagatggggcaccgtcaccaataccaagaggagatgattcagcgctacctttctgacgctgaggaaaggttccttgcagaacaaaagcaaaaggaggctgagcgaaagatcatgaatggcggcattggtggtggtcccccaccggccaagaaaccggaaccggatgccagagaggagcagcctaccggtccgcccgccgagtctagagctatggctttttccacaggctatccaggagatttcaccatcccccggccaagcggcggcggagtgcactgccaggagccccgacgccagctggccggaggcccttgcgtgggtggactccctccgtacgcaacatttcccagacaatgccctccaggcagaccgtacccgcaccaagactctattccctccctagaacctggtagccactccaaggatgggctgcaccggggcgcattgctgcctccaccctacagagtggcggacagctattccaatggctacagggaacctccggagccagacggctgggcaggcggactgcgcggcctccctccaactcagaccaagtgcaaacaacccgacggtgagctgctggtccacaggttctag

SEQ ID NO: 127509 - DNA, 927 bp, Artificial Sequence
  Description of Artificial Sequence: Synthetic coding sequence
atgtgcggagtagagggctgctgccaaggaggagccacacggaggggctctcttcctggagggcgccagttggccacccgaaagcgatctgtcgttagacgctgtttgaagatggcagctgaggagccccagcagcagaagcaggagcctctcgggtcggacagcgaaggggtgaactgtttggcttatgacgaggctataatggctcagcaagatcggattcaacaggaaatcgcggttcagaaccctctcgtgagcgagaggctggagctaagcgtcctctacaaggaatacgccgaggacgacaatatctaccagcagaagatcaaagatctccacaagaaatacagttacatccgtaagacccgccccgatggaaactgcttttatcgggcctttggcttctcgcacctggaggcccttttggacgactcaaaagagttacagagattcaaggctgtgtcagccaagtcgaaggaggacctggtgagccaaggcttcaccgaattcacgattgaagacttccacaacaccttcatggacctaatcgagcaagtagagaaacagacatctgtggctgacctgttggcttcgttcaatgatcagtccacatctgattatctagttgtgtacctgcggctattaacatctggatatcttcaacgtgagtctaagttttttgaacacttcattgagggggggcgcaccgtcaaggagttttgccagcaggaagtcgagcccatgtgtaaagagtcagaccacattcacatcatcgctctcgcgcaggcattgtctgtatccattcaggtggagtacatggacagaggcgagggtgggaccacaaacccacatatcttcccggagggtagtgaacccaaagtgtatctgctgtaccggccaggtcactacgatatcctttacaaatag

SEQ ID NO: 127510 - DNA, 816 bp, Artificial Sequence
  Description of Artificial Sequence: Synthetic coding sequence
atggccgcggaagagcctcagcaacaaaagcaggaacccctgggcagcgactctgagggcgtgaactgcctcgcttatgacgaggccattatggcccaacaggaccggattcagcaggagatagccgtgcagaaccccctggtatccgaaagactcgaactgagcgtgctctacaaggagtacgccgaagatgacaacatctaccagcagaaaattaaagaccttcataagaagtactcttacatcaggaagacccgcccggacggcaactgcttctaccgagccttcggcttcagtcacctggaagctctgctggacgattctaaggaattgcagcgtttcaaggccgtgtccgccaagtccaaagaggatctcgtgagtcaagggtttaccgagttcaccattgaagacttccacaataccttcatggacttgatcgagcaggttgaaaagcagacctccgtggcagacttacttgctagctttaacgatcagtctacatccgattatcttgttgtctaccttaggctattgaccagtggatatttacagcgtgaaagcaagtttttcgagcatttcattgaaggcgggaggaccgtgaaggagttctgccagcaagaagtggagccaatgtgcaaagaatccgatcacatacacattatcgctcttgcccaggctctgtctgtgtcaattcaggtggaatacatggacagaggtgagggcgggacaacgaatcctcatattttccccgagggcagcgaaccgaaagtgtatctactgtacaggccagggcactatgacattctgtataaatag

SEQ ID NO: 127511 - DNA, 816 bp, Artificial Sequence
  Description of Artificial Sequence: Synthetic coding sequence
atggccgcagaagagcctcagcagcaaaagcaggaacctttgggctcagactctgaaggtgtgaactgtctcgcctacgatgaagcaatcatggcccaacaggaccggattcagcaggaaatcgctgtgcaaaatcctctcgttagtgagcgtctggagttatcagttctgtataaggagtacgccgaggatgataacatttatcagcaaaaaatcaaggaccttcacaaaaagtatagctacataaggaagactcggcctgatggaaattgtttttacagggcattcggcttcagtcacctggaagcactgcttgatgactccaaagagctccagcgctttaaggctgtgtctgccaaatctaaagaggatttggtttcacagggtttcactgaattcacaattgaggatttccataatacattcatggaccttatagaacaggttgaaaaacagacgtcagtcgctgacctcctggctagtttcaatgatcaatcaacatccgattacctggtggtatatttacgactgctcaccagtggctatttgcagcgagagtcaaagttctttgaacacttcattgagggcggtaggacagtcaaggagttttgtcaacaggaagtcgaacccatgtgcaaggaaagtgaccacatccatataattgctttggcccaggctctgagtgtgagcatacaggtcgagtatatggatcggggtgagggaggaaccactaacccccatatatttcctgagggctcagagccgaaagtgtacctgctttatagacccgggcattatgacattctctataagtag

SEQ ID NO: 127512 - DNA, 843 bp, Artificial Sequence
  Description of Artificial Sequence: Synthetic coding sequence
atggctgctgaggagcctcagcaacaaaagcaggagcctctgggtagtgattcagaaggcgtcaactgtctggcgtatgatgaagccatcatggcccagcaggatcgcatccagcaagaagatatgacggatccttgtcttttgcagattgctgtgcagaatccactggtgtccgagaggctcgaattgtccgtgctctataaggagtacgcagaagacgataacatttaccagcagaagattaaagacttgcataagaaatattcatacatacgtaaaacccgccctgatgggaactgcttttacagagcctttggattctctcacttagaagctctgctcgacgacagcaaagagttgcaacggtttaaagctgtgtctgcaaagagcaaggaagacctggtgagtcagggcttcaccgaattcacgatcgaggactttcataacacctttatggacttgatagaacaggtggagaagcagactagtgttgccgatctgctggcctctttcaacgaccaaagtactagcgattacctggttgtgtacttgcggctactgacctccggctacctgcagcgtgagagcaagttttttgagcatttcatcgaaggtggacgcacagtgaaagagttctgccagcaggaggtagaaccaatgtgcaaggagagcgatcacatccacatcattgcattggcccaggccctttcagtaagcatccaggtcgaatacatggaccggggggagggcggaaccactaacccacacatcttcccagagggctccgaacctaaggtctacctcctttatcggccaggtcattatgacattctgtataagtag

SEQ ID NO: 127513 - DNA, 705 bp, Artificial Sequence
  Description of Artificial Sequence: Synthetic coding sequence
atgtccgaaacgagcttcaatctgatcagcgaaaaatgcgacatcctctctatactgagagatcaccccgaaaatcggatataccgaaggaagattgaagagctgtcaaagaggttcacagcaatcagaaaaaccaaaggcgacggcaactgcttttatcgagccctcgggtactcctacttagagtctcttcttggcaagagtagagagatctttaaattcaaagagagggttttgcaaacccccaacgacttgctcgccgcaggattcgaagagcacaagttcaggaattttttcaatgccttctattccgtggtagaattggtcgagaaagatgggtccgtgtcttccctgctcaaggtcttcaatgatcagtctgcctctgaccatatcgtgcagtttctgcgactgctgacttcggctttcatacggaaccgagctgactttttccgccactttattgatgaagagatggatataaaggacttctgtacccatgaagtggagccaatggcaacagaatgtgatcatatacagataaccgccctaagccaggctctgagtatcgctctccaggtagagtacgtagacgagatggacactgctctgaaccaccacgtgttccccgaagccgccactccatccgtatacctgctgtacaaaacctcgcactacaatatcctgtatgccgcagataaacactag

SEQ ID NO: 127514 - DNA, 222 bp, Artificial Sequence
  Description of Artificial Sequence: Synthetic coding sequence
atgagcgaaacctccttcaatttgatctctgagaagtgtgacatcctaagtatcctgcgcgatcaccctgagaatagaatttatagacgcaagatcgaagaactgtctaagcgcttcacagctatacggaagacaaagggggacgggaactgcttctatcgcgcccttgggtatagctatctggaatccctgcttggaaaatctcgcgaaatctttaagtag

SEQ ID NO: 127515 - DNA, 753 bp, Artificial Sequence
  Description of Artificial Sequence: Synthetic coding sequence
atggccgccttgtcatgtctgctggacagtgtgcgaagggatattaagaaggtggacagagagctgcggcagttgcggtgtatcgatgagtttagcacacggtgtttatgtgatctctacatgcacccctactgttgttgcgacctccacccctatccctactgcctttgctactcgaaaagaagtaggagttgcggactttgcgacctttacccctgctgcctttgcgactataagctgtactgtctaaggccgtccctccgaagtctggaacggaaggcgatcagggcgattgaggatgagaaacgtgagctggcaaagctgcgacgcacaaccaatagaattcttgcaagcagctgctgttcttctaacattctgggctcagtgaacgtatgtgggttcgaaccagatcaggtaaaggtgcgcgtgaaggatgggaaagtctgcgtgtcagctgagagagagaaccgctatgattgcctcgggagtaagaagtactcatacatgaacatctgcaaggaattctccctgccgccgtgtgttgatgaaaaggatgtgacctactcatacggactcggcagctgtgtgaagatcgaaagcccctgttatccgtgcacttctccttgttctccctgctcaccttgctccccctgtaacccatgttctccctgtaacccttgttctccctatgacccttgtaatccttgttatccctgcggttcgagattcagctgtcgcaagatgatcctgtag

SEQ ID NO: 127516 - DNA, 2418 bp, Artificial Sequence
  Description of Artificial Sequence: Synthetic coding sequence
atgaaagacaggagcagtactccgcccctgcacgttcacgtggatgagaacaccccagttcacgttcacatcaaaaagctgccaaaacctagtgctacctcttcccagaagtctcataagaggggaatgaagggagataccgtgaacgttcgcaggtcagtgcgagtcaagactaagaatcctccacattgcctagagattacaccaccaagctcagagaagctggtgtctgtgatgagacttagtgacctttcaactgaggacgacgactccggccattgtaaaatgaatcgatatgataagaaaattgacagtctcatgaatgccgttggctgcctgaagtcagaggttaaaatgcagaagggtgagcggcagatggctaaaaggttccttgaggagcgaaaggaagagctggaagaagtggcacacgaactggccgagactgagcacgaaaacaccgtcctcaggcataatatcgaacgcatgaaagaggagaaggatttcaccatactgcagaagaagcatcttcagcaggagaaggaatgcttaatgtccaaactcgttgaggccgagatggatggagccgccgctgcgaaacaggtgatggccctaaaggataccatcggtaagctgaaaactgaaaagcagatgacgtgcaccgacatcaacacgcttacacgccagaaggaactcctcttgcagaagctctcaacgtttgaagaaactaatcgtacactcagagatcttctcagagaacagcactgtaaggaggactctgagcggctgatggagcagcaaggcgcccttttaaagcggctggctgaagccgactctgagaaagccagattactgcttcttttgcaggataaggataaggaggtcgaggaacttctgcaggagattcagtgcgagaaagcacaggcaaagaccgcatctgaactttcgaagtccatggagtccatgcggggccatctccaagcacaacttcggtccaaggaagccgaaaactctcgactctgcatgcaaatcaagaatctggagagaagtggcaatcagcacaaggccgaagtggaggccatcatggagcagctgaaagagcttaagcaaaagggcgatcgggacaaagaatctctaaagaaggcgatcagagcccagaaggaaagagccgagaagagtgaagagtacgccgaacaactgcacgttcaattagctgacaaagatctctacgtcgctgaggcattgtctaccctcgaaagttggagatcgcgctacaaccaggttgtgaaggaaaagggggacctggaactggaaataattgtgctgaatgacagagtgactgaccttgtgaaccagcagcagaccctggaggaaaaaatgcgtgaagatcgggactcactggtcgaacgtctgcatcggcagacagccgagtactctgccttcaaactagaaaacgagaggctgaaggcttcatttgctccaatggaggataagctcaatcaggcgcatctggaagtgcagcagctgaaggcttcggtcaagaattatgagggaatgattgacaattacaagtcccaggttatgaagactagactcgaagctgacgaagtcgccgcacagttagaacgctgcgacaaggagaacaaaattttaaaggatgagatgaacaaagaaatcgaggcagccagacgccagtttcagtctcagctcgctgaccttcagcagcttcctgacatcctgaagattactgaggccaaactggcggagtgtcaagatcagctgcagggatatgaaagaaaaaacattgacctgactgccatcatttcggacctacgcagcagaatcgaacaccagggggataaattagagatggcgcgggagaagcaccaggcgtcgcagaaagagaataagcaactgagtctgaaagtggatgagttagaacgaaaacttgaagccacctcagcacagaatattgagtttctgcaggtcattgcgaagcgcgaagaagctattcaccagtcccaactgcgcctggaggaaaagacacgtgaatgcggcacacttgcgaggcagttggagtcagcaatagaggatgcccgcaggcaggtggagcagactaaagagcatgctctttcaaaggagcgtgccgcgcaaaacaagatactggatctggagactcagttatcacgtacaaagacagaactctcccaactccgcaggtctcgtgatgatgccgataggcgataccagagccgattacaagatctgaaggatcgcctggagcaatctgaatcaaccaaccggtccatgcagaactacgtgcagttcttaaaatcttcttatgcaaatgttttcggcgatggtccttactctacgttcctcacatcatccccgatccggagccggagcccaccagcctag

SEQ ID NO: 127517 - DNA, 2475 bp, Artificial Sequence
  Description of Artificial Sequence: Synthetic coding sequence
atgaaggaccgcagttccaccccaccgctccacgtgcatgtggatgagaatacgccggtgcatgtgcacatcaaaaagctgcccaagccttctgcaaccagtagccagaagagccacaaaagagggatgaaaggcgacacagtcaacgtgcgtagaagcgtgcgcgttaaaaccaaagtcccctggatgccccctggtaaaagtagtgcacgacccgttgggtgtaagtgggaaaatccacctcattgcctggagattacccccccaagcagcgagaagcttgtgagcgtcatgaggttgagcgatctatcgacagaggacgatgattcaggccactgcaagatgaatcggtatgacaagaagattgacagtctgatgaacgccgttggttgtctgaagagcgaggtgaagatgcagaagggagagcgccagatggccaagaggtttctggaggagaggaaggaagagctggaggaggttgcacacgagctggcagaaacagaacatgaaaatactgtattacggcacaacatagagcgcatgaaagaggaaaaagacttcaccatcctacagaagaagcacctccagcaagaaaaggaatgtttgatgagcaagctggtggaagctgaaatggatggcgctgctgctgcaaagcaggtgatggctctgaaggataccatcggcaaactgaaaaccgagaagcagatgacatgcacggatattaacacgttaacccggcaaaaagaactgcttctgcaaaaactgtctaccttcgaggaaacaaatcggaccctgcgtgatctgttgagagaacagcattgcaaagaagactctgagcggctgatggagcagcagggcgctctactcaagcggctcgctgaagcggatagcgagaaagcaagactgctactactgctgcaggataaggacaaagaggtggaagagcttttgcaggagatccagtgcgagaaagcgcaggcaaaaaccgcatctgagctatccaagagcatggagagtatgagaggccatctgcaggcccagttgcggagtaaagaggctgagaacagccggctttgcatgcaaatcaagaacttggaacggagcggaaatcagcacaaagccgaggtggaagctattatggagcagctcaaagaactgaagcagaagggagatagagataaagaatctcttaaaaaagcaatccgcgcacagaaagaaagggccgagaaatcggaggaatacgctgagcagcttcacgtgcaacttgcggataaagatctgtacgtcgctgaggctctctcaaccctggagtcgtggcgatcgagatataaccaagtcgtgaaggaaaagggcgacctggagctggagatcatcgtgctcaacgatagggtgaccgaccttgttaatcagcagcagacgctcgaggagaagatgcgagaggatagagactcattggtcgaaagactccatcgccagacagctgaatactctgccttcaagctcgaaaatgagagactgaaagcgtcattcgcccctatggaggacaaactcaatcaagcccacctcgaggtccagcagcttaaggcatctgtaaaaaattatgaggggatgatcgacaattataagtctcaggtaatgaagaccagattggaggcagatgaggtcgctgctcagttagagaggtgcgacaaggaaaataagatattgaaagatgaaatgaataaagagatcgaggccgctcgccgacaattccaatctcagctcgccgacctccagcagttacccgacattctcaaaatcactgaagccaagctggcggagtgccaggatcagctgcaaggatatgagcgcaagaatatcgacctgacagcgatcatctccgaccttaggagcaggatcgagcaccagggtgataaactcgaaatggccagggaaaagcatcaggctagccagaaagagaataagcagctctcgctcaaagtggatgagttagaacggaaactcgaagccactagcgctcagaatatcgagttcttgcaggtaatagccaagcgcgaagaggcaatccatcaaagtcagctgcggctcgaagagaagactcgcgagtgcggaaccctggctagacagctggagagcgccatcgaagatgccagacgacaggtggagcaaaccaaggaacacgcgctaagtaaagagcgtgccgcccagaacaagatcctcgaccttgagacccagctgtcaaggactaagacagagttaagccagctgaggcggtcgcgggatgacgccgacaggcggtatcaaagcaggctgcaggatctgaaagatcgcttggagcagtccgaaagcaccaacagatctatgcagaattacgtccagtttctaaaaagcagctacgccaatgtgttcggtgacgggccttattcgacattcctcacgagtagccctattaggtcgaggagccccccggcctag

SEQ ID NO: 127518 - DNA, 1917 bp, Artificial Sequence
  Description of Artificial Sequence: Synthetic coding sequence
atgagcgcctcttcttctggtgggtcacctcgattcccttcatgcggaaagaatggtgttacatctctgactcagaagaaagtactgcgggccccctgtggcgcaccatctgttaccgtcactaaaagtcacaagagggggatgaaaggagatacagtaaacgtaaggcgtagcgtgagagtgaaaaccaagaatcctccacactgtctcgaaattacccccccaagctcagaaaagttagtctcagtcatgcgtctgtccgatctgtctactgaggacgatgatagcgggcattgtaagatgaacagatatgacaagaagatcgacagtttaatgaacgctgtgggatgcctcaagtccgaagtgaaaatgcagaaaggcgagagacagatggcgaaaagatttcttgaggagaggaaagaggagctggaagaagtcgctcatgaattagccgaaaccgagcacgaaaataccgttctgcgccataatatcgaacgaatgaaggaggaaaaggatttcacaatactccagaagaaacacctgcaacaggaaaaagaatgtctcatgagcaaactggtggaagctgagatggatggagccgccgcagccaagcaggttatggcactaaaggataccataggaaaactgaaaacagagaaacaaatgacctgtaccgacatcaataccctcacgcggcaaaaagagctgcttcttcagaaattgtcgacattcgaagaaacaaaccgtactttgagggaccttcttcgtgaacaacattgtaaggaagatagcgagagattgatggagcagcagggtgctcttcttaaaaggcttgctgaggccgattctgagaaagcacgccttctgctgctgttgcaagacaaggacaaagaagtcgaggaactgttgcaagaaattcagtgcgagaaggcccaggcaaagaccgcctccgaactgtccaaatcaatggaatctatgcggggccatctgcaggcccagttacgatcaaaggaagctgagaactcccgtctgtgcatgcaaattaagaatctggaacggtctggtaatcagcacaaggcggaagttgaggccatcatggagcagctgaaagagcttaaacagaaaggcgatcgggacaaggaatcgctgaaaaaagctatcagggcccagaaggaacgcgctgagaagagcgaggaatatgctgagcaacttcacgtccagctcgccgataaggacttgtatgtggccgaggcgctgagcaccctcgaatcttggagaagcagatacaatcaggtcgtcaaggagaaaggtgacctcgagcttgagatcattgtcttaaacgacagggtgaccgatctggtcaatcaacagcaaactttggaggagaagatgcgcgaggatagagactccttagttgagaggctgcacaggcagacggcagaatactccgcgtttaagcttgaaaacgaacgcctgaaggcctctttcgcaccaatggaggacaagttgaaccaagcccatctggaggtgcagcagctgaaagcatctgtcaagaattacgaggggatgattgacaattacaaaagccaggtgatgaaaacgcgactagaagccgatgaggtggccgcccagctagaaagatgtgacaaggagaataaaatcttgaaggacgagatgaataaagaaatcgaagcagctcgccgacagttccagagtcagctggcagacctgcagcagctgcctgacattctcaaaatcactgaagcgaaactggctgagtgtcaggaccagctgcaagggtacgagcggaaaaacatcgacttaacggcgataatctcggacctccgatctcgggtgcgagattggcaaaaaggttctcacgaactgacccgcgcgggggcgaggatcccgcgatag

SEQ ID NO: 127519 - DNA, 2490 bp, Artificial Sequence
  Description of Artificial Sequence: Synthetic coding sequence
atgtctgcaagttccagtgggggtagtccccgatttccttcatgcggcaagaatggcgtcactagccttactcagaagaaagtgctgagagccccttgtggtgcgccctcagtgaccgtcaccaagagccataagaggggcatgaagggtgatacagttaatgtccggagatctgtccgcgtcaaaaccaaggtaccctggatgcctcctggtaaatctagcgcacgtccagtgggctgtaagtgggaaaaccccccgcattgccttgaaatcacacctccgagctcagaaaagctcgtttccgtgatgaggctatctgatctgtctaccgaggatgatgactccggccactgtaaaatgaatcgctatgataagaaaatcgattcattaatgaacgccgtcggctgcctcaaaagcgaagtcaaaatgcagaagggcgagcgacagatggccaaaagattcttggaggagagaaaagaggaactggaagaagtcgctcacgagttggccgaaacagaacacgaaaacaccgtgttgcgccacaacatcgagcggatgaaggaggagaaagatttcacaattcttcaaaagaagcacttgcaacaagaaaaggaatgcctaatgagcaagctcgtcgaggctgaaatggacggggccgctgccgccaagcaggttatggctttgaaagacacaatcggaaaactgaaaaccgaaaaacagatgacttgtacagatatcaatacgctcaccaggcagaaagaacttttgctgcagaaattgtctacattcgaggagactaatcggacattgcgtgacctgctcagagagcagcactgcaaggaggactcagaacgactcatggagcagcagggtgccctactgaagcggctcgccgaagcagactccgaaaaagcgagactcctcctcctgctgcaggacaaggacaaagaggtcgaagagttgctgcaggagatccagtgcgagaaggcccaggcgaagaccgccagtgagctttctaagtctatggagagtatgcgaggtcacctgcaggcacagctgcgctcaaaggaggctgagaatagccggctgtgcatgcagattaaaaatcttgagcgcagcggcaatcagcacaaggcagaggtggaagctattatggagcagcttaaggaactgaaacaaaagggcgacagagataaagagtcactgaaaaaggctatccgcgcacagaaagagagggccgaaaaaagcgaagagtatgccgagcagttacacgtgcagttggctgacaaagacctatacgttgcggaagccctctcaacgctggaatcttggcgcagtagatataaccaggtcgtaaaggaaaaaggcgacctggagctggagattattgtcctgaacgatcgtgtcacagacttggtaaaccaacagcagacacttgaagagaaaatgcgtgaagaccgcgattcccttgtagagagactccacagacaaacagctgaatactccgcgttcaaactcgagaatgagcgcctcaaagcaagtttcgcccctatggaggataagctaaatcaggcgcacctagaagtacagcagcttaaggcaagtgtgaagaactatgagggaatgatcgacaattacaaatctcaagtgatgaaaacacgtttggaggctgatgaagtcgcggcgcagctggagcgctgcgataaggagaataagattctcaaagatgaaatgaataaggagatcgaagcagcccgacgccagttccagagccagctggcggatcttcaacagctcccagatatcctgaagataacagaggcaaagctcgcagagtgccaggatcagttacagggatatgagcgtaaaaacattgatttgacggccataatttctgatcttcgctccagaatcgaacaccagggggacaagctcgaaatggcgcgggagaagcaccaggcttctcagaaagaaaacaagcagctgtctctcaaggtggatgagcttgagcgcaaacttgaagccactagcgcacagaatattgagtttttgcaagtgatcgctaagagggaagaggctatccaccagtcacagctgcggcttgaggagaagacccgtgaatgtgggaccttggcaaggcagctggagtctgctatcgaagatgccagaaggcaagtggaacaaaccaaggaacatgctttaagtaaggagcgggcagcacagaacaagatcctggatctcgagacccagttatctcggactaagaccgaactgtctcagctgcgcaggagccgcgatgacgctgacaggaggtaccagtcccggctccaggatctgaaggaccggctcgagcagagcgaatcaaccaaccggagcatgcaaaattacgtccagtttctgaagagctcttacgctaatgtgttcggcgacggtccttattctaccttcctgacctctagcccaattcggtcacgatcccctccagcttag

SEQ ID NO: 127520 - DNA, 2106 bp, Artificial Sequence
  Description of Artificial Sequence: Synthetic coding sequence
atgggagagctgcccacgggctgtaggaagcgtcgaaggaagaggggaggtgcggcagccagagccagattgcatccacctcggaggctccacggcacaactcttgcctccgattttaacgacttcatacgcaggaggttctgggcacaaccttgccgctcatggttcccttcctgcgggaaaaatggtgttacctctctcacccagaagaaggtgctgagggccccctgtggagcccccagcgtcactgtcaccaaatctcataaacgtggtatgaagggagacacagttaacgttagaagaagtgtgagggttaagactaaggtgccttggatgcctcccggcaagtcttctgcccggccagttgggtgcaagtgggaaaaccctcctcattgcctggagatcactccaccctccagtgaaaagttggtgtcggtcatgcggttgagcgatctgagtacagaggacgatgattcggggcattgtaaaatgaataggtacgataagaagattgactcccttatgaacgccgtaggatgtctgaagtccgaggttaaaatgcagaagggcgagagacaaatggccaagaggtttctggaggagcgtaaagaagagcttgaggaagtcgcccatgagctcgctgaaacagagcatgagaacaccgtgttgcgccataacattgagagaatgaaggaagagaaggactttaccatccttcagaagaagcatcttcagcaggaaaaggaatgtctgatgtcaaagcttgtggaagccgagatggacggcgccgctgccgccaaacaggttatggctctcaaggacacaatcggcaaactcaagaccgaaaagcagatgacttgcacggacataaacactctgacgcgacagaaagagcttttgctgcaaaaactgagtacctttgaagagactaatcgaacactccgcgatttgctgagggagcagcactgtaaggaagattccgagcgcctaatggaacaacagggagcccttcttaagcggttggctgaggcagacagtgagaaagcacgcctactgctgctgctgcaggacaaggacaaggaggtcgaggaactactccaagagattcagtgtgagaaggcccaggccaagacggcttctgaactgtccaaaagcatggagtctatgcggggacaccttcaggcacagttacgaagtaaagaggctgaaaatagcaggctttgcatgcaaatcaaaaacctggagcggagcggaaatcagcacaaggccgaggtggaagccattatggagcaattgaaagaactgaagcagaaaggcgatagggacaaagaatcccttaagaaagctatccgtgcccaaaaggagagagcagagaagtccgaagagtatgctgagcaactacatgtgcagctcgcagataaggacttgtatgtggctgaagcgctatccaccctggagtcttggcgcagccgctacaatcaggtggtgaaggagaagggtgacctggaattggagattatcgtactaaatgatagagtgacagacctggtcaatcagcagcaaactctggaagagaagatgcgggaagatagagacagccttgtggagaggctgcacaggcaaactgccgagtacagcgcttttaagttggagaacgagagactcaaggcgtcattcgcccctatggaggacaaactgaaccaagcacatctcgaagtacaacagctcaaggctagcgtgaaaaattacgagggaatgatagataattacaaaagtcaggtcatgaaaactcgattggaggcggatgaggttgccgcccaactggaaagatgcgacaaagagaataagattctgaaggacgagatgaataaagaaatcgaagccgcccgccggcagttccaaagccagctagctgatctccaacagttaccagatatcttaaaaattacagaagctaaacttgcagaatgccaggatcaattgcagggctacgaacgcaaaaatatcgacctcactgctattatttctgatcttcggtcccgagtgagggattggcagaagggatcccatgagctgacaagggccggtgctagaattcctcgctag

SEQ ID NO: 127521 - DNA, 1974 bp, Artificial Sequence
  Description of Artificial Sequence: Synthetic coding sequence
atggctgatcaacagggtccacaccaaaaccggtttcctagctgcggcaagaacggtgtcacgagcctgactcagaaaaaggttttaagagcaccttgtggagcacccagcgtcactgtgactaaatcacacaagcgcggaatgaaaggagacaccgtcaacgtgcggagatctgttagggtgaagacaaaggttccctggatgcctcccggtaaatctagcgcccgccccgtgggatgtaagtgggaaaacccgcctcactgcctggagatcacccctccgtcaagcgaaaagctcgtcagcgttatgaggttgagtgatctctctacagaggatgatgactcggggcactgtaaaatgaatcggtacgataaaaaaatagacagccttatgaacgccgtggggtgtctgaaatctgaggtcaaaatgcagaagggagagcggcaaatggcaaagaggtttctggaggaaaggaaagaggagttagaggaagtggcccacgagctggctgaaactgaacacgaaaacaccgtgctccggcacaacatcgagagaatgaaggaggagaaagatttcacaatcctgcagaaaaaacatctgcagcaggagaaggagtgtctgatgagcaagctggtcgaggcagagatggacggcgctgcggcagcgaagcaagttatggccctcaaggacacaatcggcaagcttaagacagagaagcagatgacctgtaccgatatcaacacactgacacgacagaaagagttgctgcttcaaaaactcagtacattcgaagagacgaacagaactctgcgagacctgctgcgggagcagcattgtaaggaagattctgaacgcttaatggagcagcagggagccttgctgaagcgccttgctgaggctgactcagagaaggctcgcctcctcttgcttctccaggacaaagacaaagaagtcgaggagcttctacaggaaattcagtgcgaaaaagctcaggctaaaacagcatccgagctgagcaaaagcatggagtctatgcgcggacacctgcaagctcagctccgctccaaagaagcagagaacagcagattgtgcatgcaaatcaaaaatctcgagcggtctggaaaccagcataaagcagaagtggaggccatcatggagcagctgaaggaactcaaacagaaaggcgaccgcgacaaggagtctcttaaaaaagccattcgcgcccagaaagaacgggctgaaaagtcagaagaatacgctgaacagcttcacgtgcagctcgccgataaagatttgtatgtggccgaggctctgtctacccttgagagctggagaagcaggtacaatcaagtggttaaggagaagggggacttagagctggagataatcgttctcaacgaccgcgtaactgacctggtaaatcagcagcagaccctagaggaaaagatgcgggaggatagggactccctggtcgagagactccaccgccagacagccgagtattctgcattcaaactggagaacgagcggttgaaagcgagcttcgcgcctatggaggacaagttgaaccaggcccacttagaggttcaacagctcaaagctagtgtgaaaaattacgagggcatgattgataactacaaatcccaggttatgaagacccgactagaggccgacgaggtggcagcccagctggagaggtgtgacaaggaaaacaagattttgaaagacgaaatgaacaaggagatcgaagccgcccgccgccagttccagtcacagctggctgatctgcagcagcttcccgacattctcaaaataaccgaggctaaactcgcggagtgccaggatcagttgcaaggttacgaacgcaagaatatcgatctgaccgcgataatctccgacttacgttcccgggtacgcgattggcagaaggggagccacgagctgaccagagccggggctcgcatccctcgctag

SEQ ID NO: 127522 - DNA, 570 bp, Artificial Sequence
  Description of Artificial Sequence: Synthetic coding sequence
atgaaagaccggagctcaaccccgccattgcatgtccacgtagacgagaataccccagtccacgtgcatataaaaaagctgcccaaaccatcagcaacaagctcacagaagtctcacaagcgcggtatgaagggcgataccgtgaacgttaggcgtagcgtgcgggtcaaaactaaggttaaaatgcagaagggagagcgacagatggccaagcgctttctcgaggagcgaaaagaggaacttgaggaggtagctcacgagctggccgaaaccgagcacgaaaatacggttctccgccataatatagaaaggatgaaggaagagaaagacttcaccatcctgcaaaagaagcacctccagcaggagaaagagtgtctaatgtccaagctggtagaagcggaaatggacggggccgctgccgcaaagcaggttatggccctgaaagacactatcggaaagctcaaaacggagaaacagatgacttgcactgacataaacactcttaccagacagaaggagttgctgctgcagaagctgtcaactttcgaggagacaaacaggacactttag

SEQ ID NO: 127523 - DNA, 618 bp, Artificial Sequence
  Description of Artificial Sequence: Synthetic coding sequence
atgtcagcctcctccagtggcgggtccccgcggtttccctcctgtggcaaaaacggagtgacctctctgacgcagaagaaggtgctcagagctccctgcggggcaccctctgtgacagtaacaaagagtcacaaacgcgggatgaagggggacaccgtgaacgtcaggcgaagtgtccgcgtaaagaccaaggtgaagatgcagaagggagaaagacagatggccaagcggttcctggaagaacggaaagaggagctcgaggaggtggcacacgaactggctgagacagaacacgaaaatactgtgctccgccacaacatagagagaatgaaggaggaaaaggacttcacaatcctgcagaaaaagcaccttcagcaagagaaagagtgcctgatgtcaaagctggtggaagctgagatggacggtgccgcggccgccaagcaagtgatggccctgaaagatacaatcggcaaactgaaaaccgaaaagcagatgacctgcactgacattaacacactcactcgccagaaggagctcctgctacagaagctttcaacctttgaggagacaaacaggacactgagggacctgttaagagagcagcactgcaaagaatag

SEQ ID NO: 127524 - DNA, 543 bp, Artificial Sequence
  Description of Artificial Sequence: Synthetic coding sequence
atgtccgcaagttcttccggcggctcccctagattcccttcttgcggaaaaaacggagttacgagcctgacacagaagaaagtactcagggcgccatgtggcgctccctccgtcaccgtgaccaagtcccataagagaggaatgaaaggtgatacagtgaacgtacggcggagcgtaagagtgaagacaaaggtcccatggatgccccccggaaaaagctctgcacgaccagtgggctgtaaatgggaaaatccaccgcattgccttgaaatcactccgccatcaagtgaaaaactggttagcgtgatgcgactgtccgatctctcaactgaggatgatgattctggccattgcaagatgaatagatacgataagaagattgactccctgatgaacgccgtgggctgtcttaagagcgaagtgaagatgcagaaaggggaaagacagatggctaagcgcttcctggaggagagaaaagaagagctcgaggaggtcgctcatgagcttgcggaaaccgaacatgaaaacaccgttctgcgctag

SEQ ID NO: 127525 - DNA, 648 bp, Artificial Sequence
  Description of Artificial Sequence: Synthetic coding sequence
atgaaagatcgtagtagcacccctccgctgcacgtccacgtagatgaaaatacaccagtgcatgtccacattaaaaagctgcccaagcctagcgcaactagcagtcagaagtcccataaaagaggtatgaaaggggacacagttaacgttcggcgtagtgtacgagtgaagacgaaaaaccccccacattgccttgaaatcactcctccctcttccgaaaagctcgtgagcgtaatgcgattaagcgacctgagcaccgaggacgatgactctggacactgcaagatgaaccggtatgataaaaaaattgactccctgatgaatgccgtggggtgtttaaagagcgaggtgaagatgcagaagggggaaagacagatggccaaaaggtttctggaagagcgcaaagaagagctggaggaagtagcccatgaactggccgaaaccgaacatgagaacacagtgctaaggcataatattgagcggatgaaagaggagaaggacttcactattctgcaaaaaaaacacttacagcaggagaaggaatgcctgatgtccaagctggtggaagctgagatggacggtgccgccgctgctaagcaggtgatggcacttaaggatactatcggaaagctgaagaccgtggggtag

SEQ ID NO: 127526 - DNA, 471 bp, Artificial Sequence
  Description of Artificial Sequence: Synthetic coding sequence
atgtctgcctcatcctctggcggcagcccgcggttcccttcgtgcggcaagaacggagtgacatctttaacgcagaagaaggtgctaagggccccctgcggagccccatctgtgacagtcacaaagtctcacaagcggggaatgaagggtgataccgtcaacgtgcgccggagcgtacgcgtcaagaccaagaatcccccacactgtctggagataacgccaccctccagcgagaaactggtgagcgtgatgagactgagtgacctctcgacggaagatgacgatagtggccattgtaagatgaatcgatatgataaaaaaatcgactctttgatgaacgctgtgggttgtctgaagtcagaggttaagatgcagaagggggaaaggcagatggccaaacgctttctcgaagaaagaaaagaagaacttgaagaagtggcccacgagctagctgaaaccgaacatgagtag

SEQ ID NO: 127527 - DNA, 1731 bp, Artificial Sequence
  Description of Artificial Sequence: Synthetic coding sequence
atgaaagatcggtcttccacaccacccttgcatgttcacgtcgacgagaatactccggttcatgttcacatcaagaagctgcctaaaccttccgcgactagctctcaaaaatctcacaaacggggcatgaagggagacacagtgaacgtccggaggagtgtgagagtgaagactaaggtgaagatgcagaagggagaacgccagatggcaaaacgatttttagaagagcgcaaagaggagctggaagaggtagcccacgagctagcagagacagagcatgagaatactgtcttacggcataacatcgagcggatgaaagaagagaaggacttcaccatcttgcagaaaaagcacctgcagcaggaaaaggagtgtctgatgtcgaagctagtcgaagctgagatggacggagcagctgccgctaagcaagttatggcactgaaagatacaatcgggaagttgaagaccgaaaagcagatgacctgtaccgatatcaatactttgacccgccagaaggagctgctactgcagaaactttcgacatttgaagaaacaaatagaactctgcgggatcttcttcgagaacagcattgtaaggaggactcagagcgtctcatggagcagcagggtgcgctgcttaaacgcctcgcggaagcggacagtgagaaggccaggttgctattacttcttcaggataaggacaaggaagtggaggagctgttacaggaaatacaatgtgagaaggctcaggccaaaacagcttcagagctctcaaaatccatggagtcaatgcggggtcatctgcaggcacagctcagaagcaaggaggcagagaatagtagattatgtatgcagataaagaacttggaacggtcagggaatcagcacaaagccgaagtggaagcgattatggagcagttgaaagaactcaagcaaaagggcgaccgtgacaaagaatctcttaaaaaagccataagggctcagaaggaacgagccgagaagtccgaagaatacgccgaacaactgcacgtgcaactggcagataaggacctgtatgtggctgaagctctgtccaccttagaaagctggcggagccggtacaaccaggtagtgaaggagaaaggggatctagaactcgagattatcgtgcttaacgacagggtgacagacctggtgaatcaacaacagacattggaggagaagatgcgagaggacagagatagccttgtcgagcgcttgcacaggcagaccgctgagtattctgctttcaagcttgagaacgagaggcttaaggcttccttcgcccctatggaggataagctcaaccaagcgcatctcgaggttcagcaactgaaggccagcgtgaagaattatgaggggatgattgataattataaatctcaggtaatgaagacccgtctggaagctgatgaggtggcagcccagctggagaggtgtgataaggagaataaaattctgaaggacgaaatgaacaaggaaatcgaggccgcaaggaggcagttccagagtcaattggccgacctccaacagctgcccgacattcttaagatcacagaggccaagcttgccgaatgccaggatcagctgcaagggtatgagcggaagaacatcgatctaaccgccattatctctgatctaaggagtcgcgtgagagactggcagaaaggctctcacgagctgactcgggccggcgcccggatcccacggtag

SEQ ID NO: 127528 - DNA, 444 bp, Artificial Sequence
  Description of Artificial Sequence: Synthetic coding sequence
atgaaggacagaagttccacaccccctttgcatgtgcatgttgatgaaaatactcccgtgcacgtacatataaagaagttgccaaagccttctgctacaagttcacagaagagtcacaagcgggggatgaagggagataccgttaacgtccgcaggagtgtgcgcgtcaagacgaaagtcccatggatgcccccaggcaaatccagcgcacggccagtgggctgcaaatgggaaacttctgaagagactcctaccacaggggagggcgtccctcatgtgcaggcgggcggtggcggcaacggctgggggtgtgggtgtcaagctgggcatggtttggagggatatcaccgggaggccgaaaacagagagacaaacgatttacacggccatcagcacccagacaaagccgagggcacttcccccgccgaggccgaacatatttag

SEQ ID NO: 127529 - DNA, 1917 bp, Artificial Sequence
  Description of Artificial Sequence: Synthetic coding sequence
atgggcaggaatagatatccccccgcctgctggtttccctcatgtggcaaaaatggggtgacgtctctgacacaaaaaaaagtgctccgggccccttgcggcgccccgtcagtcaccgttacaaagtcccataagaggggcatgaagggggacaccgtgaacgtccgcaggtccgtgcgcgtgaaaactaagaaccctcctcactgcctggaaataaccccgcctagttccgagaagctagtgtctgtcatgcggctgagcgatctgagcacagaggatgacgactcaggtcactgtaaaatgaacagatacgacaagaagatagacagcctgatgaacgcagtagggtgcttgaagagcgaggtgaaaatgcaaaaaggggagcggcagatggctaagagattcctggaagagcgaaaagaagagttggaggaggtcgctcacgagcttgctgagacggaacacgagaacaccgtgctacgccacaacatagaaaggatgaaggaggagaaagattttaccatcctccaaaagaagcatttgcagcaggagaaagagtgcctgatgtccaaattagtggaggctgaaatggatggcgcggccgctgccaagcaggtgatggccctcaaggataccatcggcaaactgaagacagaaaagcagatgacttgtaccgacatcaacacgttgacaaggcagaaagagctactcttgcaaaaattatcaacattcgaggaaactaatcggacccttcgcgacctcctgcgcgaacagcactgcaaggaggattctgaacggctgatggagcagcagggggcccttctgaaaaggttggccgaagcagatagcgaaaaggcccggctgctcctactgctgcaggacaaagacaaggaagttgaagaactacttcaagaaatacagtgtgagaaagcacaggctaagaccgcatccgagctgtctaagtcaatggagtcaatgcggggtcacctccaagcacaacttaggagcaaggaggccgagaactcaaggctgtgtatgcagatcaagaaccttgaaaggtcaggcaatcagcacaaagcagaagtggaggcgattatggagcagctcaaagaactgaaacagaagggagacagggataaggagtccctcaaaaaagctatacgggcccaaaaagaaagggccgagaaatcagaggaatatgctgagcagttacatgtgcagctggccgataaagatctgtacgtagctgaggcactgagcactttggagagctggaggtctcgatataaccaggttgtcaaagaaaagggcgatctggagttggaaataattgtattaaatgaccgcgtgactgatctcgtcaatcagcagcagacactggaagagaagatgcgggaggatcgggacagtctggtagagcgtctgcatagacagacagccgagtactccgccttcaagctggaaaatgagaggctcaaagcctcttttgccccgatggaggacaaactcaatcaagcccacctcgaagtccagcagctgaaagcctccgtcaagaattatgaggggatgattgataactacaaatcccaggtgatgaaaacgcgtctcgaagcagacgaagttgcggcccaactggaacgatgcgacaaagagaacaaaatactgaaggatgaaatgaacaaagaaatcgaggccgcacggagacagttccagtcccagctggctgatctgcagcagctcccagacatactcaaaattacagaagctaagttggctgaatgccaagaccaattgcagggctacgaacggaaaaatatagacctgacagctatcatcagcgatctgagatcccgggtgagagactggcagaaaggcagccacgagctaactagagccggggcacgtatcccccggtag

SEQ ID NO: 127530 - DNA, 765 bp, Artificial Sequence
  Description of Artificial Sequence: Synthetic coding sequence
atgacggaagaggtctggatgggaacatggaggcctcaccgcccaaggggacctatcatggctttgtacagcagccctggtcccaagtacctgatcccccctacgaccggctttatgaagcacacacctaccaagcttagggcccccgcttactcattccggggtgcaccaatgctcctggccgagaactgtagtccagggccaagatataacgtcaatcctaagatccttcggactggtaaggacctcgggcccgcgtatagtatcctgggtcggtaccagacgaaaacaatgctgacccccggtccaggggattatttccccgagaagtcaaccaagtatgtgttcgatagcgcaccatctcatagtatttccgctcggacaaaagcgttccgggttgatagcacaccaggacctgctgcctacatgctgcccatggtgatggggcctaacacagtaggtaaggctagccagccttccttctcgataaagggccggtcaaagctggggggattctcagatgacctccacaaaacacccggcccggcagcctacagacagaccgatgtgcgcgtcacgaaattcaaggccccccagtatactatggcagctcgggtggagccgcccggggacaagacgctgaaaccagggccaggggcccattcccctgagaaagtaacgttgacaaagccctgcgctcctgtggtcacctttggcattaagcatagcgactatatgacgccgcttctagtggatgttgagtag

SEQ ID NO: 127531 - DNA, 417 bp, Artificial Sequence
  Description of Artificial Sequence: Synthetic coding sequence
atgactgaagaagtctggatgggcacctggcggccacaccgtccccggggcccaatcatggcactctatagcagccctgggccaaagtatctgatcccccctacaacagggtttatgaagcacactcctactaagcttagagctcctgcatactcttttcggggagctcccatgctgctggccgaaaattgctcccccgggcctcggtacaacgtcaatccgaagatcctgaggacaggcaaagatctgggccccgcctattccatcctaggtcgataccagacaaaaaccatgctgacccccggcccggctctaaagtctgcatttcctagctggacaccaccagaccctacatggtctcctcccgttctcgagccccgaggcccaacacccagaatgctgggctcccctccctag

SEQ ID NO: 127532 - DNA, 375 bp, Artificial Sequence
  Description of Artificial Sequence: Synthetic coding sequence
atgacagaggaagtttggatgggcacatggcgcccgcaccgccccaggggccctattatggccctatactcgtcacccggtcccaagtacctgatcccacctactactggtttcatgaaacatactcccaccaagcttagagccccagcgtactcattcaggggcgccccaatgctgttggccgagaattgctcccccccgaacactgtgggcaaggcaagccagccctccttctccatcaaaggccgcagcaagctgggaggattctccgatgacctacacaaggtcactctcacaaagccttgtgccccagtcgtgacatttggcatcaaacacagcgactacatgactccgctgcttgtagatgtggagtag

SEQ ID NO: 127533 - DNA, 774 bp, Artificial Sequence
  Description of Artificial Sequence: Synthetic coding sequence
atggacgcggaatattccggcaatgaatttcccaggagcgagggggagcgagatcaacaccagcgccctggaaaagaacgaaagtctggagaagccggatggggtacaggcgagcttggtcaggacggtcgcttattatcaagcaccctgtcgctgagttctaatcggtcactcggccagcgtcaaaattcacctctgccgtttcagtggcgcattacccactcttttcggtggatggctcaggtgcttgctagcgaactttctctggtcgccttcattctcctgctggtggttgcgtttagcaagaaatggttggatctctcccggtcgctgttctaccagcgctggcctgtcgatgtttccaaccgcattcacacctcagctcatgttatgtctatggggctcttacatttctacaaatctcgctcctgcagtgatctcgagaacggcaaagtaacttttatcttttccacgttgatgctgttccccattaacatctggatcttcgaactggagcgcaacgtgtctatccctataggatggagctattttattggctggttagtcctcattctctatttcacctgcgctatcctgtgctattttaaccacaaaagcttttggagtctgattctctcccatccttccggagccgttagctgtagttcctcttttggcagcgttgaggagtctccacgcgcgcaaacgattaccgataccccaatcacccaggagggcgtgctggacccagaacagaaggacacgcacgtgtag

SEQ ID NO: 127534 - DNA, 1488 bp, Artificial Sequence
  Description of Artificial Sequence: Synthetic coding sequence
atggtcacatggttgtaccgctttctgcctacatccaatatggccgcaaagctcaggtctttgttgcctcctgatctccggctgcagttctggctgcacgcaaggttgcaaaagtgtttcctgtcgcgcggttgcggttcttattgtgcaggtgctaaagccagtccacttcctggaaagatggccatggggctgatgtgtgggagacgggaactgctccgtttacttcagtcaggacgccgggtacattccgtggctggtccttcccagtggcttggaaagcctctaacaactagactcctgtttcccgcggcaccgtgctgttgtcggccacattacctctttttggctgcgtcagggcctcggtccctgtccactagcgccataagttttgccgaggtacaggtccaggcgccccccgtggttgctgcgactcccagtccaacggctgtcccggaagtcgcctctggggagacagccgatgttgtgcagaccgcagctgagcagagcttcgcggaactggggctgggcagttacaccccagtgggccttattcagaatcttctggagtttatgcacgtggacctgggactcccatggtggggggcgatcgcagcctgcacagtttttgcccgttgccttatcttccccctgatcgttactggccagcgagaggcggccaggatccacaatcaccttcctgagattcaaaaattcagcagcaggatccgggaagcaaagttggccggagaccacatcgagtactataaagcctcctcagagatggccctataccagaagaagcatggtatcaaactgtacaagccattgatactgccagtgactcaggcccctattttcatcagctttttcatagccctcagggagatggccaacctgcctgtaccatccctgcagacaggcggattgtggtggttccaggacctcacagtcagcgatccaatttacattttaccactcgccgtcactgctaccatgtgggcagtccttgaactgggcgctgaaaccggcgtgcagagcagtgatttgcagtggatgcggaatgtgatccgaatgatgcccctcattaccctcccaattaccatgcacttccctacagcagtgtttatgtactggcttagctccaacctgtttagcctggtccaggtcagctgtctgaggatacccgccgtgcggactgtgttgaagattccccagcgggtggttcacgacttggataaattaccacctagagagggctttctggaaagcttcaagaagggatggaaaaatgctgagatgacccggcagttacgcgagcgagagcagagaatgagaaatcagctggagctggccgcaaggggtcctctccgccagacatttacacacaacccgctgctccagccaggtaaggacaatcctccaaacatcccatcctcatcaagcaaacctaagagtaaatacccttggcacgatactctcgggtag

SEQ ID NO: 127535 - DNA, 1260 bp, Artificial Sequence
  Description of Artificial Sequence: Synthetic coding sequence
atgcggggcacgcaagtgcattccgtggccggcccctctcaatggctcggcaaacccctgaccacccggctcttgtttcctgctgctccctgttgttgccgaccgcactatctattcttggctgcctccggaccaagatcgctttccaccagtgccatcagctttgctgaggtccaagtccaggcgcccccagtggttgcagccacgccatctcccactgctgtaccagaggttgcttccggggagaccgcagacgtagtacaaaccgctgccgagcaaagcttcgccgaactggggctaggaagttatacacccgttggcctgatacagaatctattggaatttatgcacgtggatctggggcttccatggtggggtgcaatagccgcctgtacagtcttcgcgaggtgcctgatctttcctctgatcgtcacaggccagagggaggcagctagaattcacaaccatcttcctgaaatccagaagttttcctcccgaattcgcgaggctaagctggcgggcgatcacatagagtactacaaggccagttcagaaatggcactgtatcaaaagaaacacggcatcaaactgtacaagcctctgattctgccggtcactcaggcccccattttcatctcatttttcattgccctgcgagagatggccaacttacccgttcccagcttgcagaccgggggtctgtggtggtttcaggatctgactgtgtcagatccgatctatattttgccgttggccgtcacagccaccatgtgggcagtgttggagctgggagctgaaaccggcgttcagtccagcgatctgcagtggatgagaaacgttatccgcatgatgcctttgattactctgcctattactatgcactttcccacggccgtgtttatgtactggctctcctccaatctctttagcctcgtccaggtatcctgtttaaggattcccgcagtaagaaccgtgctcaagatcccccagcgagtggtgcacgatctcgacaagctccctcctcgtgagggctttcttgagagctttaagaaggggtggaagaacgcggagatgacaagacagttaagagagagagagcagcgcatgaggaaccagttagaactggcagcccggggccccctgcgccaaacctttacccacaatcccttgctgcagcccgggaaggataatcctcctaacatacctagcagttcctctaagcccaagtctaaatatccctggcacgacactctcggatag

SEQ ID NO: 127536 - DNA, 732 bp, Artificial Sequence
  Description of Artificial Sequence: Synthetic coding sequence
atgagtcggctgtggtacggcaagaagggaaggagacaccaacctataaaccataaatataccctggttgtgagtgtcgctgaatatcaccggaggatcgatgcgctaaatactgaagagctcagaaccttatgcagaaggctgcagataacaaccagagaggacatcaatagcaagcaggtggccactgtcaaggcggatctggagtccgaatcattccgaccaaatctgtcagatccctccgagctgctgctgcctgaccaaatcgagaagctcactaagcatctgccccccagaacaattggctacccctggacactcgtgtacgggacaggcaaacacggaacttctctgaaaacactgtacagaacgatgactggacttgatactcccgtgctcatggtgatcaaggattctgacggacaggtctttggtgcattagcttcagagccgctcaaagtgtctgacggattctacgggactggagagaccttcgtgtttaccttttgtcctgaattcgaggtttttaagtggaccggtgataacatgttcttcattaagggagacatggattccctggcgtttggcgggggaggtggcgaatttgctctttggttagacggagacctgtatcatggaaggtcccattcttgtaaaacttttggtaacagaacactctccaagaaggaggatttctttatccaggacatcgagatttgggcatttgaatag

SEQ ID NO: 127537 - DNA, 2520 bp, Artificial Sequence
  Description of Artificial Sequence: Synthetic coding sequence
atggactatcttaccacctttaccgagaaaagtgggcggctcttgcgcggtactgccaaccgcctattgggttttggcggcggaggcgaagcacggcaggttaggtttgaggattatctaagggagccagctcaaggggacctgggctgtggatctcccccgcacagacctcccgctccatcttctcccgaaggtcccgacactggccagaaaaagaccctcgacaaaaaagacggtcgtaggatgtcttttcaaaaacccaagggtaccatcgaatatactgtggagagcagagacagccttaacagcatcgccctcaagttcgacactaccccaaacgagcttgtgcagttgaacaagctcttctcgagggccgtagtcacaggacaagtcctctatgtaccagatcctgagtatgtgtcaagcgtcgaatcgtccccatcactctcccccgtctccccactgtcccctacatcttctgaagcagagtttgacaaaactactaatcccgacgtccatcctaccgaagcaacaccgtcctctacttttacgggcattaggcctgcccgagtggtgagcagtacatctgaggaggaggaggcattcactgagaaatttttaaaaatcaactgcaagtacataacctcaggcaaaggtaccgtttcgggagtgcttctcgtcacccctaacaacattatgttcgaccctcacaagaatgatccactggtgcaggagaacgggtgcgaagaatatggcatcatgtgtcctatggaagaggtaatgtccgctgccatgtacaaagaaattcttgacagcaagatcaaggaatctctgcccatcgacattgatcagctgtccggtagggacttttgtcattcgaagaagatgaccggatcgaacaccgaagagatcgacagccggatcagagacgctgggaatgattctgccagtaccgctcctcgcagcaccgaagagtcgctcagtgaggacgtcttcactgaatccgaacttagtcccatcagagaggagctggtgtccagcgatgagcttcgacaagacaagtcttccggcgcttcttccgagagtgtgcagacggttaaccaagctgaagtcgaaagcctgacagtaaagtctgagtccactggcactcccggccacctgcgtagcgataccgaacactctaccaacgaggtgggtaccctctgtcacaaaactgatcttaataatcttgaaatggccattaaggaagatcagattgccgacaactttcaaggaatctcaggacctaaggaagattccacctctataaaggggaactccgaccaggattcctttctgcacgaaaatagtctgcaccaggaagaatcacagaaagaaaatatgccgtgcggtgagaccgcggagtttaagcagaaacagtccgtcaacaaggggaaacaaggaaaggagcagaatcaggactcccagaccgaggccgaggaactgagaaagctgtggaaaactcatacaatgcagcagactaaacagcaacgggagaacatccagcaggtgtcacaaaaggaggccaaacacaaaattacatccgcagacggtcatattgagtcatcggcactcctcaaggagaagcagcgacacagactccacaagttcctctgtctgcgggtagggaaaccaatgagaaaaacatttgtgtctcaggcatcagcaacgatgcaacagtacgcacagcgcgataaaaagcatgaatactggtttgccgttcctcaggaacgcactgaccacctgtacgcctttttcatccagtggtctccagagatctacgccgaagacaccggggagtacacgcgcgagcctggatttattgttgtgaagaaaattgaggaatctgagaccatcgaggatagtagtaatcaggcagcagcacgggagtgggaaataaccacacgggaggacattaatagcaaacaggtggccaccgtgaaggccgacttggagagcgaatccttccgccccaatctgtctgatccaagcgagctgttgctgcccgatcagattgagaaattgaccaaacacctgccacctcggactattggatatccttggacacttgtatatgggaccggaaagcacggcacgtccctgaagaccctgtatcgcactatgactgggctcgatactcctgtgctgatggttatcaaggactcagatggccaggtttttggtgccctggcctctgagcctctgaaggtctccgatggcttctacggaaccggggaaacatttgtcttcacattttgtcccgaatttgaagtgtttaaatggacaggggataacatgtttttcattaagggagatatggactctctggctttcggcggcgggggtggagagtttgcattgtggcttgatggagatctctaccatggcaggagccacagctgcaaaacattcggaaatcgcactctctccaagaaggaggactttttcattcaggacatagaaatctgggcattcgagtag

SEQ ID NO: 127538 - DNA, 2625 bp, Artificial Sequence
  Description of Artificial Sequence: Synthetic coding sequence
atgacaaaagataaaaattctccaggcctgaaaaagaaatcacagagtgtggatatcaatgccccaggttttaatcccctggctggcgccggaaagcaaacgccccaggcctctaagcctccagctccaaagacccctattattgaggaggaacagaacaacgccgctaatacacagaagcatccttcaaggcggtctgagctgaaaagattttacactatagataccggccaaaagaaaaccctggacaaaaaagacggtcgaagaatgtcatttcagaagcctaaaggcactatcgagtacactgtcgaaagccgcgactccctcaattccatcgctctgaagtttgacacgacccctaacgagctggtccaactgaacaaactgttttcacgggcagtggtgaccgggcaggtgctctatgtgcccgatccagaatatgtttcctctgtcgagagcagtccatccctgagccctgtcagtccgctgtctccgacatcatccgaggccgaattcgacaagacaacaaatcccgacgttcatcctaccgaggcaactccctcttctaccttcacgggcatcaggccggcccgtgtggtatcaagcacaagcgaggaagaggaagcctttactgaaaagtttctaaaaatcaactgcaaatacatcaccagcgggaagggaactgtatcgggggtactgttggtgaccccaaacaatattatgtttgatccgcacaaaaatgacccactcgtgcaggaaaatggttgcgaagagtacggcataatgtgccctatggaagaggtgatgagtgctgccatgtacaaagaaattttggatagcaagatcaaggagtcattaccaattgatatcgaccagctctccggtcgtgacttttgtcacagcaagaaaatgactggcagcaatacagaagaaatcgacagtcgcatccgggacgcaggcaatgattccgcctcgacagcccccaggtcgactgaggaatccctgagcgaagatgtcttcactgagagcgagttgagccctatccgagaggagctcgtcagcagcgatgagctacggcaggataaatcctccggcgcgtccagtgaaagtgtgcagaccgtgaatcaggcggaggtggagtctctgactgtcaaaagcgaatcaaccgggactcccggccacctgaggagcgatacagagcacagcactaatgaagtgggtactctctgccataaaaccgatctgaataatttggagatggccatcaaggaggatcagatcgccgacaattttcaaggtatatcaggcccaaaagaagactcgacctcaattaaggggaattccgatcaggacagtttcctgcatgaaaatagcctgcaccaggaggagtcacagaaggagaatatgccttgcggagagaccgctgagttcaaacagaaacagtctgtgaataaaggcaagcaaggcaaagagcagaatcaggattctcagactgaggcagaggaacttcgaaaactttggaaaacccacaccatgcagcagaccaagcagcagagggaaaatatccaacaggtctctcagaaggaggcaaagcataagatcacctccgctgatggccacattgaatcctctgccctgcttaaggagaaacagcgtcatcgactgcacaagtttctttgtctcagagtcggcaagcccatgaggaagacattcgtgtctcaggcctccgccacaatgcagcagtacgcacagagggacaaaaaacatgagtattggtttgccgtgcctcaggagcggaccgaccacctgtatgccttctttatccagtggagccccgagatctacgccgaagatacaggtgagtacaccagagaaccagggtttatagtggtgaagaagattgaggagtccgagacaattgaggactcatccaatcaggcagcagcccgcgaatgggaggtagtaagtgtggcggagtaccaccgtagaattgatgccttgaatactgaggaactccgaacactgtgcagacgtctacaaataactactcgagaggatatcaacagtaagcaggtggccacagtcaaagctgaccttgaatctgagagcttccgccccaatctctcagacccgtctgagctcttgcttcctgatcagatcgagaaattaacaaagcacctgccacctcgtacaatagggtacccctggactctggtatacgggactggtaagcacgggacgtcactgaagacgctgtaccgcacaatgactggcctcgacacacctgtgctcatggttattaaggattccgacggccaggtctttggcgcgttggcgtcagagcccctcaaggtgtctgacggattctatggaactggagagacattcgtgttcaccttttgtccggaattcgaagtgttcaaatggaccggcgacaacatgttttttattaagggcgatatggattcactggcattcgggggaggagggggggaatttgccctgtggcttgatggcgacctgtaccatggtaggagtcactcatgcaagacatttggcaatagaactctctctaagaaagaggacttcttcatccaagacatcgagatctgggccttcgaatag

SEQ ID NO: 127539 - DNA, 2541 bp, Artificial Sequence
  Description of Artificial Sequence: Synthetic coding sequence
atgagcgtgtcaaatttgagctggttgaaaaaaaagtctcagtccgtcgacattaatgcacctggattcaaccccctcgccggcgccgggaaacagaccccgcaggctagtaaacctcctgcccctaaaactcctataatagaggaggagcagaacaacgctgccaacacacagaaacatccctcccggcggtcagaattaaaaagattctacaccatcgacaccgggcaaaaaaagacattggataaaaaggacggccgccgcatgtcttttcagaaaccgaagggcaccattgagtatacagttgagagtcgagactcccttaattctattgcactgaaattcgacaccacccctaatgaactggttcaattgaacaaactcttcagtagggccgtggtgaccgggcaggttctctacgtgccggaccccgagtatgtatcatcggtggagtcatcaccatccctgtccccagtctcccccctgagccctacctcctctgaagcagagttcgacaaaacgactaaccccgacgtccaccccacagaggcaacacccagcagtactttcactggtattaggcccgcaagggttgtgtcgagtacatcggaagaagaagaggcctttacggagaagttccttaagattaactgcaagtacatcacgagcggtaaagggactgtcagcggggtgcttctggtcacacccaacaatatcatgtttgatccacataaaaatgaccctctggtgcaagagaatggatgtgaggaatacggaatcatgtgtccaatggaagaggtgatgtcagccgctatgtataaagagatactggattccaagattaaggagagcttacccatagacattgaccagctgtcaggaagagacttctgccattcgaagaagatgactggaagcaacaccgaggagatagacagccgaatcagagatgccggaaacgattcagcgtctacagcaccccggagcactgaggaatcgctgtcggaggatgtgttcacggagtctgaattatcacccattcgcgaagagctcgtctcttctgatgagctccggcaggacaaatcctcaggcgcgtcaagcgaatctgtgcagaccgtgaaccaggccgaggtagagtctctgacggttaaatcagagtcgaccgggacaccaggtcatctgcgcagcgataccgagcatagtaccaacgaggtgggaacgctctgccacaagactgaccttaataacctagagatggctattaaagaggaccagattgccgacaatttccagggtatctcaggtcctaaggaggactctacgagtataaaggggaatagtgatcaggattcttttttgcacgagaactctctgcatcaagaggagagtcagaaggagaacatgccctgtggcgagacggccgagttcaagcagaagcagtctgttaataaagggaagcagggcaaagagcagaaccaggactcacagaccgaggccgaagagctgcgaaaactgtggaaaacacatacgatgcagcagacaaagcagcagagagaaaacatccagcaggtctcgcagaaggaggcgaagcacaagatcacctcggctgacggccatatcgagagcagtgctctgttaaaggagaagcagagacaccggctccataagttcctatgcttgagggttgggaaacctatgcggaagacatttgtatcgcaggcgtccgctactatgcagcagtacgcccagagagacaagaagcacgagtattggttcgccgttccacaagagcgcactgatcacttgtacgcctttttcatccagtggtcacccgagatttacgctgaggacaccggagaatacacaagggaacctggattcatcgtcgtgaaaaagattgaggagtcagagacaatcgaagacagtagcaatcaggctgcagctcgagagtgggaaatcacaactcgcgaagatatcaactctaaacaagtcgcaactgtcaaagccgacctcgaaagcgagagcttccggcctaaccttagtgacccatctgaattgctgttaccggatcaaattgaaaagctgaccaagcacctgcctccacggactattggatacccatggaccctagtgtatgggacgggtaagcacgggacttccctgaagacactttatcggacaatgacaggactggacacacccgtgcttatggtcatcaaggacagtgacggccaggtgttcggggcactggcttccgagcccttgaaggtttcagacggcttctacggcaccggggaaacatttgtcttcacattctgtccagaatttgaggtgtttaaatggaccggcgacaatatgttctttatcaaaggagatatggattctcttgccttcggtggcggaggaggagaatttgcactctggctggacggcgacctatatcacggaaggtcccattcctgtaagacgtttggtaaccggactctgtccaagaaggaggattttttcatccaggacattgagatttgggctttcgagtag

SEQ ID NO: 127540 - DNA, 651 bp, Artificial Sequence
  Description of Artificial Sequence: Synthetic coding sequence
atgtcaaggctttggtacggaaagaagggcagaagacaccagcctattaatcacaaatacacgttaataaccaccagagaagacataaactccaaacaggttgccacggtgaaggcggacctggagtcagagtcctttcgtcctaacctgagcgatccaagcgaactgctgcttccggaccaaattgagaagctgaccaaacacctgcccccaagaactattgggtatccctggactctggtgtacggtactggcaagcacggcacttcacttaagacactgtaccgaacgatgactggattagacaccccggtccttatggttattaaggattccgacggacaggtcttcggcgccctggcttcagagcccctgaaggtatctgatggtttttacggaaccggcgaaacattcgtgttcacattttgccctgaatttgaagttttcaaatggacaggagataacatgttttttattaagggggacatggacagccttgctttcggcggcggagggggagaatttgccctatggctggatggtgacctttatcatggaagaagtcacagctgcaaaacatttggtaacagaaccctcagtaagaaagaggatttttttatacaggacatcgagatttgggccttcgaatag

SEQ ID NO: 127541 - DNA, 885 bp, Artificial Sequence
  Description of Artificial Sequence: Synthetic coding sequence
atgcagcagactaaacagcagcgcgagaacatccagcaggtgtctcagaaggaggccaagcataaaatcacctcggcagatggtcacatcgaaagctctgcacttttgaaggagaagcagaggcaccggttgcacaagttcctgtgcctgcgagtggggaagccaatgcgaaaaacgttcgtatcacaagcatcggccactatgcagcagtacgcccagcgagacaagaagcacgaatattggttcgctgttccccaagaacggactgatcacctgtatgctttttttattcagtggtcgccggaaatctacgccgaggatacgggggagtacacaagagagcccggatttatcgtagtgaagaagatcgaagagagtgaaactatcgaagattcgtcgaatcaggcggcagcacgagagtgggaactcactaagcacctgccaccacggacaatcggttacccatggaccctggtgtacgggacgggaaaacatggtacgtccctcaaaaccctatacagaaccatgaccggcctggacacacctgtgttaatggtgattaaggatagcgacgggcaggtctttggcgcgttagcttcggaacctttgaaggtatctgatggattttacgggacgggtgagactttcgtctttaccttctgcccagagtttgaggtttttaagtggaccggtgataacatgttcttcatcaagggagacatggattccttagcctttggtggcgggggaggcgaatttgcactttggctggacggcgacttgtaccatggccgttcacacagttgtaagaccttcgggaaccgcacgctgagcaaaaaggaggactttttcatccaagatattgaaatttgggcttttgaatag

SEQ ID NO: 127542 - DNA, 1512 bp, Artificial Sequence
  Description of Artificial Sequence: Synthetic coding sequence
atgttttgccaaagaaaggacactgggcaaaaaaaaacattggacaagaaggacggccgcaggatgagttttcagaagcctaaggggaccatcgagtacaccgtcgagtctagagactcgcttaactccattgctctgaagtttgataccacaccaaatgagctggtgcagctgaataagttattttcccgggccgttgtcactggccaagtcctgtatgtgcccgatcccgagtatgtgtcatccgtcgagtcttctccgagcctgtcgcctgtcagccctctgagtcccaccagcagcgaggccgaatttgataagactactaacccagatgtgcatcctaccgaagcaactccctccagcacattcacaggcattagacccgccagagtggtctcgagtaccagcgaggaggaagaagccttcacggaaaagttccttaagatcaattgcaagtatataacatcgggaaagggcactgtcagcggtgtcctgttggttaccccaaacaacatcatgttcgacccacacaagaatgaccccctcgtgcaggagaatggatgtgaggaatacggaatcatgtgccccatggaggaggtgatgtctgccgcaatgtacaaggagattctggacagcaaaattaaggaaagcttgcccatcgacatcgaccagctatctggacgcgatttttgccactcaaagaagatgacaggatcaaacactgaagagattgactctagaatccgggacgcaggcaatgattcggcgtctaccgcccctcgctccacggaggagtcactctcagaagatgttttcaccgagtcagaattatcccccatcagagaggagctggtgagttctgatgaactgcggcaagataaatcttccggagcatcctctgaaagcgtacagactgtcaatcaggctgaggtggagtcccttaccgtgaagagtgaatccactggaactcccggtcatttgcggagcgacaccgagcactcgacgaacgaggtgggcactctgtgccacaaaacagacctgaataatctcgagatggccattaaagaggaccagattgctgataattttcagggaatttctggccctaaagaagatagcacaagcataaaggggaatagtgatcaggattcttttttacatgagaattcactgcatcaggaggagagccagaaagaaaacatgccttgtggcgagacggcagaatttaaacagaagcagtccgtcaacaaggggaagcagggcaaggaacagaaccaagacagtcaaacagaagcggaggagctgaggaaactttggaaaacacatacgatgcagcagaccaaacagcagcgtgaaaacatccagcaagtgtctcagaaggaagccaaacataagatcacctccgctgacggccacatcgaaagtaagtgttacagggtcaacgaggtgtcatcatccaactgcatggtatccccaagtttccttacggacagtaaggctgccgtcccttag

SEQ ID NO: 127543 - DNA, 2622 bp, Artificial Sequence
  Description of Artificial Sequence: Synthetic coding sequence
atgtccgtttccaacctgtcatggctcaaaaagaagtcacaatcagtggatattaatgctccaggctttaaccctttagcaggggctgggaagcaaacccctcaggcttcaaagccacctgcccctaaaactccaataatcgaggaggagcaaaacaacgccgctaacactcagaaacacccctcgcggaggtccgaactgaaaagattctatactatcgatactggccagaagaagaccctggacaaaaaggacggtcggcgtatgagcttccaaaagcccaagggtaccattgagtacactgtggagagtcgggattcactgaattctattgcgctgaagttcgataccacccctaacgagctcgtccaattaaataagctcttttctagggcagttgtgaccggacaggtcctttatgtcccagatcccgagtacgtgtcctcagtggaatcatctccatccttgagtcccgtgagtccgctgtcgcctacaagttcggaggccgagtttgataagaccactaacccggatgttcatcctactgaagcaacaccttcctcaacctttactggaattaggccagctcgtgttgtgtcatccacctccgaggaagaagaggctttcactgagaagtttttgaagatcaattgcaaatatattacatcaggcaaaggtacagtctccggggtgctgctcgtgacgcccaacaatatcatgtttgatcctcataagaatgaccctttggtccaggagaatggctgtgaggaatacggcatcatgtgtcctatggaggaggtcatgagcgctgcgatgtacaaggagattttggattcaaagatcaaggaatcccttcctatagatatagaccagctctctggtagagacttctgtcacagtaaaaagatgaccggctctaatactgaggaaatcgactcccgaatccgggatgctggaaacgattctgccagcacggctccacgatcaacagaggagtctttgtcagaagacgtgttcaccgagtcggaactgtcccctatacgggaagagctcgtgagtagcgacgagctcagacaagacaaatcaagcggagcctcttcagagagcgtgcagactgtcaatcaggctgaggtcgaatccctgacagtcaagtccgagtcgaccgggacacccggacacctgaggtctgacaccgagcatagcactaacgaagtgggaacactgtgccacaaaaccgacctgaataacctggaaatggctattaaagaggatcagattgcagacaacttccaggggatttcagggccgaaagaagactccacatctatcaaaggaaactccgatcaggactcttttctgcacgaaaatagcctgcaccaggaggagagccagaaggagaacatgccctgcggcgaaacggccgagttcaagcagaagcaaagtgtgaataaaggaaagcagggaaaggagcagaatcaggactcacagacagaggccgaagagttacggaaactgtggaaaactcacacaatgcagcaaactaagcagcagcgggagaacattcagcaagtcagccagaaggaggccaagcataaaatcacctccgcggatgggcatatagagtcctccgccctactgaaggaaaagcagcgccacaggcttcacaagttcctgtgtctgcgggtaggcaaacctatgcggaagacctttgtctctcaggcctccgcaacgatgcaacagtacgcccagcgcgacaaaaaacatgagtactggttcgccgtgccacaggagcgtaccgatcacctttacgccttctttattcaatggagccccgaaatatatgcagaggacacaggggaatacacgcgagaacctgggtttatcgtggtgaaaaagatagaggagtcagaaaccatcgaggactcgtcgaatcaggcggctgcccgagagtgggaggttgttagcgtggccgagtatcaccgccggatcgatgcactgaacaccgaggaactgcgaacactgtgcaggcgcctgcagatcaccacccgcgaggatatcaattctaagcaggtggcgaccgtcaaggcggatctggaatcggagagttttcgccctaacctgtcagatccatctgagctgctcctccccgaccagattgaaaaactgaccaagcacctgccgcctaggaccattggttatccttggacactggtgtacggcacgggaaagcacgggacaagtctaaaaactctgtacaggactatgactgggctggacacacctgtgctaatggtcatcaaagatagcgacggtcaggtctttggggctctggcaagcgaaccactgaaagtcagcgatggcttttatggaactggagagacgttcgtctttacgttttgtccagagttcgaggtgtttaagtggacaggagataatatgttcttcatcaaaggagatatggactcactggcattcggcggaggcggtggggagttcgcactgtggcttgatggggatctttaccatggcagatcccattcctgcaagacattcggcaaccgcactctgagtaaaaaagaagacttctttatccaggatatcgagatctgggcatttgagtag

SEQ ID NO: 127544 - DNA, 2541 bp, Artificial Sequence
  Description of Artificial Sequence: Synthetic coding sequence
atgtccgtgtcgaatctgagttggctcaaaaagaaatcccaaagcgttgacattaatgctcccgggttcaaccccctggcaggggcaggtaagcaaacacctcaagcctctaaaccacccgcacccaagaccccaatcattgaagaggaacagaacaatgctgccaacactcagaagcaccctagccgacggagtgaacttaagcgtttttatacgatagatacagggcagaaaaagactcttgacaaaaaagacgggcgccgcatgagttttcagaagcctaagggcaccatagaatatacggtggagtcccgagacagcctcaattctattgcacttaaattcgataccacacccaacgaactggtccaactgaacaaattatttagccgcgcggtggtgactgggcaggttctttacgttccagatcctgaatacgtctcatcagtcgagtctagcccttctctgtctcctgtgagtccgctgtcacccaccagctccgaggctgagttcgacaagacgaccaatcctgacgtgcaccccacggaggccacccctagtagtactttcacggggatccgccccgctcgcgtcgttagctctaccagcgaagaggaagaagcctttacggaaaagttcttgaagatcaactgtaaatacatcacttctgggaagggaaccgtgtctggagttttgctggtgacacctaacaacatcatgttcgatccgcacaagaacgacccgttggttcaggagaacggatgcgaagaatacggcataatgtgtcctatggaggaagtgatgtccgccgcaatgtacaaggagatccttgactctaaaattaaagaaagtctcccaatcgatatcgatcaactctctggacgcgacttttgtcattcgaagaaaatgactggaagcaataccgaggaaatcgatagcaggatccgcgatgcgggtaatgattctgcctctaccgcacctcggtctactgaggagtccctgtcagaggatgttttcacagaatctgagctgtcccctatcagggaggagttggtgagctcggatgagctacgacaagataagtccagcggagccagttcagagtcagttcagactgtgaatcaggctgaggtcgagtcccttaccgtcaagagcgagagtacaggtacacctgggcacctccgaagcgacacagaacacagcaccaatgaggtggggaccctgtgtcataaaaccgatcttaacaacctcgagatggccattaaggaggaccaaattgcagacaacttccagggcattagtggccccaaggaagactccacctctataaaaggaaacagcgatcaggactcatttctccacgagaactcattgcaccaggaggagagccagaaagaaaacatgccatgtggtgagacagctgaatttaagcagaaacaatcagtcaataaggggaagcaaggaaaagagcagaaccaggacagtcagacggaggctgaagaactcaggaagctctggaagacccacaccatgcagcaaacgaaacagcaacgtgagaacatccagcaggtgagccagaaagaagctaaacacaagatcacctccgcagacggccatatcgaatcttctgcactattaaaagaaaaacaaagacatcgtttacataagttcttgtgtctcagggtgggcaagcccatgcgtaagactttcgtttcacaagcgtctgccaccatgcagcagtatgcccagagagacaagaaacatgagtactggtttgccgtgccccaggaaaggacagatcatctatatgctttctttatccaatggtccccagaaatctacgcagaggataccggcgaatacacccgcgagccaggctttattgtggttaaaaagatcgaagagtctgaaaccattgaggattcatcgaatcaggctgccgcccgtgagtgggagatcactactagagaggatattaacagcaagcaggtggccaccgtaaaagccgatcttgagtccgagagtttcaggcccaacctttccgatccaagcgagcttttactgcctgaccagattgagaaacttaccaaacacctgcctcccagaacaatcgggtacccctggaccctagtttacggaacagggaaacacggtacaagtctgaaaacattatatcgaaccatgacagggctggatacccccgtcctgatggtgatcaaagactctgacggacaagtctttggagccctcgcaagcgaacctttgaaggtttctgatgggttctacggtactggcgagacatttgtttttaccttttgtcccgagttcgaagtgtttaagtggaccggagacaatatgttcttcattaaaggagatatggatagcttggcttttggtggcgggggtggcgaattcgccctgtggttggacggcgacctctatcacggcagaagccacagctgcaagactttcggaaaccgcaccctcagcaagaaagaagactttttcatccaggacatagagatttgggcctttgagtag

SEQ ID NO: 127545 - DNA, 822 bp, Artificial Sequence
  Description of Artificial Sequence: Synthetic coding sequence
atgaccttcgatgatttaaagatacagacagtaaaagatcagcccgatgaaaagtccaacggcaagaaggccaaagggttacagtttctttacagtccatggtggtgtctggccgctgctaccctgggtgtgttatgcctggggctcgtcgttacaattatggtgctgggcatgcaactgtctcaagtcagcgacctgctgacccaggagcaggcaaatcttacgcaccagaagaaaaagctcgaaggccagatctctgcaaggcagcaggctgaggaagcttcacaggaatccgagaatgaactgaaggaaatgattgagacactggcgcggaaactgaatgaaaagtctaaagagcagatggagctccatcaccaaaacttaaatctgcaggaaacactgaaaagagttgccaattgcagtgccccctgtccccaggattggatctggcacggggaaaattgttacctcttctcctctggcagtttcaactgggagaaaagtcaagaaaaatgcttatccttggacgctaagctgcttaaaatcaacagtaccgccgatctggacttcattcaacaggcaatctcctactcgagctttcccttctggatggggctatctagacgcaatccttcttatccctggctgtgggaggacggaagcccactgatgcctcatctatttagagtgaggggcgccgtcagtcagacctacccatccggcacatgcgcatatattcagcggggagcagtatacgctgagaattgtattctagccgccttttctatctgccagaagaaagccaacctccgggctcagtag

SEQ ID NO: 127546 - DNA, 546 bp, Artificial Sequence
  Description of Artificial Sequence: Synthetic coding sequence
atgaccttcgacgaccttaagatacaaacagtgaaggatcagcctgatgagaagagtaacgggaagaaggcaaaggggctgcagtttctgtacagcccttggtggtgcctggctgccgcaaccctgggtgtcctgtgcctgggcctggttgtgactattatggtgctgggtatgcagttgtcccaggtctccgatcttctcacacaggagcaggctaatctcactcaccaaaagaagaagcttgaagggcagatctcagcacggcagcaagcagaggaggccagccaggagtccgaaaacgagctgaaggagatgatcgagaccctcgcaaggaaattgaacgaaaagagtaaagaacagatggagctgcaccatcagaatctcaacctccaggaaacactaaagcgcgtcgcaaattgcagcggattgcaccctgcctccaattttttatttcagttttccatcttggacggagcggtaagtgaggaaccgcagctccccatggcactgggaggacgatttagcttcgacgctcccttaatttag

SEQ ID NO: 127547 - DNA, 570 bp, Artificial Sequence
  Description of Artificial Sequence: Synthetic coding sequence
atgaccttcgatgaccttaaaattcagaccgtgaaggaccaaccagatgagaaaagtaatggcaagaaagcgaaaggcttgcaatttctttactccccgtggtggtgtctggccgcggctacattaggagttttgtgccttggacttgtggtgacaatcatggtgttgggcatgcagctgagtcaggtgtcagatctgcttacgcaggaacaggcaaaccttactcaccagaaaaaaaaattagaaggacagatttccgctcgtcagcaggctgaggaggcctctcaggagagtgagaacgagttgaaggaaatgattgaaactcttgcgaggaaactcaatgagaagagcaaggagcagatggagcttcatcaccagaaccttaatctccaggagacactgaagagagtcgcgaactgtagcgccccctgcccacaggattggatatggcatggggagaactgttacctattttcctcaggcagttttaactgggaaaaatcccaggagaaatgtctgtctttggatgcgaaacttctgaagattaattccactgctgatctgatatag

SEQ ID NO: 127548 - DNA, 1623 bp, Artificial Sequence
  Description of Artificial Sequence: Synthetic coding sequence
atgcagcaagtcctggaaaacctcacagagctcccttcatccaccggagctgaagaaatcgatcttatatttctgaaaggaatcatggaaaatcctatcgtaaagtccttggccaaggcgcatgagcgtctggaggactcaaaattggaggcagtgtctgataacaaccttgaactggtcaatgaaattctcgaggacatcactcccttaatcaatgtcgatgagaacgtggcagagctcgtgggaattctgaaagagcctcatttccagtctcttctagaggcgcacgacatcgtggcgtccaaatgctacgatagcccacccagctctccagaaatgaataacagttctatcaacaaccagctgctgccggtggacgcgatccgcatcttagggatccacaaacgtgccggtgagcctctgggagtcacatttcgggtggagaataacgacttggtgattgctcgcatcctgcacggaggcatgattgatcgtcagggacttctgcacgtgggcgatatcataaaggaggtaaatggacacgaagttggtaataatcctaaagagcttcaggagttacttaagaatatcagcggctcggtgactctcaagatactgccatcctatagggacactatcacaccacagcaggtgtttgtgaagtgccactttgattacaatccttacaatgacaacctgattccctgtaaggaggctggactcaaattctctaagggggagattctccaaatcgtcaaccgcgaagatcctaattggtggcaggcatcccatgttaaggaaggagggtcagctggactgattcccagtcagtttctggaagaaaaaagaaaagcgtttgtgcggcgggattgggataacagcggaccattttgcgggacgatatctagcaagaaaaagaaaaagatgatgtatctgaccacccgcaacgccgagtttgatcggcatgaaattcagatctatgaggaagtggctaaaatgccacccttccagcgcaaaaccctggttcttattggcgcacagggggtcggtaggcgatcccttaagaatagatttatcgtgctgaacccgaccaggttcgggacaacggtgcccttcacctcacgcaagcccagggaagatgaaaaggatgggcaggcatacaaattcgtttctagatccgagatggaagctgacatcaaggcagggaagtatttggagcatggggaatatgaaggtaatctctacggcacgaaaattgatagcattctggaggtagtgcaaacaggcaggacatgcattctcgatgttaatccccaggccctgaaggtgttacgaactagcgaattcatgccatatgtggttttcatcgcggctcccgagttagagaccctccgggccatgcataaggccgtagtcgacgccgggatcaccacaaagctcttaaccgattccgacctgaagaagaccgtggacgagtcagcccggattcagcgggcatacaaccattactttgatctgatcatcatcaacgacaatttagacaaggccttcgagaaactgcagaccgctattgagaagctgaggatggagccccagtgggttccaatcagctgggtatactag

SEQ ID NO: 127549 - DNA, 636 bp, Artificial Sequence
  Description of Artificial Sequence: Synthetic coding sequence
atgtttcatctgagaacctgtgccgcaaagctgaggccactgaccgcttcccaaactgtgaagactttctcccaaaaccgccctgccgctgcccgcactttccaacagatcagatgttactccgcccccgtcgctgctgagccgttcctttcggggacatcaagcaactacgtggaagagatgtactgtgcgtggctggagaatcccaagtccgtacacaaatcctgggacatttttttcaggaacactaacgctggggcacctcccggtacagcatatcaatctccactacctctgagccgagggtcactggccgccgttgcacacgcccagtccctggtcgaggcacagccgaacgtggacaaattagtggaggaccacctggcagtacaatcacttatcagagcctaccaaatcagagggcatcacgtagcacagctggacccactggggattctggatgctgacctggattcgagtgtccccgcagacatcatttcttcaacagataaactggggttctatggcctcgatgaatccgacctcgataaggtttttcatcttcccacaaccacattcatcggcggtcaagagagcgctttaccactgcgcgagattatccggcgcctcgaatag

SEQ ID NO: 127550 - DNA, 1284 bp, Artificial Sequence
  Description of Artificial Sequence: Synthetic coding sequence
atgttccacctgaggacatgcgcagccaaactaaggcccctgacagccagccagacagttaagaccttctctcaaaacaggcccgcggcagccagaacctttcagcagatccgctgctattctgcacccgtggcagccgaacctttcctctccggaacctctagtaattatgtggaagagatgtattgcgcctggctggagaatcctaaatccgtccacaagtcctgggatatctttttccgcaacaccaatgcaggtgcacccccgggtaccgcctaccaaagcccactgcccctctctcgcgggagcttggccgcagttgcccacgcgcagagcctcgtcgaagcacagcctaacgttgacaagttagttgaggaccaccttgccgtgcaaagtctcattagggcctaccagattagaggccaccatgtggcccagctcgaccctttgggcattttggatgcagacctggactctagtgtccctgcggacatcatctcatccactgataagcttggcttctatgggctcgacgagtcagatctcgacaaagtctttcacttgcctacaaccacatttatcggtgggcaggagtcagctctccccctgagggagatcatcagaaggctggaaatggcatattgtcaacacatcggagttgagttcatgtttatcaatgacttggagcagtgccagtggatccggcagaagttcgagaccccaggcattatgcagtttacaaatgaggagaagagaacactgctggctcgtctggtgcgcagtaccaggtttgaagagtttttacagagaaagtggtcatctgaaaagcgcttcgggttggagggttgcgaggtgttgatcccagccttaaaaacaatcatcgacaaatctagcgagaatggagtggattatgtcattatgggtatgccccacagagggagactaaacgtgcttgctaatgttatcagaaaggagctggagcagatcttttgtcagtttgacagcaaactggaggccgctgacgaaggttccggggatgtgaaataccacctgggtatgtatcatagaaggattaatcgagtgaccgatcgtaatattacgctgagcctggtggctaacccttctcatttagaagccgctgaccctgtagtcatgggtaagactaaggccgaacagttttattgtggcgacaccgagggtaagaaagtgagaccccgcgagcgacgggcgcgccaaatagtgaaagcaccctgctcctcaatggaatttcgcagccctacctag

SEQ ID NO: 127551 - DNA, 2925 bp, Artificial Sequence
  Description of Artificial Sequence: Synthetic coding sequence
atgtactgtgcttggctggaaaatcctaagtcagtccacaagtcttgggatatctttttccgaaacactaacgccggtgctcctcctggaacagcctaccagagtccccttcccttgagtaggggaagcttagccgccgtggcccatgctcagagcctggtcgaagcccagcccaacgtcgataagctcgtggaagaccatctggcagttcagagtctgattcgagcataccaggtgcggggccatcacatcgccaaactggaccctttaggcattagctgcgtcaacttcgacgacgctcctgttaccgtgagcagtaatgtggatctcgcagtgttcaaggaaagacttaggatgcttaccgtggggggattttacggcctggacgaatcagaccttgataaggtcttccatctgcccacaactactttcatcgggggtcaagagtccgcacttcccctccgggagataataagacggcttgagatggcttattgtcagcatattggcgtggagttcatgttcatcaacgacctggagcagtgccagtggatccggcaaaagtttgagaccccaggtattatgcagtttaccaacgaagaaaagcggactttgctggcacgacttgttcgcagcacccggttcgaagagttcctgcagagaaagtggagtagcgagaaaaggtttggcttggagggttgcgaagtactgatcccggctcttaagacgattatagataaaagcagcgagaacggagtggactatgtgattatggggatgccgcacaggggtcgacttaatgtgcttgcgaacgtgattagaaaggagcttgagcagatattctgtcaattcgactctaaattggaagccgctgatgaaggaagcggggatgttaaataccacctggggatgtatcaccggcgaattaacagagtcaccgacagaaatattactctctcactggtagccaatccctctcatctggaagccgcggatcctgtggtgatgggcaagacaaaagccgaacaattctattgcggagacacagagggcaagaaagtgatgagcatactcctacatggcgacgcagcgtttgccggacaaggcattgtttacgagaccttccacctatccgacctgccgtcctacactacccacggtacggtgcacgtagttgtcaacaaccagattggattcactaccgatccaagaatggccaggtcaagcccatatcctaccgacgtggctcgcgtggttaacgcccccattttccatgtgaacagtgatgacccggaggcagtgatgtatgtctgtaaggtggccgcggaatggcgtagcacctttcacaaggatgtggtggttgatcttgtttgttatcgccgcaacggacataacgagatggatgagccaatgttcactcagcccctgatgtataaacagattcggaaacagaaacctgtgctccagaagtacgctgaattgctcgtgtcccagggagttgtcaaccaaccagaatacgaagaggagatcagcaaatatgacaaaatctgtgaagaggcctttgctcggtcaaaggatgagaaaatcttgcacatcaaacattggttagattctccctggcctgggtttttcacgttggatggtcagccccggtccatgagctgcccatcaaccggactgactgaagatattctaacccacattggaaatgtggcgagttcagttccagtcgagaacttcaccattcacggagggctgagccgaatcctaaaaacacggggagagatggttaagaaccgcacggtggactgggcgctggcagagtatatggcctttggctcattactcaaagaaggaattcacatccgcctaagcggccaggatgtggagcggggaaccttctctcacagacatcatgtgctgcacgaccagaatgtcgacaaacgcacctgcatcccaatgaatcacctttggcccaatcaagcgccttacacggtgtgcaactcctccctatctgaatacggagttctcggctttgagcttggatttgccatggctagccccaatgccttagtgttgtgggaggcacaattcggagacttccataataccgctcagtgcatcatcgatcagtttatctgcccagggcaggccaaatgggtgagacagaacggaattgtgctcttactgccccatgggatggaaggcatgggtcctgagcacagctccgccaggcctgagagattcctgcaaatgtgcaatgatgatcccgacgtcctcccggacctcaaagaagcgaatttcgacataaaccagctttacgactgcaactgggtggtggtgaactgctctacacccggaaacttcttccacgttttacgcaggcagattctactgccttttcggaagcccctgataatttttacgccgaagagcttgctaaggcaccctgaggccagatcaagtttcgacgagatgcttccaggtactcatttccagcgcgtgatacccgaagacggcccagctgctcaaaaccctgagaacgtaaagcgtctgctattctgtacaggaaaggtatattacgaccttacgcgtgaacgcaaagcccgcgatatggtagggcaggtggcaatcacccgcatcgagcagctctcgccctttcctttcgatctcctgctcaaggaagtgcagaagtatcccaatgccgagctggcttggtgccaggaggagcataagaaccaggggtactatgattacgtcaagcctagactcaggacaacaatcagtagggccaagcctgtgtggtatgcaggccgggaccctgccgcggctcccgctacagggaacaagaagactcaccttacagaactacagaggctgctggacaccgccttcgatttggacgttttcaagaatttctcttag

SEQ ID NO: 127552 - DNA, 3060 bp, Artificial Sequence
  Description of Artificial Sequence: Synthetic coding sequence
atgtttcaccttagaacctgtgcagccaaacttcggcccctaaccgcatcccagacggtgaagactttctcccagaaccgaccagcagccgcccgtacttttcaacagatcaggtgctactctgcccctgtggctgccgagccctttctaagcggcacttctagtaactacgtcgaggaaatgtattgcgcctggttagagaatcctaagagtgttcataaatcttgggatattttctttaggaatactaatgcaggggcccctcccgggaccgcttaccagagcccactgcccctgtctagggggtccctggctgccgtggcacatgcccagagcctggttgaagctcaacctaatgtggacaagctggtggaggatcatctcgccgtacaatcgctgatacgagcgtatcaggttcgcggccaccatattgcaaagctcgatccgctggggattagctgcgtgaattttgacgatgccccagtcacagtctcctctaacgtgggtttttatggcctggatgaaagcgatcttgacaaggtatttcatctcccaacaaccaccttcatcgggggccaggagagcgctctccccctgagagagatcattcggagattggagatggcctactgccaacacattggcgtcgagtttatgttcattaatgatttagagcaatgccaatggattcgacagaaatttgagacccccggaattatgcagtttacaaatgaagagaagcgcaccctgctggcccgcctagtgcggagtactaggtttgaggaatttctgcagagaaaatggtccagcgagaagcgattcgggctggaggggtgcgaagttttgattccagcattgaaaacaatcattgataaaagcagcgaaaatggcgtggattacgtgatcatgggcatgcctcatcgtggacggcttaatgttctcgcaaacgtgatcaggaaggaactggaacagattttttgtcagttcgattctaagcttgaggcggccgacgagggctccggtgatgtgaagtatcacttagggatgtatcacaggcgcatcaatcgtgttacagaccggaatataacgttatctcttgtggcaaacccttcccatctggaggctgcagaccctgtggttatgggcaagacaaaggctgagcagttctattgtggcgatacagagggcaagaaagtcatgtcaatcctgctgcacggtgatgctgcttttgccggacaaggcatcgtgtatgaaacattccaccttagcgacctgccgagctacactacacacggcaccgtccacgtagttgttaataatcagatcggttttacgactgatccacggatggcccgttccagtccatatcccactgacgtcgccagggtcgtcaatgcaccaatcttccacgttaattctgatgacccggaagccgtaatgtacgtttgtaaagtggctgccgaatggcggagcacttttcacaaggatgtagtggtggacctggtgtgttataggagaaacggacataatgagatggacgaacccatgttcacgcaaccattaatgtacaaacaaattaggaaacagaagcctgttctgcagaagtacgcagagctcctggtgagtcagggtgttgttaatcagccagagtatgaggaggaaataagtaaatacgacaaaatctgtgaagaggcctttgcgcgctccaaagatgagaagatcttgcacattaaacattggctggattctccatggccaggtttctttaccctggacggacagccccgcagtatgagctgtccatctacaggcttgaccgaggacatcctgacacacattggcaacgtggcctcctcggttccggtggagaattttacgatccacggaggtctcagcagaattcttaagacgaggggagagatggtgaaaaacaggactgtggactgggcactcgccgagtacatggctttcggaagtttactcaaggagggaatccacatccgactcagtgggcaggacgttgagcgcgggaccttcagccatagacatcacgtcctgcacgatcagaatgtggacaaaagaacatgtataccgatgaatcacctgtggcctaatcaggccccctatacagtctgtaatagtagtctgtctgaatacggagttctcggcttcgagctgggctttgcaatggcaagccccaacgcactggtgctgtgggaagcacagtttggagatttccacaatacagcccagtgcataatagaccagtttatttgtcccggccaggccaaatgggtgaggcagaatgggatagttctcctgctgccacacggaatggaaggaatgggacctgagcactccagtgcaagaccagaaaggtttctgcaaatgtgtaacgatgatcctgacgttctgccagacctcaaggaagccaacttcgacatcaatcagttatatgactgcaactgggtggtcgtcaactgctccacacccggtaacttttttcatgtgcttagaagacaaatactcctacctttcaggaaacctctgatcatcttcacaccaaagagcctgctgcgccatccagaggccaggtcatctttcgacgaaatgctgcccggaacacatttccaacgggttattccagaggacggtcccgcggctcaaaatccagaaaacgtgaagaggttgctgttctgtacaggaaaggtctactatgacctcactcgggaaagaaaagcgagagatatggtcggacaggtcgccatcacacggatcgagcagctgtcaccttttccgttcgacctcctgcttaaagaagttcagaagtacccaaacgctgagctggcatggtgccaggaagaacacaaaaatcagggatattacgattacgtgaaaccgaggctgcgcaccaccatcagtagagccaaacctgtttggtatgcaggcagggacccggctgctgctccagcaactggtaataagaaaacacacctcaccgaactccaacggttgctcgacaccgcatttgatctcgatgtgtttaaaaatttctcctag

SEQ ID NO: 127553 - DNA, 2424 bp, Artificial Sequence
  Description of Artificial Sequence: Synthetic coding sequence
atggctgctactgagctacgcggtgtggtcggaccaggccctgcagcaattgcagctctaggcggcgggggtgccggacctccggtagtcgggggggggggcggtaggggcgacgccgggccgggcagcggggctgcctcaggaacggtggtggctgccgcggcaggaggccctggtcctggagccggcggagtggctgcggcaggaccagcacctgcacctcctacaggaggcagcggcggaagcggagctggaggaagtggttccgccagggaaggttggctttttaaatggactaattacataaagggatatcaaagacgctggtttgttctttccaatggactcctgtcctattatcggagtaaggctgagatgagacacacatgtagaggtaccatcaacctggccaccgctaacattaccgtagaagacagctgcaattttattattagtaatggtggcgcgcagacctatcatctgaaggcaagcagcgaggtggagcgccagcgttgggttactgctcttgaactagctaaagcaaaagctgtcaagatgctcgctgagagcgacgagtccggcgatgaagaatccgtcagtcaaactgataagacggagttgcaaaacactctcaggaccctgagctcaaaggtcgaagatctgtctacctgcaacgacttaatcgcaaaacacgggacagctctgcagcgcagtcttagtgaactggagtcactgaaactccccgccgaatctaacgaaaaaatcaagcaggtcaatgagcgcgcaacgctgtttagaattacatcgaacgccatgatcaatgcatgtcgagactttctgatgctggcgcagacacacagcaagaaatggcaaaaatccctgcagtatgaacgagaccagcgtattcgcttggaagagaccctcgaacagctggccaagcagcacaatcatctcgaaagggccttccgtggtgctactgtgctgcctgctaacacgccaggaaacgtgggctcaggcaaagaccagtgctgctctgggaagggagatatgagcgatgaagacgatgaaaatgaattctttgatgcaccagagattatcacaatgcccgaaaacttagggcacaagagaacaggctctaatatttctggagcgtcatctgacatctctctcgacgagcagtataagcatcagttagaagagactaaaaaggagaagcgtacccgcattccctataagccaaactactccctgaatttgtggagtataatgaaaaactgcattggtaaagagttgtctaagattcctatgccagtcaacttcaatgaaccattgtcaatgttacagcggctcaccgaggacctggaatatcatgaacttttagaccgggccgctaagtgtgagaactcactggaacagctatgttacgtggcggcgttcacggtgtcgtcatactcaacaactgtgtttcggacctctaaacctttcaacccgctgttgggggagacattcgaactggataggctcgaggagaacggatatagatctctgtgtgaacaggtcagccaccaccctccagctgcggcgcatcacgccgagtcaaagaatggatggactttgcgacaggagatcaagatcacgtcaaagttcagaggcaagtacctaagtatcatgccgctggggaccatccactgtatctttcatgctaccggccaccattacacatggaagaaagtgacaacaacagtgcacaacatcattgtgggtaaactgtggattgaccagtccggtgagatcgacattgtgaatcacaagactggtgacaaatgcaatttgaagtttgtgccatactcttacttctctagggacgttgctaggaaggtcactggtgaagtaactgatcctagtggcaaagtccacttcgcccttctggggacttgggacgaaaagatggaatgtttcaaagtgcaacccgtcatcggggaaaatgggggggacgccaggcagcgcggacatgaagctgaagagtcgcgggtaatgctttggaaacggaatccactgcctaagaacgccgaaaatatgtattactttagcgaactggcactgactctcaatgcatgggaaagcggaaccgccccgacagatagtcgcctgaggcctgaccagagactcatggaaaatgggcgttgggacgaggccaatgctgaaaaacagagactcgaggagaaacagcgcctaagcagaaaaaaaagggaggccgaagccatgaaagctacagaggacggcacgccttatgacccttataaggcactttggttcgagaggaaaaaggatccggtgactaaagagctgacacacatctaccggggtgaatattgggaatgcaaggaaaagcaggattggagctcgtgcccagacattttctag

SEQ ID NO: 127554 - DNA, 1224 bp, Artificial Sequence
  Description of Artificial Sequence: Synthetic coding sequence
atggccgctacagagcttcggggagtggtcggtccagggcctgccgccattgctgcactcggggggggtggagccgggccaccagtggtgggcgggggcgggggaagaggcgacgcaggaccgggttctggtgctgccctccagagattgacagaggatctggaataccacgagctattggaccgggcggccaagtgtgaaaactccctggaacagctgtgctacgtggcggcttttacagtcagtagttactcaaccaccgtctttaggaccagcaagcccttcaatcccttacttggcgaaacctttgagctggacagactcgaggaaaacggttacaggtcgctatgtgaacaggtgagtcatcaccctcctgcagccgcccatcacgccgaatctaaaaacggctggactctgcggcaagagatcaagatcacatctaaatttcgtggaaagtatctgagcattatgcccctcggcaccatccactgcattttccatgctaccggtcaccattacacgtggaagaaggttacgacaacagtccataatatcattgtaggcaagctgtggatcgaccagtcaggcgaaatcgatattgtcaaccacaaaactggcgataaatgcaacctcaaatttgtgccctattcttactttagccgcgacgtagccagaaaagtgaccggggaggtcacagatccatccggcaaagtgcacttcgctttactcggaacctgggacgaaaaaatggaatgcttcaaagtccaacctgtcatcggcgaaaacggaggcgacgcgcggcaaagggggcacgaggctgaggagagtagagtaatgttgtggaagcggaatcccctgcctaaaaacgccgagaatatgtattatttcagcgagctggctctcaccttaaatgcttgggaaagcggaaccgcaccgacagactctcgcttgcgcccagatcagaggcttatggagaatggtcgatgggacgaagccaacgctgaaaagcagcgcttagaggagaaacagaggctcagccgcaagaagcgggaggccgaggctatgaaagccaccgaagacggcaccccttacgacccatacaaggccctgtggttcgaaaggaaaaaggatcccgttaccaaggaactgacccatatctataggggagagtactgggaatgtaaggagaagcaggattggtcttcctgcccagacatcttctag

SEQ ID NO: 127555 - DNA, 2751 bp, Artificial Sequence
  Description of Artificial Sequence: Synthetic coding sequence
atgggaaaggccgccgcacccagcaggggcggagggtgcggcggtaggtcgcgcggcctgtccagtttgttcacggtcgttccatgcctgtcttgccacacggctgctccaggcatgtccgccagtacttccgggagtggtcctgagccaaaaccccagcctcagccagttccagaacctgagcgaggacctctgtctgaacaagtctccgaggcagtgagcgaagccgtacccaggagcgagcctgtgtctgaaaccaccagtgagcctgagcccggcgccggacagcccagcgaactgctgcagggcagtaggcccggcagtgagtctagcagcggagtcggggcagggccttttaccaaggcggcaagcgagccactcagcagagccgtcggctcagcgacatttctgagacccgaaagcggctccttgcctgccctgaaaccactcccacttctacggccaggacaggcaaaaaccccattgggtgtgcccatgagcgggaccggcacaaccagctccgctcccctcgccctattacccctggactctttcgaggggtggttactgaagtggacgaattatttgaaaggataccaaagacggtggtttgtgctgggcaatgggctcctgtcttactatcgaaatcaaggggagatggcacatacttgcagaggaactatcaacctttccaccgctcatattgacacagaggatagctgtggcatattattgaccagtggcgcgagatcatatcacctgaaggcaagctccgaggtggatagacagcagtggattactgctcttgagctagccaaggctaaggccgttagggttatgaacactcattctgacgatagtggagacgacgacgaggcaactacgccagctgacaagtcagagctccaccacaccttgaagaatctctctcttaaattagacgatctctcaacctgcaatgatctgattgccaaacacggcgctgccctacagcgcagccttacagagcttgatggcctcaagattccttctgaaagtggcgagaaactgaaggtggtgaatgaaagagctactctctttcggataacatctaatgctatgatcaatgcatgtcgggacttcttagagctggctgagattcattcacgcaaatggcagagggccttgcagtacgagcaagagcagcgagtgcacttggaggagaccattgaacaactggccaagcagcacaactccttagaacgtgcatttcactccgctcccggcagacctgccaatccgagcaagtctttcatcgagggaagcttactgacccccaagggggaggacagcgaggaggacgaagacacagagtacttcgatgctatggaggacagcacatcatttattactgtaataactgaggccaaagaggactcccggaaagcagagggatccacgggcacatctagtgtagactggtcctctgccgacaacgtgctggacggagcctcacttgttcctaagggatcatccaaggtgaagcggagggtgcggatcccgaacaagcccaattacagtttaaacttgtggagcatcatgaaaaattgcatcggccgggagttgagtaggattcctatgcccgtaaattttaacgagcccctcagcatgcttcagaggttgaccgaagatctcgagtaccatcacttgttagacaaagccgttcattgcacaagctcagttgagcagatgtgcctggttgccgcatttagtgtgagctcctacagtactaccgtgcatcgcattgccaagcctttcaatccgatgctgggcgaaacttttgagttggatagacttgacgacatggggctaagatccttgtgtgaacaggtcagccatcacccccccagtgcagctcactatgtgttcagcaaacacgggtggagtctgtggcaggagattacaatatcgagtaagttccgaggcaaatacatcagtatcatgcccctgggggctatacacctagaattccaggcatccggaaatcactatgtctggcgaaaaagcacttccaccgtccacaatattatagtgggaaagctttggattgaccagtccggagatattgagattgtgaaccataaaaccaatgaccgctgccagttgaagttcctcccatatagttacttttccaaagaggccgcccggaaagtaaccggggtggtctctgatagccagggaaaagcgcactacgtactgagcggctcctgggacgagcagatggagtgcagcaaggtgatgcacagctcaccatcaagcccttcgagcgacggaaagcagaaaacagtgtatcagacactttctgctaagctactgtggaagaaataccctctgcccgaaaacgcagagaatatgtactacttttcagaactcgcactgacgctgaatgagcacgaagagggcgttgcccctaccgattcacgtctccgcccagaccagcggctgatggaaaagggaaggtgggacgaggctaacacggaaaagcaacgcctggaagagaaacaaaggctatctcgcagaagacgcctggaggcttgtggtcccggctcctcatgttcttcggaggaggaaaaagaggctgacgcctacaccccgctctggttcgaaaagcgccttgaccccctgaccggtgagatggcatgtgtctataagggcggctattgggaagcaaaggaaaagcaggactggcacatgtgtcctaacatcttttag

SEQ ID NO: 127556 - DNA, 2625 bp, Artificial Sequence
  Description of Artificial Sequence: Synthetic coding sequence
atgggtaaggccgctgctccttcgcgaggtggaggatgtggagggcgcagccgcggactgtcctctctgtttacagtggtcccttgcctgtcctgtcatactgccgcacccggcatgtccgccagcaccagtgggagcggcccagagccgaagcctcaacctcagcccgttcctgagccagagcgcggccctctgtcagagcaagtgtctgaagccgtgtctgaggctgttccgcgcagtgagccagtgtcagaaacgacatccgaacctgaacccggcgccggccagcctagcgaactcctgcaggggtctcgtcccggctctgaatctagcagcggcgtgggggcaggaccgttcactaaagcagcttccgaacccctttcaagggcggttggctccgcaacgtttctgcggcctgaaagtggctcattacccgcattgaagcccctgcccctgctgaggccaggccaggccaaaacgccgctgggcgtccctatgtctggcaccggtaccacctcctctgcccccctggccctcctacctttggactccttcgaggggtggttgttaaagtggaccaactatttgaagggataccagcgaagatggtttgtgttaggtaatggtcttctgtcgtactaccggaaccagggggagatggcacatacttgcagggggacaattaacctgtccaccgcccacattgacacagaggatagctgtggcatccttttgacctccggggctaggtcttatcacttgaaggcctcttctgaagttgataggcaacagtggatcaccgccctagagctagccaaggccaaagcggtccgcgtcatgaatacccactctgacgattcaggtgatgacgatgaggctacaacccctgccgacaaatctgaattgcatcatactctgaagaacctgagccttaagttagacgacctgtctacgtgtaacgacctgatcgccaagcacggtgccgccttacaaaggtccctcacagagctggacggacttaaaatcccctctgagagcggggagaagcttaaggtcgttaatgagagggcaacccttttcagaattacgtcgaacgcgatgatcaacgcctgtagggactttctggagttagccgagatccatagcaggaagtggcagcgggcattacagtacgagcaggagcagagggtgcacctggaggagaccatcgagcaactggccaaacagcacaacagtcttgaacgcgctttccactctgcccccgggcgaccagcgaaccctagtaagtcctttatcgaggggtccctgctgactcccaagggcgaagactccgaggaggacgaggacacagagtattttgatgccatggaagactctacttctttcataactgtgatcaccgaggccaaggaagattcgcggaaggcagaggggtccaccggcacaagctcagtggattggtcttccgcagacaatgtgaacttcaatgagccgctgtcaatgttacagcgtctcacagaagacctagaataccatcaccttctggataaagctgtgcactgcacatctagcgtggaacagatgtgcctggtggccgccttctccgtgagcagctatagcacaacagtacaccggatcgccaaacccttcaaccctatgctgggtgagacttttgagcttgaccgacttgacgatatggggctgcggagcctgtgcgagcaggtatcgcaccaccctccctccgcagcacattacgttttcagcaaacatggttggagcttgtggcaagagattaccattagttcaaagtttaggggtaagtacataagtataatgccactcggcgccattcacctggaattccaagcgagcgggaatcactatgtatggcgaaagtccacctcaaccgtgcacaacatcatcgtcgggaagctgtggatagatcagtccggcgacatcgagattgtgaatcacaagaccaacgatcggtgccagttaaagttcttaccttacagctacttctccaaggaagctgcacggaaggtgactggcgtcgtgagcgacagccaggggaaggcacactatgttctgtccggcagctgggatgaacagatggaatgctcaaaagtgatgcatagtagcccgagcagtcccagtagcgacggaaagcagaaaacagtctaccaaacattgagtgcaaaattgctgtggaagaagtatcctctgcccgagaatgcagaaaatatgtactatttcagcgagctcgcactgaccctgaacgagcatgaagagggcgtggccccaacagactctaggttaaggccagatcaaagactaatggagaaagggcggtgggatgaggctaataccgagaaacagcgcctagaggagaaacaacggttgagcaggcgccggcgtctggaagcctgtgggcctggatcatcatgcagctcagaagagggggaagccggacgcgaaggccggcctggaggcgaggagcgaggagcacgcgtgggcgttccccagggaagaatccccggagagcaggcaacttccccaccgaccagccccctgtgcctccccagccgcgaaggaggaggatgcctgcatgccaccgtggtgtag

SEQ ID NO: 127557 - DNA, 2253 bp, Artificial Sequence
  Description of Artificial Sequence: Synthetic coding sequence
atgcatcgtcagagaaccagaactatgtcctccctggccgctaagcgcctcggcatgaacaggaggcctgccggatctgggggtggaggcggggaggccgccacctgggggcataggttttggcggccccaggaaagacctactgatcgaaatcagggtgaaatggcacatacttgtcgtggcacgattaacctgtcaactgcacacatcgatactgaagattcctgtggaattctgctgacctccggtgcccggtcctaccatctgaaagcctcctctgaggtagatcggcagcagtggataacagctctggagcttgccaaggcaaaggcagttcgcgtaatgaacacccatagtgacgattcaggagacgatgacgaagctactactcccgccgacaagtctgagctgcatcataccctcaagaacctaagtctaaagctagatgacctctctacttgtaacgaccttatcgctaagcacggcgccgcgctgcagagaagcctcaccgagctggatggcttgaaaattccatcagagtctggagagaagctgaaggtagtgaacgagcgagcaactttgtttaggatcacgtcaaatgcaatgataaacgcgtgccgagattttctggagctggctgagatccatagtcgaaaatggcaacgagccttacaatacgagcaggaacagcgtgtgcacctggaggaaaccatcgagcagcttgctaagcagcacaacagtctagaaagagcctttcattctgctccgggccgccctgcaaatcctagcaagtctttcatagaggggtcactgctcaccccaaagggtgaagatagcgaagaggacgaggacaccgagtacttcgatgcaatggaggatagtacctctttcatcaccgtgatcaccgaggccaaggaagacagaaaagccgaggggtcaactgggacaagctctgttgattggagtagtgccgacaatgtgcttgatggagcatccctggtccccaagggttcaagtaaggttaaacgcagagtcagaatccctaataaacccaactattctctgaacctttggtcaataatgaagaactgcatcggccgggagctgtcaaggattccaatgccagtgaacttcaacgaaccccttagcatgctccagagattaaccgaggaccttgagtaccatcacctgctggataaggccgtgcattgcacctcttccgttgagcagatgtgcttggtggctgcgttctccgtaagcagctattccacaactgtccacaggatcgccaagcctttcaatccaatgctgggggaaactttcgaactggaccggcttgatgatatgggcctcaggtcattgtgtgaacaggtttctcatcatcccccgtctgccgcgcactacgtcttcagtaagcatgggtggtctttgtggcaagagattaccatatctagtaagtttcggggtaagtacattagcatcatgccccttggcgccattcacctcgagttccaggcaagcggaaaccattacgtgtggagaaagagcacatccaccgtgcataatatcattgtggggaaactgtggatcgaccaaagtggggacattgagatcgtgaaccacaagaccaatgatagatgtcagctgaaattcttgccctactcatacttttcgaaagaagccgcccgcaaggtaaccggtgtggtgtccgattcccaaggcaaagcgcactatgtgttgtctggatcttgggacgaacagatggaatgctccaaggtcatgcacagcagcccatcgtcaccatcatccgacggtaaacagaagactgtctaccaaaccctgtccgcaaagctactgtggaagaaataccccctgcctgagaatgccgagaacatgtactatttttctgaactggcactcacactaaatgagcacgaggaaggagttgcccccaccgactctcgcttacgaccagaccagcggctaatggagaagggccggtgggatgaggccaacaccgaaaagcagcggctcgaagagaaacaacgcctgtcacggagacgacgcctggaagcatgcggacccggctctagctgctcctccgaagaggaaaaagaagccgacgcttatacaccgttatggttcgagaaacgcctggatcctctcaccggcgaaatggcctgtgtgtacaaagggggttactgggaggccaaggagaagcaagactggcacatgtgccctaacatattctag

SEQ ID NO: 127558 - DNA, 1980 bp, Artificial Sequence
  Description of Artificial Sequence: Synthetic coding sequence
atgaaaggacggggatgctgggatactgcttctgtccggtcattttgctcaagcggttgcctgaacaaatttaaaaaggacgactcaggggacgatgatgaggcaactactccagccgacaagtctgagctgcaccacacattgaagaacctatccctgaaactggacgatctcagtacgtgtaatgatctgatcgccaaacatggtgccgccctgcagagaagtctgaccgaactggacggcctcaagattccctccgaatccggagaaaagcttaaagtggtcaacgagcgtgccacactcttcaggattaccagcaacgccatgatcaacgcctgccgggacttcttagaactggctgagatccattcgaggaaatggcaacgggccctgcaatatgaacaggagcagcgagtgcacctcgaggaaacaatcgagcagctcgcaaagcagcataattcattggaacgcgcctttcattcagcacctggacgtccagcaaacccgtcaaagagcttcatcgaagggtccctgttgacaccgaaaggcgaagattctgaggaggatgaagacaccgagtattttgatgccatggaggattctacctcttttattaccgtgataactgaagccaaggaagacagcaggaaggccgaaggcagcaccgggacctccagcgtcgactggagcagcgctgataacgttctggatggggcttctttagttcccaaggggtcaagcaaagtcaaacgacgcgtgcgtattcctaacaagccaaattactctttgaatctgtggagcataatgaaaaattgcattggaagggaactttctagaatccctatgccagttaatttcaatgagccattatcaatgctgcagaggcttactgaggacctggaataccaccatctgttggataaggcagtccattgtacatcaagtgtggagcagatgtgcctggtggcagcgtttagcgtgagtagttattctacgaccgtccaccggatcgctaagccttttaatcccatgcttggtgagacatttgaactggaccggcttgatgatatgggtctgagatcattatgtgaacaggtaagccatcaccccccgtctgctgcacactatgtgttcagtaaacacgggtggagcctgtggcaggagatcacgatttcgagcaaattcagaggtaaatacatatccattatgccactgggcgcgattcacctagaatttcaggcatctggcaatcactacgtctggagaaagagtacctccacggtgcacaatatcatagtgggaaaactctggatcgatcagtcaggggatattgaaatcgtgaaccacaagaccaatgaccgatgccaactaaagtttctgccttactcttatttcagcaaggaagcggcgcgcaaagttaccggggtggtctcagattcccaaggaaaggcacattacgtgctcagcggctcatgggacgaacagatggagtgctccaaagtgatgcactccagcccatcttccccatcctctgacggcaaacagaagacggtgtaccagacactatcggccaaactgctgtggaagaagtaccctctgccagaaaacgccgagaacatgtattacttttccgagttggccctgactctgaatgagcatgaagagggcgttgccccaacagattccaggctgcggcccgaccagagattgatggagaaaggtcgctgggacgaggccaataccgagaagcaacggctggaagagaagcagcgcctcagtcgccgccgtcggctcgaagcatgtggcccagggagttcttgttcttcggaagaagcagagaaggaggccgacgcttacaccccactgtggttcgagaagaggctggatcctctgacaggtgaaatggcatgtgtctacaaagggggttactgggaggccaaggagaaacaggattggcacatgtgtcctaacatcttttag

SEQ ID NO: 127559 - DNA, 1383 bp, Artificial Sequence
  Description of Artificial Sequence: Synthetic coding sequence
atggaggatagcacgagttttattaccgtgatcaccgaagcgaaggaagatcgaaaggcagagggaagtactgggacaagctccgtggactggagctccgccgataatgtgctggacggagcctctctggtccccaaaggctcatctaaggtcaaacgccgagtgaggattcccaacaaacctaattactccctcaacttgtggtccattatgaaaaattgcatcggcagggagttatcccgaattccaatgccagtgaattttaatgaaccactatctatgttacagagactgactgaggatctcgagtaccatcaccttctggataaggctgtccattgcacaagctcagttgaacagatgtgtttagtggctgcattctcagtgagcagttactcgacaaccgtgcaccggatagcaaagccattcaaccccatgctgggagagacatttgaactagaccgcctggacgacatgggtctgagaagcctctgcgagcaagtgagccaccatccaccctccgcagcccattacgtgttttcgaagcacggctggtctctatggcaagaaataactatcagctcgaagttcaggggcaaatacatttccatcatgccccttggcgcgatccacctcgaattccaggcatccggtaatcattatgtttggaggaagtctacctccactgtgcataatataatagtcggcaaactgtggatcgatcaatcaggggatatcgaaattgtaaaccataaaaccaatgataggtgtcaactgaaattccttccatacagttacttctccaaagaagctgcccgcaaggtgactggggtggtctcagacagccaaggcaaagcccactatgtgttgagtggaagctgggacgagcagatggaatgcagtaaggtgatgcactcctcaccctcttcccctagctccgatggtaagcaaaaaaccgtatatcagacactctcagctaagcttctgtggaagaagtacccgctgcccgaaaacgctgagaatatgtactacttttcggagttagctctcaccttaaatgagcatgaggaaggggtcgcccctactgacagccgtctgcgcccagaccaaagattgatggagaaagggcgatgggacgaagccaatacggagaagcagagactagaagagaagcagcgcttaagccgtcgcagaaggcttgaagcctgtgggccaggctcttcttgctcctccgaggaagaaaaggaagcagatgcctataccccattatggttcgagaagagactggacccactgacaggcgaaatggcctgtgtgtataaaggcggatactgggaagccaaagagaagcaggattggcacatgtgccctaacatattttag

SEQ ID NO: 127560 - DNA, 2295 bp, Artificial Sequence
  Description of Artificial Sequence: Synthetic coding sequence
atggaaagggccgtccaaggtaccgatgggggagggggatcaaactctagctcaagatccagctctcgcgcaacctctgctggctcatcaccttcgtgcagcttggctggacggggagtgtcatctcgaagtgccgcagcaggtctggggggcggcgggtccaggtcatctcccggttctgttgcagcctctccctccggtggaggcggaaggaggcgagaaccggctctggaaggggtgctctccaagtacactaacctcctccagggttggcagaatcgttacttcgtcctagacttcgaagctggcatcctacagtacttcgtcaatgagcagagcaagcatcaaaaacctcggggggttctttccttgagcggagcaatagtttcactgtccgacgaggcccctcatatgctggtcgtttatagcgccaatggagagatgttcaagcttagggcagccgacgccaaggaaaaacagttttgggtgactcaactgagggcctgcgccaaatatcacatggagatgaacagtaaatccgccccttcatctcgcagccgttccctcacccttctccctcacggcactccaaattcggccagcccttgttcacaacgccatttatccgtgggcgctcccggggtggtgaccatcactcaccataagagtccggctgcagccagacgagccaaatcacaatacagcggacaactccatgaggtacgtgagatgatgaaccaagtagaaggacagcagaaaaatttggtgcacgctatcgagtctttgccaggctccgggcctctcactgctctggatcaagacctactcttattaaaagcaacatccgccgccactctttcttgcctgggtgaatgtctcaatttactgcagcagagcgttcaccaagccggccagcccagtcagaagcccggagcctcagaaaatatcctaggctggcatggatcaaagagtcattctaccgagcagcttaagaacgggactttaggctctctaccctcagcctccgctaatataacctgggccatcctgcccaacagcgccgaagacgagcagacttcacaaccggaaccagagccaaactctggcagcgagctcgtgctgtccgaggacgaaaaaagcgataatgaagataaagaggaaaccgagctcggtgtcatggaagatcaaaggtccatcatcctccatctgatctcccagctgaagctcggaatggatctaaccaaggtggtgctgcctacctttattctggagaaacggtccctgctggagatgtacgccgattttatggcccaccctgatctactcctggcgataacagctggcgcaacacctgaagagagggtcatttgctttgtggagtactatctcaccgcctttcacgagggtcgcaagggcgccttggccaaaaagccctacaaccctataatcggtgagaccttccattgttcttgggaggtccctaaagaccgcgtgaagcctaaaaggactgcctcgagatcgcccgcatcttgtcacgagcaccccatggctgatgacccttcaaaatcttacaagcttagatttgtggcggagcaggtgtcccaccacccacccatctcttgcttttactgcgagtgcgaagagaagcggttatgtgtgaatacacatgtgtggactaagtcaaagtttatgggaatgtcagtcggggtctccatgattggagaaggagttttgagactccttgagcacggggaggagtatgtgttcacactgccctccgcatatgctcggagtatcttgaccatcccttgggtggagctggggggtaaagtgtctatcaattgtgcaaaaaccggatatagcgctaccgtgatctttcacacaaagcctttttatggcggtaaggtccaccgagtcactgccgaagtaaagcacaatccaacaaacactatcgtctgcaaggcccatggagaatggaatggtacactggaatttacatataataacggagagaccaaggtcatcgacacaaccactttaccagtgtatcccaagaaaataagaccgctggaaaaacagggacccatggagtcacgtaacctctggagggaggtgacccggtatttgagactgggagatatcgatgcggcaaccgagcagaagcgccatctagaggagaagcagcgagtcgaggagcggaaaagagaaaacttacggaccccctggaagccgaagtacttcatacaggagggtgatggctgggtgtactttaatcctctttggaaagcacactag

SEQ ID NO: 127561 - DNA, 2103 bp, Artificial Sequence
  Description of Artificial Sequence: Synthetic coding sequence
atggaaagagctgtccagggaacagacggcggaggcgggagcaattcgtccagtagatcaagtagtcgagcgacatcagcagggagctccccttcttgcagtcttgcagggaggggagtgagcagccgcagcgccgctgctggcctcggcggaggcggtagccgatcaagcccaggcagcgttgcggcaagtccaagcggaggaggtgggcggcgacgggaaccagccctagagggggtgctctcaaaatatactaatttactacagggatggcagaatagatactttgtgctcgatttcgaggccggcattctgcagtactttgtcaacgagcagagcaagcaccagaagccccgcggcgtgctgtctctgagcggagccatcgtttcactgtcagatgaggccccccatatgctggttgtgtactcagctaatggcgagatgttcaagctgcgggctgcagacgccaaagaaaaacagttctgggtcacacaattgagggcttgtgctaagtaccatatggaaatgaattcaaagatgatgaatcaagttgagggacaacagaaaaatctggtgcacgccatagagagccttcccggatccgggcccctgactgcactcgaccaggacctgcttctgttaaaggccacctcagctgcaaccttgtcctgtctgggggaatgtttgaatcttctgcagcagtctgttcaccaggccgggcagcccagccagaagcctggcgccagcgagaatattcttggttggcatggctccaagagtcattctaccgagcaactcaaaaatggaacgcttggctctctacctagcgcatcagctaatataacatgggcaatcctccccaatagtgccgaagatgagcagacttcacaaccagaacccgaacccaacagcggatctgaattggtcctctccgaggacgaaaagagtgacaatgaagacaaggaggaaaccgaactgggtgtcatggaagatcaaagaagcattatattgcaccttataagccagctgaagttgggcatggatctgacaaaagtggtcctcccgactttcatcctggagaaacggtccctgctagaaatgtatgcggattttatggcccacccagacctcctccttgccattactgcgggagcgacacctgaggagcgggtgatctgctttgtggagtactatcttactgcctttcacgagggtcggaaaggtgccctggccaagaagccttacaatcctatcataggagagaccttccactgtagctgggaggtccccaaagaccgcgttaagcctaaacgcaccgcgtcgagatccccagcatcttgccacgaacatcccatggctgatgaccccagcaagtcttataagctgcgctttgttgccgagcaggtgagccaccaccccccaataagctgtttctactgcgagtgtgaggagaagcgactctgtgtcaacacacacgtttggactaagagcaagttcatggggatgagcgtgggcgtgtcaatgataggcgaaggggtcctgcgactgctggaacacggcgaagagtatgtctttactctacctagcgcttacgcccggtctatcctgacgattccgtgggtcgagcttggcggaaaggtcagtattaactgcgcgaaaactggatacagtgcaactgtcattttccacacgaagccgttttatggaggcaaagtgcatcgtgttactgcagaggtgaaacacaatccaactaacaccatcgtgtgtaaagcccacggggagtggaacggaacattagagttcacatacaataacggggaaaccaaggttatcgacacaaccactctgcccgtgtatcctaagaaaatccggcctttggaaaagcaaggtcctatggaaagccgcaatctctggagagaagtcactcggtatcttcgtttgggcgatatagatgcggccacagaacagaagagacacctggaggaaaaacaaagagtggaggagaggaagagagagaatctccgtaccccgtggaaacccaaatacttcattcaggaaggagatggctgggtatattttaaccccttgtggaaagcacactag

SEQ ID NO: 127562 - DNA, 2244 bp, Artificial Sequence
  Description of Artificial Sequence: Synthetic coding sequence
atgcagggcggggaaccagtgtctactatgaaggtgagcgaaagcgaaggcaaactcgaaggccaagccacagccgtgacacccaacaagaattcatcctgcggcggtgggatatcctcgagctccagcagcagagggggttccgcgaaaggctggcaatatagtgatcacatggagaacgtctatgggtatctgatgaaatatacgaatttagtcacgggctggcaatatcggttcttcgtcctaaacaatgaggccggtcttctcgaatactttgttaatgagcaatctcgaaatcaaaagccacgcggcaccctccagttagctggagccgtgatatctccatccgacgaagactctcatactttcactgtgaatgccgcgtcaggcgagcagtacaaactgcgcgctactgacgccaaggagcgccagcattgggtctcccggctgcagatatgcacccagcaccatacagaggcgatcggaaagaataacccccctctgaaaagcaggagcttttcactggcatcctcaagtaacagcccaatctctcagaggagaccttcacagaacgccattagtttttttaacgtaggccattcaaagctgcagtctctttccaagaggaccaacttacctcccgaccacctggtggaagtgagagagatgatgagtcacgccgaggggcaacagcgagacctgatacggaggatcgagtgcttgccaactagtggccatctgagcagcctcgaccaagacctgctcatgctgaaagcaacctccatggctacaatgaattgtctcaatgactgcttccacatcctgcaattgcagcacgcttcccatcagaaaggcagtctgccctcaggtaccaccatcgagtggttggagccgaaaatctccctgtccaaccactataaaaacggggccgaccagccatttgcaacagatcagtcaaagcccgtcgcggtgcctgaagagcaaccagttgccgaatctgggctgttggctcgtgaaccggaagagattaacgctgacgatgaaatcgaggacacttgcgaccacaaagaggacgacttaggtgccgtcgaggaacagagaagtgtcattctgcacctgctttcacagttaaagctgggcatggacctgactcgcgtggttctgcctacctttattttggagaaacggagcctcttggaaatgtacgcagattttatgtcacatcccgacctgtttatcgccatcaccaatggagctacggctgaggaccgcatgatccggttcgtggagtattatctcacttccttccacgaaggtaggaaaggagccattgccaagaagccttataatccgataatcggcgagactttccattgctcatggaaaatgccaaaaagcgaggtcgcctcctccgtcttcagctcttcttccacacaaggggttacaaatcacgcacctctgtccggggagagcctcacccaggtcggttccgattgttataccgtgaggttcgtggcagagcaggtaagtcaccatccacccgtgagtgggttctacgcagagtgtacagagcgaaaaatgtgcgtgaatgctcacgtatggacaaaatctaaatttctgggaatgtctatcggcgttaccatggttggcgagggaattctgtcccttctggagcacggagaggaatacaccttttcactcccctgtgcttacgccaggagcattctaactgtgccttgggttgagctgggcggaaaagttagtgtgaactgcgctaaaaccggatattctgcctccataacatttcacacgaaacctttttacggaggaaagttgcaccgagtaaccgcagaggtgaagcacaatatcaccaacacagtcgtctgtcgggtgcagggtgagtggaacagtgtactggagttcacttattcaaatggagaaaccaaatatgttgacttaacgaaactggcagttactaagaaacgtgtccggcctctggaaaagcaggaccccttcgaatctagacggctgtggaagaacgttaccgactctctgcgggaatccgaaattgacaaagcgacagagcacaagcatactctggaggagaggcaaagaacagaggaaaggcacaggaccgagacaggcacaccatggaagacaaagtactttatcaaggagggggatggttgggtgtaccacaagccactgtggaagatcattcccacaacacagcccgccgagtag

SEQ ID NO: 127563 - DNA, 2853 bp, Artificial Sequence
  Description of Artificial Sequence: Synthetic coding sequence
atgaatactgaagctgaacagcaactgcttcaccacgcacggaacggcaacgccgaagaagtgcgacagttgctggagaccatggcacgcaatgaagttatcgccgacataaactgcaagggcagatccaagtccaatctgggctggacccccctgcatctcgcgtgttactttggacatcgccaggtagttcaagacctcctgaaagccggcgccgaggtaaatgtgttgaatgacatgggcgatacccccctgcaccgtgctgcctttacaggccggaaagaactcgtaatgctcctactagagtacaacgccgatactacaatagtgaacggttccgggcagacagccaaggaggtgacacatgctgaagaaatccgctcgatgctcgaggcagtagaaagaacacagcagcggaagctcgaggagctcctcctagcggcagctcgggaaggcaaaacgactgagctgaccgccctcctgaatcgccctaacccacctgatgttaattgctctgaccagctgggcaacacgccactgcattgcgctgcctaccgggcccacaagcagtgtgcccttaagttgctgaggtctggggcggaccctaacctaaaaaacaaaaacgaccaaaagccattagacctggcacagggtgcagagatgaagcatatcctggtcgggaataaagtgatctataaagcccttaaacgttacgagggtccactctggaagtcatctaggttctttggatggaggctgttctgggtggttctggaacatggcgtattgtcatggtatcggaagcagccagatgcagttcacaatatatatcgccaaggctgtaagcacctgacccaagccgtgtgcacagtgaaatccaccgatagttgcctgtttttcattaagtgctttgacgatacgatccacgggttccgcgtccccaagaactctctgcaacagagtcgggaggattggctcgaagcgatagaggagcacagcgcctactctacacattactgctctcaggatcagttgaccgacgaagaagaggaggacactgtaagtgccgccgacctgaagaagagtctggagaaggctcagagctgtcaacagcgccttgatcgggagatttcgaacttcttgaaaatgataaaagagtgcgacatggccaaggagatgctgccctccttcttgcagaaggtggaggtagttagcgaggcctcccgtgaaacatgcgtggccctaacagactgtctgaatctgtttaccaagcaagagggcgtcagaaatttcaaactggaacaggaacaagagaagaacaaaatactatctgaagccctcgagaccctggcgaccgagcatcacgaattggaacagagtcttgtgaagggaagccctcccgctagcattctaagcgaagacgagttttatgacgccttgtctgacagtgagtcagaacgcagcctgtctaggctggaagctgtcaccgccaggtcttttgaagaggagggcgaacatctgggcagtagaaaacataggatgtctgaggagaaagactgtggtgggggggacgcgctcagcaacggcattaagaaacaccgcacaagtctgccatccccaatgttctcccgtaacgatttttccatttggagtatccttcggaaatgtatcggaatggagttaagcaagatcactatgcccgtcatcttcaatgagcctctgtcttttctccagcgactcaccgagtacatggaacatacctaccttatccataaggcttcaagcctgtcagatcctgtggagcgcatgcaatgtgtagcagctttcgctgtgagcgcggtcgcctcccagtgggagcgaactgggaaaccctttaatcctctgcttggcgagacatacgagctggtgcgggacgatctcggatttagactgatcagtgagcaggtgtctcaccatccccccatctccgcatttcacgctgagggcttgaataatgactttatcttccacgggagcatctacccgaagttaaagttttggggcaagtcagtcgaagcagagcccaaaggcacaatcacgttggagcttctggaacacaacgaggcctatacgtggacgaatccaacatgttgcgtacataacatcatagtgggtaagctgtggattgagcaatacgggaatgttgagatcattaatcacaagacaggggataaatgtgtattgaattttaagccatgcggcttgttcggcaaggagctgcacaaagtggagggatacatacaggacaagtcaaagaaaaaactttgcgctctctatggtaagtggactgaatgcctgtattccgtggatccggccacattcgacgcatataaaaaaaatgataagaagaataccgaggaaaagaagaatagcaaacagatgagcacctctgaggaactggatgaaatgcctgtgcccgactcagaatctgttttcatcatacccggctctgtgttactttggagaattgctccccgtcctccaaattccgcccaaatgtataactttacgagtttcgcaatggtactcaacgaagttgataaagatatggaatccgtgatccccaagaccgattgccgtctgcgccccgacatccgggcaatggagaacggcgagattgaccaggcctcggaggaaaaaaaaaggctcgaagagaagcagcgagccgctcgtaagaatcggtcaaagtctgaggaggattggaaaacacgttggtttcaccagggacctaacccttataacggggctcaggattggatttatagcggctcttattgggaccggaattatttcaatctgccagatatttattag

SEQ ID NO: 127564 - DNA, 1707 bp, Artificial Sequence
  Description of Artificial Sequence: Synthetic coding sequence
atgataaaggaatgcgacatggctaaggagatgctcccaagtttcctccagaaagtcgaagtggtgtccgaggcgagccgagagacctgcgtggcacttaccgactgtctcaacctcttcacgaaacaggagggtgtgcggaatttcaaactcgaacaggagcaggagaagaacaagatcttgtccgaagctctcgaaacattggcgacggaacatcatgagctagaacaaagcctcgtgaaggggagtccgccagcaagcattctgtccgaagatgagttttacgacgctctgtctgatagtgaatccgagcggtccctctccaggctggaggctgtgacggcccggtcattcgaggaggaaggcgagcatctaggctcacgcaaacatagaatgtcagaagagaaggactgcggcggaggagacgccctcagtaatggtattaagaaacacagaacaagcctcccttcccctatgttttctagaaatgacttctcaatatggtcaatattgaggaagtgtatcgggatggagctaagcaagataaccatgccggtgatcttcaacgagcccctgagttttctgcaacggcttaccgagtacatggagcacacctaccttatccacaaagctagcagccttagtgatcctgtcgaaaggatgcagtgcgtggcagctttcgctgtctctgctgttgccagccagtgggagcgcaccggcaaaccgttcaacccactgctgggcgaaacatacgagctggtgcgcgacgatctggggttccggctgatctctgaacaggtttctcaccatccacctattagtgcattccacgccgaaggccttaacaatgacttcatctttcatggtagcatttaccctaaacttaaattctggggcaagagcgtcgaagcggagcctaagggcaccatcaccctggagctgctggaacacaacgaagcatacacctggacgaatccgacctgctgcgtgcataacattattgtgggaaagctttggatcgagcagtacggaaacgtggagattatcaaccataaaactggcgacaagtgtgttctgaactttaagccctgtggactgtttgggaaagagctgcataaagtggaagggtatatccaggacaaaagtaaaaagaaactctgtgccctgtacgggaaatggacagaatgcctctacagcgttgacccagcaacattcgatgcctacaaaaaaaatgacaagaagaatacagaagaaaagaagaatagtaagcagatgtctaccagcgaggaactggatgaaatgcctgtccccgattccgaatccgtgttcattatacctggaagtgtgctactctggcggattgccccaaggcctccgaattccgcacagatgtataatttcacctccttcgctatggtactgaatgaggtggacaaagacatggaatcagtgattccaaaaacagactgccggcttcgcccagacatcagggctatggaaaacggagagatagaccaagccagcgaggagaagaaacggttagaagaaaagcagcgagcggccaggaagaacaggtccaagtccgaggaggactggaaaacaaggtggttccatcaaggacctaacccttataacggagcacaggactggatctattccggttcctactgggacaggaactactttaatctgcctgacatctactag

SEQ ID NO: 127565 - DNA, 303 bp, Artificial Sequence
  Description of Artificial Sequence: Synthetic coding sequence
atgaatacggaagctgaacaacaactccttcaccacgcgcggaacgggaatgccgaggaggtgaggcaattgttagaaacgatggctcgcaatgaagtgattgccgacatcaactgcaagggcagatcaaagtcaaatctgggatggactcctctgcacctggcgtgctacttcggacatcgccaggttgtgcaagacctgctcaaggccggcgctgaagtcaacgtcctgaatgatatgggagacacccctctgcaccgcgccgctttcaccgggcgcaaaatctgttcccaaggcagttag

SEQ ID NO: 127566 - DNA, 1314 bp, Artificial Sequence
  Description of Artificial Sequence: Synthetic coding sequence
atgagtgaagagaaagactgcggaggcggcgacgcattgtccaacggcattaaaaagcaccggacatccctgccttcaccaatgttttcacggaacgacttctccatttggagtatccttcgcaagtgcatcggcatggagctgtcaaagataactatgccagtgatctttaacgaacctttgtccttcctgcagcgactcaccgagtacatggagcacacatacctgatccacaaagcttcgtcattgagcgacccggttgagcggatgcagtgcgtcgctgccttcgcggtgagcgctgtggccagtcaatgggaaagaactggtaaaccattcaatccattgctgggggagacatacgaacttgtaagagacgatttagggttcaggcttatatcagagcaggtttcacaccacccgccaatctctgccttccacgccgaaggcttgaacaatgactttattttccacggcagtatttaccctaagttgaaattctgggggaagtcagtggaagcggaacctaaaggaaccataacgctcgagctgctcgagcacaatgaagcctacacatggaccaatccgacctgctgtgtgcacaatatcatcgtcggaaagctgtggattgaacaatatggcaatgtcgaaatcataaaccataagacaggggataaatgtgtgttgaacttcaaaccatgtggcctctttggaaaagagctgcataaagtagagggatacatccaggataagagtaaaaagaaactgtgcgccctgtacggcaagtggacagagtgcctctacagtgtggacccagcaacctttgacgcgtacaaaaagaatgacaagaagaacaccgaagagaaaaagaattctaagcagatgagcacatcagaggagttagacgagatgccagttcccgattccgaatctgtctttatcatacccgggtctgttctcctgtggagaattgctcccagaccaccaaactccgctcagatgtataatttcacatctttcgcaatggtgctgaacgaagttgacaaagacatggaatcagtgatccctaaaactgattgtcggctccgccccgacatccgggctatggaaaacggtgagatagatcaggcgtctgaggaaaagaaacggttggaggaaaaacagcgcgccgcacggaaaaaccgttcaaaatccgaagaggattggaagacacgctggttccaccaagggcctaatccctacaacggcgcacaggattggatctattctggttcttattgggacaggaattacttcaatctcccggatatctattag

SEQ ID NO: 127567 - DNA, 345 bp, Artificial Sequence
  Description of Artificial Sequence: Synthetic coding sequence
atgcagtccgtggccgcattcgcagtgagcgccgtggcatctcagtgggagcggactggcaagccattcaacccccttctgggcgagacctacgagcttatcagggaagacctcggctttagattcatatcggagcaggtgagtcatcacccgcccatctccgcatttcactcagagggcctcaaccacgactttctgtttcacggcagtatctatcctaaactgaagttttggggcaaaagtgtggaggctgagccccggggcacaataacgctggaactcctcaacgtgaaccagaggcatctgagagccaagcacaaaagtccgaccaacgctggaaggtag

SEQ ID NO: 127568 - DNA, 1443 bp, Artificial Sequence
  Description of Artificial Sequence: Synthetic coding sequence
atgaacggggaggaggagttctttgacgccgtcacaggcttcgactctgataacagcagcggagaattttccgaagctaatcagaaagtgaccggcatgatcgatctggacacatctaagaacaacaggatcggtaagaccggggagcgccccagccaggaaaatggcatccagaagcaccggacttctctccctgcccctatgttcagccgaagcgacttcagtgtgtggacaatcttgaaaaagtgtgtgggtctggagttgagtaagataaccatgcccatagcttttaacgaacccttaagtttcctgcagaggataacagagtatatggagcacgtctacttgatccatcgggccagctgtcagcctcagcccctggagagaatgcagtccgtcgctgccttcgccgtgtcagccgtggcgtctcagtgggagagaactggtaaacccttcaaccctctgctcggagagacatatgagctcattagggaagatctcggctttcgctttatcagcgaacaggtctctcaccatccaccaatatcagcttttcactctgaaggactgaatcacgatttcttatttcatggctcaatatatccgaagttgaagttctggggaaaatccgttgaggctgagccccgaggcaccataactctggaattgttgaagcacaacgaagcttacacatggacaaaccctacgtgctgtgtccataatgttattatcggcaaactgtggattgaacagtatgggaccgtggaaattcttaaccaccgcactggacataaatgcgttcttcacttcaagccatgtggattattcgggaaagagttacataaagtcgaagggcatatccaagacaaaaataaaaaaaagttgttcatgatttacggcaagtggaccgaatgtctctgggggatcgaccctgtctcatacgagagttttaaaaagcaggaacgtcgaggcgaccaccttcgtaaagccaagctagatgaagactctggaaaggcggatagcgacgtggccgacgatgtgcctgtcgcccaagagaccgtccaggtcattcctggaagcaagctcctgtggcggatcaacactagacccccgaactccgcccagatgtataatttcacgagcttcaccgtctctctcaacgaactggagaccgggatggagaaaacactccctcccactgattgtcggctgcgacctgacataagaggaatggaaaacggtaatatggacctggcttcccaggagaaggaaaggcttgaagaaaagcagagagaagctcggagagaacgtgccaaagaagaagcagagtggcaaaccagatggttctaccccggaaacaatccctataccggcacaccggattggctgtacgccggagactacttcgagcgaaacttttccgactgccctgacatctattag

SEQ ID NO: 127569 - DNA, 1407 bp, Artificial Sequence
  Description of Artificial Sequence: Synthetic coding sequence
atgaacggcgaggaggagttctttgacgctgtgacagaggccaatcagaaggtgacggggatgatagacttggataccagcaaaaataatagaatcggcaagactggagagcggccatctcaagagaatggtattcaaaaacacaggactagcctgccggcaccgatgttcagccgttccgattttagcgtgtggactatcttaaaaaagtgtgttggcttagaattaagtaaaattaccatgccaatagctttcaatgagccactctcattcctccagcggatcacagaatacatggaacatgtttatttgatacatcgggccagctgccagccccaaccacttgagaggatgcaatctgtcgctgcattcgcagtctccgccgtggccagccaatgggagcgaaccgggaagccttttaatcccctattaggagagacgtacgagttaattagggaagacctaggtttccgattcatcagcgagcaggtctctcaccacccgcctatctcggcctttcatagcgaaggtctgaatcatgatttcctgttccacggcagcatctatccgaagctcaaattttggggcaagtccgtggaagccgaacccagaggaaccattactctggagctgctgaagcacaatgaggcatacacctggactaaccccacttgctgtgtccataatgttattataggaaaactgtggatcgagcagtacggcaccgtcgagatactgaatcatagaaccgggcacaagtgcgttctccatttcaagccgtgcggactgttcggcaaagagctgcacaaagtggaagggcatatccaggataaaaataagaaaaaactttttatgatttacggcaagtggacagaatgcttgtggggtattgatcctgtcagctacgagagttttaagaagcaggaaagacggggcgaccatctgagaaaggccaagttggacgaggattcaggcaaagcagatagtgatgtggcagatgatgtccctgttgcacaagaaaccgtacaggtgattcccggatctaaactattatggcggataaacacaaggccacccaattccgctcaaatgtacaatttcacaagttttactgtaagcttgaatgagctggagaccggcatggaaaaaacacttcctcctacagactgtcggctacgccccgacatcagggggatggagaatgggaacatggatctcgcctctcaggaaaaggagaggctcgaagagaagcagcgggaggctaggcgcgagagagctaaagaggaagcggagtggcaaacccgttggttttaccccggaaacaacccatacacaggcacgcccgactggctgtatgccggtgactacttcgaacggaatttctccgactgtccggatatctattag

SEQ ID NO: 127570 - DNA, 1113 bp, Artificial Sequence
  Description of Artificial Sequence: Synthetic coding sequence
atgcccattgcattcaatgaacccctgagcttcctgcagcgtatcaccgaatacatggagcatgtgtatcttattcatcgcgcttcgtgccagccacagcctcttgagcgcatgcaaagtgtcgccgcattcgccgtcagtgctgtggcttcacagtgggaacgcaccggtaagccctttaacccattactgggagaaacatatgaactgatccgcgaggatctcgggtttcggtttatatccgagcaggtcagccatcatccccccatcagcgcctttcactccgaggggctgaaccacgattttttgtttcatgggtctatatatcccaagctcaaattctgggggaaaagtgtagaggccgagcctcgtggaacgattactctggaactgctgaagcacaacgaggcttatacatggacaaatcccacttgttgcgtccacaatgtcatcatcggcaagctgtggatcgaacagtatggcactgtcgagatcttgaatcacaggaccggccacaagtgcgtgctacacttcaagccttgcggactcttcggtaaggagcttcacaaagttgagggacacattcaagataagaacaagaaaaagctcttcatgatttatggcaaatggaccgagtgtctctggggcatcgatcccgtcagctacgaatctttcaagaagcaggaacgacgcggcgaccacctgcgaaaggcaaagctggatgaggactctggtaaggccgactctgacgtagctgacgacgtgccagtagcccaggagactgtgcaggtaatcccgggatctaaacttctgtggcggataaacaccagaccaccaaatagcgctcagatttggcccgcaaggcgtagaagcggatggaggcgttcacgggaaaagcacggcgggtccggtcctaggcgtagacagtccggtaggcgcggcggatccactcaggccatcacccccactttgggccctcccacagggtgtatgcaggggattaccctcagcggcatctcaccaaccgcccagataagtactgaaggtcttgagggccctggcgctcgggatcgccgtctcacacgcctggacttcctagaatggcctctttag

SEQ ID NO: 127571 - DNA, 339 bp, Artificial Sequence
  Description of Artificial Sequence: Synthetic coding sequence
agcgtagcagcttttgcggtgtccgctgtggcatcacagtgggagcgtaccggtaagccatttaaccccctcctcggagagacctatgagttgatccgcgaggatctgggcttccggtttatctcagagcaggtcagccatcatcctccgatcagcgcgttccatagcgagggtctgaaccacgatttcctgtttcacggcagcatttatcccaaattaaagttctgggggaagagcgtggaggctgagccaaggggtacaatcactttagaacttctgaacgtcaaccaaaggcacttgcgagcgaagcacaagtctccaacgaacgctgggaggtag

SEQ ID NO: 127572 - DNA, 2664 bp, Artificial Sequence
  Description of Artificial Sequence: Synthetic coding sequence
atgatgtcagacgagaaaaatctgggtgtgtctcagaagcttgtatctccctccagaagcacttcttcttgttcgagcaaacagggttcaagacaggactcctgggaagtagtggaagggttgaggggagaaatgaactacactcaggagccgcccgtccagaagggatttctgctcaagaagcgcaagtggcctttgaaaggctggcacaagcggttcttttaccttgacaagggaatactgaagtatgccaagtcccagaccgacattgaacgggagaagctgcatggctgtatcgatgttggactgagcgtgatgagcgtgaagaagtcctccaaatgcatcgatcttgacaccgaagaacacatatatcacctgaaagtaaagagcgaagaagtgttcgacgagtgggtgtctaagctcaggcatcacagaatgtataggcagaatgagatagctatgtttccacacgaggtcaatcactttttctcgggttccacaataactgatagtagctcaggggtattcgatagcattagcagtcggaagagatcctccatttctaagcagaatctgtttcagactggctctaacgtgtctttctcttgcggcggagagactcgcgttcctttatggctgcagagctctgaggacatggaaaagtgttccaaggatctggcgcactgtcatgcttaccttgtggagatgtcccagctattgcaaagtatggacgtgctgcatcggacctattcagcccctgctatcaatgcaatacaaggaggttccttcgaaagtcctaagaaggagaagagatcacaccgccggtggcggtcccgtgccattggaaaagatgctaagggcaccctgcaggtgcccaaaccgttttccgggccagtcagactgcatagctcaaatccaaatctctctaccctggactttggcgaggaaaagaattattccgatggaagcgaaacgtcctccgaattctctaaaatgcaggaggatctgtgccacatcgcacataaggtgtacttcacgttaagatcagcattcaatataatgtcagccgaacgcgagaagctgaaacaactgatggaacaagacgcctctagctcaccttcggcccaggtgattggtctgaagaacgctctgagcagcgcactggctcagaacaccgatctgaaggaacggctgcgccgaattcacgctgagagcctgctgctggattccccggccgtcgctaaatcaggtgataacctggccgaggagaactctagggacgagaaccgggccctggtgcatcagctttctaacgagtctcgcttgtcgatcactgactctttaagtgagttttttgatgctcaggaagtgcttctgagtccttcctccagcgagaatgagatttccgacgacgattcatatgtatccgatatctccgacaatctcagtttagacaatctgtcaaatgacctggacaatgagcgccagacattgggacctgtgctggattccgggagggaagctaagagtcggagaagaacctgccttccagccccttgcccgtcaagtagcaatatttcattgtggaatatactgcggaacaacataggcaaggacctaagcaaagtcgcaatgccagtggaactcaacgaaccccttaatacattgcagcgtctctgcgaagaactggagtacagcgaactgctggacaaagcggcccagattccatcgccactggagcggatggtatatgtggctgcctttgcaataagtgcttatgcctcctcttactacagggccgggagtaaaccgttcaacccagtcttgggagaaacctacgaatgtatcagagaagacaaagggtttcagttcttctctgaacaggtgagtcaccaccccccaatctcagcttgtcatgcggagagccggaattttgtgttctggcaagacgtccgttggaagaacaaattttggggtaaaagcatggaaattgtgcccattggaacaactcatgtcaccctgcctgtatttggggatcacttcgaatggaataaggtgacatcttgcatccacaacattcttagcggtcaaaggtggatcgagcactatggcgagatcgtcatcaagaatctgcacgatgattcctgttattgtaaggtgaatttcataaaagctaagtattggtctaccaatgctcacgagattgaaggtactgtgttcgatcggtccggaaaggcagtgcatagattgtttgggaaatggcacgagagcatatactgcggaggcgggtcatcctcagcctgcgtctggagagctaaccctatgcctaaaggctatgagcagtactattcgtttacccagtttgctttggagctaaacgagatggacccctcctctaaaagcctccttccccccacagacacgcggttcagacctgaccagcgctttctagaagaaggaaacctggaggaagccgagattcagaaacagaggatcgaacaactgcagcgcgaacggcgcagagtcctagaagaaaatcacgtcgagcaccagccgcgctttttccgcaaaagcgatgacgacagttgggtgtcaaatggcacttacctggagttgaggaaggacctggggttcagtaaactcgatcatccggtgctgtggtag

SEQ ID NO: 127573 - DNA, 2571 bp, Artificial Sequence
  Description of Artificial Sequence: Synthetic coding sequence
atgatgagtgatgaaaaaaacctcggagtgtcccagaagttagtcagcccttccaggtctaccagctcctgttccagtaagcagggtagcaggcaggattcgtgggaagtggtggagggcctgaggggggaaatgaactacactcaagagccaccagtccagaaggggttccttctgaagaagaggaagtggcctctcaaagggtggcataaaagatttttctatctggacaaaggcatactgaagtacgccaaaagccagaccgatatcgagcgcgagaagctccacgggtgtattgatgtagggctgagcgtaatgtctgtcaagaagtcatccaagtgtatcgacctggacacggaggagcatatataccatctgaaagtgaagagcgaggaagtgttcgatgagtgggtgagtaaactgcgtcaccatcggatgtatcgccagaatgagattgctatgttccctcatgaagtgaatcattttttcagcgggtccaccatcaccgactccagcagtggcgtgttcgacagtatctcttctcggaagcgttcaagcatctctaagcagaatctgtttcaaacaggcagtaacgtgtctttttcttgtggtggcgagacgcgggtacccctgtggctgcagtcttcggaagatatggagaagtgcagcaaggatctggcacattgccacgcatacctagtcgagatgtcccagctgctgcagtccatggacgtgttgcacaggacttactcggcccccgccataaatgcaattcaggttcccaagcctttttcaggccctgtgagactgcacagcagtaacccaaatctgtccaccttagactttggtgaggagaaaaactactctgacggttcggagacaagcagcgagttctccaagatgcaggaagacctgtgccatatcgcacacaaagtatacttcacattgagatccgcttttaatatcatgtctgcagagcgggaaaagctcaagcaattgatggaacaggatgctagctcttcaccctccgcccaagtgataggcctgaaaaacgccttaagtagcgctctggctcagaatactgacctgaaagagaggctgaggcggatacatgccgagagcttgctactggacagccccgccgtcgccaagtccggagataatctggctgaagaaaacagtagagatgagaaccgggctttggtgcaccagttgagcaacgaaagtaggctgtctattactgattccctatctgagtttttcgatgcacaggaggtgcttctcagcccctcctcttctgagaacgagatctccgacgacgacagttatgtgtcggatatctccgacaatctgtcactggacaacttgtcaaacgacctcgataatgagagacagactcttggaccagtcctcgatagtggacgagaggccaaatcccgtaggcgcacgtgtctgcccgcaccctgtccctcatcgtccaacatcagtctgtggaacatcctgagaaataacatcggcaaagacttaagtaaggttgcaatgcccgtggaactgaacgaacccctcaacacgctccagagactgtgcgaagaactagagtattctgagctgctggacaaagccgcgcagatcccttcgccccttgagcgtatggtttatgtggccgcttttgccatctctgcctacgccagcagttattatcgcgctggatcgaaaccctttaatcctgtactcggtgagacctacgagtgcataagggaggataagggtttccagtttttctctgagcaagtgagtcaccacccgccgatcagcgcctgccatgccgaatccagaaactttgtattttggcaggatgtacggtggaagaacaagttctggggtaagagtatggagatcgttccaattggaaccactcacgttaccctccccgttttcggggaccatttcgagtggaataaggtgactagctgcatccataacatcctgagtggccagagatggattgaacactacggggagatcgtgatcaagaatctacacgatgactcttgttactgtaaagtgaatttcatcaaggccaagtactggagcacgaacgcacacgagatcgaggggaccgttttcgaccggtctggcaaggccgtccaccgcctctttggcaaatggcacgagtcaatctactgcggggggggctccagctcagcgtgcgtctggcgagctaacccaatgcctaagggctatgagcaatactattcctttacccaattcgctctggagctgaacgagatggatccatcctcaaagagtctcctgccgcccaccgacactaggttcaggccagatcagaggttcctggaagaaggcaacctggaagaagctgaaattcagaagcaacgaattgagcaactgcagagggagagacgacgcgttttagaggaaaaccacgtggagcaccagcccagatttttccgaaagagtgacgacgatagttgggtgagcaatggaacctacttggagctgagaaaagaccttggctttagcaaactcgaccatcctgtcttgtggtag

SEQ ID NO: 127574 - DNA, 2556 bp, Artificial Sequence
  Description of Artificial Sequence: Synthetic coding sequence
atgatgtcagacgagaaaaatctgggcgtgagtcagaagctcgtgtcgccaagccggagcactagctcttgctcttctaagcaaggttcccgccaagattcctgggaggtggttgaaggactgcgcggggaaatgaactatactcaggaacctccagtccagaaaggtttcctgctgaagaaacgtaagtggcccttaaaagggtggcacaagcgatttttttacctggacaagggcattttaaaatacgccaaaagccagaccgacattgagagagagaaactgcatggctgcatcgatgtgggcctgagcgttatgtccgttaaaaagtcttccaagtgtattgacctcgataccgaggagcacatttaccatcttaaagtgaaatcggaggaggtctttgacgagtgggtctcaaaactgagacaccaccgtatgtaccgacagaacgagatcgcaatgttccctcacgaagttaaccactttttctctggatcgacaattaccgatagtagcagcggtgtgtttgactcaatctccagtagaaaaagatcaagcatctcaaagcaaaacctatttcagactggaagcaatgtgtccttcagctgcgggggcgaaacccgcgtgcctctatggctgcagagctctgaggacatggagaagtgtagcaaggaccttgcacattgccacgcttatctcgtggaaatgtctcagctgcttcaatctatggatgtgctgcaccgcacctattctgcacccgcgataaacgctatccagggaggttcgtttgaaagtccaaagaaggagaaacgcagtcaccggagatggcggagtcgagcgataggcaaagatgccaaaggtaccttgcaggtgccaaaacctttcagcggccccgtgaggcttcacagttcaaacccaaacttgtcaacgctggattttggagaagaaaagaactattctgacggcagtgaaacttctagtgagttttcaaaaatgcaggaggacctttgtcatatcgcccataaagtgtactttactctgcgctccgccttcaacatcatgtccgccgaaagagagaagctaaaacagttgatggaacaggatgcaagttcttccccgtccgcccaagttattggactgaaaaatgccctaagctctgagaatagccgggacgagaatagggccctggttcaccaacttagtaatgaatcacgactatccattacagatagtctatctgaattctttgatgcccaggaggtactgttgtctccttcaagctccgagaacgaaatttctgatgacgactcatatgtcagcgatatcagcgataaccttagcctggacaatctttcgaacgatttggacaatgagcggcagactttaggtcccgtactggacagcggtagagaggccaagagtcgaagaaggacatgcctgcctgctccatgcccgtcgagctcgaacatcagtctgtggaatattttgaggaacaacataggaaaagacctttctaaggtcgcaatgccggtcgagctgaacgagcctctgaacacattacagagactgtgcgaagagctagagtatagcgagctgttagataaagccgcccagattcccagtcctctggaaaggatggtctatgtggcagcttttgcgatctccgcatatgcctcaagttattacagagccggctccaagccgttcaatcccgtcctgggagaaacatatgagtgtattcgagaggataaagggttccagttcttctccgagcaggttagtcatcaccctcccattagcgcctgccatgctgaatccaggaactttgtgttttggcaggatgtcaggtggaaaaataaattctggggaaagagcatggagattgtgccaatcggaaccacacacgtgactctgccggtcttcggcgaccactttgagtggaataaggttaccagctgcatccacaatatcctgtcagggcagcgttggatagagcattacggcgagattgtaataaagaacctgcatgatgatagctgttattgtaaagtgaacttcatcaaagctaaatactggagcaccaatgcccacgagatcgagggtaccgtttttgataggagtggcaaagccgtgcatcgtctctttggaaaatggcatgaaagtatctactgtgggggtggttcttcatccgcctgtgtctggcgcgcaaatcctatgccaaaggggtacgagcagtactatagcttcacacagtttgcactagagctcaatgagatggatccctcctcaaaaagtctcctccccccaaccgatactagatttaggcctgaccagaggttcctcgaagagggcaatctggaagaggctgagatacaaaagcagcgcattgagcaactgcaacgagagcggcgccgggtcctggaagagaaccatgtcgagcatcagccacgctttttccggaaatccgatgatgactcctgggtgtcaaatggaacctacctcgagctaagaaaggacctcggcttcagtaagttggaccaccccgtgctgtggtag

SEQ ID NO: 127575 - DNA, 2556 bp, Artificial Sequence
  Description of Artificial Sequence: Synthetic coding sequence
atgatgtccgatgagaagaaccttggcgtgagccagaaactggttagtcccagccgaagtactagcagttgctcaagtaagcagggttcccgccaagatagctgggaggtggtggaaggcctcaggggagagatgaattacactcaggaaccacccgtccaaaaagggttcctccttaagaaaaggaaatggccactgaaggggtggcataagcggtttttttacttagataaaggcatactgaaatacgctaaatcccaaacagatatcgagcgagaaaaactgcacgggtgcatcgacgtgggtctaagcgtgatgtctgtgaagaagtcctcaaaatgcatagacctagacactgaggaacacatctaccacctgaaagtaaaatctgaggaagtgttcgacgaatgggttagtaaactaaggcatcatcggatgtataggcaaaatgagatagccatgtttccccacgaggttaatcattttttctccggctcaacaattactgattcatccagtggagtgtttgacagcatttcgtcccgcaaaaggtcaagtatctccaaacaaaatttgtttcagacaggctctaacgtgagcttctcctgcggtggtgagacacgggtgccactgtggctgcagtcaagcgaggatatggaaaagtgtagtaaagaccttgcacactgccacgcctatctcgtggaaatgagtcaattactgcaaagtatggacgtgctgcaccgcacatattctgccccggctatcaacgcaattcagggaggaagctttgagtcaccaaagaaggagaaacgcagccaccgcagatggcgatctagagctattgggaaggacgctaagggaacactccaggttcccaagcccttctccggccccgtccgattgcattcaagcaacccaaacttgtctaccctggatttcggtgaggagaagaattatagcgacggctcagagacctcatcagaattctccaagatgcaggaagacctctgtcacattgcacacaaagtgtactttaccttaagaagcgcctttaacatcatgagtgctgaaagggaaaaactcaaacagctgatggagcaggacgcctcttcttcgccttctgcacaagtgatcggtttgaagaatgccttgtcctccgagaacagccgggatgaaaaccgagccctggtacaccagttatctaacgagtctcggctctccatcacagactccttgtccgagtttttcgacgcccaggaggtgctactaagccccagcagctctgaaaacgagattagcgacgatgatagctacgttagtgacatttccgataacctttcacttgacaatctctcgaatgacttagataatgagagacagaccttgggccccgtattagatagcggacgggaggctaagagccggcgacgcacctgcctacccgctccgtgcccaagttcatccaatatctctttgtggaacattttacgaaacaatattggcaaagacctgagtaaggtggcaatgccagtggagctgaatgaaccgctgaatacactccagagactctgcgaggaactggagtattccgagttgcttgataaggctgctcagattcccagccccctggaaagaatggtgtacgtggccgccttcgcaatctccgcatacgccagcagttactacagggcgggttctaaaccgttcaatccagtcctcggcgaaacctatgaatgcattcgtgaggataaaggtttccaattcttctcagagcaggtctcacatcacccccccatctcagcctgccatgccgagtcacgcaacttcgttttctggcaagatgtgagatggaagaacaagttttggggcaagagtatggaaattgtgccaatcggaactactcacgtgacactccctgttttcggcgatcatttcgaatggaacaaagtgacatcatgtattcacaacatactttcagggcagagatggattgagcactacggagagatagtcatcaagaatttacatgacgactcatgctattgcaaagtgaacttcatcaaagcaaaatattggagcaccaacgctcacgaaatcgagggcaccgtttttgacagatctgggaaagccgtacacagactctttggcaagtggcatgaaagcatctattgtggcggagggagctcttctgcatgtgtgtggagagccaatccaatgcccaaagggtatgagcaatattattcattcactcagtttgccctggagcttaacgaaatggacccgtccagtaaatcactgctgcctcctacagatactaggttccgccctgaccagcgattcctggaggagggcaatctcgaagaagctgaaatccagaaacaacggatagagcagctccagcgagagcgaaggagagtactggaggaaaaccacgtcgaacaccaacctcgctttttccggaaaagcgatgacgatagctgggtgagcaacggtacctatctcgagcttaggaaagacctcgggttcagtaaactcgaccacccagtgctctggtag

SEQ ID NO: 127576 - DNA, 2571 bp, Artificial Sequence
  Description of Artificial Sequence: Synthetic coding sequence
atgatgtctgacgagaaaaacctgggcgtctctcaaaagttagtctccccgagcagatctacctcttcatgctcttccaagcaaggctctaggcaggattcttgggaggtggtggaaggactccggggggagatgaactacacacaggagcctcctgtgcagaagggattcctgttaaaaaagcggaaatggcctctaaagggctggcacaaacgattcttttacctggataagggcattctgaagtacgccaagtcccaaacggacatcgaaagggaaaagctgcatggatgcatcgatgtgggcctctcggtcatgagcgtgaagaaatcctccaagtgcatcgatctcgataccgaggagcacatttaccatctcaaagtgaaaagcgaagaagtctttgacgagtgggtgagcaagctgaggcaccaccggatgtatcgtcagaatgagattgctatgttccctcacgaggtgaatcatttttttagcggcagcactattaccgactcttccagcggcgtgttcgacagtatttcctctcgaaaaaggagctccattagcaaacagaacctgtttcagaccggatccaatgtgtccttttcatgcggtggcgagacgcgggttcctctgtggctccagtcctcggaagacatggagaagtgttctaaggacctggcccactgccacgcatatctagtggagatgtcacagcttcttcaatctatggatgtcctgcacagaacctatagcgccccagccatcaacgccattcaggtcccaaagcccttcagtggtccagtgagattgcattcttccaacccgaatctaagtacactggatttcggggaggaaaagaactactcagacgggagtgaaacctcgagcgagttcagcaaaatgcaggaggatctttgccatatcgcccacaaggtttactttacccttcgatcagccttcaatatcatgtcagcagagagagagaagctaaaacaactgatggagcaggatgcctccagtagtcccagcgcacaggtcattgggctgaaaaacgctctgagctctgccctggcccagaacaccgatctgaaagaacggcttcggcgcatccatgccgaatctttgctcctggacagcccagcagtggctaagagcggcgataatctggccgaagagaattcacgcgacgaaaatagagcactggtccatcaattatctaacgagagtcgtctctcaattaccgacagcctcagtgaattcttcgacgcccaagaagtattgttgagccccagtagttcagagaacgagatttcagacgatgattcctatgtgtccgatatcagtgataatctttccctcgataacctttccaatgatttggacaacgagcgccaaactcttggtccagtgctggatagcggccgggaagcaaagtccaggcggaggacctgcttgcctgctccatgcccctcatctagcaatattagcctttggaacatcctgcggaataacattggaaaagatctgagtaaagttgccatgcccgtcgaactgaacgaacccctaaacacattacaaagactgtgcgaggagctggaatacagcgaactgcttgataaggcagcacaaattcccagtccattggagcgtatggtgtacgtggccgcttttgccatctccgcatacgcctcttcttactaccgggctggatccaagcctttcaatcccgtcctcggggaaacttatgagtgcatcagagaagataaagggttccaattcttctctgaacaggtgagccatcatccacctattagcgcgtgtcacgcggaatcccgcaacttcgttttctggcaggacgtcaggtggaaaaacaagttctggggcaagtcaatggaaatcgtcccaattggcaccacccatgtgacactccccgtgtttggagaccatttcgagtggaataaagtaacctcttgcattcacaatatattgtctggccagcggtggatcgagcactacggggaaattgtcatcaaaaatttgcatgacgacagttgctattgtaaggtcaactttataaaggccaagtactggagcaccaacgctcatgagattgaggggacggtgttcgatcgctctggtaaagccgtgcataggttgttcgggaaatggcatgaaagcatctattgcgggggcggctcttcttccgcctgcgtttggcgcgccaaccccatgccgaaaggctatgaacaatactacagcttcacccaattcgcccttgaacttaacgaaatggaccccagttccaagtctctgctgcctcccaccgacactaggtttaggccagatcaacgctttctagaagaggggaacttggaagaagctgagattcagaaacaacgcatcgagcagctgcagcgcgaacggcgacgggtcctcgaggaaaaccacgtggagcatcaacccaggttctttaggaagagcgacgatgacagctgggtgtccaacggcacttacctggaattacggaaggacttaggcttttccaagttggaccacccggtgctgtggtag

SEQ ID NO: 127577 - DNA, 2463 bp, Artificial Sequence
  Description of Artificial Sequence: Synthetic coding sequence
atgatgtctgatgagaagaacctgggcgtgagtcagaaattggtgagcccctcacggtccacctcttcatgttctagcaaacagggctcaagacaggattcctgggaggtcgtcgagggcctgcggggtgagatgaattatacccaggagccccctgtgcagaagggttttttattgaagaaacggaagtggcctctgaagggctggcataaaagatttttttacctggacaagggaattttaaaatacgccaagtcgcagaccgatattgaaagggaaaaactgcacggctgcatcgacgtggggctgtccgtgatgtcggttaaaaaatcatccaaatgcattgacctggataccgaggaacatatctaccaccttaaagttaagagcgaggaggtgttcgatgagtgggtgagtaaattacgacaccacaggatgtataggcagaatgagatcgccatgtttccacacgaagtgaaccacttcttttccggtagcaccattaccgacagcagttccggagtattcgactctatttcttctcgcaagagaagctccatctctaagcagaatctcttccaaaccggctccaacgtctccttctcatgtgggggcgagaccagagttcctttatggctgcagtcgagtgaagatatggagaaatgctcaaaggatttggcccattgccatgcctacctcgtcgaaatgtcccagcttttgcagtccatggacgttttacaccgtacctattcagcccccgctattaatgctatccaggtccctaagcccttttctggccccgtcaggctgcattcctctaaccccaacttgtctaccctggacttcggcgaggagaagaactacagcgacgggagcgaaacttcaagtgagttctctaaaatgcaagaggatctgtgccacatcgcccacaaagtgtacttcaccctacgctccgcttttaacattatgagcgcagagagagagaaactgaagcagctgatggagcaggatgccagcagcagcccgagtgctcaggtgattggattgaaaaacgccctgagctccgagaacagtcgtgacgagaacagggctctcgtacatcagttgtcaaacgagtctaggctgagtataacggattccctcagcgagttcttcgatgcccaggaggtgttacttagtccatctagttcggagaatgaaattagcgacgacgactcatacgtgagcgatattagtgacaatctgtccctagataatctatccaatgaccttgacaacgaacggcagaccctgggccccgtcctggactccggccgagaagccaaaagccgccgccgaacctgtctgccggcaccttgcccctcctcctcaaacatttccctgtggaacattctgagaaataatattggaaaagatctgtccaaggtcgccatgccagtagaattgaacgagcctctgaacactctacagcgcttgtgtgaggaattagagtattctgagcttttagataaagctgcccagataccctctccccttgagcgcatggtctacgtcgctgctttcgccatctccgcttacgcttcctcctactacagggcaggcagcaaaccctttaaccctgtcctcggcgagacttacgagtgcatcagggaagacaagggcttccaattcttctcagagcaggtttctcaccacccacccatatcagcttgccatgccgaatcacgcaactttgtcttttggcaggacgtgaggtggaagaataagttctgggggaagtcgatggaaatcgttccaatcggaactacacacgtgactctccccgtatttggagatcacttcgaatggaataaggtgaccagttgcatccacaatatcctgtcgggtcaaaggtggatcgagcattatggtgagatagtcatcaagaacttgcatgatgacagttgctattgtaaagtgaactttatcaaagcgaaatactggtctacgaatgcgcatgaaatcgagggtaccgttttcgacagatcgggcaaggccgtccatcgtctcttcgggaagtggcacgaatctatttattgtggaggggggagttctagtgcttgtgtgtggcgggcgaaccctatgccaaaggggtacgagcagtattactctttcacacagttcgccctggaacttaacgaaatggaccccagcagtaagagtctcctcccaccgacggatacaagatttagacccgaccagcgcttcctggaggaaggcaacctggaggaggcggagatccaaaagcagcgcattgaacaactccagagagagaggcggcgggtccttgaggagaatcacgtggagcaccagccccgcttttttcgaaagtccgatgacgatagttgggtgtctaatggcacttacttagagctgaggaaggacttgggcttttccaaactcgaccatcccgttctctggtag

SEQ ID NO: 127578 - DNA, 339 bp, Artificial Sequence
  Description of Artificial Sequence: Synthetic coding sequence
atgatgagtgacgaaaagaatctgggagtgtctcaaaaactggtctctccttctcggtcaacgtccagctgctcatcaaagcagggttcccggcaagacagctgggaggtggttgaaggattacgaggggagatgaattacactcaagagccgcccgtgcaaaaaggatttctcttgaagaaacggaagtggccactcaaagggtggcacaagcggtttttttaccttgataaggggatcctgaaatacgctaaaagccaaaccgacattgaaagagagaaattgcacggctgcatagacgtcggtttgtctgtaatgagcgtgaaaaagtcttcctag

SEQ ID NO: 127579 - DNA, 186 bp, Artificial Sequence
  Description of Artificial Sequence: Synthetic coding sequence
atgatgagcgacgagaaaaatttaggggtgtctcagaagctggtgtcgccgtctcgttcaaccagcagttgcagttccaagcagggaagtcggcaggactcctgggaagtcgtagaggggctgaggggcgaaatgaattacacacaggagccccccgttcagaaaggcttcctgctcaaaaagtag

SEQ ID NO: 127580 - DNA, 2463 bp, Artificial Sequence
  Description of Artificial Sequence: Synthetic coding sequence
atgatgagcgatgaaaagaacctcggcgtatcacagaagttagtgtcccctagccggagtacaagctcgtgctccagtaaacagggctcccgccaggatagttgggaggtcgtcgagggtctgagaggtgagatgaattacacgcaggaaccccccgtgcagaagggttttctgttaaaaaagcgtaaatggccacttaaaggatggcacaaacgattcttctaccttgacaagggcatcctgaagtatgccaagtcacagaccgatatagagagggaaaaactacacggatgcattgacgtggggttgtccgtgatgtctgtgaagaagtctagcaaatgtatcgatttagacactgaggagcacatatatcacctgaaagtcaagtccgaggaggtgttcgatgagtgggttagcaagctgcgtcaccataggatgtatcgccaaaacgagattgccatgtttccacacgaagtcaatcatttcttctcaggttctactatcacagatagctcttcaggagtgttcgattctatcagctccaggaagaggtcctctattagcaaacagaatttgtttcagaccggatccaacgtgtcattcagctgcggaggagaaacacgggtgcctttatggttgcagtcatcggaagacatggaaaaatgctccaaggacttggctcactgccacgcatatctggtggagatgtcgcagctgctccagtccatggatgtcttgcatcgtacatactccgcccctgccatcaacgcaattcaggttcctaagcccttcagtggccccgtccggctgcactcaagtaacccaaacctgtctacactggattttggagaagaaaagaattactcagacggatctgaaacatcctcggagttcagtaagatgcaggaggacttgtgccacattgctcacaaagtctattttacactccgcagcgcttttaacatcatgagcgctgaaagggaaaaactcaaacaactcatggagcaagatgcttcatcctcgccatcggcccaggttatcggtctcaagaacgccctctcttccgagaacagccgtgacgaaaaccgcgctctcgttcaccagctgtctaacgaatctagactaagtatcactgacagtttgtccgaatttttcgacgcacaggaagtgctgctttcaccatcatctagcgaaaacgaaatctccgatgatgatagttacgtgtcagatatttccgataacttgagtctggacaatctgtccaacgatctcgataatgagaggcagaccctgggacctgtgctggactccggcagagaggccaagagcagacgacggacatgcctgccggccccgtgtccttcctcaagtaacatcagtctgtggaatatcctacgtaataacatcggcaaagacctaagcaaagtcgctatgcctgttgagctgaacgagcctttgaataccctgcagcggctgtgtgaagagctcgagtacagtgagcttctggataaggctgctcagatcccatctccactggagcgcatggtgtacgtagctgcattcgccatctcagcttatgctagctcctactatcgggccgggagtaagccatttaaccctgtgctgggtgaaacatatgagtgcatccgcgaagataagggctttcagtttttttcggagcaggtatcgcaccacccccctatttcagcctgtcatgccgagagcaggaactttgtattttggcaggatgtcagatggaagaacaagttctgggggaaatctatggagatcgtgcccattggtaccacacatgtgacgctgccagtgtttggggatcactttgagtggaataaggtgacatcttgcatccacaatattctgagcggtcagcgctggatagagcactatggagagatagtcatcaaaaacttgcatgacgactcctgctactgtaaggtgaatttcattaaggccaaatactggtctaccaatgcccatgagatcgagggtacggttttcgacaggtccgggaaggcagtgcataggctatttgggaagtggcacgagtccatctactgtgggggtgggagcagctctgcttgtgtgtggagggctaatccgatgcccaaggggtatgagcagtactattcatttacacagttcgccctagaacttaacgaaatggatccttcaagcaagtctctgttgccaccgactgacaccagattcagacccgaccagcgttttctggaggagggtaacctggaggaagccgagatacaaaaacagcgaatagaacagctccagagggaacgccgaagggtgttggaagagaaccacgtggagcatcagcctaggttctttcgcaaatccgacgacgattcgtgggtgagcaatgggacctacctagagctacgtaaggacctggggttcagcaagctggaccatcccgttttgtggtag

SEQ ID NO: 127581 - DNA, 270 bp, Artificial Sequence
  Description of Artificial Sequence: Synthetic coding sequence
atgatgagcgatgaaaagaatctcggagtgtcacaaaaacttgtctctccctcacggagtacctcatcatgctctagtaaacagggaagccgtcaggattcatgggaggtcgtggaaggtctccggggggagatgaactatactcaggagccacccgtccagaaaggtttcttgctgaagaaaaggaagtggcccctgaaagggtggcacaagcggtttttctatttggacaaagggatccttaagtatgcaaagtcccagacagactag

SEQ ID NO: 127582 - DNA, 2640 bp, Artificial Sequence
  Description of Artificial Sequence: Synthetic coding sequence
atgaaggaggaggcgtttctgcgcagacgcttttccctgtgtccaccctccagcacacctcaaaaagtcgaccctcgcaaactgacacgcaatctgctcctatctggcgataacgaactgtacccgctttcccccggcaaggacatggaaccgaatggtccttcacttccacgagatgagggaccacccactccctcatccgccactaaggttcctccagccgaatatcggctgtgcaatggaagtgataaagagtgtgtgtctcctacagctcgcgtgacaaaaaaagaaacgctgaaagctcaaaaagagaactataggcaggagaaaaagcgtgccacccggcagctgttgagcgcactaactgatccttccgtggtgataatggctgactcgctgaagattcgtggtacgctgaaatcctggactaaactgtggtgcgtgcttaaacccggggttttgcttatttacaagacccctaaggtaggacaatgggttggaaccgtcctgctgcactgttgtgaacttattgagaggccatccaagaaagacggcttctgctttaagctcttccaccctctggatcagtctgtctgggctgtgaaaggtcccaagggtgagtcggtggggagcatcacccagccgctgcctagctcttacctcatttttagagcagcttcagaatcggacggccggtgttggctggatgccctagaacttgccctgcggtgctcctcactcctgaggctgggaacatgtaaacctggtagggacggagagcctggcacctcccctgacgcctcgccttccagcttatgcgggttacccgccagtgcaactgtgcaccccgatcaggacctgttcccccttaacggtagctccctcgagaacgacgcctttagtgacaagtctgagagagagaacccggaagagtccgacaccgagacccaggatcattcgagaaaaaccgaatctggtagcgatcagagcgaaacgcccggggctcccgtcaggcgtggtactacatacgtcgaacaagtgcaggaggagcttggtgagctgggcgaagccagtcaggtggaaactgtctccgaggagaataaatccctgatgtggacattactgaaacagcttaggcctggcatggatttgtcaagagtagttctccctacgtttgtgctggaacctcggagctttctcaacaagcttagcgattactattatcacgcagaccttctgtcccgggcagcagtggaggaggatgcatacagccgtatgaagctggtgttgaggtggtacttaagcggcttttataagaagcccaagggcatcaagaaaccatataatccgatactcggtgaaacatttcgatgttgttggttccacccccagaccgattctcggaccttctacattgccgagcaggtttcgcatcatcctcctgttagtgcatttcacgtcagcaatagaaaggacggcttctgcattagcggttctataacagcgaagagccgattttatggcaactcactcagtgccctgcttgatggaaaagcgacactcacattcctgaaccgggctgaggactataccttaaccatgccgtatgcacactgcaagggtatcttgtacggcaccatgactctagagctgggtggaaaagtcactatagaatgcgccaagaataacttccaggctcagctcgaattcaagctgaagccctttttcggcggaagcacatcaattaatcagatttctggaaagataacatctggcgaggaagtactggcttccctcagcggccattgggaccgcgacgtgtttatcaaggaggaggggagcggctccagtgccctgttctggacaccctcgggagaggttcgtcggcagcggctaagacagcatactgtgcccctcgaggaacaaacagagcttgaatctgaacggctctggcagcacgtcactagggctattagcaaaggagatcaacatcgggctacccaagagaaatttgcccttgaggaggcacaacggcagcgagcgagagaaaggcaggagtccctcatgccttggaaacctcagctgttccacttagatcctatcacccaggagtggcattaccgatacgaagatcacagtccctgggatcctctgaaagatatagcccagttcgagcaggacgggatcctccgaactctgcaacaggaagctgtagctaggcagacaaccttcctggggagtccaggccccaggcacgagaggtcaggaccagatcagcggttgcgcaaggcctctgaccagcctagcggacattcccaggccacagagtctagcgggagtactcccgagtcctgtccagaactgtcagatgaggaacaggacggcgacttcgtccccggcggagaaagcccctgtccacgctgtagaaaagaggcccggcgcctgcaagctcttcatgaagccattctgagcattcgagaggctcaacaggaactgcataggcacctgagtgccatgctcagctcaacggctcgtgccgcacaagcgccaaccccagggcttctgcagtctccacgctcatggttcctgttgtgtgtcttcctcgcctgccagctcttcattaaccacattttaaagtag

SEQ ID NO: 127583 - DNA, 2436 bp, Artificial Sequence
  Description of Artificial Sequence: Synthetic coding sequence
atgaaggaggaagcatttttaaggagaagattcagtctgtgcccaccctcttccacccctcaaaaggtggatcctcgcaagttaacgagaaaccttctactatccggagacaacgaactgtatccactgtcaccgggaaaggacatggagcccaatggacccagcctgccccgtgatgaaggtccgccaacccccagttccgccactaaggtgccacctgccgaatacagactgtgcaatggttcagataaagagtgcgtgtctcccacagcaagagttactaaaaaggagactctgaaagcacagaaggagaactatcggcaggagaagaaacgggcaactcgccagctcttgtcagccctgaccgatcccagtgtcgtgataatggccgacagtcttaaaggccccaaaggagagtctgttgggtccatcacccagcccctcccatcttcgtatctcatctttagggctgcatccgagagcgatggaagatgctggctcgatgccctggaactagccctccgttgcagctcactcctccggctgggcacttgcaagcccggacgggatggcgagccggggacctcaccagatgctagcccatctagcctgtgcggactgccagcctcggcaactgtgcaccccgaccaagatctgttcccactcaatggttcatcgctggaaaacgacgcattctctgacaagtctgagagggagaatccagaggaatcagataccgagactcaggatcattcaagaaagacagagagtggcagcgatcagtcagaaacaccaggggcacccgttcggcgaggaaccacatatgtcgaacaagtgcaggaagagctgggtgaactcggggaagcctcacaggtcgagacggtttcggaagagaacaagagtcttatgtggacgctgctgaagcagctacggccagggatggatctctctcgggttgtcctgccaacgttcgttctggaaccacggtcctttctaaacaagctcagcgactattattaccacgctgatctcctgagcagagcagcagtcgaggaggatgcttatagtcgcatgaaactcgtactgaggtggtatctgtccgggttctataagaagcccaaaggcattaaaaaaccatacaaccccatcttaggggagacattccgctgctgctggttccacccccaaaccgactccaggaccttctatattgccgagcaggtcagccaccaccctcctgtgagtgccttccatgtgtcaaatagaaaggacgggttctgcatcagcgggtccatcaccgctaaaagccgattctatggcaatagcctcagtgcactgctggatggtaaggccacactcacatttttaaatcgtgctgaggattacaccctgacgatgccttacgcccattgcaaggggatcctctacggaactatgacccttgaactaggggggaaggtgacgatcgaatgtgctaagaacaacttccaggcacagctcgagtttaaactgaagccgttttttggcggctctaccagcattaatcaaatttctgggaagattacctcgggggaggaagtcttggcctccctgagcggacattgggatcgggacgtcttcatcaaagaagaaggatctggaagttcggccctattctggacaccaagcggggaggtgagacgccaaagattacggcagcatacagtgcctttagaggagcagactgagcttgagtcagaacggctctggcagcatgttacccgagctataagcaaaggagaccaacatcgtgcaactcaggaaaaattcgcacttgaggaagcccagcgacagcgagcccgcgaaaggcaggaatcattgatgccctggaagcctcaattattccatctggacccgattacccaagaatggcattaccgatatgaagaccactccccatgggacccactgaaggacatagcccaatttgaacaggacggaatactcagaactcttcagcaggaagccgtggcgcgccagaccacctttcttggatccccagggccgcgacacgaacgttccggacctgatcagagactaagaaaagcgtctgaccagccaagtggccatagccaggccacggaatcttccgggtccacccctgaatcttgtcctgaactgagtgacgaagaacaggatggtgactttgtccccggtggcgaatctccttgtccacggtgcaggaaggaagcccgaaggctgcaagctttacatgaggcaattctttctatccgcgaggcacagcaagaactccaccggcacctctcggccatgctctcatcaacagcccgcgctgctcaagcgccgactccagggctcctccagtcccctcggtcatggtttctactctgtgttttcctggcctgccagctgtttatcaaccatatccttaaatag

SEQ ID NO: 127584 - DNA, 1320 bp, Artificial Sequence
  Description of Artificial Sequence: Synthetic coding sequence
atggacttgtctcgcgtggtgctgccaacttttgtgctcgaaccaaggtcattccttaataagctatccgattactattaccacgcggatctactgagtcgagcagcagtggaggaggacgcctattccagaatgaagctcgtcctcagatggtacctgtcaggtttctataaaaagccgaagggcattaaaaaaccctacaatccaattctcggtgagacttttcgatgctgttggttccatccacagacagattccagaaccttttatatcgccgagcaagtgagccaccaccctcccgtctccgcctttcatgtgtctaatcgaaaagatggattctgtatctccggatcgatcactgcgaaatctaggttttacggaaattctctgagcgctctcctcgacggcaaagctaccctgacgtttctgaacagggccgaagactacaccctgacaatgccttatgcccactgcaagggaatcctttacggtactatgactctggagttgggagggaaggtgacaatcgagtgtgccaagaataatttccaggcccagctggagtttaagttgaaaccctttttcggggggtcgacttcaatcaatcagattagcgggaaaatcacaagcggcgaagaagtgctagcatctctgagcggccactgggatcgggacgtgttcattaaggaggaaggttctggctcttcagccctgttctggacgccgtccggggaggtcagaagacaacgcctgcggcagcatacggtcccgctagaggaacaaacagaactggaatctgaaaggttgtggcagcatgtcaccagagctatctccaagggcgatcagcacagggccacccaggaaaagtttgcacttgaagaggctcagcggcaacgcgcgagagagcggcaggaaagtctgatgccttggaagccccagctgttccacctcgaccctattactcaggaatggcactataggtacgaggatcacagcccatgggaccccctgaaggacatcgcccagttcgagcaggacggaatactgcgtactcttcagcaggaggccgtagctcgacaaacaactttcctagggtcgcctggtccaagacatgaaaggagcggaccagatcagcgcctccggaaagccagcgatcagccctcaggccatagccaggccacagagtcttcaggatctacacccgagtcatgccctgagttacacggcacaggcagcacaggaactgacccaaggccccccgccgaaccccctattctcgtgccagctctacgagtccctggggtgagcgcggttcattag

SEQ ID NO: 127585 - DNA, 2436 bp, Artificial Sequence
  Description of Artificial Sequence: Synthetic coding sequence
atgaaggaagaggcctttctccgccggcgcttctctctctgcccccccagttctacaccccagaaggtggacccacggaaacttacgcgtaacctgctgctgtctggtgacaatgaactgtacccgttaagccccgggaaggacatggaacctaacgggccctccttgccccgcgatgaggggcctcccaccccatctagtgcgacaaaggtgccacctgctgaatatcgcttatgcaatgggtccgataaggaatgcgttagtcctacagccagggtgactaaaaaagaaacactgaaggcacagaaagagaactacagacaagagaaaaagcgcgctacccgccagctcctgagtgcactgacggacccctccgtggtgatcatggccgatagccttaagggacccaaaggggagtctgtgggctctattacacagccactcccttcctcctatctcattttccgggccgcgagcgaatctgacggacgctgctggctcgacgcgctggagttagccctcaggtgcagcagtctcttgcgacttgggacctgtaagcccggccgggacggcgagcctggaacaagcccagacgccagtcccagttctttatgcggtcttcctgcatctgcaacagtccaccccgaccaagaccttttccctttgaatgggagcagcctggagaatgacgctttttcagacaaaagcgagcgggaaaatccagaggagtcggatacggaaactcaggaccattctcgcaagaccgagtcggggagcgaccagagcgaaacacctggagctcccgtgcgacgcggcactacgtacgttgaacaggtgcaggaggagcttggcgaattgggagaggcgagtcaggtggaaactgtgtccgaggagaataaatccctcatgtggacactactgaaacagctccgaccggggatggacctctctagagtcgtgctacccacgttcgtgctcgagccccgctcattcctgaataagctgagtgactattattaccacgccgatctgctgagcagagccgccgtcgaggaggacgcgtattcacggatgaagctggtgctgagatggtatctgtccggtttttataaaaaaccgaaaggcattaagaaaccctacaaccctatcctaggggaaacatttagatgctgttggtttcaccctcagaccgactcccggacattttacatcgcagagcaggtatctcaccatccacctgtcagtgcgttccacgtgtccaatagaaaggatgggttctgcatctcaggatctatcaccgctaagtctcggttttatgggaacagcctttcagccctcctggacggcaaagcaaccctgacattcctgaacagagccgaggactatactctcactatgccgtatgctcactgcaagggaattctatatggcactatgaccctcgagctgggcgggaaggtgacaattgagtgcgccaagaataattttcaagctcagctagagttcaagctcaagccattttttggtggttcgacatccatcaaccagattagtggtaagattacttctggagaagaagtgctcgcgtctctgagcggccattgggatagagacgtcttcataaaggaggaggggtctgggagtagcgccctattttggacaccaagcggcgaagtgcgcagacaaagactcagacaacacaccgtgcctttggaggaacagaccgagctggagtccgagcggctgtggcagcacgtcaccagagccatctctaaaggagaccagcatagagcgactcaggagaaatttgccctcgaggaggctcagagacagagggcacgggagcggcaagagagcctgatgccttggaagccacagttattccacttggaccctatcacacaagaatggcattaccggtatgaggaccattctccgtgggatcctctaaaggatatcgctcaatttgagcaggacggaattctcaggaccctgcaacaagaggcggttgcacgccaaaccacctttttaggatcccccggccctagacacgagcgcagcggtcccgaccagcgcctgcgaaaggcctcagatcagccatcaggacactcccaggcgactgagagctccggatcaaccccggagagctgcccagagctgagcgacgaagagcaggacggagatttcgtgcctggaggggagagcccctgtccgagatgtcgcaaggaagcacggcggttgcaagctcttcacgaagctatacttagcatccgagaagcccaacaggagctccaccgtcacctgagcgctatgttgagttccaccgctcgggcagctcaagcaccaaccccagggctgctgcagtcaccaagatcatggttcctgttgtgcgtatttctcgcctgtcagctgtttatcaaccacatcctaaagtag

SEQ ID NO: 127586 - DNA, 375 bp, Artificial Sequence
  Description of Artificial Sequence: Synthetic coding sequence
atgaaggaagaggcctttttaagaagacggtttagtctctgcccaccatctagcaccccacagaaggttgacccaaggaagctaacaaggaacttgcttctctctggggacaatgagttgtatcctctttctcctggcaaggatatggagccgaatggcccatccctccccagggacgaaggcccccccactccttcttcagctacaaaggtgccccctgctgaataccgtctgtgtaacggcagtgataaagagtgtgtgagtccgacagcgcgcgtcactaagaaggagaccctaaaagcccagaaagaaaattatcgacaggagaagaagcgcgctacaaggcagctcctgtctgccctgactgatccttag

SEQ ID NO: 127587 - DNA, 297 bp, Artificial Sequence
  Description of Artificial Sequence: Synthetic coding sequence
atgaaagaagaagcgttcctgcggcgaaggttctccctgtgccccccttcatcaacccctcaaaaagtcgacccccgcaagttgacccggaatctgttgctttccggcgataatgagttgtatccactttcaccaggaaaagatatggaacctaatggtcctagcctacctcgggatgaagggccacccacaccatccagtgccaccaaagtccctccagctgagtataggctgtgcaacggttccgataaggagtgtgtctctcccaccgctcgtgtaactaagaaagaaacttag

SEQ ID NO: 127588 - DNA, 420 bp, Artificial Sequence
  Description of Artificial Sequence: Synthetic coding sequence
atgaaagaggaggcttttttgagaagacgcttctccttgtgtccgccaagctctacccctcagaaagtagaccctcgtaagctaacacgcaacttactattgagcggagacaacgagctctaccctctgagcccaggcaaggacatggaacctaatggtccatctctcccacgcgatgaaggccctcccactcccagctccgcgacgaaagtgcctcctgctgagtatcggctctgcaacggatccgacaaggagtgtgtgagtcctacagcaagagtcacaaagaaggaaactttgaaagcccagaaggaaaattatcggcaggagaaaaagagggccacccggcaactgctgagcgcccttacagacccctccgtggtcatcatggctgatagcctcaagattcgaggcacattgtag

SEQ ID NO: 127589 - DNA, 273 bp, Artificial Sequence
  Description of Artificial Sequence: Synthetic coding sequence
atgaaagaggaagcattcttgcggaggcgtttttcgctctgccctccgtcgtccaccccccagaaggtcgaccccagaaaattaactagaaatctgctgctatccggcgataatgaattgtatccattaagtcccggtaaagacatggaaccaaacggtccttccctcccccgggacgaggggccgcctaccccaagctctgcaaccaaggttcctccagctgaatataggctgtgtaacgggtccgataaggaatgtgtgagccccacatag

SEQ ID NO: 127590 - DNA, 210 bp, Artificial Sequence
  Description of Artificial Sequence: Synthetic coding sequence
atgaaggaggaggcatttctgcgtcgccgtttcagcctgtgcccaccgtcctctaccccccagaaagtggatccgaggaagctgaccaggaacttgttgctgtcgggcgacaatgagctgtaccccctgagtccagggaaagacatggaacctaatgggccctcacttcccagggatgagggcccacccaccccctcgtcagccacctag

SEQ ID NO: 127591 - DNA, 1299 bp, Artificial Sequence
  Description of Artificial Sequence: Synthetic coding sequence
tataatccaattctgggggagacattcagatgctgctggtttcaccctcagaccgatagcagaaccttctacatcgccgagcaggtgtcccaccacccccccgtatcggctttccacgtgagcaacagaaaagatgggttttgtatttctggcagtataaccgctaaatcacgcttttatgggaattcactgtccgctttgctggatgggaaagccacactgacctttctcaatcgagcagaagactacactctgaccatgccctatgcccactgtaagggtattctgtacggtaccatgaccctggagctgggcggcaaagtgaccatagagtgcgcgaagaacaactttcaggcacagctcgagttcaaacttaagccattctttggtggatcaacaagtattaaccagataagtggaaaaatcacatctggcgaggaagttctggcatcactgtccggtcattgggaccgtgatgtctttattaaggaggagggaagtgggtcatcagctctgttttggaccccaagcggagaggtaagacgccaacgactgaggcagcacactgtgcctctagaggaacagacggagctcgagagcgaacggctgtggcagcacgttacacgggctataagcaagggagatcagcatagggctacgcaggaaaaatttgcccttgaggaggctcagaggcagcgtgctagggagcggcaagaaagcctgatgccttggaaaccacaactgttccacttggatccaatcacccaggagtggcactaccgctatgaagaccacagtccatgggaccctcttaaagacattgcccagtttgaacaggatggcattctgcggactctccaacaggaggctgtggctaggcagactaccttcctcggtagtccgggtcctaggcatgagagaagcgggcccgatcaacgcctgaggaaggcatcggaccaaccaagtggccactcacaggccacagagagttccggcagcacaccagagagctgtccagagctaagcgacgaagagcaggatggcgactttgttccaggaggagagtccccttgtccaagatgcagaaaggaggcccggaggctccaggcattgcacgaggccattttaagcatccgtgaagctcagcaggaactgcacagacatctgtctgctatgctctcttccacagcgagggctgctcaagcccccacaccaggcctcttgcagtcccctcgttcatggttcctgttgtgtgttttccttgcatgccagctgtttatcaaccatatcctcaagtag

SEQ ID NO: 127592 - DNA, 1533 bp, Artificial Sequence
  Description of Artificial Sequence: Synthetic coding sequence
atgtgtgtgccccatcgtcagggacaccaggaaggtgatagtcagggtgctgagggcgagctgcctgccggagaggagccgaggtcctttctcaacaagttatccgactactattatcatgcagacttgttgtctcgtgccgcagtggaagaagatgcatactcgagaatgaagttggtgctgcggtggtacctgtcaggcttctacaagaagcccaaagggataaagaaaccctataatccgattttgggcgaaactttccgctgctgttggtttcaccctcagacagactcccgtacgttctatattgccgagcaagtctcccaccacccgccagtctccgcatttcatgtgtctaataggaaggatggattttgtataagcggatctatcactgcgaaatcgcgtttctacggcaatagcttgtccgcgctgctagatgggaaagccaccctcacctttctcaacagagcggaggactacaccctgacaatgccctatgcccactgtaaggggattttgtacggcacaatgactttagaactgggcggtaaggtcacaatcgagtgtgcgaaaaataactttcaagcccagttagagttcaagttgaaacccttttttggcggtagcacgtctataaaccaaatatcaggtaaaatcacgtctggcgaggaagtcttagcgtctctctcgggacactgggacagagacgtgttcattaaggaggaggggtctgggagttcggcactattttggactcctagcggtgaagttaggaggcagcgcttgagacagcacaccgtacccctagaggagcagacagagctggagagtgagaggctgtggcagcatgtgacaagggcaatttcgaaaggcgatcaacatcgggccactcaggaaaagtttgctctagaggaggcccagaggcagagggccagagaaagacaggaatccctgatgccatggaagccacagttgttccacctggacccaatcactcaagaatggcactatagatacgaggatcattctccttgggaccccctgaaggatatcgcacagttcgaacaggatggtatcctgagaacactgcagcaggaggccgtcgcccggcaaaccacgttcctgggaagccccgggcctagacatgagcggtcgggacccgatcagagactgaggaaagccagcgaccagcccagcggccatagccaagccaccgaaagtagcgggtctaccccggaatcgtgccctgagctgtccgatgaggaacaggacggggactttgtgccgggcggcgagtccccttgtcctagatgcagaaaggaggcacggcggctccaggcattacatgaagctattctgagtatacgagaagcacagcaggaattacacagacacctgtcagcaatgttgagttccacagctagggcagctcaggcccccaccccagggctgctccagagccctcgctcttggttcctcctctgtgtgttcctcgcgtgccagctcttcattaatcacatactcaagtag

SEQ ID NO: 127593 - DNA, 2805 bp, Artificial Sequence
  Description of Artificial Sequence: Synthetic coding sequence
atgtcctccgatgagaaggggatctccccagctcacaaaactagcacaccaacacatcggtcagccagctcttccacctccagccagcgcgacagtaggcagtctattcatatcctggagcgcactgcctctagttcaactgaaccaagcgttagccgccagcttttggagcctgagccagtacctttgtctaaagaggccgactcttgggagatcatagaggggcttaagatcggccagaccaatgtccagaagcctgacaaacacgagggctttatgttgaagaaaaggaaatggcctctcaagggatggcacaagaggttctttgtgctggacaacggaatgctgaagtatagtaaagcgcctctggacatacagaagggcaaggttcacggatcgattgacgtgggcctgtcggttatgtcgattaaaaaaaaagccaggcggatcgacctagacaccgaggaacacatctatcacttgaaggtcaagagccaagattggttcgacgcgtgggtgagtaagcttaggcaccatcgattgtatcgccagaacgaaattgttcgatcaccccgcgacgcctcgttccatatatttcctagcactagtacagccgagtctagccccgctgccaacgtgagtgttatggacggtaaaatgcaacccaattctttcccatggcagagcccactcccatgtagtaatagcctacctgcaacttgcaccacaggccaaagcaaggtagccgcatggctgcaggattccgaagagatggacagatgcgcagaagatctggcccattgccagtcaaatttggttgaattaagtaaactgctccagaatctggagatcctgcagcgaacacaaagcgctcctaattttaccgacatgcaggcaaattgtgttgatattagcaagaaagacaaaagagtcaccagacgctggcgaacgaaaagcgtgagcaaggacaccaagatacagctgcaggtgccattcagtgccaccatgtcgcctgtcaggttacatagttcaaatcctaacctttgcgcggacatcgaatttcagactcctccttctcaccttaccgaccctctggaatcctccacggattacacaaagctccaagaagagttctgtcttatcgcgcagaaagtgcactcactgcttaagtcggcattcaattcgatagctattgaaaaagagaaacttaagcagatggtgagcgagcaggatcattctaagggtcactctacacagatggcgcgattgagacagtcactgtcccaagcgcttaatcaaaatgccgagctcagaagtagactgaatcgtatccacagtgagtctatcatctgcgatcaagttgtgagcgttaatattattccctccccagacgaagctggagagcaaatacacgtctctctgcctttgagtcaacaggtagccaacgaaagtcggctcagtatgagtgaaagtgtgtccgaatttttcgatgcccaggaggtgcttctgtcagcctcttccagcgaaaatgaggcgagtgacgacgaatcatatatctcagatgtgagcgacaatatcagtgaagacaatacctcagttgccgataatatatcaaggcagattctgaatggcgagctgacgggtggggcctttaggaatggaagaagggcgtgcctcccagccccctgtcccgataccagtaatatcaacctatggaatattttacgcaacaatatcggaaaagacctttctaaggtgtctatgcccgtcgaactcaacgagcctttaaacaccctccagcatctgtgtgaggaaatggagtatagcgagcttctcgataaggcgagcgaaacggatgatccatacgaacgaatggtcttagtggcagcattcgcagtgtctgggtactgttcaacatacttccgggcaggcagtaagccgtttaacccggtgctaggagagacctatgaatgcattcgggaggacaagggattcaggttctttagcgaacaggtgagccaccatccaccaataagcgcatgccactgcgagagcaagaattttgtgttctggcaggatatccgctggaaaaacaaattctggggcaagtctatggagatcctgcctgtgggaacgttgaacgtgatgctacctaagtacggagattattatgtgtggaataaggtgacaacatgcatccataacatcctgagtgggaggaggtggatcgagcactacggcgaggtgaccatcagaaacaccaagtccagtgtttgtatttgtaaactgacctttgtcaaagttaattactggaatagtaatatgaacgaggtccaaggtgttgtgattgaccaggaggggaaggctgtgtaccggcttttcgggaagtggcacgaaggattgtactgtggtgtcgccccctccgccaaatgcatctggaggcctggcagcatgccaactaattacgagttgtactacggatttacccggttcgccattgaattgaacgagctggaccctgtgctgaaagacctgttaccacccaccgatgctcggtttcgccccgatcagaggtttctagaagaaggcaatctggaagccgccgcatccgagaaacagagagtggaagagctacagcggtcacgcagaagatatatggaagagaacaaccttgagcacatcccgaagttctttaagaaggtcattgatgcgaatcagcgcgaggcctgggtgtctaacgacacatactgggagctgaggaaagacccaggattcagtaaggtcgactccccggtcttgtggtag

SEQ ID NO: 127594 - DNA, 2817 bp, Artificial Sequence
  Description of Artificial Sequence: Synthetic coding sequence
atgcatcagctttccctcattcgcggcaaccgcgggaggagtatacatattctggaacgcactgcttcatccagtacagaaccgtccgtgtcccggcaactcctggaaccagagcccgtcccactctctaaggaagccgatagttgggagatcatagagggcttgaaaatagggcagacgaacgtgcagaagcctgacaaacatgaagggttcatgctcaagaaaaggaagtggcccctgaagggctggcacaagcggttctttgtgctcgataacgggatgctcaaatatagcaaggctcccttggacatacagaaggggaaggtgcacggttctatcgatgtgggattgagtgtgatgtctataaagaagaaggccagaagaatagacttggacactgaagaacacatctatcatcttaaggtgaagagccaagactggttcgacgcctgggtgtcaaagctgcggcatcaccgcctctataggcaaaacgaaattgttcggtcacccagagacgctagttttcacatttttccatctaccagtacagccgaaagcagcccagccgcgaatgtttcagtcatggatggcaaaatgcagcctaatagtttcccttggcagagccccctgccctgtagtaactccctgccggccacatgcaccacaggccagagcaaggtggcagcctggctgcaagatagcgaggagatggatcggtgcgccgaagacctcgcacattgccagagcaacctggtggagttgagcaagttacttcagaaccttgagattctgcagaggacgcagagtgcccccaattttacagacatgcaagccaactgcgttgacatctccaaaaaagacaagcgagtcactagaaggtggagaaccaaaagcgtgtcgaaggatacaaagatacagcttcaagagggaccgccagccaagggtcagttctccaccactaggaggagacagcgactggccgcagccgtggccacgaccgtcccattctcagccacaatgtcacccgtgcggctgcactccagtaatcctaatctctgtgccgatattgaattccagacacccccatctcatctcacggaccccctggagtctagtacagattataccaaattacaagaagaattctgcttaatcgcgcagaaggtccatagccttctgaaatcggcttttaattccattgcgatcgaaaaagagaaacttaagcaaatggtcagcgagcaggaccacagtaaaggccactccacccagatggcgcggctgcgccagtccctgtctcaagccctcaatcagaatgccgagctgcgatccaggctgaacaggatccacagcgaatccataatttgcgaccaggttgtctccgtcaatatcattccctctccagatgaagctggggaacagatccacgtgagcctcccactctctcagcaggtcgctaacgaatccagactgtccatgtcagagtcagtgtccgagttcttcgacgcccaggaagtgttgttgtccgcttcctcatccgaaaatgaagcaagcgatgacgagtcatacatttcagatgtttctgataacatatccgaggacaatacttcggtggctgacaatatcagtaggcagatcctcaatggtgagttgacaggcggcgccttccgaaatggccggcgtgcctgcctgcccgcaccatgcccagacacaagcaatatcaacttgtggaatattttaaggaacaatataggaaaggacctttctaaggtttctatgcctgtggagctgaacgaaccgctgaacaccctgcaacatctgtgcgaggaaatggaatatagcgagttgttggataaggcgtccgagacagacgacccctacgagagaatggtcctggttgccgccttcgccgtgtctgggtactgcagcacctatttccgagccggttctaaacctttcaatccagttcttggcgagacatacgagtgtattagagaggataagggttttaggtttttctctgagcaggtttcacatcatcccccaatatctgcttgtcattgcgagtccaaaaactttgtgttctggcaggatatacgatggaaaaataagttctggggaaagtctatggagattctgcctgttgggacacttaacgtgatgctgcccaagtacggagactactacgtatggaataaggtgaccacatgtattcataatattctttctggaaggagatggattgagcattacggagaggtcaccattcggaatacgaagagctcggtgtgcatttgtaagcttaccttcgtcaaggtgaattactggaatagtaacatgaacgaggtacagggggtggttattgaccaagagggtaaagcagtctaccggctttttggaaagtggcacgaaggactgtactgcggtgttgcgcccagcgctaaatgtatctggagacctggcagcatgcccactaactacgagctgtattacggcttcacacggtttgctattgagttaaacgaactggaccctgtacttaaggaccttttaccacctactgatgctcggtttcggccagatcaacggtttctggaggaggggaatctggaagctgctgcttctgagaagcagcgggtagaggagcttcagagatcccgacgtcgatacatggaggagaataatctggagcacattccaaagttctttaaaaaagtgattgacgccaatcagagggaagcttgggtctcaaacgatacttattgggagttgaggaaggacccgggtttcagcaaagtggacagccccgttttgtggtag

SEQ ID NO: 127595 - DNA, 2697 bp, Artificial Sequence
  Description of Artificial Sequence: Synthetic coding sequence
atgtcctctgatgagaaaggcatttcgcctgctcacaagacatctacgcccacccatcggagtgcgtcctcttctaccagcagtcagcgggactcgagacagtccatccacatcctggagcggaccgcatccagctccacggaaccctccgtcagtagacaactgctcgagccagaacctgtaccactgagtaaggaggcggactcctgggagattatcgaaggactgaagatcggtcaaacgaacgtgcagaagccggacaagcatgaaggtttcatgctcaagaagcggaagtggcccctgaagggttggcataaacggtttttcgtccttgacaacggtatgctcaagtacagtaaagcgccacttgacatccaaaaaggcaaggtccacgggagtattgacgtcggcctgagtgtcatgagtatcaaaaagaaggcgagaagaatcgatttagacaccgaagaacatatttatcatctgaaagtgaaaagccaagattggtttgatgcctgggtgtcaaaattaaggcatcaccgtctgtacaggcagaacgaaatcgtgcgtagtcctagggatgcctcctttcatatctttcctagcacctctacagcagaaagttcacccgccgctaacgtgagtgtcatggacggcaagatgcaacccaatagcttcccttggcagagtcccctgccatgttcgaatagtctccctgctacatgcacaaccggccagtccaaagttgctgcttggttacaagacagcgaagaaatggatcgttgtgctgaagatttggcccattgccagagcaacctcgtcgaactgtcaaagctgctgcagaatctagagattctgcaacggacgcaatccgctcccaatttcactgatatgcaggcgaattgcgtcgatatctcaaaaaaggataaaagagtcacacgacgatggcggaccaagtccgtctctaaggatactaagatacagttgcaggtcccattcagtgctactatgtctccagtaagactgcacagtagcaatccaaacctatgcgcagacatcgagttccagactcctccaagccacctcaccgacccgcttgagtccagcaccgactacaccaagctccaggaagaattttgcctgattgcccagaaagttcactctctcctgaagtctgcattcaatagcatcgctattgagaaagagaaactgaaacaaatggttagtgaacaggatcactctaaaggccactcaacacagatggctcggcttcgccagagtctgtctcaggcaggtgagcagattcacgtgtctctgcctctcagccaacaggttgcaaacgagtccaggctgtctatgagcgaaagtgtgtctgaattcttcgacgctcaggaggtgctgctgagcgctagctctagtgagaatgaggcgtcagatgatgagagttacatctctgacgtgagcgataatatcagtgaggataacacttcagtggctgacaacatctcccggcagatcctgaacggggagctgactggaggagccttccgaaacgggagacgtgcatgtcttcccgctccatgtcccgatactagcaacatcaacctgtggaacatcttgagaaataacattgggaaagacttaagcaaggtctcaatgcctgtggagttaaatgagcctttaaacacattacagcatttatgcgaggagatggagtattccgagctgctagacaaagcttctgagacggacgacccctatgaacgaatggttttggtcgctgccttcgccgtaagtggatactgtagcacctacttcagggctggctcgaaacctttcaacccagtactgggtgagacctacgagtgcatccgtgaggataaaggattccgttttttttccgagcaagtgtctcaccatccgccaatcagcgcttgccactgcgagagtaagaactttgtgttctggcaggacatccgctggaaaaacaaattctggggaaaatcaatggaaattctgccggtcggtacacttaatgttatgctcccaaaatacggcgactactatgtgtggaacaaagtcaccacctgcatccataacattttgtccggtcgcagatggatcgagcactatggcgaagtcacaatccgcaatacgaaaagtagtgtgtgcatctgtaagctgacctttgttaaggtgaattattggaattccaacatgaacgaggtgcagggggttgtcattgatcaggaggggaaggctgtgtaccggttattcggcaaatggcatgaaggcctgtactgcggcgtcgcccccagtgcgaaatgtatttggcggcctgggtcaatgcctaccaactacgaactgtactatggcttcacccgcttcgccatcgagctgaacgaactggatccagttctgaaagacttgctgcctcctacggacgcccggtttagacccgatcagcgtttcctggaagaagggaatcttgaagctgctgccagcgaaaagcagcgagtggaggaactgcaaaggtcacgtcggagatacatggaggagaataatcttgagcacatccccaaatttttcaaaaaagtaattgacgctaatcaacgagaggcatgggtttccaacgacacctactgggaattaagaaaggatccaggctttagtaaagtagactcacctgttctgtggtag

SEQ ID NO: 127596 - DNA, 573 bp, Artificial Sequence
  Description of Artificial Sequence: Synthetic coding sequence
atggacggcaaaatgcaacctaactcttttccttggcagtcaccactcccttgcagtaactccctgccagccacctgcactactgggcagtccaaagttgctgcctggttgcaggactcagaggagatggacaggtgtgctgaagaccttgcacactgtcagagcaatttggtagaactctcgaaactccttcaaaatctggaaatcctacagagaacccagagtgccccgaatttcacagatatgcaggcaaattgtgtggacatctctaagaaagataagagggtgaccagacggtggaggaccaagtccgtctctaaggacactaaaattcagctgcaggtgccatttagcgccaccatgagtcccgtgcggctgcactccagcaatccgaatctttgtgcggatatcgaatttcagacaccaccacctaatcacttcggcatcctgagcgttcttctgcaaccttactctctcaagaaaaagaagaaaaagaagaagaaaagcactccgtcgcttgagagtaggattaagggcgccgaatataagattcaaagcctgacttcactgtag

SEQ ID NO: 127597 - DNA, 2880 bp, Artificial Sequence
  Description of Artificial Sequence: Synthetic coding sequence
atgagcagcgatgagaagggaatatctccagctcacaagacctccacacctactcatcggtctgcttcctcttcaacctctagccaaagagattcacgacagtctattcacattctagagaggactgcgtcgtcttctactgagccctctgtgtcaagacagcttttggagccagagccggtgcccctgtcaaaggaagcagattcctgggagatcattgagggcttaaagatcggacaaaccaatgttcagaagcctgataaacatgagggctttatgctcaagaaacgcaagtggccgcttaaaggttggcataaaagattctttgtgctagataatggcatgcttaagtactccaaggcccccctggatatacagaaagggaaagtccatggcagcatcgatgtcggccttagcgtcatgagcattaagaaaaaggcccgacgtattgatctggataccgaagaacatatctaccacctgaaagtcaagagccaggactggttcgacgcatgggttagtaagttaaggcaccacagactgtatagacagaacgaaatcgtgcgctctcctcgcgacgccagcttccacatcttcccttccacctcaacagccgaaagctctcctgccgcgaatgtctctgtcatggatgggaaaatgcagcctaactcattcccttggcagagcccccttccttgcagtaatagcctgcccgccacatgcaccactggtcaaagcaaagtcgctgcctggctacaggactccgaggaaatggatcgatgtgcagaggatttggcccactgtcagtcaaatctcgttgaactctccaagctgctacagaacctggaaatccttcaacgaacacagagtgccccaaactttacagacatgcaggcgaattgtgtcgatatcagtaagaaggacaagagggtcacaagacggtggcgtactaagagtgtaagcaaagatacaaagattcaactccaagaagggccacctgccaaaggacagtttagtaccacccgccgaaggcagcgattggctgctgcagtcgccaccacagttcctttctctgccaccatgtcccctgtgcggctccactctagtaatcccaacctctgcgccgatatcgaatttcagacacctcccagccacctgaccgatccccttgagtccagtacagattacacgaagctccaggaggaattttgcttaatcgctcagaaagtgcacagcttactgaaaagtgcctttaatagtatcgcaatcgagaaggagaagctaaagcaaatggtgtccgagcaagaccactctaaaggccatagtacccagatggctcggctgaggcagtctcttagccaagcactcaatcagaacgccgagcttcgatcccgtcttaatcgaattcattcggagtccattatctgtgatcaggtagttagcgttaatatcataccgtctcctgacgaggccggcgaacagatccacgtaagccttcccttgagccagcaggttgcaaacgagtctagattgtcgatgtccgagagtgtgtcagagttcttcgacgctcaagaggtacttttaagtgcaagctctagcgagaatgaggcatctgacgacgaatcgtacatttccgacgtctccgacaatatctctgaggacaatacctcggtcgccgataatatatcaaggcagattctgaatggcgaactgacagggggggcattccggaacggcaggcgggcctgtctgcctgctccatgccccgataccagcaatattaacctttggaacatcctgaggaacaacatagggaaagacctttcaaaggtttccatgcccgttgagctgaatgaacctcttaacactctccagcacctgtgcgaagagatggaatattcagagctgctggataaagccagcgaaaccgatgatccctacgagcgaatggtgcttgtggctgcgttcgccgtctccggctactgctcaacctattttcgggcaggaagcaaaccatttaaccctgtcctcggagagacatacgagtgcatacgcgaggacaaaggatttagattcttttctgagcaagtatcccaccaccctccgatttctgcatgccactgcgaaagtaagaattttgttttttggcaggacattcggtggaagaataagttctggggtaaaagcatggagatcctcccggttggcaccctcaacgtgatgctcccaaagtatggagactattacgtttggaacaaagttactacttgcattcacaatatactgtcaggaaggcgctggattgagcactatggggaggttacaatacgcaacactaaaagcagcgtttgcatttgtaagctgacctttgtaaaagttaattactggaactcaaacatgaacgaggtccagggagtggtgatcgatcaagagggcaaggctgtgtaccggctgtttggcaagtggcatgagggcctctactgcggggtggcgccctccgccaaatgcatttggaggcccggatccatgccgacaaactacgaattgtattacggcttcacacggtttgccatcgagcttaacgagctggacccagtactgaaggaccttttgccgcctaccgatgccaggttcaggccagaccagaggttccttgaggagggaaacctggaagccgcagcaagtgaaaagcagagggtcgaggaactccagcgctcgcggcggcggtacatggaagaaaacaaccttgaacacatcccaaaattctttaaaaaagtgatagatgccaaccaacgcgaggcctgggtgtctaacgacacatattgggagttgcgcaaggatcctggattctccaaggttgactcgcccgtactgtggtag

SEQ ID NO: 127598 - DNA, 2712 bp, Artificial Sequence
  Description of Artificial Sequence: Synthetic coding sequence
atgtcttctgacgaaaagggcatctctcccgcacataagacttccactccaactcaccggagcgcttctagttccacttctagccagcgagacagtcggcaatcaattcacattctggagcgaactgcttcttcctctaccgagccctcagtgtcacgtcagctgttggagccagagccagtgcctctgagcaaagaggccgattcttgggagatcatagaaggtctgaagattggacagacaaatgtccagaaacctgataaacatgagggcttcatgctgaagaagcgcaaatggccactgaaaggttggcacaagcggttcttcgtccttgataatggaatgctcaagtactccaaggcacccctggacatccagaagggtaaggttcatgggtccatcgacgttgggctcagcgttatgagcatcaaaaagaaggctcgccggattgacttggacaccgaagagcacatatatcatttgaaagtcaaaagccaggattggttcgatgcctgggtatccaaattacgtcatcacagattataccggcagaacgagattgttagatctccccgcgacgctagttttcatatattcccttccacgtcaacagcggagtccagccccgcagctaatgtcagtgtaatggacgggaaaatgcagccgaacagttttccatggcagagccccttgccctgttcaaattcccttcccgcgacgtgcaccaccgggcagagtaaggtggcagcctggctgcaggattcggaggagatggatcgctgtgctgaggatttagcgcactgtcagagcaaccttgtggaactgagtaagctactccagaatctggagattcttcagcgaacacagtccgccccaaattttactgacatgcaggtccccttctcagccactatgtccccagtgagattgcactcttccaatccaaacctttgcgccgacatagagttccagacacccccgtctcatcttaccgacccgttggagagctcaacagactacacaaaactgcaggaagaattttgcctaatagcacagaaagtccactctttgctcaagagcgccttcaactccattgccattgagaaggagaagttaaagcagatggtttccgaacaagatcattctaagggtcactccacccagatggccaggctgcgccagtctctgtctcaggctttgaaccagaatgctgaacttcgcagccgtctgaatcgtatccattcagaatccataatctgcgatcaggtggtgagtgtcaatatcattcctagccccgacgaggccggcgagcagatacatgtttccttgcctctgtctcagcaggtcgccaatgagagccggttaagtatgagtgagtcggtgtccgagttcttcgatgcacaagaggtactgttaagtgcatcgtcctctgaaaacgaggccagcgacgatgagtcttatattagcgacgtgtctgacaatattagcgaagacaatacaagcgttgcagacaacatttcccgtcaaatcctgaatggtgagcttaccggaggagcattccgaaacggtcgtcgcgcctgcttgcccgctccctgtcctgacaccagtaacattaatttgtggaacatcctgaggaacaacattggcaaagatcttagtaaagtgagtatgcctgtggagttaaatgaacctttaaacacccttcagcacttatgcgaggagatggaatacagtgagctcttggataaagcgtctgaaacagacgacccttacgaaaggatggtcctcgtggccgccttcgccgtttcagggtattgttccacctatttccgcgctggcagcaaacccttcaacccagtcctgggagagacctatgaatgcattcgggaagataaaggcttcaggttcttcagcgagcaggtgtcccatcaccccccgatctctgcttgtcattgtgaatccaagaacttcgtgttctggcaagatattaggtggaagaataaattttggggaaagagtatggaaatcttgccagtgggcactctcaacgttatgttgcccaagtacggagattattacgtctggaacaaagtaaccacctgtatccataacattttgtctgggaggcggtggatagaacattacggggaggtgactattagaaatacaaaatccagcgtttgtatttgtaaactcacatttgtgaaggtgaactactggaattccaacatgaacgaggtccagggagtcgtaatcgatcaggaggggaaggcggtgtaccggctgtttggaaagtggcacgaggggctttactgtggagttgcacccagcgcaaagtgcatttggcggccaggaagtatgcccacaaactacgagttatattatggattcacccgattcgcaattgagctcaatgaactggacccagttctgaaagatctcctgccacctactgatgcaagatttcgacctgatcagcgcttcctcgaggagggcaatctggaagcagctgctagcgaaaagcaacgagtcgaggaactccagcgctccaggcgaaggtatatggaggaaaacaacctcgagcacatccctaaattttttaaaaaagtcatagacgccaaccaacgcgaggcttgggtcagtaatgacacttattgggaactaaggaaggaccctgggttttccaaagtggactctcccgtgctgtggtag

SEQ ID NO: 127599 - DNA, 2529 bp, Artificial Sequence
  Description of Artificial Sequence: Synthetic coding sequence
atggattttcaagagagggatccccccttcctgcccgagtcagcccaaagctccaagccctcttctgcacagcaggcctcagaactgtgggaagttgtcgaggagccgagggtgagactgggcaccgagggtgtcatgcccgagagacaggagggtcacctgctcaaaaaacgaaaatggccactgaaaggttggcacaaacgttacttcgttcttgaggacggcatcctgcattatgctactacacggcaggacatcactaaagggaagcttcacggatcaatcgacgttaggttgagcgtcatgagtattaataaaaaagcccagaggatcgacctagataccgaggacaatatataccacctcaagataaagtcccaggacctcttccaatcttgggtcgctcagctgcgagcacataggctagcccatcgcctggatatgccgcgcgggtccctcccctccaccgcgcatcgaaaagtgccaggagcccagttacctacagcagccactgcaagtgccctgcctggtttagggccacgggaaaaagtgtctagctggttgagagactccgacggactggatcgttgctcgcatgagctgagcgaatgccaggggaaactgcaggaactgcaccgcctgctccagtcacttgagtccctgcaccggatcccttctgctcctgtgatccctacccaccaggcaagtgtgaccacagagcgccccaagaagggcaagaggacgtccaggatgtggtgtacgcagtctttcgccaaagacgacacaataggcagagtcggcaggctccatggctctgtaccaaatctctctaggtatcttgagagccgagattcatctggcactcgaggtcttccacctacagactacgcacacttacagcggtctttctgggcactggcacagaaggtacactctagtctgtctagcgtgcttgctgctttaacgatggagcgggaccaactgcgggacatgcatcaggggtcggagctttcacgcatgggagtctccgaagcttctactggacaacgccgcttgcatagtttatccacctccagcgacaccactgccgactctttctcaagcttaaaccccgaagaacaagaagcactatatatgaagggccgcgagcttacaccgcagctgtctcaaacgtcgattctttcactggcagactcacataccgagttctttgacgcctgcgaagttctcctgtccgcctcttcctcagagaatgagggatctgaggaagaagagtcgtgcaccagcgaaatcaccacgagtctgtccgaggagatgctggacctccggggagctgagaggtgccagaaaggaggctgtgtccctggcaggccgatgggtcctccccggagaagatgtctaccagccgcttccgggccaggagccgacgtgagcctctggaacattctgagaaacaatatcggcaaggacctgtcaaaagtgtcaatgcccgtacaactgaatgagcctttaaataccctgcagaggctttgcgaggaacttgaatattcatcactgctggaccaggctagccgcatcgccgatccttgcgagagaatggtctatatcgctgcctttgcggtgtccgcctattcctccacttatcatcgcgccggctgcaagccattcaatcctgttttaggtgagacttatgagtgcgagcggcccgaccgcggcttcaggtttatctctgaacaggtgtcacaccatcctcccattagcgcctgccatgctgagtcagagaatttcgcattttggcaggacatgaaatggaaaaacaagttttggggcaagtccctggagattgtcccggtcgggactgtgaacgtcagtttgccaagattcggggaccacttcgagtggaacaaggtcaccagctgtatccataatgtgctgagtgggcagcggtggattgagcattacggagaggtcctgattaggaacacgcaagactcctcctgtcactgtaagatcaccttttgcaaagccaagtactggtcaagcaacgttcacgaagtgcagggggctgtactctccagaagtggtcgggtcctccacaggttgttcggaaaatggcacgagggattgtacagaggccctactcccggtgggcagtgcatatggaagcctaactccatgcctcctgaccacgagcgtaacttcggattcacccagtttgccctcgagctgaacgagctgactgcagagctgaagcggtctttgccctctacggacactcggcttagaccggatcaaaggtacctggaggagggcaatatacaggcagccgaagcccagaagcgcaggattgagcaacttcagcgtgatagaaggaaggttatggaggagaataatatcgttcatcaagctcgtttctttagacgacagacagactcatcaggaaaggagtggtgggtaacaaacaatacatactggagacttcgcgccgaaccaggctacgggaatatggatggagcagtcctctggtag

SEQ ID NO: 127600 - DNA, 2529 bp, Artificial Sequence
  Description of Artificial Sequence: Synthetic coding sequence
atggactttcaagaacgcgaccctccctttctgcctgaatccgcccagagctcaaagcctagcagcgcgcagcaggcaagtgaactgtgggaggtggtcgaggagcccagggttaggctgggtaccgaaggcgtgatgcccgaacggcaagaggggcacctcctgaagaaacggaagtggcctctgaaaggatggcacaaaaggtactttgtcctggaggacggcatactgcattacgccacgaccagacaggacattacgaagggcaaactccatggatccatcgacgtgcggttgtctgttatgagtatcaataaaaaagcccagaggattgatctagacacagaggataatatataccatctgaagattaagtcccaagacctgttccagagctgggtcgcccagttgagggctcaccgcctggcacatcgtctggatatgcccagaggatccctgccaagtactgcccacagaaaagtccccggggcacagctccctactgcggctacagcctcggccctccccggactgggccctcgagagaaggtgtcatcttggctgcgtgacagtgatggcctggatcggtgctctcacgaactctctgaatgtcagggaaaactccaagaactgcaccgtctgctacagtccttggagtcacttcatagaatacccagtgccccagtaataccgacccatcaggctagcgtcaccaccgaacggccgaaaaaaggtaagcgtacgtccagaatgtggtgcactcaatcattcgccaaagatgatacaattggtagagtcggaaggttgcatgggtccgtcccaaatctgagtcgatatttagagtcccgtgacagctccggaacacgaggcctcccaccaaccgactacgcacacctgcaaaggagcttctgggcactggcacagaaggtgcactcctccctgtcttccgttctggccgcccttacaatggagagggaccagttgcgggacatgcaccagggttccgagctgtctcggatgggagtgtctgaagccagcactggccagaggagactgcattctcttagtacatcctccgatacaacagcagatagcttttcctctttaaatccagaggaacaggaagccttgtatatgaaggggagagagttaacacctcagctgagccagactagcatactgtccctggccgactctcacactgaattctttgacgcttgtgaggtcttgctgagtgcctccagcagtgaaaacgaggggtccgaggaggaggaaagctgtacatcagagatcaccaccagtttgtccgaagaaatgctcgacttgcggggtgccgaacgttgccaaaagggaggttgcgtgccaggacgacctatgggaccaccccggcgtagatgtctgcccgccgcctcgggccccggcgctgacgtgtccttgtggaatatcctccgtaataacattggcaaggacctgtcaaaagtgtcgatgcctgttcagttaaatgagccactgaacacactacagagattatgcgaggaattggagtactcatcattgttggaccaggcctcccggatagcggacccctgcgaacgcatggtgtatatcgctgcatttgccgtcagcgcatattcttctacatatcaccgcgccggctgcaagccttttaaccctgtgctgggggaaacttacgagtgtgagcggccagatagaggctttcgcttcatctctgagcaagtctcacaccacccgcccatttctgcctgtcatgctgaatctgagaacttcgcgttctggcaagacatgaagtggaaaaataagttttggggtaagagcctggagatcgtgcccgtgggaacggtgaacgtcagcctgccaagattcggagaccactttgagtggaataaggtaacctcctgtatccacaacgtcctgtctggccaacgatggatagagcactatggagaggtcctgatcaggaatacgcaggattcctcttgtcactgcaaaatcactttctgtaaggccaagtactggtcaagtaacgtccacgaagtgcaaggcgccgtcctgtccagaagtggaagggtgctgcatcgactcttcggaaagtggcacgaagggctgtacagaggaccgactcccggaggtcagtgtatttggaaaccgaatagcatgccccctgaccatgaacgtaacttcggattcacccaattcgccctcgaacttaacgaactgaccgctgagctgaagcgcagcctgcccagcacagacaccaggttacggcctgaccagaggtacctggaagaaggaaatatccaggcagccgaggcacagaaaaggcggattgagcagcttcagagggataggaggaaggtgatggaggaaaacaatattgtgcatcaagccaggttctttagacgacagaccgactcatccggcaaggaatggtgggtcaccaataacacctactggaggttgagagcggagcccggatacgggaacatggatggcgccgtgctctggtag

SEQ ID NO: 127601 - DNA, 2670 bp, Artificial Sequence
  Description of Artificial Sequence: Synthetic coding sequence
atggaggggggcctcgcagacggagagcccgatcgcacctcactgctgggcgacagcaaagacgtcttgggcccgagcaccgtggtcgccaattctgatgaaagccagctgttgactcccggaaagatgtcccagcgtcaaggaaaagaggcttacccgacgcctactaaagaccttcaccaaccttccctgtcccctgcatccccgcacagtcaaggttttgagcgaggtaaggaggatattagccagaacaaggatgagtcctcactctccatgagtaaaagtaaatctgagtctaagctgtataacggaagtgagaaggacagttccacttcaagcaagttaacaaagaaagaaagcctgaaagttcagaaaaaaaattaccgtgaagagaagaagcgcgccactaaagagctgctgtccacaatcacagatccatccgttatcgtaatggccgattggctgaagatccgtggaacgctgaaatcatggactaagttatggtgtgttctgaagcccggggtcctgttgatctataaaacccagaagaacggacaatgggtgggcacagtgctgttgaacgcatgcgaaataatcgaaagaccatcaaaaaaagacggcttttgtttcaagctgtttcatccactcgaacagagtatatgggcagtgaagggccctaagggagaggcagtgggaagcatcacccagccactcccatccagctatttgatcattcgggctacctctgagtcggacgggcgctgttggatggatgctctggagctcgctttgaaatgcagctcattactgaaacgtacgatgattcgagaaggcaaggaacacgacctgtctgtgtcctctgattcaacacacgtaaccttttacggcctgctgagagcaaataatctccattcaggagataacttccagctgaatgactcggagattgagcgccagcattttaaagatcaggacatgtacagcgacaaatcagataaggaaaatgaccaggagcacgatgaatcagacaacgaagtgatgggtaaatcggaggaatctgacactgacacaagcgaaagacaggatgattcctatatcgaaccggaacctgtggaacctctgaaggaaacgacctacacagagcaaagccacgaggaactcggggaggccggcgaagcctcccagacagagaccgtgagcgaggagaacaaaagccttatctggaccctcctcaagcaagtgagaccaggaatggatctgtcaaaggttgtcttacccacatttatcctggagccacgttcgtttctggacaagctgtccgattactactaccacgccgattttttgtccgaagccgcactggaggaaaatccttacttcaggctgaagaaagtcgtgaaatggtatcttagtggcttctacaagaaacctaaggggctgaagaagccatataatccaatcttgggagaaacattcagatgcctgtggatccatcctcgcacaaacagcaaaacgttctatattgccgagcaggtttcacaccatcctcctatcagtgcgttttacgtctccaatcgcaaagatggattttgtcttagcggctctatattagccaaatcaaagttttacggtaactctctttcagcaatactggagggtgaagccagactaacatttctgaacaggggtgaggactatgtaatgacaatgccttatgctcactgcaagggcatcctttacgggacaatgacccttgagctcgggggaaccgtgaatataacctgtcagaaaacaggctatagcgccattttggagtttaagcttaagcctttcctgggatcttctgactgtgttaatcagatttctggcaaattgaagctcggaaaagaagtgctggccaccctggaaggtcattgggatagcgaagtgtttataactgataaaaaaaccgacaactccgaggtcttttggaaccccacgcctgacatcaagcagtggcgcctgatcagacacacggtgaagttcgaagagcagggagacttcgagtccgagaaactgtggcagcgagttacaagagcgatcaatgccaaagaccaaaccgaagccactcaagaaaaatacgtgctggaagaggctcagaggcaggcagctcgggaccgtaaaacaaaaaacgaggagtggtcttgtaagttgtttgaactggacccgctcactggcgaatggcactacaaatttgccgacacccggccctgggacccattgaacgacatgatccagtttgagaaggatggcgtgatacagacaaaggttaaacacagaacaccaatggtgtcagtaccaaagatgaagcacaaaccgactcgccagcaaaagaaggttgccaaaggttattccagccccgaacctgacatacaggactcttcaggaagcgaggcacaaagtgtgaaaccgtcgactaggagaaaaaagggtatcgagttgggggacatacagagttccatcgaatctatcaagcaaacccaggaagagattaagcgaaacataatggccttgcggaaccacctggttagctctactccagccactgactacttcctgcagcaaaaagactacttcattatttttctcctcattctattgcaggtcatcataaatttcatgtttaaatag

SEQ ID NO: 127602 - DNA, 2544 bp, Artificial Sequence
  Description of Artificial Sequence: Synthetic coding sequence
atgtcgcagaggcaaggaaaagaggcctaccctacacccaccaaagatctccatcagccatctctgtctcccgccagcccacactcccaaggattcgaacgaggcaaagaagacatttcccagaataaggatgagtcttcgttatctatgagtaagagcaagagcgagagcaaattgtataatggcagcgagaaggacagttcaacatcgtccaagctgaccaagaaagagtctctcaaagtacagaagaagaattaccgggaagaaaaaaagcgagccaccaaggagcttctgtccactattaccgatccttccgtaatcgtgatggcagattggctcaaaatacgaggcaccctgaaaagttggactaagttgtggtgcgtgctcaagcccggcgtgttgctgatctacaaaacccagaagaatggtcagtgggttggaacggttcttctgaacgcttgcgagattattgagcgcccctctaaaaaagacgggttctgtttcaaactcttccatcccctggagcagagcatttgggcagtgaaggggccgaagggggaagccgttgggagtatcacacagccccttccttccagttacctcattatcagagccacctctgaatcggatggtcgctgttggatggatgctctggagctggctctgaaatgcagcagcctgcttaaaagaactatgattagagaaggaaaggaacatgatttgtctgtgtcctcagactccactcacgtaacattctacggcttgctgcgagcgaacaacctacactccggcgacaactttcagctgaacgactcagaaatcgaacgccagcactttaaagaccaggacatgtattctgataagtctgacaaagaaaacgaccaggagcatgacgagtcagacaacgaggtgatgggcaaaagtgaagagtccgacacagacacctcagagagacaggatgatagctacattgagccggagcctgtggagcccctgaaggagactacgtatactgagcagagccatgaggaactgggcgaggctggcgaggcctcacagaccgaaactgtgtcagaagaaaataaatctctgatctggaccctcctaaagcaagtgcggcccggcatggacttgtctaaagtcgtgcttcccacctttatcctcgagccacgctctttcttagataaattgtctgactactactaccacgccgattttctcagtgaagctgcacttgaggagaacccgtacttcagattgaagaaagtagtgaagtggtacctgtccgggttctacaaaaagcccaaaggtctcaaaaagccatacaaccctattttaggagaaactttccggtgtctttggatccacccacgcaccaattccaagacattctatatcgccgaacaggtatcacatcaccctcctatctcagctttctatgtatccaaccgcaaggacggcttctgcttatcagggtcaatcctagctaaatctaagttttacggcaactcactgtcagcgattctggaaggagaggctcgccttacctttcttaaccgaggcgaggactacgttatgaccatgccctacgcccactgtaagggaatcctctatggaacgatgacgctggagttgggcgggactgttaacattacctgtcagaaaaccggctacagtgctatccttgaatttaaactcaagccttttttaggttccagcgactgcgtgaaccagatctccgggaaactcaaactaggcaaagaggtgttggctactctagaagggcactgggactcagaagtgttcatcaccgataagaaaactgacaacagtgaggtcttctggaaccccacaccagatataaagcagtggcgtctcatacgacacacagtgaaatttgaggaacagggtgactttgaatctgaaaagttgtggcaacgagttaccagagctatcaacgccaaagaccagactgaggccacccaggaaaagtacgttctcgaggaagcccagagacaagcggcccgtgatcgcaagacgaagaacgaagagtggagctgcaaactgttcgagctggaccccttaacaggagagtggcactacaagtttgccgatacccggccctgggatccccttaatgatatgatccagttcgagaaagacggagtcatccaaacgaaagtcaagcatcgcacaccaatggtctccgtccccaagatgaagcacaagccaacccggcagcaaaaaaaggtggccaagggttattcctctcccgaacctgacatccaggacagctctggctccgaagctcagtccgttaagccatcaaccagacggaaaaaggggatcgagctcggcgacattcagtcatctattgagagcatcaagcagacccaagaggaaattaagcgcaatataatggcgctgcggaatcacctcgtgagtagcacaccagctacagactacttcctccagcagaaagactacttcatcatattcctgctcatcctgctccaggtcatcatcaatttcatgtttaagtag

SEQ ID NO: 127603 - DNA, 2544 bp, Artificial Sequence
  Description of Artificial Sequence: Synthetic coding sequence
atgtcacaaagacagggtaaggaggcgtaccctacacccaccaaagacctccatcagccatccctgagtccggcatcacctcactcccaagggttcgaacggggaaaagaagatatctctcaaaacaaagacgagtcctctctgagcatgagtaagagtaaaagcgaatccaagctgtacaatgggtccgaaaaagattccagcacaagcagcaaactcactaagaaagagtccctgaaggtccagaagaagaattatcgcgaggagaagaaacgggctaccaaggagcttctttcaaccataaccgacccatccgtaatagtaatggccgattggttaaaaatcaggggtacacttaagtcatggacgaaactttggtgcgtgctcaaacctggagtgttactcatctacaaaacccaaaagaacggtcagtgggttggcactgtgctgctgaatgcctgcgaaattatcgaacggccttccaaaaaggacgggttctgcttcaagttgtttcatcccttggagcaaagcatctgggcggttaagggtcccaaaggggaggccgtcgggagcattactcagccgctgcctagctcctatctaattattcgagctaccagcgaaagtgatggaagatgctggatggacgctctggagctggcgcttaagtgcagtagtctcctcaagcggacaatgatccgcgaaggcaaagaacatgatttgagtgtaagctcagactctacccacgttacgttttacggacttctcagagcaaataaccttcattctggagacaattttcagctcaacgacagcgagattgaacgacagcacttcaaggaccaagacatgtacagtgacaaaagcgacaaagagaacgatcaggagcacgatgaaagcgataacgaagtgatggggaagagcgaggagagtgacaccgacacgtccgaaaggcaggacgatagttacatcgaaccggagccagtggagccgctcaaggagacgacatacactgagcaatcgcacgaagagctgggggaagctggggaagctagtcagacagagactgtgtctgaggagaataaatcattgatctggaccctcctaaagcaggtcaggccaggcatggatcttagtaaggtcgtcctgcctacatttattttggaaccgaggagtttcttggacaaactttctgactactattatcacgctgatttcctgtcagaggcagccctagaagaaaacccgtattttcgcttgaagaaagtggtgaaatggtatctgtctgggttctacaagaagcctaagggcctgaagaaaccctacaaccctatcctgggagagacatttcgatgcctatggatccatccgcggaccaacagcaaaaccttttatatcgccgaacaggtctcacaccaccccccaatttcagccttttatgtctctaacaggaaggatggattctgcctttcgggctccatacttgccaagtccaaattctatggcaacagcctttctgccatattggaaggagaagcacgtttgacctttcttaataggggggaagactacgtgatgacaatgccctatgcccattgcaaaggcatcctctatggaaccatgacgctggagttaggagggaccgtgaatatcacgtgtcagaaaaccgggtactccgcgattctggagtttaaacttaaacctttcctcgggagcagcgactgtgtgaaccagatcagtggaaagcttaagttggggaaggaggttctggctactctggaaggacactgggattcagaagtctttatcacagataagaaaaccgacaacagcgaagtattctggaacccaacacctgatataaagcagtggagattaattcgtcatactgtcaagttcgaggagcagggagacttcgaaagcgagaaattatggcagagggtgacccgggcaataaacgcaaaagatcagaccgaagcgacacaagaaaagtacgtgttggaggaggctcaacggcaggccgctcgagaccggaagactaagaacgaagagtggtcttgcaagctgtttgagctcgatcctctgaccggggagtggcactacaagttcgccgacactcgcccatgggatccactcaacgacatgattcagtttgaaaaggatggggtgatccagaccaaggttaaacaccgcaccccaatggtgagcgtcccaaaaatgaaacacaagccaacacgtcagcaaaagaaagtagcgaagggctattccagtcccgaacccgatattcaagattcatctggttcagaggcgcaaagcgtcaaaccatcaactcggagaaaaaaaggtattgagctcggcgatattcagtccagtatcgagtccataaagcaaacacaggaagaaatcaagcgcaatattatggccctgcgaaatcatctggtaagcagtacccccgccaccgactacttcttacagcaaaaggactattttattatttttcttctgatcctgctgcaagtcattattaatttcatgttcaagtag

SEQ ID NO: 127604 - DNA, 2187 bp, Artificial Sequence
  Description of Artificial Sequence: Synthetic coding sequence
atggagggaggacttgctgatggcgaacctgataggacctcccttctaggcgacagtaaagacgtcctgggacccagcacagttgtggcgaacagtgatgagtctcagctcctgactcccggtaaaatgtcgcaacggcaaggcaaggaggcctacccaacacccacgaaggatctgcatcagcctagcctttcaccagcctcacctcactctcagggatttgagcgtggcaaggaagacatctcgcaaaataaggatgaatcctcgctgagcatgagtaaatctaaaagtgagagtaagctttataacggctccgagaaggattccagcacatcttctaaactcacaaagaaagagtccctgaaagtgcagaagaagaactacagagaggagaaaaagagggcgacaaaagagttgctctccacgatcacagacccttctgtgatcgtcatggcagactggcttaagattagagggaccctcaagagttggactaaactgtggtgtgttctgaaacctggcgttctcttgatctataaaacacaaaagaacggacagtgggtggggaccgtgttactgaacgcctgtgaaatcattgagcgtccctctaaaaaagacgggttttgtttcaaactcttccacccgttggaacaaagcatttgggccgtcaaaggcccgaagggagaagcagtgggcagcattactcagcccctgccttcatcatacttaatcatccgcgctacttccgaaagcgatgggaggtgttggatggacgccctggaactcgctctgaaatgttcatcattgcttaaaaggacaatgattcgggaggggaaggagcacgatctgagcgtgagtagtgatagcactcacgtaacattctatggactgctcagggcaaacaatttgcacagtggggacaatttccaattgaatgacagcgaaatcgaacggcagcacttcaaggatcaggatatgtactccgacaaatccgacaaagagaacgatcaggaacacgacgagagcgataacgaggttatgggaaagtcagaagaaagtgatacggacacctccgagcgtcaggacgacagctatatcgagcctgaaccggtcgagcctcttaaggaaacgacttacacagaacagtcccatgaggagttgggggaggccggggaggcttcccagactgagaccgtttctgaagaaaacaaatctcttatatggacccttttaaagcaggtccggcccgggatggatctgagcaaggtggttctgccgacttttatcctcgaacctaggtcgttcctggataagctctccgactactactaccacgcggattttctctccgaagcagcccttgaagagaacccttattttcgtttaaaaaaagtcgttaaatggtacctgtccggcttctacaagaaacccaaaggactcaagaaaccctacaacccgatactgggggaaacgtttcgatgcctgtggattcatccgcgcaccaattctaagacgttttacattgccgaacaggtgagccatcacccaccaatctctgcattttacgtctcaaaccggaaggacgggttttgtctgtcgggctccatcctcgcgaagtccaaattttatggaaattcactgtccgccatcctcgaaggggaagccaggctgacctttctcaaccggggcgaggactacgttatgaccatgccatatgcacattgcaaggggatattgtacggcaccatgaccctggaacttggaggaaccgtcaatatcacttgtcaaaaaactggctacagcgccatcctagagtttaagctgaagccttttctcggttcatccgactgtgttaaccaaatatctggaaagctaaaactaggtaaggaagtcctcgccacgctggaaggccactgggattccgaagtgtttattacggacaagaagacagataacagtgaggtgttttggaaccccactccagatatcaagcaatggaggctgattcggcacacagtaaaattcgaagagcagggggactttgagagcgaaaagctatggcagcgagtgacccgcgctattaatgctaaagaccagaccgaagcaactcaggaaaaatacgtccttgaagaggctcagcgacaggccgccagagatcgaaagacaaaaaatgagaagaagaagtag

SEQ ID NO: 127605 - DNA, 2625 bp, Artificial Sequence
  Description of Artificial Sequence: Synthetic coding sequence
atggagggagggctggccgatggggaacctgataggacctctgccaactctgacgaaagccagctgctgacaccaggtaaaatgtcccagaggcaaggaaaggaagcgtatcctactcccaccaaggatctccaccagccatccttgagtccggcatctccccactcccagggatttgagcggggcaaggaagacataagccagaataaagacgaatcgagtctctcgatgtctaagtccaagagcgagtcaaagctatataatggatcagaaaaagacagttctaccagctccaagttaaccaaaaaggagagcctgaaggtgcagaaaaaaaattaccgggaggagaaaaaaagagctactaaagaactgctgagcacgattaccgacccgagtgtgatcgttatggcagattggctgaaaattagaggaaccctaaagagctggacaaaactgtggtgcgtgctaaagcctggagttttactgatttataagacccagaaaaacggtcagtgggttgggaccgtgttgcttaacgcttgcgagatcattgaaagaccctctaaaaaggatggattctgtttcaaactgtttcacccattagagcagagtatctgggcagttaaggggcctaagggcgaagcggttggctctattacacagcccttgccttcaagttacctgataatcagggccacaagtgagagtgacggtcgctgttggatggacgccctcgagttagctttaaagtgtagctccctcttgaagcggaccatgatcagagaaggcaaggagcacgacctctctgtgtcctcagattcgacacatgtcactttctatggcttacttcgggctaacaacctccactctggcgataatttccagctgaatgactccgagatagagaggcagcacttcaaggatcaagacatgtactcagataaatccgacaaagaaaatgatcaagaacacgacgagtctgacaatgaggtgatgggtaagagtgaggaatccgacactgacacttccgaaaggcaggatgactcctacatagagccagagcccgtcgagccgttaaaggagaccacatataccgagcagagccacgaggagcttggtgaggctggggaagcgtctcagacagagacggtcagcgaggagaataaatccctcatatggactctgctgaagcaggtgaggccaggtatggacctgtcaaaagtggtgctgccaacattcatcttagaaccccggtccttcctggataaactgtctgattactactatcacgccgacttcctgtctgaggcagccctggaggagaacccatatttcagacttaaaaaggtcgtcaagtggtatttaagcggcttttataagaagccgaagggtctgaaaaaaccgtacaatcctatcctgggggagacatttaggtgtctgtggatccacccgcgaaccaactccaagacgttctacatcgctgaacaggtaagccatcacccaccaatttctgcgttttacgtgagcaaccggaaggacggcttctgtctgtccggctccatcctggcaaagtctaagttctacggaaattctttatcagccatacttgagggcgaagcgaggctgacatttttaaacaggggcgaggattatgtgatgacaatgccctatgcgcactgcaagggaatcctgtacggaaccatgacgctggaacttggggggacagttaacattacatgccaaaagacgggatacagcgccattcttgaattcaaactcaagccattcctgggctcttccgattgcgtgaatcaaatttccggcaagctcaagctcggcaaggaggtccttgccacactggaaggtcactgggatagtgaagtctttatcaccgataaaaaaacggacaattccgaggttttttggaatccaacgcctgacattaagcagtggagactgatacgccatacagtgaagttcgaagaacagggtgatttcgaatccgagaagctttggcaacgggttacgcgcgctattaatgctaaagatcagactgaggctacccaggagaaatacgtgcttgaagaagctcaacgccaagctgcacgggatcgaaaaactaagaatgaagagtggagctgtaagttgttcgagttagatcccctgaccggggagtggcactataagtttgcggacacccggccatgggacccattaaatgacatgatccaatttgaaaaggatggcgtgattcagaccaaagtaaagcatagaaccccaatggtttccgtcccaaagatgaagcacaaacccaccagacagcagaagaaggtggctaagggctactcctcccctgaaccagatatccaggacagctccggctcagaggcccagtccgttaaacctagcacccgacgcaagaagggaattgaactcggcgatatacagtccagtattgaatcgatcaagcaaacgcaggaagagattaaacggaacattatggcactgcgaaatcacctggtgtctagtacgcccgccacagattactttctgcagcagaaagactacttcataatctttctgctcatcttgctacaggtcatcatcaactttatgttcaaatag

SEQ ID NO: 127606 - DNA, 162 bp, Artificial Sequence
  Description of Artificial Sequence: Synthetic coding sequence
atggagggggggctcgcagatggagaacccgaccgcactagtctgctgggcgatagcaaagacgtgctgggaccgagcacaaattctgatgaatcacagctgctcactccgggcaagatgtcccagcgccagggtaaggaggcataccccactcctacctag

SEQ ID NO: 127607 - DNA, 231 bp, Artificial Sequence
  Description of Artificial Sequence: Synthetic coding sequence
atgagccagcgtcagggcaaggaggcgtaccccacccccacaaaggatcttcatcaaccctcactgtcacccgcgtctccacattcacaaggattcgaacgaggaaaggaagacatatcacagaacaaggacgagagtagcctaagtatgtcaaagagcaagagtgagagcaagctgtacaatggatccgagaaggattctagtacctcttctaagctgaccaagaaatag

SEQ ID NO: 127608 - DNA, 177 bp, Artificial Sequence
  Description of Artificial Sequence: Synthetic coding sequence
atggagggaggcctggctgatggggagcccgatagaacgagtttgctgggagatagtaaggacgttctcggcccgagcaccgttgtggcgaattccgacgagagccagcttctaacacctgggaagatgtcccaaaggcagggtaaagaagcctaccctacacccacaaaggactag

SEQ ID NO: 127609 - DNA, 336 bp, Artificial Sequence
  Description of Artificial Sequence: Synthetic coding sequence
atgagccaaaggcaaggcaaggaggcttatcccacccccacaaaagacctccatcagccgtcactgagccccgcatcccctcatagtcaggggtttgagcgggggaaggaggatatttcacagaacaaagacgaatcgagcctgtccatgtcaaaatctaaaagcgagtcaaagttgtacaatggctcagaaaaggactccagcacttcttcaaagctcactaaaaaggaaagcttgaaagttcaaaagaagaactaccgcgaggaaaaaaagagagcaaccaaagagctgctctctactatcaccgatccctcagttatagtcatggcagattag

SEQ ID NO: 127610 - DNA, 2226 bp, Artificial Sequence
  Description of Artificial Sequence: Synthetic coding sequence
atgccttaccggcgagttacgtcagggcggttacttagcctcgccgcccccaagatggcttcgattatggaagggcctctcagtaaatggactaacgttatgaaaggttggcagtacaggtggttcgtgcttgactacaatgcagggctactcagctactacacgtcaaaggacaaaatgatgagggggtcacggcggggatgcgtgcggctgcggggggcagtgatcggcattgacgatgaggacgacagcaccttcacaataacggtggaccagaagacatttcacttccaggcccgggacgctgacgagcgtgagaagtggatccacgccctagaggaaactatcctgaggcataccctgcagctccagggtttggactcaggatttgtgccttcagtccaggatttcgacaaaaaattgaccgaggccgacgcttacctacaaatcctgatcgagcagctgaagctatttgatgacaagctgcagaattgcaaagaagatgagcagaggaagaaaatagaaacactgaaagaaaccacaaatagcatggtcgagtccattaaacattgcatcgtgttgctccagatcgcaaagtcaaccattaacccagtggacgctatttatcagccttctcctctagaaccggtgattagcaccatgccatcacaaactgttctgccacctgagccagtacaattgtgcaagtctgagcagcggccctctagcctgcctgttggccccgtgttggccacactaggacaccatcagacaccgacgcctaacagtaccggcagcggacacagtccaccatcatcttctctcacatcccctagccatgtcaatttatccccgaacaccgtgccagagttctcctactcaagctctgaagatgagttttacgacgccgatgagttccaccagagcgggagtagtcctaagaggctgatcgatagtagcgggagcgcatcggtgctgactcatagcagctctggtaattccctgaaaaggcccgatacaaccgaatcgttaaattcgtcactatctaatggaacgtctgacgcagatctgttcgacagccacgacgaccgagacgacgacgccgaagctggctccgtggaagagcataaatcagtcatcatgcatttactatctcaagtccgcctgggcatggacctcactaaggtggtgctccccaccttcattctggagagacgcagcctcctcgagatgtacgcggacttcttcgcgcaccccgacttatttgtaagtatttctgaccagaaagacccaaaggaccgcatggttcaagtcgtcaagtggtatctgtcagcgttccacgctgggcgcaaaggaagtgtagcaaaaaagccctacaacccaatactcggggagattttccagtgccactggaccctgccgaatgatactgaagaaaatacagaacttgtttccgaaggccccgttccttgggtgagtaagaactctgtgacatttgtcgctgagcaggtctcccaccatcctcccatcagtgccttctatgcagagtgcttcaacaaaaagattcagttcaacgcgcacatatggacgaaaagtaagttcctgggcatgagcatcggcgtgcacaatattgggcagggatgtgtgtcatgcctggactacgatgagcactacatcttgactttcccaaatggctatggaagatccattctcactgtgccatgggtagaactgggcggcgagtgcaatattaattgctccaagacaggatacagcgccaatatcatcttccataccaagcccttttatggcggtaagaaacatcggatcacagcagaaatctttagtcccaacgacaaaaagagcttctgtagcatcgagggggagtggaacggggtgatgtacgccaaatacgccaccggggagaacaccgtctttgtagacacaaagaagctgcccatcattaagaaaaaggtacgtaagctggaggatcaaaacgaatacgaaagcagatccctctggaaggatgtcaccttcaatttgaagattagggatattgacgctgctaccgaagcaaaacacagactggaggaacggcagagagccgaggctcgcgaacggaaagagaaagagatccaatgggagacacggctgtttcacgaggacggtgagtgctgggtgtatgacgagcccctgctcaaacgcctgggggcggccaaacactag

SEQ ID NO: 127611 - DNA, 1881 bp, Artificial Sequence
  Description of Artificial Sequence: Synthetic coding sequence
atggcatttcttctggcaacttgtggggggttagatagcggtttcgtaccatctgtacaggattttgataagaagctgactgaagctgacgcttaccttcagattctgattgagcagctgaagctgttcgatgacaaactgcaaaattgtaaagaagatgagcagcgaaaaaaaatcgagaccttaaaggaaactacaaattctatggtcgagtccatcaaacactgcatcgtcctcctgcaaattgctaagtcaacgattaaccctgtcgatgcgatttatcagccaagtcctctcgaacccgtcatctccaccatgccttctcaaaccgtactgcctcctgaaccagtgcagctttgcaagtcagagcagaggccctcctcactgccagttgggccggtcttagcgactctcggacatcaccagactccgacaccaaactctaccggatcggggcattcccccccaagcagttcgctcacatccccttctcatgtaaacctgagccccaacacagttccggaattcagctatagcagctccgaggatgaattttacgatgccgatgaattccaccaaagtggcagttcgccaaagcggcttattgactcatctgggagcgcctccgtcctgacacactcaagcagtggcaactccctgaagaggccagatacaacggagtcactgaatagtagcctgtctaacggaactagcgatgcagatctgtttgactctcacgacgaccgggatgacgatgccgaggccggcagtgtggaagaacacaagtccgtcatcatgcacctgctgagccaggtccgcctggggatggacctgacaaaagttgttctcccgacctttatattggaacggaggtctctgctggagatgtatgccgactttttcgcacatcccgatctgttcgtgtctatctccgaccagaaagacccgaaggacaggatggtccaggtcgtgaaatggtatctttcagcttttcatgcagggaggaagggaagcgtggcaaaaaagccttacaatccgatcttgggagaaatattccagtgtcattggactttacctaatgatactgaagaaaacaccgaactcgttagcgaaggccctgtgccctgggtgtctaagaactcggtgacctttgtagccgaacaagtatcacaccaccccccaatttccgcgttttacgcggagtgttttaataagaaaattcagtttaacgcacatatttggaccaaatccaaattcctgggtatgagtatcggagtgcacaacatcggacagggatgcgtaagctgcctggactatgatgagcattacattcttacgttccccaatggatacggtcgctccattctgactgtaccatgggtagagctagggggcgaatgtaatatcaactgtagtaagaccgggtactctgcaaacatcatattccataccaagcccttctatggcggaaagaaacaccggattaccgcagagattttttcgcctaatgacaagaaatctttctgttcgattgagggtgagtggaatggggttatgtacgctaaatacgctactggagaaaacacagtgttcgtcgacaccaaaaagttgccaatcataaagaagaaggttcggaagctggaagaccagaatgaatacgagtcgcgttccctgtggaaggatgtgactttcaatttaaagatacgagacatagacgcagcaacagaagctaaacatcgcctggaagaacggcaaagggcagaggcacgggaacggaaggaaaaggaaattcagtgggaaacccggttgtttcatgaagacggggagtgctgggtttatgacgagcctctcctgaagagactgggcgcagccaagcactag

SEQ ID NO: 127612 - DNA, 2265 bp, Artificial Sequence
  Description of Artificial Sequence: Synthetic coding sequence
atgccatatcgccgggtcacttctggccgccttctgtccctggccgcaccgaagatggcatctatcatggaaggcccactgagcaagtggacgaacgtgatgaaaggatggcagtatagatggttcgtcctggattataacgccggcttgttgagttactatactagcaaagataagatgatgcgtggcagcagaaggggatgcgtaagactgcggggggcggtaatcggcattgacgacgaagacgatagcacattcaccatcacagtggatcagaagacattccatttccaagcccgagacgccgacgaaagagaaaaatggatacacgcgttagaggaaacaatattgcggcatacgctgcagttacaaggtctggatagtggctttgtgccctccgtccaggactttgacaagaagttgaccgaggctgatgcatatctgcaaattttgatcgaacagctcaagttgttcgacgataagctccagaactgtaaggaagacgagcagcgaaagaaaattgagaccctcaaagagaccactaactcgatggtggagtccatcaagcattgcatcgtcctgctgcagattgccaaagaccagtcgaacgccgagaagcacgccgatggaatgattagtaccatcaatcccgtcgacgctatctatcagccctccccgctcgaaccagtgatcagtactatgcccagccagactgtgctcccaccagagccagtgcagctatgcaaatctgagcaacgcccttcctcactccctgtgggccccgtgctggccactctcggccatcaccagactcccacaccaaacagcaccggatcaggccattctcccccctcatcttcccttacatcaccctcccatgtcaatctgagtccgaacactgtcccagaattcagctactctagttcagaagatgagttttatgatgccgatgaattccaccagtcaggctcctccccaaaacggttgattgattcctcaggctctgcaagcgtgttgacacactctagctcagggaactctctcaagagaccagataccacagagagtttgaactcttccctgtccaacggtacaagcgacgccgacttgtttgactcccatgatgacagggatgacgacgcagaagccggctcagtagaggaacacaagagtgtgattatgcacctcctgtcacaggtccggctcggaatggatttgaccaaggtggtcttgcccacattcatcttagagagaaggagcctgctcgagatgtacgctgatttctttgctcatcctgatctattcgtgagcatctccgaccagaaggatccaaaagacagaatggtgcaggtggtgaaatggtatctgtccgcctttcatgctgggcgcaagggaagcgtggccaagaaaccgtataatcccatcctcggcgaaatttttcagtgtcactggacacttcctaacgataccgaagagaataccgagcttgtctcagaaggccctgtgccttgggtgtccaagaatagtgtgacattcgttgccgagcaagtgtctcaccatccaccaatttccgccttttatgcggagtgttttaataaaaaaatccagtttaacgctcacatttggaccaagtctaaattcctgggcatgtctatcggcgtccataacattgggcagggctgtgtcagctgcttggattacgacgagcattatattttaacctttccaaatggatatggcagatctattctcactgtaccgtgggtcgagctcggaggagagtgcaatatcaactgcagcaaaacaggctactccgcaaatataatctttcatacaaaaccattttatggcggaaagaagcaccgaatcaccgcagaaatattcagccctaacgacaaaaagagcttctgtagtatagaaggcgaatggaatggcgtgatgtatgccaagtatgcgactggtgagaatactgtcttcgttgacacaaaaaagctgcctatcattaaaaagaaggtacgtaaattagaagaccagaacgagtatgaatctcggtcactgtggaaggatgtaacctttaacctcaaaatacgtgacattgatgcagccaccgaggctaagcatcgccttgaggaaaggcagagagctgaggcaagagagagaaaagaaaaggaaattcagtgggagacacgtctctttcacgaggacggagagtgttgggtctacgacgaacccttattgaagagactaggagcggccaaacactag

SEQ ID NO: 127613 - DNA, 2172 bp, Artificial Sequence
  Description of Artificial Sequence: Synthetic coding sequence
atggcctccattatggaaggccccctgtcaaaatggacaaacgttatgaagggatggcagtacaggtggttcgtgttagattacaatgctggtcttctgagttattacacttccaaggacaagatgatgcgcggaagccgaaggggctgcgtgcggctaagaggcgcagtcatcggcattgacgacgaagacgactcgacttttaccatcacagtggatcagaagacctttcattttcaggcacgggacgctgacgaacgagagaaatggatacacgctctggaggagacaattttaagacacaccctgcagctgcaggggctagacagcggattcgtgccctccgtacaggactttgacaaaaagctgactgaggccgacgcctaccttcagattttaatcgagcagctcaagctgtttgacgacaaactgcaaaactgcaaggaggatgagcagcggaagaagatagagaccctcaaggagacgactaatagcatggtggagagcattaagcactgcatcgtgctattgcagatcgcgaagagtacaataaaccctgtagatgccatctatcagccttcaccactagagccagttatctcaactatgcctagccagaccgtgctccctccggagcccgtccagctgtgtaagtctgagcaacgaccgtcctctctgcctgtcggccccgtattagctacacttgggcaccaccaaacccccacccccaactctacaggtagcggccattcgcccccttcctccagccttacaagcccttcacacgttaaccttagtcctaatacagttccagagtttagctattcttctagcgaagatgagttttatgacgcagacgagtttcatcagtctggctcgtccccaaagcgactgatcgactcttccggatctgcatccgtgcttacacattcttcatctggaaactctctcaagcgcccggatactaccgaaagtctgaattcatcactatctaacgggacatctgacgcagatctgttcgacagtcacgacgaccgcgacgacgacgccgaagcaggaagcgtagaagagcacaaaagtgtaatcatgcacctccttagtcaggtaaggctgggaatggacttgactaaagtggtgctgccaacttttatcctcgaacgccggagtttgctggagatgtacgcagatttcttcgcccacccagatctcttcgtgagcatctcagaccaaaaggaccccaaggaccgcatggtgcaggtggtgaagtggtacctgtccgccttccatgcaggtcggaaaggctcagtggcaaagaaaccatacaaccctattctcggagaaatatttcagtgccactggacacttccaaatgatacggaggagaacacagaactggtcagcgaaggacctgtgccatgggtgtcaaagaatagtgttacctttgtggcggaacaggtgtcacatcatcctcctatatccgctttctacgctgaatgttttaataaaaaaattcaattcaacgctcacatatggaccaagagcaaattcctaggcatgagcattggcgtgcataatatcggccaaggctgtgtaagttgcttggattatgatgagcattacattctgacctttcctaatggatacggtcgatcaatccttaccgtgccatgggtggagctaggcggtgaatgcaatatcaactgttctaaaacagggtactcagccaacataattttccacacaaaacctttttatggcggcaaaaagcataggataacagcagagatcttttcccctaatgacaagaagtctttttgtagcatcgagggggagtggaatggggtgatgtacgctaaatatgctaccggggaaaataccgtgttcgtcgatacgaagaagctgcccatcataaagaaaaaggtccgtaaactcgaggatcagaacgagtacgagtccaggtcactatggaaggatgtgacctttaatctcaagattagggacattgatgccgccacggaggccaagcaccggcttgaagagagacaaagggcagaggcacgggagcgtaaagaaaaagaaatccagtgggagaccaggctctttcacgaagatggggagtgctgggtgtacgatgagccactcctgaagaggttgggagccgccaaacactag

SEQ ID NO: 127614 - DNA, 2211 bp, Artificial Sequence
  Description of Artificial Sequence: Synthetic coding sequence
atggcctctattatggaagggcccttgtctaaatggacaaacgttatgaagggttggcagtaccgatggttcgtgctcgactataacgctggattactgtcttactacactagcaaggacaagatgatgaggggctctcggcggggatgcgttcggcttcgaggcgcagtgataggtatagacgatgaagacgatagcacatttactatcactgttgaccagaaaaccttccacttccaggcgcgcgatgccgacgagagggagaaatggattcacgctctggaggaaaccatccttcggcacactctgcagcttcagggcctggattctggcttcgtgccttcagtccaggatttcgacaagaaactcaccgaggccgacgcctatctgcaaatcttgatcgagcagctgaagctattcgacgacaagctccagaattgcaaggaggacgagcagaggaagaaaatagagaccctgaaggagacaacgaactcaatggttgagtccatcaaacactgtattgtgctgctgcagatcgccaaggatcagagcaacgctgaaaagcacgccgatggcatgatatcaacaatcaaccctgtcgacgcgatctatcagccctcaccgctggaacccgtgatctccactatgccgtcgcaaacagtgctgccacccgaacctgtgcaactctgtaagagcgaacagagacccagttccttgcccgtcgggcctgtccttgctactctgggacatcaccaaactcctaccccaaactccaccggatcggggcacagccctccatcaagctctctgacatccccttcacatgtcaatctgtccccaaacacagtccccgagttttcctacagttccagcgaggatgagttttacgacgctgacgaattccatcagtcagggtccagtccgaagcgcttgatcgattcctctggatccgcctccgtgctgactcattcatcctccggaaatagcctgaagaggccagacacaaccgagtccctaaacagttccctcagcaatggaacgtcggacgccgacctcttcgactcccacgatgaccgcgacgatgacgcggaagccgggtcagtggaagaacacaaatcagtcatcatgcatctcctgtcccaggtacgtctcggaatggatcttaccaaggtggtgctgccaacattcatactggagcgtagatcactgttagaaatgtatgctgacttttttgcccatcccgacctgttcgtctcaataagtgatcagaaagatcctaaggacagaatggtgcaggttgtaaagtggtatctcagcgcctttcacgctggtagaaagggcagcgtcgctaagaagccatataatccgatcctcggggaaatcttccagtgccactggactcttcccaatgataccgaagagaacaccgaattagtttctgaagggcctgtgccctgggttagtaagaatagcgtgacgtttgttgcagaacaggtgtctcaccatcctccaatctctgctttctacgctgaatgcttcaacaaaaaaatccagttcaacgcccacatttggacaaaaagcaagttcctgggcatgtctatcggggtgcataacattgggcaaggctgtgtgtcttgcctggactatgacgagcactatatacttacctttcccaacgggtatggcaggagtatacttacggtcccttgggtggagctgggaggcgaatgcaacatcaattgctccaaaacgggatatagcgctaacatcatttttcatacaaaaccgttctacggagggaaaaaacatagaatcacggcagagatcttttcacctaacgacaagaagtccttttgcagtatcgagggagaatggaacggagtaatgtatgctaagtatgcaaccggcgaaaataccgtctttgtggacactaagaagctccccatcatcaagaaaaaggtgcgaaagctggaagatcagaacgagtatgaatcccggtcactatggaaggacgttacttttaatctgaagatccgggacatcgatgctgccacagaagccaaacataggcttgaagagcgacagcgggctgaagcaagggagagaaaagagaaagagatccaatgggagacaaggctgttccatgaagatggagaatgctgggtttatgacgagcccctgctgaagcgcctcggcgcagcaaaacactag

SEQ ID NO: 127615 - DNA, 1716 bp, Artificial Sequence
  Description of Artificial Sequence: Synthetic coding sequence
atggtcgagtccattaagcactgtattgtgttgctgcagattgcaaaggaccaatccaatgccgaaaagcacgcagacggaatgattagcaccatcaacccagtggatgccatttaccaaccatcacctctcgagccggtgatctctacgatgcccagtcagactgttctccccccggaacccgtgcaactgtgcaagagtgagcagcgcccttctagtcttcccgtcggtccagtactggccacactcggtcatcatcagacccccactcccaacagcactggcagtggacacagtccaccttcaagctcgcttaccagtcccagtcatgtcaacctttcaccaaacactgtgccagaattttcctactctagctctgaagacgagttttacgatgcagatgaatttcaccaatctggatctagtccaaagcgcctaatagactcctcaggaagcgcctcagtccttacacatagctcttcaggcaatagcttaaaacgcccggataccactgagagcctaaactcctctttgagtaatggcacctccgacgccgatctgttcgattcgcacgatgacagggatgacgacgcagaagcgggatcggtagaggaacacaaatctgtcataatgcatcttctgagtcaggttaggcttgggatggacctcacgaaggttgtgttgcctacctttattttggaacgcaggtcactgttggaaatgtatgccgacttctttgcacaccctgatctgtttgtgtctatttcagaccagaaggatcctaaagaccgaatggttcaggttgtaaaatggtatctatccgccttccatgccggccgcaagggaagcgtcgcgaaaaagccttataaccctatcctgggcgaaattttccagtgccactggaccctgccgaatgacaccgaagagaacacagaattagtctccgagggtccagtgccctgggtttcaaaaaacagtgtcacgttcgtggcggagcaggtgtcccatcaccccccaatcagcgccttttatgccgagtgcttcaacaagaagattcagttcaatgctcatatttggaccaaaagcaaattcctaggcatgtccataggcgtgcataatataggacaggggtgtgtctcctgtctggattacgatgagcattatatcctgacttttcccaacggatacgggaggtctattctgactgtcccctgggtcgaactaggaggcgaatgcaatataaactgctccaaaactgggtattcagccaatataatcttccatacaaaaccattttacggaggcaagaagcacaggatcaccgctgagatcttttcccctaatgataagaagtctttttgcagcatcgagggggaatggaacggagtcatgtacgccaagtatgctactggtgaaaatacggtatttgtagacacaaagaaactccccattattaaaaaaaaggtccgaaagctggaggaccagaacgaatacgagagccggagcctttggaaagatgtcacttttaacttaaaaatcagggatattgatgccgctacagaagccaagcatcggctagaggagcgtcagagagcagaagctcgggaacgaaaagagaaagaaatccagtgggaaactcgccttttccacgaagatggcgaatgttgggtatatgatgaacctttactgaagagattgggggccgccaagcattag

SEQ ID NO: 127616 - DNA, 2241 bp, Artificial Sequence
  Description of Artificial Sequence: Synthetic coding sequence
atggctagtattatggagggccctctgtctaagtggacaaacgtgatgaaggggtggcaatacagatggttcgtgctggattacaacgcaggattactgagctactacacctccaaggataagatgatgcgtgggtcccggcgcgggtgcgtgcgccttaggggggccgtaattggcatcgacgatgaggatgactccacattcactattactgtagaccaaaagacatttcactttcaggcccgcgacgccgatgagcgggagaagtggatacacgcactggaggagactattctgcgacacaccctccagctgcaaatctcaacgacccttgccttcttccaatcatctggcatctctccagtccttgaattctctaaaattattggcctggattctggctttgtgccgtcagtgcaggattttgataagaaactgactgaggctgatgcatacctgcagattttgattgaacagctcaagctgttcgacgataagctgcaaaattgcaaggaggatgagcagcggaaaaagattgaaacgctgaaagaaacaacaaattcaatggtagagagcatcaagcattgtatcgtcctgcttcagattgctaagagcaccattaatccggttgacgcaatctaccaaccctcccctctggagcccgtgataagtacaatgccatcccagacagtgctgcctcctgaaccagttcaactgtgtaagtcagaacagcgcccgagtagcttacctgtgggacccgttcttgcaactctgggccaccaccagacccccaccccaaacagtactgggtccggtcatagtcctccatccagctcgttaactagcccatcacacgtgaatctcagcccgaacaccgtgccagagttcagctattcctcctccgaagacgagttctacgatgctgacgaattccatcagtctggctcttcacctaagaggctgattgatagctctggcagtgcatcagtgttgacacacagtagctctgggaatagcttgaaacgcccagacacaacggagtctctgaattcttccctcagcaacgggacctccgacgccgatctattcgacagtcatgacgacagggacgatgatgcagaggccggttctgtcgaggaacacaaatccgtaattatgcacctgcttagtcaggtgaggcttggcatggatctaactaaagtggtccttcccacttttattctcgagagacgctcgcttttggagatgtacgcggactttttcgctcacccagacttattcgtcagcatctccgatcagaaggacccaaaagataggatggtacaggttgtcaagtggtacctaagtgccttccatgccggcaggaaaggatctgtcgccaagaaaccttacaacccaattctgggggagatcttccagtgtcactggaccctgccgaacgacaccgaagaaaacacggagcttgtctccgaaggaccagtgccctgggtaagcaaaaactcagtgacgttcgtcgccgagcaggtgtctcatcatcctccaatctcagctttttatgctgaatgtttcaataagaaaatccaattcaacgcgcatatttggaccaagtcaaaattcttgggtatgtccataggtgtgcacaatattgggcaaggctgtgtaagttgtttggactatgatgaacactacattctgaccttcccaaatggttacggaaggtccattctgaccgtcccgtgggtcgagttgggaggagaatgcaacatcaactgttctaaaactggatattccgccaatatcatcttccacactaagcctttttatggggggaaaaaacaccggatcaccgccgaaatcttcagtcctaacgacaagaagtcattttgtagtatcgaaggggaatggaatggagtcatgtacgcaaaatacgctacaggcgagaataccgtcttcgtagataccaaaaaactgcctatcattaagaagaaagtgcggaaattagaagaccagaatgagtatgagtcccggtcactgtggaaggacgtgacatttaatcttaaaattcgggacatcgatgcagccacggaagcaaagcatcggcttgaggagcgccaaagagcggaggcacgggagcgaaaagagaaggagatacagtgggaaacacggttattccacgaagatggggagtgctgggtttacgacgagcccctcctgaaacggctgggcgctgcgaaacattag

SEQ ID NO: 127617 - DNA, 2160 bp, Artificial Sequence
  Description of Artificial Sequence: Synthetic coding sequence
atggcgagcatcatggaggggccactgtccaagtggaccaatgtcatgaagggctggcagtaccggtggtttgtgctagattataacgctggcctgctgagctattataccggggccgtaattgggatcgacgatgaagacgattcaacattcaccatcactgtggaccagaaaacattccacttccaggctcgtgatgccgatgaaagggagaagtggattcacgcattagaggagaccatccttaggcacaccctgcaactgcaaggactagattccggatttgtaccctcagtgcaggacttcgataagaaattaacagaggctgatgcctatctgcagatccttattgagcaactgaagctgtttgacgataagttacaaaattgtaaagaagacgaacagcgcaaaaaaatcgagactctgaaagagacaaccaacagtatggtagaaagtatcaagcattgtatcgtcttgctccagatagccaaagaccaatcgaatgctgagaaacacgccgacggcatgatcagcacaatcaacccagttgacgctatctatcagccctcacctctcgagccagttatttccacaatgccgagtcagactgtcctgccgcctgagcccgtgcagttgtgtaagtccgaacaaaggccatcctcccttccagttggccctgtgcttgccactcttggacatcaccagacacctactcccaatagtaccggaagcggtcattcccctccctctagttccttgacatccccctcacacgtgaatctcagtcctaacactgttcccgaattcagctacagtagttctgaggatgagttttacgacgccgatgagtttcaccagtctggctctagtcccaaaagactgatcgactcaagtgggtctgcttcagttctgacacattcatcctccggcaattcacttaagcgccccgatacaaccgagtccctcaactccagcctttctaacgggacttctgatgccgatctcttcgactcccacgatgatagagatgacgacgctgaagctggctcggtagaggagcacaaaagcgtgatcatgcatctgctgagccaggtgcggttaggaatggatctgactaaggttgttctgcctacattcatcctcgagaggaggtccctactcgagatgtatgccgatttcttcgctcacccagatctatttgtctctatctcagaccaaaaggaccctaaggacagaatggtccaagtggtgaagtggtacctgagcgcttttcatgctggccggaaaggatctgtcgctaagaagccctacaatccaattctgggagaaatttttcaatgccactggacccttcccaatgatactgaggaaaataccgagcttgtcagcgagggccccgtgccgtgggtctccaagaactccgtgaccttcgttgccgagcaggtaagtcatcacccacccattagtgctttttacgcagagtgcttcaacaaaaaaatccaattcaatgcccacatatggacaaagtccaagttcttgggcatgtccatcggcgtccacaacattgggcaggggtgcgtgagttgtctggactacgatgaacactacatcctgacattcccaaacggctacgggcgcagcattcttaccgtcccttgggtcgagttaggtggcgagtgcaatattaactgctccaaaaccgggtacagcgcaaatatcatctttcatacaaagccattttatggcggtaaaaaacaccgaatcacagcagaaatattttcgccaaatgacaagaagagcttttgttccatcgaaggagagtggaatggcgtcatgtatgccaagtatgctaccggggagaacacagttttcgtcgacactaaaaagcttccaattattaaaaaaaaagtgagaaagttagaagaccagaatgagtatgaatcgagaagcctgtggaaggacgtgacattcaacctgaagattagagatatcgacgccgccactgaagcaaagcatcgcctggaggagcgtcagcgcgccgaggcccgtgagcggaaggagaaggagatccagtgggaaactcgtcttttccacgaagacggagaatgctgggtctacgatgaacccctactcaagcgcttgggtgccgcgaagcattag

SEQ ID NO: 127618 - DNA, 1677 bp, Artificial Sequence
  Description of Artificial Sequence: Synthetic coding sequence
atggtggagagcatcaaacactgcatagtactgttacagatcgctaaatcaacgattaacccagtggatgcaatttatcagccctcgcctctggagccggtgataagtacaatgccatcccagacagtattgcccccagaacccgtacagctttgcaagtccgagcagcgtccaagttccctgcctgtcggacctgtcttggcaacattgggtcaccaccagacccccactccaaattcaacaggctccggtcacagccctccaagtagtagcttgacgtcacccagccacgttaacctgtccccaaataccgtcccagaatttagctacagcagttctgaagatgagttctatgacgccgacgaatttcatcagtctggatccagtcccaagagactgattgattccagcgggagtgcttctgtactgactcattcctcctcaggaaactccctcaagcgccctgacaccacagagagcctgaacagctcattatcgaatggaacatccgacgcagatctattcgatagccacgacgatcgtgatgacgatgcagaggctggcagtgttgaagaacacaaatccgtcatcatgcatctgcttagtcaagtcagactcggcatggaccttacaaaggtggtcctgcccacttttatcctggagcgtcggagcctgctagaaatgtacgccgacttctttgcccaccctgatctattcgtcagtatttctgaccaaaaggacccaaaggatagaatggtccaggtcgtgaagtggtatctgagcgccttccacgccggtcgcaaggggtctgtggcaaagaagccctacaatcccattctgggcgaaattttccaatgccactggacacttcccaacgatacagaagaaaatacagagctcgtgtccgagggccctgtcccctgggttagcaaaaactctgtgacttttgtggccgagcaagtgtcgcaccatccccctatctctgcattctacgctgaatgctttaataaaaagatccagttcaatgctcatatatggactaagagtaagtttctgggaatgtccatcggtgtgcacaacataggtcaaggctgcgtgtcttgtctggactacgacgaacactacatcctcacctttcctaatggatacggtagatcaatcctcacagtgccttgggtcgagcttggtggtgaatgcaacattaattgttccaaaactggatattccgccaacatcatattccacacgaagccattttatgggggcaagaagcaccggatcacggctgaaattttttcccctaacgacaaaaagagcttctgtagtattgagggggagtggaatggggttatgtacgcaaaatacgccactggggagaacaccgtttttgtcgacacaaagaaacttccaatcatcaaaaagaaggtgcgcaaactcgaagaccagaatgagtacgagagcagaagtctctggaaagacgtaaccttcaacctaaaaattcgggatatcgacgccgccacggaggcgaaacacaggctggaggagaggcagagggcagaagccagagagcgcaaggagaaggagattcaatgggagaccaggctttttcacgaggatggtgagtgttgggtctacgacgagcctctactgaagcgactgggcgctgccaaacattag

SEQ ID NO: 127619 - DNA, 99 bp, Artificial Sequence
  Description of Artificial Sequence: Synthetic coding sequence
atggttgagtcaatcaagcattgtatagttctgctccaaatcgcgaaggatcaaagcaacgccgagaagcacgctgatggaatgatcgtatcgctatag

SEQ ID NO: 127620 - DNA, 1677 bp, Artificial Sequence
  Description of Artificial Sequence: Synthetic coding sequence
atggtcgaatctatcaaacattgtattgtcctgttgcagatagccaagtctactattaatcccgtagacgcgatttatcagccaagtcccctggagccggtcatctctactatgccctcacaaactgtgctccccccggaacctgtgcagctgtgtaagagcgagcagaggccctcttctctgcctgtggggcctgtcctcgccacactgggccaccatcagacacctaccccaaattctaccggatccggccatagccccccaagctctagtctgacttcccccagccacgtgaacctgtcaccgaatactgtaccagagtttagctactccagcagtgaagacgagttttatgatgcagacgagttccaccaaagtggcagtagtcctaaacgtctcatagactctagcggcagcgcctcagtgttaacacactcctcaagcggcaactccctgaagcgcccggatacgacggagtccctgaattcgtcactgtctaacggaacaagcgatgctgacctgtttgacagccatgatgatagagacgacgatgccgaagctgggagcgtagaagagcacaaatccgtgatcatgcaccttcttagtcaagtgcgcctgggcatggatcttaccaaagtggtgctcccaacttttatattagagaggcgctctctgcttgaaatgtacgctgacttctttgcacacccggatcttttcgtgtcaatctctgaccagaaagacccgaaggacaggatggttcaagtggttaaatggtatctctctgcctttcatgccggccgcaaaggatctgtggccaagaaaccctacaatcccatcctgggggaaatctttcagtgtcattggaccctgcctaatgatacagaagaaaatacagaactagtgtcagagggccccgttccgtgggttagcaagaatagcgtcacgttcgtggctgagcaagtatcacatcaccctcccatctcagctttctatgccgaatgctttaataagaagatacagtttaacgctcacatctggacaaagagcaaatttcttgggatgtcaattggggttcacaacattggccagggatgtgtgagctgtctagactacgatgagcattatattcttactttccccaatggttacggaagatccatccttactgttccttgggtggagctcggcggagagtgcaacattaattgctcaaagaccggttattccgcaaacatcatttttcatacgaaaccattctacgggggcaagaagcatagaatcacagctgagatatttagcccgaacgacaagaagtctttttgttctattgaaggggagtggaatggggtgatgtatgccaagtatgctacaggagagaataccgtgttcgtcgacacaaaaaaactgccaataatcaaaaagaaagtgcgcaagttagaggaccagaatgagtacgaatcacggagtctatggaaggacgtgacatttaatctcaagatacgcgatatagatgcggccactgaggctaagcaccgtttagaggagcgacagcgagctgaggccagggaaagaaaagagaaggaaatccagtgggaaacaaggctgtttcacgaggacggagaatgttgggtatatgacgaaccattactcaaaaggttaggcgctgccaagcattag

SEQ ID NO: 127621 - DNA, 1968 bp, Artificial Sequence
  Description of Artificial Sequence: Synthetic coding sequence
atgggttgctgctgctgctggttggttttcactgaggctcgagacgctgacgagcgcgagaaatggatccatgcacttgaggagaccatcctcaggcacaccctgcagctccaggggctggactccgggttcgttccttcggtgcaggacttcgacaagaagctgaccgaggcagacgcctacctgcagatactgatcgaacagcttaagctgtttgatgataaattacagaattgcaaggaagatgagcagcgcaagaaaattgagacactgaaggaaaccactaactcaatggtggaatctattaaacactgcatcgtgttgcttcagattgccaagagtaccatcaaccctgtggacgccatctaccagcctagccccctggagcctgtcatcagcaccatgccatcacagacagtgctgcccccagaacctgtgcagctatgtaagagcgaacagaggccttctagcctgccagtgggacccgttctggctacccttggccatcatcagacacccacccctaactcaactggtagtgggcactctcccccgtcctctagcctgacgagcccctctcacgttaatctttcccccaacacagtacccgagttctcttactcgtcaagcgaggatgagttctacgatgcagacgagttccaccagtctggctcttcccccaagcggcttatcgattcatctggttcagcgtctgttttgacacactccagctccggaaattccttgaaaaggcctgatacaacagagtccttgaactcatccctttcaaacggaaccagcgacgcggatctgtttgatagtcatgatgacagggacgacgatgccgaggcaggctctgtggaggaacacaaatctgtaattatgcacctgctcagtcaggtgagactgggaatggacttaacaaaggttgtactcccaacattcatcttagagcggcgctcactgctcgaaatgtatgcagactttttcgcccatcctgatctgttcgtaagcatctctgatcaaaaggatccaaaggaccgtatggtgcaggtggtgaagtggtatctcagtgccttccacgccggacgcaaaggctcagtcgccaagaagccatataatcctatcctgggtgagattttccaatgccactggaccctccctaacgacacagaggaaaatactgaattggtgagcgagggtccagtaccttgggtgagtaagaattccgtcacatttgtcgccgagcaggtcagccatcacccacctatttctgcattctacgctgaatgcttcaacaaaaaaattcaatttaacgctcacatatggaccaagtccaaattccttgggatgtccattggagttcacaacataggacaaggctgcgtgtcgtgtctggactacgatgagcattatattctcacatttcccaatggatacggcaggtctattcttaccgtgccctgggttgagctcggaggagagtgcaatatcaattgttccaaaacaggctatagcgctaacatcatctttcatacaaagcccttctatgggggcaagaaacaccggataacagctgagattttttctcccaacgacaagaagtctttttgctcaatagagggggaatggaacggtgtcatgtacgccaaatatgctactggtgaaaataccgtctttgttgacactaagaagctgcccattattaagaagaaagtaaggaagctggaagaccagaacgaatatgagtctaggagcttgtggaaagacgtcacttttaacttaaaaattcgtgatatcgatgccgcaaccgaggcaaagcatcgattggaggagagacagcgcgcagaagcaagggagcggaaggagaaagagattcagtgggagacacgcctattccacgaggatggcgagtgttgggtctatgacgaacctctcctcaaacggctgggggctgctaaacactag

SEQ ID NO: 127622 - DNA, 330 bp, Artificial Sequence
  Description of Artificial Sequence: Synthetic coding sequence
atggtggagagcattaaacactgcatcgtcctgctgcagattgctaaatccacaattaatccggtggatgctatctatcagcctagtccactggagcccgttatcagtacaatgccttcccagactgtcctgcctcccgagcccgtgcaattgtgtaagagcgagcagcgcccgtccagcctaccagtgggccctgtgctagccacactgggccaccaccagacacctacaccaaactccactggatccggccacagccccccatcttcctctctgacttccccctcccacgtgaacctcagtcctaacactgtccccgagttcagctag

SEQ ID NO: 127623 - DNA, 1170 bp, Artificial Sequence
  Description of Artificial Sequence: Synthetic coding sequence
atggagggagccctggccgccaactggtcagctgaagctgccaatgcaagcgcggccccccctggagccgaaggcaaccgaacggcgggcccaccacggaggaacgaggctctggccagggtggaggtggcggttttatgtcttatcctgctgctggccctgagtggcaatgcctgcgtgttgctagctctgaggacaacacgtcagaagcactccagactgttttttttcatgaaacacctgagcatcgcagacctcgttgtggccgtcttccaggtactaccacaactcctgtgggacatcacctttcgcttttacggaccagacctgctttgcaggcttgtcaaatacctccaggtggtaggcatgtttgcatctacttatctactgctgctgatgtccctggaccggtgtttggcaatttgtcagccactgaggagtctgaggcgccggaccgatagattggctgtactggctacctggctggggtgtctggtggctagcgcaccccaggtgcatatcttcagcctgcgggaggttgctgacggcgtcttcgactgttgggccgtgtttattcagccctgggggcccaaggcctatatcacatggatcacacttgccgtgtatatcgttcccgtgattgtactcgccgcttgttacgggcttatctcctttaagatatggcaaaatctgcgcctcaaaacggcagcagctgcggcagcagaggcgccagagggcgcggctgcgggagatggggggcgcgtggcactcgcccgcgtgtcttccgttaaacttatttccaaggccaagatccgtactgttaagatgacgttcatcatcgtgctggctttcatcgtgtgctggacgcccttcttttttgtccagatgtggtccgtttgggatgctaatgctccaaaagaagcttctgctttcataatcgtaatgctgctggcgagcctgaacagttgttgcaacccatggatttatatgttatttaccggacaccttttccatgagctggtgcagcgatttctctgttgtagcgcctcatacttaaaaggtagaagactcggagaaacaagcgcgtccaaaaagtcaaatagctcctcttttgtgttaagccatagatcatcatctcagcgaagctgttcccaaccctccactgcctag

SEQ ID NO: 127624 - DNA, 132 bp, Artificial Sequence
  Description of Artificial Sequence: Synthetic coding sequence
atggagggagccctcgctgctaattggtcagccgaggcagcaaacgcaagtgccgcacccccaggtgccgagggcaacagaaccgccgggcccccacgcaggaatgaagccctggcccgggtcgaagtttag

SEQ ID NO: 127625 - DNA, 279 bp, Artificial Sequence
  Description of Artificial Sequence: Synthetic coding sequence
atggaaggggccctggccgccaactggtctgcagaagcagccaatgcctcagcggccccacctggagcggaaggcaaccggactgccgggcccccaagacggaacgaggctctcgcccgagttgaggtagcagtcctctgcttgattctccttctggcacttagcggcaacgcctgtgtccttctggccctgcggacaactagacagaagcattctagactgttttttttcatgaaacatctgagcatagcagacctggtcgtcgcagtgtttcagtag

SEQ ID NO: 127626 - DNA, 1518 bp, Artificial Sequence
  Description of Artificial Sequence: Synthetic coding sequence
atggcttcaggacggagggcccctcgtacagggttgttagagctgcgggctggggccggatcaggcgctggcggagaacgttggcaacgagtcctcctgtccctagctgaagacgtgttaaccgtatctcccgctgatggggatcctgggcctgaacccggtgcccctagggagcaggagcctgcacagctcaacggggccgctgagcccggcgcaggcccaccgcagcttccagaggcacttctgctccagagacgccgagtcaccgttcggaaagctgacgctggcgggctagggatttccattaagggaggtcgggagaataaaatgccgattctcatttctaagatctttaaaggcctcgccgcggaccagaccgaggcgctttttgttggggatgcaattctctctgtaaacggtgaggacctgtcaagtgccacacacgatgaagctgtgcaggtactgaaaaaaaccggaaaagaggtggttctggaggtcaagtacatgaaggacgtctccccatactttaagaactccaccggcggcactagcgtgggctgggattctccacccgctagtcctctccagagacaaccctcctctcccgggccaactccaagaaacttctctgaggcaaagcacatgagtctcaagatggcctacgttagtaagcgatgcactcccaacgacccagagccaaggtacctcgagatctgttcagccgacggacaagataccctgttcctgagagcaaaggatgaagcctctgcgaggagctgggctacagccattcaggcacaggtgaacaccctcaccccacgcgtgaaggatgagttacaggccttgctcgcggcaacctcgaccgccggctctcaggacatcaagcaaataggctggctgaccgagcagttgccaagtggcggaacggctcccaccctcgccctgctcactgagaaggagttgcttctctacttgtccttaccggagacgcgagaggctctgagccgcccagcccgcactgcacctctaatagcaactcgactcgtccacagtggaccctccaaggggtctgtgccctacgatgctgagctatcttttgcgctgcggactgggactcggcatggagtcgatactcatctctttagcgtggagagccctcaagagttagctgcatggactcgccaactggtggacggctgtcaccgtgcggcggagggagtgcaggaagtgtccaccgcctgtacttggaacggcagaccgtgttcactgtccgttcacattgacaaggggtttactctctgggcggcagaaccgggggccgcacgggctgtgctacttcgacaacccttcgaaaaactacagatgtccagtgatgacggggccagcctactctttctggacttcggcggcgcggaaggcgagatccaactggacctgcacagctgccctaagacaatcgttttcattattcactctttcctgagtgccaaggtgactaggttgggactgctcgcctag

SEQ ID NO: 127627 - DNA, 441 bp, Artificial Sequence
  Description of Artificial Sequence: Synthetic coding sequence
atgggctttctccgcaggctgatctatcgaagacgtcccatgatatacgtggagtctagcgaagaaagcagcgacgagcagccagacgaggtggagagtcccactcagtctcaggattcaactcccgctgaagaacgggaggatgaaggagcgtcagccgctcagggacaggagcccgaagctgactcacaagagctcgtccagccaaagaccggctgtgagttaggtgacggcccggatactaagcgggtgtgccttaggaatgaggagcagatgaagttgccagcagaagggcctgaaccggaggccgattcccaggagcaggtacatcctaagactggctgtgagcgcggggatgggcccgatgtgcaagaactgggacttccaaaccccgaagaggttaagaccccagaagaggacgagggacaaagtcaaccgtag

SEQ ID NO: 127628 - DNA, 336 bp, Artificial Sequence
  Description of Artificial Sequence: Synthetic coding sequence
atgagtgagctgcttcgggccaggtctcagagcagcgagcggggaaatgaccaggagagtagtcagcccgtgggttcagtgatcgtacaggagcctaccgaggaaaaacgccaggaggaggaacctccgaccgacaatcaggggatagctcccagcggcgagattgagaatcaggctgtacctgcctttcagggtccggacatggaagcattccagcaagaactggccctgctgaaaattgaggacgagccgggtgacgggcctgatgtgagggaagggattatgcctacatttgacctgaccaaggtgctggaggcaggggacgctcagccatag

SEQ ID NO: 127629 - DNA, 195 bp, Artificial Sequence
  Description of Artificial Sequence: Synthetic coding sequence
atgtcagagctgctgcgagccagatctcagtcttcagaacgcggaaatgatcaggagagcagccagcccgttggttctgtgatcgttcaggaacccacagaagagaagagacaggaagaagaaccccccactgataatcaaggtatcgccccgagcggagagattgaaaaccaagccgtgcctgcttttcaatag

SEQ ID NO: 127630 - DNA, 342 bp, Artificial Sequence
  Description of Artificial Sequence: Synthetic coding sequence
atgtctggccatcagaggaccaggtccagaagccgtgaaaggagagacgatcaagactctaatcaccctgtaggagccgtggtcgcccaagagctgcccagtaacgaccagcttcagcaggaggagccccctattgaatcccaggactatactccaggtcaggagagggacgagggagctttggatttccaggttctgggcctggccgcctatctttgggagctcacccgcagtaagacaggaggggagcgtggggatgggcccaatgtgaaaggtgagttcctgcctaatttagagcctgtcaagattcctgaggcaggagaaggccagccatctgtgtag

SEQ ID NO: 127631 - DNA, 342 bp, Artificial Sequence
  Description of Artificial Sequence: Synthetic coding sequence
atgtctggacaccagaggactcgaagtcggtcccgggaacgcagggacgatcaggattcaaatcatccggtcggggccgtagtcgctcaggagctcccatctaacgatcagctacagcaggaagaaccgcctattgagtctcaggactacacccctggacaggagagggatgaaggggcgctcgattttcaagtgctgggtctagcagcctatctgtgggagctaacaagaagcaaaactggaggcgagagaggagacggccccaatgttaaaggggagttcctgcccaatcttgagccagtcaagatacctgaggccggagaaggacagccttctgtgtag

SEQ ID NO: 127632 - DNA, 1458 bp, Artificial Sequence
  Description of Artificial Sequence: Synthetic coding sequence
atggctgctgtgtggcagcaggtgcttgccgtagatgcacgatataatgcctacagaacacctacattcccccagttcagaactcagtatattcggagaagaagccaactgctgcgggagaacgcgaaggctggtcacccgcccgccctgaggcggcagtacctgcgcctgcggggccagctgctgggacagaggtatgggcctctgagtgaacccggttccgcccgggcttactcaaattcaattgtcagatcctcccgcactactttggatagaatggaggacttcgaggatgacccacgcgccctaggcgcgagaggacaccggcggagcgtgtcccggggatcataccagctgcaagcgcagatgaaccgggctgtgtacgaagatcgccccccagggagcgtcgttcctacaagtgctgcggaagcatccagggcaatggccggcgatacaagcctctcagagaactatgcctttgcaggcatgtaccacgtgtttgatcagcacgtcgatgaagctgtaccaagagtccgcttcgccaatgacgatcgacatcgactcgcctgctgctctttagacggatctattagtctgtgccaactcgtacctgccccacctacagtgctccgggtgctgcgcggacacaccagaggtgtgagtgactttgcttggagtcttagcaatgacatcttggtgtccacatcactcgacgccaccatgcggatctgggctagtgaggacggacggtgtattcgtgaaattcctgatccagattccgcagagctgctatgctgcactttccagcctgttaacaataacctgactgtggtggggaatgctaaacataatgttcacgtcatgaatatctccacgggaaagaaagtcaagggaggctccagcaaactcaccggtcgcgtgttggccctgtcctttgacgcgcctggccgattgttgtgggcaggcgatgatcatgggtctgtgttttccttcctgtttgacatggctactggtaaattgacaaaagccaaacgcctagtggttcacgagggctcccctgtaacctctatctctgcgaggtcatgggtcagtagagaagctcgggacccgtctctgctgatcaatgcttgtctcaacaaactgctgttataccgggttgttgataacgaaggaacactgcaactcaaacgtagcttccccatcgagcagagcagtcacccagtgaggtccatcttctgtcccctcatgtcattcagacagggagcctgcgttgtaactggaagtgaggatatgtgtgtgcacttttttgatgtggagcgcgcggccaaggctgcagtgaataagctccagggccatagcgcccccgttcttgatgtgtcttttaattgcgatgaatctctactggcctcctcagacgcctccggaatggttattgtgtggagacgcgaacagaaatag

SEQ ID NO: 127633 - DNA, 309 bp, Artificial Sequence
  Description of Artificial Sequence: Synthetic coding sequence
atgtctgctagggtacgctcccggagcaggggaagaggagacggtcaggaagccccggatgtggtggcgtttgtggcaccaggtgagagtcagcaggaggagcccccgacggacaaccaagatattgagcccggacaggaacgggaaggcactccgcccatagaagaaaggaaggtcgagggggattgccaagaaatggacctggaaaagactaggagcgaacgcggcgacgggagtgatgtgaaggaaaagacaccaccaaacccgaagcatgccaagaccaaggaggcaggcgatggtcagccttag

SEQ ID NO: 127634 - DNA, 1575 bp, Artificial Sequence
  Description of Artificial Sequence: Synthetic coding sequence
atgagcgataacggcgagcttgaggataagccgccagcaccacccgtccgaatgagtagcacaatcttctcaactggcggtaaagaccctctgtccgccaatcactccctgaaacccttgccctcagtgcccgaagagaaaaagcctcggcacaaaattatcagtatcttcagcggaaccgaaaagggctcgaaaaaaaaggagaaagagagacccgagatctcacccccctcggacttcgagcacacgatccacgtgggcttcgacgctgtgaccggcgagttcaccggaatgcccgaacagtgggctcgcttactgcagacaagcaatataactaagctcgagcagaagaaaaaccctcaggctgtcctcgacgtgctcaaattttacgacagtaataccgtaaaacagaaataccttagttttaccccaccagagaaagacgggttcccatccgggacccctgctctgaacgccaagggaacagaggccccagctgtggtcacggaggaggaggatgacgacgaggaaaccgcccctcccgtaattgcgccccgtcccgatcacacaaaatccatatatacccgatcagttattgatccagtgcctgctccagtcggcgactcacacgtagacggtgcagctaaaagtctggacaagcagaaaaaaaagacgaaaatgacagatgaggaaatcatggagaagctaagaactatcgtgagcattggcgatccaaagaaaaaatacacacgatatgagaaaatcgggcagggcgcttccggcacagtgttcaccgctactgatgtagccctcgggcaggaggtcgccatcaaacagatcaacctccagaaacagcctaagaaggagcttatcatcaatgagattcttgtgatgaaggagctgaaaaaccccaacattgtgaatttcctagattcttatcttgtaggcgatgagctgttcgtggtcatggagtatctggcaggcgggtccctgaccgacgtggtcaccgaaacctgcatggacgaggcccagatcgctgctgtatgccgggagtgtctgcaagcacttgaattcctgcatgccaatcaggttatccacagggatataaaatccgacaacgtgcttctggggatggagggcagcgtgaaattgacggatttcggattttgcgcgcaaatcaccccagaacagtcaaaacgtagcaccatggtgggaacaccgtactggatggcaccagaggtcgttactaggaaggcttacgggcctaaggtggacatctggtccctcgggatcatggccattgagatggtggaaggggagcccccttaccttaacgaaaacccactgcgggctctgtacttgatagccaccaacggcacccctgaactgcaaaaccctgaaaaactgagccctattttcagagactttttgaatagatgcctcgagatggacgtggaaaaacgagggtccgctaaagagctactgcagcaccctttccttaagctggcaaaaccattgagtagtctcacaccccttatcatggccgccaaggaggcaatgaagtcgaatagatag

SEQ ID NO: 127635 - DNA, 1680 bp, Artificial Sequence
  Description of Artificial Sequence: Synthetic coding sequence
atgtcagatggcctggacaacgaggaaaagccccccgcccccccccttcgaatgaacagtaacaatcgcgattccagcgccttgaatcactccagcaagcctctccctatggcgccggaggagaaaaataaaaaggcaagattgcgtagtatttttcctggtggcggggataagaccaacaagaagaaagagaaggagagaccggagatctcgctccccagcgactttgagcacacaatccatgtggggttcgacgccgtgacaggcgagttcacccccgatctgtatggctcccagatgtgccccggcaagctgccggagggcatccccgagcagtgggctaggttacttcagaccagcaacatcactaaactggaacaaaaaaaaaatccacaagccgtactggacgtcctcaaattctatgatagtaaagagaccgtgaacaaccagaagtacatgagttttacaagcggcgataagtccgctcacggatatatagcggcacacccttctagtaccaaaaccgcatctgaaccaccactggcccctcccgtctctgaagaagaagatgaggaggaggaggaggaggaggatgaaaatgaacctcctccagtcattgcccccagacctgaacacacgaagtctatttatactcgaagcgtggtcgagagcatcgcgtcccccgccgtccctaataaggaagtcaccccaccctccgctgaaaacgccaactcttccacactgtataggaacactgaccggcaacggaagaagtcgaagatgaccgatgaggagatcctcgagaagcttaggtcaatcgtgagcgtaggcgacccaaagaagaagtacaccagatttgaaaaaattggacagggagcttcaggcactgtctatacagcactggacatcgctactggtcaagaggtggctattaagcagatgaaccttcagcagcaacctaagaaggagttgattatcaacgagattttggtcatgagagagaataaaaacccaaacatcgtgaattatctggactcatacttagtgggggacgagctgtgggtcgtaatggagtacctcgctgggggctccctgaccgacgtggtaacagaaacttgcatggacgaggggcaaatagccgctgtttgtcgagagtgcctacaggctttggactttctccattccaatcaggtcatccacagagatattaagagtgataacatcctcctggggatggacggttctgtgaaactcaccgactttgggttctgcgcacagattacccccgagcagagtaagcgcagtactatggtgggcacaccatactggatggccccagaagttgtcacgcggaaagcctatggtccgaaggtggatatctggtcgttggggattatggccattgagatggtggaaggagagcccccttatctgaacgagaatcctctcagggcgttgtatctgatcgccactaacgggacgcctgaattgcagaatccagaacgcctgtccgctgtattccgtgatttcttaaatcggtgcctggagatggatgtggataggagggggagcgccaaagagttgcttcagcatcccttcctcaaattggccaagccactgagttcattaacccctcttattatcgcagccaaagaggcaattaaaaatagcagccggtag

SEQ ID NO: 127636 - DNA, 1743 bp, Artificial Sequence
  Description of Artificial Sequence: Synthetic coding sequence
atgtccgatggcctcgacaacgaggaaaaaccgcccgccccacctctcagaatgaactctaataatcgggattccagcgccctgaaccactcatcaaagccgctgccaatggcccctgaggaaaaaaataagaaagcgagactgagatctattttccccggcgggggcgacaagaccaacaagaagaaggaaaaagaacggccagaaatatccttgccttctgactttgagcacactatacatgtcgggttcgatgccgttacaggggagtttacaaacagtccctttcagacctctcgtccagtcaccgtggccagcagtcaatccgagggcaagatgccggacctatatggcagccagatgtgtcccggaaagctcccagaagggattccggagcagtgggccagacttctccaaacaagtaatattacgaagctggagcaaaagaagaacccacaagccgtgctagatgtgcttaagttttatgactctaaagagactgttaacaaccagaaatacatgtctttcacctctggagacaagagtgcgcacggctacattgccgctcatccaagttccacaaaaacggcgtcagagcctcccctcgcaccacctgtgtcagaggaggaggatgaagaggaggaggaggaggaggacgaaaacgagccgcctcccgtgattgcccctcggccggagcatacgaaatccatttatacgagatccgtggtagagtccatcgcctctcccgccgtgcccaataaggaagtcactccccctagtgcagagaacgccaactccagcaccctgtacagaaatacagatagacaaaggaaaaagtccaagatgacagacgaagaaatcctggagaagctgaggtctattgtgtcagttggcgatccaaaaaaaaaatataccagattcgagaaaattgggcagggcgcctccggcaccgtatataccgcccttgatatcgcaactgggcaggaggttgccatcaagcaaatgaatcttcaacaacagcctaaaaaggagcttattataaatgagattttggtcatgcgcgaaaataagaatcctaatatcgtaaattatctggatagctacctcgttggggacgagttgtgggtcgtcatggaatacctcgcgggcgggtcccttaccgatgtggtgacggagacctgcatggacgagggccagatcgcagctgtctgtcgggaatgtctgcaagccctggactttcttcattcaaatcaagtgattcaccgggacattaagagcgataacattctcctgggtatggatggcagcgtgaagttgaccgactttggcttctgtgctcagatcaccccagagcagagcaaacggagcactatggtgggtaccccttattggatggcacctgaggtggtcactcggaaggcttacgggcctaaggtggacatctggtcattgggcatcatggccatcgaaatggtcgagggagaacccccgtacttaaacgagaatcccctgcgcgctctatacctgatcgccaccaatggaaccccagagcttcaaaatccagagaggctgtccgcggtctttagggacttcctgaacagatgcttggaaatggacgtcgatagacgcggaagtgcaaaggagctactgcagcacccttttctcaagcttgccaaacctctctccagcctgaccccgctcataatcgccgccaaggaggccataaaaaactctagcagatag

SEQ ID NO: 127637 - DNA, 1635 bp, Artificial Sequence
  Description of Artificial Sequence: Synthetic coding sequence
atgtctgatggacttgataatgaagagaaacctccagcaccgcctctcagaatgaattcaaacaacagagactcctctgccttgaaccactcttccaagccactgccaatggcccccgaagagaagaataagaaggcccggttgcggtcaattttccccggaggaggagataagaccaataaaaaaaaggagaaagagcgcccggagatctctctgccctcagattttgagcatactatccatgtcgggtttgatgctgtgactggggaatttactgggataccagaacagtgggccaggttgctgcagaccagtaacattactaagctggagcagaaaaaaaatccacaggcggttttagacgtgctcaagttttatgactctaaagaaacagttaacaaccagaaatacatgtcattcacttcaggagacaagagcgcacacgggtacatagccgctcacccttcctccaccaaaacagcatccgagccacctctggcaccaccagtatctgaagaagaagatgaagaggaggaggaggaggaagacgagaacgagccccccccagttatagccccacgtccagaacatactaagagcatctacacccgctctgtggtggagagtattgcgtccccagcagttccaaacaaggaggtgaccccgccctcagctgaaaacgccaacagcagtaccctataccgaaataccgatcggcagcgcaaaaaatccaagatgacagatgaagaaatactggaaaagctgcgtagcatcgtcagtgtgggagacccaaaaaaaaaatatacccggttcgagaagatcgggcagggtgctagtggtacagtgtacaccgctctcgatattgcaaccggacaggaggtggccatcaaacagatgaatctccaacagcagcccaaaaaagagttaattattaacgaaatcctcgtcatgagagagaataagaacccgaatatcgtcaattatttggacagttatctggtcggggatgaattgtgggtggtcatggagtatctagccggcgggagccttacagacgtggtaactgaaacgtgtatggacgaggggcaaattgccgcagtgtgtcgggaatgtctgcaggccctggatttcctgcacagcaatcaggtgatacaccgcgatataaagagcgataatatccttctcggtatggacggatctgtgaaactaactgatttcggcttctgcgcacagattactcccgaacagtccaaacggtcgactatggttggcacaccctattggatggcccctgaagttgttacgcggaaggcatacggaccgaaggtcgatatctggtccttaggcatcatggcaatcgagatggttgagggggagcctccctacctcaacgaaaaccctctgagggccctgtacctgatagcgacaaacggaacccctgagctgcaaaaccctgaaagattgagcgctgtgttcagggatttcctgaaccgatgtttggaaatggacgtagaccgtagaggctcagccaaagagcttcttcaacaccctttcctcaagctggcaaagcccctgtcctctctcaccccactcatcatcgccgccaaagaagctatcaagaattcttcgagatag

SEQ ID NO: 127638 - DNA, 1680 bp, Artificial Sequence
  Description of Artificial Sequence: Synthetic coding sequence
atgagcgacgggcttgacaacgaggaaaagcctcccgctccacctcttcgcatgaattccaataacagagattcatcagcccttaatcattcttctaagcccctccccatggcccccgaagagaagaacaagaaggctcggctgcggagcattttcccaggcggcggtgataaaaccaacaagaaaaaagagaaagaacgccctgagattagcctgcctagcgacttcgagcataccatccatgtgggatttgacgctgtcaccggagaatttaccccggatctctatgggagtcaaatgtgccccggtaaattgcccgaggggatccctgaacagtgggcacgcctgctccagacctctaacataactaaactcgagcagaagaagaacccccaggcggtcctggacgtgctcaaattttacgacagtaaggaaaccgttaacaatcagaaatacatgagcttcaccagcggcgacaagagtgcccatggctatatcgctgcacacccgagttcaacgaaaactgcatccgagccccctttggctccgccggtttctgaggaggaggatgaggaagaggaagaagaggaagatgaaaacgaaccaccccccgtaatagctcctcgacccgagcacacaaaaagtatttatactagatcagtggtggaaagtatcgctagtccagctgttccaaacaaagaggtcactccaccaagtgccgaaaacgccaactcctctacgctgtatcgaaatactgatagacaaagaaaaaagtccaaaatgaccgacgaggaaattctggaaaaactcagatccattgtgtctgtgggcgacccaaagaaaaaatatacccgctttgagaagatcggacagggtgcctccgggaccgtgtatacagccctggatatcgctaccggccaggaggtcgcgattaaacagatgaatctccagcagcagcctaagaaggaactaattattaacgaaatcctggttatgcgtgaaaataagaatccaaatatcgttaactacctggacagctacctcgtcggcgacgagttatgggtggtcatggagtatctggccgggggctctctgacggacgttgtcaccgagacctgcatggatgaaggtcagatagccgctgtgtgtagggagtgtttgcaagcgctggactttctacactccaaccaggtgatccaccgtgatattaagtccgacaatatcctgctgggtatggatgggtctgtaaagttaactgatttcgggttttgcgcccagataactccggaacagtccaaaagatctactatggtcggcacgccttattggatggcgccagaggtcgtgactcgcaaagcttacggaccaaaagtggatatttggagtctgggtatcatggctattgaaatggttgagggggaacccccctacttgaacgaaaatccacttagggcgctgtacctgattgctactaacggcacccctgaactgcaaaaccccgaacggctgagcgccgtttttcgggattttctgaaccgttgcctggaaatggacgtggataggcggggaagcgccaaagagcttttacagcacccatttctgaagctggccaagcccctgtcttcactgacccccctgattattgccgcaaaggaggccataaaaaatagcagtcgctag

SEQ ID NO: 127639 - DNA, 1698 bp, Artificial Sequence
  Description of Artificial Sequence: Synthetic coding sequence
atgagcgatgggttagacaatgaagagaagcccccagctcccccattgcgaatgaacagtaataatcgggacagcagcgcacttaatcacagctccaaacctctgcctatggcccctgaggagaagaacaaaaaagcccgcctcagatccattttcccagggggcggagataaaaccaacaagaaaaaggagaaagagcgtccagagatctccctgccctcagattttgaacatactatccatgtaggattcgatgctgtcacgggggaattcacgaactcaccctttcaaacttcacgccccgtgaccgtggcaagctctcaatcagaggggaaaatggggattcctgagcagtgggcacggctactgcagacttcgaacattacaaaattggaacaaaagaaaaatccccaggccgtgttggatgtcctgaagttctacgatagcaaagaaacagtgaataaccagaaatacatgtcattcacttcaggagacaaatcagcacacggatatatcgccgcccatccaagcagcactaaaaccgcctccgagcctcctctagcacccccagtgtctgaagaggaggatgaggaagaggaggaagaggaagacgaaaacgaacctccacccgtcatcgcaccgcggccagaacacaccaagtctatttacactagatccgtcgtggaatctatcgcctccccagctgtgcccaataaggaggtgacacccccttccgcagagaatgccaatagtagcaccctctaccggaacaccgaccgtcagcgcaaaaaatcgaagatgactgacgaggaaatcctagaaaagcttcgctcgatcgtctctgtcggggatcccaaaaagaagtatacaaggttcgagaaaattggtcagggggcctcaggaactgtatataccgcacttgatatcgccaccgggcaagaagttgccatcaagcagatgaatctccagcagcagccaaagaaggagctgatcataaatgagatcttggtgatgcgagagaataaaaaccctaacattgtcaattatctcgacagctacctggtaggcgacgaactgtgggtggttatggagtatctcgccggcggcagtctgactgacgtggttacggagacctgcatggatgaaggccaaatcgcagccgtttgccgagagtgtctgcaggctctggactttttgcactcaaatcaggtgatccatagggacataaaatctgacaatattctgctgggaatggacggtagtgtgaagctgaccgacttcggcttttgcgcccaaatcacccctgaacaatctaagagatcaaccatggtcggtactccctactggatggctcccgaagtcgtgactaggaaggcctacgggcctaaggttgacatttggagcctggggattatggcaatagagatggttgagggggaacctccgtacctgaatgagaaccccctacgggctctctacctgatcgctacaaatggcacccccgaacttcagaacccggaacgcctcagcgctgtattccgcgactttttaaatagatgtctggagatggacgtggatcgtagaggaagcgccaaggaactcctgcagcacccatttttaaagttagcgaagccgctgtcaagcttaacccccttgataatcgccgcaaaggaagcgatcaaaaactcctcccgctag

SEQ ID NO: 127640 - DNA, 1635 bp, Artificial Sequence
  Description of Artificial Sequence: Synthetic coding sequence
atgtccgacggtctggacaacgaagaaaagcctcctgcccctccactcagaatgaactcaaataatcgggactcaagcgccctcaatcattcctctaagcccttacccatggcacctgaagaaaagaacaaaaaagctcgtctgaggtcgattttccccggagggggcgataagactaacaagaaaaaagagaaggaacggcccgaaatctccctgccgtctgatttcgagcataccatccatgtcggattcgatgccgtaaccggggagttcacaggtatcccagagcaatgggcccgcctgcttcagacgtcgaacattaccaaactggagcagaagaaaaacccacaggctgtccttgatgtgcttaaattctacgattcgaaagagactgtaaacaaccagaagtacatgagttttacttcaggagacaagagtgcccacgggtatatcgctgcccacccttcatctacgaaaaccgccagcgagcctcctctggcaccccccgtgagtgaggaggaggatgaagaggaggaagaagaagaggatgaaaatgagccccctcccgtgatcgcacctcggccggaacacacaaagtcaatatacacccgcagcgttgtcgagagcattgcctcacccgcagtcccaaataaagaggtaacccctcctagcgctgaaaatgctaactcaagtactttatatcgcaatacagaccgccagaggaaaaagtcaaagatgaccgacgaggaaatactggagaaactgaggtctatcgtgtccgttggggatcccaagaaaaagtacactagatttgagaagattggacaaggagcttctggcacagtgtacacagccctcgacatcgccaccgggcaggaagtggcaatcaaacagatgaatcttcagcaacagcccaagaaggagctgataatcaacgaaatactggtcatgagggagaataagaatcctaacatcgtgaactaccttgattcatacctcgtaggtgacgagctgtgggtagttatggagtatttagccggcgggtcgttgactgacgtcgtgaccgagacatgtatggatgaggggcaaattgcagccgtttgcagagaatgcctccaagcactggatttcctgcacagcaaccaagtaattcacagggacattaagtctgataatattttacttggaatggacgggtccgtcaaactcaccgacttcggattctgcgctcagatcacccctgaacagtcaaagagatccactatggtaggcacaccatactggatggccccggaagtggtgaccaggaaggcttatggtccaaaggtagacatatggtcactgggtataatggcgatcgaaatggtcgagggtgaaccaccatacctgaatgagaacccactgcgggcattatatctcattgctaccaacggaactcccgagctgcagaacccagaacgactctccgctgtctttagggacttcctcaaccgctgtctcgagatggacgtggaccggcgcgggtctgccaaagaattactccagcatccgtttctgaagttggcaaagcctctctcgagcttaacccctctgattatagccgctaaggaggctatcaaaaacagcagtcggtag

SEQ ID NO: 127641 - DNA, 546 bp, Artificial Sequence
  Description of Artificial Sequence: Synthetic coding sequence
atgtcagatggcttagacaatgaagagaaaccacccgccccaccgttaagaatgaactccaataatcgagactccagcgccctaaaccatagcagtaaacctctaccaatggcacccgaggaaaaaaacaaaaaggccagattacgaagcattttccccggcggaggtgataaaacaaacaagaagaaggaaaaggaaagacctgagatcagcctacctagtgattttgagcacaccatccatgtaggcttcgatgcggtcactggggagttcaccaactctccatttcagaccagtaggccggtcacagtcgcctcaagccagagtgagggaaaaatgccagacctgtacggctcccagatgtgccctggcaagctacctgaaggtatccccgagcagtgggctagactgctgcagacttcaaacatcaccaagctggaacaaaaaaagaacccccaggccgtgctcgacgtgttaaaattttatgacagtaaggagaccgtgaacaatcagaagtatatgtccttcacctcaggggacaaatag

SEQ ID NO: 127642 - DNA, 1635 bp, Artificial Sequence
  Description of Artificial Sequence: Synthetic coding sequence
atgagcgatgggctggacaatgaggaaaagcctcccgcccccccacttcgcatgaacagcaataaccgggattctagcgccttgaatcattccagcaagccactgccaatggctccggaagagaagaacaagaaggcccgcctgcgatcaatctttcccgggggcggggataaaaccaataaaaaaaaagaaaaggaaagacctgaaattagcttgcccagcgattttgaacacaccatacatgtgggctttgacgccgtgacaggcgaattcacagggatccccgaacaatgggcacggcttctgcagacctcaaatattactaaactggagcagaagaaaaacccccaggctgttctcgatgtgcttaagttctacgactcaaaggagaccgtcaacaatcagaagtatatgagcttcacgagcggggacaagagcgcgcatggctacatcgcagctcatccaagctccactaaaactgcctccgagcctcccctggctcctcctgtgtcggaagaggaggacgaggaggaggaagaggaggaggatgagaacgagccaccacctgtgatcgccccccgtccagagcacaccaagtctatttatactagaagcgttgtggagagtatcgcttcgccggcggttcccaataaggaggtgactccaccctccgcagagaacgccaactccagtactctgtataggaacacagatcgccaacgcaagaagagcaaaatgaccgatgaggaaatcctggagaagctgaggagcatcgtgtctgtgggagatcctaagaagaagtatacccggttcgagaaaatcggacagggggcctctggcacagtgtacactgccttggacatcgccacggggcaggaggtggccataaagcagatgaacctccaacagcagccaaagaaggaactcatcattaatgagatcctggtgatgagggagaacaagaaccccaatattgttaactatctagactcctacctggtcggagacgagctttgggtggtcatggagtatttggccggaggatccctgactgatgtggtaacggaaacgtgtatggacgaggggcagattgcggctgtgtgtcgcgagtgtctccaggccttggattttctgcactccaatcaagtgatccatcgcgatataaagagcgacaacattctcctgggcatggacggaagcgttaaactgacggattttggcttctgcgcacagattacccctgagcaatccaaaagatctacaatggtaggtacgccctattggatggctccagaagtcgtgactcggaaagcctacggaccgaaagtagatatctggtctctaggtatcatggcaatcgagatggttgagggcgaaccaccgtacttgaacgaaaatcctctaagggctctgtacctcatcgctactaacggaaccccggagctccaaaaccccgagcgactcagtgcagtgtttcgtgacttcctgaatcggtgcctagagatggatgtggaccgcaggggatcagcgaaggaactactgcaacacccattcttgaaattggcgaaacctctgagtagtctaacccctttaatcatcgccgcaaaggaggccataaaaaattccagtagatag

SEQ ID NO: 127643 - DNA, 1743 bp, Artificial Sequence
  Description of Artificial Sequence: Synthetic coding sequence
atgagcgacgggctcgataacgaagagaagcctccagccccgcctctgcgtatgaactcaaataatagggacagtagcgcattgaaccactcatctaagcccctccccatggcaccggaagaaaagaataagaaagccagactacgctctatcttcccgggagggggggataagactaacaaaaagaaggaaaaagagcggccggagatcagcctgccaagcgacttcgagcatacaattcatgttgggttcgacgctgtgactggcgaattcactaattctccatttcagacatctagacctgttaccgtcgccagctctcagtcggaagggaagatgcccgacctgtatggaagccaaatgtgcccgggtaagctgcctgaaggtatacccgaacagtgggctagactgttacaaacgtctaacataaccaagttagagcagaaaaagaatcctcaggccgtccttgacgtgctgaagttttatgactctaaagaaaccgttaataatcagaagtatatgtcatttacctcaggtgataaaagtgcgcacggctacatagctgctcacccttcctcgacaaaaactgcgtccgagcctccattagcacctcctgtttccgaagaagaggacgaggaggaggaagaagaggaggacgagaacgagcccccacctgttattgcaccgagacccgagcatacaaaatctatttatacccgtagtgttgttgagtccatagcgagccccgcggttccgaacaaggaggtgacgcccccttcggcagagaatgcgaattcgtcgactctctaccgcaacactgatcgccagcgaaaaaaaagtaaaatgaccgacgaggaaatcttggaaaagctacgaagtatcgtgagcgtcggtgaccctaaaaaaaaatacacccgctttgagaaaatcgggcagggggcctctggaaccgtttatacggctctggatatagccaccgggcaggaagtggctatcaagcagatgaacctacagcagcagccaaagaaggagctgatcataaacgagatccttgtcatgcgcgaaaataaaaaccctaatatcgtaaactacctcgatagttacctggtgggcgatgaactctgggtggtgatggaatatctcgccggcgggagcttgaccgacgttgtgacagaaacatgcatggacgagggccagatcgccgcggtctgtagagagtgcctccaggctctggacttcttacactcaaaccaggtgatccacagggatattaagtccgataacatcctcctggggatggatggcagcgtaaagttgacagattttggtttctgtgcccagattacccccgagcagagcaaacggagtacaatggtggggaccccatattggatggccccggaggtcgtgactcgcaaagcctatgggccaaaggttgacatctggtccctagggatcatggccatagaaatggtcgagggggaaccaccatatttgaacgaaaatcctctgcgggcactgtatttgatcgctaccaacggtacgccagaactacagaatcctgagcgtctaagcgctgtctttagggacttcctgaaccgctgcttagagatggacgtggatcggagggggtctgcaaaggagcttctacagcacccctttctaaagctggcaaagccccttagctctctgacaccactgatcattgccgccaaagaggccatcaagaacagcagcagatag

SEQ ID NO: 127644 - DNA, 1698 bp, Artificial Sequence
  Description of Artificial Sequence: Synthetic coding sequence
atgagcgatggcctggataacgaggagaaacctccagcccccccattacgcatgaactctaataacagggactcctccgcacttaaccactcctcgaaaccgcttcctatggctcccgaggagaagaataagaaggcaagattgcggagcattttccctggggggggagataagacaaataagaaaaaagagaaagagcgcccagagatctcgttaccatccgatttcgagcataccatccacgtgggatttgatgcagtgacaggggaatttacgaactcacctttccagacatcccgtcccgtgacggtggcgtcgtctcagagtgagggtaaaatgggaatccccgaacaatgggcaagactgttgcagacttccaacattacaaagcttgaacagaagaaaaatccccaggccgtgctggacgtgctcaaattttatgatagcaaggagactgtaaacaatcaaaaatacatgagctttacatcgggggataagtcagcccacggatacatcgctgcccatccgtcaagcactaaaaccgcatcagagcctcctctcgcacctccggtgagcgaggaggaggatgaagaggaagaagaagaggaggacgaaaacgagcctcccccagttatcgctcctcgtccagagcataccaagagcatttacaccaggagcgtagtcgaaagtatcgcatctcccgccgtgccaaataaagaggttacacctccttccgccgaaaacgccaacagtagcaccttgtaccgcaatacggatagacagaggaagaagtccaaaatgaccgacgaagagattcttgagaaactacggagtatcgtgtctgtgggcgacccgaaaaaaaaatatacacgtttcgaaaagatcggacaaggtgcctctgggaccgtctacacggcactcgacatcgcaaccggccaagaggtggcaatcaagcagatgaatttgcaacagcagcctaagaaggagctcattattaatgagatcctggtgatgagagagaacaaaaatcctaacattgtgaattatctggattcatatctggtcggcgacgagctctgggtggttatggaatacctagccgggggtagtctaaccgatgtcgtgaccgaaacgtgtatggacgaggggcagattgctgcagtgtgccgagaatgcctgcaggcccttgacttcctgcactctaatcaagtgatccatagagacatcaagagtgataatattctgctcggcatggatggcagtgtgaaactgactgacttcgggttttgcgcacaaattactccagagcaatcgaaacggagcactatggttggcacaccatattggatggcccctgaagtggtcacccgcaaggcgtatggccctaaggtggatatctggtctcttggaataatggctatagagatggtcgagggagagccgccatacctgaacgaaaatcctctccgcgctttgtatctgatcgctacgaatggcaccccagagctgcagaatcctgagcgtttgagtgctgtatttcgtgatttcctgaacaggtgtttggaaatggacgtggatagacggggcagcgctaaagaacttctccaacatcctttcctgaagcttgccaagccattgtcaagccttactcctttgatcattgcagccaaggaagccattaaaaactcgagcagatag

SEQ ID NO: 127645 - DNA, 2046 bp, Artificial Sequence
  Description of Artificial Sequence: Synthetic coding sequence
atgttcagaaagaaaaaaaaaaaacgcccagaaatcagcgccccacagaattttcaacaccgtgtacataccagctttgacccaaaagaagggaagttcgtgggcttgccaccccaatggcagaatatactggataccctccgcagacccaaacctgtggtagatccgtcacggataactagagttcagttgcagcctatgaagacagttgtgcggggatctgctatgccagttgatgggtatatcagcggcttattaaacgatattcaaaagctgtccgttatctccagcaacaccttacggggcagaagcccaactagccggcggcgtgcacagtctcttggcctgctgggcgacgagcactgggctaccgaccctgacatgtacctgcagtccccacaatcggagaggactgacccgcacggcctgtatctgtcttgcaacggaggaaccccagctggccacaagcagatgccttggcccgagccacagagccccagagtgctccctaatggcttggccgcaaaagcccagtcactggggcccgctgagtttcaaggcgcctctcagcgctgtcttcagctgggcgcatgtttacagtcttcaccgccgggagccagcccacccaccggcacaaacagacacggcatgaaagctgccaagcacggctcagaagaggcaagacctcaatcttgtttagtgggctccgctactggtaggccagggggggagggcagtccctcacccaagactagggagagttccctcaaacgaaggttgtttcgttccatgttcctgtctacagccgctactgctccccctagcagtagcaagcccggtccaccgcctcagtctaagcctaactcaagctttcggccccctcagaaggacaatccccccagtctggtcgctaaagctcaaagtctgcccagcgaccagcccgtgggcacattcagccctttgactacttccgacacaagcagcccccaaaagtccttgcgcaccgcccctgccactggccagctgccgggaaggtcaagtcctgccggttcccctcgtacgtggcacgcacaaatctctacctccaacctgtatctgccacaggaccctactgtggccaagggagccttagccggcgaagacactggcgttgtaacacacgagcagtttaaagctgcattgagaatggttgtggaccagggcgaccctcggttgctcctggattcctatgtgaaaattggcgaaggttccactggcattgtttgtctcgctcgcgagaaacattccggtaggcaggtggctgtgaaaatgatggatctgcgcaaacagcagcgaagagaattactatttaatgaagtcgtgattatgcgcgattaccagcatttcaatgtggtggagatgtataagtcttatctggttggtgaagaattgtgggtgctgatggagttcctgcaaggcggtgccctaacagacattgtgtcacaggtgaggctgaacgaagaacagatcgcaacagtatgcgaggccgtgcttcaggccctggcttacttacatgcccaaggcgttattcacagagatattaaatccgactccatcctcctcaccttagatggccgggtgaagcttagcgactttgggttctgcgcccagattagtaaggacgtgccaaagaggaaatcccttgttgggaccccgtactggatggcgcccgaggtcatttcccgatctctgtacgcaactgaggtcgatatctggagcctgggcatcatggtcatagaaatggtggacggggagcccccttactttagtgacagccctgttcaagcaatgaaaaggctgcgcgacagtcccccgccaaagctgaagaattcccataaggtgagcccagtcctcagggacttcctggagcgcatgctggtgcgggacccacaagagcgagcaacggctcaggagcttctggaccaccctttcctccttcaaaccggtctgcccgaatgcctggtccccttgatacagctgtatcgcaagcagaccagtacctgctag

SEQ ID NO: 127646 - DNA, 2046 bp, Artificial Sequence
  Description of Artificial Sequence: Synthetic coding sequence
atgtttagaaaaaagaaaaagaaacgccccgaaatttcagctcctcagaactttcagcaccgagtgcacactagctttgaccctaaagaggggaagtttgtgggcttgccgccccaatggcagaatatactggatacactccggcggccaaaacctgtcgtggatccctctaggatcactcgcgtacagcttcagccgatgaaaaccgtggtcagaggatctgcaatgcccgtggacgggtatattagcggactgttgaacgacatccaaaaactcagtgtgatctcaagcaacaccctgcgggggaggagccctaccagccgccgccgtgcccaatctctcggcctcttgggtgatgaacattgggctactgatcccgacatgtacctacagtcaccacagtcagagaggactgatcctcatggactatacctttcttgcaatggtggcacccccgcagggcacaagcagatgccttggcccgagccacaaagccctcgtgtcctccccaacggcttggcagcaaaagctcagtccctggggccggcagagttccagggagcatcccaacgatgcctacagctgggagcctgtctgcagtcctcccctccaggagccagtccacctacggggacaaaccgccatgggatgaaagcggcgaagcacgggtcggaagaggcacggccacagtcatgcttggtaggctctgccacagggcgaccagggggagagggctcccccagtcctaaaaccagagagtcctctctgaagagacgcttgttccggtccatgtttctcagtactgctgccactgcccccccaagcagttctaaacctggacctccaccacagtccaaacctaactcgtcttttaggccaccccagaaggataacccaccatcgctggtggctaaggcgcagagtctgccctcggatcagcccgttgggaccttttcaccccttacaactagcgacacctcatccccacaaaagagccttcgcactgcccctgctaccggacagttgccaggcaggtccagcccagcaggaagcccccggacttggcacgcacagatcagcacctcaaatctgtatcttccccaggaccccactgtcgcaaaaggagccctcgccggtgaagacacgggagtcgtcacacatgaacagtttaaggctgcccttcgcatggtggtggatcagggggacccacgccttctgctggactcctatgtgaaaataggcgaggggtccaccggcattgtctgtctggcaagggagaagcattcaggccgacaagtggccgtgaaaatgatggatctaaggaaacagcagcgccgagagctgctcttcaatgaggttgtgatcatgagagactatcagcacttcaacgtggttgaaatgtacaagtcttatctcgtgggcgaggagttgtgggtcctgatggagttcctgcaagggggagcacttacagacatcgtctctcaggtacgactgaatgaggagcagatcgctaccgtgtgcgaggctgtgctacaggccctggcttacctgcatgcccaaggcgtcatccaccgcgacattaaaagtgattctatacttctgacactggacggacgggtcaagctgtccgattttggcttttgcgctcagatctccaaggacgttccaaagcggaaatctctggtgggaaccccatactggatggcccctgaagtgataagtcggtccttatacgccacagaagtagatatctggagccttggcataatggtaattgagatggtcgacggagagcctccgtacttcagcgattccccagtgcaggccatgaagaggctgcgcgactcccctcctcccaagctgaagaattcccacaaagtgtctcctgtgctgagagatttcctggaacgtatgctggtgcgagatccacaagagcgggccacggcccaggaactgttagatcaccccttcctcttacagactggtctccccgaatgtctggtacctttgattcaactgtatcgcaagcaaacctcaacatgctag

SEQ ID NO: 127647 - DNA, 2046 bp, Artificial Sequence
  Description of Artificial Sequence: Synthetic coding sequence
atgtttagaaaaaaaaaaaaaaagcgacccgagatcagtgcccctcagaattttcagcaccgggtgcatacatcattcgatcccaaggagggcaaattcgtgggtctgccccctcaatggcagaacatactggacactttacgaaggcccaagcccgtggtggatccttcgaggatcacacgggtgcaactccagcccatgaagaccgtcgtccgaggctccgctatgcccgttgacggctacatttccggcctgctgaacgacatccagaaactaagcgttatctcttcaaacacactacgtgggcggagcccgactagccgaaggcgagcccagtctctgggactgcttggtgacgagcactgggccaccgatcctgacatgtatctacagtcccctcagtccgaacggacggatccgcacggactgtacctgtcttgtaatggcggcacacctgccggccataaacaaatgccgtggccagaaccgcagtcacctcgggtgctgccaaacgggttggcggccaaagcccagtcactggggcctgcagaattccagggcgctagtcagagatgtctccagctcggcgcatgcttgcagtcatcaccccccggggcctcgccaccaacagggacaaatcggcatggaatgaaggctgcaaagcacggcagtgaagaggccagaccccagtcttgcctggttgggagtgcaactggtaggccaggaggggaaggaagccccagcccaaaaactcgtgaatcctccctgaaaagacgactgttccgtagcatgtttttaagcacagccgcgacagccccaccttcctcatccaaacctggacctcctcctcaaagcaagccaaacagctcatttagacccccccaaaaggacaaccctcccagcctggttgctaaggcacagagcctgccatccgaccagcccgttgggacatttagcccccttacaaccagtgacacgagcagtccacagaagagtctcagaacggcgcccgccaccggacaattgcccgggcggtcgtcaccagccggtagtcctagaacgtggcacgctcagatttccacatcgaatctatatctgccccaggatcccaccgtggccaagggtgcgctcgcgggagaggacaccggtgtcgtcactcatgaacagttcaaggcggcattgagaatggtagttgatcagggcgatcccaggctgctgttagattcctatgtgaagatcggggagggttccaccggtatcgtttgtctggcacgtgagaaacattccggaaggcaggtagctgtcaaaatgatggacctgcgtaagcagcaacgccgagagctactctttaatgaagtggttatcatgcgcgactatcagcatttcaacgtggtcgagatgtacaagtcttacttggtcggcgaggagctctgggtccttatggagtttctgcagggaggggcactgactgatattgtgagtcaggtcagacttaatgaagagcagatcgctacagtgtgcgaggctgtattgcaggctcttgcatacctgcacgcacagggcgtgatacatagggacataaagtctgactctatcctgctgacgttggacggaagggtgaaactgagcgattttggtttttgcgctcaaatttctaaagacgtgcctaaacgcaagtctttggtcggaacgccatattggatggcgcccgaagtgatctcccgcagcctttatgccactgaggttgacatatggagcctcggtataatggtgatagaaatggttgacggggaaccaccctattttagtgatagccccgtccaggcaatgaaacgcctccgggattctccgccacctaaactgaagaactcccataaggtcagtccagtgctgcgagacttccttgagagaatgctggtgagagaccctcaggagcgggctaccgcacaagagctcctggaccacccatttctacttcaaaccggattgccagagtgtctggtgcctttaatccagctgtaccggaagcagaccagcacttgctag

SEQ ID NO: 127648 - DNA, 369 bp, Artificial Sequence
  Description of Artificial Sequence: Synthetic coding sequence
atgtttaggaagaaaaagaagaaaagacctgagatttccgccccgcaaaacttccagcaccgggttcacactagtttcgatccaaaagaggggaagttcgtcggcctaccccctcagtggcagaatatattggacactctgagacgccctaagcccgtcgtggatccttctaggatcactagagtgcaacttcagccaatgaagaccgtagtgcgcggaagcgcaatgcccgtggacgggtacatctctgggctgttaaacgatatccaaaagttgagtgtgattagctcaaacacgctcagaggcaggtctcctactagcagaaggcgggcccaatccctggggcttcttggagacgagcactggtag

SEQ ID NO: 127649 - DNA, 372 bp, Artificial Sequence
  Description of Artificial Sequence: Synthetic coding sequence
atgttccggaagaaaaaaaaaaaaagacccgagatctcagcacctcagaattttcagcaccgagtccacacctctttcgacccgaaagaaggaaaatttgtgggcctgccacctcagtggcagaatatcctggacactttgcgccgcccgaagcccgtggtcgacccttctcgcataaccagggtgcagctccaacccatgaagactgtggtgagaggcagtgcaatgccggtagatggatacattagcggattgcttaacgacattcagaagctctcggtgatctctagcaacacattgcgcgggcggtccccaactagtcgacggcgggcacagagcttaggattactgggggacgaacattgggcctag

SEQ ID NO: 127650 - DNA, 330 bp, Artificial Sequence
  Description of Artificial Sequence: Synthetic coding sequence
atgtttagaaagaagaagaaaaaaagacccgagatttctgccccccaaaactttcaacatagggtccatacttcctttgacccaaaagagggcaaatttgtcggactccccccgcaatggcagaacattcttgatacccttcgtcggccaaaacctgtggtcgatcctagccgaattacaagggtacaacttcagccgatgaaaacagttgtgagggggtccgcaatgcctgtggacggctacatttccgggctgttgaatgatatccagaagctgtccgtgatctcatccaatactctccgagggcgcagtccaacgagccggcgttag

SEQ ID NO: 127651 - DNA, 339 bp, Artificial Sequence
  Description of Artificial Sequence: Synthetic coding sequence
atgtttcgtaaaaaaaagaagaagcggccggaaatttcggccccccagaacttccagcatcgagtccacacgtcctttgacccaaaggagggcaagtttgtaggcctgcccccccagtggcagaacatccttgacactctgcggcggcctaagccagttgtggatccctcaagaattacccgcgtccagctgcagcccatgaagacggtagtgcgggggtccgcaatgcccgtggacggctatatctctggcctgctgaacgatattcagaaactgtctgttatcagttccaacaccctccgcgggcgctccccaacatcaaggcgcagggcccagtag

SEQ ID NO: 127652 - DNA, 2046 bp, Artificial Sequence
  Description of Artificial Sequence: Synthetic coding sequence
atgttccgaaagaaaaaaaaaaaacggcctgagataagcgccccacagaattttcagcatcgcgtgcacacgtctttcgatccaaaggaaggtaaatttgtcggcttgcctcctcagtggcagaatatactggacacccttcggcggcctaaacccgtagtcgatccatccagaattacaagggtacagctgcagcccatgaaaaccgttgtgcgcggctccgccatgccagtcgacgggtacatatcgggattgctcaacgacattcagaaacttagcgtcataagttctaacacactccgggggcgatcacctacgtcacggcgccgggcccaatcccttggactacttggtgacgaacactgggctaccgatcccgatatgtacctgcagtcaccccaatccgagcgtacagaccctcacggcctgtacctctcctgcaacgggggcacacccgcggggcacaaacagatgccttggccagagcctcaaagtccaagagtcctacccaacgggcttgcagcaaaagctcaaagtctcggcccggctgagtttcagggcgcgagtcagcgctgtttacagcttggtgcatgcctgcagtcatccccgccaggtgcttccccccccacgggcacaaacagacacggcatgaaagcagcaaagcacggaagcgaagaggcccggccccagagttgtctagttggctcagccactgggaggcccggtggagaaggatcacccagtcctaagactcgcgagtcaagtcttaagcgtaggctgttccgaagcatgttcctgtccaccgctgcaactgcccctcctagtagctccaagcctggccctcccccacagtctaagcccaacagctccttcaggcctcctcagaaggataaccccccctcactggttgcgaaggcgcagtccctcccatcagaccagcctgtcggaaccttctctcctctaaccactagtgatacctccagcccccagaagtccctgaggacagcgcccgcgacgggacaactcccagggcggtccagccctgcaggatccccaagaacctggcatgcccagatctcgacgagcaatttgtaccttcctcaagatccgaccgtggctaagggagccctcgctggcgaagatactggcgtagttacccacgagcagttcaaagccgccctgaggatggtggtggatcagggcgatccccgattgctcctggatagctacgtgaagatcggagaaggatcaacaggcatcgtctgcctggcgagagaaaaacatagcggacgccaggtggctgttaaaatgatggatctgaggaagcagcagcgccgtgaactactctttaatgaagttgtaattatgcgcgactaccagcacttcaacgtggtggagatgtacaagtcatacctagtgggcgaagagctttgggtgctaatggaattccttcagggtggggccttaaccgacatcgtgtcacaggtgcgccttaacgaagagcagattgccaccgtctgcgaagccgttctgcaggctctggcttacctccatgcccagggggtcatacatagggatatcaagagcgactctattctgctgaccctggatggtcgcgtaaaacttagtgatttcggtttctgtgcccagataagcaaggatgtcccaaaaagaaagtccctcgtgggaacaccttattggatggccccggaggtgatttccagaagtctgtacgcaaccgaggtggatatatggtctttgggcattatggttatcgagatggtagacggcgaacctccatacttcagcgattcacccgttcaggccatgaagaggctgcgggattctcccccccccaagttgaagaactcccacaaggtgagccctgttcttcgagactttcttgaaagaatgctggtgcgtgatccgcaagaaagagccacagctcaagagttgcttgaccacccgtttcttctccagaccggactccccgaatgcttggtgccacttatccagctctaccgcaaacagacgtccacctgttag

SEQ ID NO: 127653 - DNA, 855 bp, Artificial Sequence
  Description of Artificial Sequence: Synthetic coding sequence
atgtttaggaaaaagaaaaaaaaaaggccggaaatctcagcgcctcaaaattttcagcaccgtgtgcatacctcttttgatcccaaagaagggaaattcgtaggactgccaccccagtggcaaaacatactggataccctgcggagacccaaaccagtcgtcgatccaagccggataacgcgggttcagctacaaccaatgaagactgtggtgaggggtagtgccatgccagtggatggctacatctccggcctgctgaacgacattcagaaactttccgtcatctcatcaaataccctgcgcggtcggtccccgacctcccgccgaagagcccagagcctcggcctcctgggagacgagcactgggccactgacccggatatgtatttgcaatccccccaatccgagcgcactgacccacatggactgtatttgagttgcaatgggggcacgcctgcggggcacaaacaaatgccctggcctgagccacagtcaccgagggtcctacctaacgggctggccgccaaagcccagagtcttgggcctgccgaatttcaaggggcatcgcagcggtgtttgcagctgggagcttgcttacagtcttcccctcccggggcttcacctcccactggtacaaaccggcacggtatgaaagccgccaaacacgggtctgaagaggctcgaccgcaatcatgcctggttggtagcgccacaggaagacccggaggcgaaggcagcccttccccgaagactcgagaatccagcctgaagagacgattgttccggtcaatgtttctgtccacagcggccactgcacccccgtcctccagcaaacctggaccccccccgcaatag

SEQ ID NO: 127654 - DNA, 318 bp, Artificial Sequence
  Description of Artificial Sequence: Synthetic coding sequence
atgttccgtaagaagaagaagaagcggcccgaaattagcgccccgcagaactttcaacatcgcgtgcacaccagcttcgatcccaaggagggaaaattcgtcggattgccccctcagtggcaaaacatcttggatactctacggcgcccgaagccggttgtggacccgagcagaatcacccgcgtgcagctgcagcccatgaagactgtggtgcgcggatctgccatgcccgtggatgggtatatatcaggccttctcaatgatatacagaaactgtctgtcatctcttccaatacgctccgcggaaggagtccatag

SEQ ID NO: 127655 - DNA, 441 bp, Artificial Sequence
  Description of Artificial Sequence: Synthetic coding sequence
atgatcaatatgggcgactcacatgtcgatacgtcatcgactgtttcagaagctgtggctgaagaggtaagtctctttagtatgaccgatatgattttgttcagtctgatcgtgggattactcacttactggtttctcttcaggaagaaaaaggaggaggtgcctgagttcacgaaaatacaaaccttgacctcttcagtgcgggaaagctcctttgtggagaagatgaagaagactgggagaaatattatagtgttttacgggagccaaaccgggactgctgaggagtttgccaataggctgtcaaaagacgcccatcgctacggcatgagaggtatgtctgcagatcctgaggaatatgatctggccgatttgtcatccttaccagagatcgacaacgctttagtcgttttttgtatggccacatacggagagggctag

SEQ ID NO: 127656 - DNA, 519 bp, Artificial Sequence
  Description of Artificial Sequence: Synthetic coding sequence
atgataaatatgggcgattcccatgtggacacttctagcacagtgtccgaagcagtcgccgaggaggtctcactgttctcaatgacggatatgatcttgtttagccttatcgtcggactgctgacatactggttcctgtttagaaagaaaaaagaggaggtgcccgaattcacaaagatccagacacttacatcctcagttcgcgagagctcctttgtcgagaagatgaagaagacagggcggaatatcatcgtcttctatggctcccagacgggtaccgccgaggagtttgccaatcgcctcagcaaggacgctcaccggtacgggatgcgtggcatgagtgccgatcctgaggagtatgacctcgccgatctcagttctctgccagagatagataacgccctcgtcgttttctgtatggcaacctacggtgagggtgaccctactgacaatgctcaggacttctacgattggctgcaagagacagatgtggacctctctggcgtaaaatttgcttag

SEQ ID NO: 127657 - DNA, 189 bp, Artificial Sequence
  Description of Artificial Sequence: Synthetic coding sequence
atgattaacatgggtgattcccatgttgataccagcagcaccgttagcgaagcggtggccgaggaagtgagtctcttcagtatgacagacatgattctgtttagcctgattgtggggctgttaacttactggtttctcttccgcaaaaagaaagaggaagtgccagaatttacgaagattcagacatag

SEQ ID NO: 127658 - DNA, 1107 bp, Artificial Sequence
  Description of Artificial Sequence: Synthetic coding sequence
atgggcaagtatgtcgacaaacgcttagagcagcttggggcacagagaatttttgagttaggtctcggagacgatgatggaaacctggaggaagatttcatcacatggcgtgagcagttttggccagcagtgtgcgagcacttcggcgtagaagcaacgggcgaggaatctagtatacgtcagtacgaactggtcgttcataccgatatcgatgcggccaaggtgtacatgggcgagatgggccggctcaagtcctacgaaaaccagaaacctccttttgacgccaaaaatccattcctggcagccgttactacaaataggaagctcaaccaggggacagaaagacatctcatgcatcttgagctggacatctcagacagcaagatcagatatgagagtggcgaccacgtggctgtctacccggctaatgatagtgctctagtgaaccaactgggcaaaatcctcggggccgatttggacgtggttatgtcactgaataatctggacgaggagtccaacaaaaagcaccccttcccctgtcccacatcttatagaacagcactgacttactacctggacatcactaatccaccccgtactaacgtgctgtacgaattggcacaatatgcctcagagcccagcgaacaagaactacttagaaagatggcttctagctctggtgagggaaaggagctttatttgagctgggtggttgaagctaggaggcacatccttgccatactgcaggactgcccgtcactacggccaccaatagatcacttgtgcgaactcctgccaagactgcaggcccgttattattcaatagccagctcttcaaaggtccacccaaattctgttcatatctgtgccgtcgtggtggagtatgagacaaaggccggccgaatcaacaagggtgtggctacaaattggctgagagctaaagagccagctggggagaacggaggaagagcgctcgctgtgcccacctcaacaagtgttggcatgcacggaacttggcccggtatgtgtcgcacgccctcaacaacttcttggctgtcaagcggcccatggtcaaccagaaggcgctggaccaccagtcgcaactag

SEQ ID NO: 127659 - DNA, 120 bp, Artificial Sequence
  Description of Artificial Sequence: Synthetic coding sequence
atgattaacatgggagattcacatgtggatacatcatcaactgtatcagaggccgttgctgaagaggtgtccctctttagtatgacggacatgatcttgttctccctgatcgtaggatag

SEQ ID NO: 127660 - DNA, 501 bp, Artificial Sequence
  Description of Artificial Sequence: Synthetic coding sequence
atgatcaacatgggcgactcccacgtggacacttcctccaccgtgtcagaagccgtcgctgaagaggtcagtcttttcagcatgactgatatgattttattcagcctgattgtaggcttgctcacttactggttcctgttccgaaagaagaaagaggaagtgccagaatttacaaagattcagactttaacatccagtgtcagagagagtagctttgtggaaaaaatgaagaaaacgggccgcaatatcattgtgttctatggatctcaaacaggcactgcagaagaattcgccaacaggttatctaaggacgctcatagatacgggatgcggggtatgtctgcggatccagaggagtatgatctggccgatctgtcttccctgccggaaattgataatgcactggtggtgttttgcatggcaacctacggtgagggagatccaaccgacaacgcgcaggacttctatgactggctacaggagacagatgtagatctgtag

SEQ ID NO: 127661 - DNA, 567 bp, Artificial Sequence
  Description of Artificial Sequence: Synthetic coding sequence
atgattaacatgggggatagccacgtggatacgtcttcgacggtctcagaagcagttgccgaagaagtttcccttttttccatgaccgacatgattcttttttccctcattgtcggactgctgacatactggttcttattcagaaagaagaaagaggaggttcctgaatttaccaagatccagaccctcacatccagcgtcagagaaagttcctttgtggaaaaaatgaaaaaaaccggcaggaatatcatagtgttttatggttctcagacgggcaccgccgaggagttcgctaaccgtctgtcaaaagacgctcacagatatggtatgcggggtatgtcagcggatcctgaggagtatgacctggccgatctgtccagtctgccagaaatcgacaatgccctcgtcgtgttttgtatggccacctatggtgagggcgatccaacagacaacgcgcaggatttttatgactggctgcaagaaacagatgtcgacttaagcggagtgaaatttgctgtgtttggtctgggcaacaagacatatgagcactttaatgccatggggtag

SEQ ID NO: 127662 - DNA, 189 bp, Artificial Sequence
  Description of Artificial Sequence: Synthetic coding sequence
atgattaacatgggggatagccacgtcgacacatcttccactgtgtcagaggctgtagccgaagaggtcagcctgtttagtatgaccgacatgatcctgttcagcctgattgtgggcctgctgacctactggtttctgttcagaaaaaaaaaagaggaagtacccgaatttacaaaaattcagacatag

SEQ ID NO: 127663 - DNA, 1722 bp, Artificial Sequence
  Description of Artificial Sequence: Synthetic coding sequence
atgggtagcagatggcccgctgtgcccccttggggattgcaaatccacgtgtccgaacgccagccgtcaaggcctccaccatgtccccaacagccagggcaggccacctgtgagaccctcagcagcgcccccgaccctagcaccactagaatgtctcctccgtgcccgcagccacagtccgcacccgggggaatcggatgctggcgattgaaggtattcggactggggaacaaaacatacgaacatttcaacgcaatgggtaagtatgtagacaagcgcttggaacagttaggcgcacaacgcatcttcgagttaggattgggagacgatgacggaaatctggaggaagatttcattacctggagagagcagttttggcccgcggtctgcgaacactttggcgtcgaagcaacaggggaggagtctagcatacggcagtacgagctggtcgttcacacagatatcgacgcggcaaaggtgtatatgggtgagatgggccggctaaagtcctacgagaaccagaaaccgcccttcgatgctaagaatcctttcctggcagctgtgaccaccaatcgcaagcttaaccagggaacagaaaggcacctgatgcacctggaactggacatatcagactccaagattagatacgagagcggtgaccacgtagcagtctaccctgcaaatgattcggctctggtgaaccagcttggcaagatattgggggccgacctggatgtggtgatgtcgctgaacaacctggacgaggaatctaacaagaagcaccccttcccttgcccaacctcatatcgtacggccctcacttattacctggatattacgaaccccccaagaactaacgtgctgtacgaactggcacagtatgcatccgaaccctccgagcaggaactgctgcggaaaatggcatccagctccggagagggaaaggaactatacctgtcttgggtcgttgaagcccgaagacacatcttggccattcttcaggactgtccatcacttcgaccccctatcgaccacctctgtgaattgttgcccagactgcaagctcgatactacagcatcgcgtcaagcagcaaagtgcatcccaattctgtccacatctgcgctgtggtggtggaatatgaaaccaaggccggtcgaattaacaagggcgtggccacaaactggctgcgagcgaaggagcctgcgggcgagaatggcgggagagccctggtcccaatgtttgtgcggaaaagtcagttccggttgccttttaaagcgactacaccagttattatggtcggcccaggcactggcgtggctcccttcatcgggtttattcaggagagggcctggctgcggcagcagggcaaagaggtaggcgaaacactgctgtactatgggtgtagaaggtctgacgaggactacctgtaccgggaggaactggctcagttccatcgggacggtgccctgacccagctgaatgtggcattctcaagagaacagtctcataaggtgtatgtccagcacctgttaaagcaggatagagagcacctgtggaagttaattgaggggggtgcgcatatttacgtatgtgggactccctcttcctgtccaggcatgcatggcacttggcccgggatgtgtcgcactccatccactacttcatggctgagttcaggaccttggtctacccggcggcggtggactacaagccggaattag

SEQ ID NO: 127664 - DNA, 423 bp, Artificial Sequence
  Description of Artificial Sequence: Synthetic coding sequence
atgattaatatgggtgatagccacgtggacacctcctcaacagtatctgaagcagtggctgaggaagtgtcactgtttagcatgaccgacatgattctcttctcacttatcgtaggtctgctgacctattggttcctcttccgcaaaaaaaaggaggaggtgcccgaattcactaagatacaaaccctgaccagcagtgtgcgagagtcttcctttgtagaaaaaatgaagaagacggggcgaaacatcatcgttttttatgggtcacagacggggactgcggaagagttcgcaaacagactctccaaggatgcacatcggtacggaatgcggggcatgtcagcagacccagaagaatatgacctggccgatctctcttcgctgcctgaaattgataatgcccttgtagtgttttgtatgtag

SEQ ID NO: 127665 - DNA, 2043 bp, Artificial Sequence
  Description of Artificial Sequence: Synthetic coding sequence
atgatcaacatgggggactcacacgttgacactagctctaccgtcagcgaagctgtggccgaggaagtttcactgttttcaatgactgatatgatcctgttctcccttattgtgggactccttacctattggttcctgtttcgcaagaaaaaagaagaggtccctgagtttacgaagattcagaccctgacgtctagcgtcagagagtctagtttcgttgaaaagatgaaaaaaacgggccgcaacatcatagtattctacggcagccaaactgggaccgctgaagagttcgccaataggttgagcaaagacgcacaccggtacggcatgcggggtatgagcgccgacccggaggagtacgaccttgctgacctttcctcactgcccgaaatcgataacgccttagtcgtgttctgcatggcaacctacggggaaggcgaccccacagacaatgcccaagacttctatgactggcttcaagaaaccgatgtcgatctgagtggcgtcaaattcgcagtttttggcttgggaaacaagacctacgagcatttcaatgcgatgggaaagtatgttgacaagaggctagaacagcttggagcccagcgtatctttgagcttggactgggcgacgacgacggaaatctggaggaggacttcataacatggcgggagcagttctggccggcagtgtgtgagcacttcggcgtcgaggctaccggcgaagagtcatctattaggcagtatgagttagttgtgcacaccgatatcgatgccgccaaagtctacatgggagagatggggcgcttaaagtcatatgaaaatcagaagcctccttttgacgctaaaaatcccttcctcgccgccgtaacgacgaatagaaagctgaaccagggaaccgaaaggcatctgatgcatcttgaactagatataagcgactcgaagataaggtatgagtcgggcgaccatgtggccgtctacccggcgaatgattcagcactcgtgaatcagcttgggaaaattttgggggcggatctcgatgtcgttatgtccctcaacaatttagatgaggagagcaataagaagcaccccttcccttgtcccactagctataggaccgccctaacctactatctggacataaccaaccccccaagaacaaacgtgctctacgagttggcccagtatgcgtctgagcccagtgaacaggagcttctacgtaagatggcctcatctagtggagaaggaaaagaactctatttgtcctgggttgtcgaggccaggagacacatcttagccatcctccaggattgcccttcccttaggcccccgatcgatcatctgtgtgagctcctgccccgtctacaagctcggtattactcaatcgccagcagctcaaaggtgcacccaaattctgtacacatttgcgcggttgtcgtggaatacgaaactaaggccggaagaatcaacaagggcgtcgctacaaattggctgagagccaaagagcctgcgggagagaacggtggtcgggcgctcgtgcctatgtttgttcggaaaagccagtttcgcctgccttttaaggcaactacgccagtcatcatggttggacctggtaccggggtcgccccttttattgggttcattcaggagagagcctggctgagacaacaagggaaggaagtgggggaaaccctgctgtactacggctgtcgtagatccgacgaggattacctataccgcgaggaactggcacaatttcatcgggatggggcgctaactcagctgaacgtggcgttcagtcgtgaacagtcccacaaggtgtatgtgcagcacctattgaaacaggaccgggaacacctgtggaaattaattgagggaggcgcacacatttatgtctgcggggacgcacgtaacatggcccgggacgttcagaatacattctacgatatcgtggcggaactcggggccatggagcacgcccaagcagtggactatatcaagaagctcatgacaaaaggaaggtattcactggacgtgtggtcttag

SEQ ID NO: 127666 - DNA, 1467 bp, Artificial Sequence
  Description of Artificial Sequence: Synthetic coding sequence
atgccacgtacgagtaccacaggatgcaggaggcagacgtggatctcactgggtagctcctcgaggctagaggaagactttataacttggcgtgagcaattctggcctgctgtgtgcgagcattttggggtcgaggccaccggagaggagtcttccatccgccaatatgagttagtggtgcacactgacatcgacgcggccaaagtgtacatgggcgagatgggtagactgaaaagctacgaaaatcagaagccaccctttgacgccaaaaatcccttcttggccgcagtgaccactaataggaagctaaaccaagggacagaacgccatctgatgcacctcgaactcgatatttctgattctaagatacggtatgagtcaggggaccatgtagctgtttatcctgcaaacgatagtgccctggtcaatcagttgggtaaaatcctcggtgccgacctggacgtggtaatgagcttgaacaacttagacgaagagtccaataagaagcacccatttccctgccccacatcctatagaacagccctgacctactacttggatatcacgaacccccccagaaccaatgtgctgtatgagctggcccagtacgcctccgaaccctccgagcaggagctcctgcggaaaatggcatcaagttcaggtgaagggaaagaactttacttaagctgggtcgtggaggctagacggcacattctggctatcctccaggactgccctagcttgcggccgcccattgaccatctgtgcgagttgctgccaagactgcaggccaggtactactctattgccagttcatctaaagtgcaccccaactcagtgcatatctgtgccgtggtggtagagtacgagaccaaagctgggaggatcaacaagggggtggccacaaattggcttagagccaaagagcctgcaggcgagaacggcggccgagctctcgtgcctatgtttgtgaggaagagtcagtttagacttccttttaaggccactaccccggttatcatggtagggcctgggaccggagttgctcccttcatcggcttcatccaggaacgcgcctggctacgccagcaggggaaagaagtcggggaaactttattgtactatggctgccggaggagtgacgaggattacttgtaccgtgaagagttggctcagtttcacagggacggcgccctcacacagctgaacgttgctttctcacgggagcagtcccacaaggtgtacgtgcagcacctactcaagcaagacagggaacatctgtggaagttgattgaaggaggcgcccacatatacgtctgtggcgacgcaagaaacatggctcgtgatgtgcaaaatacgttctacgatatcgtggccgaactcggagctatggagcatgcacaggcggtggactatatcaaaaaattgatgacaaaggggcggtacagccttgacgtgtggagctag

SEQ ID NO: 127667 - DNA, 402 bp, Artificial Sequence
  Description of Artificial Sequence: Synthetic coding sequence
atgcttagtcccgaggctgaaagggtgctacggtacctggtggaggtcgaagagttggcagaagaggtcctcgcggataagagacagattgtggatctggataccaagcgtaaccagaatagggaaggcctcagggcattgcagaaagacctaagtctttctgaggatgttatggtatgcttcggcaacatgttcattaagatgccacaccccgaaactaaggagatgatcgaaaaggatcaggatcatctggacaaggagatagagaagctgaggaagcagctcaaagtaaaagtgaatagactctttgaggcccagggcaaaccagaactgaaaggctttaatctcaaccctctgaatcaggatgagctaaaggccctcaaagtgatactgaagggttag

SEQ ID NO: 127668 - DNA, 1605 bp, Artificial Sequence
  Description of Artificial Sequence: Synthetic coding sequence
atgaagttcaccctgggccttgggtccagggcgtggagagtgtcatgggagggagccgcagccgccgctgctgggcctggcgccggcgggtcagctttaagatgtcgagcccagagggtaagcagccctaggctgggccgccggggcagtaggctgtctggggccctcccattatgcctgagccgtggaggtggtggcgctcaggcactccctgattgcgcaggccctagtccgggtcaccctggacaccctggggcacgccagctggcaggccctttggccatggaacaaacctatggtgaggttaaccagctgggtggagtgtttgttaacgggcgtccacttcccaacgcaattcgtctgcggattgtggagttagcacagctgggaatacgcccatgcgacatcagtaggcagctaagagtctcacatgggtgcgtcagtaagattcttgctcggtataatgaaaccgggagtatcctgccaggggctattggaggctctaaaccccgcgtcacaacacctaacgtagtcaagcatatacgggactacaaacagggcgatcccggcatttttgcctgggaaatccgcgacaggctgctggccgacggggtctgtgacaagtacaacgtgcctagcgtgagctctatctcaaggattttgcgcaataagattgggtctctggctcagcccggcccctacgaggctagtaagcagcccccttcgcagcccacacttccttacaatcacatctatcagtacccatatcccagtcccgtgagcccgactggagctaagatgggatcccaccccggagtaccaggtaccgccgggcatgtgtcaatacctcgtagctggccttctgctcacagtgtatccaatatcctcggaatccgcacattcatggaacaaacgggcgcactggctgggagcgagggcaccgcttactcccccaaaatggaggactgggcgggcgtgaatcgtacagccttccctgccacacccgccgtaaatggccttgaaaaaccggcccttgaggctgacataaaatacacacaatcagctagtaccctgagcgcagtgggcggcttcctgccagcctgtgcatatcctgcttcaaatcagcatggagtttattccgcacctgggggcggctacctcgctcctggcccgccatggcctccagcccagggccctcctcttgctccccctggagcaggggttgcggtccacggcggcgaactcgcagcagcaatgacattcaagcacccctccagggagggaagtttgccagctcccgctgcacgacctcgaactccctctgtcgcctatacagactgtcctagccgtccccgcccgcccaggggaagtagccctcggacgcgggcgcgaagagagagacaggcggaccccggcgcccaagtgtgcgctgctgcccctgccatagggacaggaaggatcggaggattggcagaggaggaagcctcggccgggccgcggggtgcccgcccggcttctccccaggcccagccctgtctgtggcccgatccccctcactttttgtattggtcaggatttttggggttctcagagttgggattttag

SEQ ID NO: 127669 - DNA, 1185 bp, Artificial Sequence
  Description of Artificial Sequence: Synthetic coding sequence
atggacatgcattgcaaggccgatcccttctcagcaatgcatcctgggcacggtggagtcaaccagctaggaggagtgttcgtgaacggcaggcctctccccgatgttgtaaggcagcgtatcgtggagctggcgcaccaaggagtgagaccctgcgacatcagcaggcagcttagagtgagtcacggatgcgtctctaaaattcttggcagatactatgagactggatctattaaacctggagtcataggcggctctaagcctaaagtagcaactcccaaagtggtggacaaaatcgccgagtataagcggcaaaatcccaccatgtttgcttgggaaatcagggaccgactgctcgctgaaggcatctgcgataacgatacagtgccatctgtatcttccattaaccgcatcatccgcaccaaagttcagcagccatttcatcctactcccgacggcgccggcaccggtgtaactgcccccgggcacacgatcgtcccgagtaccgcctctcccccggtgagttccgcctccaatgaccctgtgggtagttacagcatcaatgggatcctgggaatcccacgaagtaatggagaaaaaagaaaaagggacgaggacgtgtcggaggggagcgtgccgaatggcgattcacagtctggggtggattccttgcggaagcatttgagggctgacacttttactcagcagcagttggaggcactggacagggtcttcgagcgtccctcatacccagacgtttttcaagcctccgagcacataaaatctgagcaagggaacgagtactccttgcccgctctcacacccggcctggatgaggtgaaaagctcccttagcgcttccactaacccagaattagggagcaacgtctctggtacacagacctaccccgtcgtgacaggcagggatatggcttcaacgacccttccgggatatccgcctcacgtaccccctaccggacagggctcctacccaacttcaacactcgccggaatggtgcctggcagcgagtttagcggcaacccatacagccaccctcagtacaccgcctacaacgaagcctggagattcagcaaccccgcccttctgtcatcaccttactactactcagcagccccccggggaagcgccccagccgctgccgccgcagcctacgacagacactag

SEQ ID NO: 127670 - DNA, 1191 bp, Artificial Sequence
  Description of Artificial Sequence: Synthetic coding sequence
atggacatgcattgcaaggcagatcccttcagtgctatgcaccccgggcacgggggagtgaaccagctcggtggagtgttcgttaatggacgtccactccctgacgtcgtgagacaacgcatcgtggaattggcccaccagggcgtcagaccttgtgacatttcccgacagctacgagtgtcccacggctgcgtgtcaaagattcttgggaggtattacgagacggggtccataaaaccaggagtcatagggggttctaagcctaaagttgccaccccaaaagtggtcgataaaatcgctgagtacaaacgacagaaccctacaatgttcgcctgggaaatacgagataggttactggctgaaggcatatgcgacaacgataccgtgcccagcgtgagttctatcaaccggattattaggacgaaggtccagcagccatttcacccaaccccagatggggctggaaccggtgtcacagctcctggacacacaatcgtaccctctacagcatcacctccagtttcaagtgcatcaaatgatccggtgggcagttacagtatcaatggcatcctggggatcccaaggagcaatggcgaaaaaaggaagcgcgatgaggacgtgtccgaggggagtgtcccgaatggagactctcagtctggcgtggacagtctccggaagcaccttagagcagacaccttcacacagcagcagctggaggctcttgaccgcgtgttcgagaggccctcataccccgacgtgtttcaggcctcagagcacatcaagtctgaacaggggaacgaatactccctgccagccctgaccccaggactggatgaggtcaaaagttcactgagcgcctccaccaaccccgaactcggatccaatgtcagcgggactcagacttaccccgtggtgactggccgcgatatggcctcgactaccctgccggggtatccaccacatgtacccccaaccggccagggctcatatccgaccagtacactggcaggaatggtccccgaggccgcggttggcccatccagttctctgatgtctaagcccggacggaagctggctgaagttccaccttgcgttcagccaacaggtgccagctcaccagccacccgcactgccaccccatcgactagacccaccactcgcctgggagactctgctacccccccttactag

SEQ ID NO: 127671 - DNA, 990 bp, Artificial Sequence
  Description of Artificial Sequence: Synthetic coding sequence
atgttcgcctgggaaatcagggatcgtctcttagccgagggaatatgcgacaatgatacagtgccatcagtgtcttcaatcaatcggatcattcgcacaaaggtgcagcagccttttcacccgacccccgatggggcggggacgggcgtgaccgctcccggccacactattgtgccctccactgcatccccccccgtgagctccgcctcaaatgaccccgtcgggtcatacagcataaacggcattctgggcatcccaagaagcaacggtgaaaagagaaagagggacgaggtagaggtgtacactgaccctgcccatataaggggtggggggggactgcacctggtctggacccttagggacgtatctgaagggtccgtccccaacggcgattctcaaagcggggttgattccttgaggaagcacctgagggccgatacctttacgcagcagcaactggaagcccttgatcgggtcttcgaaaggccttcatacccggacgtgtttcaggcaagcgagcatatcaagtcagagcagggtaacgaatacagcctgcctgcacttacacccggcctggacgaggttaaaagcagcttaagcgcctctactaatcccgagttaggatccaatgtgagcggcacccagacctacccagtggtgaccggtagggacatggcctccacaactctgccaggctaccccccccacgtgcctccaaccgggcagggtagctaccctacctccactctggccggaatggtccccggctctgagttctctgggaatccttactcacacccccagtatactgcgtacaacgaggcgtggcggttctcgaatcctgctctgctgagtagtccctattattattccgctgccccgcgcggatcgctgccactcctccccttacccatgaccgccacttcatatagaggagaccacatcaaactgcaagctgacagtttcggcctgcacatagtgcccgtttag

SEQ ID NO: 127672 - DNA, 1260 bp, Artificial Sequence
  Description of Artificial Sequence: Synthetic coding sequence
atggacatgcactgcaaggccgatcccttcagcgccatgcatccaggacacggcggcgtgaaccagctgggtggcgttttcgtcaacgggcggccactgccggacgtcgtacggcaacgtatcgttgaattggcacaccagggggtgcgcccttgcgacataagccggcagctgagggtaagccacggctgcgtctcaaagattctcggacgctactacgaaaccggatctatcaagcctggggtgataggagggagtaaacccaaagtggctactcccaaagtggtggataaaatcgctgaatacaagcgccaaaaccctacgatgttcgcatgggagatcagagaccgccttctcgccgaggggatctgtgacaacgatacagtgccatcggtctcgtctattaaccgcatcattaggaccaaagtgcagcagccatttcatcctactccggatggcgcgggaacaggagtcaccgctcccggccatacaattgtgccaagcactgcatctccccctgtgagctctgcgtcgaacgatccagtgggatcttactctatcaatgggattctgggaatccctcgctcaaatggggagaagcgcaagcgagacgaggtggaagtctacactgatccagcacacattcgaggcggcggcggcttacatcttgtgtggaccctgagagacgttagcgaggggagtgtgccaaatggggactctcagtcaggcgttgacagtctgagaaagcatctgagggcagacacctttacacaacagcagttagaagctctggatcgggtgttcgaaaggcccagttacccagatgttttccaagcgtctgaacacattaagtctgagcagggcaatgagtattccctaccggctctcacaccaggtttggacgaggttaaatcctcattatctgcctctaccaatcccgaactcggcagtaacgtctcagggactcagacttatcccgttgttacaggtcgggatatggcttccacaaccttgcccgggtatcctccgcacgtcccccccacgggtcaagggtcgtacccaacttctaccctggccggcatggttcccgaggccgccgtggggccgtcttcgagcctgatgtcaaaaccaggaagaaagctggccgaagttcccccatgcgtgcagccaaccggtgcgtccagtccagccacaagaactgccacgccttccactcggccaactacccggctgggcgactcggcgactccaccctactag

SEQ ID NO: 127673 - DNA, 645 bp, Artificial Sequence
  Description of Artificial Sequence: Synthetic coding sequence
atggatatgcactgcaaggccgaccctttttccgccatgcaccctggccatggaggagtaaaccaacttggaggcgtatttgtcaacgggagacccttacctgatgtggtcaggcagcgcatcgttgagcttgcccatcagggcgtacggccctgtgacatctctaggcagctgagggtcagtcacgggtgcgtaagcaagatcctcggcaggtattacgaaaccggcagtattaagcctggagtgatcgggggaagtaaacccaaagtggctactccaaaggtggtcgacaagatcgcagagtacaaacgccagaatccgaccatgtttgcctgggagatcagagaccgccttctggctgagggcatctgtgacaatgataccgtaccttcggtgtctagcatcaatcggatcataaggaccaaggtgcaacaaccttttcatcccactcccgatggcgcaggcaccggagtcaccgcacctggtcataccattgtcccaagcacagcctcccctcccgtgagctccgctagcaacgacccggttggatcatattctatcaatggcatccttggaattcctaggtctaacggcgagaagcggaaacgagacgaggtagaagtttacaccgatcctgcgcattag

SEQ ID NO: 127674 - DNA, 1254 bp, Artificial Sequence
  Description of Artificial Sequence: Synthetic coding sequence
atggatatgcactgcaaggccgacccattctccgcaatgcaccccgggcatggcggagtgaatcagctcggaggggtgttcgtgaacgggaggcccctcccggacgtcgtccggcaacgaatcgtggagcttgcccaccagggcgtgcggccatgcgacattagtaggcagctgcgggtttcccacggatgtgtgagcaagatcctgggtcgctattatgagacaggcagtattaagccaggagttatcggaggaagtaagccaaaagttgccacccccaaggttgttgacaagatcgctgagtacaagcgacagaaccctactatgtttgcgtgggaaatccgggaccgcctgcttgcagaggggatctgcgataatgatactgttcctagcgtgagtagtatcaatagaattattagaacaaaggtgcagcagccctttcacccgacgccggacggggccggcacaggcgttacagccccgggacacacaatcgttcctagtacagcttcacctcctgtttcctccgctagcaacgacccagtcggttcgtactccattaatggcatccttggcattccaaggtctaatggcgagaagagaaaaagggacgaggtcgaagtctatactgatcccgctcacattcggggtggcgggggcttgcatctggtctggaccctcagagatgtgtccgagggcagcgtccctaacggtgattcacagtccggtgtcgacagcctccgcaagcacctgcgagctgatacgtttacgcagcaacagctggaggctttggacagagtgtttgagagaccctcttaccccgatgtcttccaggctagtgagcatatcaagtccgagcaaggcaacgagtacagcctacccgccctcaccccaggcttggatgaggtcaaaagctctctcagcgccagcactaatccggagctcggaagcaatgtatccggcactcagacatatccagtagtaaccggaagggacatggcttctacaactcttcctgggtaccctccccatgtacctcccacagggcaggggtcctatcccacgagtaccctggctggcatggttccaggtagcgagttctccggaaatccctattcgcatccccagtatacggcttataacgaagcttggaggttttcgaatcccgcgctgctaagctctccttattattactcagccgcaccccgcgggtccgcacctgccgcagcagctgccgcttacgatcgacactag

SEQ ID NO: 127675 - DNA, 621 bp, Artificial Sequence
  Description of Artificial Sequence: Synthetic coding sequence
atgacaaccctggctggagccgtcccacgaatgatgcggcctgggcccggacagaattatcctcgctcaggctttcctcttgaggtcagcacaccactaggacagggaagagtgaatcagctcggcggcgtctttatcaatggtcggccactgcccaaccacatccgtcataaaattgttgaaatggctcatcacggcatcagaccctgcgttataagtcgccagctcagagtcagccatggttgcgtctcaaaaatactttgtcgatatcaagagacaggttcaatcagaccaggcgctatcggcggctcgaagccgaaacaggtgactacacccgatgttgagaagaaaatagaggaatacaagcgggaaaaccccgggatgttttcatgggagatacgcgacaagttgctgaaggacgcagtgtgcgataggaacaccgtgccatccgtaagcagcatatctcgtatcctgaggagcaaatttggaaagggcgaggaggaagaagccgacctcgagaggaaagaggctgaggaatctgagaaaaaggctaaacattcgatcgatggaatcctgtccgaaaggggtaaggctttggtgagcggagtatcatctcactag

SEQ ID NO: 127676 - DNA, 1224 bp, Artificial Sequence
  Description of Artificial Sequence: Synthetic coding sequence
atgaccaccctggcaggtgccgttcccagaatgatgcgccccggacctggccaaaactacccccgctcaggttttcccctggaggtgtctaccccccttggtcaggggagggtcaaccagcttggcggggtgtttatcaacggtcgacctcttccaaaccacattcgccacaagattgtcgaaatggcacatcacgggattcgcccatgtgtaatcagtcggcagctacgcgtgagccatggatgcgtctctaaaatactgtgcaggtatcaagaaaccgggagcattaggcccggagccattgggggctccaaacccaaacaagtgaccacaccagacgtagaaaaaaagatagaggagtataagcgtgagaatcccggtatgttttcttgggagatccgagacaaactgttgaaggatgccgtgtgcgatcgcaataccgtgccttccgtaagctcgatcagcagaatactgagatccaaattcggaaaaggggaggaagaagaagccgatttagagcggaaggaggcagaggaatctgagaagaaggctaaacattcaattgatgggatcctgagcgaaagggcgagcgcacctcagtccgacgaggggagcgatattgattctgaaccagatctgcctctcaagcgcaagcagcggcgaagtagaacaacgtttacagcagaacagctggaggagctggagagagcgttcgaacggactcattatccagacatatacacgcgggaggaactagcgcagagggctaaactcacggaagcgagagtgcaagtttggttttcaaaccgtagggcccggtggcgcaaacaagcgggagctaatcagctgatggcgtttaatcaccttatccccgggggtttccctccaactgccatgcctaccctacctacgtaccagctgtctgaaactagctaccagcctacgagtattccacaggcagtctctgaccccagttccacagtgcaccgcccacagcccctgccaccctccacagtgcatcagagtaccatcccttcgaatcctgattccagctcagcttactgcctgccctctaccagacatgggtttagctcctacacagatagcttcgtgccaccctcaggaccatcaaatccaatgaaccccaccatcggcaatgggcttagtccgcaggtgccattcattatctcatctcagataagcctcggtttcaaatccttctag

SEQ ID NO: 127677 - DNA, 1212 bp, Artificial Sequence
  Description of Artificial Sequence: Synthetic coding sequence
atgactaccttagccggcgccgtccctcgcatgatgcgacccggacccggtcagaactatcctaggagtggtttcccacttgaggtgagcacccccttgggccaggggcgggtcaaccaactgggcggggtgttcatcaatggtcgccctttgcccaatcatattcggcataagattgtcgagatggcacaccacggaatccgaccttgcgtcatctcgcggcagctaagagtgagccacgggtgtgtttctaagattctgtgccgctaccaggagacaggcagcatcagacctggtgccattggtggctccaaacccaaacaggtgactacaccagatgtggaaaagaaaatcgaagagtataagagggaaaatccgggaatgttttcgtgggagattagggacaaactgctgaaagatgctgtctgcgaccggaataccgtcccatccgtcagctccatctcccgcatcctgaggagcaaatttgggaaaggtgaggaagaagaagctgacctggagcgaaaggaggccgaagaaagcgagaaaaaggctaaacattccattgacgggatcttgagcgagcgggcatcggccccccagtcagatgaaggaagtgacattgactctgaacccgatctgcccttaaaacggaaacagcgcaggtcccgtaccacattcaccgctgagcaactggaggaattggagcgagcttttgagaggactcactaccctgatatttatacccgcgaggaactggcccagagagcgaagctaaccgaagcccgcgtgcaggtctggttctctaataggcgggctagatggcgtaagcaggccggcgccaaccagctgatggccttcaaccacctcatcccaggcgggttccctccgacagctatgccaactctccctacttaccaactcagtgagacgtcctaccaacctacatcgatcccccaagccgtatccgacccctcttccaccgttcaccggccccaacctctccctccatccacggtgcaccagagcacgattccaagcaatcccgattcttcctccgcatattgtctgcctagtacgaggcacggcttttcaagttacacggacagcttcgtgccccccagtggcccgtcgaaccccatgaacccaaccattggcaatgggctgtcaccgcaggtacccttcattatatcatcacagatcagccggaagtag

SEQ ID NO: 127678 - DNA, 1440 bp, Artificial Sequence
  Description of Artificial Sequence: Synthetic coding sequence
atgactactctcgccggggccgtgccccggatgatgcgaccgggccctgggcagaattatccaaggtctgggtttccactagaggtttcaaccccgctggggcaaggacgcgtcaaccagctaggaggcgtgtttataaacggacgcccactgcctaaccatatacgccacaagatcgtggagatggctcaccacggcattcggccctgcgtgatttcacgtcagcttagagtatcgcacggatgcgtgagcaaaatcctctgtcgatatcaagaaaccgggagtattcgaccaggagctattgggggttccaaacctaaacaagtgacgacaccagacgttgagaagaagatagaagagtacaagagagagaatccaggcatgttttcctgggagataagggataagctgttgaaggatgctgtctgcgatagaaacaccgttccatccgtgtcaagcatcagccggatcctgagatctaagtttggcaagggggaagaggaagaagccgatttagagcggaaggaggcagaggaaagcgagaagaaggcgaaacacagcattgacggcatcctgagtgaacgcgcatcagctccgcagagcgacgaggggtcagatattgattcagagcccgacttgcctctcaagcgcaaacagagaaggtcaaggacaacatttactgcggagcaattggaagagctcgagcgcgcctttgagaggactcactatcctgatatctataccagggaggagctagctcagagagcaaagctcaccgaggcccgcgtacaggtgtggtttagcaatagacgggcccgctggcggaagcaggccggagctaatcagctcatggccttcaatcacctgatcccggggggatttcctcccaccgccatgcctacattgccaacctaccagctgtccgagacgagctaccagccaacgtccatcccccaggccgtctccgacccctcttcaaccgtgcaccgaccgcagccccttcccccatctacagtccatcagtctacaatcccttctaatccggactccagctctgcctattgccttccatcaaccaggcatgggttctctagttataccgactcttttgtccctcccagtggaccctctaatcccatgaaccctaccatcggaaatggacttagcccacaggtgatgggactgctgacaaaccacggaggagtgccccatcagccacaaactgattacgccttaagtcctctaacaggtggactcgaacctactacaacagtgagcgcctcctgcagccaaaggctggatcacatgaaatcccttgactcacttccgacttcacagtcctattgccctccgacctactcaaccaccggctactccatggaccccgtgaccggctaccaatacggacagtatggccagtcaaaaccctggactttctag

SEQ ID NO: 127679 - DNA, 1518 bp, Artificial Sequence
  Description of Artificial Sequence: Synthetic coding sequence
atgacaaccctggccggcgctgtgcctcgaatgatgcgaccagggcccggtcagaattatcctaggtccggctttcctctggaagtcagcactcctctgggccaaggcagggttaatcagctgggtggagtctttattaatggcagacccctgcccaaccacataagacacaagattgtggaaatggcccaccacgggataagaccctgtgtgattagccgccaactgagagtgtcccacggctgcgtttcgaagatcctgtgtagatatcaggaaaccggttcaatccgtcccggagccattggagggagcaagcctaagcaggttaccacaccagacgtagagaaaaagatagaagagtacaaacgcgagaatcccggtatgttcagttgggaaattcgggataagcttctgaaagacgcggtgtgcgataggaacactgtgccaagcgtcagcagcatatcaagaatactgcgctctaaattcgggaagggggaagaggaggaggctgatttggaaagaaaggaggctgaagagtcagagaaaaaagctaagcatagtatcgacggcatcctgtcagagcgcgcctcagctccccagtcagatgaagggagcgacattgatagcgaaccagatctacctttgaagcgtaaacagcgcaggagccgcacaacctttaccgctgagcagttagaggagctcgagagagcctttgagcgaacacactatccagatatctacacacgcgaggagctggcccaacgcgccaagcttactgaggcacgcgtgcaggtctggttcagtaacaggcgagcccgttggcggaaacaggccggggccaatcaactaatggccttcaatcacttgatacctggcggctttccgcccactgctatgccaacgctgcctacgtatcaactgtcagagacctcctatcagccaacgtccattccccaagccgtctcagatcctagtagcactgtccacagacctcagccgctccctccctcaaccgtgcaccagtccactatcccttcgaatcctgacagtagctccgcctactgcctgccctcaaccaggcacggctttagctcctacaccgactcatttgtgccaccatctggacctagtaatcccatgaatccaaccattggtaatgggctttcacctcaagtgatgggcctgctgactaaccacggcggagttccccaccagcctcagacagactatgccctctcccccctgactggtggactggaaccaacaacgactgtgagtgccagctgttcacagcggctcgatcacatgaagagtttggacagcctgcccacgtcccagagctactgtccacccacctactcaacaacgggatatagcatggatcccgtgacaggctaccagtatggccagtatggtcagtcggctttccactatctgaagcctgacatcgcgtggtttcagatactgttaaacaccttcgataaaagcagtggtgaagaggaggacttagaacagtag

SEQ ID NO: 127680 - DNA, 1455 bp, Artificial Sequence
  Description of Artificial Sequence: Synthetic coding sequence
atgaccacactagccggcgccgtgcctcgaatgatgaggcccggccccggtcagaattaccctagatcaggctttcccttggaagttagcactccattggggcaaggacgggtgaaccagttaggaggggtgttcatcaacggtcggccactaccaaaccatatccggcacaaaattgtcgaaatggctcatcacggtatcaggccctgtgtcatcagccgccagctgcgggtttcccacgggtgtgttagcaagatactgtgcaggtatcaggagactgggtccatcagacccggagccattggagggagcaagccaaagcaagttaccacgcctgatgtggaaaaaaaaatagaagaatataaacgggagaacccaggcatgttttcttgggagatccgggataagcttctgaaagacgctgtctgcgaccgcaataccgttccctccgtgtcttcaatctcacggatcctgagaagcaaattcgggaagggagaggaggaggaagcggacttagaaagaaaagaagccgaagagagcgagaagaaggccaagcactcaatagatggaattctctcagaacgggcaagtgcgccccaatctgatgagggatcagacatcgactctgagcccgatctgcccctgaagcgcaagcagcgtcgatcgagaactacctttacagcagaacagctggaggagctggagcgcgcctttgaaagaacccattaccctgacatttacaccagagaggaactggcgcagagggcgaaattgactgaagctagagtccaggtttggttctccaaccgacgcgcaaggtggcgcaagcaggcgggagcaaaccagctgatggcctttaaccatctcatcccaggaggcttccctccaactgctatgcccacattgccgacctatcaactgtctgagacaagctaccagccaacctctatcccccaagccgtgagtgacccaagctccactgtgcatcgtccgcagccattgccgcccagcaccgtccatcaaagtacaattccttctaaccctgattcttcctctgcttattgtttgccaagcactcggcacggattttcatcctatacagactcattcgttcccccttcaggaccttccaatcctatgaaccctactattgggaacgggctgagtccgcaggttatgggcctcctgacaaatcatgggggggttcctcatcagccccagacagactacgcgttgtcccccctcactggcggactggagccaactacgactgtgtccgcatcgtgtagccaacgccttgaccatatgaaaagtttggacagtttacccacatcacaatcatactgtccccccacatactcaacaacgggctattctatggatcccgtgaccggataccaatatgggcagtacggtcaatcagcctttcattacctgaagccagatatagcctag

SEQ ID NO: 127681 - DNA, 1452 bp, Artificial Sequence
  Description of Artificial Sequence: Synthetic coding sequence
atgacaaccttagccggagcggtgccaagaatgatgagacccggcccaggccagaactaccccaggagtggtttccctcttgaggtgtcgactccactgggacagggtcgagtcaatcagctgggtggcgtcttcatcaacggccgaccgctgcctaaccatatccgacataagattgtcgaaatggcacatcacggcatccgcccttgcgtgatttccaggcagctgagagtatcacacgggtgtgtttcaaaaatcctgtgtcgttaccaagagacaggttcgatacgccccggggctattggtggtagtaagccaaaagtcactacacctgatgtagaaaaaaagatcgaggagtataagcgcgaaaatccaggcatgttttcttgggagatcagagacaagttacttaaagatgcagtgtgcgacaggaatacagttccctccgtatcaagcatatcgcgcatcctgcgaagtaagttcggcaagggcgaagaggaagaggctgatctcgagcgcaaagaagcagaggagtctgaaaagaaagccaagcactccatcgatggcattctgagtgagagagcttccgcacctcagtcggacgaaggatccgatatcgatagcgaaccagacctcccactgaagagaaagcagaggaggtccagaaccaccttcacagccgaacagttggaagaactggagcgtgcgtttgagaggactcactacccagacatctatacccgagaggaacttgcgcagagagcgaaactcacggaagcaagggtgcaagtgtggttctccaatcgcagagcgcggtggaggaagcaagccggcgccaaccaactaatggcctttaaccacctgatccctggtggctttccaccaaccgccatgccaactctacctacctaccagctcagcgaaacatcatatcagccaaccagcataccacaagccgtgagcgacccatcctccacagtccatcgccctcagcctcttcctccaagtaccgtgcatcagagtacaataccgtctaatccggatagctcatccgcttattgtctcccctctactaggcatggtttctcatcatacacagattcttttgttcccccttcaggtcctagcaatcccatgaaccccaccatcggaaatggcctttctccacaagtgatggggcttctcaccaaccacggtggggtacctcatcagcctcagaccgattacgccttatccccgttgactgggggcctagagccgacaacaactgtttccgcaagctgttcccagcgactggaccatatgaagagtctggacagcctccctacctcccaaagctattgccccccaacgtactcaactacaggttactctatggaccctgtgacagggtatcagtacggccaatatgggcaatcagcttttcactacctgaagcctgatattgcctag

SEQ ID NO: 127682 - DNA, 648 bp, Artificial Sequence
  Description of Artificial Sequence: Synthetic coding sequence
atgaccaccttagccggcgcagtgccacggatgatgagacccggccctggccagaattaccccaggtcaggttttccgttagaggtctctacccccttggggcagggtagagtgaaccagctgggaggcgtgttcatcaacggccgcccattacctaatcatattcgacacaagatcgtggaaatggcccatcatgggatcagaccatgtgtcatctcgcgtcagctgagggtttcccacgggtgcgtgagtaaaatcctgtgtcgctatcaggaaacaggcagtatcaggccaggagctataggcggtagtaagcctaagcaagtcactacccctgatgttgagaaaaaaattgaggagtacaaacgggagaaccctgggatgttcagttgggaaatccgtgataaactgctgaaggacgccgtatgcgaccggaataccgtgcccagcgtcagctctatcagtagaatactccggtccaaattcggaaagggcgaagaggaggaggccgacctggagcgaaaagaggcagaagagtcggagaagaaagcaaagcactcaattgatggcatattgtccgagcggggaaagcgatggaggctagggagaaggacatgttgggtgacgtggcgagcaagtgcctcatag

SEQ ID NO: 127683 - DNA, 822 bp, Artificial Sequence
  Description of Artificial Sequence: Synthetic coding sequence
atgcatcaggatggcatcagcagtatgaaccagctcggcggcctctttgtgaacggtaggccactgcctctggacacacggcagcagatcgttaggttggcagtgtcaggaatgcgtccttgtgatatttcaaggattctcaaggtcagcaacggttgtgtcagcaagatcctgggaaggtactataggactggcgttctggagccaaaaggcatcggcggtagcaaacctagacttgctactccgcctgtggtggcgcgtatcgctcagctcaagggggaatgccccgctctgtttgcctgggagatccaacgacagctctgcgccgaaggtctgtgtacccaggacaagacaccgtccgtgtctagtattaaccgagtgctgagagccttgcaggaagatcaggggctcccctgtacccggctgcgcagccccgcagtcctggcacctgcagtgctgaccccacatagcgggtccgaaaccccccgcggcacacatcccggaacagggcatcgaaaccgaaccattttcagcccatcccaagccgaggccctggagaaggagttccagcggggccagtaccccgatagtgttgctcgtggaaagttagcaaccgccacaagtttacctgaggatacagtcagggtatggttcagtaatcggcgggctaaatggcgccgccaggagaaactgaaatgggagatgcagctacctgctgtaccatggcaatgcgcacactcttctcctgcgtgtcccggcacgaccggatctttgctcctgagtgccgtcctaggtaactccacacgaaaggtatctgaatag

SEQ ID NO: 127684 - DNA, 1032 bp, Artificial Sequence
  Description of Artificial Sequence: Synthetic coding sequence
atgaaccaacttggcgggctgtttgtaaatggccggcccctgcctctggacaccaggcaacagatagttagactggcagtctctgggatgcggccttgcgatatctctcggatactgaaggtgagcaatggatgcgtaagtaagatcctgggccgttactacagaacaggcgtccttgaaccaaaagggattggcggctccaaaccacgcttggccacacccccagtggttgcccgaattgctcaactgaaaggagagtgcccggctttattcgcgtgggaaattcagcgccagctttgtgctgagggcctctgcacacaggataaaacacccagtgtatcttctatcaatagggttttgagagccctgcaggaagaccaaggcctcccctgcacgcggttacgttctccagccgtactcgcacccgctgttctgaccccacactcagggtctgagaccccacgcggaacccaccccggcacaggtcacaggaatagaacgattttttcacccagccaagctgaagcgttagaaaaagaattccaaagaggtcagtatcccgattctgttgcacgcggtaagctagcaacagcaacttcactgcccgaggacacagtgcgcgtatggttttctaatcgaagagcaaaatggcgacggcaggaaaaactcaaatgggaaatgcagcttcctggggcatctcagggcctcacggtgccgagggtggcacccgggatcatctccgcccagcagtctccaggctcagtgcctacagctgcattacccgcactggaacctctagggccaagctgttatcagctgtgttgggccaccgcacccgaacggtgtctgtcggacactccccccaaggcatgtctcaaaccatgttggggtcatctgccccctcagccaaacagcttagatagcggccttctatgcctcccatgtcccagcagccactgccatcttgctagcctcagtggcagtcaggcacttctatggcctggctgccccctgctgtacgggctagaatag

SEQ ID NO: 127685 - DNA, 1047 bp, Artificial Sequence
  Description of Artificial Sequence: Synthetic coding sequence
atgcatcaggatgggattagcagtatgaaccaactggggggtctgtttgtaaatggcaggccgctgcctttagatacacggcagcaaatcgtgaggctcgcggtctctgggatgaggccttgtgatatttctcgcattctcaaggtcagtaacggatgcgtgtcaaaaatcctaggtaggtactaccggaccggcgtcctggaacccaaggggataggaggctctaagcctaggctagcaactccccctgtggtggcgagaattgcccagctaaaaggtgagtgtcccgccctgtttgcttgggaaattcagaggcagctgtgcgcggaaggtctttgtacccaagacaagaccccatcagtgagttccattaacagggtgttgcgcgcattgcaggaggaccagggcctgccctgcacaaggcttcggtctcctgcggtgctggccccagctgtattgacaccccattcaggaagcgaaacacccaggggcacacacccaggtaccgggcaccggaataggaccattttctcacccagtcaggcagaagctctagaaaaagaattccagcgggggcagtaccctgactctgtcgccagagggaaactcgctaccgcgacctcccttcctgaagatactgtccgagtctggttctctaatcgccgagcaaagtggcgacggcaggagaagctcaaatgggagatgcaactgcccggagcctctcagggcctaactgtgccccgcgtggcccctggaatcattagtgcccaacagagccccggaagtgtgccgacagctgcactgcccgccctggagcccctcggcccaagctgctaccaactctgttgggcaaccgcacccgagcgatgtctttccgacacaccaccgaaagcctgtctcaagccctgctgggactgcgggtcttttctactcccagtaatcgccccatcatgtgtggacgtggcatggccctgtctggatgcctccctggcacaccatttaattggtggtgcgggcaaggccacccctactcacttctcccattag

SEQ ID NO: 127686 - DNA, 1563 bp, Artificial Sequence
  Description of Artificial Sequence: Synthetic coding sequence
atggctgcactacccggcaccgtcccacgaatgatgcgaccagctcctggtcagaactacccccggacaggatttccactagaagtgtccacccccttagggcaagggcgggtaaatcagctggggggtgtgtttataaacggacgcccgctccctaatcacattcggcataagattgttgaaatggctcatcatggcataaggccatgcgtcatcagccggcagctaagagtgtcacatgggtgcgtgagcaaaattctgtgtcgctaccaggaaaccggttccatccggccaggtgccattggcggttcaaaaccccgtcaggtcgcaacacccgatgtagagaagaagatcgaggaatacaagagggaaaaccccggaatgttctcttgggaaataagagaccgtttgctgaaggatggacattgcgaccggtcgactgtcccgtcaggtctggtcagcagtattagtagagtgcttagaattaaattcgggaaaaaggaggaggaggacgaagcggataagaaggaagacgacggggaaaaaaaggctaaacacagcatcgatggaatattaggggataaaggaaatcggctggacgagggatcagacgtggagtccgagccagacttgcccctgaagcgcaaacagcgccggtctagaacaactttcacagcagagcaacttgaggagctggagaaagcttttgagcgaacacactaccctgacatctataccagggaggagctggcacaaagaacaaaactgactgaagctcgcgtgcaggtatggttttcaaataggagagcacgctggagaaaacaagccggagccaatcagctggctgcattcaaccatcttctgccaggcggctttccccctacaggcatgccaacactccccccttatcagctacctgatagcacataccctacaaccacaatatcccaggatggcgggtctacagttcaccgtcctcagcctctccccccaagcacaatgcaccagggcggactggcagccgcggcagctgcagctgacaccagctctgcctatggcgctagacattcattctcgtcgtacagcgactcttttatgaaccccgcggcgcctagcaatcatatgaaccccgtgagcaacgggttatccccacaggtgatgtctatcctcggaaacccttccgccgtccccccccagccacaggcagatttttccatttcacccctgcatgggggcctggatagcgccactagtatatctgccagttgctctcaacgggcagactccatcaaaccaggagatagcctaccaactagtcaggcctattgtccacccacctatagcaccacggggtattccgtcgaccctgtcgcaggctatcagtatggccagtatggacagtctgagtgcctagttccctgggccagtcctgtcccaattccctcccctaccccgcgggcaagttgtctgttcatggagtcctataaagtggtgtccggctgggggatgagtatcagtcagatggaaaagctgaaatcttcccagatggaacagttcacgtag

SEQ ID NO: 127687 - DNA, 1557 bp, Artificial Sequence
  Description of Artificial Sequence: Synthetic coding sequence
atggcggccctgcccgggactgtcccgagaatgatgcgccccgcacctggtcagaactaccccaggaccggcttcccactcgaggtctctactccccttggacaggggcgggttaatcagttgggcggagtgttcatcaatggacgacccttgccgaaccacattagacacaagatagtcgaaatggcgcaccacggcattcgaccatgcgtgatctcccgccaattgcgcgtgtcacatggctgcgtttccaagattctttgtcggtaccaagagaccggcagtatcagacccggggccattgggggctcaaaaccaagacaggtggcgactcccgacgtcgagaaaaagattgaggagtataagagggaaaatcctggcatgttctcatgggagatacgcgatagacttttaaaagacgggcactgcgacaggagcactgtccctagcgttagcagcatctctagagtgctgcgaatcaagtttgggaaaaaagaggaggaggacgaggccgacaagaaggaagatgatggggaaaagaaggcaaagcattctatcgacggcatcttgggggataaggggaatcgtctggatgaaggatccgacgtggaatccgaaccagacctgccgttgaagcgaaaacagcgacgctctagaaccaccttcacagccgagcagctggaggagctagaaaaagcttttgaaaggacccattaccctgacatttatacacgcgaggagctggcccagcgcaccaaactgaccgaagcacgcgtccaagtatggttctctaaccgtcgggcccgctggaggaaacaggctggtgccaatcagctagcggccttcaatcatctacttccgggtggcttcccccccactggaatgcccaccctgcccccgtaccagctgcctgattctacctacccaacgaccacgataagccaggacggcggctcaacggtccaccggccacagcctctgccaccttccacgatgcaccaggggggactagcggccgctgcggccgccgcagatacttccagtgcatatggcgcccgtcactcattttcttcgtattcagatagcttcatgaatccggcagctcccagtaaccacatgaatcctgtttccaatggactgagcccccaggtgatgtctattttgggcaatcctagtgctgtccccccacaaccgcaagccgacttttctatttcccctctccacggcggattggactctgccaccagcatctccgcatcgtgctcccagcgggctgattccattaagccaggggacagcctacccaccagccaggcgtattgtcctcctacttacagcacaacagggtactctgtggaccctgtcgcaggatatcagtatggacagtatggccagtccgagtgcctggtgccttgggctagcccagtgcctattccgtcacccacccctcgcgcatcatgcctattcatggagtcatacaaagtggtttcaggttgggggatgagcatctcgcaaatggaaaaactaaaatccagccaaatggaacagttcacatag

SEQ ID NO: 127688 - DNA, 1518 bp, Artificial Sequence
  Description of Artificial Sequence: Synthetic coding sequence
atggccgcactcccaggcacagttcctcgcatgatgagaccagcccccgggcagaactacccacgcaccggtttccctctcgaagtctccacgcctttgggacagggcagagtgaaccaactgggaggtgtcttcattaatgggaggcctttaccaaaccacatcagacacaagatcgttgagatggcgcatcatggtataaggccttgcgttatcagtcgccagctgcgagtcagtcacggatgtgtgtccaagattctctgcagataccaggaaacggggtccattaggccaggcgcaattggcggaagcaagccgcggcaagtcgccactccagacgttgaaaagaagatcgaagaatacaagcgtgaaaatcctggaatgttcagctgggagattcgagatcgcctacttaaggacgggcactgcgataggagcacggtgcctagcggcttagttagcagcatcagtagggtcctcaggattaaattcggcaaaaaagaggaggaagacgaggccgacaaaaaggaggatgacggcgaaaaaaaagcgaagcattccatcgacggcatcctcggcgacaaggggaatcggctggacgagggatctgacgtcgagagcgagccagatctgcccctgaagcgcaaacagcggagaagtagaaccacgttcacagctgaacagctcgaagagcttgagaaggctttcgagagaacccactacccagacatatacaccagagaggaactggcacagcggaccaaactgactgaggccagggtgcaggtgtggttcagcaatcggcgggcacggtggcgaaagcaggccggggccaatcagctggcagcatttaatcacttgctgccgggcggattcccacccacaggtatgccaacacttccgccttaccagctccctgatagtacctatccaacaaccaccatcagtcaagacggaggctccacagtacataggccacagccacttccaccttccaccatgcatcaaggtggactcgctgcagccgcagccgcggctgacacctcatccgcttacggggcccggcatagcttttcatcctacagcgatagctttatgaatccagccgccccctccaatcacatgaatcccgtctcaaatggcctcagcccgcaggttatgagcatactcgggaatccaagcgcagtgccccctcagccacaagccgacttcagcatttctccgctgcacggcggacttgacagtgctaccagcatctctgcttcttgcagccagagggcagatagcatcaagcctggcgacagtctgccaactagtcaagcgtactgcccgcccacctattcgactactggttacagcgttgatccggtagctggataccaatatggtcaatacggtcagacggcggttgactatttggcaaagaatgtgtctcttagtactcagcgtaggatgaagctcggcgagcatagcgcagtgttaggactgctgccggtggagaccggccaggcttattag

SEQ ID NO: 127689 - DNA, 1026 bp, Artificial Sequence
  Description of Artificial Sequence: Synthetic coding sequence
atggagcctgcattcggggaagtgaatcaattggggggagtattcgtgaacggcagacccctgcctaacgcaatcagactgagaatagtggaactggcgcagctgggaattaggccgtgtgacatcagtcggcagctgagagtgagccacggatgcgtatcaaagatcttggcacgctataatgagactggctccatcctgcccggagccattggcggttccaaaccacgagtgacaactcctactgtcgtcaagcatattaggacttataagcagagagacccaggaatctttgcttgggagatcagagaccgactcctggctgatggggtgtgcgacaaatacaacgtgccgtctgtgagtagcattagcaggatcttacgcaataaaattggcaacctcgcccaacaggggcattatgactcctacaaacaacatcaacctaccccccagcctgcattgccttacaaccacatctatagttatccttcacccataaccgctgccgcagccaaggtgcccacccccccgggggtgccagcgatacctgggtctgtggcaatgccacgaacatggcctagctcccattcagtaactgacattctcggcattcgttccattactgaccaggtgagcgactcttctccgtaccactctcccaaagtcgaagaatggtcttcccttgggcggaacaattttccggcagctgctccacacgccgtcaatggactggagaagggagcactggagcaggaagccaagtacggacaagcacccaatggcctcccggcagtgggcagctttgttagtgcctcctctatggctccatatcctacacctgctcaggtgagtccctacatgacgtactcagctgctccctctggctacgtggcaggccacggttggcagcatgcaggaggcacttcgctgagtccgcataattgcgacatcccggctagcctggcctttaaaggaatgcaggcggctagagagggatcacatagtgttacagcttccgcactctag

SEQ ID NO: 127690 - DNA, 1026 bp, Artificial Sequence
  Description of Artificial Sequence: Synthetic coding sequence
atggagcctgcgtttggtgaggtgaatcagctgggaggtgtctttgtcaacggcagaccactcccaaacgctattcggttgcgaattgtcgaattggcccagctaggtatcagaccctgcgatatttcccggcagctcagagtaagccacggctgtgtttccaaaatcctggctcggtacaacgaaacagggtccatcttacctggagctattggcggatctaagccaagggttacgactcctaccgtagtgaagcacattcggacgtacaagcagagggaccccgggatttttgcttgggaaattagggacagactgctcgctgacggtgtttgcgacaaatacaatgtgcctagcgtctctagcatctctcggatcctgagaaacaaaattggaaacctggctcagcagggacattacgactcttataagcagcatcaacctactcctcagcctgccctcccttataaccacatctacagctacccttccccaattacagccgcagcagccaaggtgcccaccccgcctggagtcccggccatccccgggagcgtcgccatgccgagaacatggccttccagtcatagcgtgacggatatcctgggaataagatcaattaccgaccaggtgtctgatagctctccgtatcacagtccgaaagttgaagaatggtcatcgctgggtcggaacaattttcctgctgccgcaccccacgcagtcaacggtctagagaaaggggccctcgagcaagaagctaagtatggacaggcgccgaacggactccccgccgtcggctcatttgtgagcgcctccagtatggcaccctaccccactccagcccaggtgtccccctacatgacgtacagcgctgcgccgtcgggatatgttgctggacacgggtggcaacacgccgggggcacctctctctcacctcacaactgcgacatcccggcaagcctggcatttaaagggatgcaggctgcacgggaaggctcgcactccgtcacagcaagcgctctgtag

SEQ ID NO: 127691 - DNA, 183 bp, Artificial Sequence
  Description of Artificial Sequence: Synthetic coding sequence
agcgattccagcccttaccactccccgaaggtggaagagtggtcttctttggggcgcaataacttccctgctgctgcgcctcatgcggttaacggcttggaaaagggtgccttggagcaggaggctaagtatgggcaaatccaaaacttcttcctcctgatgatttccagactgaagttctag

SEQ ID NO: 127692 - DNA, 912 bp, Artificial Sequence
  Description of Artificial Sequence: Synthetic coding sequence
atgggaagacctttgctgttaccactgctcccattgcttctgcctcccgcgttcttgcaaccaagcgggtccactggctctggtccttcttatttgtatggggtgacccagccgaagcatctgtctgcgagcatgggtggcagtgtcgagatccccttctcattttattacccttgggagctggctactgccccagatgtcagaataagctggcggcgcgggcacttccaccggcagagcttttatagtactagacccccctccatccacaaggattacgtgaaccggttgttcctgaattggacagaaggtcagaaatccggctttctgagaatctcgaacctgcagaaacaggaccagtcagtgtacttttgtagggtggagttggatactcggagtagtggcaggcagcagtggcagagtattgagggtactaagctaagtatcacacaagccgtaacaactaccacgcagcgccccagctctatgactacaacatggcggttgagctccacaaccacaaccacaggactgcgtgtgactcagggaaagaggcgcagcgatagctggcatatcagtctagagacagccgtcggggtggctgtggccgtgaccgtcctaggcatcatgatcttgggactgatatgcctgctccgctggcgtagacgcaaaggccagcagagaactaaggccacaactcccgcccgtgaacctttccagaataccgaggagccttacgagaatatcagaaatgagggccaaaacacggatcccaaactaaaccccaaggacgacgggatcgtttacgcatccttggccctcagcagctccacaagcccgcgagcccccccctctcatagaccactgaagagcccacaaaatgagacactctatagcgtgttgaaggcctag

SEQ ID NO: 127693 - DNA, 693 bp, Artificial Sequence
  Description of Artificial Sequence: Synthetic coding sequence
atgggccgcccgctgctcctccctcttttgcctctgttattacccccagcgtttctgcagccctccggcagtaccggtagcggaccctcctacctatatggcgtgactcagcccaagcatttgagcgccagtatgggcgggtccgttgaaatccccttctcattttattacccatgggagcttgccacggctcctgatgtgagaatcagctggagaagaggtcattttcatagacagtctttttatagcaccagaccacctagcatccataaggactatgttaacagattgttcctaaactggacagaggggcagaagtctggcttcctgcggatcagtaatcttcaaaagcaggaccagtctgtgtacttctgtcgcgtggagcttgacactcggtctagcggacggcaacagtggcagtccatcgaagggaccaaattgtctataacccaggggcagcagaggaccaaagcgactactcctgccagggaaccatttcagaataccgaagagccatacgagaacattagaaacgaaggccagaataccgaccctaagcttaatcccaaggatgatggcatcgtgtacgctagtctcgctctgtcctcaagcaccagtccacgcgcacctcctagccatcgccctctcaaatctcctcagaatgagacgctgtattccgtgctgaaagcctag

SEQ ID NO: 127694 - DNA, 528 bp, Artificial Sequence
  Description of Artificial Sequence: Synthetic coding sequence
atgggcagacctttgcttctgcccctgctgcctcttctgcttccgcctgcctttctgcaacccagtgggagcacgggcagcgggccaagttacctgtacggggtgacccaacccaaacacctctctgcgtcaatggggggatcggtggaaattccattctctttctactacccttgggagctggccaccgcaccagacgttcgcatttcttggagacgaggccactttcacagacagtctttctatagcactcgccccccatcaatccacaaagactatgttaatcggctcttcctcaattggacggaaggtcagaaatccggcttcttaaggatttccaatctgcagaagcaggatcaaagcgtctacttttgccgcgttgagctcgatacccgctcaagcggcaggcaacagtggcagtcaattgagggcaccaaactgtctataacgcagggcaacccctcgaaaactcagaggtcacatatgcggatatctggcatgaaggataagatccaaatcccaagctag

SEQ ID NO: 127695 - DNA, 492 bp, Artificial Sequence
  Description of Artificial Sequence: Synthetic coding sequence
atgggaaggcctctgttgcttcccctgctgcctctcttgctgcctcccgcttttctacagccgtctggcagcacaggatctggcccctcctatctctacggggttacccagccgaagcatttgagcgcctccatgggtggctcagtagagattcctttctcattttattatccatgggaacttgctactgctcctgacgtgcggatctcttggagaagaggccatttccacaggcaaagcttctatagcactcggccccctagtattcataaagattatgtcaatagactatttcttaactggaccgaggggcaaaagtctgggttcctccgcatttctaatctccaaaaacaggaccagtccgtctacttttgtcgtgtggagcttgacacaaggtcaagcggacggcaacagtggcaatcgattgaggggactaaactctcaatcacccaagggcagcagcgtaccaaggcaaccacccccgcccgatag

SEQ ID NO: 127696 - DNA, 684 bp, Artificial Sequence
  Description of Artificial Sequence: Synthetic coding sequence
atggggcggcctctcttgcttcctttgctgctcctgctgcagccccccgcattcttacagcccggtgggagcacagggtcaggcccctcctatctttatggcgttacacagcctaagcatttatcagcgagcatgggaggatcagtggaaattcccttctctttctactatccatgggagttagccatcgtgcctaacgttaggatcagttggagacgcgggcatttccatggtcagagtttttacagcactagacccccctctattcataaggactatgttaaccggctcttcttaaactggactgagggccaggagagtggcttcctacgtatcagcaacttacgtaaggaagaccagagtgtgtatttctgccgggtcgaacttgataccaggcgctcaggccgccagcagctccaatccataaagggcacgaagcttaccatcacccaggcagtaacaactactaccacatggcggccttcctccaccactacaatcgctggcctgcgcgtgactgagtccaaaggccatagcgagtcctggcatctttcactcgacactgctatccgggtagctttggccgtggcagtgctcaagaccgtgatactgggtctgctttgtctccttcttctttggtggcgcagacggaaagggtccagagcgccatcaagcgacttttag

SEQ ID NO: 127697 - DNA, 999 bp, Artificial Sequence
  Description of Artificial Sequence: Synthetic coding sequence
atgggccgtgcttcatacggaggatcacccgtgggccaccagtcatcttccgatcatcctagagccaagacttgcaggtcacccgtcagagatggaccaagaacactgtgtggtgtgccaaccgtagcactatctctccacttcctccgcgaagcatctagtggaagccgaacatgtggaagacggactagcctgtgcacatctgcaaaaagttcctggacataccgctccgctctgcgccagccactccatcgcgctcccctattgccaggacaattgtgttggagcccaagaccactggagaagaacaaagccatgggtagacccctcctgttacctctcctgctgctcctgcagcctccggcatttctccagcccggaggcagtactggctctggcccttcatatctgtacggggtaacacaacctaaacacctctctgcatccatgggtgggtccgtcgagattccatttagtttttactatccctgggagttagctatcgtgcccaacgtacgcatcagttggcggaggggtcatttccacggacaatcattctactctactagacccccttcaattcataaagactacgtgaatcgactctttttaaattggacagagggacaggagagcggatttctgcggatttccaaccttagaaaagaggaccagagcgtctatttctgtagggtcgagctagacactagaagatctggaagacagcagctgcagtcgatcaagggcactaagttaactatcacacaggcagtaaccacaacaaccacctggagaccgtcttctactactacgatagccggcctgcgggtcacggagtcaaaaggtcacagcgaaagttggcatctgtctcttgacaccgcgattcgagtggcactggccgttgctgtgctgaagactgtcatcctcggcctgctgtgtctgctcctcctttggtggcgccgcagaaagggttcgagagcaccttcaagcgacttttag

SEQ ID NO: 127698 - DNA, 384 bp, Artificial Sequence
  Description of Artificial Sequence: Synthetic coding sequence
atgggcaggccactcctgctgcccctgttactgctgttgcagccccccgcattcctccagccgggcggaagcaccgggtccggaccctcttatctttatggcgtgacacagcccaaacatcttagcgcttcaatgggtggcagcgtcgagatcccattctctttctactatccgtgggaattagctatcgtcccaaatgttcggataagttggcgtcggggtcactttcacgggcaaagcttttactcaacaaggccaccctctatccataaggattacgtcaacagactgtttctgaactggaccgagggccaggagagtggctttttgaggatctccaacctacggaaggaagatcagtctgtctatttttgcagagtttag

SEQ ID NO: 127699 - DNA, 684 bp, Artificial Sequence
  Description of Artificial Sequence: Synthetic coding sequence
atgggcaggcctttgttgctccccttattgcttcttctgcagccgccagctttcctgcagcccggcggtagtacaggcagcggcccgtcctatctatatggagtgacacagccaaagcatctgagcgcgagtatggggggcagcgtcgagattcccttttccttctactacccatgggaattggcaatcgtgcctaacgtgaggattagttggaggcgaggacacttccatgggcaaagcttctactcgacacgcccgccttcaatacacaaggattacgtgaatcgacttttcctgaattggaccgaagggcaggaatccggatttctaaggatttccaacttgaggaaagaagaccagtctgtgtacttttgtcgggtcgagctggacacaaggcggtctggcagacaacagctccagtcgatcaaaggcaccaaacttacgatcacccaggccgtcactacgaccacgacttggcggccgtctagcacaacgacaatcgccgggctgcgtgtcaccgaatccaagggacactccgagtcctggcacctgtccctcgacaccgctatcagagtggcgctggcggtggctgtgttgaagacagtcatcttaggcctcctctgtctgctcctgctgtggtggcgacgccggaaaggatctcgagctccttctagcgatttctag

SEQ ID NO: 127700 - DNA, 384 bp, Artificial Sequence
  Description of Artificial Sequence: Synthetic coding sequence
atggggaggcctctgctcctgccccttcttttattactgcagcctccagctttcctccagcctggaggaagcacaggatcaggtcctagctatctttacggcgttacgcagcctaaacatttgtctgcatccatgggcggatcagtggagatccccttttcattctattacccctgggaactggcgattgttccaaatgtccggattagctggagacgcggccattttcacggccagagtttctactccacaagaccccccagcattcataaggattatgtgaatcgcctttttctcaactggacagagggtcaggaaagcggcttcttacgaattagtaatctacgcaaggaagaccaatctgtgtatttttgtcgagtctag

SEQ ID NO: 127701 - DNA, 183 bp, Artificial Sequence
  Description of Artificial Sequence: Synthetic coding sequence
atgggcaggccactgctgctccctctgctgctcttattgcagccaccagcatttctacagccaggactctgcgagcccgcactgtctgaattagaccgcggctctggcgagcggctgccccaggacctgaagcctgcagaaggtggccccgtttgcgtctttcttccatctagagctggatag

SEQ ID NO: 127702 - DNA, 366 bp, Artificial Sequence
  Description of Artificial Sequence: Synthetic coding sequence
atgggacggcccctactcttacccctcctgttgctgctgcagccccctgcctttctccagcccggcggttctacaggatcgggcccatcatatctttacggggtaactcagcctaaacacctgagtgctagcatgggaggatccgtagagatcccattttctttttactacccctgggagttagctatcgttcctaatgttcggatctcctggcgccgcggccacttccacggtcagagcttctattccacgcgccctccttcaattcacaaggactacgtgaatcgtctctttctcaattggactgaggggcaagaatctggatttctgaggataagcaacctgcgaaaggaagaccagagctag

SEQ ID NO: 127703 - DNA, 384 bp, Artificial Sequence
  Description of Artificial Sequence: Synthetic coding sequence
atggggcggcctctccttctccccctactgctgttgttacagcctcccgcctttttgcagccgggcggctcgactggaagcggaccctcctatctgtatggggtgacacaacctaaacacttgtccgcatcaatgggaggatcagtggaaatacccttctctttctattacccctgggagttagccattgtgcctaatgtgaggataagctggaggcggggacattttcacggccagtctttctatagtactaggccaccgtctatacataaggattatgtgaaccgactttttttaaattggacggaaggtcaggagtcaggtttcctgagaatctctaaccttcgcaaggaggatcagtccgtttacttttgtcgagtgtag

SEQ ID NO: 127704 - DNA, 684 bp, Artificial Sequence
  Description of Artificial Sequence: Synthetic coding sequence
atgggaaggcctctgctgctgcccctgttactgttattgcaacctcctgcgttcctgcaaccaggagggagtacgggaagcggcccatcctatctctacggggtaacccagccgaagcatctctctgcttcaatgggcgggagcgtggagatccccttttcgttctattatccctgggagcttgctatagtgccgaacgtgagaatttcatggaggagggggcactttcatggccagtctttctattctacacgccctcctagcatccataaagattacgtgaaccgtctgtttcttaattggacagagggtcaggaatcaggcttcctcagaatcagtaatttacgaaaggaggaccagtccgtgtatttctgtagagtggaactggacacccggagaagcggccggcagcagttgcagagtatcaaaggcactaagttgaccatcacgcaggcagttaccaccaccaccacatggaggccctcctcaacaacaactattgcagggctccgggtcacagagagcaaaggtcattccgaatcgtggcatctttcattggatacagccattagagtcgcactggctgttgccgtccttaagacagtgattctgggattgctgtgcctgctgctgttgtggtggcggcgtcggaagggttccagagctccctccagtgacttctag

SEQ ID NO: 127705 - DNA, 450 bp, Artificial Sequence
  Description of Artificial Sequence: Synthetic coding sequence
atgggaagacctttgctcctgcctttgctattgttactccagccgcctgccttcctgcagccagggctctgtgagcccgcattgtcagaactcgaccgtggaagcggagagagactgccgcaggacttgaagccagccgaggggggccctgtttgcgtattcctgcccagccgagcaggtcacccagagattagggaagccgcagtggcagtgcatcagggcgaccagacccatcaccaccctggatgtcacaatcatcaccacttggaggcgcagcagcacaatcaccactctaggccgcaggggcaccgaaagcagcgggccctgaggattatggctcccaaaagtggtcactgtcaccagggatgcatcggatgcagatgtgcacagaattgccattttggcactgctgtgccaccccctccagtagtcgaagagaaggaaaggtag

SEQ ID NO: 127706 - DNA, 816 bp, Artificial Sequence
  Description of Artificial Sequence: Synthetic coding sequence
atggggcgcgcttcttacggcggatcgcccgtgggccatcaaagcagctcagaccaccctcgggccaagacctgtcggagccccgttcgagacggtcccaggactctgtgcggggtgcccactgtggcactcagtctgcattttctgcgagaggctagctcaggtagcaggacatgcgggcgaaggacatcgctgtgtacatcagctaaaagctcctggacttaccggtcaggtagactcagttggcagagcatcaaaggcacccatctgacaatcacccaggcactaaggcaacctctgcaccgagcccctttattgcctggtcagttgtgttggagccccaggcctttagagaaaaataaagctatgggccggccactgcttcttcctctactgctgctgctccagccccccgcgttcttacagcctggcctgtgcgaacctgcactctcagagttggaccgtggctctggggagcgcttgccccaggatctgaaacccgccgagggaggtcccgtatgcgtctttttgccgtctcgcgctggtcatccagaaattagagaagcagccgtggcagtacatcaaggcgaccaaacgcaccatcaccccggatgccataaccaccaccacctcgaggctcagcagcacaatcatcactctcgaccacagggtcaccgcaaacagcgcgccctgaggatcatggctcccaaaagcggccactgccaccaagggtgcattggatgtaggtgcgcgcagaattgccactttggtaccgcagtcccaccgccacctgttgtggaagaaaaagagagatag

SEQ ID NO: 127707 - DNA, 684 bp, Artificial Sequence
  Description of Artificial Sequence: Synthetic coding sequence
atggggagacctctcctgttgcccctcttactcctgcttcagccacctgcattcctgcagcccggaggttccacaggctcgggcccttcttatctttatggtgtgactcaaccaaaacacttaagcgcctctatgggtggttccgtcgaaatccccttctcattctattatccatgggaactggcaattgtccctaatgtccggatcagctggcgtagaggacacttccacggtcagtccttctatagcactagaccaccctcaatacacaaagactacgtaaacaggttattcctcaactggacagaaggacaggagtcaggctttctgcggatcagcaatttgagaaaagaggatcagtcagtgtacttctgcagggtggagctggacacacggaggtctggtaggcagcaactccagagcattaagggcaccaaacttaccataacccaggctgtgacaactaccacaacctggcgcccctcttcaactacaacaatcgcaggactccgagtaaccgagtctaaaggacatagtgaatcttggcatttatcactggacactgctatcagggtggccctagccgtggcagtgctcaagaccgttatcctgggtttgttgtgtctgctcctgctgtggtggcgtcgccgaaagggctcccgggctcctagcagcgacttttag

SEQ ID NO: 127708 - DNA, 327 bp, Artificial Sequence
  Description of Artificial Sequence: Synthetic coding sequence
atggggagagccagctacgggggttcccctgttggacatcagagctcgagcgaccaccctagggctaaaacctgccggtctcctgtaagagacggccccagaacactttgtggcgtgcctaccgttgcactgtcattgcattttctccgtgaagcctcttcgggcagtcgcacttgcggcagacgcacgtccctctgtaccagcgcaaagtccagctggacctataggtctggacggttatcctggcagtccattaaagggacacacttaaccattacgcaggcactccgtcaaccgctgcaccgtgcacccctgctccctggctag

SEQ ID NO: 127709 - DNA, 384 bp, Artificial Sequence
  Description of Artificial Sequence: Synthetic coding sequence
atgggtcggcctctcttactccccctgttactcctgctacagccccccgcttttcttcagcccggcggatctaccgggtccgggccgagttacttgtatggggtgacacagccaaagcacttaagcgcctctatgggcgggtccgtggagattcctttctctttttattatccatgggaactggccatagtgccaaatgtgcgtatctcgtggagacgcggacattttcatggccagtctttctacagcacaaggcctccaagcattcacaaggattacgtgaatcgcctcttcttaaactggacagagggacaggagtccggctttctccgtatttccaatctgagaaaagaagatcagtctgtatacttctgtcgagtctag

SEQ ID NO: 127710 - DNA, 738 bp, Artificial Sequence
  Description of Artificial Sequence: Synthetic coding sequence
atgacctcttcatacggccacgtgctggagagacagccagcgctgggtggacgcttagactcacccggtaatctggatacactgcaggctaaaaaaaatttcagcgtgagccatctgctggatttggaagaagcgggcgatatggtcgccgcccaggctgacgaaaatgttggcgaggccggtaggagcttgctagagtccccgggcttaacaagcgggtccgacacaccgcagcaggacaatgatcagctcaactcagaagaaaagaaaaaaaggaagcaacgaagaaaccgtacaacattcaatagtagccagctgcaagccctcgagcgcgttttcgagcggacccactatcccgatgcattcgtgcgcgaggacttagcccgacgcgtgaatctaacagaggcacgcgtgcaggtctggtttcaaaatagacgcgctaaatttcggaggaacgaacgcgccatgctggctaataaaaatgccagtttgttgaaaagctatagcggggatgttacagctgttgagcagccaatcgtgcctaggcccgcacctcggcccaccgattacctctcttggggcactgccagtccatatagcgcaatggccacatactcagcgacatgtgccaataacagcccagcccagggcatcaatatggcgaattctatcgcgaatttgcgtttaaaagcaaaagaatattcattgcaaaggaaccaggtgcctaccgtgaactag

SEQ ID NO: 127711 - DNA, 654 bp, Artificial Sequence
  Description of Artificial Sequence: Synthetic coding sequence
atgactagcagttacggacatgtcctcgagagacaaccggccctgggcggccgattggattccccaggtaacctagatactctccaggccaagaaaaactttagcgtttcccatctgctggacctggaagaggccggcgatatggtggcggctcaggccgacgagaacgttggggaggccggccgctctctacttgaatcaccaggcctcacctctggttctgacactcctcagcaagacaatgaccagctgaactccgaggagaagaagaagcggaaacagaggaggaatcggactacgttcaatagtagtcagttgcaggcactggagcgggtgtttgaacgaacccactatcctgacgcattcgtgagggaagacctggctcggcgtgtaaacctcacagaagcacgagttcaggtttggtttcaaaaccgtagggccaagtttcggagaaatgaacgcgccatgctcgcaaataagaatgcctctctgctgaagagctatagcggagatgtcacagccgtggagcagcctattgttccgaggccagcccccagacccacggactacttgagttgggggaccgcgagcccttatcggtccagttcgctgccacgttgctgcctccatgaggggcttcacaatgggttttag

SEQ ID NO: 127712 - DNA, 762 bp, Artificial Sequence
  Description of Artificial Sequence: Synthetic coding sequence
atggattctgccgcagccgcgttcgctcttgacaaacctgccctgggacctggacctccccctcctccacccgcactgggccctggggactgtgcgcaggctaggaagaattttagcgtgtcgcatctcctagatttagaggaagtggctgctgcaggaagactggcggctcgccccggcgcccgtgcagaagccagggagggcgccgcaagggagcctagcggggggagctccggctctgaagcagctccgcaggacggcgaatgcccaagccccggccgaggcagcgccgccaaaaggaagaagaagcagagacggaatcggacaacattcaacagtagccaactccaggccctcgagcgggtgtttgagagaacccactaccctgacgcttttgttcgcgaagaactggccagacgcgtgaatctctccgaagcccgagttcaggtgtggttccagaacagaagggcaaaatttaggagaaacgagagagctatgctggcctctaggagcgcatctctccttaagagctactcccaggaagccgccatagagcaaccagttgctcctagacctactgcactgtctcctgattatctctcttggacggcatcctcaccgtactctacagttcctccatattctccaggtagcagcggaccagcgacccccggggtgaatatggcgaattctattgcaagcctgagactcaaagcaaaggaattttccttacatcattcacaggtgccgacagttaactag

SEQ ID NO: 127713 - DNA, 855 bp, Artificial Sequence
  Description of Artificial Sequence: Synthetic coding sequence
atggactactcttacctcaactcttacgactcatgtgtggccgcaatggaggcatctgcgtatggagactttggggcttgcagtcagcccggggggtttcagtacagtccactgcgtccagcctttcctgctgctgggccaccctgtccggccttgggcagttctaactgtgcgctgggtgccttgcgcgatcaccagcctgctccttatagtgctgtgccatacaagttttttcctgaaccatccggcctgcatgaaaagagaaagcagcggcgcataaggaccacatttacatcagcgcagttgaaggaactggagcgggtgtttgctgaaacccactaccccgatatttatacacgtgaagaactggccttgaaaattgacttgacggaggcccgagtgcaggtgtggttccagaataggagagcaaaattccgaaagcaggaacgggcagctagcgctaaaggtgccgccggagcagccggagctaagaagggcgaggcacggtgttcttctgaggatgatgatagcaaagaatctacctgttctccaacaccagactcgacagctagtttaccacctcctcctgcgcccggactagcctcccctcgattgagcccttctccccttcccgtggcccttggttccggccccggtccggggcccggtccacagcccctgaagggagccctctgggcaggggtggccggcggcggaggcgggggaccaggtgctggcgccgctgaactacttaaggcctggcaacccgcagagagtgggccgggtcccttttcaggggtgctttctagcttccatcggaaacctgggcctgcgcttaagactaatctgttctag

SEQ ID NO: 127714 - DNA, 1800 bp, Artificial Sequence
  Description of Artificial Sequence: Synthetic coding sequence
atgaagctgctgaaattgacaggctttatttttttccttttttttctgacagagagcctgactctgccaactcagccaagagatatcgagaactttaacagcactcagaagttcatcgaggacaatattgaatacatcacaattatcgccttcgcccaatatgttcaggaagctactttcgaggaaatggaaaaactggtaaaagatatggtggagtataaggaccggtgtatggcggacaagaccctcccagagtgttctaagctgcctaacaacgtactccaagagaagatatgtgcaatggagggtcttccacagaagcataatttctcccattgttgctccaaagtcgacgcccagcgtaggctctgcttcttttacaataaaaagtcggacgtcgggtttctgccaccatttcccaccctggacccagaagaaaaatgtcaggcctatgaatccaacagagaaagcctgctcaatcactttctgtacgaggtggccagacggaacccatttgtgtttgccccaaccctgctgaccgtggcagtgcacttcgaagaagtagcgaagtcctgttgtgaagaacagaacaaagtgaattgcctacagacacgggccattcccgtgacccaatacctgaaagcattttccagctatcagaagcacgtttgcggcgctttacttaagttcggtactaaggtggtgcattttatctacatcgcaatcctgtcacagaagttccctaaaattgagttcaaagagttgatctccctcgtcgaagacgtgtcctccaactacgacggctgttgcgagggggatgttgttcaatgtattcgggacacgtcaaaagtaatgaaccatatctgctccaagcaggatagcatctcctccaagattaaagagtgttgcgaaaagaagataccggagcggggacagtgcatcataaattcaaacaaggacgaccgcccaaaggatctcagccttcgggagggaaagttcacagactccgaaaacgtgtgccaggaacgagatgcagatccagatacattcttcgcaaaatttactttcgaatacagcagaagacatcctgatctaagcatccccgagttgttgagaattgttcaaatttacaaggacttgttgagaaactgctgcaatacagagaaccctcccggctgttatcgatatgcagaggacaaattcaacgagaccacagagaaatccttgaagatggtgcagcaagaatgcaagcactttcaaaatttgggcaaggacgggctaaaataccactacctcatcagattgacaaaaatcgcccctcagttatccaccgaggagctagtctcccttggagaaaagatggtgaccgcatttactacctgttgtacattgagtgaggaatttgcctgtgttgataatctggcggatcttgtctttggcgagctttgtggggtgaacgaaaacagaaccataaaccctgccgtggaccactgttgtaagaccaattttgcatttcggcgcccttgtttcgagtccctgaaggccgacaaaacctacgtgcccccccctttttctcaagacctctttaccttccacgcagacatgtgccagtcccaaaacgaggaactgcagagaaagaccgacaggttccttgtcaacctggtgaagctgaaacacgagctcacggacgaagaactccagtcgttgtttacgaatttcgctaatgtcgttgataagtgttgcaaagccgaatcgcccgaagtgtgttttaatgaggaatccccaaaaataggaaattag

SEQ ID NO: 127715 - DNA, 945 bp, Artificial Sequence
  Description of Artificial Sequence: Synthetic coding sequence
atggacgctttcaaggggggaatgtctttggagcgactacccgagggattgagacctccacctcctcctccccatgatatgggcccagcttttcatctggctcggccggcagaccctcgcgagcccctcgagaactcagcatccgaatcaagcgacaccgagctgccggagaaggagcggggaggggaaccaaagggaccggaagactcaggggcaggcggaactggatgcgggggggctgatgaccccgccaaaaagaaaaagcagagacgccaacggacacacttcacatcacagcagctccaggagctggaagcaacattccagcgaaatagatatcctgatatgagcatgagggaggagattgccgtgtggaccaacctgaccgagccacgtgtgcgggtttggttcaaaaaccggcgagccaagtggagaaagagggagagaaaccagcagttggatctctgtaagggtggatacgtcccacagttctcagggctggtccagccttacgaggacgtgtacgcagcaggttacagttataataattgggctgcaaagtcactggcccccgccccactgtcaacaaagtcatttacattcttcaactctatgagtcctcttagctcacagtcgatgttctcggcgccgtcctcaataagttctatgaccatgccaagcagcatgggccctggagccgtgccaggcatgcccaatagcggcttgaacaatatcaataaccttaccggctcaagtcttaattccgcgatgtcgcccggggcctgtccctatggtaccccagccagcccctacagcgtctacagggacacttgcaactctagcttggccagcttgagactaaagagcaaacagcactccagctttggctatggcggtctacaggggccagcctcaggcctcaacgcctgtcaatacaatagctag

SEQ ID NO: 127716 - DNA, 345 bp, Artificial Sequence
  Description of Artificial Sequence: Synthetic coding sequence
atggacgcttttaaaggtgggatgagtctcgaaagactgcccgaaggactaaggccccccccccccccgccccatgatatgggaccagctttccatctggctaggccagccgatcccagggaaccgctggagaacagtgcatcagaatcctcagatacggagctcccggagaaagagcgtggaggcgagccaaagggcccggaagattcaggagcaggcggaacaggctgtggcggagccgacgatccagccaaaaaaaaaaaacaacgaagacagaggactcacttcacctcacaacagctccaagaattggaagccactttccagaggaatcgctacccttag

SEQ ID NO: 127717 - DNA, 945 bp, Artificial Sequence
  Description of Artificial Sequence: Synthetic coding sequence
atggacgctttcaagggggggatgtcactggagcgtctgccagagggcctccgccctccccctccaccaccccatgatatgggtcctgcattccacctcgcacggcctgccgacccacgtgagcccctggagaatagcgcctctgagtccagcgacaccgagctgcctgagaaggaacggggaggcgagccgaaagggcccgaggattccggagctggcggaactgggtgtggtggagcagatgacccagccaagaaaaagaagcagagacgacaacgaacccatttcacctcgcaacagctgcaggaactggaggcaacctttcagaggaatagataccctgatatgagtatgagagaagaaatagcagtttggactaatttgacagaaccccgagtgcgggtttggtttaagaaccggcgggcgaaatggcggaagcgcgagagaaatcagcagctcgacctctgtaaaggggggtacgtgccacagttttccggactcgtccaaccctatgaggacgtatacgccgctggctatagttacaacaattgggccgcgaaaagccttgctcctgctcctctttctaccaagagctttaccttctttaacagcatgtctcctctgagctctcagtccatgttctccgccccatcctctatttcaagcatgaccatgccatcttctatgggacctggcgccgtgcctggtatgcctaacagcgggcttaacaacattaacaaccttaccggcagcagtctgaattctgcaatgagccctggagcatgtccctacggtacccctgcttccccatattccgtgtatagagacacatgcaatagcagcctggcgagccttaggcttaagagcaaacaacactccagctttggatatggcggactgcagggccctgcgtccggactgaacgcatgccagtataactcctag

SEQ ID NO: 127718 - DNA, 396 bp, Artificial Sequence
  Description of Artificial Sequence: Synthetic coding sequence
atggatgcttttaagggcggcatgtcattggagcgcctgcctgaagggctgagacccccaccgccccccccccatgatatggggcctgctttccacttggcaagacccgctgacccgagagagcccctagaaaactctgctagcgaatcatcagacactgagttacccgaaaaggagcgcggcggggagccgaagggccctgaagattccggcgccggcggaaccggatgcggtggggccgatgacccagccaagaaaaaaaaacaacggcgccaaagaactcactttacttcacagcagctgcaggagttagaggccaccttccagagaaacaggtaccccgatatgagcatgagggaagagatagctgtgtggaccaatctcaccgaaccctag

SEQ ID NO: 127719 - DNA, 975 bp, Artificial Sequence
  Description of Artificial Sequence: Synthetic coding sequence
atgaattgcatgaagggccctctgcatctggaacaccgcgccgcgggcaccaagctgtcggccgtcagctcttcgagctgtcaccacccacaacccctcgcgatggctagtgtgttggccccagggcagccaagatcattagattccagtaaacaccgcctcgaggtccacactatttccgataccagttcccccgaggcagctgagaaggacaaaagccaacagggcaaaaatgaagacgtgggtgccgaagacccctccaaaaaaaaacggcagcgcaggcagagaacccatttcacttcccagcaactgcaggagctcgaggccacttttcagcgaaacagatatcctgacatgtctacacgggaagagatcgcagtttggactaatctgaccgaagcgcgcgtccgagtgtggttcaaaaacaggcgcgcaaagtggcggaagagggaaaggaaccagcaggctgaactgtgtaaaaacggttttggtcctcaatttaatgggctcatgcagccatacgatgacatgtatcccggctactcctataacaattgggctgctaaggggctgacatccgcctcactgtctacaaaaagttttccattttttaattctatgaatgtaaatcctctgagctctcagtcaatgttctctccccctaactcaatcagtagcatgtccatgtcatcctcaatggtcccaagcgccgtgactggtgttccaggaagcagcctaaattccttaaacaacctgaacaacctgagcagcccatcacttaattctgctgtccccacacccgcttgtccttatgccccaccaacgcctccatatgtctaccgggacacctgcaattctagcctagcatctctacgtctgaaggcaaaacaacacagctctttcggctacgctagtgtccagaaccctgctagtaatctgtctgcctgccagtatgccgttgataggccagtctag

SEQ ID NO: 127720 - DNA, 954 bp, Artificial Sequence
  Description of Artificial Sequence: Synthetic coding sequence
atggagacaaactgtagaaagctcgtgtcggcatgcgttcagctcggagtgcaacctgccgccgtggagtgcttgttcagtaaagactctgaaattaagaaggtggagtttactgatagcccggagtcccggaaggaagcagctagctctaaattttttccaaggcagcatcccggagccaacgagaaggacaaatcccagcagggcaagaacgaagatgtcggcgctgaggacccatctaagaaaaagcgacagaggcgacagagaactcactttactagtcaacagctgcaagagcttgaggcgacatttcagcgcaaccgataccctgacatgtctactcgagaagaaatagctgtgtggacaaatttaactgaggcaagagtgagagtgtggtttaaaaacagacgcgctaagtggcgcaagcgggaacgtaaccaacaggccgagctgtgcaagaatggcttcggaccacagtttaacggtttgatgcagccatacgacgacatgtaccccgggtactcatacaataactgggccgcaaagggcttgacaagcgcgagcctgtcaactaaatcctttccattcttcaacagcatgaatgttaacccactgtccagtcaaagcatgttttcaccaccaaattcaatatcttctatgtcaatgtctagtagcatggtgccctccgccgtcactggcgttcccggcagcagtctgaatagcctgaacaatctcaataacttgtcaagcccctctttgaatagtgccgtgcctactcccgcttgcccatatgcccccccaacccccccttacgtttacagggatacatgcaattcctcccttgcaagtctccgcctcaaagccaagcagcactcttcattcggatacgctagcgtccagaaccctgcaagtaatctgtccgcatgtcagtacgccgtagaccgaccagtgtag

SEQ ID NO: 127721 - DNA, 816 bp, Artificial Sequence
  Description of Artificial Sequence: Synthetic coding sequence
atggaaacaaattgtcgcaagctggttagtgcatgcgtacagttggagaaggataaatcccagcagggcaagaatgaggatgtcggggccgaagatccttcaaaaaagaagaggcagcgacgtcagcgaacacactttactagtcagcaactgcaggaactggaagcgacattccagcggaacagataccccgacatgtcaacaagggaggagatagcagtttggacaaacctgacagaggcgcgggtccgcgtatggtttaaaaacagacgagctaaatggcgaaaacgagagaggaatcaacaggccgagctgtgcaagaatgggttcgggccccagtttaatgggctgatgcagccttatgacgacatgtaccctgggtactcatacaacaactgggctgctaaaggattgactagcgcttctttaagcaccaaatccttccccttctttaattctatgaacgtcaatcctctgtccagtcaaagtatgttttctcctccaaattctatcagctcaatgtcgatgagcagttcaatggtcccatccgctgtgactggtgtcccgggatctagtctcaattccctcaacaatctgaacaacctgtcttctccatcgttgaacagcgcagtgcctacaccagcatgcccgtatgcacctccaactccaccttacgtgtatcgagacacctgtaacagctcactggcatcactccgacttaaggcaaagcagcatagctcctttggatatgcgagcgtgcagaacccagcaagtaacttatcagcctgtcagtacgcggtcgacaggcctgtgtag

SEQ ID NO: 127722 - DNA, 954 bp, Artificial Sequence
  Description of Artificial Sequence: Synthetic coding sequence
atggagaccaactgtcggaaactcgtgtctgcttgcgtccagctgggcgttcagccagcagccgtggagtgcctatttagtaaagattcagagatcaaaaaggtggagtttacagactcaccagagtccaggaaagaagcggcctcctcaaaatttttccctagacaacacccaggggccaatgaaaaagacaagtcccagcagggtaagaatgaagacgtgggcgcagaagatccgtcaaagaagaaaaggcagagaagacagaggacccactttactagccaacagctgcaggagctggaagcaacctttcagcggaacaggtacccggacatgtcgaccagggaggagatagccgtctggaccaacctgacggaggccagagtccgcgtctggtttaaaaatcgtagggcaaaatggcgaaagcgtgaacggaaccaacaggcggagctgtgcaagaatggattcggcccccagttcaatgggcttatgcaaccttacgacgacatgtacccaggatactcatacaataactgggcagccaagggactgacctcagcatccttgtccaccaaatcttttcccttttttaattcgatgaatgtcaaccccctctcctcacagagtatgtttagtccacctaacagcatatcaagcatgtccatgtcctcaagcatggtgccatctgccgtgacgggggtgccaggctcaagcctgaactcactcaacaacctcaataatttgtcttccccgtccctcaattctgctgttccaactcctgcatgtccttatgcaccacctactcctccatatgtttaccgtgacacttgcaattcatctctggcttccctgcgactgaaagctaagcagcacagttccttcggctatgcatccgtgcagaatccggcgtccaatctgtctgcctgccagtacgctgtggaccgcccagtctag

SEQ ID NO: 127723 - DNA, 873 bp, Artificial Sequence
  Description of Artificial Sequence: Synthetic coding sequence
atggagacaaactgccgcaagctggtcagcgcctgtgttcaactgggagtccagccggccgctgtggagtgcctgttttccaaggatagcgagataaagaaagtcgaatttaccgacagccccgagtctcgtaaggaagcagcctcatctaagttctttccccgtcagcacccaggagctaacgaaaaggataaaagccagcaaggaaaaaacgaggatgtcggcgcggaagatccatcaaagaagaagaggcaacgcaggcagagaactcacttcacaagtcagcagctgcaggagctggaagctacatttcaacgtaaccgttatccagatatgtctaccagagaagagattgccgtgtggaccaacctgactgaggcacgggttagggtgtggttcaaaaatagacgcgccaagtggcgaaaaagggagcggaatcagcaggccgaactgtgcaaaaacggattcgggccacaattcaacggactcatgcagccctacgacgatatgtacccaggatactcctacaataactgggcagctaagggacttacatccgcctcgttaagtactaaatcctttccctttttcaattctatgaacgtgaatcctctcagttctcaatctatgttttccccccctaacagcattagcagtatgtctatgagcagttccatggttcctagcgctgtcactggcgtgcctggctccagtctgaacagtctgaacaacctgaataacctctcctccccttccctgaatagtgctgttcccacaccagcctgtccatatgctccgccaaccccgccctacgtgtaccgtgatacatgcaactcatccttagctagtctgcggcttaaggcaaaacagtag

SEQ ID NO: 127724 - DNA, 357 bp, Artificial Sequence
  Description of Artificial Sequence: Synthetic coding sequence
atggaaaccaactgtagaaagctggtctcggcttgcgtccagctcgagaaagacaagtctcagcaggggaagaacgaagacgtgggtgccgaggatccgagcaaaaaaaaacggcagcggagacaaagaacacactttacttcccagcagctccaggaactggaagctacctttcagcgtaatcgctatcccgatatgtcaaccagggaagagatagcagtgtggactaatctgacagaagctagggtgagggtctggttcaagaacaggagagccaaatggcgcaagcgcgagagaaaccagcaggcggaactgtgcaaaaacgggttcggtccacagttcaacggcctgatgtag

SEQ ID NO: 127725 - DNA, 909 bp, Artificial Sequence
  Description of Artificial Sequence: Synthetic coding sequence
atggaattcggcctgctctccgaggccgaggccagaagcccagcacttagcttgagcgatgccggaactcctcacccacagttgccagaacatggctgcaaagggcaggagcattcagacagcgagaaagcatcagcctccctgcccggtggatctcctgaggatgggtctttaaagaaaaagcagcggcgacagcgtacccacttcacatctcagcagctccaggagttggaggctacttttcagagaaatcgctaccccgacatgtcaacccgtgaggagattgctgtctggacaaatctgactgaagctagggtcagggtgtggtttaagaacaggcgcgcgaagtggagaaaacgtgaacgatcccagcaagctgagctttgcaaaggcagtttcgctgctccactcggaggccttgtcccaccatacgaggaagtctatccaggctacagctatgggaactggcctcccaaagcgcttgcccccccattagccgcaaagaccttccccttcgctttcaacagtgtcaatgttggtcctctggccagccagcccgtcttttcccctcctagtagtatcgctgcttccatggttccaagtgcagctgccgctcctggaacagttcccggacctggggccctccagggcctcggggggggcccaccagggttggcacccgccgccgtatcttctggggccgtctcctgcccgtacgcatccgcagccgcagcagccgccgctgctgcttcctctccatatgtgtatcgggacccctgcaactcgtccctggcgagtttgaggctcaaggcaaagcagcatgcctcattcagctatcctgctgtacacggaccccctcctgctgctaatctttccccgtgccagtatgccgtggagcgccccgtgtag

SEQ ID NO: 127726 - DNA, 909 bp, Artificial Sequence
  Description of Artificial Sequence: Synthetic coding sequence
atggagttcgggctcctcagtgaggcagaggcaagaagccccgctctgtctctctctgacgctggaactcctcatccccagcttcctgaacatggctgcaagggccaggaacactccgactctgaaaaggcctccgcgtctctcccggggggctccccagaagatggatcccttaaaaaaaagcagcggcgacagcggacccacttcacttctcagcagctccaggaacttgaggctaccttccagagaaataggtatccagacatgtctacgagagaggagatcgccgtttggaccaatctaacagaagcccgcgtgcgcgtgtggtttaagaatcgcagagccaagtggaggaaacgcgaaaggtcacagcaggcagaactatgtaaaggatccttcgccgcccctcttggcggcctggttccgccttacgaagaggtttatcccggttacagttatggcaactggccccccaaggcactggcccccccactagcggcaaaaaccttcccctttgcattcaatagtgtgaacgtgggacctctggcatcgcagccagttttcagtcctcctagtagtattgctgcatctatggttccttcagcagccgccgcacccggaactgtgcccggtcctggcgctctgcagggacttggtggtgggccacccggcctggctcctgccgccgtcagctctggtgctgtatcttgcccttacgccagtgcagccgctgctgcagccgcagctgcctccagtccctacgtgtaccgcgacccttgtaactcttctctggcctccctaagactgaaggctaagcaacacgctagcttcagctaccccgcagtgcacggcccccctccggcagccaacctctccccgtgccagtacgctgttgagaggcctgtgtag

SEQ ID NO: 127727 - DNA, 1179 bp, Artificial Sequence
  Description of Artificial Sequence: Synthetic coding sequence
atggagcttgttgctggctgttacgaacaagtgctgtttggatttgccgtccaccctgaacctgaagcctgcggcgatcacgaacagtggactctggtggcggattttactcaccatgcccacaccgcgtcgctctcagcagttgctgtcaactctagattcgtggtcacagggagcaaagatgagactattcatatatatgacatgaagaagaaaatcgagcacggtgcccttgtacatcactccggaactattacatgcctgaagttttatggcaatcgtcatcttatttccggtgccgaggacgggttgatttgcatttgggacgccaaaaagtgggaatgcctgaaatctatcaaagcacataaaggccaggttacatttcttagtatccacccttctggcaaacttgcactttcagtcggaactgataagacgctgcgcacttggaacctggtagagggtcgcagtgctttcattaaaaatattaagcagaatgcccatatcgtagagtggagcccgaggggtgagcagtacgtagtaattattcagaataagattgacatctaccagttagacactgcctcaatatcaggcaccattaccaatgaaaagagaatctcctctgtcaaatttttatccgagagcgtgttagcagtcgccggtgacgaagaggttatacggttctttgattgcgattcgctggtgtgtctctgtgagtttaaggcccacgaaaatagagttaaggacatgttctcattcgaaattcccgagcaccacgttattgttagcgcaagctcagacggcttcattaagatgtggaaactgaaacaggataaaaaagtccccccctccctactgtgcgaaattaacacaaacgcacgtctcacttgcttaggcgtgtggctggataaagtggccgacatgaaggaatcgctcccccctgctgccgaaccttctccggtgtcaaaagagcagtcgaagatcggtaaaaaggagcccggcgacacagtgcacaaggaggaaaagagatccaagcctaataccaaaaaacgcggtctaactggggattccaaaaaggcaacgaaggaatcgggactgatttccactaaaaaacggaaaatggtggagatgttagagaagaagcgcaaaaagaagaagatcaagaccatgcagtag

SEQ ID NO: 127728 - DNA, 3372 bp, Artificial Sequence
  Description of Artificial Sequence: Synthetic coding sequence
atgtcaggcacctcttcacacgagagcttctacgactctctatcggatatgcaagaggagagcaagaacaccgatttttttcctggcctgtcagcattcctgagccaagaagagattaataaaagtttggacttagcaagacgggccattgccgacagtgaaaccgaagatttcgatagcgaaaaagagatcagccagatattctccacttcccctgcttcgttgtgcgaacacccttcacacaaggagacaaaactgggtgaacacgccagtaggaggccacaagacaatcgatctactcctgtgcagcctttagccgaaaagcagacaaaatccatatcttctcccgtatctaagaggaaacctgctatgtctccattactcacaagaccatcttacattcgatctctgaggaaggccgagaagcggggggcaaaaacaccttcaactaatgttaagccaaaaacccctcatcagcgcaaaggaggccctcagagccagctctgtgacaaggctgcaaatttaatcgaggagctaactagcatctttaaggccgccaaacccagaaacagatcccctaatggggagtcatcgagcccagactccgggtacctctcccccaagaatcagccatccgccctcctgtctgcctcagctagccagagcccaatggaggaccagggcgaaatggagcgcgaagtgaaatcccccggcgccagacactgctatcaggacaatcaggacctggccgttccccacaacagaaagtcacatccacaacctcattccgcactccacttccccgcagccccgaggttcattcagaaacttcgatcacaagaagtggccgaaggctcccgggtatacctcgaatgtcgagtcaccggtaatcctacaccaagagtccggtggttctgcgagggaaaggaactccataatacgccagatattcagattcactgtgaagggggggacttgcataccctgatcattgccgaggcctttgaagacgatacgggcagatatacgtgtctggctacaaatccctcaggatccgacacaacatccgcagaagtgttcattgagggcgcatcctctactgactctgatagtgaatccctggcattcaaatctagagctggggcaatgccacaagcccagaaaaagactacctcagtttctctcacgatcggaagcagctccccaaagactggagtgaccaccgccgttatacagcccctgtctgttccagttcaacaggtgcatagcccgaccagctacctttgtcgtcctgatgggacgaccaccgcttactttcctcctgttttcacaaaggagcttcagaacactgcagtggcagaaggacaggttgtggtgctcgagtgccgagtcagaggtgcccctcctctccaggtgcagtggttcaggcaaggttcagagatccaggacagcccagacttcagaatcctccaaaagaagccaaggtcaactgccgagccggaggagatttgcacactcgtgatcgctgagaccttccccgaggacgccggaattttcacatgttccgcccgcaacgactatggttcggccacctctaccgcacaactggtagttacctctgctaatacagaaaactgtagctacgagtcaatgggggagagcaacaatgatcactttcagcattttccccccccgcctcctattctcgagacttcaagcctggagcttgcttcaaaaaagccaagcgagattcagcaggtaaacaacccagagctcggactgtccagggctgccctccagatgcagttcaacgctgctgaaagggagaccaatggagtccacccatctagaggggtaaacggactcatcaacgggaaggctaacagtaataaatctttacctacacctgctgtgttactttctcctacgaaagaacctccccctctcttagccaagcccaaactgggattccccaagaaggctagccgaaccgcgcgtatcgcgtcggatgaggagattcagggcacaaaagacgcagttatccaggatctggaacggaagctccgcttcaaggaggacctactaaataacggccagccaagactgacatacgaggagcgcatggcgaggagactgttgggtgctgattcggcaaccgtgttcaatatccaagaacctgaggaggaaactgcaaatcaggatattggatcacctcacgccagcgtggggagcccattagacggccagaaggaatacaaggttagctcatgtgaacagcgcctgatatccgagattgagtatcgcttagaacgttcacccgtggatgagtcaggcgacgaggtgcagtatggcgacgtcccggtcgagaatggaatggccccctttttcgaaatgaaacttaaacactataagatatttgaagggatgcccgtgacatttacctgcagagtggctgggaaccctaaacctaagatatactggtttaaggacggaaaacagatatccccaaaatccgaccactacacaatccaacgcgacctggacgggacctgtagcctgcatactaccgcgagcacactggatgatgatggcaattacacaatcatggcagccaaccctcagggcaggatttcctgcacagggcggctgatggttcaggccgtcaaccagagaggacgtagccctcgtagcccatctgggcatccccatgtgagaaggccaaggtctagatcacgggacagcggcgatgagaacgagcccatccaggagaggttcttccggccacatttcctccaagcacccggagatctgactgtgcaagaaggcaagctgtgccgtatggactgcaaagtatccggattgcctactcccgatctctcctggcaactggacggtaagccggttaggcctgactccgcacataaaatgctggtgcgcgaaaacggcgtccactcactaatcatcgagcctgtgaccagccgagatgcaggcatctatacctgcattgccacgaaccgggcggggcagaattcattctcgctggagttggtagtggctgccaaggaggctcataaaccaccagtctttatcgagaagctgcagaataccggcgtggcagacgggtatccagtgcgcttggagtgcagagttttgggggtgccacccccacagatattctggaagaaggagaacgagtcgctcacacacagcaccgaccgagtctctatgcaccaagacaaccacggatacatctgtctgctcatacaaggcgcaacgaaagaggacgccggatggtatacggtaagtgccaaaaatgaagctggaattgtgtcttgcacagctaggttggacgtgtacatctccaggcattag

SEQ ID NO: 127729 - DNA, 2019 bp, Artificial Sequence
  Description of Artificial Sequence: Synthetic coding sequence
atgtccgctctggcatcccgttctgcacctgccatgcaatcatccgggtcttttaactatgctaggcccaagcagttcatcgctgcgcagaatttaggccccgcctccggccacggtactccagcgtcctcaccctcatcttcctcacttccctcacctatgtctcctacccctcgccagtttggccgcgctcccgtgccacccttcgcgcagccgtttggcgcggagcctgaagctccttggggttccagctctccttccccgccgccgcccccgcccccagtgtttagtcccaccgcagcctttccagtccccgacgtgttccccctcccgccaccaccaccgcccctccccagcccagggcaggcgtctcactgctccagcccagcaacccgattcggacattcacagacacccgcagctttccttagcgccctgctccccagccagccgccacctgccgccgtcaatgctttaggactccccaagggcgtaacacccgcaggatttcctaaaaaggcgagcaggacagccagaattgcgagcgatgaggaaattcaggggaccaaagacgccgtaattcaggatctggagcgaaagctccgatttaaggaagaccttctgaacaacggacagcccaggctcacatacgaagaacgcatggcccggcgcctccttggcgctgactccgccacagtgttcaatatccaggagcctgaggaggagacagcaaatcaagaatataaagtcagcagttgcgaacaaagactgatctccgagattgaataccgcttggagcggagcccagtggatgagtctggcgatgaggtgcagtatggggacgtgccagtggagaacgggatggccccatttttcgagatgaagctgaaacactacaaaatttttgaaggcatgcctgtcacttttacctgtcgcgtcgctggcaatcccaagccaaagatctattggttcaaagacggcaaacaaatctctccaaagtcagaccactacactatccagcgtgacctcgacggcacgtgttccctgcacaccactgccagcacattagatgatgatggcaactacactattatggccgccaatccccagggacgcatttcctgcactggcaggttgatggtgcaggcagttaaccagaggggcaggtccccccggagcccctcaggccaccctcacgttaggcgccctcgatcccggtctcgtgattctggtgacgaaaatgaacctatccaggaacgcttctttcggccacacttcttgcaagcccccggcgatcttacagtccaggaaggcaagttgtgtcggatggattgtaaagtcagtggcctaccaacgcctgatctgagctggcaactggatgggaagccagtgaggcctgattctgctcataagatgctggtaagagagaacggcgtgcatagcctgatcatcgagcccgtcacgagtcgtgacgcgggaatctacacctgtattgccacaaatagggccggacaaaactccttctccctcgagctggtggtcgccgccaaagaggcacacaaaccacccgtgttcatagagaagctgcagaataccggcgtagcagacgggtatccagtgaggttagagtgtcgcgtgctaggcgtcccacctccgcaaatcttctggaagaaagaaaatgaaagcctgacccatagtacagaccgagtcagtatgcaccaggacaaccacggatacatttgcctgctcatacagggagccaccaaggaggacgctggatggtacacagtgagtgccaagaacgaagctgggatcgtatcgtgtactgctagattggacgtttatacccagtggcatcagcagtcacaaagcacaaagccaaagaaagtgcgccccagcgcctcccgctacgcagctcttagcgaccaaggtttagacatcaaagccgcgttccagcctgaagccaaccccagccaccttacgttaaatacagccttggtagaatcagaagacctttag

SEQ ID NO: 127730 - DNA, 2334 bp, Artificial Sequence
  Description of Artificial Sequence: Synthetic coding sequence
atgccgcaagcccagaagaaaacaacttccgtttcacttacaataggctcttccagtcctaaaactggtgtcaccactgcagtgatacagcccttaagtgtcccagtacagcaagtgcattctcccacatcctacctctgtcggcccgacggcaccacgactgcttacttcccccctgttttcacaaaggagctgcagaacaccgctgttgctgagggacaagtggtggtcctggagtgtagagttaggggtgcgccccctctccaggtgcagtggtttcgtcagggctctgaaatccaggactctccagactttagaatacttcaaaagaaacctagaagtaccgctgagcctgaggaaatttgtactctcgtcatcgccgaaaccttcccagaagatgctggaatctttacctgctccgcgagaaacgactacggcagcgccacgagcaccgcacaactggtggtgaccagcgcaaacacagagaattgctcctatgagagtatgggtgagtctaacaacgatcactttcagcatttcccaccaccccctcccattctggagaccagctccctcgagctcgcgtctaagaaaccgagcgaaatccagcaggttaacaaccctgaactaggacttagtagagccgcactgcagatgcaattcaacgctgcggaacgggagaccaacggcgtgcacccttctagaggtgtgaatggtttaatcaatggaaaagctaatagcaacaagtctctgcctacccctgccgttctgttgagtccaactaaagagcctcccccattgctagctaagcctaagctcggctttcccaagaaggcgtctaggacggctcggatcgcctccgacgaagagatacaggggaccaaggatgctgtgatccaggacctagagcggaagctcaggttcaaggaagacttacttaacaacgggcagcccagactgacctacgaggagcgcatggctagaaggctgttgggagctgactccgctaccgtgtttaatattcaagagcctgaggaggagacagcaaatcaggagtacaaagtctcttcctgtgagcaacgcttaatttctgaaattgaatatcgcttggaacggtcaccagtggatgagtccggcgacgaggtacaatacggcgacgtccccgtggagaacggcatggccccattttttgagatgaagctgaagcactataagatcttcgaggggatgccggtcacattcacttgcagagtggccggaaatccaaaaccaaaaatctactggttcaaggatggtaagcagatctctccaaagtcagaccattacactatccagagagatcttgacgggacctgtagcctgcatacaacagccagcacgcttgatgatgacggcaactataccattatggccgcgaatcctcaagggagaatttcttgcaccgggagacttatggtgcaggccgtgaatcaaaggggaaggtcaccgcgatcaccttctggtcatccccacgtccggagacccaggtcacgctcgagggactcaggtgatgagaacgagccaattcaggagcgcttcttcagacctcacttccttcaggctccgggcgacctcaccgtacaagagggcaaactttgtaggatggactgcaaagtttccggactgcctactcccgatctctcctggcaactggatggcaaaccagtccggccagatagtgcccacaagatgcttgtccgggagaatggtgtgcacagtctcatcatagagcctgttacttctagggatgctggcatttacacttgcattgcaaccaatcgggctgggcagaatagcttctcccttgaactggtggtagcagcgaaagaagcacataagccccctgtttttattgagaagttgcaaaatactggagtcgccgatgggtatccagtgcggctcgagtgtagagttttgggggtcccgcctccccagatcttttggaaaaaggaaaacgaaagtttgacgcactctaccgatcgcgtttctatgcaccaggataatcatggatatatctgtctgctcatccagggagctaccaaagaggacgccggatggtacacggtcagtgccaagaacgaggccggcatcgtgtcttgtaccgcgcggctggatgtatacacccaatggcaccagcaaagccagtctacaaaacctaagaaggttcgcccttctgcctctaggtacgccgctttgtccgaccagggcctggacatcaaggctgccttccagccggaggcgaatccaagccacttgaccttaaacacagctctggttgaatctgaggatctctag

SEQ ID NO: 127731 - DNA, 3321 bp, Artificial Sequence
  Description of Artificial Sequence: Synthetic coding sequence
atgtccggaactagtagtcacgaatcattctacgactcattgagcgacatgcaggaagagtccaagaatactgactttttcccggggctaagcgccttcctgtcccaggaggagattaacaagagtctcgacctggcccgacgcgccatcgccgacagcgagaccgaagatttcgactcagaaaaggagatttcacagattttttccacttctcccgcctccttgtgtgaacacccttcgcacaaggagactaaactcggtgagcacgcttccagaaggcctcaggataaccgctctaccccggtccagccactggctgagaagcagacaaagtccatctcgtccccagtgagtaagcggaagcctgctatgagtccgctgctgaccaggccatcatatatcaggagcttaagaaaagccgagaaacgaggggctaagaccccctccaccaacgtcaagcccaagacaccccaccagcggaagggcgggcctcagagccagctttgcgataaagctgctaatttaattgaagaactgacctcgatcttcaaagccgctaagccccggaataggtctcctaatggagagagctcaagccccgactcagggtacctgtcccccaagaaccagccaagcgcactgctgtcagcgagcgcatcccaatcccctatggaggaccagggagaaatggagagggaagtaaagagtcccggggcacgtcactgctaccaagataatcaggacctcgccgttccacacaaccgcaagagccaccctcagccccatagcgctctacacttcccagccgcacctagattcattcagaaactgcgatcccaggaggtggctgagggatcaagggtgtatctcgaatgccgcgtgactggcaaccccactccacgggtccgatggttttgcgaaggaaaagaacttcacaatactcctgatatccagattcactgcgagggaggtgatttgcacacgctcattatcgcagaggcgtttgaggacgatacaggacggtacacttgcctcgctactaatccaagcggatccgacactaccagcgccgaggtattcattgaaggggcctcttccactgactctgacagcgagtctctcgcattcaagagcagagccggcgctatgccccaagcgcaaaaaaagacgacctcggtcagtctgacaataggatcatcatcacctaaaacaggagttaccacagccgtaattcaaccactgtctgtacccgttcaacaggtgcattccccaaccagttatctatgccggcccgatggtaccacgaccgcctacttcccaccagtgtttactaaggagttacagaataccgccgtagccgaaggacaggtcgtggttctcgaatgcagggtacgcggggcaccgcctctccaggtgcagtggttccggcagggaagcgaaattcaggatagccctgattttcggattctccagaaaaaacccaggagcaccgctgaaccggaggagatttgcacactggtcatcgctgagacctttcccgaagatgcaggtatttttacatgtagcgctagaaatgactacggctcagccacatcaaccgcccaactcgtggtcaccagcgcaaatactgagaattgctcttacgaaagtatgggggagagcaacaatgaccacttccagcatttcccgccaccacccccaattttagaaacatcgtctctcgagctagcctccaaaaagccctcggagatacaacaggttaataacccggagctcggattaagtagggcggcgctgcagatgcagttcaacgcagccgagagagaaactaatggggtgcatcctagccggggagtgaatggcctcattaacggcaaagcaaattccaacaaatctcttccgacacctgccgtgttgttatctcccaccaaagagcccccaccactgctggcaaagcccaagcttgggtttccgaaaaaagcttccagaaccgctcggatcgcttcagatgaagaaatccagggcacaaaggacgcagtcattcaggacctggagcgaaaactgcggtttaaggaggacctgttgaacaatggccagcctcgcctaacctacgaggagcgcatggcccgaaggctcctgggagcagacagcgcaaccgtttttaacatccaggagcctgaggaagagactgctaatcaggagtacaaagtaagcagttgtgagcagcgtttgatctccgagatagagtacaggctggagagatcgcctgtggacgaaagcggtgacgaggtgcagtatggagatgtgcctgtggaaaatggaatggcaccctttttcgaaatgaaactcaagcattacaagatattcgaagggatgcccgtgacatttacctgccgggtggctggaaatcccaaacctaagatctactggtttaaagacggaaagcagatctcccccaagagcgaccactacaccatccagcgcgacctagatggcacctgtagtctgcataccacggcctccaccctcgatgacgacggcaactacacaatcatggctgctaatcctcagggaaggatttcttgcactgggcgtctcatggtgcaagcggtgaatcagcgtgggagatctcccaggagcccatccggacacccacatgtaaggcgacctaggagtcggtcccgcgactccggggacgagaatgagcctattcaggagcgtttctttcgtccccacttccttcaggcaccgggtgatttgaccgtgcaagaaggaaaactctgccgcatggattgtaaggtgagcggtctgcctacacctgatttgtcctggcagctggacggcaaacctgtgcggcccgatagcgctcacaaaatgttggtgcgggaaaatggggttcactctcttatcattgaaccagtgacatctcgcgacgctggaatttatacatgcatcgccacaaatcgggccgggcaaaattcattcagtctagaactggtcgtggccgcgaaggaggcacataagccccctgtctttattgagaagctccagaacaccggagtcgcagacgggtacccagtccggttggagtgtcgagttctcggagtaccccccccacaaattttttggaagaaggagaacgaaagtctgacacattcaactgacagggtgagtatgcaccaggacaaccacggctacatctgcctgctgatacaaggcgcaactaaggaggatgccggatggtatactgtcagtgccaagaatgaggcagggattgtgtcttgcactgccagactggatgtgtatatttcccggcactag

SEQ ID NO: 127732 - DNA, 1233 bp, Artificial Sequence
  Description of Artificial Sequence: Synthetic coding sequence
atgagtcccctgctgacgagaccttcctacattagatccctgcgcaaggccgaaaaacggggggctaaaaccccatctaccaacgtgaagccaaaaaccccgcatcaaagaaagggggggccacaaagtcagctgtgcgacaaagctgctaatctaattgaagaattaacgtctatatttaaggcagccaagcctagaaatagaagtcctaacggggaatcctcgagtcccgattcaggctatctgagccctaagaaccaaccatccgccttactgagcgcttccgcgtcgcagtctccgatggaagaccagggtgagatggagcgcgaagtgaaaagcccaggcgcaagacactgctaccaggacaatcaggatctcgcggtaccacataacagaaagagccacccacagccccactctgctcttcacttccccgcggctccaaggttcatccagaaactgcgttcccaagaagtagctgaagggagccgagtgtacctggagtgtcgagtaaccggcaacccgaccccccgtgtccgttggttctgtgaggggaaggaactgcataatacccccgatatacagatacattgtgaaggaggtgacctccacacgctgataatcgccgaagccttcgaagacgacactggccggtacacctgcctggccacaaacccctctggctccgacactaccagcgcggaggtcttcattgagggggcatcaagtaccgattcagattccgagtccctggcttttaaatctcgggcaggagccatgcctcaagcccaaaaaaagacaacctctgtgagtctgaccattggatcttcttcacctaagacaggagtgacgactgcagtgatccagccactgtctgtgccagtacagcaggtgcacagccccacaagttatctttgtaggcccgacggcaccacaaccgcttattttccacctgtttttaccaaagaactgcagaatactgcggtggcagaagggcaagtagttgtgctggagtgtagagtgcgtggcgccccgcccctgcaggttcagtggttccggcaggggtccgaaatacaagactcacctgacttcaggattctgcagaagaagccccggtctacggccgaacctgacgttctgtacgtgttcgttcgcgtacggtgtcaccagatgaaaattcaatactacaatctggctcacctgatcagttcttggcttagctccttcttgtag

SEQ ID NO: 127733 - DNA, 3006 bp, Artificial Sequence
  Description of Artificial Sequence: Synthetic coding sequence
atgcctcaggctcaaaaaaagaccacgagcgtgagcctcaccatcgggagctcctcaccgaagaccggcgtcaccacagccgtgatccaaccactgtccgtgccagttcagcaggttcactcccccaccagttacctgtgcaggcctgatggcactaccactgcctacttccctcctgtgttcaccaaggaactgcaaaacacagccgtggccgaaggacaggtggttgttctggagtgccgggtgcgcggcgctcctccccttcaggtgcaatggttccggcagggttccgaaattcaggactctccagatttcaggatccttcagaagaaacctcgctccacggcagagcccgaggaaatttgtacactggtcattgccgagacctttcctgaggacgccgggattttcacttgctccgcgcggaacgactacggctcagctacctccacggcccagctggtcgtgactagtgccaacactgagaattgttcctatgagtcgatgggtgagtccaacaacgaccactttcagcatttccccccccccccgcctatcctagagaccagcagtctggagctggccagtaagaaaccgagtgagattcagcaagtaaataatcctgaactcggcttgtcaagggcagctctgcagatgcaatttaacgctgctgaaagagagaccaacggagttcacccaagtcggggggtgaacggtcttattaacgggaaagcaaattccaataagtcgctgccaacccccgcggtgctgttatcacctactaaagaacccccaccattgctagcaaagcccaagttggatccgctcaaactgcagcagctgcagaatcagattaggttagaacaggaggcgggcgcccggcaacctccccccgctcccaggtctgctccacctagccctccattccccccccccccagcttttcctgaattggccgcctgcacaccacccgctagtcctgaacctatgtcagccttggcatccaggtctgctcctgctatgcagtcttcggggagttttaactacgcaagacctaaacagtttattgctgcccagaatcttggtccagccagtggacacggaacacctgcttcatctccttccagtagtagtctcccttctccaatgtcccccacgccgaggcagttcggacgcgctccagtgccgccattcgcccagccttttggagccgagcctgaggccccctggggctcaagctcaccttctcctccaccaccccctcctcctgtgttctcaccaacagcagcttttccagtgccggacgtgttccctctccccccgcccccacccccgctgccatctcctggtcaagcttctcattgcagctctcctgcaacaagatttggccattcccagactccagctgcctttttaagcgctcttcttccaagtcagcccccgccagcagccgtgaatgcattaggactaccaaaaggcgtcacccccgccggttttcccaagaaagcctctcgtactgctcgaattgcctccgacgaggaaattcagggcactaaggacgcagtcatccaggaccttgagaggaagttaaggtttaaggaggatttgctcaacaacgggcagccccggctgacatatgaagagaggatggcaagaaggttactgggagccgactccgccaccgtgttcaatatccaggaacccgaagaagagacagccaaccaggagtacaaagttagcagctgtgaacagagactaatctccgagattgagtacaggctagagcgctctccggtcgacgaatctggagacgaggtgcaatatggggacgtcccagtagagaacggaatggccccattctttgagatgaagctcaagcactataaaatctttgagggtatgcccgtaacgtttacatgtcgcgtggctggaaatcccaagccgaagatctactggtttaaagatggcaaacaaatctcgccgaagagtgaccattacaccatccagcgcgaccttgacggcacatgctctctgcacaccaccgcttccacattggacgacgatggcaactacacaatcatggctgctaaccctcaaggccgtatcagttgcactgggagactaatggtgcaggcagttaatcaacgcggaagatcccccagatctccatcggggcacccacatgtgaggcgccccagaagcagatctcgcgacagcggcgatgagaatgagcccatccaggaaaggttcttccggcctcactttctgcaagcgcccggggacctgaccgtgcaggaaggaaagctctgtagaatggactgtaaggtgtccgggctcccaacccccgacttgtcctggcagctggacggaaagcctgtgcgcccagacagtgcccacaaaatgctggttcgcgaaaacggcgtgcattcattgattatcgagcccgtcacttcccgcgatgcagggatttatacctgtattgctaccaacagggctggtcagaattcctttagcctggagctcgtggtcgcagctaaggaagcccacaagcctccagtatttatcgaaaaacttcaaaacaccggagtagctgacggctaccctgtgagacttgagtgccgtgtcctgggtgtgccaccgccccagatcttttggaagaaggagaacgaatctctcacacactccacggaccgggtgagcatgcaccaggacaaccatggatacatatgccttctcattcagggcgcaactaaagaagatgccggatggtatacggtcagtgcaaaaaatgaagccggcattgtgagttgcacagctaggttggatgtttatacccaatggcaccagcagtcacaatcaacaaagcctaagaaggtgcgcccatcagcgagcagatacgccgctctgtccgaccaggggttggatataaaggctgcttttcagccagaggctaatcctagtcatctcactctcaataccgctctggtggagtctgaggatctgtag

SEQ ID NO: 127734 - DNA, 483 bp, Artificial Sequence
  Description of Artificial Sequence: Synthetic coding sequence
taagggaaacctgtgcgccccgactcagcacataagatgcttgtccgcgagaatggcgtccacagtcttattattgagccagtgacctcccgggacgccgggatttacacttgtatcgccactaatcgcgccggccaaaattccttttccctggaactcgtcgtagccgcaaaagaggcccataaacctcctgtttttattgaaaagctacagaacacgggcgtggcagatggatacccagtgagattagaatgtagggttttaggtgtaccacccccgcagattttttggaagaaggaaaacgagtccctgacgcattcaacagaccgcgtctcgatgcatcaggataatcacggctatatttgtctccttattcagggagcgacaaaggaggatgctggttggtatacagtgtcggcgaaaaacgaggctgggatagtcagctgcacagctcgtctggacgtctacattagccgacattag

SEQ ID NO: 127735 - DNA, 1539 bp, Artificial Sequence
  Description of Artificial Sequence: Synthetic coding sequence
aagaatactgactttttccccggcctctctgcatttctctcccaggaggagatcaacaaaagtcttgacctcgcaaggcgcgcgattgccgattccgagaccgaggacttcgactccgagaaagagatctcacagatcttttctacctccccagcttccctttgtgaacacccttcccataaggagacaaaactgggcgaacacgcttctcgcagaccacaggataatcgatcaacccctgttcagcctttggccgagaaacagacaaaatcaatttcgtcacctgtatctaaaagaaagccggcaatgtctccacttttgactcggccatcgtacatcaggtcgttaaggaaggctgagaagaggggtgcaaagacgcccagtactaatgtcaagcccaaaacaccccaccaacgcaagggagggcctcagtcccagttgtgtgataaagcagctaatcttatcgaagaacttaccagcatctttaaggcggctaagcccaggaaccgaagtcctaacggggaatcatcatcaccagactcaggatacctttcacccaaaaaccagccaagcgccttactgagcgcgagcgcctcgcaatcaccaatggaagaccagggagaaatggaacgggaagtgaagtctccaggagctagacactgctatcaggacaaccaggatcttgccgtcccccacaatcggaagagccatccccagccacattcggccctgcactttcctgctgcaccccggttcatccagaaacttaggagccaggaagttgccgagggcagtagggtgtacctcgagtgcagagttacagggaatcccacccctcgggtaaggtggttttgtgaaggcaaagagttacacaacacccctgatatccagattcactgtgagggcggcgatctgcacacactgatcatagcggaggcttttgaggatgacaccggtaggtatacctgtttggcaacaaaccccagtggatcagataccacttcggctgaagtgttcatcgagggcgcatctagtacggacagtgattcagagtctttagcattcaaaagccgcgctggcgccatgcctcaggcacagaaaaaaacaaccagcgtctccctgacaatcggcagttcaagtccaaagaccggcgttaccactgccgtcattcagccgctatccgtaccggttcagcaggtccacagccctacatcctacttatgccggcccgatgggacaacaactgcctactttccccccgtgtttactaaagaacttcaaaacacagccgtagctgaaggccaggtagtcgtattagaatgccgggtcagaggggccccccctctccaggtgcagtggttcagacagggatcagaaatacaggatagtccagactttagaattctacagaagaaacctcgttcaaccgccgaaccagatgtgctgtacgtctttgtgcgagtgcgatgccaccagatgaagattcaatactacaacctggctcacctgatcagttcctggctgtcaagtttcctctag

SEQ ID NO: 127736 - DNA, 87 bp, Artificial Sequence
  Description of Artificial Sequence: Synthetic coding sequence
atgagcggaacatcttcacacgaatcattctacgacagcctttccgatatgcaggaagaatctaaaaacacggatttctttccttag

SEQ ID NO: 127737 - DNA, 690 bp, Artificial Sequence
  Description of Artificial Sequence: Synthetic coding sequence
atggctgcacagcctctgcgccatagatccagatgcgctactccaccccggggagatttctgtggcgggacagaaagagccatcgaccaagccagcttcacaacatccatggagtgggatacacaggtagtgaagggcagctctcctctaggcccggccggccttggggctgaggagcctgctgcagggccacaactgcccagctggttacagcccgaacgctgcgccgtgttccaatgcgctcaatgtcatgccgttctagctgactctgtccacctggcctgggatctaagccgaagtttaggcgctgttgtgtttagccgggtgaccaataacgtggtattagaggcaccattcttggtgggcatcgagggtagcttaaaggggtccacgtacaacctgctgttttgtggaagttgtggaatccccgtgggattccacctgtactccacccatgctgcgctagccgcccttagggggcacttctgcctcagctcagacaaaatggtctgttacttattaaagactaaagccatcgtaaacgcaagtgagatggatattcaaaatgtccctctgtccgagaaaatcgcagaacttaaagaaaagatcgtcctgacccataacaggctgaagagtttaatgaaaatactgagcgaggtgacccctgatcagtccaagccggagaattag

SEQ ID NO: 127738 - DNA, 816 bp, Artificial Sequence
  Description of Artificial Sequence: Synthetic coding sequence
atggcctctccaggatgtctttggctgttagctgttgcgctgctgccatggacctgcgcgtcccgcgctttgcagcatcttgacccaccagcaccgctcccgctcgtcatctggcatggcatgggcagccgatacgttgctcagacaggcctggaactcctcgcctcaagtaacccacctgcctccagctaccagtccgctggtatgattggggattcttgctgtaaccccctaagtatgggcgctataaaaaaaatggtggagaaaaaaattccaggcatatacgtcctgtccttggagattggaaaaactctcatggaggacgttgaaaacagtttttttcttaacgttaatagtcaggtgacgactgtctgtcaggcattagcaaaggatcccaagcttcagcaggggtacaacgcgatgggattcagccaaggagggcaattcctccgggctgtggcccaaaggtgtccttccccacccatgattaatcttatctcagttgggggtcagcaccagggcgtgtttggattaccccggtgccccggcgaaagctcccatatctgcgacttcatcaggaagacactcaacgctggagcttacagtaaagttgttcaggaacgcctggtccaggctgagtactggcacgatcccattaaagaggacgtctaccgcaatcattccatatttttggcagacatcaaccaggagcgaggaatcaatgaatcttacaagaagaacctgatggctcttaagaagtttgtaatggtgaagtttctgaatgacagtattgtggatccagttgattccgaatag

SEQ ID NO: 127739 - DNA, 921 bp, Artificial Sequence
  Description of Artificial Sequence: Synthetic coding sequence
atggcttctcctgggtgcctgtggctcttggcagtcgcacttctgccctggacttgcgccagcagggcactccagcacctcgatccaccggctcctttgcccctggtgatttggcacggcatgggggacagttgttgcaacccgctgtctatgggagcgatcaaaaaaatggtggagaaaaaaattcctggcatctatgtgctcagtctcgagatcgggaagaccttaatggaggacgtggaaaattcattcttcctcaatgtcaatagccaggtgacgaccgtttgtcaggccctggccaaggacccgaagctgcaacagggttataacgccatgggatttagccaggggggacagtttctcagggccgtcgctcaacgatgcccctccccaccgatgatcaacctcatcagtgtcggcggacaacatcagggcgttttcggcctgcctcgctgtcctggagagagcagccacatttgtgacttcatccggaagactttgaatgccggcgcttactcgaaggttgtccaggagagactggtacaggctgagtactggcacgatccaatcaaagaagacgtgtatcggaaccactctatttttcttgccgacataaatcaggagaggggaatcaacgagtcttacaaaaaaaatctgatggctttaaagaagttcgtcatggtgaagtttctcaatgatagcattgtggacccagtggactccgagtggtttggattctatagatccgggcaggctaaagaaactatccccctgcaggagacttccctctacactcaggaccgactcgggttgaaagagatggacaatgctggccaactggttttcctggcgactgagggagaccacctgcagctgtcagaagaatggttttatgctcacattatcccatttctcggatag

SEQ ID NO: 127740 - DNA, 612 bp, Artificial Sequence
  Description of Artificial Sequence: Synthetic coding sequence
atggcctcccccggctgtctctggctgctggctgtggccctcttgccctggacatgcgcctccagagcgctgcaacacctagatccccccgctcccctccctcttgtgatctggcatgggatgggagtgtttggcctgcctcggtgtccgggcgagagctcccatatctgtgatttcatccggaaaaccctcaacgccggggcctactcaaaagtggtgcaggagaggcttgttcaggcggagtattggcacgatcccattaaagaggacgtgtaccggaaccatagcatttttcttgccgacatcaatcaggagcgtggcatcaacgaatcatataaaaagaaccttatggccttgaagaagttcgtaatggtcaagttcctcaatgattccatcgtggacccggtcgactcagaatggttcggattctaccgcagcggacaggccaaggaaacaatcccccttcaagaaaccagcctttatactcaggacaggttaggactgaaagaaatggataacgccggtcaactagtgttcttagccaccgagggagaccacttacaactcagcgaggagtggttctatgcccatatcatcccttttttggggtag

SEQ ID NO: 127741 - DNA, 921 bp, Artificial Sequence
  Description of Artificial Sequence: Synthetic coding sequence
atggccagccccggatgcctttggcttctcgcagttgcacttctgccctggacctgcgctagccgtgctttgcagcacctagatcctccagcacccctgcctttagtaatttggcatggaatgggggactcttgttgtaatcccctgtctatgggggccatcaagaaaatggtggagaagaaaattcctggtatctacgtcctgagtttggaaattggcaagactttgatggaggacgtcgagaactctttttttttaaatgtgaactctcaggtgaccactgtgtgccaagcccttgccaaggacccgaagctacagcagggatacaacgctatggggttctcgcaggggggtcagtttctcagagctgtcgctcagcggtgcccttccccgcccatgataaacctaatctctgttggggggcagcatcagggagttttcggccttccccgttgccccggggaatcctctcacatttgcgacttcattagaaagacgttgaatgctggagcttatagcaaagtcgtacaggagcgcctggtacaggctgagtattggcacgaccctataaaggaggacgtttatcgtaatcactcaatctttctcgctgacatcaaccaagaacgagggattaacgagtcttataagaagaacctaatggccctgaaaaagttcgtgatggtcaagtttcttaatgactctatcgtcgatccagtcgattccgagtggtttggcttctaccgcagtggccaggccaaggagacgattccactccaggagacttcactctacacgcaggatcgcctagggctgaaggaaatggacaacgccggccagctagtattcctggcaactgagggcgaccatctgcaactctccgaagagtggttttatgcgcatataatacccttcctagggtag

SEQ ID NO: 127742 - DNA, 909 bp, Artificial Sequence
  Description of Artificial Sequence: Synthetic coding sequence
atgttaggactatgtggtcagagactgcccgcagcatgggtcctgttgttactccccttcctaccgttactgctcttagccgccccggcacctcaccgtgctagctacaagcctgtcatcgtcgtccacggtttgtttgactcatcttatagttttagacacctcctggagtacattaatgaaacacaccccgggactgtggtgaccgtgctagatcttttcgatgggagggaatccctgcggccgctgtgggagcaggtccagggcttccgcgaggctgtggtcccaattatggccaaggctcctcagggtgtccacctgatttgttacagccagggcggacttgtctgtcgagcccttctgagcgtgatggatgatcacaacgtggacagcttcatttcactgtccagcccccagatggggcagtacggggatacagactacctgaaatggcttttccctacaagtatgcggagtaacctgtatagaatttgctattctccctggggtcaggagttctctatttgcaactactggcacgatcctcaccatgacgacctatacctcaatgccagtagcttcctcgccctgatcaacggcgagcgggatcatcccaatgctaccgtgtggagaaagaacttcctcagagtgggacatctagttttgattgggggtccagacgatggcgtgattaccccatggcagagctctttcttcggcttttatgatgcgaacgaaacggttctggagatggaggagcagctggtctaccttagggattccttcggcctcaagactctcctcgccagaggcgcaatcgtccgttgtcccatggccggcatctcgcataccgcctggcactccaacaggaccctatatgagacttgcatcgagccatggttgagctag

SEQ ID NO: 127743 - DNA, 927 bp, Artificial Sequence
  Description of Artificial Sequence: Synthetic coding sequence
atgaagtcttgcggctccatgcttgggctatgcggccaacgcctaccagccgcctgggtgttactgcttctgccctttctgccgctgttgctgttggctgcccctgcccctcatagagctagctataagcctgtaatcgtggtgcatggactgttcgacagctcctatagctttcgccatctcctggaatacatcaatgagacacacccgggaactgtggtcacagtactcgacctgtttgatggaagagagagcctgcggcccttatgggagcaagtgcagggattcagagaggcagtggtgcccattatggctaaggccccacagggggtccacctgatctgttactcccaaggggggcttgtgtgtcgggcgttgctgagtgtgatggatgaccacaatgtcgactctttcatcagcttaagctcaccgcagatgggtcagtacggtgatacggactatttgaagtggctgtttcctacatcaatgagaagtaatctgtacaggatatgctactctccctggggccaagaattctccatctgcaattactggcatgaccctcatcatgatgatctctacctaaatgcttcctccttcctggcactgatcaatggcgaacgcgatcaccctaatgccaccgtgtggcgcaagaattttctccgtgtcgggcacctggtcctgataggcggccccgatgatggcgtcattaccccctggcagtcctccttcttcggtttctacgatgctaacgaaacagtgctcgaaatggaagaacagctagtgtatttgagagattcatttggactcaaaacactcctggctcgaggcgcaatcgtcaggtgccccatggccggcatatcacatacagcctggcactcaaatcgaaccctctacgaaacttgtatcgagccatggctgagctag

SEQ ID NO: 127744 - DNA, 909 bp, Artificial Sequence
  Description of Artificial Sequence: Synthetic coding sequence
atgctgggcttgtgtggccagcgacttcctgctgcttgggttttgttgctactgccctttcttcctttactgctcctcgcagctcccgctccccatagggcctcctacaagcctgtgattgttgttcacgggctgtttgactcttcctacagctttcggcaccttttggagtatattaacgagactcatccaggcaccgttgtgaccgtactcgacctgtttgatggtagagagagcctgcgaccactctgggagcaagtgcaagggttccgggaggccgtggtaccaatcatggctaaggccccccagggcgtgcacttgatttgctactcgcagggggggctggtctgtagagcactgctcagtgtgatggatgatcataacgtggattcatttataagcctgagtagcccccagatgggtcaatacggcgacaccgactacctgaagtggctcttcccgactagcatgcgaagcaacctctatcggatatgttacagcccttggggtcaggaattctctatttgcaactattggcatgacccccaccacgatgatctgtatctgaatgcctctagcttcttggctctgatcaatggtgagcgagaccaccctaatgcgaccgtttggcgaaagaattttctccgtgtcggacacctagtgcttatcggaggaccggacgacggagtgataacaccttggcaatcatcctttttcgggttctacgatgccaatgagactgtgttggagatggaagagcaactggtgtacctgcgggattcattcggactcaaaactctgttggcacggggggcaatcgttcggtgtcccatggcaggaatcagccacacggcatggcactcaaatcgtactctgtatgagacatgtatagaaccttggctcagttag

SEQ ID NO: 127745 - DNA, 909 bp, Artificial Sequence
  Description of Artificial Sequence: Synthetic coding sequence
atgcttgggctttgcggccagcggcttcctgcagcttgggtactgctgcttctcccgtttctgcccctgctcctactggccgcccccgcccctcatagagcctcctataagccagtgattgtggttcatgggctgtttgacagctcttactctttccgccacctcttagagtatatcaacgagacacatccagggacagtggttacggtccttgatctgttcgacggaagggagtcactgcggcctttatgggaacaggtccaaggcttccgggaagccgttgttcctattatggctaaagcaccgcagggagtgcacctgatctgttatagtcagggcggcctggtgtgtcgggccttactcagcgtcatggacgatcataatgtggactccttcattagcctcagctcacctcagatgggccagtatggcgatactgactacctcaaatggttgtttccaactagtatgaggagcaatctgtatcgaatttgttactccccctggggccaggagttcagcatctgtaattattggcacgacccccatcacgatgatctgtatttaaacgcctccagctttctggcacttattaatggagaaagggaccacccgaacgccaccgtctggaggaagaacttcctgcgcgtcgggcaccttgttctcattggaggtcccgacgacggtgtcatcacaccatggcagagctcattcttcggtttttatgacgccaatgaaacagtgcttgagatggaggaacaactggtctacctgagggacagctttgggttgaagacgctcctggcccgaggagccattgtccgctgtcccatggctggcattagccatacagcctggcacagcaataggacactgtatgaaacttgtattgagccatggctctcttag

SEQ ID NO: 127746 - DNA, 927 bp, Artificial Sequence
  Description of Artificial Sequence: Synthetic coding sequence
atgaaatcatgtggctcaatgctcggcttgtggggccagaggctccccgctgcttgggttttgcttttgctcccattcctcccactgctcttgcttgccgcccctgctcctcacagggagtcctataagcccgtgattgttgtgcatgggttgttcgactcttcatactcttttaggcatctgctcgagtatattaatgaaacgcaccctggcacggtcgtgacagtgctggatctatttgatgggagagagtccctgaggcccctgtgggaacaggttcaggggtttagagaggctgtggtgccgatcatggccaaggccccccagggagtccacctcatttgctacagccagggggggctcgtttgccgggccctgctttccgtcatggatgatcacaacgtggacagctttattagcctcagctcccctcagatgggacagtacggcgatacagattatctcaagtggttgttcccaacttccatgaggagtaatttgtacagaatctgttacagtccatggggccaagagttctctatctgcaattactggcacgacccccatcatgatgatttgtatctcaacgcctcctctttcctggcgctgattaacggggagagggaccaccccaacgccacagtttggcgaaagaactttctgagggtgggccacctggttctcattggcggcccggacgacggggttattaccccttggcaatcgagcttttttggtttctacgacgccaatgagacagtcctggagatggaggagcagctggtttacctaagggacagctttgggctcaaaaccctgctggcaagaggagccatcgtccgctgtcccatggcaggaattagccataccgcatggcactctaacagaacattgtatgaaacttgcatcgagccctggctatcctag

SEQ ID NO: 127747 - DNA, 927 bp, Artificial Sequence
  Description of Artificial Sequence: Synthetic coding sequence
atgaagtcctgtgggtccatgttgggactgtggggacagaggctgccggctgcctgggtgcttcttctgctcccatttcttccactactactgctagcggccccagccccacatagagcatcttacaagcctgtcattgtcgtccacggcttatttgacagctcctactctttcaggcaccttttggaatatattaacgaaacccaccccggaacagtggtcacagtgctcgacctgttcgatggacgcgagagtttacgcccactgtgggaacaggtgcagggcttcagagaggccgttgtgccgatcatggccaaggccccgcaaggcgtccatctaatatgctatagtcagggcggcttggtttgccgagccctgctgagcgttatggacgaccacaacgtggattcttttatttccttgtcaagcccgcaaatgggccagtacggagacacagactacttaaagtggctgttcccgacgtcaatgagaagcaacctgtatcgcatctgttactcaccgtggggccaggaatttagtatctgcaattactggcacgatccacaccatgatgacttgtacctaaatgcttcgagcttccttgctctcatcaacggtgagcgcgaccaccccaatgcgaccgtctggagaaaaaactttctgagagtggggcatcttgtgttgattggaggcccggatgacggagtcatcaccccttggcagagttctttttttggattctatgacgctaatgagaccgtgctagagatggaggagcaactggtgtatctgcgcgacagctttggactgaaaacacttctggcccgcggggcgatcgtgcgatgtccaatggccggtatctcacacaccgcctggcactccaataggactctgtacgaaacatgtattgaaccttggctcagctag

SEQ ID NO: 127748 - DNA, 909 bp, Artificial Sequence
  Description of Artificial Sequence: Synthetic coding sequence
atgttaggcctctgcggccagcgacttccggctgcttgggtcctcttgcttcttccttttctgccattactgcttctggccgctccagcaccccaccgtgcctcttataagcccgttattgtggttcacgggttgtttgatagtagttacagctttaggcacctcttggaatatatcaatgaaacacaccctgggaccgtcgtgacagtgttggatctattcgatgggagggaaagcctccgacccttgtgggagcaggtgcaagggtttcgcgaggccgtggttccaattatggctaaagctcctcaaggagtacacctgatctgctatagccagggagggctcgtctgccgagccttactgtcagtgatggacgaccataatgttgactcctttatcagcttgagcagccctcagatggggcagtatggcgatacagattacttgaaatggctgtttcctacctcgatgaggtccaacctctaccggatctgttattctccctggggccaggagttctccatctgtaattactggcatgatccccaccatgacgatctgtacctgaacgcgagtagtttcctagccctgataaacggcgagcgggatcaccccaatgcaactgtctggcgaaagaacttcctgcgagtgggccacctcgtgctgattggagggccagacgatggagtgatcaccccatggcaaagctctttttttggcttctacgatgccaatgagacggtgctcgaaatggaggagcagctcgtatacttgcgggacagtttcggccttaagacactgctggccagaggggccatcgtcaggtgccccatggccggtattagccacaccgcctggcactcaaaccgcactctgtacgaaacttgcatcgagccgtggctttcctag

SEQ ID NO: 127749 - DNA, 909 bp, Artificial Sequence
  Description of Artificial Sequence: Synthetic coding sequence
atgttaggcctctggggacagcgccttccagcagcgtgggtcctgctcctactcccttttctgcctctcctcctgctggccgcacccgcccctcatcgggaaagctacaagccggttattgtggtccacggtctttttgattctagctactcctttagacacctacttgagtacataaatgagacacaccccggcacagtagtgaccgttcttgacctctttgatggccgtgagtctctcaggcctctctgggaacaggttcaggggtttcgggaggccgtagtaccaataatggccaaggctccgcagggtgtccatcttatctgctatagtcagggtggactggtctgtcgcgccctcctctccgtcatggacgatcataacgtggattccttcattagtctatcctctcctcagatgggacagtatggggacacagattatctgaagtggctgtttccaacgtctatgagatccaacttatatagaatatgctactcaccgtggggacaagagttcagcatttgtaactattggcatgacccccatcatgacgacctctacctcaatgcttccagtttcctggccttaattaacggggagcgtgaccacccgaatgccacggtatggagaaagaattttttgcgagtggggcacctcgtgctgattggcggacccgacgacggggtgatcaccccgtggcagtccagtttctttggcttctacgatgcaaacgagacagtgttagaaatggaggagcagctggtgtacttacgcgacagttttggcctgaagaccctactcgctcgcggcgccatcgtccggtgccctatggcagggatctctcacaccgcatggcacagcaacaggactctctacgaaacatgtattgagccttggttgagctag

SEQ ID NO: 127750 - DNA, 909 bp, Artificial Sequence
  Description of Artificial Sequence: Synthetic coding sequence
atgctggggttgtggggacagagactgcccgccgcctgggtgctcctgctgctgccattcttgcctttgctcctcctggctgcccccgctccccaccgggagtcgtacaagcccgttatagtcgtccacggcttgttcgattcatcctatagcttcagacacctgctggagtacatcaatgaaacccatccaggcacagtggtaaccgtactcgacctatttgatggtcgcgaatcactgcgcccgctctgggaacaggtgcaggggttccgagaagccgtggtgccgattatggcaaaggccccgcagggcgtgcatcttatctgctatagtcagggaggattagtttgtcgagcccttctgtccgtgatggacgaccataatgtggactcctttatctccttgtcctcaccacagatgggtcaatacggcgatacagattacctgaagtggctatttcctacatctatgaggtccaacctataccggatttgttacagtccttggggccaggaatttagcatttgtaactattggcatgatccccatcacgacgacctgtacttaaatgcctcatcatttctggccctaatcaatggagagagagatcaccctaacgccaccgtttggagaaagaactttctccgggtgggccacttggtgcttatcggcggacccgacgatggggttattacaccctggcaaagtagcttctttggcttttatgatgcaaacgaaaccgtgttggaaatggaggaacaacttgtatacctgagggattcttttggcctgaaaaccctcctcgctaggggcgccatagtcaggtgccccatggctggaatctctcacaccgcctggcactctaatcgaaccctgtatgagacttgtatcgaaccatggctctcatag

SEQ ID NO: 127751 - DNA, 909 bp, Artificial Sequence
  Description of Artificial Sequence: Synthetic coding sequence
atgctggggctgtgggggcaaagacttcccgccgcctgggtattgttgctgttaccattcctcccactcctgttactggcggccccagctccccatagagaatcctacaaacccgttatcgtggtccacggcttattcgatagcagttattcattcagacatttgctcgaatatatcaatgaaacgcaccctgggaccgtagttaccgtgcttgacctgtttgacggccgcgaaagtctgcggccgttatgggaacaggtgcagggttttagagaagctgtggtccccattatggctaaagccccacagggcgtgcacctcatttgttattcgcagggcggccttgtgtgtcgcgccctgctcagcgttatggatgaccacaatgtggatagctttattagcctgtcatccccgcagatgggtcagtacggggatacagactatttgaagtggctatttcctactagcatgagatccaacttgtatcgtatttgttattccccatggggacaggaattttcgatttgtaactattggcacgacccccaccatgacgacctttatcttaacgccagctccttcctcgccttgatcaatggcgagagggaccaccctaacgctacagtgtggagaaagaactttctcagggtaggacatttggtgctgatcggtggtccagatgacggggtgatcaccccttggcaatcatcattcttcggattctacgatgctaatgagacagttctggagatggaggagcagctggtgtacctgcgagatagctttgggctgaaaaccctacttgctagaggtgcaattgttcggtgtccaatggccgggatctcccacacagcttggcactctaaccgcaccctctatgagacctgtattgaaccctggcttagttag

SEQ ID NO: 127752 - DNA, 909 bp, Artificial Sequence
  Description of Artificial Sequence: Synthetic coding sequence
atgctcggactatggggacaaaggctccctgccgcatgggtccttttactcctaccgttccttccactactcctgttggcagcccctgcccctcaccgggcctcatataaacctgtaatcgtagtacatggattgtttgacagctcctacagtttccggcatctgctggagtacatcaacgagacacacccagggacagtggtgacagtcctggatctgttcgatgggagagaaagtctgaggcctctgtgggaacaagtacaggggttccgcgaggctgtcgtacccatcatggcgaaagctccccagggtgtgcaccttatctgctattctcagggaggactagtgtgcagggccctgctgtctgtgatggacgatcacaatgtagattccttcatttctttgagtagcccgcagatgggccagtatggagataccgactacttaaaatggctgtttcccacttcgatgcgcagtaatctctatcgtatctgttactcaccctggggtcaggagttcagtatctgcaattactggcatgacccccaccacgatgatttgtatcttaacgcgagtagcttcctcgctctcattaatggagaaagggaccaccccaatgctaccgtttggcggaaaaatttcctccgagtggggcatctggtcttgatcggaggccccgatgacggtgtgattaccccctggcagtcaagtttcttcggattctacgatgcaaatgagacggttcttgagatggaggagcagctcgtgtatctcagggattcctttggtctgaagaccctgctggcgcggggagcaatcgtaagatgccctatggctggcataagccacactgcctggcacagcaacagaacactttacgagacttgcatagaaccctggctatcttag

SEQ ID NO: 127753 - DNA, 909 bp, Artificial Sequence
  Description of Artificial Sequence: Synthetic coding sequence
atgctcggtctgtggggacagcgcctccccgctgcatgggtgctgttacttctccctttcctgcctctgctgctgttggctgctccggccccacatcgcgcctcttacaaaccagtcattgtggttcacggcctgtttgactcctcatactccttccgccacttactggagtatatcaatgaaacccatcccggtacagtggtgactgtgcttgacctctttgacggcagggagtcactgcggcccctctgggagcaggtccaaggattccgggaggctgtggtgcccattatggcaaaagctcctcagggggttcatctgatatgttattcccagggaggtctggtctgtcgcgctttgctaagtgtcatggacgaccacaatgtggatagcttcatcagtctaagtagcccacagatggggcaatatggagacactgattacctcaagtggctgttcccgacctccatgcggtcgaatctgtatagaatctgctactctccatggggccaagagttttcaatctgtaactactggcatgatccccaccatgacgacctctatcttaacgcaagctcattcctggctttaatcaatggcgagcgagatcatccaaacgccacagtgtggcggaaaaactttttacgcgtaggccatctagttctgataggcggcccagatgatggcgttattacaccatggcagtcaagcttctttggcttttacgacgcaaacgagacggtcctagagatggaggagcagctggtgtacctccgcgacagctttggcctaaaaacattgttggccagaggcgcaatagtgagatgtcctatggccggaatcagccacacggcctggcatagcaatcgaacactgtatgaaacctgcatcgagccatggctgagttag

SEQ ID NO: 127754 - DNA, 909 bp, Artificial Sequence
  Description of Artificial Sequence: Synthetic coding sequence
atgctcggcctctggggacagcgccttcctgcagcatgggtgctgctgctgctgccctttctccctttgctgctactggccgcccctgctccacatcgcgcgagttacaagcccgtgatcgtcgtgcatggcctctttgactcctcgtactcgttccggcatctattagagtacatcaacgaaactcacccaggtaccgtcgtaactgtgctagacctctttgacgggagagaaagcctccgcccactttgggagcaggtgcaggggttcagggaagctgtcgttcctatcatggctaaagctcctcagggtgttcacctcatctgttactcgcagggggggctcgtgtgtcgcgccttgctgtccgtaatggacgatcacaatgtggatagctttatctccctctcatctccacagatgggccagtatggcgacaccgattacttgaaatggttgtttcccacttccatgcgctcaaacctttacaggatctgctacagcccatgggggcaggaattttcgatctgtaactattggcacgacccccatcacgacgatttatatctgaatgcttcatctttccttgcgctgattaacggggaacgggaccaccccaacgctaccgtgtggcgaaagaactttctgagagtgggtcatctggtgctaatcgggggccccgatgatggcgtgatcaccccctggcagagttcgtttttcggattttacgatgctaacgagactgtgctcgagatggaagagcagctcgtgtaccttcgggattcttttgggctgaagactctgctagctcggggggccattgtaaggtgtcctatggccggtatctcccacacagcttggcacagtaataggaccctgtacgagacctgcatcgagccctggcttagctag

SEQ ID NO: 127755 - DNA, 927 bp, Artificial Sequence
  Description of Artificial Sequence: Synthetic coding sequence
atgaagagctgcggctcaatgctcggcctgtggggccaaaggctcccagccgcttgggtgctattgttactgccattcttgcctttactgcttctagcagcacctgctccccaccgggcaagttataaacccgtgatcgttgtgcacggactctttgattcttcttactccttccgccaccttctggaatacattaacgagacacatccaggcactgtggtgactgttctcgacctgttcgatggccgggagtctcttcgcccgttatgggagcaggtgcagggttttagggaagccgtggtccctattatggctaaagccccccagggggtgcaccttatctgctattcccagggcggccttgtatgccgagctctcctgtcagttatggacgaccataacgtggatagctttatatcactgtcgtcccctcagatgggacagtacggagacacagattacctgaaatggttgttcccgacttctatgcggagcaacctctaccgcatctgttattcaccatggggccaggagttttccatctgcaactattggcacgaccctcatcacgacgatttatatttaaatgcctcttcctttttagcactgattaacggtgagagagatcaccctaacgctaccgtatggcgaaagaacttcctcagagtgggccatctcgtgctgattggtggacccgacgatggcgttatcacaccctggcagtctagctttttcggcttctacgacgccaacgaaactgtgctggagatggaagagcagctcgtctatttaagagactcattcgggctgaagacacttctcgcgagaggcgcaattgtgcgatgcccaatggcgggcattagccacaccgcctggcacagcaacagaacactgtacgagacttgcatagagccctggctgtcgtag

SEQ ID NO: 127756 - DNA, 282 bp, Artificial Sequence
  Description of Artificial Sequence: Synthetic coding sequence
atgctcgggctgtggggccagaggctgccagctgcatgggtgttgcttttgctcccctttcttccattgctcctgctggccgcgcctgcccctcatcgggccagttacaagcctgtgatcgtcgttcatggtctttttgactcatcttacagtttccgtcatctccttgagtatatcaatgagggggccctgtgtgctggcttgtgcttcctttcttggatgatcacaacttggattttgagcagtccgagtcctctacacagatgggactccatggaatag

SEQ ID NO: 127757 - DNA, 543 bp, Artificial Sequence
  Description of Artificial Sequence: Synthetic coding sequence
atgctcgggctatgtggacagcggctgcctgcagcctgggtgcttctgctcctgccatttcttcctctcctgctgctggcagctcctgctccacatcgtgccagttacaaacctgttatcgtagtccacggtctgttcgattccagttacagcttccgccatttgttggaatacatcaatgaaacgcatccggggactgtggtcactgtgttagatctcttcgacgggagggagtccctgagacccctctgggaacaggtgcaaggatttcgagaggccgtggtccccattatggcgaaggccccacagggcgttcatctcatctgttatagccagggtggcctggtgtgcagggctttactatccgttatggacgaccataacgttgactctttcatttccttgtccagtccacaaatgggccagtacggggatacagattatctcaagtggctcttccctacatccatgcgttctaatctgtatcggatctgttactccccttggggacaggaatttagtatttgtaactattggcactag

SEQ ID NO: 127758 - DNA, 927 bp, Artificial Sequence
  Description of Artificial Sequence: Synthetic coding sequence
atgaagagctgtggcagcatgctcggtctgtgggggcagaggctgccggccgcttgggtgcttctcctcctgccctttctccctctgctattgctagccgccccggctccccatcgcgccagttacaagcctgtgatagtcgtacacggtctctttgatagctcgtattctttccgccatcttctagaatacatcaatgagacacaccccgggacagtggtgaccgtgctcgatcttttcgatgggcgcgaaagcttgcgaccactctgggagcaggtgcagggatttagagaagcagtagtgcctataatggccaaagccccgcagggagtgcacctgatctgctatagccagggtggcctagtctgccgggccctgctttctgtgatggatgaccacaatgttgacagctttatttcactgtcttcaccccagatgggacaatatggggacaccgactacttgaagtggctgtttcctacctctatgagatccaacctgtatagaatttgctatagtccctggggtcaggagttcagcatttgcaattattggcacgacccacaccatgatgacctgtacttaaacgcttcttccttcttggccctcattaacggcgaaagagaccatcccaatgcaactgtatggcggaagaatttcttgcgtgtgggccacctagtattaatcggagggccggacgacggcgttatcacaccttggcagtcctcttttttcggcttctacgacgcaaatgagactgtgttggagatggaagaacagttagtctacttgcgggactcgtttgggttgaaaacactcctggcccgtggggctatagtgaggtgtccaatggccggtatctctcacacagcttggcattctaatcgcacactgtacgaaacttgcatagagccctggcttagctag

SEQ ID NO: 127759 - DNA, 603 bp, Artificial Sequence
  Description of Artificial Sequence: Synthetic coding sequence
atgctcggcctctggggacagagactccctgcagcctgggtgctcctgctgctgccattcctgccgctcctgctgctagcagcccccgcaccacatcgtgagtcatacaagcctgtgatcgtagtgcacggcctgtttgattcaagttattcttttaggcatctgctggaatatatcaatgagactcacccaggtaccgtcgtgaccgtactcgacctgttcgacggcagggaaagtcttcgacccttgtgggagcaggtccaggggttcagagaggctgttgttcccattatggccaaggctccacagggagtgcacctgatatgttactctcagggtggccttgtgtgtcgagctctcctatctgtcatggacgatcataatgtggattctttcattagcctttctagcccacagatggggcaatacggagatacggactatctcaaatggctcttccccacatctatgcgaagcaacttataccgcatctgctactcaccatggggccaagaattctccatatgcaattactggcatgacccgcaccacgatgatctgtatttgaatgcctcttccttcctggctctaatcaacggatag

SEQ ID NO: 127760 - DNA, 477 bp, Artificial Sequence
  Description of Artificial Sequence: Synthetic coding sequence
atgcttgggctttggggacagcggctgcctgctgcatgggtgcttttactgctgccctttctccccctactgcttttagccgccccagcgccccaccgcgagtcctacaagcccgtcattgtcgtgcatgggctgttcgactcttcatatagcttccgccatttgttagaatatatcaatgaaatgggccagtatggggacaccgattaccttaagtggctgttccctacctccatgaggagtaatttataccgtatttgttatagcccatggggtcaggagtttagcatttgtaattactggcatgatcctcatcacgacgacctgtatttaaatgctagctcattcctcgccctcatcaatggagagcgtgaccatcccaacgcaacagtctggaggaaaaattttttgcgggttggccatctcgtcctgataggtggcccagatgatggagtgatcactccatggcagagttag

SEQ ID NO: 127761 - DNA, 543 bp, Artificial Sequence
  Description of Artificial Sequence: Synthetic coding sequence
atgcttgggctctgggggcaacggctgcctgccgcctgggtcctcctgctgctgccgtttttgcctctcctcctgctggccgcccccgccccacacagggcctcttacaagcctgtgatcgtggtacacggtttgttcgattctagctacagcttccggcacctgctggaatacattaatgaaacgcacccagggacagtggttaccgtactggatctgttcgatggccgggaatctctgcgacctctgtgggagcaggtccaggggttcagggaggccgttgtacccatcatggctaaggctccacagggcgtccacctcatttgttactcccagggcggcttagtatgcagagccttgttaagcgtaatggacgatcacaacgtcgattccttcatctcactgagctcaccccagatgggtcagtacggagacacagattacttgaaatggctctttcccacgagcatgaggagcaacctgtatcgaatttgctatagcccctgggggcaggagtttagcatctgcaactattggcactag

SEQ ID NO: 127762 - DNA, 477 bp, Artificial Sequence
  Description of Artificial Sequence: Synthetic coding sequence
atgctcggcctttggggccagaggctccctgccgcgtgggtgctgctgctcttgcctttcctgcctctgctcttacttgcagcacccgcaccccatagagcttcttataagcccgtgatcgtggtgcacggcttgttcgatagttcttacagcttccgccacctcttggagtacattaatgaaatggggcagtatggcgataccgactatctcaaatggctttttccaacttccatgcgctccaatctatataggatatgctatagcccgtggggccaggagttcagcatttgcaactattggcacgacccccatcacgacgatctctatcttaacgcaagctcatttttggccttaattaatggagagagagatcatcctaacgctacagtgtggcggaagaactttctgcgggttggtcatctggtgcttatcggcgggcccgacgacggcgtgattaccccatggcagtcatag

SEQ ID NO: 127763 - DNA, 543 bp, Artificial Sequence
  Description of Artificial Sequence: Synthetic coding sequence
atgttagggctctggggccagcgtctacccgcagcgtgggttttgttgctcctacccttcttacctctcctgctcttggcagccccagctcctcacagggctagctataaaccagtgatcgtcgtacacggcttgtttgatagttcctacagctttcggcatttactcgaatacatcaacgaaactcaccccggcacagtcgtgaccgtcctggacctgttcgacggccgggaatccttgaggccgctctgggagcaagtgcagggcttccgggaggccgtcgttcccattatggcgaaggccccccagggcgtgcatctaatctgttacagtcaggggggattagtctgtagggcactgctctctgtgatggacgaccacaacgtagacagctttatctccctgtcttctccccaaatgggccagtacggggatacggactatctaaagtggctgttcccaacgtccatgagatctaatttgtaccgtatctgttattccccatggggccaggaattttctatctgcaactattggcattag

SEQ ID NO: 127764 - DNA, 909 bp, Artificial Sequence
  Description of Artificial Sequence: Synthetic coding sequence
atgctgggcctgtggggccaacgccttccagctgcatgggttctcctactgctcccattcctcccactgcttctcctggccgcacccgccccgcacagagcctcctacaagcctgtcatcgtagtgcacgggctgttcgatagtagctatagtttcaggcatctcctggaatacataaatgaaacccaccctggcacagttgtgactgtccttgacctcttcgatgggcgcgagagccttcgcccgctttgggaacaggttcagggattcagagaggctgtggtgccgattatggcgaaggcacctcagggtgtccaccttatttgttatagtcagggaggcctcgtgtgtcgagccctgcttagcgtgatggacgatcacaatgtagattcattcatctccttgagttccccacaaatgggacagtatggcgatacggactacctgaagtggctgttcccaacgagcatgcggagtaacttgtataggatctgttacagcccctgggggcaggagttctccatttgcaactactggcatgacccccatcatgacgatttgtacctcaacgcctcaagcttccttgcgttgattaatggggagagggaccatccaaatgcgacagtatggcgaaagaattttctgagagtggggcacctggtcctgattggaggacctgatgacggtgtgatcactccctggcagtccagcttttttggcttctacgacgcgaatgagacagttcttgaaatggaagagcagctagtgtaccttagagacagcttcggcctcaagacacttctcgcacggggcgcaattgttcggtgccccatggctggcatctctcacacagcatggcattctaataggaccttgtatgagacatgcattgaaccatggctcagctag

SEQ ID NO: 127765 - DNA, 909 bp, Artificial Sequence
  Description of Artificial Sequence: Synthetic coding sequence
atgctgggtctatgggggcagcgattgcccgcagcctgggtccttctgctgctgcctttccttcccctgttgttgctggctgcacctgccccacatcgagcttcctacaagccggtgatcgtagtgcacggtttgttcgattcctcatacagcttccgacatctgctagagtacataaatgagacccatccaggcacggttgtcacagtccttgatctattcgacggtagagaaagcctccgacctctgtgggagcaggtgcagggcttcagagaggctgtcgtgcccattatggcgaaggcaccacagggtgtccacctcatatgctactctcaaggaggcttggtgtgcagagccctgctttccgtgatggacgatcacaatgtggacagtttcatctccctgagcagcccccagatggggcaatatggcgacacagactacctgaagtggttattccccacatctatgagatcaaacctgtacagaatctgttactcaccctggggtcaggaattttcaatctgtaattattggcatgacccacaccacgatgatttgtatcttaacgcctccagcttccttgcactaatcaatggcgaacgcgatcacccaaatgcgactgtgtggcgcaagaacttcctccgcgtagggcacttagttctgattggcggtcctgacgacggagtgatcacaccatggcaaagttcatttttcggattctatgatgccaatgaaaccgtgttggaaatggaagaacaacttgtctaccttcgagatagttttggactaaagaccctcctcgcacgaggtgcaatcgtgcggtgtcccatggccgggatcagccacaccgcttggcattccaatcgaaccctgtacgagacatgcattgagccatggctgagttag

SEQ ID NO: 127766 - DNA, 927 bp, Artificial Sequence
  Description of Artificial Sequence: Synthetic coding sequence
atgaaatcatgtgggagtatgctcgggctgtggggccaacgcctcccagcggcgtgggtcttgctgcttctccccttcttgcctcttctgctcctggccgcaccagcccctcacagagcgagttacaagccagtcatagtggttcacgggctctttgactcctcatacagctttcggcatctgttggagtacattaacgagacccaccccggtaccgtcgtcacagttctcgatctgttcgatggtcgagaatcacttcgccctctatgggagcaggtccagggctttcgggaagccgtcgttcccataatggctaaggccccacagggcgtgcacttgatttgttatagtcaaggtggcttagtgtgcagggcgctactttccgtgatggatgaccacaatgtggacagctttatcagtctcagttccccgcaaatgggccagtacggagatacagactacctgaagtggttgtttcccaccagtatgcgctctaacctgtaccgaatctgttattctccttgggggcaggagttttccatttgcaattattggcatgatccccatcacgatgatctctacctgaacgcctccagttttctggctttgattaatggtgagagagatcacccaaatgcgactgtgtggaggaaaaattttctacgagttggccacctagtgctcatcggtggccccgacgatggtgtgattaccccatggcaaagctcgttttttggcttctatgatgcaaatgagaccgtgctggagatggaagaacagctggtgtacctcagggattcctttggactgaagactcttctggcccgcggtgctattgtgcgatgtccaatggccggtatttctcacacagcctggcatagcaacaggacactctacgaaacttgcatagagccctggttatcctag

SEQ ID NO: 127767 - DNA, 282 bp, Artificial Sequence
  Description of Artificial Sequence: Synthetic coding sequence
atgctgggtctgtggggccagcgtcttcctgctgcatgggtgcttttgcttctcccattcctgccccttctattgctggcagcgcctgcccctcatagagccagctataaacctgtcattgtggtgcacggcctcttcgattccagctactccttccggcatcttttagaatatattaacgaaggggccttgtgtgccggcctgtgcttcctgagctggatgatcacgacttggatcctctcctcacccagcccactccacaggtgggactctatggagtag

SEQ ID NO: 127768 - DNA, 909 bp, Artificial Sequence
  Description of Artificial Sequence: Synthetic coding sequence
atgctgggcctctgggggcaaaggctccctgccgcctgggtcctccttttattgccttttttgccactgttgctgctcgccgcacctgcaccccaccgggcttcatacaaaccagtgattgttgtgcacgggctctttgatagctcctactcatttcgccatcttctggagtatattaatgagacccaccctggcactgtcgtaaccgttttagacttgtttgacgggcgtgagtcactccgacctctctgggagcaggtgcaagggttccgagaagctgtcgtacctatcatggcgaaggctccccaaggggtacacttaatatgctactctcagggcggtctggtttgccgcgctcttctctctgttatggatgaccacaatgtggactctttcatttccttgtcgtcccctcaaatgggccagtacggggacaccgactacctaaagtggttgtttccaacctcgatgaggtcaaatctgtacagaatctgttattctccatggggacaggagtttagtatttgcaactattggcacgatccccaccacgatgatctctatctgaatgcgtcaagtttcttggctctgatcaatggcgagcgagaccatccgaatgcaaccgtgtggcgtaaaaacttcctcagggtcggtcatctggtccttatcggcggtccagatgacggtgttatcacaccttggcagtcttctttttttgggttttacgatgccaacgaaaccgtgctcgagatggaagagcagctggtctacttacgggactctttcggattaaaaacactactggctcggggcgcaatcgtcagatgccctatggccgggattagtcacacagcctggcacagcaatagaaccctgtatgaaacttgcattgagccatggctgtcctag

SEQ ID NO: 127769 - DNA, 477 bp, Artificial Sequence
  Description of Artificial Sequence: Synthetic coding sequence
atgctcgggttgtgcggacagcgtctgcctgctgcttgggtgctcctactcctaccatttctccctctgctgctgctagccgccccagcccctcatagggcgtcttacaaacccgtgatcgtggtgcacggtctatttgacagctcttatagctttcgtcatctgctcgagtacataaatgagatggggcagtatggcgacacagattacctcaagtggttatttcccacttctatgcggagcaacctttacagaatttgttactcaccttgggggcaggaattttcgatctgtaactactggcacgaccctcaccacgacgacttgtacctcaatgccagcagctttctcgcattgatcaacggagaaagagaccatcctaacgccaccgtgtggcgcaagaatttcctgcgggtaggccatcttgtattaatcggagggcctgatgatggtgtgatcaccccctggcagtcctag

SEQ ID NO: 127770 - DNA, 711 bp, Artificial Sequence
  Description of Artificial Sequence: Synthetic coding sequence
atgcttggtctttggggccagagactcccagctgcctgggttctcctgctgcttccattcctacccctgctgctactagcggcaccagcccctcacagggaaagttacaaaccagtgattgtcgtgcatgggctcttcgactcctcttacagcttccgtcaccttttagagtatattaacgaaacacatcccgggactgtcgttactgtactggacttgtttgacggacgtgaatctttgcgccctttatgggagcaggttcagggattccgcgaggccgtagtgccaataatggctaaagctccacaaggggttcacctcatttgttactcacaaggaggacttgtgtgcagggctttactcagtgtgatggatgaccataacgtcgactcattcatatccctgagttcaccccaaatggggcagtacggcgataccgattatctgaagtggctcttcccaacgagtatgcgctcaaatctctaccggatctgttacagcccctggggacaggaattcagcatctgcaactactggcacgaccctcaccatgatgacttatatctgaacgccagctcattcctcgctctgattaacggtgagcgcgaccaccctaatgccaccgtttggcgtaagaactttctgcgagtgggccacctcgtacttattggcggcccagatgacggagtcataacaccttggcagtcatag

SEQ ID NO: 127771 - DNA, 543 bp, Artificial Sequence
  Description of Artificial Sequence: Synthetic coding sequence
atgctgggtctctgggggcagcgtctgcccgccgcgtgggtcctgctgctgctcccattcttacccctgctgctgctggcggctcccgcaccacacagagcaagctacaaaccggttatagtagtacacggtctgtttgatagctcctattcattccgtcatctactggagtatatcaatgagacacatccagggacagttgttacggtattagatctgtttgacgggagagagagtttgcgcccgctttgggaacaagttcagggattcagggaggccgtggtgcccattatggccaaggctccacagggggtccacctgatttgctattcccaaggaggtctcgtgtgcagagccctcctgtctgtgatggacgaccacaacgtagattccttcatctctcttagctcaccccaaatgggccagtatggcgacacagactacctgaagtggctatttcctacaagcatgcggagcaatctgtacaggatctgttactcaccatgggggcaagaattctcgatttgcaactactggcattag

SEQ ID NO: 127772 - DNA, 711 bp, Artificial Sequence
  Description of Artificial Sequence: Synthetic coding sequence
atgctcggcttgtggggacagagactacccgcagcctgggtactgttactgcttccattcctgccccttcttcttttagctgcacccgcacctcaccgcgagtcctacaagccagtcattgtcgtgcatgggctgtttgatagctcttattcttttcggcacctgctggaatacatcaatgagacccatcctggcactgtcgtcactgtcctcgacctattcgatggcagggaatcgctcaggccattgtgggaacaggtccaaggttttagagaggctgttgtgccgatcatggccaaagccccacagggcgttcacctgatttgctactctcagggcgggctggtgtgtagagccctgctgagcgtgatggatgatcacaatgtggacagtttcatctcactcagttcaccacaaatgggccagtacggagataccgattacctgaagtggctgttcccaacatccatgcggtcaaacctatatcggatctgttatagcccatgggggcaggagttctctatctgcaactactggcacgatcctcaccacgatgacctttacctgaatgcttcctccttcctggccctaatcaatggcgagagagatcaccccaacgccacagtgtggcggaagaactttctacgggttggacacttagtactcatagggggacccgatgatggtgtcattactccctggcagagttag

SEQ ID NO: 127773 - DNA, 603 bp, Artificial Sequence
  Description of Artificial Sequence: Synthetic coding sequence
atgctcggattatggggccagaggctgcctgcagcctgggtcttgctgctactgcctttcctgcctctgctgctgctggctgcccctgccccacacagagctagctataaacccgttatcgtggtccatggcctgttcgatagctcctactcttttaggcaccttctggaatacataaacgagacacaccccggtacggtggtgacagtactcgacctatttgacgggcgcgaaagcctgagaccactctgggagcaggtgcaagggttccgcgaggccgttgtgccgattatggccaaagcacctcagggggtccacctgatctgttacagtcaaggcggtctggtctgccgggctctgctaagcgttatggatgatcataatgtcgatagctttatcagcttgtcctccccccagatgggtcagtatggtgatacggactacctaaagtggctgttcccaaccagtatgcgctctaacctatacaggatttgttatagtccgtggggacaggaatttagcatttgcaattattggcatgaccctcaccatgacgacctgtacctgaacgcttcttcctttctggctcttattaacgggtag

SEQ ID NO: 127774 - DNA, 909 bp, Artificial Sequence
  Description of Artificial Sequence: Synthetic coding sequence
atgttgggcctctggggccagcgccttcctgcagcttgggtgctgctgttgttaccctttttgccgttactgttgctcgcggcccctgcccctcaccgcgcttcttataagccagtcattgtggtacacggcttattcgattcaagctactccttccgtcatctgttggagtacattaacgagactcaccccgggacagtcgtgacagtcctggaccttttcgacgggagagaaagtttgaggcccctgtgggagcaggtgcagggattcagagaggccgtggtcccaattatggccaaggctcctcagggggtgcacctgatctgttactcccagggcgggttggtatgtcgggcccttttatctgtgatggatgaccacaacgtcgattcatttatttccctatcctcgccgcagatgggacagtatggagataccgattatctgaaatggcttttccccacctcaatgcgttctaacctgtatcggatctgttattccccctggggtcaggaatttagtatctgcaattactggcacgatcctcaccacgatgatctttatctaaacgcttcatcttttctggcactgattaacggagagcgagaccaccctaacgccactgtctggcgcaaaaatttcttgagagtgggacacttagtgctaatcggcggacctgacgacggcgtcatcacgccctggcaatcctcattctttggcttttatgacgcaaatgagaccgtgcttgagatggaggagcagctcgtgtacctgagagattcgttcggactgaagacactgttagcgcgcggcgcaatcgtgcggtgccctatggccggtatttcccacacagcatggcactccaaccgtaccctttacgagacttgcattgagccttggcttagttag

SEQ ID NO: 127775 - DNA, 603 bp, Artificial Sequence
  Description of Artificial Sequence: Synthetic coding sequence
atgcttggactctggggccagcggcttcctgccgcatgggtgttactcctactgccctttctcccactcctcttgctggctgctcccgcccctcaccgagcctcttacaagcctgtgattgttgtgcacggtctcttcgacagttcgtattccttccgccacttactagagtacatcaatgagactcaccctggcacagtggttacagttctcgacctgttcgacggaagggagagtctgcggcccctttgggagcaagttcaggggttccgtgaagccgtcgtacccatcatggccaaagccccccagggcgtgcacctgatttgctatagccaggggggactggtctgcagggcactgttgtccgtgatggatgaccacaacgtcgactccttcattagtttatcttcaccccagatgggacaatatggcgacaccgactacctcaaatggctctttcccactagcatgaggtctaacctctaccgcatttgttactctccttggggccaggaattttctatatgtaactactggcacgacccccaccatgacgatctgtatttaaatgcatcttcatttttggccttaatcaacgggtag

SEQ ID NO: 127776 - DNA, 729 bp, Artificial Sequence
  Description of Artificial Sequence: Synthetic coding sequence
atgaagagttgtggctctatgctcggcttatgggggcagcggctacccgccgcctgggtactcctcctgttgcctttcctgccccttctgctccttgctgcccctgcacctcatcgggaaagctacaagcccgtcattgtggtgcacggcctgttcgacagttcttattctttccggcacttactggagtacatcaacgaaacccaccccggcactgtggttactgtcttggacttattcgatggacgtgaaagtcttcggcctctgtgggagcaggttcagggcttcagggaggctgtggtccccattatggccaaggcccctcagggagtgcaccttatatgctattctcaaggcggcctagtatgtcgtgccttgctttcggtgatggatgatcacaacgtcgactcttttatctccctgagctcacctcagatgggtcagtacggtgacactgattatctcaagtggctgtttcccactagtatgcggtcaaacctgtaccgcatttgctactccccttggggacaggagttcagcatctgtaactactggcatgatccacatcacgacgacctgtatctcaacgccagctccttcctggccctgattaatggggaacgcgatcatcccaatgctactgtttggaggaagaacttcctgagagtggggcaccttgtgctgattggcgggcccgacgatggcgtaatcaccccatggcagtcttag

SEQ ID NO: 127777 - DNA, 711 bp, Artificial Sequence
  Description of Artificial Sequence: Synthetic coding sequence
atgttgggcctctgggggcagagacttcccgctgcatgggtcctactccttctgcctttcctgcctctgctgcttctagctgctccagcccctcaccgcgagtcttataagcctgtgattgtcgtgcatggcctatttgacagcagctattcctttagacatctcttggaatatatcaacgagacacaccccggcaccgttgtgacagtgcttgacctttttgatggccgtgagtccttgcgccctctctgggaacaggttcaaggctttagagaagccgttgtccctatcatggctaaggccccacagggcgtccacctgatctgttactcgcaggggggactggtgtgcagagccctactgtctgtgatggacgaccataacgttgacagttttatctccttgagtagtccccaaatgggacaatacggtgatactgactacctgaaatggctgtttcctacttccatgcgttccaacttataccggatctgttactcgccatggggacaagagttctccatttgcaactattggcacgacccccatcacgatgatctttaccttaatgcctcatcctttttggccctaattaacggagaacgcgaccatcccaatgccaccgtttggaggaaaaatttcttacgggtgggccacctcgtgctgattggcggccctgacgatggtgtaatcacgccgtggcagagttag

SEQ ID NO: 127778 - DNA, 543 bp, Artificial Sequence
  Description of Artificial Sequence: Synthetic coding sequence
atgttggggctttggggacagagactccccgccgcctgggtccttctccttctacccttcctgcctctgctcctgctggccgccccagcccctcatcgggcttcctataagccagtgatagtggttcatggactcttcgactctagctacagttttagacatttacttgagtatattaatgagacacaccccggcacagtggtcactgttctggatttattcgacggcagagagtccctcagacctttgtgggaacaggtccagggctttcgggaagcagtggtgccgattatggcgaaagcccctcagggggtgcacctgatctgctactcgcagggagggctcgtgtgccgcgcactgctgagcgtgatggacgatcataatgtcgattccttcataagcctgtcaagtccccagatgggccagtatggcgatactgattacctgaaatggcttttccccacatctatgcggagcaatctgtacaggatttgctattccccatggggtcaagagttttcgatttgcaactactggcactag

SEQ ID NO: 127779 - DNA, 477 bp, Artificial Sequence
  Description of Artificial Sequence: Synthetic coding sequence
atgctggggctgtggggccagaggttgccagccgcatgggttctactccttcttccctttctgcccctgttgctgctggccgccccggcccctcatcgcgctagctataaaccagttattgttgtacatgggctgtttgatagcagctattccttccggcatctgcttgagtatatcaatgagatgggacaatacggtgacacggactatcttaaatggctatttccgacatcaatgcgtagtaacctgtataggatctgttatagcccatggggccaggagttcagcatttgcaactactggcatgacccccatcatgacgacctctaccttaatgcttctagcttcctggcactcatcaacggcgaaagagaccaccccaatgcaacagtgtggcgcaagaattttttgcgagtgggacacctggtcttgattggcggtcccgacgatggggtaatcactccttggcagagttag

SEQ ID NO: 127780 - DNA, 603 bp, Artificial Sequence
  Description of Artificial Sequence: Synthetic coding sequence
atgctcggcctgtggggccaacggttgcccgctgcgtgggtactgctacttctgcctttcttaccactcctgctgctggctgcccctgcacctcaccgagagtcgtacaagcctgtgatcgtggtccacggtctcttcgattctagctacagcttccgccatctcctagaatacattaatgagacacaccccggaacagttgtcacggtgctggacttatttgatggcagggagtccttaaggcccctctgggaacaagtacaggggtttcgagaggccgtcgtgccaattatggctaaggctcctcagggcgtccatttgatctgctactctcagggaggtctggtatgtcgtgctcttctttctgttatggacgaccacaatgtcgactcgttcatatccctatcatctccccagatgggacagtatggcgacacagactatctgaaatggttgttcccaacatcaatgagatctaatttatatcgcatttgctattccccttggggacaggagtttagtatctgcaactactggcacgatccgcaccatgacgatctttacctgaatgctagtagcttccttgcattgatcaacggctag

SEQ ID NO: 127781 - DNA, 603 bp, Artificial Sequence
  Description of Artificial Sequence: Synthetic coding sequence
atgctgggactttgcggccagaggctgcctgcggcttgggtcttgctgctattgccgtttctcccattacttctgcttgcagcccctgctccacaccgtgcaagctacaaacccgtgattgtagtgcatggcctctttgatagttcatattcatttaggcacctcttggaatatataaatgagacgcacccaggaacagtggtgaccgtgctggaccttttcgacgggagagaaagtctgcggcctttgtgggagcaggtacaaggattcagagaagccgtggtcccgattatggctaaggccccacagggagtgcacttaatttgttacagccagggcggactcgtgtgcagggcactgctctccgtaatggacgaccacaacgtggactcatttatcagcctgagtagcccacagatgggccaatacggagatactgactatctcaaatggctattcccaacctccatgcggagcaacttgtatagaatctgttatagtccgtggggacaggaattttcaatttgcaactactggcacgaccctcaccacgacgacttatatctgaatgcttctagtttcctggccctcataaatgggtag

SEQ ID NO: 127782 - DNA, 441 bp, Artificial Sequence
  Description of Artificial Sequence: Synthetic coding sequence
atggatgatcataacgttgacagctttattagcctgtccagtccccagatgggacagtatggcgacacagactatctgaaatggctttttccgacctctatgcggtctaacctgtatagaatttgttactcaccttggggccaggaattttctatttgcaactactggcatgatcctcaccacgacgacttgtatctcaacgcctccagtttccttgccctgattaatggcgagcgtgatcatcccaatgcaaccgtttggaggaagaattttctgagagtgggtcacttggtgctgataggcggccccgacgatggcgtgattacaccctggcagtcctccttcttcggcttctatgatgcaaacgagactgtgctcgaaatggaagagcagcttcctgtcggctcctcagtaaaagctaatcatggtgtccagggctag

SEQ ID NO: 127783 - DNA, 477 bp, Artificial Sequence
  Description of Artificial Sequence: Synthetic coding sequence
atgctgggcttgtggggtcagcgcctccccgcggcctgggtgttgctgctgttaccttttctgcccctcttgctgctggcagccccagccccgcaccgcgcaagctacaaaccagttatcgtggttcacggcctgtttgatagcagctattccttccgccatcttctcgagtatatcaacgagatgggccagtatggcgacactgattacctaaagtggttgtttcctacctcaatgaggtccaacctgtatcgaatctgttatagtccatggggccaggagttttctatttgcaactactggcacgacccgcaccacgacgatctgtacctgaatgccagtagtttcctggccctcatcaacggcgaacgggatcaccctaatgctaccgtgtggaggaagaattttctccgggtgggccacctggtgctcatcggcgggccagatgatggcgtgatcaccccctggcagtcttag

SEQ ID NO: 127784 - DNA, 909 bp, Artificial Sequence
  Description of Artificial Sequence: Synthetic coding sequence
atgctgggattatggggacagcgcctgcctgccgcctgggtcttactccttctgccttttcttccgttattgctcctagctgcccctgcgccccacagggctagctataagcctgtaatcgttgtgcatggtctgtttgatagttcttacagtttccggcacctgcttgaatacattaatgaaacacaccccggcacagtcgtcacagtcctggacctgtttgacgggagggagtcacttagaccactgtgggaacaagttcaggggtttcgggaggctgtcgtccctatcatggctaaagccccacagggggtccatctcatttgttactcgcaaggcggactagtttgtagggcactgctgtcagtgatggacgatcacaacgtcgattccttcattagcctgtccagccctcaaatgggccagtacggagataccgactacctcaagtggctgtttccgaccagcatgcgcagtaacctctacaggatttgctattccccatggggacaggagttttccatctgtaattactggcacgacccacaccacgatgacctgtacttgaacgccagttcattcttagctttaattaatggggagcgagaccacccgaacgctactgtgtggaggaaaaattttctcagggtggggcatctggttctgattggtggccctgatgatggagtgattactccttggcagagctcgttcttcggcttctacgatgcaaacgagacagttttagaaatggaggagcagctcgtttatttacgcgacagttttggcctgaaaactttgctggctaggggtgcaattgttaggtgcccaatggcaggtataagccatacggcctggcattccaaccgtacactctacgaaacctgcatcgagccctggctgtcttag

SEQ ID NO: 127785 - DNA, 909 bp, Artificial Sequence
  Description of Artificial Sequence: Synthetic coding sequence
atgcttggcctttgggggcagagattacctgccgcgtgggtacttctactcctaccgtttctgccccttctcttgctcgccgctccggcccctcaccgggcttcctacaagccggtcattgtagtgcacggactgtttgattccagctactctttccgacatctccttgaatatatcaacgaaacacaccccgggactgtcgttacggtcctggatctttttgatggtagggaatcactcaggccactgtgggagcaggtccagggtttccgggaagcagtcgtgccaatcatggccaaggcaccgcaaggagtccacttgatttgttacagtcagggcggtctggtatgcagggctcttctgagcgtgatggacgaccataacgtggacagtttcatcagcctgtccagtccacaaatgggccaatatggtgatacagattatctcaaatggctgtttcccacatctatgaggtccaatttgtatagaatatgctattccccttgggggcaggagtttagcatttgcaactactggcacgatccccatcatgacgatttgtatctcaatgccagcagtttcctggccctgattaacggggagagggaccaccccaatgccacagtgtggcgaaaaaactttctcagggtcggccacctggtactgatcggcggacccgatgacggcgttataacgccttggcagtcatcttttttcggtttctacgacgccaatgaaaccgtgcttgaaatggaagaacagctggtgtacttacgcgatagctttgggttaaaaactctactcgctcggggcgccatcgtccggtgtcccatggctggcatttctcacactgcatggcacagcaaccggactctatacgaaacctgcatagaaccttggctgagttag

SEQ ID NO: 127786 - DNA, 909 bp, Artificial Sequence
  Description of Artificial Sequence: Synthetic coding sequence
atgctaggtctctggggtcagcgactgccagctgcttgggtgctgctcctgctgccattcctccccctcctcctcctagccgctcccgcccctcacagagcctcctacaaacctgtcattgtagtacatggtctctttgacagcagctactccttccgacatctgctagagtatattaatgagactcaccctggtacagtcgtgacagtcctcgacctctttgacggaagggagtctctgcgcccattatgggaacaggtacagggcttcagggaggccgtggtcccaatcatggctaaagctcctcagggagttcatctgatctgctattcgcaaggtggcctcgtttgtagagcgctccttagcgtcatggatgaccataatgtggattctttcatctcactatcaagtccacagatggggcaatacggcgacaccgactatctcaagtggctctttcctacctccatgcggagcaacctttacaggatttgttacagtccctggggccaggaattttccatttgcaattactggcatgatccacaccatgatgatctgtacttaaacgcctcttcattcctggcattgatcaatggtgaacgggatcaccctaacgccaccgtgtggcggaaaaatttcttgagggttggccacctagtgctgatcgggggccccgacgacggcgtcattaccccatggcagtcatcattcttcgggttttacgatgcaaatgagactgtgctcgagatggaggagcagctggtttacctgcgtgacagttttggccttaaaaccctgttggcccgaggcgccatcgtgagatgccctatggctgggatcagtcataccgcatggcactctaaccgcaccctctatgagacttgtattgagccatggctgagttag

SEQ ID NO: 127787 - DNA, 282 bp, Artificial Sequence
  Description of Artificial Sequence: Synthetic coding sequence
atgctcggactgtggggtcagcgcctgccggccgcctgggtccttctcttgctgcccttcctgccgctcctgctgctcgctgctcccgcgccacatcgtgagagctacaagcccgtaattgtggtgcatggactttttgacagctcgtactcctttcgacacctgctggagtacatcaacgaaggcgcgctctgtgccggtctgtgtttcctgagctggatgatcacaacatggattctctccagtccttctccgctgcacaggtgggattctatggaatag

SEQ ID NO: 127788 - DNA, 603 bp, Artificial Sequence
  Description of Artificial Sequence: Synthetic coding sequence
atgctagggctctggggacagagattgccggctgcatgggtgcttttactgctgcccttcctgccgttacttctgcttgccgcccccgccccacaccgggcgtcgtacaaacctgtgattgtggtgcatggactgtttgactctagctacagttttagacatttgctggagtatattaatgaaacccaccctgggaccgtggtgacggtcctggatcttttcgatggtcgagaaagcttgcggcctctgtgggaacaggtccagggcttccgggaggctgttgtgcccattatggccaaagcaccccagggggttcatctaatctgctactcgcaaggcgggttggtgtgcagggcgctcctcagtgtcatggacgaccacaacgttgatagtttcatctccctgtctagcccccagatgggccagtacggtgacactgattacctgaaatggctgtttccgacatctatgagatctaatttatatcgcatctgctactcaccttggggtcaagaatttagcatctgtaactactggcacgacccccatcacgatgatttgtacctcaacgccagcagcttcctagccctgataaacggatag

SEQ ID NO: 127789 - DNA, 603 bp, Artificial Sequence
  Description of Artificial Sequence: Synthetic coding sequence
atgcttggcttatggggccaaagacttccagcagcatgggtccttctcctgctccccttcctgcccctcctgctcctcgcagcccctgccccccatcgggcatcatacaaaccagtcatagtggtacatgggttattcgacagttcctattcattccggcacctcttggaatacatcaatgaaactcatccaggtaccgtggtaactgtcctggatctcttcgacggaagggagagcttaaggccgttgtgggagcaggttcaagggtttagagaggcagtcgtgccaatcatggctaaggcacctcagggcgtacacttgatctgttacagccaggggggcctcgtgtgccgcgccctgctttccgttatggacgatcataacgttgattcattcattagtctgtcttcaccgcagatgggtcagtacggagataccgactacctcaaatggctgttcccaacctccatgagatcgaacttgtatcgcatctgctatagtccatggggtcaggagttttctatctgtaactattggcacgatcctcaccatgatgacctgtacctgaatgccagctctttcctggccctgattaacggatag

SEQ ID NO: 127790 - DNA, 909 bp, Artificial Sequence
  Description of Artificial Sequence: Synthetic coding sequence
atgctaggcttatggggccagcgattgcctgctgcgtgggtgctgttgcttttaccttttcttccattgttactcctggcagctcctgccccacatagggccagctacaagcctgtcattgtggtgcatggcctgttcgacagttcatattctttcaggcatttactggagtatattaacgaaacccaccctggcaccgttgtcacagttctggacctgttcgacggaagagagagtttgcgcccactatgggaacaggttcaagggttcagagaagctgtggtgcctatcatggccaaggctcctcagggcgtccaccttatttgctattcacagggtggactcgtgtgtcgcgcccttctctccgttatggacgatcataatgtggattctttcataagcctgagctccccgcaaatggggcaatacggcgacactgattatttaaagtggctgtttccaacctcaatgagatcgaatctgtatagaatttgttacagcccatggggccaggagtttagcatatgcaactactggcacgatccacaccacgatgacctttacttaaatgccagttctttcttagccctgattaacggcgaacgcgaccatccaaatgcgactgtgtggcgcaagaacttcttgagagtgggccacctggtgctcataggcgggccagacgatggagtgattacgccctggcagtcgtctttcttcggcttttacgatgctaacgaaacagtgttggaaatggaggagcaacttgtctatctgagggactctttcggtctgaagactctcctcgcccggggggcgatcgtcagatgcccaatggccggcatttctcacacggcttggcatagcaacaggaccctttacgagacatgtatcgaaccctggctgagctag

SEQ ID NO: 127791 - DNA, 906 bp, Artificial Sequence
  Description of Artificial Sequence: Synthetic coding sequence
atgctagggttatgcggccagagactgcctgccgcttgggttcttctactgcttccctttctccccctgctcctgttggccgcccccgcaccgcaccgcgcgagttacaaacccgtgatcgttgtccacggactcttcgactcatcttattcttttagacatttgcttgaatacatcaacgagacacatcctggcacagtggtcacagtgttggacctgttcgacggtagggaatccctgcgacccctttgggagcaagtccagggcttccgggaagcagtggttccgatcatggcaaaagcccctcagggcgtacacctcatttgctattctcaaggcggattggtgtgccgtgctctgttgtccgtgatggatgatcacaacgtagactccttcattagcctgtcatcccctcagatggggcaatatggagacacagattacctgaagtggctgttcccaaccagcatgcggtccaacctataccgtatatgttactcaccttggggccaagaattcagtatatgtaattattggcatgacccacaccacgatgacctgtatcttaacgcaagctctttccttgccctgattaatggagagcgtgatcaccctaatgcaactgtgtggcgcaagaattttttgcgagtcggacacctggtactcatagggggcccagacgacggagtcatcactccgtggcagtcctctttcttcggcttttatgacgcaaatgaaactgtcctggaaatggaagagcagctgccagcacgccctactcatcagtcagaactgttgctgctgagattggtgtgtctcaaaccccctagacgcaaaaagccagcctgcagggtacagcggcagagtgagagctggggtccagggctgtcatgtgccttatcctag

SEQ ID NO: 127792 - DNA, 477 bp, Artificial Sequence
  Description of Artificial Sequence: Synthetic coding sequence
atgctgggcctgtggggacagcgcctgccagccgcgtgggtgctcttgcttcttccctttctgcccctattactattggccgccccggccccccaccgagaatcctataagcccgtcattgttgtgcacggtctcttcgatagttcatacagctttcggcacctgttggagtatattaacgagatgggacagtacggggataccgattacctgaagtggctctttcctacaagtatgagatcaaacctgtacagaatctgctactctccttggggacaagagtttagcatctgcaattactggcatgacccccaccatgacgacttatatcttaatgcatcatcgttccttgcgctaattaatggcgaacgggatcatcctaacgctacagtgtggcgcaagaattttttaagggtgggacaccttgtgctaatcggtgggcctgacgatggcgtgataactccctggcaatcttag

SEQ ID NO: 127793 - DNA, 543 bp, Artificial Sequence
  Description of Artificial Sequence: Synthetic coding sequence
atgttgggcctgtggggccaacgcttgcccgcagcttgggtcctgctccttctgcctttcctgccgctgctcctcctagccgcacccgccccacaccgagcatcctacaagcctgtgatagtggtacacggcttgtttgacagtagttatagttttagacacctgttagagtacattaacgagacccaccccggaacagtcgtgaccgttctggatttatttgatggtcgcgaaagtcttcggcccctgtgggaacaggtgcaggggtttagagaggccgtagtccccatcatggctaaagctccgcagggggtccatttgatatgttactctcagggcggactcgtttgcagagccctcctctcggtgatggatgatcacaatgttgattcattcatctctctgtcgtccccgcagatgggccaatacggggacacagattacctgaagtggctgttccccacttccatgaggagtaacctgtacagaatctgctacagcccgtggggacaagagttctccatctgcaactactggcactag

SEQ ID NO: 127794 - DNA, 603 bp, Artificial Sequence
  Description of Artificial Sequence: Synthetic coding sequence
atgctaggcctatggggccaaagacttcctgccgcttgggttctcctattgctcccattcctgcctctgctcctgctcgccgcaccagccccgcatagggcaagttataagcccgtaatagtggttcacggcctatttgacagttcatactcctttaggcacctgctggagtatatcaatgagacacaccctgggaccgtggtaaccgtccttgatttgtttgacggacgggaatctcttcgccccctgtgggaacaggtgcagggcttcagggaggctgtggtgccgatcatggccaaggcaccccagggggtccatctcatctgctattcacagggcggtctggtttgccgggctctgctgagtgtgatggatgaccacaacgtggactcatttatatcactgagcagtcctcaaatgggacaatacggcgacacggattacctgaagtggctttttcccacgtcaatgcgttcaaacctgtaccggatttgttactctccgtggggacaagagttcagcatttgcaactattggcacgaccctcaccatgatgacctctatctaaacgcttcttctttcctcgcactaatcaacggctag

SEQ ID NO: 127795 - DNA, 909 bp, Artificial Sequence
  Description of Artificial Sequence: Synthetic coding sequence
atgctcggcttatggggacagcggctgccagcagcctgggtgctgcttcttttgcctttcctgccactgctcctgcttgctgcccccgccccccatagagcttcttataaaccagtgatcgtggtacatggcctgtttgattcgagctacagcttccggcacctactcgaatacattaacgaaacccatccagggacagtcgtgaccgttctagacttgttcgatgggcgcgagagcctgaggcctctgtgggaacaggtccagggctttcgcgaggctgtagtgcccatcatggcgaaggctccacagggcgttcacctgatctgttattctcagggcgggctggtgtgtcgtgcattgctcagtgtgatggatgaccacaacgtggatagcttcatcagcctgagttctccgcagatgggccagtatggggacacggactacctcaagtggcttttccctacttccatgaggtcaaatctgtatagaatttgttacagcccctgggggcaggagttctccatctgcaactactggcatgacccgcaccacgacgacctctacttaaacgcctcgtcctttctcgcgcttataaacggagagcgcgatcatcccaacgccacagtatggcgaaagaactttctacgtgtcggacacctggtgttgatcgggggcccggacgacggagtgattacgccttggcagtcaagtttcttcgggttctacgacgcaaatgaaaccgtcctggaaatggaagaacagctggtttaccttagagattccttcggcctgaaaacgctgctcgctcgcggagccattgtccggtgccccatggctggaattagtcacaccgcctggcacagcaaccggacactgtacgaaacctgcatcgagccttggctgtcttag

SEQ ID NO: 127796 - DNA, 909 bp, Artificial Sequence
  Description of Artificial Sequence: Synthetic coding sequence
atgctcggcttgtggggtcagcgcctgcccgcggcctgggttctgctgcttctcccgttccttccactactgttgctggctgctcccgcccctcatagggcgtcatataagccagtcatagtggtgcatggcctcttcgactcatcttattcttttcgccacctgctcgaatatatcaacgaaacccaccctggaaccgttgtaaccgtcttggacctgtttgacggccgggagagtctccgtcctctctgggaacaagtgcaaggatttagagaagcagtggttccaattatggccaaagctccacagggggttcatctgatttgctattcccaagggggcttagtatgccgcgccttactgtcagtgatggacgaccacaatgtggactcatttattagcctgagctcaccacagatgggccaatatggtgatactgattacctaaaatggttgtttcctacaagcatgcggtccaacctataccgcatttgttactccccgtggggccaggaattcagcatatgcaactactggcatgatcctcaccatgacgacttgtatctgaatgcttcctctttcctggctcttataaacggcgaaagggaccacccgaacgcgaccgtgtggcgcaagaattttctgagggtgggtcacttggtcctgatcggcgggccggacgacggtgtgatcacaccctggcaatcctcgttctttgggttttacgatgccaacgaaacagtgttggaaatggaggaacagttagtgtaccttcgagacagcttcgggctcaaaaccctgttagcacgcggggctatcgtcagatgcccaatggcagggattagccacaccgcctggcattctaatcgcactctgtacgaaacctgcatcgagccatggttgagttag

SEQ ID NO: 127797 - DNA, 282 bp, Artificial Sequence
  Description of Artificial Sequence: Synthetic coding sequence
atgctgggactgtggggtcagcggcttcctgccgcctgggtgctgttgctcctgccatttcttccattgctgctcctggctgcaccagcaccacaccgcgcttcatacaagccagttatcgtagttcatgggctctttgactccagctactcatttcggcatcttcttgagtacattaacgaaggagctctgtgcgcgggcctctgctttctgtcttggatgatcactacatggattctgtcttccccaagccccctccataggtgggactccatggaatag

SEQ ID NO: 127798 - DNA, 282 bp, Artificial Sequence
  Description of Artificial Sequence: Synthetic coding sequence
atgctcggcctgtgcgggcagagactccccgctgcatgggtgctcctgctattgcccttccttcccctgcttctgttagcagctcctgctcctcatcgcgcttcatacaaacctgtgattgtggtgcacggactgttcgattcttcttatagtttcagacatctgctcgaatacatcaatgagggcgccctgtgcgccggactctgttttctatcttggatgattaccacgtggattctgagttcaccgtctcccctgcatcgatgggacagcatggaatag

SEQ ID NO: 127799 - DNA, 909 bp, Artificial Sequence
  Description of Artificial Sequence: Synthetic coding sequence
atgttgggcctgtggggccagcgtttgccggccgcatgggtcctgctgctgctgccattcctaccattgctgctcttagctgctcccgctccgcaccgtgcctcttacaagcctgttatagtggtgcacggactctttgactccagctattcctttagacacctgttagaatacatcaacgagacacacccaggaactgtcgttactgtactagacctgtttgacggccgcgagtcactaagacctctgtgggaacaggtgcaagggttcagagaagcagtggtccctataatggcaaaggccccgcagggggtccatcttatctgctactcccaggggggtctggtgtgcagggctctgctgtcagtgatggatgaccataacgtggactcatttatctcgcttagcagtcctcagatgggacagtatggagataccgactatcttaaatggctgttccccacctccatgcggtccaatctgtatagaatttgctacagcccttggggccaggaatttagcatttgcaactattggcatgatccccatcatgatgacttgtatttgaacgcttctagcttcctggcccttatcaacggagagcgggaccatcctaacgcaacagtgtggagaaaaaacttccttagggttggacacctggtgctcatcggtgggcctgacgatggagtcatcacaccttggcagtcaagctttttcggattttacgatgccaacgaaacagtcttggagatggaagaacagctcgtctatctgcgagattctttcggattgaaaacattgctggcaaggggagctatagtgcggtgtccgatggctggcatcagccatactgcgtggcacagcaaccgcaccttgtacgagacttgcatcgaaccttggctctcctag

SEQ ID NO: 127800 - DNA, 909 bp, Artificial Sequence
  Description of Artificial Sequence: Synthetic coding sequence
atgttgggcctttggggacaacggcttccggctgcttgggtcctcctgcttttgccctttctgccacttctgctgctggccgccccagcgccccaccgtgcatcgtataaaccagtcattgtggtgcatggactgtttgactccagctactccttcaggcacttgcttgagtacatcaatgaaactcatccaggaacagtggtcacagtgctggatctgtttgacggtcgggaatcactcaggcctctgtgggagcaggtacagggtttccgtgaagctgtagtgcctatcatggccaaggctcctcagggagtccatctgatttgctatagtcaaggtggcctcgtgtgccgggctttactgagtgtgatggatgatcacaacgtggacagctttataagcctgagctcccctcagatgggccaatacggcgatactgattacctcaaatggctcttcccaacgtccatgcgcagtaacttgtaccggatctgctatagtccgtggggccaggagtttagcatctgtaattattggcacgacccacaccacgatgacctgtacctgaacgctagttcattccttgccctaatcaatggagaaagagatcaccccaatgccactgtttggcggaagaatttcttacgggtgggtcacctcgtcctgatcgggggccctgacgatggtgtgatcacaccctggcagtcttcattcttcggattttacgacgccaatgaaaccgttcttgagatggaggaacagttagtgtaccttagggattcatttgggctcaagaccctgctggctaggggagctatcgtccgttgtcctatggctggtattagccatacagcctggcattctaaccgaactctgtacgagacgtgcattgagccttggctgagctag

SEQ ID NO: 127801 - DNA, 543 bp, Artificial Sequence
  Description of Artificial Sequence: Synthetic coding sequence
atgcttgggctctgggggcagcggctgccagctgcatgggttttgctgttgctgccatttctacccctgctgctactcgcagcgccagcacctcaccgggagtcctacaagccggtgatcgtagtgcacggattatttgattccagctactctttccgacatctgttagaatatatcaacgagacacatcctgggactgtggtaaccgtgttggacctgtttgacggacgcgaatcactgagacccttgtgggaacaggtccagggctttagggaagccgtcgtccccatcatggccaaagcccctcagggcgtgcatctgatctgctattcacaggggggactcgtgtgccgggccctcctgagtgtgatggatgaccacaacgttgattcttttatcagtctaagctccccacagatgggtcaatacggggatactgactatctgaagtggctgtttccgacctccatgcgctcaaacctgtaccgcatctgctacagcccctggggccaggaattctctatttgcaattactggcactag

SEQ ID NO: 127802 - DNA, 543 bp, Artificial Sequence
  Description of Artificial Sequence: Synthetic coding sequence
atgctgggactttggggtcaaagattgcccgccgcctgggtcctgttgttactcccgttcctgcccttactgctcctcgcagcccccgccccccacagggagtcctataaacccgtgatcgtagtgcatggcctcttcgactcttcttatagcttcaggcatctgttagagtatatcaacgagacccatccggggaccgtcgtgactgtgctcgacttgttcgatggtcgcgagagcctgagaccgctgtgggagcaagtgcaaggctttcgggaggctgtagttcccattatggccaaagcaccccagggggtacatctgatctgttattcacagggaggccttgtttgtcgagctctgttgtccgttatggatgatcacaatgtggacagctttataagtctatcttccccccagatggggcagtacggtgatactgactacctgaaatggctgtttcccacgagtatgaggagtaatctttataggatttgctattctccttgggggcaggaatttagtatctgcaactactggcattag

SEQ ID NO: 127803 - DNA, 282 bp, Artificial Sequence
  Description of Artificial Sequence: Synthetic coding sequence
atgctcgggctatggggtcagcgattacccgccgcgtgggttctcctgttgttaccattcctcccattgctgcttttggccgctccagcaccacacagggagtcgtacaaacctgtcatcgtagttcatgggttgttcgacagtagctactcctttcggcacctcctggaatacataaacgaaggagccctgtgtgctgggctatgttttttaagttggatgataacaacatggatcctaagcagcccctctcctctccaccggtgggacagcatggagtag

SEQ ID NO: 127804 - DNA, 711 bp, Artificial Sequence
  Description of Artificial Sequence: Synthetic coding sequence
atgttaggactctggggacagcggctccctgcagcatgggtcctgctcctcctccccttcctgcccctgttgttgctcgccgcccctgctccgcaccgggagagttacaagccagtgattgtcgttcatgggttgttcgactcctcttactctttcagacacttgctcgaatacatcaacgaaacacaccccggcacggtggtcactgtgctggacctgttcgacgggagagaaagccttcggcctttgtgggagcaggtccagggcttcagagaggctgtggttcctatcatggccaaggcaccgcaaggagtccacctcatctgttactctcagggaggcctggtgtgccgtgcgctgctgagcgtaatggacgaccacaatgtggattcttttatcagcctgagtagtccccagatggggcagtatggcgatacagactacctcaagtggctatttcccacttccatgcgaagtaatctttacaggatctgttacagcccctggggccaggagtttagcatttgtaattactggcacgacccgcaccatgacgacctgtacctcaatgcatctagttttttggccttaatcaatggcgagagagaccaccccaatgccactgtatggaggaaaaattttctgcgggtggggcacctagttctcatcggcggtccagacgatggggtcattactccctggcaatcatag

SEQ ID NO: 127805 - DNA, 165 bp, Artificial Sequence
  Description of Artificial Sequence: Synthetic coding sequence
tagcacgacgacctgtacttgaacgcctcttctttcttggccctcatcaatggtgagcgagatcaccctaatgctaccgtctggcggaaaaattttcttcgagtgggtcacctggttctaatcggcgggcccgacgacggcgtgataacaccttggcagtcttag

SEQ ID NO: 127806 - DNA, 711 bp, Artificial Sequence
  Description of Artificial Sequence: Synthetic coding sequence
atgcttggactctggggccagcgtctgccagccgcttgggtcctcctgcttcttccattcctccccttgctcctccttgctgcacccgcccctcacagagagtcttacaaacccgtcatcgtggtgcatggattgtttgactcgtcttactcttttaggcaccttttagagtatatcaacgagacccatcctggtaccgtggtaacagtgcttgatcttttcgatggccgcgagtccctgagacctctgtgggagcaggtgcaagggttcagggaagcagtggtgccaatcatggccaaagctccacagggagtacatctcatttgctattctcagggaggattagtgtgccgagccctcttgagtgtgatggacgaccacaatgtggacagctttattagcctgtccagccctcagatgggacagtacggagacaccgactacctgaagtggttgtttcctacatctatgcgtagcaacctttaccggatctgttactcaccgtggggccaggaattctcaatttgtaattactggcatgaccctcaccacgacgacctctacctcaacgcaagcagcttcctggccctgataaatggtgagagggaccacccaaatgcaacggtgtggagaaaaaactttctgagggtaggccacctggtactgatcggggggcctgacgacggtgtcattaccccctggcagtcttag

SEQ ID NO: 127807 - DNA, 909 bp, Artificial Sequence
  Description of Artificial Sequence: Synthetic coding sequence
atgcttggtctgtggggccaacggctccccgctgcttgggtccttctgcttttgcccttcctgcctctgctgctgctcgctgcaccagcccctcatagagcaagctataagccagtcattgttgttcatggtctctttgacagcagctactctttcagacacctccttgaatatattaatgagacccatcctggaaccgtcgtcactgttttagacctgttcgacggccgcgagtccctccggcccctatgggagcaggtgcagggctttcgggaggcagtagtccccattatggccaaagcacctcaaggggtgcacttaatttgctactcacagggggggttggtatgcagagcactattaagcgtgatggatgaccataacgtcgactcctttatcagcctgagcagcccacagatgggacaatacggagatacagactacctgaagtggttgtttcctacttccatgcgctccaacctgtaccgaatctgctacagtccatgggggcaggaattcagcatctgtaactactggcatgatccacatcacgatgatctgtacctcaatgcatcaagtttcctggctctgatcaatggggaaagggaccaccctaatgcgaccgtgtggcgcaaaaacttcctgcgcgtgggacacctagttttgatcggtggaccagatgacggcgtgataaccccgtggcagtcctcgttcttcggcttctatgatgccaacgaaaccgttctggaaatggaggaacagctggtttatctcagagatagtttcgggctgaaaactctgttggcgcggggggctattgtccgttgtccaatggctggaatttctcataccgcctggcacagtaatcggaccttgtatgaaacctgtattgaaccgtggctaagctag

SEQ ID NO: 127808 - DNA, 909 bp, Artificial Sequence
  Description of Artificial Sequence: Synthetic coding sequence
atgctcgggttgtgggggcagagactgcctgccgcttgggtccttcttctcctgccctttctacctcttctgctcttggctgctccggctcctcatagagcctcttataagccagtgattgttgtgcacggattatttgattcttcgtatagcttccgccatctgctggagtatattaatgagacacacccaggaacagtggtgaccgtgctggacctgtttgatggccgggaaagcctgcgccccttgtgggagcaggttcagggatttcgagaggccgtcgtgccaatcatggcaaaggctccacagggagtgcaccttatttgttactcacaggggggcctggtgtgtagggcccttttgagcgtaatggacgaccacaacgtggattccttcatttcgctttcctccccacagatggggcagtacggggacaccgactaccttaagtggttgttccctacttctatgcggtctaatctttataggatctgttattctccctggggccaggagttttccatttgtaattactggcacgacccacaccatgacgacctctaccttaacgccagttcttttcttgccctgattaatggagaaagggatcaccccaacgcaacggtgtggcgaaaaaacttcctgcgcgttggacaccttgtcctgattggcgggccagatgatggagtgataactccgtggcagagtagctttttcggcttctacgatgccaacgaaacagttctcgagatggaggagcaattagtgtacctcagggactcattcggactcaagacccttctggcccgcggcgctattgttcgctgtcctatggcgggaattagccacactgcctggcactccaatcggactctgtacgagacctgtatcgagccgtggctgtcgtag

SEQ ID NO: 127809 - DNA, 909 bp, Artificial Sequence
  Description of Artificial Sequence: Synthetic coding sequence
atgcttggcctctgggggcagcggcttcctgctgcctgggtcctgctgctgctgccgtttctgccactcctgttgctcgccgccccagcaccacacagagctagctacaaacccgtgatcgtcgtccatggtctgttcgactcttcctacagcttcaggcaccttctagagtatattaatgagacccaccccggtacggtggtgaccgtcctcgatctgtttgacggtagggaaagcctcaggccattgtgggagcaggtgcagggattcagggaggctgtcgtgcccatcatggccaaggcccctcagggcgtgcacttgatttgttatagtcaagggggactggtttgccgagccctgctgtcagttatggacgatcacaacgtggactcatttatatctctttcctcaccacagatggggcagtacggcgacaccgattatctaaaatggctgtttcctacctcaatgcgatccaacctgtatagaatctgctattccccctggggtcaggagttctctatttgtaactactggcacgatccccaccacgatgatttgtatctaaacgcaagtagcttcctcgccttaatcaacggggaaagagatcatccaaatgcgaccgtgtggaggaagaatttcctcagggtaggccacctggtacttattggaggtcccgatgatggggtgatcactccttggcagagttcattcttcgggttctatgatgctaatgagacggtcttggaaatggaggaacagctcgtgtatctcagggattcatttggcctaaagacactcctggcgagaggcgccattgtgcgttgccctatggccggaatatcccacaccgcctggcatagtaatcgcactttgtatgaaacatgtatcgagccttggttatcatag

SEQ ID NO: 127810 - DNA, 441 bp, Artificial Sequence
  Description of Artificial Sequence: Synthetic coding sequence
atggatgatcacaatgtggactccttcatttctctgtcctctccccagatggggcagtatggcgacacagactatcttaagtggctctttccaacaagcatgcgatctaatctataccggatctgttattctccatgggggcaggaatttagcatctgtaattactggcatgacccacaccatgacgacttgtacctgaatgctagtagctttctcgccctcattaacggcgaacgagaccatccgaacgcaaccgtgtggcggaaaaactttcttcgggtgggccatctcgttctgatcggggggcccgatgatggcgttataaccccctggcagagtagctttttcggcttttatgatgccaatgagacagtcctcgagatggaagaacaactgcctgtgggaagcagtgtgaaagctaaccatggggtgcagggttag

SEQ ID NO: 127811 - DNA, 927 bp, Artificial Sequence
  Description of Artificial Sequence: Synthetic coding sequence
atgaaaagctgcggttccatgctgggcctgtgggggcaaagacttcccgccgcgtgggtcctgcttctgctcccgttcctacccctgttattactggctgcaccagcaccccacagggcctcctacaagccagtcatagtcgtgcatggtctattcgatagctcctactcatttcgtcaccttttggagtacataaacgagacacatcccgggactgtggtgactgtactggaccttttcgacgggagggaaagtctgagaccactgtgggaacaggtgcaggggtttcgagaggccgtggtgccgattatggcaaaagccccacaaggggtgcatttgatatgctactcccagggaggattggtttgtcgcgccttgttgagcgtgatggatgaccacaatgttgactccttcataagcctgtcttctcctcagatggggcaatacggtgatacagactatttaaaatggttgttcccaacctcaatgcggagcaacctatatcgcatctgctacagcccctggggtcaggagtttagcatctgcaattactggcacgacccgcatcacgacgacctgtacctgaatgccagcagctttctagcgctcatcaacggggagcgagatcacccgaacgctactgtgtggcgcaagaatttcctccgggttggccatttagtgttaataggtggcccagacgatggggtcatcacgccctggcagtcttccttcttcggcttttacgacgccaatgaaacagtgctggaaatggaggagcagttggtttacctgagagattccttcggtttaaaaactcttttagctcggggtgccattgtccggtgcccgatggccggcatctcacacactgcgtggcattcaaaccgtactctgtatgagacctgcattgagccctggctatcctag

SEQ ID NO: 127812 - DNA, 882 bp, Artificial Sequence
  Description of Artificial Sequence: Synthetic coding sequence
atgggttcccgcgcggaactctgcacccttctcggcggatttagtttccttcttctgctaattccaggggaaggcgctaagggtggatcactcagagaatcacaaggagtctgcagcaagcagacactggttgttcccctccactacaatgaaagttacagtcagccagtgtataaaccatacctcacactgtgtgccgggcggagaatctgctccacttatagaacgatgtatagagtcatgtggcgagaggtgcgcagggaggttcagcagactcatgctgtgtgttgtcagggatggaaaaagagacaccccggagctttgacttgcgaagcaatttgcgcaaagccttgtctgaacgggggagtctgtgttcgccctgaccagtgtgagtgcgctccggggtggggcggaaagcactgccacgtcgacgtggacgagtgtcgaacctcaataaccctatgtagtcatcactgtttcaacacggctggcagttttacctgcgggtgcccccatgatctggtgctgggtgtcgatgggcggacctgtatggaaggtagtcctgaacccccaactagtgcctccatcttgagtgttgccgttagggaggccgaaaaggacgaacgcgcgcttaagcaagaaatccatgaacttcggggtcggcttgaaagactcgaacagtgggctggtcaggccggcgcatgggtccgtgcagtgctgcctgtgccaccggaagaacttcagccagagcaggtggcagagctttggggcagaggtgacaggatagagagcttgtccgaccaagtcttattactggaagagaggttgggcgcctgtagctgtgaggataactccctggggcttggcgtgaaccaccggtag

SEQ ID NO: 127813 - DNA, 906 bp, Artificial Sequence
  Description of Artificial Sequence: Synthetic coding sequence
atgcttggactgtggggccagcggttgccagcagcatgggtcctcctcttattgccatttttgccactcctcctgctggcggcgcctgccccccacagggctagctacaagcctgtcatcgtcgtgcacggcctgtttgattcttcttactcatttagacatcttctggaatatattaatgaaacgcatcccggaaccgtcgtaaccgtgctggatctgttcgatggaagggagtcactcagacctctgtgggaacaggtgcagggcttccgtgaagcagtcgtcccgataatggccaaggccccccagggtgttcacttgatctgctatagccagggcgggctggtgtgccgagccctcctgtcagtgatggacgaccataacgtggactcctttatatcactctctagcccccagatgggacaatatggagatactgattacctgaagtggctatttcccacatcaatgagaagcaacctgtaccgaatatgttattccccttggggccaggagttctccatttgcaattactggcatgacccccatcacgacgacctctatctgaacgcctcttcatttctggcactgataaacggggaacgggatcacccaaacgccaccgtctggcgaaaaaatttcctcagagtcggtcatctcgtgctcattggcggacccgacgatggtgtgatcacaccatggcaatcaagcttcttcggcttctatgatgccaacgaaactgtgcttgagatggaggaacaactgcctgccaggcccactcaccagtccgagctacttctgctcaggctcgtctgtctgaagccaccccgcaggaaaaagcctgcatgccgagtccagcgacaatccgagagttggggccctgggctgtcttgtgccctctcgtag

SEQ ID NO: 127814 - DNA, 909 bp, Artificial Sequence
  Description of Artificial Sequence: Synthetic coding sequence
atgcttggactctgggggcaacgactcccagcggcttgggtcttgctactgcttcccttcttaccgctgttgctgctggccgctcccgcccctcaccgcgaaagctacaagccagtgattgtggtccacggcctcttcgatagctcttactcctttcggcatctcctcgagtatatcaatgaaactcatcccggaactgtggtaaccgtgttggacttgtttgatggacgcgagtccctgagaccattgtgggaacaggtgcaggggttcagagaagcggtggtgcccatcatggcaaaagctccacaaggcgtgcacttgatttgctactctcagggcggtctggtctgcagggctttgctgagcgtgatggatgaccacaacgtggactcttttatttccctgtcgagcccccagatgggccagtatggggatacggactacctgaaatggttgttcccgacctctatgcgaagcaatctgtatcgtatctgttacagtccgtggggccaagagttctccatttgcaactactggcacgatccccaccatgacgatttgtacctgaacgcatcatcttttctggccctcattaatggcgagagagatcacccaaatgctactgtctggaggaaaaattttcttagagtgggccatctggtactgattggtgggcccgatgacggggtgataacaccgtggcagtcctctttttttggtttctacgacgccaatgaaacagtgttggaaatggaggaacagttagtctatctcagagactccttcggcctcaaaacactgctggcgcgcggcgccatcgtgcggtgccccatggccggaataagtcacaccgcatggcatagtaaccgaaccctatatgaaacctgcatcgaaccatggctgtcttag

SEQ ID NO: 127815 - DNA, 441 bp, Artificial Sequence
  Description of Artificial Sequence: Synthetic coding sequence
atggacgatcataatgtcgacagtttcatatcactgtcatccccccagatgggtcagtacggggataccgattatctcaaatggctcttccctacatccatgagaagcaatctttaccgaatctgttactccccttggggacaagagtttagtatctgcaactattggcacgatccccatcacgacgacctgtatcttaatgcttcgagtttcttagccctgattaatggcgagcgcgaccatcccaacgcaaccgtgtggcgtaaaaacttcctgagagtcggtcatctggttttgattggtggacccgacgatggtgtcatcacaccttggcagtcatccttcttcggcttctacgacgccaacgagactgttctggaaatggaggagcagctgccagtgggatcttccgtcaaggcaaatcatggggtgcagggttag

SEQ ID NO: 127816 - DNA, 882 bp, Artificial Sequence
  Description of Artificial Sequence: Synthetic coding sequence
atgggcagccgggccgagctgtgtacgctgttaggtgggttttccttcttgcttctccttattcctggagagggggcaaagggagggagtctcagagaatctcagggtgtgtgttctaagcagaccctcgtcgtgcctctccattacaacgagagctatagtcagccagtttataaaccctacctgaccctttgtgccggaaggaggatctgctcaacctatcgcacaatgtaccgggtaatgtggagggaggtgagaagggaagtgcaacagacccacgcggtctgttgccagggatggaagaagagacatccgggagccctgacctgcgaagccatttgtgccaagccatgtctgaatggcggcgtctgtgtccgtccagatcagtgcgaatgtgctccaggatggggcgggaagcactgccatgtcgacgttgacgagtgcagaacttccattacactgtgtagccatcactgctttaatacagccggatcttttacatgcggctgccctcacgacctcgtgttgggagttgatggccgcacgtgcatggaggggtcgccggagccacccaccagcgcctctatcttgagcgtagccgtacgtgaggcagaaaaggatgagcgcgcactgaaacaggagattcatgagctgcgtggccgactggaacgcctggaacagtgggctgggcaagcgggcgcctgggtccgtgcggtccttccggtgcctcctgaggaactgcagcccgagcaggtggcagaactgtggggcagaggcgaccgaatcgaaagcctcagcgaccaggtgctgctcctcgaagaaaggctcggcgcttgctcatgtgaagacaactcacttgggctcggcgtaaatcaccggtag

SEQ ID NO: 127817 - DNA, 906 bp, Artificial Sequence
  Description of Artificial Sequence: Synthetic coding sequence
atgttgggtctctgggggcagcgcctacccgccgcttgggtgctgttactgttaccgttcttgcctcttttactgctggccgcccccgcccctcacagagcctcttataagcctgtgatcgtcgttcatggactttttgatagttcttattcatttcgccacctgctcgaatatatcaatgaaacacaccccgggacggtggtaaccgtgctggacctctttgacggacgagaaagcctgcgccctttgtgggagcaggttcaaggcttcagagaggcagtggttcccattatggctaaggcaccccagggggtgcaccttatctgctactctcagggaggcttggtttgtcgcgcactactgagcgtaatggacgaccacaatgtggactcattcatctctctgagcagtcctcagatgggacagtacggagataccgattacctcaagtggctgtttccaactagcatgcggtctaacctgtacaggatctgttattcgccctggggtcaggagttttctatctgtaactactggcacgatccacatcacgacgacctttacctgaacgcttccagttttctcgcattgattaatggcgaacgagaccacccaaacgctaccgtctggcggaaaaattttctcagagtgggccatctggtcttaattggaggaccagacgacggggtgataacgccctggcagtcttccttttttggcttttatgacgctaatgaaaccgtgctggaaatggaggagcagctcccagctcgtcctacccaccagtccgagttgttgttactccggctcgtatgcctgaaaccgccgcggcggaagaagcccgcatgcagagtgcaaaggcagtctgagtcttggggcccaggcctgagttgcgcactgtcttag

SEQ ID NO: 127818 - DNA, 441 bp, Artificial Sequence
  Description of Artificial Sequence: Synthetic coding sequence
atggatgatcataacgtggatagcttcataagcctgagttctccacagatgggccagtacggtgacaccgattatctcaagtggctgttcccaactagcatgagatctaacttgtatagaatctgctatagcccctggggtcaggagttctctatttgcaactattggcatgatccccaccatgatgatctctacttgaatgccagttcctttctcgcactcatcaatggagaacgggaccacccaaatgccactgtctggagaaagaacttcctgagagtggggcacctggtgctgatcggaggtccagacgacggtgttataaccccatggcagagctctttttttggcttttacgatgcaaacgaaaccgttttggagatggaggagcagctgcccgtcggttcctctgtgaaggctaaccatggcgtgcaagggtag

SEQ ID NO: 127819 - DNA, 906 bp, Artificial Sequence
  Description of Artificial Sequence: Synthetic coding sequence
atgctgggcctatggggtcaaaggctacccgctgcctgggtgttgctgctgttgcccttcctcccattgttgctcctggctgccccggccccccatcgcgcttcatacaagcctgttatagtggtgcatggactttttgactcatcatattcctttcgacatctgctcgagtacataaatgagacccatcctggtacggtggttactgtgctcgacctgttcgatggtcgggagtctctgaggcccctctgggaacaagtgcaaggattcagggaggctgttgtgcccataatggccaaggcacctcagggggtacatctaatatgctatagtcaaggcggtcttgtttgccgagccttgttatctgtcatggacgaccacaacgtggactcatttatttccctcagctcaccccaaatgggacaatacggcgatacagactacctcaagtggctgtttccaacaagcatgcgcagcaatctgtaccggatatgctattctccttggggccaggagttctccatctgcaactactggcacgatcctcatcacgacgatctctatttgaacgcgagttcctttttggccttaattaacggtgagcgggaccatccaaatgccactgtctggcgaaagaacttcctccgtgtgggtcatctcgttcttattggaggcccagatgatggggtgattaccccctggcagagcagtttctttggcttttacgacgccaatgagaccgtccttgagatggaggagcagcttccagcccggcccacgcaccaaagtgagctactgctcctgcgactggtgtgtcttaagccgccgagaaggaaaaagccagcctgcagagtccaacgccagagcgaatcctggggaccaggtttgtcctgtgcactctcatag

SEQ ID NO: 127820 - DNA, 441 bp, Artificial Sequence
  Description of Artificial Sequence: Synthetic coding sequence
atggatgatcacaatgtggactccttcatctccctgagttcacctcagatgggacagtacggagacaccgactatttgaaatggctcttccccacctccatgcgttctaacctgtatcggatctgttacagtccatggggccaagaattttcaatttgcaactattggcacgatcctcaccatgacgacctgtacttgaacgcttcttccttcttggcactgattaatggggagagagatcacccgaacgcaactgtctggaggaaaaatttccttagagtcgggcacctggtccttatagggggtcctgacgacggcgtgatcaccccctggcagagcagcttctttgggttttatgacgccaatgaaacggtgctggagatggaggagcagttgccagtgggctcaagcgtcaaagctaaccacggggtccaggggtag

SEQ ID NO: 127821 - DNA, 882 bp, Artificial Sequence
  Description of Artificial Sequence: Synthetic coding sequence
atgggttctagagctgagctgtgtacgcttttaggcgggttctcgtttctgttattactcatcccaggggaaggcgccaaaggcggatccctgcgggagtcccaaggtgtttgcagcaaacagactctggtcgtgccactccactataacgagagctactctcagcctgtgtataaaccatacctcaccttgtgcgctgggcgacggatctgttcaacctacagaaccatgtatcgcgtgatgtggcgcgaggtgagaagggaggtacagcaaactcatgctgtgtgctgtcagggatggaaaaagagacatcctggtgctctgacatgcgaggccatctgcgccaagccatgtttaaacggcggtgtatgtgttaggcctgatcagtgtgagtgcgctcctgggtggggtgggaagcattgccacgtcgacgtagacgagtgccgaacctctataactctttgctctcatcactgtttcaacactgccggatcctttacctgcgggtgcccccacgacctggtgctgggagtagatgggcgcacgtgcatggagggttccccggaacctcccacctcggctagtatactgagcgtggctgtgcgggaagcagagaaagatgagcgtgcacttaagcaagaaatccacgagctgaggggccgcttagagcggctggagcagtgggctggccaagccggagcatgggtgcgcgctgtgcttccagttccacccgaagaactgcaacctgaacaggtggcggaactgtggggtaggggtgataggatcgagagtctgtccgatcaagttctgctcctggaggaaagactcggagcttgtagttgtgaggacaatagcttgggcttgggcgtgaaccaccgttag

SEQ ID NO: 127822 - DNA, 882 bp, Artificial Sequence
  Description of Artificial Sequence: Synthetic coding sequence
atgggctcacgggctgagctatgcacactcctcggggggttttcgttcttgctgctactcatcccaggcgagggggctaagggtggcagcttgcgggagagccagggtgtctgctcgaaacaaactctggtggtgcctctgcattacaacgagtcttacagtcaacctgtctacaaaccctacctgactctgtgcgcagggcgacggatatgctccacctatcgcaccatgtaccgggttatgtggagggaagtgagacgcgaagtgcagcagacacatgcagtttgttgtcaggggtggaagaagcgacatcccggtgccctcacctgtgaagctatctgtgcaaaaccttgtctgaacggcggcgtctgtgtgaggccagaccagtgcgaatgtgcgcctggctggggtggaaaacactgccacgtggacgtggacgagtgtaggacttctatcaccttatgctcccatcactgctttaatactgccgggtcctttacgtgcgggtgtccacacgacctggtcctcggcgtggatggccgaacctgcatggaggggtcccctgagcctccaaccagtgcgagcatcctgtcagtcgccgtccgagaagccgagaaagatgagagggcgttgaagcaggagattcatgagctgcgtggccgactggagagactggaacagtgggctggccaggccggtgcatgggttcgggcggttctcccagtgccacccgaggaactgcagccagagcaggtcgccgagctgtggggccggggtgatcggatagaatctctttcagatcaggtgttattactcgaggagcgcctgggagcatgcagttgcgaggacaattcactgggattgggggttaaccataggtag

SEQ ID NO: 127823 - DNA, 909 bp, Artificial Sequence
  Description of Artificial Sequence: Synthetic coding sequence
atgttagggttgtggggacaacgactccccgcggcctgggtcctcttactcctacctttcctgccactgctactgctggcagccccagccccgcacagagcctcttataaaccagtgatcgtcgtgcacggcttgtttgactctagttattcattccgtcaccttctcgagtatattaacgaaacacatcccggtactgtggtgactgtgctcgatctgttcgacggccgcgagtccctgcggccgttgtgggagcaagtccagggtttcagggaggcagtcgtccctatcatggctaaagctccgcagggggtgcatctgatctgttatagtcaaggaggtctggtttgtcgggcattgcttagcgtgatggatgaccacaacgtggacagtttcatctctctgtccagcccacagatgggccagtatggtgatacagactatttaaagtggctttttcccacgtccatgagaagcaatctttacaggatctgctacagcccgtgggggcaagagttctctatttgcaattactggcacgacccccaccacgacgacctctacctgaatgctagctccttcctggccctcataaacggggaaagggatcatcctaatgccaccgtgtggcgcaagaatttcctccgggtgggacacctggtcctgatcggaggccccgatgatggagtcatcacaccatggcagtcctcatttttcggtttctacgatgccaacgaaaccgtcttggaaatggaggaacaactcgtgtacctacgagactccttcggactgaaaacactgctcgcccgcggggctatcgtgcggtgtccaatggctgggattagccacaccgcatggcattcaaacagaacgctgtacgagacctgcatagaaccctggctatcttag

SEQ ID NO: 127824 - DNA, 441 bp, Artificial Sequence
  Description of Artificial Sequence: Synthetic coding sequence
atggacgatcacaatgttgattcctttattagtctttccagtccccagatgggacagtacggagacactgattacctcaaatggctgttccctacgtccatgaggagtaacctgtatagaatatgctatagcccttgggggcaggaattctctatttgcaattactggcatgacccacaccacgacgatttgtatctaaatgcttctagctttttagccctgatcaatggcgaaagagaccaccccaacgccaccgtgtggcggaagaactttttgcgcgttgggcacctggttctcataggcggcccagacgacggagtgataacgccgtggcaatcctcattctttggcttctacgacgcaaacgagacagttctggaaatggaggaacagctcccagtgggcagctccgtcaaggcaaatcacggagtacagggttag

SEQ ID NO: 127825 - DNA, 909 bp, Artificial Sequence
  Description of Artificial Sequence: Synthetic coding sequence
atgctcggtctgtgggggcagaggcttcctgcagcctgggtattgttactgctaccatttctcccactacttctgctggccgctcctgctccacatagagcttcctacaaacccgtcattgtcgtccatggactttttgactcgtcttactccttccgccaccttctggaatacatcaacgagacccatccagggaccgttgtaaccgtcctagacttatttgacggaagggaatcattacgacctctgtgggagcaggttcagggattccgggaagccgtggtccccattatggccaaggctccccagggcgtgcaccttatctgttactctcaaggaggactagtgtgtagggccctgttgagcgtcatggacgatcataacgtagacagcttcatcagtctctccagccctcagatgggtcaatatggcgataccgactatttgaagtggctcttccctacctctatgaggagcaacttgtaccgcatctgctatagcccatggggccaggaattcagcatttgcaactactggcacgaccctcaccacgatgatctgtacctcaatgcatctagttttctcgctctgattaacggcgagagagaccaccctaacgccacagtctggcgaaagaacttccttagggtgggacacctggtactgattggcgggcccgatgacggagtgattaccccctggcaatcctccttcttcgggttttacgatgccaatgagactgtgctggagatggaggaacaactggtgtatttacgggactcattcgggttgaagacgctgctggcacgaggcgccatcgtgaggtgccctatggctggaatcagccacacagcttggcacagcaatcgaaccctctatgagacatgcatcgaaccttggctaagttag

SEQ ID NO: 127826 - DNA, 441 bp, Artificial Sequence
  Description of Artificial Sequence: Synthetic coding sequence
atggatgatcacaatgttgattccttcatctcactatctagccctcagatggggcagtacggggacaccgattacctcaaatggctcttccccacatccatgcgaagcaatctgtaccggatctgttactctccctggggacaggagttctccatatgtaactactggcacgatccacatcacgatgacctttacctgaacgcttccagctttctggccctaattaatggagagcgagaccatcccaatgctactgtttggagaaagaattttctgcgcgttggccacctagttctgatcggcggtcctgatgatggggtgattactccatggcagagttcttttttcgggttctacgacgctaatgagacagtgctggagatggaggaacaactcccagttggctcttcagtgaaggcaaatcatggagtgcagggctag

SEQ ID NO: 127827 - DNA, 906 bp, Artificial Sequence
  Description of Artificial Sequence: Synthetic coding sequence
atgctgggattatggggtcagaggctacccgccgcctgggtgttgctgctgttacctttcctacctttactgctgctcgccgctcccgctccccacagagcatcctataagcctgtcatcgttgtacacggactgtttgacagcagctactcatttcggcacctgttggaatacatcaacgagactcatccagggaccgtggttactgtcctcgatctcttcgatgggcgtgagtcgctgcgacctctgtgggagcaggtccaagggtttagggaggcagtcgtgccaatcatggccaaggcgccccaaggggttcatctaatatgctattcccagggaggcctggtctgtcgcgccctcctctccgtaatggacgaccataatgtggactcttttatttctctcagcagtccgcagatgggtcagtacggcgacacagactacctcaagtggcttttcccgacgagtatgcgctcaaacctttataggatttgttacagcccgtggggtcaagagtttagcatatgcaactactggcatgacccacatcacgatgatctctatctcaatgccagctcctttttggctctcattaatggagaacgcgaccaccctaatgccacggtgtggcggaagaattttcttagggttggccatctggtgctgatcgggggcccggacgacggtgtaatcaccccatggcagtcctcattttttggattttacgacgcgaacgaaacagtactcgaaatggaagagcagctgcccgcccggccgacacatcagtccgagttacttttattgcgattagtgtgccttaagcccccaagaaggaagaaaccggcatgccgcgtccagcgccagagcgagtcatggggtccagggctcagctgtgcactgtcatag

SEQ ID NO: 127828 - DNA, 906 bp, Artificial Sequence
  Description of Artificial Sequence: Synthetic coding sequence
atgctcgggttatggggccagagactgccagctgcttgggttctcctgctcttaccatttctgcccctcctacttctggcggctccagccccccatcgagaatcctacaaacccgtgattgtagtgcacggactgttcgacagctcctactctttccgccatctcctagaatatatcaacgaaacccaccccgggaccgtcgtgactgtgctggaccttttcgacggcagagaaagcttgagaccactatgggagcaggttcagggcttcagagaagccgttgtgccgatcatggctaaggccccccaaggcgtccacttaatctgctattcacagggagggctcgtctgcagggcattactaagcgtaatggatgaccacaacgtggactcgtttatctcactgtcttctccccagatgggccagtatggagacaccgactatctcaagtggctgttcccgacttctatgaggtccaacctctatcgcatctgctatagcccatggggccaggaattttctatctgtaattattggcatgacccccaccacgacgatctctatttaaacgcttcatccttcctggcattgataaatggagagagagaccaccccaacgctactgtttggcgtaaaaactttcttcgcgtcggtcatctggtgctcattggtgggccggatgatggagtcattactccatggcaatcctctttcttcgggttttatgatgccaatgaaactgtcctggaaatggaagagcagttgccagccagacccacacaccagtccgaacttcttctactgcgtttagtttgcttgaagcccccccggcggaagaagcccgcatgtcgcgtacagcgacagagtgagtcctggggtcccggattaagttgtgcactaagctag

SEQ ID NO: 127829 - DNA, 906 bp, Artificial Sequence
  Description of Artificial Sequence: Synthetic coding sequence
atgttgggcctgtggggccaacgcctgcccgcagcttgggtgctgctacttttaccgttcctgccactcttactgctggccgctccggcacctcatcgcgcctcttataaacccgtgatcgtcgtgcacgggctctttgactcgagttactcatttcgccacttgctagagtacatcaacgaaactcacccaggtacagtcgtgactgtgcttgacctctttgatggccgggaatccctgcgtccactctgggagcaagttcaggggtttcgcgaagctgtggtaccgattatggcgaaagcgccccagggtgtgcaccttatttgctacagccagggcggactggtctgtcgagcccttctgtcagtaatggatgatcacaacgtagactcctttataagtctttcatcccctcagatgggacagtatggagacactgactacctgaaatggcttttcccaacgtcaatgcggagtaatctctatcgtatttgttacagcccttggggacaggagttttcaatctgcaactactggcatgatcctcatcatgacgatctgtatctgaacgcctccagcttcctagcactcatcaacggagagcgggaccatccgaacgctaccgtttggcggaagaatttccttagggtggggcacttggttctcattggtggccctgatgacggtgtgattaccccttggcagagttccttctttggcttctatgatgctaacgagacagtattagaaatggaggaacagctgcctgcccggcccacccaccagtccgaactgctgctgcttcgcctcgtctgcttgaaacccccacggaggaagaagcctgcatgtagggtacaacgacagagcgagagctgggggccgggcctctcttgcgcgttgtcttag

SEQ ID NO: 127830 - DNA, 909 bp, Artificial Sequence
  Description of Artificial Sequence: Synthetic coding sequence
atgcttggcttgtgggggcagcgcttgccagcggcttgggtgttgcttctgctgccttttctcccccttctgttgcttgctgctcccgcaccgcaccgcgcgagttacaagcctgtcattgtggtacatggcctcttcgactccagttactcctttcggcatctactggagtacatcaacgagacccaccctgggacagtcgtgaccgtcctcgacctgtttgacgggcgggaatccctgaggcccttgtgggagcaggtccaagggtttagggaagctgtggtgcctataatggctaaagccccgcagggggtccatctcatctgttacagtcaaggcggcctcgtatgtagagcactgctcagtgttatggatgatcataatgtcgacagcttcattagccttagctctccccaaatgggacagtatggggatactgactatctgaagtggttgtttcccaccagcatgaggtctaacctgtatcgcatttgttatagtccttggggacaggaatttagcatttgcaactactggcacgatccccaccacgacgatttgtacttaaatgcttcgtccttcttggctctcatcaatggggagcgcgaccacccaaacgcaaccgtgtggcggaagaactttctacgcgttgggcacctggtcctcatcggcggcccagatgatggagttattacaccgtggcaatcaagcttcttcgggttttacgatgccaatgaaacagttctagaaatggaggagcaacttgtgtacctgcgggactcctttggtttaaagactctgctggcaagaggggcaatcgtgcggtgccccatggccggaatctcccacactgcttggcacagtaaccgcaccctgtacgagacgtgcattgagccgtggctctcatag

SEQ ID NO: 127831 - DNA, 3606 bp, Artificial Sequence
  Description of Artificial Sequence: Synthetic coding sequence
atgaatttcgaggggttagacccaggccttgctgaatacgcacccgccatgcacagcgcactcgaccctgtgctagatgctcacttgaatccttctctccttcagaacgttgagctggaccccgagggggtggcgctggaggccctgcctgtgcaggagtcggtccatatcatggagggtgtgtacagcgaattgcattccgtggttgctgaagtgggagtgcctgtgagcgtgagccactttgacctccatgaggagatgctctgggtgggatcacacggtggacatgcaactagttttttcggccctgcacttgagcggtattcgagctttcaggtcaatggcagtgacgacatccgccagatccaatccttagagaacgggattttattccttactaagaacaatctcaagtacatggcacggggaggacttataattttcgattacctcttggacgagaacgaagacatgcattcgctgttgctgaccgactcttcaaccttacttgtgggcgggctccagaaccacatcatcgagattgacctcaatactgtgcaggagacccagaagtacgcagttgaaacacccggcgtcactatcatgaggcaaaccaatcggttcttcttttgcggccatacgtcaggaaaagtctccctcagagatctcagaaccttcaaggtggaacacgagtttgatgcattctctgggtctctgtctgacttcgacgtgcatgggaacctgctggctgcatgcgggttttcctcccgtcttactggactagcctgtgaccgctttctgaaggtgtatgatctgagaatgatgagagcgatcaccccgctccaggtgcacgtggatcctgcttttctgaggtttatcccaacatacacaagtcgtctcgccattatcagccagtcgggccaatgtcagttttgcgaaccaaccggactggcgaaccccgccgacatatttcacgtgaacccagtcgggcccttgttgatgacatttgacgtgtcagcctctaagcaagcccttgctttcggcgattcagagggctgtgtgcatctctggaccgacagtcccgagccgagcttcaatccatacagccgggagacggagtttgctctgccatgccttgtggactcgctgcccccacttgactggtctcaggacttgctgccgctctcccttataccagtgccactcacgaccgacacgttgctcagcgattggccagccgcaaatagtgcccctgcccccaggcgcgcgcccccagtggatgccgagattctccgcacaatgaagaaggtaggttttatcgggtacgcccccaaccctcgcactagactaagaaatcagatcccttatcgtctgaaggagtccgacagtgagttcgattctttttcacaggttacggagtcccctgtcggccgcgaggaagagccgcatcttcacatggtatcgaagaagtatcgcaaggtgacgattaaatattccaaattagggctggaggatttcgacttcaagcactacaacaaaacactgtttgctggcctggagccacatattcctaatgcctattgcaattgtatgatccaggttctttactttctcgaacctgtgaggtgtttgattcagaaccatctatgtcaaaaggaattttgtctggcttgtgagctggggttcctgtttcatatgctggacctgtcacgaggagacccatgccaaggcaacaacttcctgcgtgctttccgcactatccctgaagcaagtgcgctgggattgattttagccgattccgacgaggcctccggaaagggaaaccttgccagactcatccagcggtggaaccgcttcattctgactcagctccaccaggatatgcaggaactggagatcccgcaggcctacaggggtgctggtggatctttctgtagttctggcgacagtgttatcggccagctgttctcctgcgaaatggaaaattgcagcctctgtaggtgcggctcagagacagtccgcgcctcctccactttgctatttacattgtcgtacccggacgggagtaaaagcgataagaccggcaagaactacgatttcgctcaagtcctaaagcggagtatctgtctcgaccaaaatactcaggcctggtgcgatacttgcgaaaagtaccagcctaccattcagactaggaacatcaggcacctgcccgatattctcgtcatcaactgtgaagtgaactcgtcgaaggaagctgacttttggcgtatgcaggctgaggtcgcattcaagatggcggttaagaagcacgggggggagataagcaagaacaaagaattcgccctggctgactggaaagagctaggctcacctgaaggcgttttggtttgtcccagcattgaggagttaaaaaatgtgtggctgccctttagcattagaatgaaaatgaccaagaacaagggactggacgtatgtaactggacggatggtgacgagatgcaatgggggcccgcacgagcagaggaggagcacggtgtgtacgtgtacgacctgatggccacagttgtccatatcctggacagccggaccggaggtagcctggtcgcccacattaaggtaggtgagacctatcatcagcggaaagaaggagtgacacaccagcagtggtacctgtttaacgatttcctgatcgagccaattgacaagcacgaggccgttcagtttgatatgaattggaaggtgcctgccatactgtattacgtgaaaaggaatctgaattctagatacaacttaaatatcaagaaccccattgaagcatccgtgctcctggccgaagcctcactggctagaaaacagaggaaaactcacacaacgtttattcccctgatgttgaatgaaatgccccagatcggcgacttagtgggcctggacgccgagtttgtcaccttgaatgaagaagaggcagagttacggagtgacggaaccaaatccactatcaagccctcacagatgtccgtagccaggatcacatgcgtgcgcgggcaaggcccaaatgaaggaataccttttatcgacgactatatatccacacaggaacaggtcgtcgattacctaacacagtattccgggatcaagccaggggatttggatgccaagatttctagcaaacacttaactacattaaaaagcacctacttgaaactgcgctttcttattgacatcggggtaaagtttgtgggccacgggctacaaaaggacttccgagtgattaatcttatggtgcccaaagaccaggtgttggacactgtatacctcttccatatgcctcgcaaacgcatgataagtctcaggtttctcgcatggtatttcttggatctgaaaatacagggcgagactcatgacagtatagaggacgccaggactgcactacagctctatcgtaagtatctcgaactgtccaaaaatgggactgagcctgaatcctttcacaaggtgctgaaaggcttgtatgaaaaaggcagaaaaatggactggaaggtccccgagcctgaggggcagacctcgccgaaaaacgccgccgtgttttccagtgttctggctctgtag

SEQ ID NO: 127832 - DNA, 3609 bp, Artificial Sequence
  Description of Artificial Sequence: Synthetic coding sequence
atgaattttgagggcctggatcctggcttggcagagtacgctcctgcaatgcattccgctttggacccagtgctggacgctcatctgaacccatcactgctgcagaatgtagagctcgaccctgagggtgtcgccctagaggctctgcctgtccaagaatctgtccacataatggagggcgtctatagtgagctccactctgtagtcgctgaggtcggggtacctgtatccgtcagccatttcgacctgcatgaagaaatgttgtgggttggaagccatggtgggcatgccacgagtttcttcggtcctgccttagagagatatagttcctttcaggtgaatggctctgacgacattcgccagatccagagcttggaaaatggcattctgtttctgaccaaaaataatttaaagtacatggcccgcggcgggctgatcatattcgactacttactggatgaaaacgaggacatgcacagcttgctgttgaccgatagctcaaccctgctggtgggcggactgcagaatcacatcattgaaattgatttgaataccgtgcaggagacgcagaaatatgctgtggagacaccgggagtgactattatgcggcaaactaacaggtttttcttttgcgggcacacctccggaaaggtctccctccgagatcttaggactttcaaagtcgagcatgaatttgatgcatttagcgggtctctttcggactttgacgttcatggaaatctgcttgccgcctgtggcttttctagcaggctgacgggcctggcatgcgatagattcctcaaagtttatgaccttcggatgatgagagcaataactcctttacaggttcacgtggaccccgctttccttcggttcattccgacctacacaagtagattagccatcatatcacaatctgggcagtgccaattctgcgagcctacgggcctggcgaatcccgcggatatcttccatgtcaatcctgtaggccccttattgatgaccttcgacgtgagcgcaagcaagcaggccctcgcttttggagactccgaaggttgtgtgcacttgtggaccgattcacctgaacccagcttcaatccctactcacgcgaaacggaatttgctctcccatgcctggtggattctttacctcccctggactggtcccaggatctcttacctctgtccctgattcccgtgccccttacaaccgacactctgttatctgattggccggctgccaattcggcccccgctccaaggagagcccctccggtagacgcggagatcctccgcacaatgaagaaggtaggattcattggatacgcacctaatccacggactcgcctaagaaatcagattccttataggttaaaagagtcagactctgagttcgacagcttcagtcaagtaacagagagccccgttggccgagaggaggagccccatctacacatggtgtctaaaaaatatagaaaggtgaccataaagtatagtaaactcggactggaagacttcgactttaaacactacaacaagaccctcttcgccgggttagagccccacatcccaaatgcatattgcaactgtatgatccaagtgttatacttcctggagccagtcaggtgtctcattcagaatcacctttgccagaaggagttttgcctggcctgtgagctcgggttcctcttccacatgcttgatcttagcaggggtgatccttgtcaaggcaataacttcttgagagcctttcgtacaatcccggaggcatctgctctgggactcatcttggctgactccgatgaagcaagtgggaaggggaacctggccaggcttatccagaggtggaatcgatttattctcacacaactccaccaggacatgcaggagttagagatacctcaggcataccgcggcgctggcggaagtagtttctgttcaagcggtgatagtgtaatcggccagctcttttcttgcgagatggagaattgtagcctgtgtaggtgcggcagcgagacagtcagggcaagtagcacactgctgtttaccctatcatatccggatgggtcaaaatcggataagacaggcaagaattacgatttcgcacaagttctaaagcgatcaatatgtcttgaccagaacactcaggcatggtgtgacacttgcgagaagtatcaaccaacaattcaaacacgcaatatcaggcatttgcctgatattctggtgatcaactgtgaagtgaactcctcaaaggaggccgatttctggcgcatgcaagccgaggtcgcctttaaaatggctgtgaaaaaacacggcggcgagattagcaagaataaggagtttgccctagccgattggaaggagctgggcagcccagaaggcgttctggtttgtccctctatcgaggaattaaagaatgtctggcttcctttcagcattaggatgaaaatgacgaagaacaaggggctggacgtatgcaattggaccgacggagatgaaatgcagtggggtccggcccgcgcggaggaggagcatggagtctacgtgtacgacctgatggctaccgtcgtccacatcttagactctaggaccgggggatccttggtggcccacatcaaggttggcgagacttatcatcaaaggaaggagggagtgactcatcagcagtggtatttatttaacgactttcttatcgagcccattgataagcatgaggccgtccagtttgatatgaactggaaagtaccagcgatcttatactacgtgaaacgtaacctcaattcgcgatataacctgaacatcaagaatccaatagaagcctccgtgttactggcagaggctagtctggctcggaagcaacgcaagacccatactaccttcattccattgatgctgaatgaaatgccccagattggggacctagtcggcttggacgccgaatttgtgaccctcaacgaggaagaagccgaactgcggtccgatggcaccaagtctactataaagccctcccagatgtccgtggccagaatcacatgtgtcagaggccaggggccaaatgaggggattccttttatcgatgactacataagcacccaggaacaggtcgtcgactatttaacacagtactctggcatcaaacccggcgacctggacgccaagatctccagtaaacacctcaccacactaaaatctacctatctgaagttgaggtttctgatcgacatcggagtcaaatttgtaggtcacggactccaaaaagacttcagagtgatcaacctgatggtccccaaggaccaggtcctggatactgtatatttgtttcatatgccaagaaagcgaatgatatcactaaggttcctggcctggtactttctggacttaaaaatccaaggtgaaacacacgattcaattgaggatgcccggactgctctgcagctttataggaagtatctggaactgagcaagaatggcacagagcctgagtcttttcataaggttctcaaaggcctgtatgaaaagggacggaagatggactggaaggtgccagaacccgagggtcaaactagtcccaaaaatgccgccgtcttctcctcggtcctcgctctctag

SEQ ID NO: 127833 - DNA, 3597 bp, Artificial Sequence
  Description of Artificial Sequence: Synthetic coding sequence
atgaactttgaaggcctggaccctgggctggcagaatatgcccctgccatgcactccgccctggatccagtgctcgacgctcatctgaacccgtccctgttgcagaacgtggaattagaccctgagggagttgcactggaggcactccctgtgcaggaatcggtgcacattatggaaggggtctattccgagttgcattcggttgttgcagaagtgggagtaccggtctccgtgtcacacttcgacctgcacgaagagatgttatgggtggggagtcatggcggacatgccaccagcttttttggccctgccctggaaaggtattctagctttcaggtgaatggaagtgacgacattaggcagatccagagcctggagaatgggattctctttctgactaagaataacttgaagtacatggcccgagggggattgattatattcgattatctgctggacgagaacgaggatatgcattcgttattgctcaccgattcctcaacactcctggtgggcggcttgcagaaccatataattgagatcgatctgaatacagttcaggaaacacagaagtatgcagtggagaccccaggagtgactataatgaggcagacaaatagattctttttttgcggccatacttctgggaaggtgtccctaagggacttgcgaaccttcaaagtggaacacgaattcgatgcgtttagcggcagtctgtctgacttcgacgtgcacgggaaccttctcgctgcctgcgggtttagcagtcgactcactggcttggcatgtgaccggtttctgaaggtttatgacttgcggatgatgcgagctatcacccccctccaggtgcatgtcgatcccgcatttttgagattcattccaacatatacgagtcgccttgccataatcagccagtcgggccagtgccagttttgtgagcctactggtcttgctaaccctgccgacattttccatgttaaccctgtgggccccctcttgatgacctttgatgtgtcagccagtaagcaggcacttgccttcggtgacagtgaaggatgcgtgcatctttggacagacagtccagagccctcgtttaatccatactctagggaaaccgaattcgcactgccgtgccttgtggatagcctgccacccctcgactggagccaggatctgctcccactgagccttattccagtacccctcacaaccgacacactgctctccgactggcctgccgccaacagtgccccggcgccccgaagagctccaccggtggatgcagagattcttagaacgatgaagaaggtcggttttatcggatatgcccctaaccctaggacaagactcaggaatcagatcccgtaccgtctgaaggagtccgactcagagttcgactctttttcccaagtgaccgagtcacccgtcgggcgcgaagaagagccacacctgcacatggtgagcaagaagtatcgtaaggttacaatcaagtattccaaattgggcctggaagatttcgatttcaaacactacaacaaaacactatttgctgggcttgagcctcatatacccaacgcgtactgtaactgcatgatccaggtcctctatttcctggaacctgtccggtgtctgattcaaaaccacctctgccagaaggaattttgtctggcttgtgagctggggtttctgtttcatatgcttgatctcagtcggggggacccatgccagggcaacaactttcttcgagccttccgcactatcccggaggcatcagcactgggcctgatcctggctgattcagacgaggcttccgggaagggcaacctggcccgcctaattcaacgctggaaccgcttcatcctgacacaattacaccaagacatgcaggagttagagatccctcaggcgtacaggggagccggcggctcaagcttctgcagtagcggtgacagcgtgattggacagctctttagttgtgagatggagaactgctctctgtgtcgctgcggctctgaaaccgttcgggcgtctagtaccttactcttcacactgagttatcccgatgataagaccgggaaaaattacgattttgcccaggtacttaaaaggagtatctgtctggaccagaacacccaagcctggtgcgacacatgtgagaaatatcagccaaccatccagacgagaaacattagacatcttcctgatatactggtgatcaactgcgaagttaactcctctaaggaagcggatttctggcgcatgcaagcggaagtggcctttaagatggcggtgaagaaacatggcggcgaaatttccaaaaataaggagttcgcactcgcagactggaaggagctgggctctcccgagggagtgctcgtgtgcccatcaatcgaagaattaaagaatgtttggctcccctttagtatccgcatgaagatgaccaagaataagggtcttgatgtttgtaactggacagacggcgacgaaatgcagtgggggcctgcccgagccgaagaagaacacggcgtgtatgtatatgatttgatggcaactgtggtgcacatcttagactctcgcaccggcggtagtcttgtcgcacacattaaagtcggtgaaacctatcaccaacgcaaggaaggcgtgacgcatcagcagtggtatctgtttaacgattttctgatagagccaatcgacaaacatgaagctgttcagttcgacatgaactggaaggtgcccgccattctctattacgttaaaaggaacctgaattcccgatacaaccttaacattaaaaaccctatagaagcgagtgtactgcttgccgaagcgagcctggccagaaagcagcgtaagacacacacgacctttatccctttgatgctgaatgagatgcctcagataggggatcttgtgggacttgatgccgagttcgtcacactgaacgaagaggaggctgagctgagaagtgacggaacgaagtctaccataaagccttcacagatgagtgtcgctcggataacctgtgtccgcggacagggaccaaatgagggtatcccattcattgatgactacatttctacacaggagcaggttgttgattatcttacacagtattctggtatcaagcccggcgacctagacgccaaaatctcatccaaacacttgaccacgctgaaaagcacttacctgaaacttcgattcttgatagatatcggagtgaagtttgttggccatggactccagaaagacttccgcgtcattaacctgatggtgcctaaagaccaggtcctggatactgtctatttgttccatatgccccgcaagcgcatgatatcactacgcttcttggcatggtattttctcgatctgaaaattcagggggaaactcatgacagcattgaagatgcgaggacagcattgcagctatatcggaagtaccttgaactgtccaagaatgggaccgagccggaatcttttcataaggtacttaaaggcctgtatgagaagggtcggaagatggactggaaggtgcctgagccggagggccagaccagccccaagaacgctgcggttttctcctctgtgttggcgctctag

SEQ ID NO: 127834 - DNA, 3609 bp, Artificial Sequence
  Description of Artificial Sequence: Synthetic coding sequence
atgaatttcgagggcctggatcctggccttgctgaatacgctcctgccatgcattccgcactggaccccgtcctggacgcccatcttaacccctccctgctgcaaaatgtagaattagacccagagggtgtggccctcgaggccctacccgtacaagagtccgtacatattatggagggggtatactcagagctgcattccgtggttgctgaggtgggcgtccccgtgtcagtctcccattttgacctgcatgaggagatgctgtgggtggggtcccacggaggccatgccacaagcttcttcgggccagctctcgagaggtattcaagcttccaggtcaatggttctgacgacattcggcagattcaaagcctcgaaaacgggattctttttcttactaaaaataacctgaaatatatggccaggggcggactcattatctttgattacctactggatgagaatgaggatatgcatagcctgcttctaaccgattcatcgacgcttctggtgggcggattacaaaatcacatcatcgaaattgaccttaatactgttcaggagacacagaaatacgcagtggaaacgccaggggtgacgataatgaggcagaccaatagattttttttctgtgggcacaccagtggtaaagtgagcttgcgggacctcaggacgtttaaggtcgagcatgaattcgacgcatttagcggtagtctaagcgatttcgacgtccatggaaatctgctggctgcatgcggtttcagttctcggctgacaggactggcctgcgaccgctttctaaaggtttacgaccttagaatgatgagagccattacccctcttcaggtgcatgtcgatcccgccttcctgcggttcataccaacatatacttcccgattggccatcataagccagtctggacagtgccagttttgcgagccaaccggattggccaatccagctgatattttccacgttaaccccgttggtcccctcctgatgactttcgacgtttccgcctccaaacaggcactggcctttggcgattctgaagggtgtgtgcatctgtggactgacagccctgaaccttcctttaatccctactctcgggagactgagtttgccctgccttgtctggtggatagtttacccccccttgactggagccaggatctcttgcccctgtccctgatcccagtcccccttactactgataccctcctgagtgactggccggctgccaattctgcccctgccccccgtcgggcaccccccgtcgatgctgaaattctgcggacaatgaaaaaggtagggttcataggttacgcccccaaccctaggactaggttgagaaatcagatcccttaccgactaaaagaatcggacagtgagtttgattcgttcagccaggtaaccgagagcccggtcggcagagaagaagagccccatctacatatggtctcaaaaaaataccggaaagtgacaattaaatactccaaactcggcctggaggatttcgattttaaacattataataagaccctattcgcaggacttgagccacacataccgaatgcatactgcaactgtatgattcaggtgctctattttcttgagcctgtgaggtgccttatacagaaccatctgtgccagaaggagttctgccttgcctgcgagctgggcttcctgttccacatgcttgacctatcacgcggagatccttgccagggaaacaactttctgcgcgccttcagaacgattcccgaagcctctgccttgggcctgatcctggcagatagcgatgaagcttctggcaagggcaatctcgccagactcattcagagatggaatagatttatcctgacccagctccaccaagacatgcaggaactggagattccacaggcttatcggggcgccggtggatcaagtttttgttcatccggcgattccgtgataggacagttgttctcctgtgagatggagaactgcagtctctgtcggtgcgggtctgagaccgtcagagccagctctactttactatttactctttcgtatccagacggatcaaaatctgacaaaactggcaaaaattacgatttcgcacaggtactaaagcgatctatctgtttagatcagaacactcaggcgtggtgtgacacctgcgagaagtaccaacccaccattcagactcgaaatattcggcacctgccagatatcttggtcattaattgtgaggttaattcttccaaggaggctgatttttggcgaatgcaggccgaagtcgcctttaagatggccgtgaagaagcacgggggtgagatttctaaaaataaggagtttgcactcgccgattggaaggaacttggatcaccggagggagtgctagtctgtccgagtattgaagaactcaaaaatgtatggctgcctttttctattaggatgaagatgacgaagaacaaggggctagacgtctgtaactggactgatggagacgagatgcagtgggggccagccagggccgaggaagagcatggcgtgtacgtgtacgatctcatggctaccgtcgtgcatatactcgattcgagaaccggcggtagtctggttgctcacatcaaggtgggcgagacgtatcatcaacggaaggaaggagtgacccaccaacagtggtacctgtttaacgatttccttattgaacccattgataagcacgaggcagttcagtttgacatgaactggaaggtgccggctatcctctattatgtcaagagaaacctcaatagcagatataacttgaacatcaagaatcctattgaggcgtccgtgctgttggcagaagcttcccttgcaaggaagcagcgtaagacccataccacattcatcccgctgatgcttaacgagatgcctcaaatcggtgacctagttgggctggacgcggaattcgtcactttaaacgaagaagaggccgaactgcgctctgacggaacaaaatccaccatcaagccttcacagatgagcgtagctcgaatcacatgtgtacgtggacaaggaccaaatgaaggaattcctttcatagatgactatatctctacccaagaacaggtcgttgattatctgactcagtatagtggcattaaacccggcgacctggatgccaagatatctagtaaacatctgaccactttgaaaagtacatatcttaagcttagattcctgatagacattggcgtaaaatttgttggccatggcttgcagaaggacttccgagtcatcaacctcatggtgcctaaggatcaggtgctggacacagtttatctctttcatatgcctaggaagaggatgatcagccttcgtttccttgcttggtactttctcgatttgaagatacaaggggaaactcacgacagcattgaggacgctcgcactgccctgcagctctaccgaaaatatttagaactgagcaaaaacggtactgaaccagaatcctttcataaagtcctgaaggggttatacgagaagggtagaaaaatggattggaaggtcccagagcctgaagggcagacaagtcccaagaatgctgcagtgttcagttccgtgttagccctctag

SEQ ID NO: 127835 - DNA, 987 bp, Artificial Sequence
  Description of Artificial Sequence: Synthetic coding sequence
atggacgccgtgctgctggagcatttcccaggcggacttgatgcttttccatcatcatacttcgatgaggatgacttctttactgaccaaagctctagggatccactggaagatggtgatgaactcttagcagacgagcaggcagaggtcgaattccttagtcatcagctccatgagtactgctatcgggatggcgcctgcctgctgctccagccagcgcccccagctgcccctctggcgcttgccccaccctcttccgggggcttaggtgagcctgatgacgggggaggaggaggatactgttgcgaaactggagcccctcctggcgggttcccctactcccctggctctcccccttcatgcctcgcatacccttgtgccggggccgcagtgctgtcccctggggcccggctcagaggcctgtctggggcagctgccgcggccgcacgtaggcgtcgacgggtgcggagcgaagcagagcttcagcagctgaggcaggcagccaacgtccgcgagcgcaggagaatgcagtccatcaatgatgccttcgaggggttaagatcacatattcccaccctgccgtacgagaaacgcctgagcaaggtggatacacttagacttgcgattgggtacatcaatttcctgtctgagctggttcaggcagacctgcctcttaggggtggtggtgctggaggatgcggcggtcctgggggcggcggcaggctcgggggcgattctcctggttcccaggcacagaaggtgattatctgtcatcgcgggactaggtctccctcacccagtgatcctgattatggcctgccacccttggccggccacagtctctcgtggaccgacgagaagcagctcaaggaacagaatataatacggacagccaaggtgtggacgcctgaggaccccaggaagctcaacagcaagagcagcttcaacaacattgagaacgagcccccatttgagttcgtgtcatag

SEQ ID NO: 127836 - DNA, 852 bp, Artificial Sequence
  Description of Artificial Sequence: Synthetic coding sequence
atgaatggcgaggaacagtactacgcagcaactcaattatacaaggatccctgcgctttccagcgagggcctgctcccgaatttagcgcctcgccacctgcatgtctctatatgggccgccagcccccgcctccacccccacatccttttcccggagctctcggggctcttgagcaaggcagcccaccagatatctccccctatgaagtgcctccactcgcagacgatcccgccgtggcacacctgcatcatcatctgcccgcccagcttgcgctgccccatcctccagccggcccatttccagaaggagccgagccaggagtgctcgaggagcctaatcgagttcaactgccattcccttggatgaaaagtaccaaggcccatgcctggaaggggcagtgggcgggcggagcatacgccgctgagcccgaggagaataaaaggaccagaaccgcttatacaagggcccagctcctggaactcgagaaagagttcctattcaacaagtatatctctcgccctcgccgggtggaactggcagtgatgctgaatctgaccgaacggcatatcaagatttggttccagaatagacgaatgaagtggaaaaaggaggaagataagaaacgcggaggggggacggccgttgggggcggcggagtcgccgagcctgagcaggattgcgcagttacaagcggagaggaattactggcccttccaccccccccccctcccggaggggcagtgccacccgccgcacctgtggccgctcgtgaaggaagacttcctcccggtctcagcgccagtccacagccttcttctgtcgctcctagaagaccccaagaaccccgatag

SEQ ID NO: 127837 - DNA, 1398 bp, Artificial Sequence
  Description of Artificial Sequence: Synthetic coding sequence
atgctgcctctctggacactgagcctgctcttgggggccgttgcgggaaaggaagtgtgctacgagcggcttggctgtttttctgatgattccccttggtctggcattacagagagacctctacacattctgccttggtctcctaaagatgttaacacacgatttctgctttacactaacgagaaccccaacaactttcaggaggtggcagccgatagctcatccatctcgggcagtaatttcaaaaccaatcgcaaaacaaggtttattatacatgggtttatagacaagggagaggagaattggctagccaatgtctgcaaaaacctcttcaaagtagagagtgtgaactgtatttgtgtcgactggaagggcggctcaaggacaggctatactcaggcaagccaaaacattcggatcgtgggagcagaggtggcctactttgtagaattcctccagagtgctttcggctattccccatccaatgtgcacgtcattgggcactccttaggagctcacgccgctggagaggctggtagacgcacaaacggcactataggccgcattacagggctggaccccgctgaaccatgttttcaaggaacccctgagttagtcagactcgatcctagcgacgctaaatttgtagatgtgattcatactgatggggcccctatcgtgcccaatcttggattcggcatgtcccaggtggttggtcacctggatttcttccctaatgggggagtagagatgccgggatgtaagaaaaacatactgtctcagatcgtagatatcgatggaatatgggagggcacaagagattttgctgcttgtaaccacctgaggtcttataagtattacactgacagcatcgtgaatccagatggttttgccggctttccatgtgccagctacaacgtttttaccgcgaacaaatgttttccgtgtccctcaggcgggtgccctcagatgggacactatgctgaccgctaccctggcaaaaccaacgatgtgggccagaaattttatttagacacaggagatgcctcgaatttcgctcggtggagatataaggtttccgtgaccttatctgggaaaaaggtgacaggtcatattctggtgagcctcttcggcaacaagggtaattcgaagcagtacgagatcttcaagggcacactgaagcccgattctactcattccaatgagtttgatagcgatgtggacgtgggagatcttcagatggttaaattcatttggtataacaacgtgataaaccctacccttcctagggtcggcgcctctaagattatcgtcgagactaacgttggtaagcagttcaacttctgttcacccgagaccgtaagggaggaagttttactgaccctgactccttgctag

SEQ ID NO: 127838 - DNA, 3372 bp, Artificial Sequence
  Description of Artificial Sequence: Synthetic coding sequence
atgaacagcccaaacgaatctgctgacggcatgagcggtcgagagccttctctggagattttgccccgaactagtttgcactcgattccagtaacagtagaagtcaaacctgtacttcctcgtgctatgcccagttctatggggggaggaggaggaggttctccatcaccggtggagctgaggggagcactagtgggcagcgtggatccgaccttgagggagcagcaactgcagcaggagctgctggcccttaagcagcagcagcagctgcagaagcaactactattcgccgaatttcagaaacagcatgaccatcttaccaggcagcacgaagtccagctgcagaagcatctgaaacaacagcaggaaatgctggccgcaaagcagcagcaggaaatgttggctgcaaaacgccagcaggagctggaacagcagcggcaacgcgagcagcagaggcaggaagagctggaaaagcaacgactcgagcaacaactgctgatccttagaaataaggaaaagagtaaagaatctgctatcgctagtactgaggtcaaactgaggctgcaggagtttttgctttccaagtcaaaggagccaactcctggcgggctcaatcatagcctgccccagcaccccaaatgttggggagcccaccacgccagtctcgatcagtccagtccaccgcagagcggaccgcctggcacccctccctcttacaagctacccctgcctggaccgtacgatagtcgagacgattttcccctccgcaagacagcttccgagcctaatctgaaggtgcgtagccgcttaaagcaaaaagtggcagagcgccgatcttcacccctgttgaggaggaaagatggaaccgtgatatcaaccttcaaaaagcgggctgtggagatcaccggtgccgggcccggagcttcttcagtatgcaactccgcccccggttctggacccagctccccaaatagctctcacagtactattgctgaaaacggatttacaggctccgttccgaacataccaactgaaatgctgccccagcatcgggccctcccactcgatagcagcccaaaccagttcagtctctataccagtccaagtttaccaaacatctccctgggtttgcaagccaccgtaacagtaacgaatagccacctcactgcttctccaaaactgagcacacagcaagaggcagagaggcaggcgctgcagtcgttgagacagggcgggacactgacagggaaatttatgtcaaccagcagcattcctggttgccttttaggagtggccctggaaggcgacggctctcctcatggccacgcgagcctgctccagcacgttctgctactcgagcaagcacgccagcagtccacgcttatcgccgtcccccttcacggacagtctcccctagtgaccggcgagcgtgttgcaactagcatgaggacagtgggtaaactgccccggcaccgaccactgagccggacgcagtcttccccgttgccccagtcaccccaggcgctgcagcagctggtcatgcagcagcagcaccagcagtttttggagaaacagaaacagcagcaattacagttaggaaaaatcctgaccaagactggggaactgccacgccaaccaacaactcacccagaggaaacggaggaagaactgactgaacaacaggaagtccttttgggggagggcgctctaacaatgcccagagagggaagcacggaaagtgagagcactcaagaagacctggaggaagaggatgaagaagacgatggcgaggaggaggaggattgcatccaagtcaaggacgaagaaggtgagagtggggcggaggagggccccgatttggaagaaccgggtgctggatacaagaaactgttcagtgatgctcaacccttgcagccgctccaggtgtaccaggctccactgagtctcgcaacagtgccacaccaggcgctgggaagaactcagtccagccccgcagcgccagggggaatgaagagtccacctgatcagcctgtgaaacacttatttacaaccggggtggtgtatgatacatttatgctgaagcatcagtgcatgtgcgggaacacccacgtccacccagagcacgccggcagaatccagtcaatctggtccaggttacaggagacaggcttgctatctaagtgcgagagaattagaggacggaaagccacattggatgaaattcagaccgttcactccgagtaccacaccctgttatatgggacgtctccactcaatcggcaaaagctggactcaaagaaactgctggggcccatctcacagaagatgtacgccgtgttgccttgcggggggattggggtcgacagtgacacggtgtggaacgaaatgcatagctctagtgctgttaggatggctgtgggatgcctgctagagttggcgttcaaggtggcggcaggcgagttgaagaatggattcgccatcatcagaccacctgggcaccacgcagaagaatccacagctatgggtttttgctttttcaactctgtggccatcaccgctaaactgctgcagcaaaaactgaatgtcggcaaggtcctgattgtggattgggacattcatcatggtaatggaacgcaacaagctttttacaatgacccttcggtgttgtatattagcctgcacaggtacgataatgggaatttcttccccgggtcaggcgctccagaggaagtcgggggcggacctggcgttgggtacaacgttaatgttgcttggacagggggagtggacccccctattggggatgtcgagtatctcacagccttccgaactgtggtcatgccaatcgcccacgaattttccccggacgtggtgcttgtctccgccggattcgacgcggtggaagggcatctgagccccctcggcggatattctgtgactgcaagatgctttgggcatctgaccaggcagctgatgacactggcagggggtagggtcgtactggcactcgaaggtggccacgatctgactgcgatatgtgacgctagtgaggcctgtgtatcggcgctgctgagcgtggagctgcagcctcttgatgaagctgtcctgcagcaaaaaccaaatatcaacgccgtcgccacactggaaaaagtcattgagatccagtcaaagcattggtcctgcgttcaaaagttcgccgcaggcctcgggcggtctctgagagaggcccaagcgggtgagactgaagaggctgaaactgtgagtgcaatggcccttctgagcgtgggggccgagcaagctcaggcagcggcggccagagaacactcccctcggccggctgaagaaccaatggagcaggaacccgcgctgtag

SEQ ID NO: 127839 - DNA, 1128 bp, Artificial Sequence
  Description of Artificial Sequence: Synthetic coding sequence
atgaatacaagccatcttctggctctgctgctccctaaaagcccccagggggagaaccgatcaaagcccttgggcactccgtataatttctcggagcactgtcaagattcggtcgatgtgatggtgtttattgtcactagctactctatcgagacggtggtgggcgtcctggggaacctctgcctcatgtgcgtgacggtgagacaaaaagagaaagcgaacgttacaaatctcctcatcgcgaaccttgctttctcagattttttgatgtgtctgctctgccagcctctaacagctgtgtacacaatcatggactattggatctttggcgagacactatgcaaaatgagcgcgttcattcaatgtatgtctgtaacagtgtccatactgtctctggttctcgtggcactagagcgtcaccaactcataataaatccgaccggttggaagccgtccatctctcaggcctacctcgggatagtgcttatttgggtgattgcctgcgtgttgtcattgccattcctagctaatagcattcttgagaacgtgtttcataagaatcactccaaagccctcgagttcctggcagacaaagtggtttgtaccgagtcttggcccttagcgcatcaccggactatatacaccacattcctgctgctctttcagtattgtctgccactaggattcatcctggtctgctatgcaaggatttatcggcggttgcagcgtcagggacgtgtgttccacaagggtacctacagtcttcgggcgggtcacatgaaacaagtgaatgtcgtgcttgtcgtgatggtggtggcgttcgcggtgctgtggctgcccttgcacgtgttcaactcgctggaagattggcatcatgaagcaattccgatctgccacggaaatcttatcttcctagtgtgtcatttgctggccatggcatccacatgcgtgaaccccttcatctacgggttcctgaataccaacttcaagaaggaaataaaagctctggtgttgacttgtcagcagtccgcacctttggaggaaagtgaacacttgcctctgtcaaccgtgcataccgaggtcagcaaaggttctttgagactgtctggacggtctaatcctatttag

SEQ ID NO: 127840 - DNA, 1128 bp, Artificial Sequence
  Description of Artificial Sequence: Synthetic coding sequence
atgaacacctcacacctacttgcattattactgcctaagtctccccagggcgagaatagatctaagccgctgggcacaccttataactttagcgaacattgccaggacagtgtggatgtaatggtgttcattgtgaccagttactctatcgaaaccgtggtgggagtgctcggcaatctctgcctgatgtgtgtgacggtccgccagaaggagaaggccaacgtaactaacttgctaatcgccaatttagcctttagtgatttccttatgtgtttattatgccagcctctgactgccgtctacacaattatggattattggatcttcggcgagacactctgtaagatgagtgcattcattcaatgcatgagcgtgaccgtttctattctttctctggttctggtcgctctggagaggcaccagttgattatcaatcccactggatggaaaccttccataagtcaggcctacttgggaatcgtgttaatctgggtgattgcatgtgtactctctctgcccttcctggcaaatagtattctcgagaacgttttccataaaaatcactcaaaagccctggaattcctggcagataaggtggtgtgcaccgaatcatggccgctggcacaccacaggacaatatatacaacatttctactgctctttcagtattgtcttcctttggggtttatcctcgtctgttacgccagaatctatcggagactgcaacgacaagggagagtgttccacaaaggcacgtattccctccgggccggtcacatgaagcaggtgaatgtggtcctcgttgttatggtggtggcattcgctgttttatggctgcctctccatgtattcaacagcctggaagactggcaccacgaggcaatcccaatctgccacgggaatcttattttcctggtgtgtcatctattggctatggccagtacttgcgtcaatccgtttatttacggattcctgaacaccaattttaagaaggagatcaaggccctcgtcttgacctgccagcaaagcgcacctctggaggaatcagagcaccttcccctgtcaacagtgcatactgaagtgagcaagggtagtttgagactctccgggcgaagcaatcctatctag

SEQ ID NO: 127841 - DNA, 1797 bp, Artificial Sequence
  Description of Artificial Sequence: Synthetic coding sequence
atgctcaagctggttggaggcggcggcggacaggattgggcgtgttctgtggctggcacatcattgggcggagaggaggccgcattcgaggttgccaggcccggagaccagggaaaagcaggcgggggatctcccggctggggctgcgcgggtatccctgactctgctccaggcgcaggggtcctgcaggccggcgcagtgggccctgcgcggggagggcagggtgccgaggaggtgggggagagtgccggcggaggcgaagagcgcagggttcgccacccccaagcacctgctctccgcctgctgaatcgcaagccgcaggggggaagcggggaaatcaaaacaccagaaaacgatctccagcgaggaagactctcacgaggtccccggaccgctccaccggccccaggaatgggagaccggtctgggcaacaggaaaggtccgtaccccatagccctggagcccctgtcggcactagcgcagctgctgtcaacggcctcctgcacaacggcttccaccccccaccagtgcaaccgccccacgtatgctcgaggggccccgtggggggaagcgacgccgcaccgcagaggttgcccttgctccctgagttacagccacagcccctgctaccccagcatgactcccccgctaaaaagtgtcgccttcggcggcgcatggattctggaaggaaaaaccggcccccttttccatggttcgggatggatattggcggtaccctggtgaagttagtttacttcgagcccaaagatattactgccgaggaggaacaggaagaagtagagaatctcaagtccattcgcaagtacttaacaagtaacaccgcctatgggaaaaccggcatcagagacgtacacctggagctgaagaatctgacaatgtgtggtaggaaaggcaacttgcatttcatacgtttccccagttgcgccatgcaccgattcatacagatgggttccgaaaaaaacttcagctccttgcacaccactctgtgcgcaacaggcgggggggccttcaagttcgaggaagacttccgcatgatcgcggatctacaactgcacaaactagacgagctggattgcctaattcagggtctattgtacgtagactcagtgggattcaatgggaagcctgaatgttactacttcgagaacccaactaatccagagttatgtcaaaaaaagccctattgtctggataatccatacccaatgctcctcgtgaacatgggatccggcgtatctatactcgcagtatattcaaaggacaattataaacgcgttacaggcaccagcctgggcggggggacgtttctgggcctgtgctgtctcttgacaggatgcgagacattcgaagaagccctggaaatggccgccaaaggtgattccaccaatgtggataaactcgtaaaggacatttacggcggggactatgagcgtttcggcttgcagggcagcgctgtcgcaagctctttcggcaacatgatgagtaaggaaaagcgcgattctatctcgaaagaagatctggcacgagctacactagtaacaatcaccaacaacattggctctattgcccgtatgtgcgccctgaatgagaacatcgaccgcgtggtgtttgtcggcaattttctcagaattaatatggtgtcgatgaagctcttggcgtacgcgatggatttttggtcaaaaggccaactgaaagcgctgtttctcgaacacgaaggctacttcggcgcggtaggcgcacttctagaactgtttaagatgactgatgacaaatag

SEQ ID NO: 127842 - DNA, 945 bp, Artificial Sequence
  Description of Artificial Sequence: Synthetic coding sequence
atgaagttgatcaatggtaaaaaacagaccttcccctggttcgggatggatattgggggcactctggttaaattggtgtacttcgagcccaaggacatcaccgcggaagaggagcaggaggaggtggaaaatcttaaatcaattagaaaatatctcaccagcaacaccgcctacgggaaaacaggaatacgggacgtgcatctagagttgaagaaccttactatgtgcggcagaaagggaaatctgcactttatcagattcccaagctgcgctatgcaccgtttcatccagatgggatcagagaaaaatttctccagcctgcataccactctctgcgctaccggcggaggggcctttaaatttgaggaggattttagaatgattgccgacttgcaactccacaagctggacgaactggactgtctcatccagggcctactgtatgtagactccgtcggattcaatggcaaacccgagtgctactattttgagaatcccactaaccccgaactgtgtcagaaaaagccttactgcctagataatccataccccatgctgctggtgaacatggggagtggggtgtctatcctagccgtatatagcaaggataattataaaagggtaactggcacaagtttcggaaacatgatgagcaaagaaaagcgcgattccatctctaaggaggatttggccagagccaccctcgtgactataacaaataatatcggctcaattgcgcgaatgtgtgccctaaatgaaaacattgacagagtggtgtttgttggtaattttctaaggatcaatatggtctccatgaagctgcttgcttatgccatggacttctggagtaagggccagcttaaggccctgttcctcgaacacgagggatacttcggtgctgtgggcgcactgctggaactatttaagatgacggatgataaatag

SEQ ID NO: 127843 - DNA, 1122 bp, Artificial Sequence
  Description of Artificial Sequence: Synthetic coding sequence
atgaagctgatcaatggtaaaaagcagacttttccctggttcggcatggatatcgggggaactctggtcaaacttgtgtattttgagcccaaggacatcaccgcagaggaagaacaggaggaggtggaaaacctgaagagcatccggaagtacctcacctccaatactgcgtatggcaaaacgggtatacgggatgtacaccttgaacttaagaacctgacaatgtgcggtaggaagggcaacctgcacttcatacggtttccctcatgcgccatgcaccgcttcatccaaatgggttctgaaaaaaactttagcagcctccacactaccctttgtgccactggaggaggcgctttcaagtttgaggaagatttcagaatgatcgcagatctccagctgcacaaactggatgaactcgactgtttaattcagggactgttgtatgtggattctgtgggcttcaatggcaagcccgagtgctactattttgagaatccgacaaatcctgagctgtgtcagaagaagccctactgcctcgacaatccgtacccaatgcttttggtgaatatgggctctggcgtttccatactcgcggtgtacagcaaagacaattacaagcgggtgacaggaacctctctggggggcggcacctttctcgggctttgctgtctattgactggttgtgaaacctttgaggaagctctggaaatggccgctaagggagattccactaacgtagataagctcgtcaaagacatttatggaggcgactacgaacgattcggcttgcaggggagcgctgtggcgtctagttttgggaacatgatgtctaaggagaagcgggatagcattagcaaagaggatctcgcgagggccactctcgttacgatcaccaacaacattggaagcatcgctcgaatgtgtgctctcaacgagaatatcgatcgggtggtgtttgtcggcaactttttacgcattaacatggtgtcaatgaagcttctcgcatacgctatggatttttggagtaagggccagctgaaggcactgtttctggaacatgagggctattttggcgccgttggtgctttgctagaactgtttaaaatgaccgatgacaaatag

SEQ ID NO: 127844 - DNA, 1203 bp, Artificial Sequence
  Description of Artificial Sequence: Synthetic coding sequence
atggccaaaagcaagcacgcactgcttccattctgccacggaatgatgcagcaagagggtctccaccaaatgcagtccctcgatctcgggctgctcagccttcaaaacagtttcccctggttcggaatggacatcggaggaacacttgtgaaattggtgtattttgagcccaaagatattacagcggaggaagagcaggaagaggttgaaaatttgaaaagcatccgtaagtatctgacgagcaacaccgcctacggcaaaacagggatccgagacgtccatctggaactcaagaacctgactatgtgtggtcgcaagggaaacttgcacttcatcaggttcccgtcttgcgccatgcaccggttcattcagatgggaagcgagaagaactttagcagcctacacaccaccctttgtgccaccgggggaggggccttcaagtttgaagaggacttccgtatgatcgccgacctacaacttcacaaactggatgagctggattgcctgattcaggggttgctgtacgtggacagcgtagggtttaacggaaagccagaatgttattactttgagaaccctacaaatcccgaactctgccagaaaaaaccctactgcctggataacccctatcccatgttgctggtgaacatgggttccggggtctccattttagctgtgtattcgaaagacaattataagagggtgaccggaacctccctcggcgggggaacttttctgggactttgctgcttattgacagggtgcgagacctttgaagaggctctggagatggcagccaaaggagatagtacaaacgtggataagctcgtcaaagatatctacggcggagattatgaaagatttggcctgcaggggtccgccgtggcctcatccttcgggaacatgatgtccaaagagaaaagagatagcatcagcaaggaagacttggctagagccaccctggttacaattactaataatatcgggtccattgctcggatgtgcgctctgaatgagaacattgatagggtagtgttcgtggggaacttcctgcgtattaatatggtctccatgaaattgctggcctatgctatggacttctggtccaaagggcagttaaaagccttgttcctggagcacgagggctacttcggcgccgttggtgccttgctggaactgttcaaaatgactgatgacaagtag

SEQ ID NO: 127845 - DNA, 1386 bp, Artificial Sequence
  Description of Artificial Sequence: Synthetic coding sequence
atgggcgatcgctctggccaacaggaacgatctgtcccccactcccctggagcccccgtcggcacctctgctgccgctgttaatggcctactgcacaatggctttcacccccctcccgttcagcctccccatgtgtgttcaagggggcctgtgggtggtagcgacgccgccccccagagattacccctgcttcctgaattgcagccccaaccactgctccctcaacacgatagcccagcgaaaaaatgccgcttgagaaggagaatggactctggacggaagaaccgtcctccttttccctggtttgggatggatataggaggcactctggtgaagctcgtgtacttcgagccgaaggacataacagctgaggaggaacaggaggaggtggaaaacctgaaatcaattagaaaatacctaacctctaacaccgcttatggaaaaacgggcattagggatgtgcatttggaactcaagaacctgactatgtgcggaaggaagggaaatctgcatttcatccgcttccccagctgcgccatgcatcgcttcatacaaatggggtctgagaaaaacttttcctctctgcatactacgctgtgcgccaccggaggaggtgccttcaagttcgaagaggatttcagaatgatcgccgacctgcagctgcataaacttgacgagctggactgcctgatccagggtctgctatatgttgactctgtgggatttaatgggaaacccgaatgttactacttcgaaaatcctacaaatccagaactatgtcagaaaaagccctactgcctggataatccatacccaatgctgcttgtgaatatgggatctggggtgagcattctggcagtgtatagtaaggataactataaaagggttacaggcaccagtcttggaggagggacattcctaggtctgtgctgtctgctcacaggatgcgagacatttgaggaggcacttgaaatggcagcaaaaggcgactctacgaacgtcgacaaactagttaaggacatctacggcggagattacgaaaggttcggattacagggtagcgccgtcgcttctagtttcggaaatatgatgtccaaagagaaacgtgacagcatatcaaaagaagacctagctagagctaccttggttaccatcacgaataacattgggagcatcgcccgtatgtgcgcgttgaacgagaatatcgacagggtagtgtttgttggaaacttcttaagaatcaatatggtctctatgaagctgcttgcctatgcaatggacttttggagtaaaggccagctgaaagcattgtttctggagcacgaggggtattttggagcagtcggggcacttcttgagctcttcaagatgaccgatgacaaatag

SEQ ID NO: 127846 - DNA, 1713 bp, Artificial Sequence
  Description of Artificial Sequence: Synthetic coding sequence
atgcgccgcttaggtcccttccacccccgggtccactgggcggctcctccatccctgtcctccggcctgcatagattgctattcttgaggggcacccgcattccatcctctactaccttaagtcctccacgtcatgactccttgagtctcgacgggggcaccgtcaatccccccagggtgagagagccaactggcagagaggcattcggcccaagtcccgcatcaagtgattggcttcctgcaagatggcggaacgggagaggaggtaggccaagggctcggctttgctctgggtggactgccgctgaggaagcgcgcagaaaccccactctaggtggtctcctcggcaggcagagactgcttttgaggatggggggagggcggctgggcgctccgatggagagacacggccgggctagtgcgacgtccgtgagctcggctggtgaacaagctgcaggcgatccagaagggaggagacaggaacctcttcgaaggcgggcgagttcggcctcggtacctgcggtcggtgcctctgcagaaggcacaagacgcgatcgcctcggatcttactccgggcctacaagcgtctctagacagagagtcgagagcctgaggaaaaagagacctcttttcccctggttcggcctcgatataggagggacattagtgaaattggtttatttcgagcctaaggatatcacggccgaggaggaggaagaagaagtggaaagtctgaagtcaatcaggaaatacctgacttctaacgttgcttacggtagcaccggcattcgggacgtccacctcgaactcaaagacctgaccctgtgtggcaggaaaggtaacctgcatttcattaggtttccgacccatgatatgccagccttcatccagatgggtcgggataagaacttcagcagcctgcatactgtgttttgtgctactggcggcggagcctacaagttcgaacaggactttttaaccataggcgacctccagctgtgcaagctcgacgagctggactgtctgatcaaaggtatcctgtatattgacagcgtgggcttcaatggaaggtcccagtgctactacttcgagaatcccgctgacagtgagaagtgccagaaactgccatttgacttgaagaatccgtatccacttctcttggtcaacattggatccggggtcagcatcttagccgtgtacagcaaggataactataagagagtcacagggactagcctgggtggcgggaccttcttcggcctgtgctgcctgctaacgggttgtactacgtttgaagaagccttggagatggccagccggggggacagcaccaaggtggataaactagttcgggatatttatggcggcgactatgaacggtttggtctccccggatgggctgtggcttcctccttcggcaacatgatgtcaaaggaaaagcgggaggcagtgtcaaaagaagatcttgcaagagccactttaattactattacaaacaatataggcagtatcgcacggatgtgtgctctgaacgagaacattaaccaggtggtttttgtgggtaacttcctcagaattaatactatcgcgatgcggctcttggcttacgccctggattattggtcaaaagggcaactcaaggcactgttcagtgagcacgaggggtacttcggagccgtgggagccctcctggaactccttaagatcccttag

SEQ ID NO: 127847 - DNA, 1161 bp, Artificial Sequence
  Description of Artificial Sequence: Synthetic coding sequence
tctggaagagtcaatccagctggggggctcgggtgttctgaatccgggaccttcggtgggccgcctgcgcccatagtatttccatggttcggtctagacataggcggtacccttgttaagctggtatactttgaacccaaggacatcacagccgaagaagaggaagaagaggtcgaaagtctgaagtcaatccgtaaatacttaacttctaacgtggcctacggttcaaccgggattagagacgtgcacctggagcttaaagatctcacattatgtggaaggaaaggaaatctccactttattcgctttcccactcacgacatgccagcctttatccagatgggacgcgacaaaaatttcagcagcttgcatacagtcttctgtgctactggcgggggtgcatataagtttgagcaggactttcttactatcggtgatctccaactgtgcaaactcgacgagctagactgtttgatcaaggggattctttatatcgattccgtgggctttaatggacgctcccagtgctattattttgaaaatccagcagacagtgaaaagtgccagaaactgccctttgacttgaagaatccctatcccctgttactcgtgaacatcggatcaggagtctctatcctcgccgtgtactctaaagacaattacaagcgggttactgggacaagcttgggcggcgggacattctttgggctgtgctgcttactcacgggatgtactacgtttgaggaggccctggaaatggcttctcgcggtgacagcacaaaagtggacaagctggtgcgcgatatctacggtggcgattatgagcgtttcgggcttcctggttgggctgttgcatccagctttggcaatatgatgagtaaagagaaacgggaggcggtgtcaaaagaggatttggcacgcgcgaccctgatcacaataacaaacaacattggaagcatcgcacggatgtgcgcgctgaatgagaatatcaaccaggtcgtctttgtgggcaacttcctccggatcaataccatcgcaatgcggttattggcatatgctctggattactggtccaaaggccagctgaaagccttattttcagaacacgaaggatacttcggcgcggtgggcgcactactggagctattgaagattccatag

SEQ ID NO: 127848 - DNA, 840 bp, Artificial Sequence
  Description of Artificial Sequence: Synthetic coding sequence
atgccagcattcatacagatgggcagggataagaatttcagttccttacatacagtcttctgtgccacaggcgggggcgcatacaagttcgaacaagacttcttaacaatcggagacctccaattatgcaaattagacgaactcgattgcttgattaagggcattttgtacattgattctgtcggattcaatggccggtcccagtgctattattttgagaatcctgcagacagcgagaagtgtcaaaaactgccattcgatctgaagaatccctacccacttctgctcgtcaatataggctccggagtttccatcttggcagtgtattcaaaggacaactacaaaagggttacaggcacttcactgggtggcgggacttttttcggcctatgctgcctgctgacgggctgcactactttcgaggaggctctcgagatggcgagtcgcggggattcgaccaaagtagacaagcttgttcgagatatttacggtggggactacgaacgctttggcctgcctggctgggccgtcgccagcagctttggtaacatgatgtcaaaagagaagcgcgaggcagtatctaaagaggacctggcccgcgcaactctgataacaatcacaaacaatatcgggtcgattgctcgcatgtgcgcgctgaacgagaacataaaccaggtggtgttcgtaggcaatttcctgcgtatcaatactattgcaatgcggctgcttgcttatgctttggattactggtccaaagggcaactcaaggccctattttccgaacacgagggatattttggcgccgtcggagcgctgttggagttgttgaagataccctag

SEQ ID NO: 127849 - DNA, 1113 bp, Artificial Sequence
  Description of Artificial Sequence: Synthetic coding sequence
atgaaaatcaaggacgccaagaagccatcatttccttggttcggaatggatataggagggacattggtgaagctgtcatacttcgaacccatcgatatcactgctgaagaggagcaggaggaagtcgagtctctcaagagcattaggaaatacctgacttccaatgtcgcttacggcagcactggaatccgtgatgtccacctcgagctgaaagacctcacactctttgggagaaggggcaacttgcacttcatccgattcccgacacaagatctgcccacattcattcagatgggaagggataagaatttttcaactctgcaaacggtgttgtgtgctacgggtgggggcgcttataagtttgaaaaggattttcggacaataggcaatctgcacctccacaagctggatgagttagactgcctggtaaagggccttctgtacatagattccgtaagcttcaacgggcaggccgaatgttattatttcgccaacgcaagtgaacccgagcgctgccaaaaaatgcctttcaacctagacgatccataccctctactggtcgtgaatatcggtagcggggtgtcaatcttagctgtgcacagcaaggataactataagcgcgtgactggtacaagtcttggcggaggaacttttctcgggctctgctcccttctaacggggtgtgagtcattcgaagaggccctggagatggctagcaagggcgacagtacacaggccgataaattggtgcgcgatatatacgggggggactacgaacgtttcgggcttccaggttgggccgtagcttcttcctttgggaatatgatttacaaggagaaacgtgagtcagtttccaaggaggatctggctcgggccacactggttactatcaccaataatatcggttctgtggctaggatgtgcgccgtgaatgagaaaatcaatcgagtggtgtttgtcgggaacttcctaagagtgaatacactgagcatgaagttgctggcttatgccctcgattattggtccaaaggacaactgaaggccttgttcttggaacacgaggggtatttcggagctgtcggcgcattactaggcctccccaacttctcctag

SEQ ID NO: 127850 - DNA, 2322 bp, Artificial Sequence
  Description of Artificial Sequence: Synthetic coding sequence
atggccgaatgcggggcttccggaagcggcagcagcggggacagtctcgacaaatccatcacccttccccctgatgagatcttcagaaacctcgaaaatgccaaacgcttcgctattgacattggtggatcactaacaaagttagcctattactctacagtgcaacacaaggtggctaaggttcgctcttttgaccattccgggaaggataccgaacgagagcacgaacccccctacgagatctctgtgcaagaggagattacagctcgtctacacttcatcaagtttgagaatacttacatagaggcatgcctggactttattaaggatcacctcgttaacacggagaccaaggtgatccaggccactgggggcggcgcttacaagttcaaggatctgattgaggagaagttgcgacttaaggtagacaaagaggatgtcatgacatgtctgatcaaaggctgtaatttcgtgcttaagaacattccgcacgaagcctttgtgtaccagaaggactccgatccggaatttcggttccagactaaccatcctcacatattcccttatctgctggtgaatatcggcagtggagtatcgatagtgaaagtagaaaccgaagatcgttttgagtgggttggcggaagctccattggcggcggtacattctgggggctaggcgcactgctgactaaaaccaaaaagtttgacgaattgcttcacctcgccagccgtggccagcatagtaacgtggacatgctcgttcgagatgtctatggtggggctcaccaaacgctgggactgtctgggaatcttatagccagttctttcggcaagagcgcgacagctgatcaggagtttagtaaagaagacatggctaaaagcctcctgcatatgatctccaacgacattgggcagctggcatgccttcatgccagactacattcacttgatcgcgtttattttggcggtttcttcatcagagggcaccctgttactatgaggactattacatacagcatcaattttttcagtaaaggggaagtgcaggcactgttcttgcgccacgaggggtacctcggggcaattggggcttttctgaaaggcgcggagcaggacaatccaaaccagtactcttggggggagaactatgccggcagttcagggctgatgagcgcctctccggagctggggccggcacaaagggcccggtcagggactttcgacttgctagagatggataggctagaacgacctctcgtggacctgcccctgcttctagacccgccatcttatgtgcccgatactgtcgaccttactgacgatgcactggcgcgcaagtactggcttacgtgctttgaagaagcccttgatggggtggtcaagagagccgttgcaagtcagccagactctgtggacgcggccgaaagggccgagaagttccgtcagaaatactggaacaaacttcagactctgcggcaacagccattcgcgtacgggacgcttaccgtcaggtctctgctggatactcgcgagcactgcctgaacgaattcaacttcccagacccctattccaaagtgaagcaacgggagaatggcgttgcacttcgctgtttccctggcgtcgttcgatccctggatgcgctcggttgggaggaaaggcagctggcattagtgaaaggactccttgctggaaatgtgttcgattggggggcaaaggccgttagcgcagtcctggagagcgatccatactttgggttcgaagaagcaaaacggaaactacaggagaggccttggctagttgactcttattccgagtggcttcagagacttaagggccccccccacaaatgcgctctgattttcgccgacaactcaggcattgacatcattttgggcgtgttcccattcgtccgcgagttactgctgagaggcaccgaggttatcctcgcttgtaattctggacctgctctgaacgacgtgacacacagcgaatcccttattgtggccgaaagaatcgctggaatggatcccgtcgtgcactcagccctgcaagaggaacggctgctcctggtgcagaccggcagctcaagcccctgtctggatctctcccgcctggataagggcctcgcggccctcgttcgggagcgcggcgctgacctggtggtgattgaagggatgggtagggctgtgcacaccaactatcatgctgccctgcggtgcgagtcactgaaacttgccgtgataaagaatgcctggttggctgagcggcttggcgggaggctgttcagtgtgatattcaaatacgaggtcccagcagagtag

SEQ ID NO: 127851 - DNA, 1455 bp, Artificial Sequence
  Description of Artificial Sequence: Synthetic coding sequence
atgttcccaaattcaatccttggtaggcccccgttcaccccgaaccatcagcaacataacaatttcttcaccctgagtcccaccgtgtattcccaccagcagttaattgacgcccagtttaacttccaaaacgctgacctgtccagggctgtttcattacagcagctgacgtacggtaacgtttcaccaattcagacctcagctagtccgttatttagaggccggaaaaggctgagcgatgagaagaacttgcctctcgacggtaagaggcagaggttccattcccctcaccaggaacctaccgttgtgaaccagatcgtccccttaagcggagagaggcgctattctatgcctccactctttcacacacactacgttccagacatagtgcggtgtgtgccgcctttcagggaaattgctttcctggagccccgcgagattactcttcctgaggccaaggataaattaagtcaacagatactggagctttttgagacctgccagcaacagatctcagatctcaagaagaaagaattgtgccgaacgcagttgcagcgggagatacagctgctgtttcctcagtctcgcctgttcttggtcggaagtagtctgaatggatttggaacaaggagtagtgacggcgacctgtgcttggtcgtcaaggaggaaccatgtttctttcaggttaatcagaaaaccgaagcccgccacatccttacactggtacacaaacacttttgcacccgactgagcggctacattgagcgacctcaattgatcagagccaaagttcctatcgttaagttccgggataaggttagctgtgtcgaattcgatctcaacgtgaacaacatcgtgggcattagaaatacctttttattgcggacatacgcgtaccttgaaaacagggttcggccactggtcttggtgatcaaaaaatgggcctctcatcaccagatcaacgacgccagcagaggtacgctgtcttcctacagtttggttctaatggtgcttcattacttacagaccctccctgaacccatcctgccctccctccagaagatctatcccgaaagcttctcccctgctatacaactccacttggtgcatcaggccccctgcaacgtgccaccttatctcagcaagaatgaaagcaatctgggtgatctgctgctcggattcctcaagtactatgcgacagaattcgactggaacagtcaaatgatcagcgtgagagaggcaaaggctatcccgcgccccgatggtatcgaatggcggaataaatacatctgcgtcgaggaaccgttcgatgggactaacacggcacgcgctgtacatgaaaaacaaaagttcgacatgatcaaggatcagtttctgaaatcttggcatcgcctcaaaaataaacgtgacctgaactcgatcttgcccgtgcgggcagccgtgctgaagagatag

SEQ ID NO: 127852 - DNA, 1443 bp, Artificial Sequence
  Description of Artificial Sequence: Synthetic coding sequence
atgtttcccaactccatcctgggtaggcccccattcacaccaaatcatcagcagcacaacaacttctttaccctcagtccgactgtctacagccatcagcagctgatcgacgctcaattcaactttcagaacgccgacctgtcacgcgctgtctcgctccaacagctgacatacggaaatgtgtctcctatacagacttccgcttcccctctttttcggggtaggaaacggctgagcgacgagaaaaatctgccactggatggaaagagacagagatttcactcgccacaccaagagcctactgtggtcaatcagatcgtaccgctatctggagagcgccgatatagtatgccgcccctcttccacactcattacgtgcctgatatcgtgcgatgtgtcccgcctttccgcgaaattgccttcttggaaccaagagaaattaccctgccggaggcaaaggacaagctttcacaacagattctggagttgtttgaaacctgccaacaacagatcagcgatcttaagaaaaaagagttgtgccgcacccaactgcaacgcgagattcagctgctctttcctcagtccaggctttttctggtcggatcctcacttaacggcttcggcacaaggtcctccgatggtgacctgtgtctagtagtaaaagaggagcctgttaaccaaaagaccgaagcgcgacacattctgaccctggttcacaaacatttttgtacacgcctgtccggatacatagagcgtccacagctgatacgagctaaagtgccaatcgtcaaattcagggacaaggtgagctgtgtagagtttgatttgaatgtgaataatatagtgggcatcaggaacactttcttgctgcgtacatatgcctatctggaaaaccgcgttcgccctctggtcctggtgataaagaaatgggcatcccaccatcagataaatgacgcttccagaggcaccctgtcttcatactcactggtcctgatggttctgcactacttgcagacactgcccgaaccaattctaccatccttacagaaaatttatcccgaatctttcagccctgctatccagctgcatcttgtccaccaagccccatgcaatgtgccaccttacttaagcaaaaacgagtccaacttgggcgacctcctcctgggattcctcaagtactacgctacagaatttgactggaatagccagatgatttctgtgagggaagccaaagccatcccaaggcctgatggtattgagtggagaaataaatacatctgcgtggaagagccattcgatggcaccaacaccgcgcgcgcggtccacgagaaacaaaaattcgatatgattaaggaccagttcctgaaaagctggcataggttaaaaaacaaacgggacctcaattctatcctgcctgtaagagccgcggtgctcaaacggtag

SEQ ID NO: 127853 - DNA, 1455 bp, Artificial Sequence
  Description of Artificial Sequence: Synthetic coding sequence
atgttccctaactctatattgggacggcctcctttcactccgaatcaccaacagcacaacaatttctttactctctccccaaccgtgtactcccatcagcagcttattgacgcccaattcaattttcagaatgccgacctgtctcgtgctgtctcactgcagcaattaacatacggcaatgtgtcgccaatccaaactagcgcctcccctctattccgcggcaggaagcgcctgtctgacgaaaagaacctgcccttagatggtaagaggcagcgctttcactcaccacatcaagaacccacagtggtcaaccagattgtccctctgtcaggtgaacgccggtatagcatgccacctctgtttcacacccattatgtccctgatatcgttaggtgtgtgccccctttcagagaaattgcattccttgaaccaagagaaattacattacccgaggctaaggataaattaagccaacagattcttgaactgtttgagacctgccagcagcaaatttctgacctcaagaaaaaagaactttgtcggactcagctgcagcgcgaaatccagcttctttttccccaaagtagactttttcttgtgggctcttcccttaacgggttcggcaccagatcatcagacggagacctgtgtttagtggttaaggaggagccatgtttctttcaggtgaaccaaaagacagaagcacggcacatcttaacattagtgcataagcatttttgtacccgcctgtctggatacatagaacggccacagctgatccgcgccaaggtcccaatcgtgaaattcagagataaggtgtcttgcgttgaattcgacttgaacgtgaacaatatcgtggggatccggaatactttcctgctccggacttacgcctacctggagaaccgagttaggcctctggtgttggtgattaagaagtgggcatctcatcatcaaatcaatgacgcttcccgcggtaccctcagtagctacagtctggtcctgatggtactgcactacctccagaccttaccggaaccaatcttgccctctctccagaaaatataccctgaatcattttcccctgctatccagttgcacttagtgcaccaggctccgtgtaacgtcccaccgtatctgtctaaaaatgagtccaacctgggagatctgttactgggatttctgaaatactacgccacggagtttgactggaacagccagatgatatccgtgcgggaagccaaggccatccccaggcccgacggcatcgaatggcgaaataaatacatttgtgtggaggagccattcgacgggacgaacactgcaagggccgtgcacgaaaaacagaagtttgatatgattaaagatcagttcctgaagtcttggcaccgcttaaagaacaaaagggacctaaacagtattctcccagtgcgggccgccgtgttaaagcgatag

SEQ ID NO: 127854 - DNA, 1455 bp, Artificial Sequence
  Description of Artificial Sequence: Synthetic coding sequence
atgttccccaattccattttggggaggcctccatttaccccgaaccatcagcaacacaacaattttttcacactcagccccactgtgtactcacaccagcaactaattgatgcccaatttaattttcaaaatgccgatctctcacgggcagtgtctctgcagcaactgacctacgggaatgttagccctatccagacgtcggccagtccacttttcaggggccgcaagcgcttgagtgatgaaaaaaatctccctctcgatggaaagaggcagcgatttcacagccctcatcaggagccgacagtggtcaaccagatagtccccctttctggggagcggaggtatagtatgccgcctctgtttcatacccactatgtacccgacatagtgaggtgcgtgcctcctttccgggagattgcatttctggagccacgagaaatcacactaccggaagctaaggataagctgtctcaacagatactcgaactgttcgagacttgccagcagcaaattagtgacctgaaaaagaaggaactatgccggactcagctccagcgcgagatacaattgctgtttccccagagccgtcttttcctcgtcggcagctccctgaacggattcggaactagaagctccgatggcgatctttgccttgtggtgaaagaggaaccatgtttctttcaggttaaccagaaaactgaagcacggcatattctgactctagtgcataaacacttctgcactagactgtcaggctacattgagcggcctcagttgatccgagcaaaggtgcctattgtcaagttcagagacaaggtctcttgcgtcgagttcgaccttaacgtcaacaatatcgtcggtattcgcaacaccttcctactgcggacttatgcatacctggaaaacagggtgcgccccttagtgttggtgattaagaagtgggccagtcaccaccagattaacgacgcaagtaggggaaccctgagtagctacagtctggtgctcatggttctccattatctacagaccttgccggagcctattttgccctccctccaaaagatctacccagaaagctttagccctgccattcagctgcacctggtgcaccaggcaccttgcaacgtgccgccgtacctgtcaaagaacgaaagcaatcttggagaccttttattagggtttcttaagtattacgccacggagtttgactggaactcgcagatgatttcagtacgagaagcaaaggcgattccacgaccggatggcatcgagtggcgtaacaagtatatttgcgtcgaagagccattcgatgggacaaataccgcccgggccgtgcacgaaaagcagaagttcgacatgattaaggaccagttcctgaagagttggcatcgcttgaagaacaaacgcgacctcaactcgatcctgccagtgcgtgctgccgtgctaaaacgatag

SEQ ID NO: 127855 - DNA, 1476 bp, Artificial Sequence
  Description of Artificial Sequence: Synthetic coding sequence
atgtcactggtggcttacgcgagttctgacgaaagtgagcctgatgaggccgagcccgaaccagaagaggaggaggcggtggcacccacctctggtcctgcactgggcgggctcttcgcctcactccccgctccaaagggaccagccctccttcctcctcctcctcagatgctagcccctgcctttccgcctccattgctgctcccaccgccaacaggcgatcctaggctgcagccgcctccaccactacctttcgggctgggggggtttccccccccaccaggtgttagccccgcggaagcagctggagttggcgaaggcctgggcctaggactgcccagcccccgagggccaggtctgaacctaccaccccccatcggtggtgctggacctcctctcggtctcccaaagccaaaaaaaagaaaagagcccgtgaagatagccgcccctgagttgcacaaaggggacagtgatagcgaggaggacgagcctacaaaaaaaaagactatcctccagggtagttcagagggcacgggcctttctgccttgctccctcaacctaaaaatttgactgtcaaggagaccaatcggctcctactgccccacgccttttcccggaaaccctcggacggatcccctgacaccaaaccaagccggctggcctccaaaacgaaaaccagtagtctagctcccgtggtaggtacaaccacgactaccccttctccgagtgcaatcaaggccgcagcaaaatctgccgccctgcaggtgacaaagcaaatcactcaagaggaggacgacagcgacgaagaagtagctcccgaaaacttcttctctctgcccgagaaggccgaacctccgggtgtcgaaccctatccttacccaatccctactgtccctgaagagctccctcccggcacggagcctgaacctgcctttcaggatgatgccgccaatgcccccctagagttcaagatggcagctgggagttccggagctccatggatgcccaagcccggtgatgattacagttacaatcagttctcaacttacggagacgccaatgccgcaggggcttactatcaagactattatagcggcggctactaccccgctcaggaccccgcgctcgttccccctcaggaaattgcccccgacgctagctttattgacgacgaagccttcaaaagattacaggggaaaagaaacaggggtagggaggaaattaatttcgtagaaatcaaaggagacgatcagcttagcggtgcccagcagtggatgaccaagtctttaaccgaggagaagaccatgaaatccttcagtaagaagaagggagaacaacccactggacagcagcgacggaagcaccagatcacctacctgattcaccaagctaaggagagagagctcgagctgaaaaacacgtggagcgaaaataagttgtcgcgccggcagacacaggctaagtacggattctag

SEQ ID NO: 127856 - DNA, 1380 bp, Artificial Sequence
  Description of Artificial Sequence: Synthetic coding sequence
atgtcactggtggcttatgctagttccgacgagagcgaacccgacgaagctgaacctgaacctgaggaggaagaagctgtggctccaacaagtgggccagcactcggggggttattcgctagtctgcccgcaccaaaaggtccagctctactgcctcccccaccccagatgctcgcaccagcgtttcccccgcctctgttactacctcctcctactggcgatccccggctgcagccccctcccccactccccttcggactggggggattccctccgccccctggggtgtcaccggcagaggcagcaggtgtcggtgagggtctcggcctgggacttcccagtccccggggccctggactgaacctgccgcctcctataggaggggctggtcctcctctgggtctgcccaagcccaagaaacgtaaagagcctgtgaagattgctgccccagagctccataagggcgattccgactccgaagaggacgagccgactaagaagaagaccatcctgcaggggtcaagtgaaggcacgggtctatctgcgttactgccacaacccaaaaatctgaccgtgaaagagactaataggctgttgttgcctcacgccttttctcggaaaccttccgacggtagtcccgataccaagccttctcggcttgcatctaagactaagacaagcagtctggcgcccgtagtcggaactactactacaactccctcaccctcagcgatcaaggctgcagccaaaagcgccgctttgcaggtcacaaaacagatcacacaggaagaagacgactccgacgaggaggtggctccagagaatttcttctcactccctgagaaagccgaacccccgggggttgagccgtatccctacccgatcccgactgttccagaggaactgccccccggtactgagcctgagcctgcttttcaggacgatgccgccaatgccccgctggagtttaagatggctgcaggatcaagcggggctccttggatgcccaaaccaggcgacgactatagttacaaccagttttctacctatggcgatgctaacgcggctggagcttactatcagttcaagcggctgcaaggcaaacgaaaccgcgggcgcgaggagataaattttgtcgagataaagggggatgaccagctgtcaggtgcacagcagtggatgacaaagagcctcacagaggagaaaaccatgaaaagcttttccaaaaaaaaaggtgagcagcccaccggacagcagcgccggaaacatcagataacctatttgatccaccaagccaaagaacgggaactcgagttgaaaaacacctggtctgaaaacaaactttctagacgtcagactcaggcaaaatacggcttttag

SEQ ID NO: 127857 - DNA, 1404 bp, Artificial Sequence
  Description of Artificial Sequence: Synthetic coding sequence
atgttagcaccagcattccccccacctctgttactgccgcctcccaccggcgatccccgactccagccacctcctccactgccatttggcctgggtggattccctcctcccccaggagtatcccctgccgaagcagcaggggtgggagagggccttggcctcggtttgccttctccgcggggtcctggcttgaatcttcccccacctattggaggggcgggtccccctctggggttgcccaagcccaaaaagcggaaggagccggttaagattgccgcgcctgagctgcataagggtgactcagacagcgaggaggacgagcccaccaaaaagaagaccattttacagggcagtagcgaggggaccggcttgagcgccctgttgccgcagccgaagaatcttacagttaaagagaccaatagattactcctgccacatgcgttctcaaggaaacccagtgacggcagcccggacaccaaacctagtcgactggcctccaagacaaagacctcaagcttggctcctgtcgtgggcactactacaaccaccccatctcccagcgctatcaaggcagcagcgaagtccgccgcactccaggtcaccaagcagatcactcaggaggaagatgattcagatgaagaggtggccccagagaatttcttttcattgccggagaaggccgagccccctggagtggagccttatccttacccaatccctactgtgcctgaagagctcccgccaggcaccgaacccgagcccgctttccaggatgatgctgctaacgcgccgctcgagttcaaaatggctgctggatcatctggtgccccatggatgccaaagcctggagacgattatagttacaatcagttttctacctacggagacgcgaatgcagctggcgcctactaccagggcttacagcagcatctgggacatagtcccctgaggggaatcatgcgatttctcaattcaaagtccggtaagagaacttgcttcgtgccgagttttgattactacagcggaggatattacccggcacaggatccggccctggttcccccgcaggaaattgctccggacgcaagctttattgatgacgaagccttcaaaaggctccaggggaagcgcaacagaggccgggaagagataaatttcgttgagattaagggagacgatcaattatctggggctcagcagtggatgaccaagagtctgaccgaggagaagacaatgaaaagcttcagcaaaaaaaagggagagcagcctacgggacaacagcgcaggaaacatcagatcacttatctgatccatcaggccaaggaacgggagctcgaactcaaaaacacatggtcagagaataagctgagccgccggcaaacacaggcgaagtacggcttttag

SEQ ID NO: 127858 - DNA, 3096 bp, Artificial Sequence
  Description of Artificial Sequence: Synthetic coding sequence
atgaaagtgaccgtttgctttggaagaactcgggtagttgtgccatgtggagacggccatatgaaagtttttagccttatccagcaggccgtgacccgatatcggaaagctatcgcgaaagaccctaactactggattcaggtgcaccggttagagcacggagacgggggcatcctggacctcgacgacatcttatgtgacgtcgctgatgacaaagaccggttggtcgcagtgtttgatgaacaggatccacatcacgggggtgatgggacgagtgcctcctcaactggaacacagagccccgagatttttggatcagagttaggcactaacaacgtgagcgctttccaaccttaccaggccacgtctgaaatcgaggtcactccttcagtgctgcgagccaacatgcccctccatgtgcggaggtcctctgacccggctttgatcggcctctccacatcagtttccgactcgaacttttcctcggaggagccctctcggaaaaatcctacccgctggtccactactgctgggttcttgaaacagaacacggcagggtctccaaagacctgtgatcgcaaaaaggatgaaaattaccgcagccttccccgtgacacctccaattggtccaaccaatttcagcgtgataatgccaggtcctccctgagtgccagccaccccatggttggcaagtggctggagaagcaggaacaggatgaggacggaacagaggaagataacagtagagtggagccggtaggacacgcggatactggcctggagcatattcccaattttagccttgacgatatggtaaagcttgttgaagtccctaatgatggaggacctctagggatccatgttgtccccttctccgcacggggtggccgcacattggggctgctcgtgaagagactcgagaaaggcgggaaggccgagcatgaaaatctattcagggaaaatgattgcatcgttcggatcaacgatggagacctcagaaaccggcgatttgaacaggcccagcacatgtttagacaagccatgcgcacccccattatctggtttcatgtggtcccggcagccaataaagagcagtacgaacagctgagccagtccgaaaagaacaattattactcatctcgatttagtccagacagtcagtacattgataatagatcagtgaattccgcagggttgcacacagtgcaaagggctccacgcctgaatcacccaccagaacagattgacagccattctaggcttcctcatagtgcgcatcctagtggcaagccccccagtgcacctgcgtctgcacctcagaatgtgtttagcactaccgtgagtagcggttacaacaccaaaaagattgggaagaggctcaatatccagctgaaaaaaggcaccgaaggcttgggcttctcgataactagtagagacgtgacaataggaggctctgctccaatctacgtcaaaaatatccttcctaggggggccgctatccaagatggccggcttaaggcgggcgacaggctcattgaagtcaatggcgtggacctcgtggggaagtcccaagaagaagtggtctccttgctccgctcgaccaagatggaggggaccgtatcactgctagtgtttcggcaggaagatgcattccaccctcgcgaactgaacgctgagcccagccagatgcaaattcccaaggaaacaaaagctgaggatgaggacatcgtgctgactcctgatggcaccagagaattcctgacatttgaagtgccactcaacgattcagggtcagccggacttggtgtgtccgtaaagggcaaccggtcgaaggaaaaccacgccgacctaggcatcttcgtgaaatccatcataaacggaggggccgcaagcaaggacggaagacttcgggtcaatgaccagctgattgcggtgaacggggaatcgttgctgggcaaaactaaccaagacgcgatggaaacattacgtcgctctatgagcaccgagggcaacaagcgggggatgatccagctcatcgtggcgcgccggatatctaaatgtaacgaacttaagagtccgggaagcccacccggtcccgaacttcctatcgagacagccctcgatgacagggagagaaggattagtcacagcttgtattctggaatagagggactggacgagtcacctagccgcaacgctgctctctcgcggattatgggtaagtatcagctttctcccacggtcaacatgccccaggatgacaccgtaatcatcgaagacgatagactcccagttttgcctccccacctgtctgaccagtcctctagctcttcccatgatgacgttggctttgtgaccgcagatgctggtacctgggctaaggctgcaatcagtgactccgcagattgttccttgtcccctgatgtcgatcccgtgttggccttccaacgcgagggttttggacggcaatcaatgagcgagaaaagaacgaagcagtttagtgacgccagtcagctagacttcgtcaagaccaggaagtctaagagcatggacctcgggatcgcagatgagacaaagctgaacacagtagacgaccaaaaggccggaagtccgagccgggatgtgggaccaagtctcggacttaagaaatcttcttctctagagagtctgcagactgccgtagctgaagtaacacttaatggcgatattccctttcacaggccacggccacgcatcatcaggggaagggggtgcaacgaatcttttagagctgctattgataaatcctacgataaacccgcggtcgacgacgatgacgagggcatggaaaccctcgaagaggacaccgaggaatcatcacggtcaggtagagagtccgtatcaaccgcaagcgatcaaccgagtcatagtctggaacgccaaatgaatgggaatcaggaaaaaggagacaaaacagatcggaagaaggataagaccggtaaggaaaaaaagaaagaccgggataaggaaaaagataaaatgaaggctaagaagggcatgctcaaagggctcggtgatatgttctcacttgctaaattgaagcccgagaaacggtag

SEQ ID NO: 127859 - DNA, 3960 bp, Artificial Sequence
  Description of Artificial Sequence: Synthetic coding sequence
atgaaggtaacggtatgcttcggcagaactagagtggtggtgccgtgtggagacggccacatgaaagtcttcagcctgatacagcaagcggtgactaggtacagaaaagccatcgccaaggacccgaattattggattcaagtgcatcgtcttgagcatggagatggcgggatcctggatctggacgacatactctgtgacgtggccgacgataaggaccggctggtggcagttttcgacgaacaggatcctcatcacggtggcgacgggacttccgcctcctccaccggcacccagtcccctgagatttttggatctgaactgggcacgaacaatgtatcagcattccagccttaccaggcaacctcagagatcgaggtgacaccctcagtcctgagggccaatatgcccttgcacgtgaggagatccagcgaccctgctctcatcggcttaagcacctctgtttcagattctaacttctcctcagaggagcctagtcgaaagaatcccactaggtggagtactaccgccggctttctgaaacagaacacagctggcagtcccaagacctgcgaccgcaaaaaggatgagaattaccggagtcttcccagggacacatctaactggtcgaaccaattccagagagacaacgcacggtcatccctctcggctagtcatcccatggtcggtaagtggctcgagaagcaggagcaagatgaggatgggacagaggaagataatagccgcgtcgaacctgtcggccatgcagatactggtctggaacatatccccaatttctcactcgatgatatggtgaagcttgtggaggtacctaacgacgggggaccactaggcattcacgtcgttccattttctgcccggggggggagaacattaggactgctggtcaaaaggctggaaaaaggggggaaagcagagcatgaaaacctatttcgcgagaacgattgcatcgtccggataaacgatggggatcttaggaaccggaggtttgaacaggcccaacacatgtttcgacaggccatgaggacccctataatttggtttcacgtcgtgcctgccgccaacaaggagcagtacgagcagctgagtcaaagcgagaagaacaactattactcttccagattttctcctgatagccagtatatcgataaccggtctgtgaacagcgcgggtttacatactgttcagcgcgctcccagactaaaccatcctcccgagcagatagattcacatagtcggcttccgcactctgcgcacccttcagggaaacccccgagcgcacctgccagtgcgccacagaacgtgttttccaccacagtgtcaagcggatataacaccaagaaaattggaaagagacttaacatacaactgaagaaaggcactgagggacttggcttctcgatcacatcacgagacgttaccattgggggaagtgcccccatttatgtgaagaatatccttcctagaggagccgccatccaggacgggcggctgaaggccggggatcggctgatagaggtgaacggcgtggaccttgtcggtaaaagccaagaggaagtggtcagcctgctgcgcagtacaaagatggaaggtaccgttagcctgctggtgtttaggcaggaggatgctttccatccccgcgagcttaacgccgaaccttctcaaatgcagattcccaaggagactaaagcggaggatgaagacatagtcctcactcccgacgggacaagagaatttctaacttttgaagtgcccctcaatgacagtggatccgccggtttgggtgtgtccgtgaagggcaaccggtccaaggaaaaccacgccgatctggggattttcgtgaaaagcatcatcaatgggggcgctgcctccaaagatggaagattgcgcgtgaacgaccagctgatcgcagttaacggagagagcctgctgggcaagacaaatcaggatgccatggagaccctcagacgatctatgagcactgaaggaaacaaacgaggtatgatccagctaatcgtcgcccgacggatcagtaaatgcaacgagctaaagagtcctgggtctcctcccggcccagagcttcctatcgaaactgctctggatgaccgcgagcggagaatttcccattccctctactctgggattgaagggttagatgaaagcccttcacgcaatgcggcgctgtcacggatcatgggtgagtccggcaaataccagctctctcctaccgtcaatatgcctcaagatgataccgtcatcatcgaggacgacagactgcccgtcttgcccccacaccttagcgaccagtcatcttcctcctcgcacgacgacgtgggcttcgttacagcggacgcgggtacgtgggctaaggccgcaatttcagattctgccgattgcagcctgagccccgacgtagaccctgtcttggcgtttcagagagagggattcggccgccagagcatgtcggagaagcgaacaaagcagttcagtgacgcatctcagctggatttcgtgaagacaagaaagtcgaagtcaatggacctggggattgctgacgagaccaagcttaacacagttgatgaccagaaagctggaagtccctcccgtgacgttggcccttcactcgggctgaaaaagtcatcttcgctcgagagtctccagactgccgtcgccgaggtcactctgaacggcgatattccctttcataggccaagacctcgaattatacgtggccgcgggtgcaatgagtcatttagagctgcaatcgataaaagctatgataagcctgcagtggacgatgatgacgaaggaatggagaccttggaagaagacactgaagagtcgagtcggagtggtcgggagagtgtttccaccgccagcgatcaacctagccatagcttagaacggcagatgaacggaaaccaggagaagggtgataagaccgacaggaagaaagataagacaggcaaggaaaagaaaaaagacagagacaaggagaaggacaagatgaaggccaagaaagggatgctcaagggccttggagacatgttcagaatccaggccaagactcgggaattccgcgagcgccaggccagagaacgagactatgccgagattcaggacttccatcgcacttttggctgcgacgacgaactgatgtatggaggcgttagcagctacgaggggtcaatggccctgaacgcccgaccacagagtcctagggagggccacatgatggatgccctatacgctcaggtgaagaagccacgaaattcaaagcctagtcccgtggacagtaatagaagcaccccctccaaccatgaccgtattcagcggctccgtcaggagttccagcaggcaaaacaagacgaagatgtggaggacagaaggcgcacatatagtttcgagcagccatggcctaacgccagacccgcgacccagagtggcagacactctgtctctgtggaggtgcaaatgcaacggcagcggcaggaggaaagggaaagctctcaacaagcgcaaaggcagtacagtagcctgccccggcagagtcgcaaaaacgcctcctctgttagccaggattcgtgggaacagaactactctccgggcgaaggttttcagagcgcaaaggaaaatcccagatactcatcttatcaggggtcgcgcaatggctacttgggaggacacggtttcaacgcgagggtaatgctggagacacaggagctgttacggcaggagcaaaggcgaaaggagcagcaaatgaagaaacaaccgccaagcgaaggcccttcaaactacgattcctacaaaaaggttcaggacccctcttatgcccctcctaagggcccattccgccaagatgtccccccatctccctcccaagtggcaaggttgaatcggcttcaaacgccagaaaaaggaagaccattctatagctag

SEQ ID NO: 127860 - DNA, 3933 bp, Artificial Sequence
  Description of Artificial Sequence: Synthetic coding sequence
atgaaggtaacagtttgttttgggagaactcgggtggtagttccgtgtggcgatggccatatgaaggtattcagtctgattcagcaagccgtgacaagatataggaaggcgatcgctaaggatcccaactattggatacaggtgcaccgtctggagcatggggacggaggaatcttggacctggatgacatcctgtgcgatgtcgccgacgacaaggaccggttagtcgctgtgttcgatgagcaggacccgcaccatggtggcgatggtacgtcagcctctagcacaggcacgcagtcccccgaaatttttggttctgagctgggcactaataatgtgtccgcttttcaaccctaccaggcaacctccgagatcgaagtgacacccagcgtgctgcgggctaacatgccactccatgtgagaagatcatcggaccctgctctcatcggcctctcaacatctgtatctgactccaatttcagcagcgaggagccctcgcggaaaaatcctacacgatggtctacaactgccggttttttaaagcagaacactgctgggtcccccaagacttgtgatcgtaaaaaagatgaaaactaccgtagtctgcctagagatacttccaattggtcaaaccaatttcagagggataatgcgcgatctagtctctcggcctcacacccaatggtgggaaaatggttggagaaacaggagcaggatgaggacggaaccgaggaagacaacagcagggtggagcccgtgggccacgccgatactggactagagcacatacctaatttctcattggacgacatggtcaaattagtggaggtgcctaacgatggaggtccgcttggaatccatgtcgtgcccttctccgccaggggcggacgcaccctgggccttctggtgaagcgcctcgaaaaaggggggaaagccgaacatgaaaacctgtttcgggagaacgactgtatagtaagaattaacgacggggatttgcgaaatcggcggttcgagcaggcccagcatatgttcagacaagccatgcggacacccatcatctggttccacgtcgtgccagctgcaaataaggaacagtacgaacagttgtcacagagcgagaaaaataactactactcaagcaggttttcaccggatagccagtacatcgacaacaggtccgtcaattcagcaggtctgcacactgtgcagcgcgcgcccagactcaaccatccacccgaacagattgactctcattctcggctccctcatagcgcacacccctccgggaagccacccagcgcccctgcgagtgcaccacagaacgtgttctccaccaccgtgagctcaggctataatactaaaaaaattggtaaaaggctgaatatccagctcaaaaaggggacagagggtctgggcttcagtatcacctcacgagacgttaccatcggaggctcagcaccaatctacgtgaaaaatatcctccctaggggggccgccattcaggacgggagactcaaagctggtgaccgcctgattgaggtgaacggcgtagaccttgttgggaaatctcaggaagaggtggtctctctgcttcggagcaccaaaatggaaggtacagtatccctcttggtttttcgccaagaggatgctttccatccacgggaactcaaggccgaggacgaggatattgtgttgacacctgacggaactagggagtttctaacttttgaagtccctctgaacgacagcgggtccgctggcctcggcgtctctgtgaaaggcaaccgctccaaagagaaccacgccgacctaggcatcttcgtgaagtcaattattaatggaggggccgcgagcaaggacggtcgcctgcgcgtgaatgatcagctgatcgcagtgaacggtgagagtttgttaggaaagaccaaccaagatgcgatggagacgctccggcgcagcatgtctaccgaaggcaacaagagaggcatgatccagctcatcgtagcgcggaggattagcaaatgtaatgagttgaaaagccctggaagcccccctgggcctgagttgccgatcgagactgcactagacgacagggagagacgaatcagccatagcctgtacagcggtatcgaaggtctcgatgagtctcctagtcgtaatgccgctttatcgcggattatgggtaagtaccagctgtctcctacagtcaacatgccgcaggacgacacagtgattatagaagatgatcggcttccagtcctgccaccccacctgtccgaccagagcagttccagtagccatgacgatgtggggtttgtaactgccgatgctgggacctgggctaaggctgctattagcgacagcgccgactgtagcttgagtccagacgtggatccggtactagcgttccagcgggaggggttcgggagacagatcgccgatgaaaccaaacttaacacagttgatgaccagaaagcagggagccccagcagagacgtcggtccaagcctcgggttgaagaagtcaagcagtttggaatcgctccaaaccgcggttgctgaagttactctcaatggagacatcccttttcacagaccaagacccagaattatcaggggtcgcggttgtaatgaatcattccgagccgccatcgataagtcttatgataaacccgcagtagatgatgacgacgaagggatggagacgcttgaggaagataccgaggagtcttccagaagtggccgcgaaagcgtgtccaccgccagcgaccaacctagccacagcctggaacggcagatgaacgggaaccaggagaagggcgataagactgaccgaaaaaaggacaaaacggggaaggaaaaaaagaaggatagagataaggagaaggacaagatgaaagcaaagaaaggcatgctgaagggcctcggggatatgttcaggtttggtaaacacagaaaggatgacaagatagagaaaacagggaagattaaaatccaggagagcttcacttccgaagaagaacggattcgcatgaagcaggaacaggagagaatacaggccaaaacaagggaatttagagagagacaagctagggagagagactacgccgagatccaagacttccacagaacctttggctgtgacgacgaacttatgtatggcggcgtaagctcgtatgaaggttctatggctctgaatgcccggcctcagagccctagggagggacatatgatggacgcgttatatgcccaggtgaaaaagcctaggaacagtaaaccaagccctgtagattcaaataggtctaccccatcgaatcatgataggatccagaggctgaggcaggagtttcaacaagctaagcaggatgaagacgtggaggacagacgcagaacgtactcgtttgagcagccttggccaaacgcccgtcccgcaacccagtccggccggcacagtgtctccgtagaagtacagatgcagcgtcagcgtcaggaggagcgggaaagctcccaacaagcccaacgacagtacagctctctccctagacagtctaggaagaacgcttcaagtgtgtcgcaggactcttgggagcagaactacagtcctggggaaggctttcagtcagcaaaggagaaccctaggtacagtagctaccaggggagtagaaacggctacctgggcggacatgggtttaacgcacgtgttatgttggagacccaggaacttctgagacaggaacagcgacgtaaggagcagcaaatgaaaaaacaacctccctctgaaggaccctccaactatgattcatacaagaaagtacaggatcccagctacgcccccccaaagggcccctttcggcaggatgtcccccccagcccgtcccaagtggcgcgactgaatcgactccagacccctgagaaaggcaggcccttctatagctag

SEQ ID NO: 127861 - DNA, 540 bp, Artificial Sequence
  Description of Artificial Sequence: Synthetic coding sequence
atgcagattcccaaggagaccaaagccgaggacgaagatattgtgctcacacccgacggaaccagagagttcctgactttcgaagtacccttaaacgatagtggaagtgccgggcttggggtgtcggtcaaaggcaatcgcagtaaagagaaccacgccgaccttggcatattcgtgaagagcatcattaatggtggagccgcctctaaagacggccggctgcgggtgaatgatcagctcatagctgtgaacggcgaaagcctgctcggaaagacaaatcaagacgccatggaaactctgagacggtctatgagcacagagggaaataaacgcggaatgatccagctgatagtggccagaagaatctctaagtgcaatgagctgaagtcgccagggagtccgcccggccctgagcttcccattgagacagccctcgatgacagggagaggaggatttctcattccctctattctggaattgagggactggatgagagcccatctaggaatgctgctctatcccgtatcatgggcacctag

SEQ ID NO: 127862 - DNA, 3006 bp, Artificial Sequence
  Description of Artificial Sequence: Synthetic coding sequence
atgaaagttacagtctgtttcggaaggactcgggtagtggttccgtgcggagacgggcatatgaaggtgttttctctcatccagcaggctgtcacacggtaccggaaagcaatcgccaaagatcccaactattggattcaggtacaccggctagagcatggagatggcggcattctcgacttagacgatatattatgcgacgtcgctgatgacaaggatcgcctggtggctgtatttgatgagcaggacccccaccatggtggtgacggtacatctgccagtagtacaggaacacaatcaccagagattttcggaagcgaactggggactaacaatgtttccgcctttcaaccttatcaagctaccagcgaaattgaggtgacaccatcagtactcagagctaatatgccgctccatgtgagaagaagctctgatcccgctcttattgggcttagcaccagcgtgtcagactcaaactttagctcagaggagccatcccgtaagaatcccacccgttggagtactacagccggatttctaaaacagaataccgccggctctcctaaaacctgcgatagaaaaaaagatgaaaattacaggtccttacctagggacaccagcaactggtctaatcagtttcaacgcgataacgctaggtcaagcctaagtgcctcccaccccatggtgggtaagtggttggagaaacaggagcaagacgaggatggtaccgaagaagacaatagccgtgtcgagccggtgggccatgccgatacgggattagaacacatacctaatttcagcttggatgatatggttaagttggtagaggttccaaacgatggtggacctttggggatccatgttgtccctttcagcgcccggggcgggaggacactggggctactcgtgaagcggctggaaaaaggcggcaaagccgaacacgagaatctctttcgggaaaatgactgtatcgtaagaatcaatgatggggacctaaggaatcgacgctttgagcaggcccagcacatgttccgccaagctatgagaacgccgattatctggttccacgtcgtccccgccgcgaataaggaacagtacgaacagctgtcacagtctgaaaaaaacaactattattcctccagattctcccccgattctcagtacatcgacaacagatcagtcaatagcgcgggcctccacaccgtgcagcgggcaccccggcttaatcatccccctgaacagatcgactcacactctcggctccctcactctgctcacccctccggaaaaccgccttcggcacccgcgtcggcacctcagaacgtattcagtaccacagtgtcctcaggctacaataccaaaaagataggaaagaggttaaatattcagctgaagaagggcaccgaaggcctgggctttagcatcacgagcagagacgttactatcgggggctctgcacctatctacgtcaagaacatcttgcctcggggggctgccatccaggatggtcggctaaaagccggagaccgcctcatagaggtcaacggggtggacctggtcggcaagagccaggaagaagtcgtctccctccttaggagcacaaagatggagggcaccgtctccctcctggtgttcaggcaagaggacgcctttcaccctcgtgagctgaatgcagagcctagccaaatgcaaatacctaaggagacaaaggccgaggacgaggatattgtgctaacgccggacggtactagggaatttttgacgttcgaggtgccactcaatgatagtggctcggccgggctgggcgtgtccgtgaaggggaatcgctctaaagaaaatcacgcagacttggggatctttgtgaagagcatcataaacgggggtgcagctagtaaggatggccggctccgggtaaatgaccagttgatcgctgtgaatggggagtctctccttggtaagactaaccaggacgcaatggagactttaaggaggagcatgtccaccgagggcaacaagaggggaatgatccagctgattgttgcacggcgaatttccaaatgcaatgaactcaaaagtccggggagcccaccagggcctgagctgccaatcgaaacagcactggatgatcgcgaaaggagaataagtcatagcctctatagcggcatagaaggactggacgaatccccgagtagaaacgccgcactctcccgcatcatggggaagtatcagctatcaccgactgtgaatatgccccaagacgacacagtgataattgaggacgatagactccctgtcttgccgccccatttaagcgaccagtcttcgtcttcctctcacgacgatgtgggcttcgttaccgctgacgccggtacatgggccaaagccgccatcagtgattctgccgattgcagcttatccccagacgtggaccccgtgctggcatttcagagggagggatttggccggcaaatcgccgatgagacgaagctgaacactgtcgatgatcagaaggcaggcagcccgtccagagacgtggggccatctctgggactcaagaagtcaagcagcctagagagtttacaaacggccgtagccgaggtgactctcaatggcgatattccatttcatcgtcctaggccccgcattatccgggggcgggggtgtaacgagtcttttcgcgccgctatagataagagctatgataagccagccgtggatgatgacgacgagggcatggaaacactagaggaggatactgaggagtctagcaggagcggtagagagtcagtttccacagcatctgaccaaccctcacacagtctagagcgtcaaatgaacgggaatcaggaaaaaggcgataagacagataggaagaaagacaagacaggaaaggagaaaaaaaaggaccgtgacaaagagaaggacaagatgaaggctaaaaagggaatgctcaaaggactgggcgatatgttctcattagcaaagctgaagcccgagaagcggtag

SEQ ID NO: 127863 - DNA, 2967 bp, Artificial Sequence
  Description of Artificial Sequence: Synthetic coding sequence
atgaaggtcaccgtgtgcttcggccggacaagagtggtggtcccgtgtggagacggtcacatgaaggtcttctccctgattcaacaggcggtaacccgatataggaaggctatagcaaaagaccctaactactggattcaggtgcacagactcgagcacggagatggtgggatattagatttagatgatattctgtgcgatgttgccgacgataaagatcggttagtcgcagtattcgatgaacaggatccgcatcacggtggcgacgggaccagcgcttcctccacgggaactcagtctcccgaaatatttgggtcagagctcggcaccaataacgtgtccgcgttccaaccgtaccaggccacaagcgagatcgaagtcaccccctccgtgctgagagcaaacatgccgttgcatgttcggcgtagtagcgatcccgcactgatcggtttgagcactagtgtttccgactccaatttttctagcgaggaaccatcacgcaaaaatcctaccaggtggtccacgacagctggctttctcaagcagaacacagccggctcacctaaaacgtgtgatagaaagaaggacgaaaactacaggtccctcccacgtgacaccagtaattggtccaatcagttccagagagataacgccagaagctcactgtcagcctctcacccaatggttggcaagtggctggaaaaacaggagcaggacgaggacggaacagaagaagataatagccgcgtggaaccagtcgggcacgcggacaccggcctggaacatatcccaaatttcagcctcgatgacatggtcaaactggtggaagtgcctaacgacggaggacccctgggaattcatgtagtacccttcagcgctcgcggtggtagaacattgggcctccttgtcaagagactagagaaaggcggaaaagccgaacatgagaatctgttccgggaaaacgattgcatcgtgcgaataaacgacggagacctgcgaaatagacggtttgagcaggctcagcacatgttccggcaggcaatgcggacccctattatctggttccacgtagtgcccgcggccaataaagaacagtatgagcagctgtcgcagtccgagaagaataactactactcgtcacgcttcagccctgattctcagtacatcgataatcgctcagtgaattctgcaggcttacacaccgtacaacgcgcgcctaggttaaatcaccctccggaacaaatcgatagccattcacgacttccccactctgctcacccttcaggcaagcctccttctgccccagcatcagcgccccagaacgtcttcagcactaccgtgtctagtgggtataacaccaagaaaatcggcaaacgcctgaacattcagctgaaaaaaggcactgagggactcgggttctctattacctcccgcgacgtgaccatcggagggagtgcaccaatctacgtgaaaaatatcctccctcgtggggctgcaatacaggatggccgccttaaagctggagacagactgattgaagtcaacggagtggacctggtggggaagagccaagaggaagttgtgtccctgctccgcagtactaaaatggaaggcactgtgagcttgttagtttttcgtcaggaggacgccttccatccacgggagctgaaggcggaggatgaggatatcgtgctcacacctgatgggacgcgggagtttctcacatttgaagtgcctcttaacgatagtggctctgctgggctcggagtgtcagttaaaggaaatagatctaaagagaatcacgctgatttaggaatcttcgttaaatcgattatcaacggaggagcggcatctaaggacggccgcctccgggtgaacgaccagttgatagcggtgaatggggagtctctactgggcaaaaccaaccaagacgccatggagacactccgccgtagcatgtctacggaagggaataagcgcggaatgattcaactcattgtagcgcggaggatttcaaaatgcaatgaactaaaatcacccggaagcccgcccggcccagagctccccatcgagacagccctcgacgacagggagaggcggatctctcattctctctactcaggtattgagggcttggacgaaagtcctagcaggaatgctgccttatctaggatcatggggaaataccagctgagcccaaccgtgaatatgcctcaggatgacaccgtgataatcgaggatgatcgattaccggtcctgccgcctcacctgagcgatcaatcttcctctagcagccatgacgacgtaggtttcgttactgccgacgcaggaacttgggcaaaagccgcgatatccgacagcgcagattgctcgctctcgccagacgtggatcctgtgctggcctttcagagagagggcttcgggaggcaaatcgctgatgagactaaattaaacaccgtggatgatcagaaggctgggtccccttcccgcgatgtagggccgtccctcggtctcaaaaagtcatctagtttggagtcactacagactgctgtcgccgaggttactctgaatggcgatatcccattccatcgccctagaccaaggattatccgcgggcgcggatgcaatgagagctttcgggctgcaatagacaagtcctatgacaaacctgctgtcgacgacgatgatgaggggatggagaccctcgaagaggatacagaagagtcctcaagatccggtcgagagtccgtgtctacagcgtctgatcagccctcgcattccctggaaagacagatgaatggcaatcaggagaaaggggacaaaacagaccgtaagaaggataaaaccggtaaggagaaaaagaaggatcgggataaagagaaggacaaaatgaaagctaaaaagggaatgctcaagggcctgggggatatgttcagcctggccaaactcaaaccggagaaaagatag

SEQ ID NO: 127864 - DNA, 4062 bp, Artificial Sequence
  Description of Artificial Sequence: Synthetic coding sequence
atgaaggtcactgtttgttttggccgaaccagggtggtggtaccctgcggagatggccatatgaaagtctttagcctgatacaacaggccgtgacaagatacaggaaggcaatcgccaaagatcccaattactggatccaggtccatagattggagcacggtgatgggggaatccttgacctagatgatatcctttgtgatgtcgccgacgacaaagatcggctcgtggccgttttcgatgagcaggatccccatcatggcggggacggcaccagtgcctcttcaactggcacgcagtcccccgaaatcttcgggtccgagctgggtactaacaatgttagcgcctttcagccttatcaggctactagcgaaatagaggtgaccccatcagtgctgagggctaacatgccgctgcatgtccggagatccagcgacccagctctgatcggactcagtacctccgtgagtgatagcaatttctcttcagaggaacccagcaggaagaaccccacgcgatggtcaaccacagctggttttctgaaacaaaatactgccggtagccctaagacctgtgaccgcaaaaaggatgagaattatagatctttgcccagagatacatccaattggagcaatcagtttcagcgagacaacgctcggagtagccttagcgctagccacccgatggtcgggaaatggctcgagaagcaggaacaggacgaagacggcaccgaggaagacaactccagagtggaacccgttggccatgccgatacgggcctggaacacattcccaacttttcacttgacgacatggtaaagctagtagaagtccctaacgacggtggtcccctggggattcacgttgtgccattcagcgcgagaggaggacggaccctgggtttgctcgtcaaacgcctggagaaaggcggcaaggccgaacatgagaatctgttccgcgagaatgattgcatcgttcgtattaatgacggcgacttacggaaccgccgctttgaacaggcacagcacatgtttaggcaggctatgcgtacccccataatatggtttcatgtcgtgccagcagccaacaaggagcaatatgaacagctgtcacagtcagagaaaaataactactactcctctaggttcagtccggacagtcagtacatcgacaatcggagtgtgaactccgctggcctacataccgtgcagagggcaccccgcctaaatcaccccccagaacagatcgattcccacagtcggttgccccattccgcacaccctagtgggaaacctccctccgcacccgcatcagctcctcagaacgtgtttagcaccactgtgagcagcggatacaatacaaaaaagattgggaagcggcttaacatccaattgaagaaggggaccgaggggttggggttcagtataactagcagagatgtgacgattggcggatcagctcccatttatgttaagaacatcctccccagaggggccgccatccaagatgggcgcttaaaggccggggaccgcctgattgaggttaacggtgtagacttggtaggtaagtcccaggaagaggtggtatcactactgcggagcacaaaaatggaggggactgttagtctgttagtgtttcggcaggaagacgctttccatcctagagagctgaatgcagagccgtcacagatgcagattcccaaggagactaaagctgaggacgaagatatcgtgctgacccccgatggtacccgagaattccttacgttcgaggtgcctcttaatgacagcggttccgccgggttaggcgttagtgtaaagggaaatagaagcaaggaaaaccacgctgatttgggtattttcgtgaagagcatcatcaatggtggcgccgcgtctaaggacggacgcctgagagttaacgaccagttaatcgcagtgaatggcgaaagtctgctaggaaagacgaaccaggacgctatggagactctgagacgctcaatgtccacggagggaaataagagaggaatgatccagctgatcgtggctagacgtataagtaagtgcaatgaactcaaatcccccgggagtcctccaggccccgagcttcccattgagaccgccctggatgaccgggagaggcggatctcccattcactctactcaggcatagaagggctggacgagagcccctctcgaaacgcggcgcttagccgcataatgggaaagtaccagcttagccccaccgtgaacatgccgcaggatgacaccgtcattatcgaagatgacagattgcctgtcttgcctccacatctgtctgatcagtcctcatccagcagtcacgatgatgttggttttgtaaccgctgacgccggtacttgggctaaggctgctattagcgatagcgccgattgcagcctgagccccgacgttgaccctgtattggcttttcaaagggagggcttcggacgccagtcaatgtctgaaaagcgcactaaacagttcagtgatgctagtcagctcgatttcgtgaaaaccaggaaaagcaaatcaatggatttaggaatagccgatgagacgaaacttaacaccgtggacgatcaaaaagcagggagcccttccagggatgtggggcccagtttggggttgaagaaatcctcctcactggaatctctccagaccgctgtcgccgaggtgaccctgaacggagatatcccattccatagacccaggccccgcatcattagagggagaggctgtaacgagagcttcagagcggcgatcgataaaagttacgataagccggccgtggacgacgatgatgaaggaatggaaacactggaagaggatacggaagaatctagccgatcaggacgcgagtctgtctccaccgcctccgatcagccttcgcacagtctggagcggcagatgaatggtaaccaggagaaaggggacaaaaccgatcggaaaaaagataagaccggaaaggagaagaagaaggacagggataaagagaaggacaagatgaaggccaagaaaggcatgctgaaaggtctgggagatatgttccggtttgggaagcatagaaaggacgacaagatcgagaaaaccgggaaaattaaaatccaggagagctttacaagcgaggaagagcgtatccgcatgaagcaggagcaggaacgcatccaggccaagactagagaatttcgtgagcgccaggcccgcgaaagggactacgcggagattcaggactttcaccgtactttcggttgtgatgatgagctaatgtacggaggagtatcctcctatgagggatcgatggcacttaacgcaagaccccagtctccaagggaagggcacatgatggatgcactgtatgcacaggtgaagaaacccaggaactctaagcccagccctgtggactccaaccgctcaactccatcaaaccacgacaggatccaacgcttgcgccaagaatttcaacaggccaaacaggacgaggacgtggaggaccggagaagaacctactctttcgagcagccctggcccaatgcccggcctgccacacagtccggccgacactccgtgtctgtggaggtccagatgcagcgccagcgccaagaggagagggaatcatcgcaacaagcccagcgccagtactcttcacttccccgccagtcacgtaaaaacgcgtctagtgtgagccaagactcttgggagcaaaattactctccaggagagggttttcaatccgctaaagaaaaccctcggtactccagttaccagggttctagaaatgggtatctgggtggccacggttttaacgccagagtcatgctcgagactcaagagctgctgcgacaggaacagcgccgcaaagagcagcaaatgaagaaacagccccctagcgagggtccttcgaattatgacagctataagaaagtgcaggacccaagttatgcacctcccaagggacccttcaggcaggacgtgccaccgagtccctcacaggttgcaaggcttaatcggttgcagacccctgaaaaggggcgccccttttacagttag

SEQ ID NO: 127865 - DNA, 4071 bp, Artificial Sequence
  Description of Artificial Sequence: Synthetic coding sequence
atgaaagtgacggtctgctttggcagaactagggtcgtggtgccatgcggggatggccacatgaaagtgtttagcctaattcagcaagccgtcactcggtacaggaaagcaattgcaaaagacccgaattactggatacaagtgcaccgcctggagcacggcgatggaggcattttagatctggatgacatattgtgcgacgtcgcggatgataaagaccggctagtggcagtgtttgatgagcaagatccccatcacggaggggatggtacctccgccagcagcacaggcacgcaatcacctgaaatctttggctctgagttaggtaccaataacgtgtctgcttttcaaccttaccaggccacctcagagatcgaggttacaccgtccgttctcagagctaatatgcctctgcacgttcgacggtcctctgaccccgcccttatcggtctttccacttctgtgtctgattccaattttagctctgaggagccctccaggaagaacccaactcgatggtcaactaccgccgggttcctgaagcagaacacagccggatctccaaaaacttgcgaccgaaagaaggatgaaaattatagaagtctgcctagagacacgtcgaactggagcaaccagttccaacgggacaatgcacgaagtagtctctctgcctctcatccaatggtaggaaaatggctggagaagcaggaacaggatgaagatgggacggaagaagataactctcgggtcgagcccgtggggcacgccgataccggcctggagcatatcccaaactttagtcttgacgacatggttaagcttgtagaggttcctaacgatggtggcccattgggtatccatgtggtgccattttccgcccgtggcggaaggacactaggactgctggtgaaaaggctagaaaaaggtggcaaagcagagcatgagaatctcttccgggaaaacgactgtattgtcaggatcaatgatggcgatcttcggaatagaagattcgagcaggctcagcacatgttcagacaggcaatgcgcacccctattatttggttccacgtagtaccggccgcaaacaaagaacagtatgagcaactgagccagagtgagaaaaataactactattcttccaggttctcacctgacagccagtacatagataatagatctgtcaatagtgccggcctgcacacagttcaacgtgctcccagactcaaccaccccccagaacagattgacagccactcccgccttccacacagtgcccacccatctgggaagccaccttctgcccctgcctcagccccccagaacgtattctcaacaactgtgagcagcggctataataccaagaagatagggaagcgtcttaatattcaactgaagaaaggaacagaaggtctgggattctctattacgtcaagggatgttacgattggcgggagcgccccgatctatgtcaaaaacatcctcccacgcggggccgccatccaggatgggagattgaaggccggtgaccggttgattgaagtaaacggagtagacctggttgggaagagtcaggaggaagtggtttctctactgcggagtactaagatggagggaaccgtgagcctcctcgtgttccgccaggaagatgcctttcatccgagagagctgaatgccgaaccaagtcagatgcagataccaaaagagaccaaagccgaagacgaggacatcgtactgacccctgatggaactagggaattcctaacctttgaggtgccactgaatgattcgggcagcgccggcctcggagtgagcgtcaagggcaatcgcagcaaggaaaaccatgctgacctgggcatattcgtgaagtctatcataaatggcggggccgcctccaaagatggaaggctaagagtgaatgaccaactgattgccgtcaatggcgaaagcctgctcgggaaaaccaatcaggatgccatggagacgcttaggcgcagcatgtccactgagggtaataagcggggtatgatacagcttatcgttgcgaggaggattagtaaatgtaacgaactcaagtctcctgggtcacctccaggcccagagcttccaattgaaaccgcgctggatgacagggaaaggaggatcagccactccttatattcaggcatcgaagggttggatgagagccccagcagaaacgctgccctgtccagaattatgggcgagtctgggaagtatcagctgtctcctaccgttaatatgccacaggacgatacagtgataatcgaagatgatcgtctaccggtcttgcctccacacttgagtgaccaatcaagctcctcctcccatgacgacgtggggttcgtgaccgcggacgccggaacatgggccaaggcagccatcagcgactccgccgactgttctctcagccccgacgtagaccccgtcttagctttccagcgcgaagggttcggacgacagtctatgtccgaaaaacgcacaaaacagttttctgatgcctcccagctcgactttgtgaaaacacggaaatccaagtccatggatctcggaatcgccgatgagacaaaattaaacaccgtagacgaccagaaggcagggtccccttctcgcgatgtggggccttcactaggcctgaagaagagctcttctttggaatcgctgcagactgcagtggcagaagtaactctgaacggagacattccctttcaccggcctagaccaaggatcatccggggccgcggatgtaatgaatccttcagggctgccatagataagtcatacgataagcctgccgtggatgacgacgatgaaggaatggagacactggaagaagatactgaggaaagtagtaggtccggtcgtgaaagtgtgtctacagcttccgatcagccttcccatagcctggagcgccagatgaatggcaatcaagagaaaggggataagactgatagaaaaaaggacaagaccggcaaagagaaaaaaaaggaccgtgataaggaaaaagacaagatgaaggcaaagaaggggatgctgaaagggctcggtgacatgtttagattcggaaaacatcgaaaggacgacaaaatcgaaaagacaggtaagattaaaatccaagaatctttcacatcagaggaggagaggattcggatgaagcaggaacaggagcgcattcaggcaaagacgcgagaatttcgagagaggcaggctagggagcgcgactatgctgaaattcaagatttccacaggacttttggttgcgacgacgaattaatgtatggtggcgtcagctcttatgagggctccatggccctgaatgcccgtccccaaagtccacgggaaggtcatatgatggacgccctctacgcacaggtgaagaagcccagaaactctaaaccttcaccagtggatagcaaccgctctactcccagcaatcacgataggatccaacgcctgcggcaggagtttcagcaggccaaacaggacgaggatgttgaggacagacggcgaacctattcctttgaacaaccctggccgaacgcacggccagcaacacagagtggtagacactccgtctcagtggaggtgcagatgcagagacagagacaggaagaaagagagtctagccaacaggctcagagacaatactcctcactgcctcgccagagtcggaaaaatgcctcctccgtgagtcaggactcgtgggaacagaactactcgcccggggagggattccagagcgccaaagaaaacccacgatatagttcttatcaagggagtagaaatgggtacttgggcggccacgggttcaacgcaagggtgatgttagaaacgcaagagctgctccgtcaggagcagcggaggaaagaacaacagatgaaaaagcagccgccttctgagggcccctcaaattacgattcctataagaaagtgcaggacccgtcctacgccccaccgaaaggaccattccgacaggatgtacctccttcacctagccaggtcgcgagactaaatcgtttgcagacccccgagaagggccgccctttctatagttag

SEQ ID NO: 127866 - DNA, 3891 bp, Artificial Sequence
  Description of Artificial Sequence: Synthetic coding sequence
atgaaggtgaccgtctgtttcgggcggacacgggtggtggtcccatgcggcgacggtcacatgaaggtgtttagcctgattcagcaggccgtgaccagatacagaaaagccatcgccaaggatcccaactactggatccaagtgcacaggctagaacacggggatggagggattcttgatctcgatgatatcttgtgcgatgtggcagacgacaaggataggctggtcgcagtttttgacgaacaggacccacatcacggcggtgacggtaccagtgcctcctccactggcacccagtcgcctgaaattttcggtagcgaactgggtaccaacaacgtaagtgcttttcagccctaccaagcaaccagtgagattgaggttactcccagcgtgctgagagccaatatgccactccacgtgcggaggtcttcagacccagcgcttatagggctgtctacttcagtctccgacagcaactttagctccgaagaaccttcacgcaagaaccccacaagatggagtacaacagccggtttcttgaagcagaataccgcaggaagcccaaaaacatgcgaccgcaaagacgaggatgggactgaggaggataatagccgcgtagagcccgtgggacatgctgacaccggccttgagcacatccctaacttcagcttagacgatatggtcaaactcgtggaggtgccaaatgatgggggcccgctgggaatccacgtcgtgccatttagcgcaaggggcgggcggaccttaggcctcttggtcaagcggcttgaaaaaggtggaaaagccgagcacgaaaacctgttcagagagaacgattgcatcgtgcgcattaacgatggggatttgcggaatcggagattcgaacaggcgcagcacatgttccggcaggcaatgcgcaccccaattatatggttccatgtagttcccgccgcgaacaaggaacaatatgaacagttaagccagagcgagaagaataattattactcatcacgcttctctccggattcccagtatattgacaaccggtccgtgaacagcgccggtctccacacagtgcagcgagcacctaggttgaaccaccctcctgagcagattgatagccactctaggctgccacacagcgctcatcctagcgggaaacccccatctgcgcccgcgtcggcaccccagaacgtgttctccactacggtgtctagcggatataatactaaaaaaatcgggaagaggctgaacatccagctgaagaaagggactgagggcttgggcttctccattacatctagggacgtcaccatcggcggctctgcgcccatctatgtgaaaaatatcttgccccgcggcgccgctattcaggatggcagactgaaggccggggatagactcattgaagttaatggcgtagacctcgtaggtaaatcccaggaggaagttgtgagccttctgcggtccacaaagatggagggcacagtgagcctgctggtgtttaggcaagaggacgcgttccatccaagggagctcaaagcagaggacgaagatatcgtcttaacaccagacggaaccagggagtttttaaccttcgaggttcctctgaacgatagtggttcagccggcctgggagtgtcagtaaaagggaatcgctctaaggaaaaccacgcagatcttggtatcttcgtcaaatcgataattaacggcggtgccgccagcaaagacggccgcttgcgggtcaatgaccagctgattgccgttaatggcgaatcgttgttgggtaaaaccaatcaggatgccatggaaacactcagacggtctatgagcactgagggaaacaagagagggatgattcagttgatagtagcgcggcgaattagcaaatgcaatgaactgaaatcacccggctccccccccggcccagagttgccgattgagacagcactcgacgatcgagagagacgcatttcacacagtctgtactctggtattgaagggctggatgaatctccatccaggaacgcagccctgtcacgaattatgggcaaataccagctctctcccactgtgaatatgccacaggacgacacagttattatcgaagatgataggctgcctgtgctgccaccacacttatcagaccagagttcttcttcaagtcacgacgacgtgggatttgttaccgctgacgccggtacctgggccaaggcagctatttccgactcggctgactgctctctgtctcccgacgtggaccctgtactggcctttcaaagggaaggcttcggacgacaatctatgtccgaaaaacgcactaagcaattcagtgatgcttcacagctggatttcgtgaagacccggaaatctaaaagcatggatctaggcattgccgatgagacaaaactgaataccgtggacgatcaaaaagctggatccccctctcgtgatgtgggccccagcctggggctgaaaaaaagctcttcattggagtcattgcagaccgctgtggccgaggtgaccttaaacggggatataccatttcacagaccccgccctcgcattatccggggacgcggatgcaacgagagtttccgcgccgcaattgataaaagttatgacaagccagccgtcgatgatgacgatgaaggcatggaaactctggaggaagacaccgaggagagtagcagaagcgggcgcgagagtgtttctaccgcatccgatcagccttctcacagtctcgaaaggcagatgaacggtaatcaagagaaaggcgataagacagacagaaaaaaggacaaaaccggaaaagaaaagaaaaaggaccgcgacaaagagaaagataagatgaaagccaagaagggtatgctgaaaggtttgggcgacatgtttcggtttggcaagcacagaaaggacgataaaatcgaaaagacgggcaagattaagattcaggagtctttcacatccgaggaagagcggatccgaatgaaacaggagcaagagaggatacaggcaaagacgcgcgaattccgagagagacaggcacgcgagcgggactacgcggaaattcaggatttccaccgcactttcgggtgcgatgatgagctgatgtacggaggcgtgagctcttatgaaggcagtatggcacttaacgctcgaccacagtcgcctcgggaggggcacatgatggacgctctctatgcccaggtaaagaaaccaaggaattccaagccctcccccgtcgacagcaacagatctacaccttcgaaccacgacaggattcagcgactgaggcaggagttccagcaggccaagcaggacgaggatgtggaagaccgcagacgcacctattctttcgaacagccatggcccaacgcaaggcccgcaacacagtcagggcgccattccgtctctgtggaggtccagatgcaacggcagcgtcaggaggagcgcgagtcatcccagcaggcccagaggcagtatagcagcctacctcggcagtctcgcaaaaatgccagttcagtgagccaagattcatgggaacagaactattcaccaggggaggggttccagagcgcgaaggagaatccccgctattcctcgtaccagggatccaggaacggatacctcgggggacacggcttcaacgctcgagtgatgttagaaactcaggagttgctgcggcaggaacagcgaaggaaggaacagcagatgaagaagcagcctcccagcgagggcccctctaattacgatagctataagaaagtgcaagacccatcttacgctcctcctaagggaccctttagacaggacgttcctccgtccccctcacaagtggctagactgaacaggttgcagactccagagaaggggcggccattttatagttag

SEQ ID NO: 127867 - DNA, 3735 bp, Artificial Sequence
  Description of Artificial Sequence: Synthetic coding sequence
atgaaagtcaccgtttgcttcggccggaccagggtcgtggttccgtgcggcgatggacacatgaaggtgtttagcctaatccagcaggccgtgacaaggtaccgaaaagcaatcgccaaggaccctaactactggatccaggtccaccggctcgaacacggagatggaggaattctggatctggatgatatcctgtgcgatgttgctgatgacaaagaccgtcttgtggcggtcttcgatgaacaggacccacatcatggtggcgacgggacaagcgcctcctccacaggaactcagtccccagagatatttggcagcgagctggggactaacaacgtctccgccttccagccatatcaggcgactagcgaaattgaagtcaccccatccgtattaagagcaaatatgccgctccacgtcagaaggagcagcgacccggcactgattggcttgtcgaccagcgtgtcagatagcaactttagttctgaggagcctagtcgcaagaatccgactcgctggtcgacgacagctggattccttaaacagaacaccgccggatcaccaaagacctgtgacaggaaggatgaagatggcacagaggaggataacagtcgtgttgagcctgtggggcacgccgacacggggctggagcacatccctaatttcagtctggacgatatggttaagctagtcgaggtgccgaacgatggtggtcctttaggaatacatgtcgtcccattcagcgccagaggcgggagaaccctcgggctgttagtgaagcgcctagagaagggcgggaaggcagagcacgaaaacctgtttagagagaatgattgcattgtgcggatcaatgacggggacttgaggaaccggcggttcgaacaagcccaacacatgttccggcaagccatgaggacccctatcatttggtttcatgtggtccctgccgcgaacaaagagcaatatgaacagctctcacagagtgaaaagaataactactacagtagtcgcttcagtcctgatagccagtatatcgacaaccgatctgttaactcagctgggctccacaccgtccagagggctccacgcctgaaccacccccccgaacagattgatagccatagccgccttcctcactccgctcatccgtctggtaaaccgccgtccgcccctgcaagtgccccacagaatgtgttctctacaaccgtgtcaagcgggtataatacaaagaagatcggaaagagactaaacattcagctcaaaaagggaacagagggcctggggttcagtataacaagcagagacgtgactatcgggggctccgctccaatctacgttaaaaacattcttccacgcggtgccgcgatccaagatggacgccttaaggctggagatagacttattgaggtaaacggtgtggatttagtgggaaagtctcaggaggaagtggtgtctctgctccgctctaccaaaatggaggggactgtgtcgctccttgtgtttagacaggaggacgctttccaccctagggaactgaaggcagaagatgaggacatagtcctgacacctgacggcactagagagtttctgacattcgaggtgcccctgaatgactctggctctgcaggattgggcgtgtcagttaagggaaatcggtccaaagaaaaccatgccgatttaggcatttttgtgaaatctatcattaatggcggagccgcatctaaggatggtcgactcagggtgaacgaccagctcatagccgttaatggcgagtcattgctcggcaaaaccaatcaggatgcgatggagactctaagacggagtatgagcaccgaggggaacaagcgtggcatgatacaattgatcgtggccagaaggatttcaaagtgtaacgaacttaaatcaccaggcagcccacctggcccagagcttccgatcgagactgcattggacgaccgtgaaaggcgaatctcgcattcgctttacagcggtatcgagggcttagacgagagtccaagccggaacgccgctcttagccggatcatggggaaatatcaattgtctcccacagtcaatatgccccaagatgacactgtaattattgaggacgatcgcctgcccgttttgccaccacatctttcagatcagtcatcctcctcctcgcatgatgacgtgggatttgtgacggcagatgctgggacttgggcaaaggccgccataagcgacagcgcagactgctcattaagcccagatgtggatccagtgctcgcatttcaacgtgaaggattcggaagacagagcatgtctgagaaacggactaaacaattcagtgatgctagccaacttgatttcgtaaagactagaaagtccaagagcatggacctgggttccagccccagccgggacgttggtccctcactgggattgaagaagtcgagctcactggaatcactgcagactgccgttgctgaggttaccctcaatggggacataccattccaccgacctcgtcccaggatcatccggggcaggggatgtaacgagagcttccgcgcagccattgataagtcatacgataagccagctgtggacgatgacgacgagggaatggaaactctcgaggaggacacagaggagtcctccagatcagggcgcgaatctgtctccaccgcctccgaccagccctcccacagtcttgagagacagatgaatggcaaccaagagaagggtgacaaaactgacaggaagaaagacaagacaggaaaggaaaagaagaaggaccgtgacaaggagaaggacaagatgaaagctaagaaagggatgctcaagggcctgggcgacatgttccgaattcaggcgaagaccagggagtttagggagcgacaggcccgggagcgtgattacgcagagattcaggactttcacaggacttttgggtgtgacgatgagctgatgtacggaggggtaagcagttacgagggctcaatggccctcaacgcaaggcctcagtcaccccgcgaaggacacatgatggacgctctgtacgctcaggtcaagaaaccacgcaattcaaaacccagtcctgttgattcaaaccggagcaccccatctaatcatgaccgcattcagcgactcagacaggagttccaacaggctaaacaggatgaagacgttgaggaccgccggcggacttattctttcgaacagccctggcccaatgcgaggcccgccacgcagagcggccgccactccgtgtctgtggaagtccaaatgcagagacaacggcaggaagaacgggagtcgtctcaacaggcgcagaggcagtactcgtcgctacctcggcagagcagaaagaacgcatcatccgtctcccaggacagctgggagcagaactactcccccggcgaaggctttcagtcggctaaagagaatccacggtattctagttatcaaggaagcagaaacgggtatctgggcgggcatggtttcaacgcacgtgtcatgctcgagacccaggagctgcttcgacaggagcaacgacgcaaggagcagcaaatgaaaaagcagccaccctcggaggggcccagtaactacgactcatacaaaaaggtgcaagatccaagctatgctccacccaagggtccttttagacaggacgtcccaccatcgccttcccaggtggctaggttaaatcggctccaaacacctgaaaaaggtcgccctttctacagctag

SEQ ID NO: 127868 - DNA, 2244 bp, Artificial Sequence
  Description of Artificial Sequence: Synthetic coding sequence
atggtaaaattggtggaggtgccaaacgacggaggtcccctcggaatccacgtggttcccttctctgccaggggaggcaggaccctgggtctcctggtcaagcgtcttgaaaaagggggtaaagcagagcacgagaacctgtttagagaaaacgattgcatcgtgcgcatcaatgacggtgatctcagaaatcgcaggtttgagcaggcccagcacatgtttcgacaggccatgcgaacacctatcatctggtttcatgtggtccccgccgccaacaaagaacagtacgagcaactgagtcagagtgagaagaacaactactactcatcccggttctccccagatagtcagtacattgacaatcggagtgtgaactccgctggacttcatacagtccagagggcccctaggctgaatcacccacccgaacagattgacagccattcccgccttccacactccgcccatccaagcggcaaacccccttctgcccccgcttccgctccccagaatgtgtttagcacgaccgtgtcttccggctataataccaagaaaatcggaaaacgcctcaatattcagctgaagaaaggcacggagggacttggattttctataacctctcgtgacgtgaccatcgggggttccgccccaatttatgtcaagaacatcctcccccgcggggctgccattcaggacggccggttgaaggccggagaccggttgatagaggtcaatggcgtcgatttagtcggcaaatctcaggaggaggtggtcagcctgctccgttccactaagatggaaggcacagtgtctctgttggtgtttagacaagaggacgcttttcacccacgcgagctgaaagctgaggatgaggacattgtgctcacccctgatggcacacgggaatttcttacgttcgaggtgccactgaatgacagcggaagtgctggacttggcgtgtccgtgaagggaaatcggtctaaagaaaaccacgccgatttgggtatcttcgtgaagagcattatcaacggcggcgccgcctctaaggacggacggttgcgggtcaatgatcagctgattgccgtcaatggcgagagcctgctgggcaaaaccaaccaagacgctatggagactctcagaagaagcatgagcactgaggggaataagagaggcatgatccagctgatcgtggccaggcgcatttccaagtgtaacgagctcaaatcaccaggcagccctcccggaccagaactgcccattgaaacagcacttgacgatcgcgagcggcgcatctcgcactccctctattctggtatagagggattagatgaaagcccttccagaaatgcagctctttccaggatcatgggcaagtaccaactgtcacctactgtgaacatgcctcaagatgacactgttatcattgaagacgaccgcctgccagtgctgccaccccacttatctgatcagtctagcagctcatctcacgatgatgtgggattcgtaaccgcagacgccggtacttgggccaaagccgctattagcgattctgccgactgttctctctcgccagatgtggatccagtcctggcgtttcagagggagggcttcggcagacagtcaatgagcgagaaaagaaccaagcaattcagtgatgcatcccagctggatttcgtgaagacgcggaagagcaagagtatggatctcgtagcagacgagaccaaactgaacaccgtcgacgaccaaaaagctggctccccatctagggacgtggggcctagtctgggcttgaagaagtcaagctccttggaaagcctccaaacagccgtggccgaagtgaccctgaacggcgatatcccttttcatagaccaagaccacgtattattagagggcggggctgcaacgagtccttccgcgcagctatcgacaagtcctacgacaaaccagctgtcgacgacgatgatgaaggcatggagaccctggaggaggacaccgaggaatcctcccggagcggcagggaatctgtgtccaccgcctccgaccagccctcccactcattagagcggcaaatgaacggtaaccaggagaagggcgacaagacagacaggaagaaggacaagaccggaaaggagaagaagaaagaccgagataaggaaaaagacaaaatgaaagcgaagaaaggcatgctcaagggactgggagatatgttttccctcgctaagctgaagcccgaaaagcggtag

SEQ ID NO: 127869 - DNA, 3801 bp, Artificial Sequence
  Description of Artificial Sequence: Synthetic coding sequence
atgaaggtaaccgtgtgttttggacgtactcgggtggtggtgccctgcggcgacggccacatgaaagtcttttcactgattcagcaagcggtcacccggtataggaaggccatcgcaaaggatccaaactactggatacaggttcaccgcctggaacatggtgatggggggatcctggatttagatgacattctgtgcgatgtggcagacgacaaggataggctggttgcagtgttcgacgagcaggatcctcaccatggaggggacggcacaagcgcttccagtactggcacgcagtcccccgagattttcggtagcgagcttgggactaataacgtgtcagcatttcagccgtaccaggctacttccgaaatagaagtgaccccaagcgtcctgagagccaacatgccgctccatgtccgtcggtcgagcgatccagcgctcatcggcttatcaacctctgtgagtgactccaacttctctagcgaggagccgtctcgaaaaaatccgactcggtggtcaacgactgctggctttctgaagcagaacactgccggcagtccaaaaacttgtgacagaaaggatgaggacggcactgaagaggataattcacgggtagagcccgtaggacatgctgacacaggcttggagcatatccccaacttctccctggacgatatggttaaactcgtagaagttccaaatgacgggggcccccttgggattcacgtggtcccattctcagcccgcggggggcgcactctgggcctgctcgttaagagactcgagaaggggggtaaggcggagcatgaaaatcttttccgcgagaacgactgcatcgttcgcatcaatgatggggatctgaggaataggaggtttgagcaagcccaacacatgttccggcaggctatgcgaacaccgataatatggttccacgttgtgcctgcagccaacaaagaacagtacgagcagctgtcccagtccgagaagaataactattatagctcccgcttttctcctgacagccaatacatcgacaacaggtctgtaaactccgcagggctacacaccgttcagcgagcccctaggcttaatcatcctccagagcagatcgacagccactcacgactccctcactcagcacacccgagcgggaagcctccgtctgctcctgcttccgcaccccagaatgtgtttagcacaacagtcagcagcggctataacaccaagaagataggaaagcggttgaatattcaactcaaaaagggcacagagggcctgggctttagcattacatcgcgtgacgtgactattggaggcagcgcacctatttatgtgaaaaatattctgccacgaggagccgctattcaggacggaaggctcaaagccggcgatcgtctcattgaagtgaatggagtggacctggtcggcaaaagccaggaggaagtagtctctctgctcaggagcactaagatggagggaactgtgtcgctgttggtgttcagacaggaagatgccttccaccctcgcgaattaaaggctgaggatgaggacatagtcctgacacccgacggcacccgtgaattcttaacgtttgaagtgcctctcaacgatagcgggagcgctgggttaggagtatcagttaaaggaaaccgatccaaagagaaccatgcagatctgggaatcttcgtgaaatctatcataaacggtggggctgccagtaaggatgggaggctccgtgtcaatgaccagctgatagcggtcaatggcgaatctctgcttggtaagacaaatcaggatgccatggaaaccttgaggaggtcaatgagcaccgagggaaataaaagggggatgatccagttgatagtggcacgccggatcagcaaatgcaacgagcttaagtccccgggcagtccaccggggccggagctgccaatagaaacagccctcgacgacagggagagacggatttctcatagcctctattcagggatcgagggcctggatgagtccccctcccggaatgctgcgttgagccggataatgggtaaataccagttatccccaacagtaaacatgcctcaggatgatacagtcatcatcgaggacgataggcttccggttctgcctccccacttgtctgatcagtccagcagctccagccacgatgacgttggttttgtaacagccgatgccggcacttgggcaaaggcagctatctcagatagcgccgattgttcgttgtccccggacgtggaccccgtgctagctttccagcgcgagggtttcggccggcagattgccgatgagaccaaactgaatacagtcgacgaccagaaggctggctcaccttccagggatgtaggaccttcgttgggcctgaaaaagtcaagttcactggaatctctgcagacagcagtggccgaggtgacgttgaacggcgatataccatttcacaggccgcgtcctcgcatcatccgggggcgaggctgcaatgagtccttccgggcggccatcgataaatcatacgataagcctgccgtcgacgacgatgacgaggggatggagaccctggaggaagacaccgaggagagttcccgcagcggccgggagtcagtgtccacagcaagtgatcaacccagtcattccctggaaagacagatgaacggcaaccaagagaaaggggacaaaacagatagaaagaaggataagacaggaaaagaaaagaagaaggatcgggataaagagaaggacaagatgaaagccaaaaagggcatgctcaagggcctcggggacatgttcaggttcggcaaacaccgcaaggacgacaaaattgagaagacaggtaaaattaaaatacaggagtccttcacctcggaggaagaaagaatcagaatgaaacaggaacaagaacggatacaagcaaaaacacgtgaattcagagagcggcaagcccgggagcgagactacgccgagattcaggatttccatcgaacttttggctgtgatgatgaactgatgtatggcggagtgtcatcgtatgaggggagcatggctttaaacgctagaccccagtcccctcgggagggacatatgatggatgctctatatgcccaggtaaagaaaccacggaacagcaagccttcacccgttgacagcaaccggagcacgccatcaaaccacgatcggatccagagactcaggcaggagttccagcaggctaaacaggacgaggatgtcgaggaccgaagacgaacgtattcctttgaacaaccttggcccaatgctaggcccgctactcagagcggtagacactccgttagcgtggaggtccagatgcagcgacagcgtcaagaggaaagagagagctcacagcaagcacagcgtcagtattcttctctgcctaggcagtctaggaagaatgcaagcagtgtaagtcaggatagttgggagcagaattactcccctggagaaggtttccagagtgcgaaggagaacccaaggtatagtagttatcaaggtagtcgtaacgggtacctaggcggccatggatttaacgcacgggtcatgctagaaacacaggaactgttgcgccaggagcagcggcgcaaagagcaacagatgaaaaagcagccaccctcagagggtccctctaattatgatagctataagaaggtacaagatccatcttacgccccacctaaaggaccatttaggcaagacgtgccacctagcccatcacaggtggccaggttgaacaggcttcagactcccgaaaagggaaggcctttctactcttag

SEQ ID NO: 127870 - DNA, 4023 bp, Artificial Sequence
  Description of Artificial Sequence: Synthetic coding sequence
atgaaggttacggtgtgcttcgggagaactcgagtggtggttccctgtggagatggccatatgaaggtgttttcactgatccagcaggccgttacccgttacaggaaggcaatcgcaaaggatcctaactattggatccaggttcatcggctggaacatggggacggcggcattctggacctggacgatattctctgtgacgtggccgacgataaggaccggctcgtggccgtgtttgatgaacaggatccccaccacggaggggatgggactagcgctagttcaactggcacacagagccctgagattttcggttcagagctgggtacaaataacgtttctgctttccagccctaccaggccaccagcgagattgaggttaccccctccgtcctgagggcaaacatgccactccatgtgaggcgaagcagcgacccagcactaattgggctcagcaccagcgtgtccgactcaaactttagctccgaggagccgtctaggaagaatccaaccagatggtccacaacagcgggattcctgaaacaaaataccgcgggttccccaaaaacctgtgaccgcaagaaagacgagaattatagaagccttcccagggacacaagcaactggagtaaccagtttcaaagagacaacgctcggagttccctttcagcttcccaccctatggtgggaaagtggttggaaaaacaggagcaagacgaagacgggaccgaggaagataactcacgggtcgagccagtcggccatgcggataccggcttagagcacatccccaacttctcactggacgatatggtcaagttggtagaagtaccaaacgacgggggccctctgggaattcacgtcgtgccattcagtgccagaggagggaggacactcggactgctggtcaagagactggagaaggggggcaaagccgagcacgagaacttatttcgagagaatgactgcatcgtgagaatcaatgatggggatctgcggaacaggagatttgagcaggcacagcacatgttcagacaggctatgaggacacccattatctggtttcatgtcgttcccgccgcaaacaaagagcagtacgagcagctcagccaatcagagaagaacaattactactcatccaggttcagtcccgactctcaatacatcgataaccgatccgtcaattctgcaggtctgcataccgtgcagcgcgccccccgactcaatcatcctcccgaacagattgactctcactcccgcctccctcattccgctcatccctcaggcaaacctccatcagctcccgcttctgcgcctcagaacgtattcagcaccaccgtgagctccggatacaataccaaaaaaattgggaaacgcctcaacattcagcttaagaagggtactgagggcctcgggttctctatcacatctagggacgtgaccatcggaggtagcgcgcccatttatgtgaaaaatattctgccgaggggcgcagctatccaggacggaagactgaaagcaggcgatagacttatcgaggtgaatggagtcgacctggtgggaaagtcgcaggaggaagttgtgagcctcctccggagtaccaaaatggaaggaacagtgtcactgctagtttttcgacaggaggatgctttccatcccagggagttgaaagccgaggatgaggatattgtcctaacacccgacgggactcgcgagtttctgaccttcgaggtacctcttaacgacagtgggagcgctgggcttggcgtttctgtgaaggggaacaggtccaaagaaaaccatgctgacctgggcatctttgtgaaaagtataatcaacggcggggctgcatctaaggatggtcggctccgcgtgaatgaccagttgatcgctgtcaatggggagtcactgctaggaaagacgaaccaggatgcgatggaaaccctcagacgcagtatgagtactgaaggaaataagagggggatgattcagctgattgtggcacggagaatctccaagtgcaatgagttaaaatcgcctggctcacctccgggcccagaactccctattgaaactgctctcgacgacagagagcgtaggatctcgcattctctctactcaggaattgagggactggacgagtccccgtcccggaatgcagccctctcccgcattatgggaaagtaccagctatcaccaaccgtcaatatgccccaggatgacacagtgattatagaggacgatagacttcctgtgctcccccctcatttaagcgatcagtcttctagcagtagtcatgatgatgtgggcttcgtgaccgccgacgccggcacttgggccaaggcagctatttcagattcggccgattgctccttgagcccagacgttgatccagtgcttgcgttccagcgggagggttttggccgacagagcatgtcagagaaaagaacaaagcagttcagcgacgcatctcagcttgattttgttaagacgcgcaaatcaaaatctatggaccttggcatcgccgacgaaactaaactgaacactgtcgatgaccaaaaggctggaagcccttccagggatgtgggtccatctttgggccttaaaaaatcctccagcctcgaatccctccagaccgccgtggcagaggtcacgttgaatggagacattccattccatagacctagaccaagaatcatccgtgggcggggctgtaatgagagcttcagagcggccattgacaagtcttacgacaagcctgccgtggatgatgatgatgagggaatggaaacgctcgaggaggatacagaagagagcagtcgatcaggccgggagtctgtgtctacggcctccgaccagcctagtcacagcttggaacgtcagatgaatggcaaccaagagaaaggtgacaagactgaccgcaaaaaggacaagactggcaaggagaagaagaaggatcgtgacaaggagaaagataaaatgaaggctaaaaaaggcatgctgaagggactaggcgatatgttcaggtttggcaagcacaggaaagacgataaaatagaaaagaccgggaagataaaaattcaggaatcatttaccagcgaagaggaaagaatcagaatgaagcaggaacaagagaggattcaggcaaagaccagggagttccgcgagcggcaagcccgtgagagggattacgcagagattcaggatttccaccggacattcggatgtgacgatgagttgatgtacggaggagtatcttcatacgaagggtccatggccctgaatgctaggcctcagtctccgcgcgaggggcatatgatggacgcgctgtacgctcaggtgaagaaaccaaggaatagtaagcccagccctgtcgattccaaccgctcaacccccagcaaccatgataggatccagcgtctcagacaggaattccagcaggcgaaacaggatgaagacgtggaggaccggagaagaacttactccttcgaacaaccatggccgaacgccagacccgccacgcaaagcggtagacattcagtgtccgtcgaggtgcagatgcagcgacaaaggcaagaggagcgagaatcttcacaacaggcccaacggcaatacagcagcctgcctaggcagtcgcgcaaaaatgcctcttccgtgtcacaggattcttgggagcaaaactactcccccggcgaggggtttcagagcgcaaaggaaaaccctcgctactcctcttatcaaggttcccgtaatggatacctgggaggacatggcttcaacgcccgtgttatgctggagacacaggagttgctgagacaagaacaacgccggaaggaacagcagatgaagaaacagcccccaagtgagggtccttctaattacgatagttacaagaaggtgcaggatccatcatacgcgccccctaaaggaccctttcggcaggacgtgcccccaagcccgagtcaggtcgctagactgaacaggcttcagacacccgaaaaaggccgccccttttactcttag

SEQ ID NO: 127871 - DNA, 1119 bp, Artificial Sequence
  Description of Artificial Sequence: Synthetic coding sequence
atgaatcgctcacatcgccacggcgccggcagcggctgcctaggaaccatggaagtgaaaagcaagtttggagcagagtttagaagattctctctggagcgcagtaagcccggcaagtttgaagaattctacggtttacttcagcacgtccataaaatccctaatgtcgacgtcttagtcggctatgcagacatacatggcgacctgctgcctatcaataacgatgacaattatcataaagccgtatctaccgccaatcccctgttgaggatcttcattcaaaagaaggaagaggcagactatagcgctttcggcaccgatacacttatcaaaaaaaagaatgttcttactaacgtgcttagaccagataatcatcgcaaaaagccacacatagttatctccatgccacaggattttaggccagtgtcttccatcatcgacgttgacatactgccagagacccaccgccgagtcaggctttacaaatatgggacagagaagccactgggcttttatataagggatggcagctcagttagagtcaccccacacgggcttgaaaaggtaccgggaatttttatcagtcgcttagtgccaggaggattggcacagtctacagggctgctggcagtcaatgacgaagtgctggaggtgaacggtatcgaagtcagcggtaaatcgctcgaccaggtcactgacatgatgattgcaaatagtcgcaacctgataatcacggttcggccggctaaccaacgcaataatgtagtgaggaattcccgaacttcaggtagttccggccaaagtaccgacaactctttgctgggttatccccagcaaatcgagccctcattcgaacccgaggacgaggactccgaggaggatgacattattatcgaggacaacggtgtgccgcagcagattcccaaggccgtgcctaacaccgagtctttagagagcctcacacagattgaactatcattcgagtctggccagaacggattcatcccgagtaatgaagtcagtttggcggcaatcgcgtcctcttcgaacaccgagttcgaaactcacgccccggaccagaaactgcttgaagaggatgggactattatcacattgtag

SEQ ID NO: 127872 - DNA, 1131 bp, Artificial Sequence
  Description of Artificial Sequence: Synthetic coding sequence
atgaaccggtcattccacaagtctcagacactccgattttacgattgtagcgcagtggaggtcaagtccaagtttggcgctgaattccgacgattcagtctggaccggcacaaacctggcaaatttgaggacttctataagcttgtcgtgcacacgcatcacatctctaatagtgacgtgactattggttacgccgatgtgcacggtgacctcctacctattaacaacgatgataacttttgcaaggcggtgtcttctgccaatcccttattgcgcgtattcatacagaagcgcgaggaagcagagaggggcagtttgggcgccggcagtttgtgccgaaggagaagggcactgggggcactgagagacgagggccctcggcgcagggcacacctcgatattggactgcctagggattttagacctgtgtcgagtattatcgacgtcgatctggtccccgaaacccacaggagagtgcgactgcatcggcacggctgcgaaaaaccgctgggtttttatattagggacggggccagcgtcagagtcacacctcacggcttggagaaggtccctggaatcttcatttccagaatggtgcccggaggacttgccgagagtactggtcttctcgctgttaatgacgaggttcttgaggtgaacggcatcgaggtggccggcaagacactcgaccaggtgacggacatgatgatcgcaaatagtcataatcttatcgtcacagtcaagcccgcaaatcaaagaaacaacgtagttagaggaggccgggcgcttgggtcttcgggcccaccctcagatgggactgccggtttcgtggggcctcccgcaccccgcgttctccagaatttccatcctgatgaggccgaaagcgacgaggacaatgacgtggtgatcgaaggtaccttggaaccagcccggccaccgcaaacccccggcgctccagccggaagtctgagcagggtgaacggggcaggcctggcgcagaggctgcagcgcgacttggcgcttgacggcggtttgcagagattactgtcatccttgcgagctgatccacggcattctctggcactccccccgggcggagtagaggagcacgggccagcagtgaccctttag

SEQ ID NO: 127873 - DNA, 1236 bp, Artificial Sequence
  Description of Artificial Sequence: Synthetic coding sequence
atggctgaggctgagctccacaaggagagactgcaggcgatcgccgaaaagcgtaagcgacagaccgaaatcgaaggcaaaagacagcagctcgatgagcagatccttctgcttcagcacagcaaaagtaaggtgctgagggagaaatggcttctgcaggggatacctgccgggaccgcagaggaggaggaggcccgccgccggcagtctgaagaggacgagtttagggtgaaacagctggaagataatatacaaagactcgaacaggagatacagacgctggaaagcgaagaaagtcagatatctgctaaagaacagataatcctggaaaagctgaaggaaactgaaaaaagcttcaaggacttccaaaagggattctcgtctactgatggagatgcagtgaactatatatcgtctcagttacctgacctacctattctctgttcaagaacggcagaaccatcacctggccaagacggtacctccagagccgcggcagtgtacgctatggagatcaatgtggaaaaggataagcagacgggagaaactaagattctttccacatcgaccatagggcccgagggtgtgcaccaaaaaggagtgaaagtctacgacgacggaacgaaggtcgtatacgaagttagaagtggcggaaccgtcgtggagaatggcgtgcataagctgtccacaaaggatgtggaggagctgatacagaaggcgggacagagttccctgggtggcgggcatgtctcggagcgcacggtgatcgctgatggatcactttctcaccctaaggagcatatgttgtgcaaggaggccaagttagagatggttcacaaatccagaaaagaccacagcagtggtaaccctgggcaacaagcccaagcacccagcgccgcaggccctgaggccaaccttgaccaaccagtaacaatgatttttatgggatatcaaaacatagaagacgaggaagaaaccaagaaagtgctgggctacgatgaaaccattaaagccgaactggtactgatcgatgaggacgacgaaaagagtctcagagaaaaaacggtcacagacgtgtccactatcgacgggaatgccgccgagcttgtgagtggacggccagtgagtgatactaccgagccaagttccccagaggggaaggaggaaagcctggctaccgagccagctcctggcacgcagaaaaagaagcgctgtcagtgttgcgtggtgatgtag

SEQ ID NO: 127874 - DNA, 1140 bp, Artificial Sequence
  Description of Artificial Sequence: Synthetic coding sequence
atggagatggctgaggcggagctgcataaggagagacttcaagccatcgctgaaaaacggaagaggcagacggagattgaaggcaagcggcagcagttggatgaacaaatcttactgctacagcatagcaaatctaaggtgctgcgtgagaaatggctgctgcagggcatccccgctgggacagcagaagaagaagaagcacgcagacggcagtctgaagaggacgaatttagggtgaagcaattggaagataatatacagaggctggaacaggaaatccagaccctcgaatcagaggaaagtcagatctcagcgaaggagcagatcatcttggagaagctcaaggaaacagagaagtcattcaaagatttccagaaaggcttctcatctaccgacggggcagtgtatgcaatggagattaacgttgagaaggataagcagaccggggagaccaagatcctgtcaacatctactataggtcctgagggtgtgcaccagaagggcgttaaggtttatgacgacggcacaaaagtagtttacgaagtacgttccggcggcactgtggtcgaaaatggtgtgcacaaactgtctacaaaggacgtcgaagaattgatccagaaggcgggacagtcatcactgggcggaggtcatgtgtccgaacgcaccgtgatcgccgacggaagtctgtcccacccaaaggaacacatgctctgtaaggaagctaagctggaaatggttcataagtcccggaaggatcacagttctgggaaccctggacagcaggctcaggcacccagcgctgctggccccgaggcaaacctagaccagccggtgacaatgatattcatgggatatcagaacatagaagacgaagaagaaacgaagaaagtgctgggatacgatgagacgatcaaggcagagctggttcttattgatgaggatgacgagaagagtctgagggagaagacggttaccgacgtgagcaccattgacggcaatgccgccgagctggtgtctggccgaccagtcagtgatacgaccgagccatcttcaccagaggggaaggaagagagcctggcgactgagccggcacctggtacgcagaagaaaaaacggtgtcagtgttgtgtcgtgatgtag

SEQ ID NO: 127875 - DNA, 1242 bp, Artificial Sequence
  Description of Artificial Sequence: Synthetic coding sequence
atggaaatggcagaggccgagctccataaagagcggttacaagccatcgctgagaaaaggaagagacagacggagatagaagggaagcgccagcagctggacgagcagatcctacttttacagcatagtaaaagtaaagtgctccgcgaaaagtggctactgcaaggaattcctgctgggacagccgaagaggaggaggccaggagaagacaaagcgaagaggatgaattccgtgtgaaacagcttgaagataatatacagagattggaacaagagattcagactcttgagtcagaagaatcccagatttcagcgaaagagcagatcatcctggaaaagctgaaggaaacagagaagtcatttaaggatttccaaaagggtttttcctccacggatggagacgcggttaattacattagctcacaactgcctgacctgccaatactatgttcccgaaccgcagaaccttctccaggacaggatggcacaagtagggcagctgctgtgtatgcaatggagatcaatgtagagaaggataagcagaccggcgaaaccaaaatactgtctacctcaaccatcgggccagagggggttcatcagaagggagttaaggtctacgacgacgggactaaagtagtctatgaagtaagatctggaggtactgtggtcgagaatggggttcacaagctgtctaccaaggacgtggaggaactcatccaaaaagctggccagtcctcacttggcggcggacatgtgagcgagaggactgtgattgctgacgggtccctgtctcaccccaaggagcacatgctatgtaaagaggccaagttagagatggtgcataaaagtcgtaaggatcatagttcaggtaaccccggccaacaggcccaggcaccctctgccgcaggccctgaagctaacttggatcagccggttactatgatctttatgggttatcaaaacatcgaagacgaggaggaaacaaagaaagtcctgggctatgatgagaccattaaagccgaattagtgctcatcgacgaggacgacgaaaaaagcttgagggaaaagaccgtgactgatgtaagtaccatcgatggaaatgccgccgaactggtatctggtcgtcccgtgtccgacacaacagagccatcgtcaccagagggtaaggaagaatccttggcgacagaaccagcccctgggactcaaaagaaaaaacgttgccagtgctgcgtagtcatgtag

SEQ ID NO: 127876 - DNA, 1167 bp, Artificial Sequence
  Description of Artificial Sequence: Synthetic coding sequence
atgggcagggctaggaggtttcaatggcccttactgctcctctgggctgctgccgcgggacctggtgctggtcaggaggtacagactgagaatgtgacagttgcggagggcggggtagctgagatcacttgtaggctccaccagtatgatggaagtatcgtcgtgattcagaatcctgccagacagaccctgttcttcaacgggacccgagcgctgaaagatgagcgctttcaactcgaggaatttagccctagaagagtgaggatccgcttgtccgacgctcggcttgaagatgagggtggatatttctgtcagttgtataccgaagacacgcatcaccaaatcgctaccctgacagtcctggtggcccctgagaatcctgtagtagaagtgcgggaacaggccgtcgaaggcggggaggtagaactcagctgcctggtgcccagatcgaggccagccgccacgctgcgctggtatagggaccgaaaggagctcaagggagtatcttcatcccaggagaatggcaaggtgtggagcgtggcctcaacagtccgttttagggtggaccgtaaagatgatggagggatcattatttgtgaagcccaaaaccaggccttgccctccggccatagtaagcagacacagtacgtcttagatgttcagtacagcccaactgcgcggattcacgccagccaggcagtggtccgagaaggagacaccctcgtcctgacctgtgccgtaactggcaacccacggccaaatcagataaggtggaaccggggcaacgagtcgctgccagagagagcagaggctgtcggtgagacactcactcttcccgggctggtctccgctgataacggtacttacacttgcgaggcttctaacaagcacggccacgcccgcgcactttatgtgttggtggtctatgatcctggagcagtggtggaggcccagacatctgttccgtacgctatcgtcggtggaatactggctctgcttgtttttctgataatctgcgtgttggtcgggatggtctggtgctccgtccgccagaaaggaagttatctcacgcacgaggcatctggactcgacgaacaaggcgaggcaagagaggcgttcctaaacggatccgacggccacaaaaggaaggaggaattttttatttag

SEQ ID NO: 127877 - DNA, 1068 bp, Artificial Sequence
  Description of Artificial Sequence: Synthetic coding sequence
atgggcaagctggtcgcattggtgctgctcggcgtcggcctcagtttggtcggtgagatgtttctggcattccgggaaagagtgaacgcaagccgcgaggtggaaccggtcgagcccgagaactgtcatctcattgaagaacttgaaactggcagcgaagacctggaaattttacccaacggtctggcctttatctctagcggtctgaagtatccgggcataaagtcattcaacccaaactctcctgggaaaatcctccttatggacctgaacgaggaagaccctaccgtactggaactgggcatcaccgggtctaaatttgacgtgagttctttcaatccccacggtataagcacatttacagacgaggataacgccatgtatctgctcgtggtaaaccaccctgatgccaagagcaccgtcgagttattcaagttccaggaggaggagaaaagtttgctgcatctcaagactataagacataagctgctccccaacttaaatgacattgtcgctgttggcccggagcacttctatggtaccaacgatcactactttctcgacccgtacctgcaaagctgggagatgtatctaggtcttgcctggagctatgtggtgtactactcaccttcggaagtgcgtgtggtggccgagggcttcgacttcgctaacggcattaacatctcccctgacggcaagtatgtttatattgctgaactcctagcccataagatccatgtgtatgagaagcacgctaattggactctgacgcccctgaagtccctagatttcaatactcttgtggacaatatatcagtggacccagagacaggggacttatgggtagggtgccacccaaacggtatgaaaatctttttttatgattccgagaatcctcccgcctccgaggttctacgcatccaaaacattctgacagaggaacctaaggtgactcaggtctatgctgaaaatggaactgtcttgcagggctcaactgttgcctcagtgtataaggggaagctcctgattggcaccgtgttccataaagcattgtactgtgaactgtag

SEQ ID NO: 127878 - DNA, 1017 bp, Artificial Sequence
  Description of Artificial Sequence: Synthetic coding sequence
atggccgcgggatgctccgaggcaccccgcccggctgcagccagcgatggctcactggtgggacaggcaggcgtactaccttgtctggaactgcctacttatgctgcagcttgtgccctcgttaacagccgctattcgtgcctggtagctggccctcatcagcggcacattgcactgagccctcggtacctgaataggaagcggacaggtataagagagcaactcgatgccgaactgctgcggtattctgaatcactactgggtgttcccatcgcttatgataacattaaagtggtcggcgagctgggtgacatctacgacgaccagggtcatattcacctgaacattgaagccgatttcgtaattttctgccctgaacctggccagaaactcatgggtattgtaaacaaggtgtcttcatcccacattggctgcctcgtgcacggatgtttcaacgcgagcatcccaaaacctgaacagctgtccgctgagcaatggcagacaatggaaataaacatgggagatgagttggagttcgaggtttttaggttagacagcgacgccgccggagtattctgtattcgagggaagctgaatataacatctctacagttcaaacgcagcgaggtgtcagaggaggtcaccgagaacggaacagaagaagccgccaaaaagcctaagaaaaagaagaagaagaaagatcccgaaacctatgaagtggactcaggtaccaccaagctcgctgacgatgccgacgacaccccaatggaagagagcgcacttcaaaataccaacaatgcaaacggaatctgggaagaagaacccaaaaaaaaaaaaaaaaagaaaaagcaccaggaagtccaagatcaggacccagtttttcagggctctgacagttccggttatcaatctgatcataagaagaaaaagaagaagaggaaacacagtgaagaggctgaattcacccctccacttaagtgcagccctaagcgtaaagggaagtcgaatttcctttag

SEQ ID NO: 127879 - DNA, 1059 bp, Artificial Sequence
  Description of Artificial Sequence: Synthetic coding sequence
ggagctgctgggggatgcggactggcgggcgaccgcgcaggcctaggcgagcgcctgctcgctctgcggaacagactcaaggctagccgcgaggtggaatcagtagacctcccccattgtcatttaatcaagggtatcgaggcgggcagcgaagacatcgatatactgcccaacggcctggccttcttttcagtcgggctgaaattccccggactccacagcttcgcccctgacaaacccggaggcatcctcatgatggatctcaaagaagagaaaccccgtgcaagagaactccgaataagccgtggcttcgatcttgcaagcttcaatccccacggaatcagcacatttatcgacaacgacgatactgtgtatctgtttgtggtcaaccaccccgaatttaagaatacagttgagatattcaagttcgaggaagctgagaactccctgctgcacctgaagactgtgaaacatgaattactgccttctgtcaatgacattaccgccgtggggcctgcccatttctatgccaccaatgatcattattttagcgacccctttctcaaatatctcgaaacttacctcaacctgcattgggccaatgtggtgtactactctccaaatgaagtgaaggtggtcgcagagggatttgacagtgccaacggcatcaacattagccccgatgacaagtacatctacgtagcggacattctggctcacgagatacacgtgttggagaagcataccaacatgaatctgactcaacttaaagtgttggaactggacactctggtggacaatctcagtatagatccttcatccggcgacatctgggtcgggtgtcacccaaacggccagaaactgttcgtctatgacccaaataaccccccctcctccgaggtgctacggatccagaatattctgagcgagaagccaaccgtaacaactgtctatgccaacaatgggagtgtgctgcaggggtcaagcgtggcctcagtgtacgatggcaaactcctgatcggcactctctaccaccgtgcattgtattgcgagctctag

SEQ ID NO: 127880 - DNA, 1128 bp, Artificial Sequence
  Description of Artificial Sequence: Synthetic coding sequence
atggctccccccacagagctgctggcacgtcctgagaggggctccgctcccggcagtagggcgatgggccggctggttgcagttggtctccttggcatagcacttgcgttgctgggcgaacgtctgctggccctgcgtaatcgactgaaggcatcacgagaggtcgaatcagtggaccttcctcattgtcacctgatcaagggcatcgaggccggatcagaggatattgacattttacccaacggcttagcatttttttcagtgggactgaaattccccggcctgcacagcttcgcgcccgataagccgggtggcatcttgatgatggatctgaaagaagagaagccgagagcccgagaacttcgcatctccaggggctttgacttagcgtccttcaatcctcatggtatttctaccttcatcgataacgacgacactgtctacttgtttgtcgttaatcatccagaattcaaaaacaccgtggagatctttaagttcgaggaggccgaaaacagtctgctgcacttgaaaacagtaaaacacgagctgctgccatcagtgaacgatataaccgccgtgggccctgcccacttttatgccaccaacgaccattactttagtgatccctttctgaagtatttagagacctacttgaatctgcactgggcaaacgtggtatactactcacctaacgaagtcaaggtcgtcgcggagggattcgactccgctaatggtattaatatttccccagacgacaaatatatttacgtcgccgatatcctggcccacgaaattcatgtgcttgagaagcacacaaacatgaacttgacccagctgaaagtgctggagcttgacacactggtcgacaacctgtccatcgatccctcctcaggagatatctgggttggttgccaccctaatgggcaaaagctgtttgtctatgatcccaataacccaccatcgagtgaagtcctgagaatccagaatatactgtcggaaaagccaaccgttactacagtgtacgccaacaacggctcagtgctccagggttctagtgtggcctccgtatatgatgggaagcttctgattggtaccctgtatcacagggccctatactgtgagctatag

SEQ ID NO: 127881 - DNA, 1029 bp, Artificial Sequence
  Description of Artificial Sequence: Synthetic coding sequence
atgggcagactggtggccgtcggcctgctggggattgcattagccttactgggcgaaaggcttctggccttacggaacagactcaaagcctctcgcgaagtcgagtcggtggacttaccgcactgccatctcatcaaaggtattgaggccgggagtgaggacattgatatcctgcctaatggactcgccttcttctccgtcgggctgaagttccccggacttcacagtttcgcccccgataagcccggcggcattttgatgatggatctgaaggaggagaaacctcgagcccgagagctgcgcatctcgcgaggcttcgatttggcgtccttcaacccacacggtatcagcactttcattgacaacgaattcaagaataccgttgaaattttcaagtttgaagaagcagaaaatagtttactgcaccttaagacagttaagcatgagctgctcccctccgttaatgatattaccgctgttggccctgctcacttttatgcgacgaacgatcactacttttccgacccatttctcaagtatctggaaacatatttgaaccttcactgggctaacgtggtgtactattcccctaatgaagtcaaggttgtcgccgaggggtttgactccgcgaatgggatcaacatttcccccgatgacaagtatatttatgtggcggatatcctcgctcatgagattcacgttctcgagaagcacactaacatgaatctgacccaactgaaagtgttagaacttgacaccctagtggataacctttctattgatccttcaagcggtgacatctgggtggggtgtcatcccaacggccaaaagctcttcgtgtatgacccaaacaatcccccttccagcgaagtcctgcggattcagaacatactatctgagaagcctactgtgaccactgtgtacgcgaacaacggctcggtgctgcaagggtcgagtgttgcctcggtgtacgacggaaaactcttaatcggtactctgtaccatcgcgcattgtactgtgagttatag

SEQ ID NO: 127882 - DNA, 1065 bp, Artificial Sequence
  Description of Artificial Sequence: Synthetic coding sequence
atgggcaagctcgttgccttggttctgttgggcgtaggcctttctctcgtgggagagatgtttctcgctttcagggagagggttaacgcgagtagggaggtggaacctgtggaaccggaaaactgtcacttaatcgaagaattagagtcaggcagcgaagatatcgacatcctgccatcgggccttgccttcatctccagcgggttaaaataccccgggatgcccaattttgccccagatgagcctggaaagattttcctcatggatctgaacgagcagaaccctagagctcaggcactggaaatcagcggaggtttcgacaaggaattgtttaaccctcacgggatttcaatctttattgacaaagataatactgtgtacttgtacgtggttaatcaccctcatatgaaaagcaccgtcgaaatttttaagtttgaggagcagcagagaagcctagtgtaccttaaaacaatcaagcatgagctcttgaaaagcgtaaacgacatcgttgtgctgggtcccgaacagttttatgccaccagagaccactactttactaacagtctgcttagcttttttgaaatgattcttgatctacggtggacctatgtactgttttacagccctcgcgaggtcaaagtcgtggccaaggggttttgcagtgccaatggcattactgtgtctgcagatcagaaatacgtctacgtggctgacgtcgctgcaaagaacatccacattatggagaagcacgacaattgggatctcacccaactgaaggttatccaactgggcacattggtggataatttgacagtggacccagccactggggacatactcgccggttgccacccaaaccctatgaagctgctcaattataaccccgaagatccccctggatccgaggtgctccgtatacagaatgtgctgtcagaaaagcctcgcgtttcaaccgtgtacgcaaacaatggcagcgtgctgcagggcaccagcgttgccagtgtttaccacggcaagatactaatcggaaccgttttccacaaaaccctctactgtgaactgtag

SEQ ID NO: 127883 - DNA, 1572 bp, Artificial Sequence
  Description of Artificial Sequence: Synthetic coding sequence
atgatgcttcgtggcaaccttaagcaggtcagaatagagaaaaacccagcaagacttcgagcactggaatccgctgtcggagaatcagaaccagcagcggccgcagccatggccttagccttggccggcgagcccgccccacccgcacccgctcccccagaagaccaccccgatgaagaaatggggtttactattgatatcaagtctttcctgaagcccggtgaaaagacctacacacagcgatgtaggctgttcgtgggtaacctcccgacagacattactgaagaagacttcaagagactgtttgaacgatacggcgagccgtcggaggtgttcatcaaccgggatcgagggttcggctttatacggttagaatcccggacgcttgccgagatcgccaaggctgagctggacgggaccattctgaaatcgagacctctcagaatacgctttgccacccacggtgccgccctgaccgtcaagaatctttcccccgttgtgtcaaatgaactgctggagcaagcatttagccagttcggacccgtggagaaggcagtggtggtggtggatgaccgcggtagagcgactggcaagggattcgtggaatttgccgcaaaacccccggccagaaaggccctcgaaagatgtggggatggggcctttctgcttactaccacccctcgccccgtgattgtggagcccatggagcagtttgacgatgaagatggcctgcctgaaaaactcatgcagaaaacacagcagtaccataaggaacgcgagcagccccctagattcgcacaaccgggaacgttcgaattcgagtatgcatccaggtggaaggccttagatgaaatggagaaacagcagcgcgagcaagtcgatcggaatataagagaagctaaagagaagttggaggctgagatggaggccgcccggcacgagcatcagctaatgttgatgcgtcaagacctcatgcgacgccaagaggagctgagaaggctggaggaactacggaaccaggagctgcagaagcgtaaacaaatccagctgcgccacgaggaagaacaccgccggagagaggaagagatgatccgccaccgagagcaagaagaactgagacgccagcaggaaggatttaaacctaactatatggaaaacagagagcaagaaatgcgtatgggcgacatgggaccccgcggcgccatcaacatgggggacgcattctcccccgctcccgcgggaaatcagggccctcctcctatgatgggcatgaatatgaataaccgggccacaatcccaggcccaccaatggggccaggccccgccatgggtcctgaaggggccgctaacatgggcactccaatgatgcctgacaacggtgctgtccacaacgatcggttcccccaggggcccccatcccagatgggatcacctatgggctcccgtactggaagcgaaacaccacaagcccctatgtccggagtaggtccggtatccggagggcccggcgggttcggtaggggatcccagggaggaaatttcgagggacccaacaaaaggcggagatactag

SEQ ID NO: 127884 - DNA, 1392 bp, Artificial Sequence
  Description of Artificial Sequence: Synthetic coding sequence
atgggctttaccatcgacatcaagtcctttctgaagcctggggagaaaacgtatacacaacggtgtaggcttttcgtggggaatttgcctaccgacatcacagaagaggactttaagagactctttgaacggtacggggagccttctgaggtgtttattaaccgagatcgaggatttggttttataagacttgagagccggaccctcgccgaaattgctaaagccgagctggatggaactattctgaagtctagacctctcaggattcgcttcgcgacccacggcgcagccctcaccgttaagaacctgagcccggttgtaagcaacgaactcctcgaacaggccttttctcagttcgggccagtcgaaaaggccgtcgtggtggtggacgacagaggccgggccaccggaaaggggttcgtggaatttgcggccaaacctccggcaagaaaggcattagaaaggtgcggagatggggcctttctgctaaccacaactccaaggcccgtgatagtggagccgatggaacagtttgacgatgaggacggcctgcccgagaagctcatgcaaaagacccagcaatatcacaaggaacgcgaacagcctccacggttcgctcagcctggaacattcgaattcgagtatgcttctagatggaaggccttagacgagatggaaaaacagcaaagggagcaagttgatcggaatatccgggaggcgaaagagaaacttgaagccgagatggaagcagcccggcacgagcaccagctcatgctgatgagacaagatttaatgcgcagacaagaggaactcagacggctggaggaactacggaaccaggaactccagaagcgcaagcagatacaactgagacatgaagaagagcaccgaaggcgtgaagaagaaatgatacgccatcgggagcaagaggagctcaggcggcagcaggagggattcaaacccaattacatggaaaaccgggaacaggagatgagaatgggagatatgggacccaggggagcaattaatatgggagatgccttctctcctgcccccgcaggcaatcaaggtccccccccaatgatggggatgaacatgaataaccgggccacgataccagggccgcccatgggcccaggtccagccatggggccggaaggggcagcaaacatgggaacccctatgatgcctgacaatggggctgtccataacgacagatttccacaaggcccaccaagtcaaatgggctcccctatgggatctcggacaggctctgaaaccccgcaagctccgatgtccggggtaggcccagtgtccgggggacctggcggctttggcaggggatcacagggcggtaactttgaaggaccaaacaagagacgcagatactag

SEQ ID NO: 127885 - DNA, 747 bp, Artificial Sequence
  Description of Artificial Sequence: Synthetic coding sequence
atgatgttacgcggtaacctgaaacaggtgcggatcgaaaaaaatcccgcccgcttgcgcgcacttgagtccgctgtcggggaatctgaacctgcggccgcagcagctatggctctggcgctggccggagagcccgcaccccctgcaccagctccgcctgaagatcacccagatgaggagatggggttcactatagacattaaaagttttctgaaacctggtgaaaaaacttatacacaacggtgcaggttatttgtggggaacctgcccaccgacatcaccgaagaagactttaaacgcctgtttgaacggtacggcgaaccgtcggaggtgtttattaatagagaccgcgggttcgggtttatcaggctggagagtcgtacgttagccgaaattgcaaaggcagaattagacggaactatcctgaaaagtcgccccctgcgaattcgattcgccacacacggtgccgccctgaccgttaagaatctatctcctgtcgttagtaacgaactgctggagcaggccttctcacagttcgggcccgtggagaaggccgtcgtcgtcgtcgatgatcgcggtagggcaacaggaaagggattcgtagagttcgctgcaaagccacccgctagaaaggccttggaacgctgcggcgacggagcttttcttctgaccactactcccagaccagttatcgtggaacccatggagcagttcgatgatgaagatggcttaccagagaaactgtag

SEQ ID NO: 127886 - DNA, 309 bp, Artificial Sequence
  Description of Artificial Sequence: Synthetic coding sequence
atgtctgaaaagagtgtggaagctgctgccgaactttccgcaaaagacctgaaagaaaaaaaggaaaaggtggaggagaaggcttctagaaaggagaggaagaaggaggtcgttgaggaagaagagaacggcgcagaggaagaagaggaggagaccgctgaagatggagaggaggaagatgagggagaggaagaggatgaggaggaagaggaagaggacgacgaaggtccagccctgaagcgcgccgcggaagaagaagatgaggctgacccgaagcgccagaaaacagagaatggcgcaagtgcatag

SEQ ID NO: 127887 - DNA, 315 bp, Artificial Sequence
  Description of Artificial Sequence: Synthetic coding sequence
atgtctgagaaatctgtagaggctgccgccgaactgtcagctaaggacctcaaggagaagaaagagaaggtggaagaaaaagcctcccgtaaggagcggaagaaagaggtcgttgaggcaccagtgccactcgtggtcatggtgggtaaagcctgcagccagccagaggctacccccagccccgggccacaccggaggcggcgcacagggctcaggagaaaaaagaagaagctgcccagaatggagcggcggaaaatgaagggcaaaaaaaagatgcgcaagaaaaagaaacggatgatgaagggcccccgttag

SEQ ID NO: 127888 - DNA, 306 bp, Artificial Sequence
  Description of Artificial Sequence: Synthetic coding sequence
tcccgcgaccctgcttgcagagcagctgagctctccgctaaagacctcaaagaaaagaaggagaaagtcgaggaaaaggcatctcggaaggagaggaaaaaggaggtggtcgaggaggaggaaaacggcgcagaggaggaagaggaagagaccgccgaggatggggaagaggaggatgagggagaagaagaagatgaggaggaagaagaggaggatgatgaagggcccgcccttaagcgggccgctgaggaggaggacgaggctgacccaaaacggcagaagacagagaatggtgcttccgcctag

SEQ ID NO: 127889 - DNA, 528 bp, Artificial Sequence
  Description of Artificial Sequence: Synthetic coding sequence
atgcagcgcaggttggtgcaacagtggagcgtggcggtgtttttgctgtcttacgctgtgccatcctgcggaagaagtgtggaaggcctctcacgccggctgaaacgcgcagtatccgagcatcagctgctacatgataagggtaaatctatccaggacctgaggagacgatttttcctgcaccatttaatcgccgaaatccacactgccgaaataagggccacctcagaggttagcccaaacagcaagccttctcctaacactaaaaaccatcccgtgcggtttggttccgatgacgaagggcggtatttaacacaggaaacaaacaaagtggagacttataaggagcagcccctgaaaacgccagggaagaagaaaaaagggaagccaggcaaaagaaaggaacaagagaagaaaaaaaggaggacgcgatcagcctggcttgactccggcgtgacaggtagcggcctcgagggagaccacctgtccgacacctccaccacctcactggaactggacagcaggtag

SEQ ID NO: 127890 - DNA, 630 bp, Artificial Sequence
  Description of Artificial Sequence: Synthetic coding sequence
atgcaacgacgcctcgttcaacaatggagcgttgctgttttcctgttatcatatgccgtgccatcctgtgggcgatccgttgaaggtttgagccgaaggctgaagagggcagtttccgaacaccagcttctccacgataaggggaagtcgattcaggacctcaggcgtagatttttcctccaccatctgatcgctgagatccacactgccgagatcagggccacctccgaagtgtcccccaactcaaagccctcaccgaatactaagaaccatcctgtacgcttcggctccgatgacgaggggcggtacttaacacaagagacgaacaaggtggagacctacaaagagcagcctctgaagacccccggaaagaaaaagaagggaaagcccggcaagcgaaaggaacaagagaaaaagaagaggagaacccgttctgcatggctggacagtggtgtgactggcagcgggttggagggtgatcatctgagcgacactagcacaaccagcctcgaactggactctcgaactgcattgctgtggggcctgaagaagaagaaagagaacaaccgacgcactcaccatatgcagctgatgatctctctgtttaaaagtccactccttttactgtag

SEQ ID NO: 127891 - DNA, 528 bp, Artificial Sequence
  Description of Artificial Sequence: Synthetic coding sequence
atgcaacggcggctggtccaacagtggtcagttgcagtgttcttactctcttatgcagtcccatcgtgcggccggagtgtggaaggactgtcacgcagacttaaacgtgctgtgagtgagcaccagcttcttcatgataagggtaaatctattcaggatctccgtagaaggttcttcttgcaccacctcattgccgagattcataccgccgaaatacgagccactagcgaggtctcgccgaacagcaaacccagccccaataccaagaaccaccctgtgcgctttggttccgacgacgaaggtcgatatctaactcaggaaacaaacaaggtggaaacatataaagaacagccccttaaaaccccggggaagaaaaaaaaagggaagcctgggaagcggaaagagcaggagaagaagaaaaggcgaacacggtctgcatggctcgactctggggtcacgggcagtgggctggagggcgaccaccttagcgatacgagtaccacttctcttgagctcgattcacggtag

SEQ ID NO: 127892 - DNA, 534 bp, Artificial Sequence
  Description of Artificial Sequence: Synthetic coding sequence
atgcagaggaggctagtgcagcaatggagcgtcgccgtcttcctgctgagctacgctgtcccatcctgcggccggtctgtcgagggcctgagccgccggttgaagcgcgccgtgtcggagcaccagttactgcatgacaaaggcaagtctatccaggaccttagacgacgcttcttcctccatcacttgattgcagagattcacaccgccgaaatcagagctactagcgaggttagtcctaactccaaaccaagcccaaacactaagaaccaccctgtgcgattcggaagtgatgacgaaggtaggtatctcacccaagagacaaataaagtcgaaacttataaggagcagcctctgaagaccccaggcaaaaagaagaagggaaagccaggaaagagaaaagagcaggagaagaagaaaaggagaacgcgcagtgcatggcttgactccggcgtgaccgggtcaggactggaaggtgatcacctgtcagataccagcacgaccagcctcgagctcgatagtagaagacactag

SEQ ID NO: 127893 - DNA, 528 bp, Artificial Sequence
  Description of Artificial Sequence: Synthetic coding sequence
atgcagagacgccttgtccaacagtggtctgttgcagtcttcctgctgtcttacgccgtacctagttgtgggcgcagcgtggaagggttgtccagacgtctgaagcgtgctgtgtccgagcatcagctgctgcatgacaaggggaagtctatccaggatctaagacgccggttttttttgcatcacctcattgctgagattcacacagctgagatacgagcgactagcgaagtcagtcccaattccaaacctagcccaaatacaaaaaaccatccggtccggttcggctctgatgatgagggccgttatctgacacaggagacaaataaggttgaaacttataaggaacagccactgaagacacccggcaaaaagaaaaaggggaagcccggcaaaagaaaggagcaggaaaagaaaaagaggagaacccgatcggcgtggttggattccggcgtgaccggttcaggcctcgagggtgaccatctgtctgatacgtcgaccaccagtttagaactggattcccgatag

SEQ ID NO: 127894 - DNA, 81 bp, Artificial Sequence
  Description of Artificial Sequence: Synthetic coding sequence
acggctctgctttggggactaaagaagaagggaaagcagcagaaaaacacttcctatgccacaaacgatttaattatctag

SEQ ID NO: 127895 - DNA, 630 bp, Artificial Sequence
  Description of Artificial Sequence: Synthetic coding sequence
atgcagcggagactggtgcagcagtggagtgtcgccgtatttctgctaagctacgccgtaccaagctgcggccgcagcgttgaaggcctgtcaaggcggttgaagagagctgtgtcagaacatcaacttctgcacgataagggcaagagtattcaggatctcaggcgtcgattttttttgcatcatctgatcgctgagattcacaccgcagaaattagagccacctcagaggtaagtccaaactccaaacctagccctaacacgaaaaaccacccagtgcggtttgggtccgacgacgaaggcaggtatctgacccaggagacaaataaggtggagacctataaagaacaacctcttaagacaccaggtaaaaaaaagaaagggaaacccggtaaaagaaaggaacaggagaagaagaagcgaagaacaagatccgcctggcttgattccggagtcacgggaagcggcctggagggagaccatctgagcgacacaagtaccactagcctggaacttgatagtcgaactgcactgctgtgggggctgaagaagaaaaaagagaacaaccggagaacccaccacatgcagctcatgatttcgttatttaagagccccctcctactgctgtag

SEQ ID NO: 127896 - DNA, 534 bp, Artificial Sequence
  Description of Artificial Sequence: Synthetic coding sequence
atgcagcgtagactcgtgcaacagtggagtgttgccgtgtttctactgagctatgcggtgccaagctgcggtcggtctgtggaaggcctctctagacgtctgaagagagccgtgtccgaacatcaactgttgcacgataaaggaaagtcaattcaggacctgcggcgccggttcttcctgcatcacctgatcgcagagattcacacagcagaaattcgagcgacttctgaggtctcacccaatagcaaaccttcacccaacacaaaaaatcacccagttaggtttgggtcagatgatgagggacggtatctgacccaagagacaaataaagtcgaaacatacaaggagcagcccctgaagacgcctggaaaaaaaaagaaaggcaaacccggcaagagaaaagagcaagaaaagaagaagaggaggacgcgttccgcctggttagacagcggcgtgacaggctctgggctggagggggatcatctctcagatacatctaccacctcccttgagttagacagcaggagacactag

SEQ ID NO: 127897 - DNA, 519 bp, Artificial Sequence
  Description of Artificial Sequence: Synthetic coding sequence
atgcagaggcgcctggtacagcaatggtcagtcgcagtgttccttctgagttacgccgttcctagctgtggacgtagcgtcgagggcctgagccgcagactgaaacgcgcggtgagcgaacatcaattgcttcacgacaaaggcaaatccattcaagacctccgccggcggttcttcctgcatcatttgattgcagagatccacactgctgagatccgcgctacgagtgaggtctcccccaatagtaaacccagtcccaacactaagaatcaccccgtccgattcggctctgacgatgagggtcgttacctcacacaggaaaccaataaagtggagacttacaaggaacagccactgaagactcctggaaagaaaaagaaagggaagccaggaaaaaggaaggagcaagaaaagaagaaaagaagaacaagaagtgcctggctagattctggcgtgacgggcagtgggctggaaggcgaccatttaagcgacacatcaacgacaagcctcgaactttag

SEQ ID NO: 127898 - DNA, 534 bp, Artificial Sequence
  Description of Artificial Sequence: Synthetic coding sequence
atgcaacgcagacttgtccaacaatggtccgtagctgtattcctgctcagttatgcagtccctagttgcggacgttcggtggaaggtctgtcccgcagactgaaacgcgctgtgagcgagcaccaattgctacacgacaaaggcaaaagcattcaggacctcaggagacggttctttcttcaccatctgattgcagagatacataccgctgagataagggctacttccgaggtctctcctaacagtaaacccagtcccaacaccaagaaccatccagtcagatttggatctgacgacgagggacgctacctgacacaggagactaataaggtcgagacctacaaagaacaacccctaaaaaccccagggaagaaaaagaaggggaagcctggtaaacgaaaagagcaagaaaagaagaagcggaggacgcggtcagcatggctggactctggggtgacaggctccggcctggagggcgaccacctgtcagacacttctacaacctccctcgaactcgactctaggcgacactag

SEQ ID NO: 127899 - DNA, 891 bp, Artificial Sequence
  Description of Artificial Sequence: Synthetic coding sequence
atggtcgcagagaaggagactctgagcttgaacaagtgcccggataaaatgcctaaaaggacaaagttgctggctcagcagccattaccagtgcatcaaccacattctctggtgagcgaaggcttcacagtgaaggcaatgatgaagaacagcgttgtaaggggcccacctgccgccggcgcattcaaggagcgaccgacgaagccgaccgcctttaggaagttttacgagcgcggcgacttccccattgccctggaacatgactcaaaaggcaacaagattgcatggaaagtagaaatagaaaagttggactatcaccactatcttcccctgttttttgacgggctgtgcgagatgaccttcccatatgaattctttgcccgacagggcattcacgacatgctggagcacggcggcaacaaaattctccctgtcctgccccagctgatcatccccattaagaatgcactgaatttaagaaatcgccaggtgatctgcgttaccctgaaagttctgcagcacctggtcgtgtccgctgagatggtcgggaaggcactggtgccgtactacagacagatcctgccagtactgaatatcttcaagaatatgaatggttcctacagcttgccaagactagaatgtagcggggctatcatggccagatgtaaccttgaccatttgggaagttccgaccctccaacatctgcctctcaggtagctgaaataatcgtgaattccggtgacggtatcgactattcccaacaaaaacgcgaaaacattggagatcttatccaagaaactctggaggccttcgaacgctacggaggtgaaaatgctttcattaatattaagtacgtcgtacctacttatgaatcatgtttgctgaattag

SEQ ID NO: 127900 - DNA, 774 bp, Artificial Sequence
  Description of Artificial Sequence: Synthetic coding sequence
atggtggcggagaaggagacactgtccctgaacaagtgccccgacaagatgcccaaaagaacaaaactgctcgcacagcaacccctcccagtgcaccagccccattcactggtgtcggagggtttcaccgtgaaagccatgatgaagaatagcgttgtgcgcggacctccagctgctggggctttcaaagagaggccaaccaagcccaccgctttcagaaaattctacgagcgaggggattttcctattgctctggagcacgactcaaaaggtaataaaatagcctggaaggtcgaaatagaaaagctggactaccaccactaccttcctctgtttttcgatggtttgtgcgaaatgacttttccctacgagttttttgctcgacaggggattcatgacatgctggaacatgggggaaataaaatcctccccgtgttaccccagctcattattcccatcaagaacgccctaaacctccgaaacaggcaagtaatctgtgtaaccctgaaggttctgcagcacctcgtggtgtccgcagagatggtcggaaaggccctggtgccatactataggcaaatccttcctgttcttaatatcttcaaaaacatgaatgtgaactctggcgacggcatcgactactcacagcaaaagcgggagaacattggcgacttgatccaggagacactcgaggccttcgagaggtacgggggcgagaacgcgtttatcaatataaaatatgtggtgcctacttatgagtcttgtctgctgaattag

SEQ ID NO: 127901 - DNA, 774 bp, Artificial Sequence
  Description of Artificial Sequence: Synthetic coding sequence
atggtagcggagaaggagactctcagtctgaataagtgcccggacaaaatgcctaagcgcactaagctgctggctcaacaacccttaccagtacaccagcctcacagcctggtgtctgagggcttcacagttaaggccatgatgaaaaacagtgtggtgaggggtcccccggccgccggagcttttaaggaaagaccaactaagccaaccgccttcagaaagttctatgagaggggcgactttccaattgcgctggagcacgatagtaaaggcaacaagatagcgtggaaagttgagatagagaagctcgactatcaccattaccttcctctgttcttcgatggactctgtgagatgaccttcccatatgaattttttgctaggcagggtatacacgatatgctggaacacggtggaaataagattctgcccgttttgccacagttaattattcccatcaagaacgctttgaatcttcgcaaccgtcaggtcatctgtgtcactctcaaggtcttgcagcacctggtagtgtctgccgagatggtcggcaaggccctggtgccctattatagacaaatcctccctgttttgaacattttcaagaacatgaacgttaactccggggacggaattgattactcccagcaaaagcgagagaacatcggagacctaatccaagagaccctggaggcatttgaacggtatggaggtgagaacgcctttattaatatcaaatacgtggtgccgacatacgagtcatgcttgcttaattag

SEQ ID NO: 127902 - DNA, 825 bp, Artificial Sequence
  Description of Artificial Sequence: Synthetic coding sequence
atgtccggggagtgtcaatcgccccattgccctgggactagtgccgaattcttctttaagtgtggagcccatccgacctctgacaaagagacatcagtggccctgcacctgattgctacaaacagcagaaatatcacttgtataacatgcactgatgtccggtctcctgtattggtcttccagtgcaatagccgccatgttatatgtctggattgcttccacttatattgcgtcacgcgcttaaacgatcggcagttcgtgcacgatccccaactcgggtacagtctaccgtgtgtggcaggctgtcccaatagcctgatcaaggaactgcaccactttaggattctgggggaggaacagtacaacagatatcagcagtacggggcagaggaatgcgtcctgcaaatgggaggggttctgtgtccaagaccgggatgcggagcaggccttcttcccgagcctgatcaacggaaggtgacatgcgaaggaggtaacggcttagggtgtggcttcgcgttttgtagagaatgcaaagaagcatatcatgaaggtgagtgctccgccgtcttcgaagcttcggggactacgacacaggcctatagagtcgatgaaagagctgcagaacaggccagatgggaagccgcatcaaaggagactatcaagaaaaccacaaaaccttgcccccgctgtcacgtgcccgtggagaagaatggggggtgtatgcatatgaagtgtccgcagccacagtgtaggctcgagtggtgttggaactgcggatgtgaatggaaccgggtctgtatgggtgatcactggttcgacgtctag

SEQ ID NO: 127903 - DNA, 1107 bp, Artificial Sequence
  Description of Artificial Sequence: Synthetic coding sequence
atgatagtgttcgttaggttcaattcctcacacgggtttccagtggaagtggactccgatactagcatcttccagctgaaagaagttgtcgctaagcgacagggcgtgcccgcagatcagctccgagtgatcttcgctggcaaggagctgagaaatgactggactgtgcaaaactgtgacctcgaccaacagtctatcgttcacatcgtccaacgcccttggcggaagggccaggaaatgaacgcgacagggggcgacgatccgcggaatgccgctgggggttgtgaacgtgagcctcagagcctcaccagggttgacctttcttcatctgtcttgccaggagactccgtcggacttgcagtcattctccatacagattcaaggaaggacagcccacctgcaggttccccggccggaagatctatctataactctttctacgtttattgcaaagggccttgtcagagggttcagcccggtaagctgagagtgcaatgcagcacatgtagacaggccacactgaccttgactcagggcccgagctgttgggatgacgttctaatccctaacagaatgtctggggaatgccaatccccgcactgtcccgggacaagcgcagagttctttttcaagtgtggggcgcaccccactagtgacaaggagacatccgtcgctctgcaccttatcgccaccaatagccggaacatcacttgtattacctgcacagatgtgcggtcacccgttctggtctttcagtgcaacagtcgtcacgtgatctgtctggactgctttcatttatattgcgtaacacggcttaacgatcggcaatttgtgcacgatccccagctgggttattcactaccttgtgtcgccggctgcccaaactccctaatcaaggaattgcatcatttccggatcttgggggaggaacaatataatcgctaccagcagtacggggctgaggagtgtgtgctccagatgggtggggtactctgtcccaggcctggttgcggtgccgggctgctccccgaacccgatcaaaggaaagtcacctgcgaggggggcaacggtctcgggtgcggctatggccagagaagaactaagtag

SEQ ID NO: 127904 - DNA, 825 bp, Artificial Sequence
  Description of Artificial Sequence: Synthetic coding sequence
atgtccggtgaatgtcagagtccccactgtccaggcaccagcgcagagtttttcttcaagtgtggagctcaccccactagtgataaggagacatctgtggcactacatctgatagccaccaactccagaaatatcacctgcatcacttgcaccgatgtgcggtctcctgtgcttgtgttccagtgtaattccagacatgtgatctgcctggactgttttcacctgtactgcgtaacgagactaaatgatcgacagttcgtgcacgacccacagctcggctatagcctcccctgtgtggcaggctgtccaaacagtctcatcaaggagctccatcacttccgtatccttggagaggagcagtacaatcgatatcaacagtatggcgcagaagagtgtgttcttcaaatgggaggagtcttatgccccaggcctggatgcggggctggtctgctgccagaacctgaccagaggaaagtcacctgtgaaggcggcaacgggctgggctgtgggtttgctttctgtcgggaatgcaaagaggcatatcacgagggagaatgcagtgctgtgtttgaggcgagtgggaccactacccaggcatacagggtggatgagcgggcagcagagcaagcccgttgggaggcagcttctaaggagacaatcaagaaaaccaccaaaccctgcccccgctgtcatgtccctgttgaaaaaaatggcggttgcatgcatatgaaatgcccacagccccagtgtaggctcgaatggtgttggaattgcggctgcgaatggaacagggtgtgcatgggcgaccactggttcgacgtatag

SEQ ID NO: 127905 - DNA, 657 bp, Artificial Sequence
  Description of Artificial Sequence: Synthetic coding sequence
atgaatgcaacggggggcgacgacccacggaacgctgctggtggctgcgaaagggaaccacagtccctcaccagggtcgatttgtcgtcctccgtactccccggtgatagcgtcggtctggcggtgatcctgcacaccgattctcggaaagattccccccctgctggatccccagctgggaggtctatctacaacagtttttatgtgtactgcaaaggcccgtgtcaacgagtgcagccaggtaagctgcgagtccagtgcagtacctgccgtcaagccaccctgactctcacacaagggccttcctgttgggatgatgtcctaataccaaacaggatgtccggcgagtgtcagagcccccattgcccagggacttctgcagaatttttttttaagtgcggagcacatcctactagtgataaggaaaccagcgtggcgctacatcttattgccacaaactctcggaatatcacttgcatcacttgtaccgacgtccgaagcccagtgttggttttccagtgcaattccagacacgttatctgcctcgactgtttccacctgtactgcgtgacaaggcttaatgatcgccaattcgtgcacgatccgcagttagggtacagcctaccatgcgtggtgtccctgctacctagccaatag

SEQ ID NO: 127906 - DNA, 951 bp, Artificial Sequence
  Description of Artificial Sequence: Synthetic coding sequence
atgatagtcttcgtaaggttcaacagctctcacgggttccccgtcgaggtcgatagcgatacctcaattttccagttaaaagaggtggtggctaaacgtcagggagtaccggcagaccagctgcgtgtcatcttcgctggcaaggaactcagaaacgactggaccgtccaagaattttttttcaagtgcggcgctcacccgacctccgacaaagagacatcagtggcactgcacctaattgctactaatagtcgtaatattacctgcattacctgcactgacgttaggtctccagtgctggtgtttcagtgtaattcgaggcacgtaatctgtctagattgtttccatctgtattgtgtgacacgtctcaacgacagacagtttgtacacgacccccagttaggctactcgcttccatgcgttgcggggtgtcccaactctttgattaaagagttgcaccacttccgaattttgggtgaggagcaatataatcggtaccagcaatatggagctgaggagtgtgtcctgcagatgggaggcgtcctgtgtccaagacccggctgcggagccggactcttgcccgagcctgatcagagaaaggttacctgcgagggagggaacggacttggctgtggcttcgccttttgccgtgaatgcaaagaggcgtatcatgaaggcgagtgctccgcggtgttcgaagcatccggcactaccacccaggcctatcgcgtggatgagagagcagccgagcaagcaagatgggaggccgctagcaaagagaccattaaaaaaaccaccaaaccctgtcctcggtgccatgtgcctgtggagaaaaatggcgggtgtatgcatatgaaatgcccacagcctcaatgccgcctcgagtggtgttggaactgtggatgtgaatggaatagagtgtgtatgggggaccactggttcgacgtatag

SEQ ID NO: 127907 - DNA, 1314 bp, Artificial Sequence
  Description of Artificial Sequence: Synthetic coding sequence
atgattgtgtttgttaggtttaacagtagccacgggttccccgtcgaagtggactctgacacctccatctttcagctcaaagaggtggtggctaaacggcaaggggttcccgccgaccagctgagagttatctttgccggcaaggagctgcgtaatgattggaccgtgcagaactgcgacctggaccagcagtctatagtgcatattgtgcagagaccatggagaaaggggcaggaaatgaatgccacaggcggtgacgacccacggaatgcggccggggggtgcgaaagggagcctcaaagtctaacccgggtggatctgagtagttccgtgcttcctggagacagcgtggggctcgccgtgatcttgcacaccgatagtaggaaggattcgccaccggctgggagtccagccggccgctccatttataatagcttctacgtttattgcaaaggaccatgccagcgggttcagcctggaaagttgagagtgcagtgttcaacttgtcgacaggctacgttaacactcacccaagagtttttctttaagtgtggcgcccatccgacaagtgataaagagacctcagtcgccctgcacctgattgccaccaacagcaggaacatcacatgtattacctgcacagatgtgcgctcacctgttctcgtcttccaatgcaattcaaggcatgtgatttgccttgattgcttccacctgtactgtgtgactcgcttaaatgatcgccagttcgtgcatgatcctcagttaggttatagtctcccttgtgtagccggttgcccaaacagccttattaaagagctacatcattttcgcatcctgggcgaggaacagtacaacaggtatcagcagtatggtgcggaggaatgtgtgttgcagatgggtggcgtgctctgcccgagacctggctgtggcgccggactactgccagagccagaccagcgcaaagtaacctgcgagggaggcaatggactcggttgtggtttcgctttttgccgagagtgcaaggaggcctatcacgagggagaatgctccgccgtatttgaggcgagtggcaccaccactcaggcttatcgggtggatgagagagccgccgaacaggcaaggtgggaagccgccagcaaggagacaataaagaagacgactaagccctgcccgcggtgtcatgtgccagtcgaaaagaatggcggatgtatgcatatgaagtgtccgcagccccagtgtcgtcttgagtggtgctggaattgcgggtgcgagtggaacagggtgtgcatgggggaccactggtttgatgtgtag

SEQ ID NO: 127908 - DNA, 1398 bp, Artificial Sequence
  Description of Artificial Sequence: Synthetic coding sequence
atgatcgtttttgtgaggtttaactccagtcatggtttccccgttgaggtagatagtgatacatccatattccagttaaaggaagtggtagccaaacgtcagggggttccggccgaccagctgcgcgtgatatttgctgggaaagagctgcggaatgactggactgtgcagaactgcgacctcgaccagcaatcgatagtacacatcgtgcagagaccctggaggaaagggcaagaaatgaacgcaacaggtggggatgatccacgaaatgctgccggtggctgcgagcgagaacctcagtccctgacccgcgtagacctcagctctagcgtgctacctggggatagcgttggcttggcagtcatacttcacacagatagcaggaaagacagcccccctgcaggaagtcctgctggccggagcatttacaactcgttttatgtctactgtaaaggcccctgtcagcgggtccagcccggaaaactgagggtgcaatgtagcacgtgtcggcaagccaccctaactctgacacagggtcctagctgctgggacgacgttctcattcctaaccgaatgtcaggggagtgtcaaagcccacactgtcctggcacttcagcagagttcttcttcaagtgcggtgcccatccgacttccgataaagagactagcgtagcgctgcacttaatagccacgaacagccgcaatattacatgtattacatgcactgatgtgaggtcccctgtccttgtcttccaatgcaatagcaggcatgtcatctgcttagactgtttccacctttactgcgtgacacgcctcaacgaccgccagttcgtccacgatcctcagctgggttattcactgccttgcgtcgccggctgtccaaacagcttgattaaggaattacaccatttccggattttaggcgaggagcaatacaacagatatcagcagtatggcgccgaggagtgcgtcctgcagatgggaggcgtcctgtgccccagacccgggtgcggggccggactgctgccagagccggaccagcgcaaagtcacctgtgagggtgggaatggcttagggtgcggttttgcattttgccgtgaatgtaaggaggcttatcatgagggggagtgctctgccgtattcgaagcatctggtaccactactcaggcctaccgcgtcgatgagagagctgcagagcaggccaggtgggaggccgcctccaaggagaccatcaagaaaacaactaagccatgtcctcggtgtcacgttcctgtcgaaaaaaatggtggctgcatgcatatgaagtgcccccagccacaatgccgactcgagtggtgttggaactgcggatgtgagtggaaccgcgtgtgtatgggagaccattggttcgatgtatag

SEQ ID NO: 127909 - DNA, 612 bp, Artificial Sequence
  Description of Artificial Sequence: Synthetic coding sequence
atgtctggagagtgtcagtctccccattgcccaggtacttccgctgagtttttcttcaagtgtggcgcccaccccacctctgacaaggagacctcggttgcgttgcacctgatcgcaaccaattcacgcaatatcacatgtatcacttgcacagacgtgaggtctcctgtgttagtatttcagtgtaactccagacacgttatttgcctggactgttttcacctttattgtgtcacaaggctcaacgacagacagtttgtgcatgatccccagctggggtattcacttccttgcgtcgctggctgtcccaattcattgattaaagagctgcatcatttccgaattctgggcgaggagcagtacaacagataccaacagtacggggccgaagaatgtgtgcttcaaatgggcggcgtgttatgcccccggccagggtgcggtgctggtttgctgccggagcctgatcagcgtaaggtgacttgtgagggagggaatggcctcggttgtggatttgcattttgccgagagtgtaaagaagcctatcacgaaggtgagtgcagcgccgttttcgaggcctccggcactactactcagcatagcggctgtacatag

SEQ ID NO: 127910 - DNA, 429 bp, Artificial Sequence
  Description of Artificial Sequence: Synthetic coding sequence
tctgtgtttgtgcggttcaacagtagtcacggctttcccgtggaggtcgatagtgacacctctatcttccagttgaaggaggtcgtcgccaagagacagggcgttcctgcagaccaactccgcgtgatattcgccggcaaggagctgcgtaacgactggaccgttcagaactgcgatctggatcaacaatccattgtccacatcgtccaacgcccgtggagaaaggggcaagagatgaatgcaactggcggggatgatccaagaaatgctgccggtggctgcgagagggagcctcagtcactgacgcgggtcgacttatctagttcagtgctaccaggggactccgttggcctggctgtgatccttcacaccgactctaggaaggattcaccaccagccggcagccctggcaactgcctccacgggtag

SEQ ID NO: 127911 - DNA, 429 bp, Artificial Sequence
  Description of Artificial Sequence: Synthetic coding sequence
atggctgcagtcgtcgctgcaactgctctgaaaggccggggagcccgtaatgccagggtgctgaggggcatactggcaggcgcaaccgctaacaaagcgagtcataaccggaccagggcattgcagtcccactcatctcccgaggggaaagaagagccagagcccttatctccagagctggagtacatccctcggaaacggggaaaaaaccccatgaaggccgtcggactcgcctgggctatcggattcccctgtggaatcctccttttcattttgacgaaacgcgaggtagataaagatcgcgtgaaacagatgaaggcgagacaaaacatgcgtcttagcaatactggcgaatacgagagccaaaggttccgggctagtagtcagtctgcgccctcaccggacgtgggatctggcgtgcagacctag

SEQ ID NO: 127912 - DNA, 1086 bp, Artificial Sequence
  Description of Artificial Sequence: Synthetic coding sequence
atggcctggcaggggtggcctgccgcttggcagtgggtagccggatgttggcttctccttgtacttgtcctggtcctcctggtaagccccaggggctgccgcgctcgaaggggcctgcgaggactgctaatggcgcattcccagaggctcctttttaggatcggatactccctttatacaaggacttggcttggctacctgttctataggcagcagcttaggcgtgctaggaataggtatccaaagggccatagtaaaacacagccgcggctgttcaacggggttaaagtgctccctataccagtgttgtctgacaactactcatatctgatcatcgacacgcaagcccagctagccgtagctgtcgaccctagtgacccacgtgccgtacaagcatccatagagaaggagggcgtaacactggtcgctatactgtgcacacataagcactgggatcatagcggaggaaaccgggacctgtctcgcaggcatagagactgccgggtgtatgggtccccacaagacggaattccttacctgacccacccgctctgtcaccaggatgtcgtgagtgtggggagattacaaatccgcgctctggctactccggggcacactcagggccatttggtctacctgctggatggagagccctataaggggccatcttgtcttttttcaggagatttgctatttctctcagggtgtggaagaacctttgagggtaatgcagagacaatgctttcttcacttgacaccgttctcggactcggtgatgatactctattgtggcccggtcacgaatacgcggaagagaatctgggctttgcaggggtggtggaacctgagaacctggccagagaaaggaagatgcagtgggtgcagagacaacggctggagcgcaaaggcacatgtccatcaaccctcggcgaagagaggagctacaatccctttttacgtacacactgtcttgcgctgcaagaagcacttggacccggaccgggtcctacaggtgatgatgactattctcgggcccagctcttggaggaactcagacggctgaaagatatgcataagagcaagtag

SEQ ID NO: 127913 - DNA, 1158 bp, Artificial Sequence
  Description of Artificial Sequence: Synthetic coding sequence
atggctgccgtcgtcgctgcaacagcgcttaaggggcgcggtgcgaggaacgccagggtcctgcgcggaatactagccggcgccactgcgaacaaagcgtctcacaacaggactcgggctctccagagccattctagccctgaaggtaaagaggaaccagagccactcagtcctgagctggagtacatcccgcggaaacggggaaagaacccaatgaaggccgtcggtttagcctggtactccctctacacacgaacttggctgggatacctcttttacagacagcagctgaggagggcaaggaatcgctaccctaagggacattccaagactcagccaaggcttttcaatggcgttaaagtcctgcctatccccgtccttagcgacaactactcatatctcattatcgatactcaggcccagctggccgtagccgttgatccatccgaccctagggccgttcaggcttcaattgagaaggaaggggttactctcgtggcgatcctgtgcacacataaacattgggaccactccggtggcaacagagacctaagtcgccgtcatagagactgcagggtctatggcagtccccaggatggtattccttatctgactcacccactatgccaccaggatgtcgtctcagttggacgcctgcagatccgggcactcgcaacgccaggacatacccaaggccacctggtatatctgctggatggggaaccgtataaaggtcccagctgtctgttctcaggagatctgctgtttctgagtggctgtggccggaccttcgagggcaacgctgaaaccatgctgtcgtccctggacactgttttgggtctgggagacgatacgcttctttggcccggccatgagtatgctgaagaaaatcttgggttcgcgggggtcgtagagccagagaatctggcccgcgagcgtaagatgcaatgggtgcagaggcagcggctggagagaaaagggacatgccccagcacactcggagaagagaggagctataatcccttcctgaggacgcactgccttgcactccaagaagccctgggtcctggaccaggtcctacaggtgatgacgactattctagggcacaactgctcgaggagctcaggcggttgaaggatatgcacaaatctaagtag

SEQ ID NO: 127914 - DNA, 1455 bp, Artificial Sequence
  Description of Artificial Sequence: Synthetic coding sequence
atggcagctggcggggatcacggtagcccggacagctacagaagtccccttgcgtcacgatatgcatcaccagaaatgtgcttcgtgtttagcgatagatataagttccggacctggcgacaattgtggttatggctggcagaggccgaacagacccttgggctgccgattacagacgagcagattcaagaaatgaagtccaatctggagaacatcgactttaaaatggccgccgaggaagagaagagactgagacacgatgtgatggctcacgtccatacatttggacactgctgtccaaaggccgccggcatcattcacctgggtgccacttcttgttatgtgggagataacacagatctgatcattctacgcaatgccctggatctgcttcttcctaaacttgctcgggtgatcagccgactggctgacttcgcgaaggagcgggcgtccctgcccactcttggctttactcattttcagcccgcccagttgaccaccgtcggaaagagatgctgtctgtggatccaggatctgtgtatggatttacagaaccttaagagagtccgagatgatctacgtttccgtggtgtgaagggcaccaccggaacacaggcctccttccttcagctgttcgagggggacgaccacaaagtggaacagctggataaaatggtgaccgagaaggctgggtttaagcgcgccttcataataacagggcagacctacacgagaaaggttgatattgaggtgctgtcggttctggcctccctaggagcgtcagtgcacaaaatttgcacggatattaggctgctcgctaacctgaaggaaatggaggaaccatttgagaagcaacaaatcggtagtagcgccatgccatacaagcggaatcccatgaggtcagagagatgttgctcactggctcgccaccttatgacattagtgatggatcccctccagacggcaagcgtacagtggttcgagaggacactggatgacagcgccaaccgccggatttgtctggccgaggcttttctcactgctgatacgatcctgaatacacttcagaacatatctgaaggattggtcgtgtatccaaaggtgattgagcggcggatccgccaggaattgcccttcatggccacggaaaacattatcatggccatggtgaaagcaggaggatcccggcaggattgtcacgaaaaaattcgggtcttgtctcagcaggccgcatccgttgtgaaacaggaaggcggagataatgacctgatcgagcgaatccaggtcgatgcctacttctccccgatccactctcaattggatcacttactggacccttcttcgtttaccgggcgggcaagccagcaggtccaacgatttctggaagaagaagtgtaccctctgctgaaaccttacgaatcagtgatgaaggttaaggccgagctgtgtctgtag

SEQ ID NO: 127915 - DNA, 237 bp, Artificial Sequence
  Description of Artificial Sequence: Synthetic coding sequence
atggtcggactaaaaaagaagtcagctgatgacgtcaaaaaggtgttccatatgttggacaaggataaatctggcttcatcgaagaggatgaactgggcttcattttaaaagggttcagccccgacgcaagggacctgagtgccaaagagacaaaaatgcttatggccgctggagataaggacggggacggaaagatcggcgtcgacgaatttagcactctcgtcgccgagagctag

SEQ ID NO: 127916 - DNA, 333 bp, Artificial Sequence
  Description of Artificial Sequence: Synthetic coding sequence
atgtctatgactgacctgctgaacgccgaggacattaagaaggccgttggggcattttccgccaccgatagcttcgaccacaaaaagttctttcagatggtcggattgaaaaaaaaaagcgcagacgatgtgaaaaaagtgttccacatgctggacaaagataagtcgggcttcatcgaagaggatgagctgggattcatactgaaaggattctcgccggacgctagggaccttagcgcaaaggagaccaaaatgctgatggctgctggtgataaagatggtgatggcaagattggggttgacgaatttagcactcttgtcgcggaatcctag

SEQ ID NO: 127917 - DNA, 306 bp, Artificial Sequence
  Description of Artificial Sequence: Synthetic coding sequence
atgagtatgaccgacctgcttaatgccgaagacattaagaaggccgtgggtgcgttcagtgccaccgacagcttcgatcacaagaagtttttccagatggtcggcctgaagaaaaagagtgctgacgatgttaagaaggttttccacatgcttgataaggacaaaagtgggtttatcgaagaggacgaactggggtttatcctaaaagggtttagcccagatgccagggacctgtccgctaaggaaactaaaatgctgatggctgccggcgataaagatggagatgggaagattggcgtggactag

SEQ ID NO: 127918 - DNA, 984 bp, Artificial Sequence
  Description of Artificial Sequence: Synthetic coding sequence
atgtcggatcttcaggaggagggcaaaaacgctatcaactccccaatgtccccagccctggtggacgttcaccccgaggacacgcagttagaagagaacgaagagcggaccatgatagacccgacctctaaggaggacccaaagtttaaagaacttgtcaaagtgctgctagattggattaatgatgttttggttgaagagcgtattatcgtgaagcagctcgaagaagatctctatgacggccaagtgctgcaaaagctactggaaaagctggcaggctgcaaactgaatgtggctgaggtgacccagtcagagatcgggcagaagcaaaagctccagacagttctggaggcagtgcacgatcttctgcgccctcgcggctgggcactgcgttggtccgtggactctatccatggtaagaatctggttgcaattctccacctcctcgtgtctctggcaatgcattttcgggcccctatccgcctgccggagcatgtaaccgttcaggtggttgtggtgagaaaaagagagggcctgcttcattcgtctcacatctcggaagagttaacaactactactgaaatgatgatgggccgttttgaaagagacgcttttgacacactgtttgaccatgcccctgacaaactctctgtggtaaagaagtctctgatcacttttgtgaacaaacatcttaataagttgaatctggaggtgactgaattggaaacgcagtttgctgacggtgtgtatctcgtgctgctgatgggcctgctcgaggactacttcgtgccccttcatcacttttatctgactccagagagtttcgatcagaaggtgcataatgtgagttttgcgtttgaactaatgctggatggaggactcaagaaacccaaggctcgtcctgaggatgtagttaacctcgatctcaaatccacacttagagtcctttacaacctcttcacaaagtacaagaatgtagaatag

SEQ ID NO: 127919 - DNA, 1239 bp, Artificial Sequence
  Description of Artificial Sequence: Synthetic coding sequence
atgctcggcattatcccactccccttcgggaaaccacagccacagagtaggcgccgacctttgcggccgccttctgcctcttccgcctcccgccccgccagaggatcacttcgccgtgccatggcaacatcccctcagaagagtcctagcgtgccgaagtctcctacccctaagagtcctcccagtcgcaagaaagatgacagcttccttggcaagttgggcggcactctcgcccggcgtaaaaaggccaaagaggttagcgagctgcaggaagaggggatgaacgcgattaacctgccattatctccgattccctttgaactggatccagaggatacaatgctcgaggagaacgaggtccgaaccatggtagacccaaactcccggtcagacccaaagcttcaggagctgatgaaggtattgatagactggattaatgacgtcctggtgggagagagaatcatcgtgaaggatctggcagaggatctgtacgatggacaggtgctgcagaagctcttcgagaaactcgagtcagaaaagctgaacgttgccgaagttacacagagcgagatcgcacagaagcagaaactacagacggtgttagagaaaatcaatgaaacgttgaaattgccgccgcggtctatcaaatggaatgtcgacagcgtgcacgcaaagtccttagtcgctattctccacctactggtggcccttagccagtatttccgggcccccattcggctccccgatcacgtttctatacaagtagtcgtggttcagaaaagggaaggaattctccagtcacgtcagatccaggaggaaatcactggtaatacagaggcattatcgggcaggcacgagagagacgcctttgatacccttttcgatcatgcgccagataagctaaacgttgtgaagaagacactaataaccttcgttaataaacaccttaacaagctgaacttggaggttaccgaactggaaacccagtttgccgacggcgtatatctggttcttctcatgggcctcttggaagggtactttgtgcctttgcactctttctttctcaccccagattcattcgagcagaaggtgttgaatgtgtcctttgcctttgagctgatgcaggacggaggattggaaaagccaaaacctcgccccgaagacatcgttaactgtgatctgaagagtactttgcgtgtgctttacaatctcttcactaaataccggaatgtggagtag

SEQ ID NO: 127920 - DNA, 873 bp, Artificial Sequence
  Description of Artificial Sequence: Synthetic coding sequence
atgaacgcaataaacctccctttatctccgataccctttgaactggaccccgaggacaccatgctcgaggagaatgaagtgcgcactatggttgacccgaactctaggtctgatccgaaattgcaggaactgatgaaagtgttgatcgattggattaatgacgtgcttgtgggggagagaatcatagtcaaggatcttgctgaggacctgtacgatggccaggtgctgcagaaattattcgagaagctggaatcggaaaagcttaacgtggcagaggtaacccagagcgagatcgctcaaaagcagaagcttcagaccgtactggaaaagatcaacgagaccctaaagctgccaccaaggtccattaagtggaacgtggacagtgttcatgctaaatcgctcgtggctattctccacctgcttgtggcactgagccaatacttcagggctcccatcaggttgcctgaccacgtaagtattcaggtggtggtggtgcagaagcgggaaggcatacttcaatcacggcagatccaagaggagattacaggcaatacagaagccctgtctggaagacatgagagggatgccttcgataccttgttcgatcatgcccccgataagctcaacgtggtcaagaaagttggaaaagggtgcttgggttggacagaaggctccgaaatgcagcagaacattggaaaaactcatccttgctcacttcgcgctagctgtcaaaactggtggcatcaccttacaagcgcccacacggggttatcgcccctgccctccatgtatctgtcggtgcctcattggatgctgcacttagggctcttcccttcaatctcaatgaatagtctctcgtctcaccctggatag

SEQ ID NO: 127921 - DNA, 1119 bp, Artificial Sequence
  Description of Artificial Sequence: Synthetic coding sequence
atggcgacatcacctcagaagtccccgtctgtcccgaagagcccaaccccgaaatccccgcctagcaggaaaaaagatgatagcttcctcgggaaactaggtggcactttggccagacgtaagaaggcaaaagaagtgagcgaactccaggaggaaggcatgaatgctataaatctgcctctgagcccaatccccttcgaactggatccagaagataccatgctggaagagaatgaggtacggacaatggtcgaccctaactcccgttccgatcccaaactgcaggagcttatgaaggtactgatcgactggataaacgacgtgctggtcggcgaacgtataatcgtcaaggacttggccgaggacctctatgatggccaggttctgcaaaaactgtttgaaaagctcgaatcggaaaaactgaatgtagccgaggtgacacagtcggagattgcccagaaacagaaactgcagacagtgctggagaagatcaatgagacactaaagctgccaccaaggtccatcaagtggaacgtggacagcgtccacgcaaaatctctcgtggccattctgcacctgctggtcgctctgagccagtactttcgagcccccattcgactaccggaccacgtgtctattcaagtcgtggtcgtacagaagagggaaggaatcctgcagtcacgtcagatccaggaagaaataaccggaaatacagaatatgtttccagtagacacaaaagggatgccttcgacacattattcgatcacgctccagataaactgaacgtggtgaaaaagactctcatcacattcgtaaataaacatctgaataagctcaacctggaggtgacagaactagaaacacagttcgccgacggagtttacctggtattgcttatgggccttctcgagggctactttgttcctcttcatagttttttccttacgcccgatagcttcgagcagaaggtgttgaacgtcagcttcgcatttgaactaatgcaggacggtggactggagaagcccaagccaaggcctgaggatatagtcaactgcgatctgaagagcaccttaagagtgctgtacaacctttttaccaagtatagaaacgttgagtag

SEQ ID NO: 127922 - DNA, 1119 bp, Artificial Sequence
  Description of Artificial Sequence: Synthetic coding sequence
atggccacgagtcctcagaagtcaccatcggtgcccaaaagccccactcctaaaagcccgccctcccgaaagaaggacgacagcttcttgggaaaactaggcggaacattagcaagacgtaaaaaagcaaaggaggtcagcgaacttcaggaagaagggatgaacgctataaacctgcccttgagcccaatccctttcgagctggaccccgaggacacaatgcttgaggagaacgaagtgcgcactatggttgatccaaacagcaggagcgaccctaagctgcaagaacttatgaaggttttgattgactggatcaatgacgtcctggtcggggagagaatcatcgttaaggatttggctgaggacctgtatgatggtcaggtcctccagaagctttttgagaagcttgagtcagagaaacttaacgtggccgaagtcacacagagcgagatcgcccagaaacagaaactgcagaccgtgctcgagaaaattaacgaaacacttaagcttccccctcggagcattaaatggaacgtggactcagtgcacgcgaaatcactagtagctattctgcacttactggtagctctcagccagtattttcgagcacccatccggctgccagatcacgtcagcattcaagttgtggtcgttcagaaacgcgaggggatcctacagtccaggcagatacaggaggaaattaccggtaacactgaagcactctctgggaggcacgaacgggatgcctttgataccttgttcgatcatgccccggataagctgaatgtggtcaagaagacacttatcactttcgtgaataagcatttgaacaaacttaacctggaggttactgaactcgagactcagttcgcggatggggtgtatctagtgctcctcatgggccttctggaaggatacttcgtgcccctgcatagctttttccttactcctgattcttttgagcagaaagtgctgaatgtttcttttgccttcgaactaatgcaagatgggggcctggaaaagcccaagccaagaccagaagatattgtcaactgcgacctgaagagcaccttgcgtgtcttgtacaacctatttactaaatatagaaatgtagagtag

SEQ ID NO: 127923 - DNA, 1095 bp, Artificial Sequence
  Description of Artificial Sequence: Synthetic coding sequence
atgagttctgcgcccagatcacccactccacggcccaggaggatgaagaaggacgaaagctttctcggcaagctaggcggcaccttggctcgcaaacggagagcccgagaagtctccgatctgcaggaagaggggaaaaatgctatcaatagccccatgtctccggcccttgtcgatgtgcaccccgaggacactcagctggaggagaatgaagagaggacaatgattgacccaacttcaaaggaagaccccaagttcaaggaactggtgaaggtgttgcttgactggatcaatgatgtcctggttgaggaacggattattgtcaagcaactagaggaagatctttatgacgggcaagtactgcagaaactcttggaaaagcttgccgggtgtaagcttaacgttgctgaggttacccagtcagaaataggacagaagcaaaagctgcaaacagttttggaagctgtccacgatttgctgcgccccagaggatgggctttacggtggtctgttgatagcattcacggcaagaatctcgtggcaatactgcacctcctcgtgagcctggcgatgcacttccgggcaccaatcagactcccggaacatgtcaccgtgcaggtcgtggtggtccgaaagcgagagggtttgctgcacagcagccatattagcgaagaacttacaaccaccacggagatgatgatggggcgatttgaaagagacgcatttgacacattatttgatcatgccccggataaactgtccgtggtcaagaagagtctcattacattcgtgaacaagcatctgaataaattgaatctggaagtaactgaactggagacccagttcgctgatggcgtgtacctggtgctgctcatgggccttttggaggactactttgtgcccctgcatcatttctacctcacaccagaatcttttgaccagaaagttcacaacgtttcgttcgccttcgagcttatgcttgatggtggcctgaagaaacccaaggctcggccggaggacgtggtgaatcttgacctgaagtccacactcagggtcctgtataatctgttcacgaagtacaagaatgtagagtag

SEQ ID NO: 127924 - DNA, 1194 bp, Artificial Sequence
  Description of Artificial Sequence: Synthetic coding sequence
atgcatcatgtttttaaagaccaccagcgaggggaaaagaggggattcctgtcccctgagaacaaaaactgccggaggttagagctaagaagaggctgttcgtgtagttgggggctttgctcccaagcactgatggcctctcttgcggggtctctactgccaggtagcgaccggtcgggggtcgagacttcagaatacgcacagggcggggtgtccgatctgcaggaggaaggcaagaatgccattaattctccgatgagcccggcactagtcgacgttcacccagaagatacccagctggaagagaacgaggagaggacaatgattgacccaacgtctaaagaagatcccaaatttaaggagttagtgaaggtgcttttagactggattaatgatgtgctagttgaggaaaggatcattgtgaagcagctggaggaagacctctacgacggacaggtgctgcaaaaattgctggaaaagctggccgggtgtaaactcaacgtggctgaggtgacccagtccgagatcgggcagaagcaaaagctccagacggtgctagaggccgtgcatgacctcctgagacccaggggttgggccttgcggtggagcgtagattccatccacgggaagaatctggttgccatactgcatcttctcgtctccctggcaatgcacttccgcgctccaatcaggctacccgagcacgtaaccgttcaggtcgtggtcgtgaggaagcgggagggactcctccactccagccatatcagcgaggagttgacaaccacgacggagatgatgatgggtagattcgaacgggacgcctttgacacccttttcgatcatgcccctgataagctctcagtcgttaaaaagtcattgatcactttcgtcaacaagcaccttaataagctgaacctggaggtcacagagctggagacgcagtttgccgacggggtgtaccttgttctcctaatgggcctgctggaggactacttcgtgcccctgcaccacttctatttgacacccgagtctttcgatcagaaggtgcacaatgtatctttcgctttcgaactgatgcttgacggcggtctgaagaaacctaaagctaggcccgaagacgtggtcaacttggatctgaagtctaccctgagagtactgtataacctgtttactaagtataaaaacgtagaatag

SEQ ID NO: 127925 - DNA, 996 bp, Artificial Sequence
  Description of Artificial Sequence: Synthetic coding sequence
atggagccggagtttttgtatgacctcctacaattgcctaaaggggttgaaccccccgccgaggaggagctgtccaagggcggtaagaagaaatatcttcccccaacgagtcggaaggatcctaaatttgaagaacttcagaaggtgctgatggagtggatcaatgcaactctcctaccggaacacattgtggtacgatctcttgaagaggacatgtttgacgggctcatcctgcatcacctattccaacgccttgccgctttaaaattggaggccgaggatattgccctgacagctacttcccagaaacataaactgaccgtcgttctggaggccgttaatcgctcccttcagttggaggagtggcaggccaagtggtcggtggaatctatttttaataaagacctgctgtctaccctccatctattggtcgcgcttgctaagcgcttccagcccgacctgtcactgccgacaaatgtccaagtggaggtaataactattgagagtaccaagagcggtcttaagtcagagaagctcgtggaacagttaaccgaatatagtacagacaaggatgagccacccaaggacgtgtttgacgagctgttcaaattggcccctgagaaagtcaacgctgtcaaggaagccattgtaaacttcgtgaaccaaaaactggatcgcttggggctatcagtgcaaaacttagatacacagttcgcagatggcgtgatcctgctcttgctgatcggtcagctggagggcttctttttgcacctcaaagagttttacttgacaccaaactcccctgccgagatgctacataatgtgactctggcactagagctccttaaagacgagggtctactcagttgccccgtgtctcccgaagacatcgttaacaaggatgcaaaatctaccctgcgggttctgtatgggctgttttgcaagcacactcagaaagcacatagggacaggaccccacacggtgctcctaactag

SEQ ID NO: 127926 - DNA, 81 bp, Artificial Sequence
  Description of Artificial Sequence: Synthetic coding sequence
atggagcctgaattcctgtatgacttgttgcagctgcccaaaggcgtcgagcccccagctgaagaagaactgagcaaatag

SEQ ID NO: 127927 - DNA, 93 bp, Artificial Sequence
  Description of Artificial Sequence: Synthetic coding sequence
atggagccagaattcctgtacgacctgctccagctcccaaaaggagtggaaccgcccgcggaggaggagctgagtaaaggcgtttgtccctag

SEQ ID NO: 127928 - DNA, 996 bp, Artificial Sequence
  Description of Artificial Sequence: Synthetic coding sequence
atggagccagagttcctctacgatctcctgcaattgccaaagggagttgagcccccggcagaggaagagctttctaagggcggcaagaaaaagtatctccctcctacatctcgcaaggatcccaaatttgaagagctccaaaaagtgctgatggagtggatcaatgccaccctgctccctgaacacattgtcgtgcgaagcctggaagaagatatgtttgacggattgattctccaccacctgttccagaggctggctgcgctcaagctcgaagccgaagatatcgccctgaccgccacaagtcagaagcacaaactgactgtggtactagaagccgtgaatcggagcctgcagctggaagagtggcaagccaaatggagcgtcgagtcgatattcaacaaggatctgctgtccaccctgcacttacttgtggctctggcaaaacggtttcaaccagatttatccctgcccaccaacgtgcaggtggaggtgatcaccatcgagagtaccaaatctgggctgaaatccgaaaagctggtggagcaattaaccgagtactccaccgataaagacgagcctcctaaggacgtgtttgatgagctatttaagctggcccccgaaaaggtgaacgccgtgaaggaagccatcgtgaacttcgtaaatcagaaactagatagactcggcctgagtgttcagaatctagacactcagtttgctgacggtgtcatactgctgctgcttatcgggcagctggaagggttctttctgcacctcaaggaattttacctgactcctaacagccccgctgagatgttacacaacgtgactctagccctcgaattactgaaggacgaagggcttctcagttgtccagtttctcccgaggacatcgtgaacaaggatgcaaagtccaccttacgagttctctatgggttgttctgcaaacatacacagaaggcgcatcgggatagaacaccacacggcgccccaaattag

SEQ ID NO: 127929 - DNA, 996 bp, Artificial Sequence
  Description of Artificial Sequence: Synthetic coding sequence
atggagcccgagttcctttatgatctcttgcagctgcccaaaggggtcgaaccgccagccgaggaggaactgtctaagggcgggaaaaagaaatacctgccccccacgagtaggaaggatcctaagttcgaggaactacagaaggtccttatggagtggatcaacgctacactgctgccagaacacatcgtggtccgttcccttgaggaagacatgtttgatggtcttatacttcaccacctctttcagaggctggctgcgttaaaactcgaggcagaggacattgcactgaccgcaacatcccaaaagcataaattaacggtcgtgcttgaggccgtgaaccggtctctccagttagaagaatggcaggctaagtggtcggtggagtccatctttaacaaggatttactgtcaacattgcacctgttggtggccttagcaaaacgtttccagcccgatctaagtctgcctaccaatgtgcaagttgaggtaattaccattgagtcaactaaatctggactgaaatccgaaaaacttgtggagcaactgactgaatattctaccgataaggacgagcctccaaaagacgtattcgatgagctgttcaaactagccccggaaaaagtaaacgccgtgaaagaggctatcgtgaacttcgtcaaccagaaactggaccgacttggactgagtgtgcaaaacctagatacgcagtttgctgatggtgtcatcttgctcctgctcatcggccagttagagggcttctttctccatctgaaagagttctacttgacccccaattcaccggcagagatgttacacaacgtgactctggccctcgaattgctgaaggatgagggcttgttgagttgccccgtcagcccagaggatatcgtaaacaaagacgccaagtctaccctccgagtcctttatggtctgttttgtaaacacacccagaaagcgcaccgagacaggacgccgcatggagctcctaattag

SEQ ID NO: 127930 - DNA, 414 bp, Artificial Sequence
  Description of Artificial Sequence: Synthetic coding sequence
atggtgcccgccaaggagcaggttccgggacgctgcgactctacccaacggtgttttccaggcccaagcaactggactggcgcgggcggaagggcggggtctcagccattcgtaggcgacgggaccctgggcactccaaatttctgctgggaccacaaagagaaacgagcagcggagtctcagcttcaggcctgggaagctatggagcctgaattcctgtatgatctcctgcaattgcccaaaggagtggaaccccccgccgaggaggagctgagcaagggggggaagaaaaaatacctgccacctacatccaggaaggaccctaaatttgaagaattgcagaaacacacttggccctcccccgtcaccggaacgggggatacgatctgcggactcgctcgcaagacctggtag

SEQ ID NO: 127931 - DNA, 1083 bp, Artificial Sequence
  Description of Artificial Sequence: Synthetic coding sequence
atggctgcggaacgtggtgcagggcagcaacagtcccaggaaatgatggaggtggacagaagagtggagtccgaagaaagtggggatgaagaagggaaaaaacacagcagtggcatcgtcgccgatttgagtgagcagagccttaaagacggcgaagaaagaggcgaagaagatccagaggaagaacacgagctccccgtcgatatggagactatcaacctggaccgcgacgctgaggacgtggatctgaatcattatcgcattggcaagatcgaagggtttgaagttctcaagaaagtcaagacgctctgtctgcggcagaacctcatcaagtgcatcgagaacctggaggagcttcagtctttgcgagaacttgatctgtacgacaatcagatcaagaagatcgagaacctcgaggctctgacagagctcgagatcttggatattagcttcaatctcttacggaatattgagggcgtggacaaattgaccaggctcaagaagctgttcctcgttaacaataagatctccaaaatcgaaaatctgtcaaacctgcaccagcttcagatgctggagctgggcagcaaccgcattagggccatcgagaatatcgacacactgaccaacttagagtccctatttttgggtaagaataagatcactaagttacagaacttagacgccctcacaaacttgaccgttctgtcaatgcagtccaataggttgaccaagattgagggacttcagaaccttgtcaacctccgcgagctgtacctgagccacaatgggatcgaagtgatcgagggtctggagaacaacaataaattaacaatgctcgacattgcaagtaaccgaatcaaaaaaatcgaaaacatatcgcatctgaccgaactccaggaattttggatgaacgataacctcctcgagtcctggtccgatttagatgagctcaagggcgcccgctctctcgagacagtctaccttgaacgaaacccactgcagaaggaccctcagtatcgccggaaggtgatgttggcattaccaagtgtgcgccagatcgacgcaacatttgtgcgcttttag

SEQ ID NO: 127932 - DNA, 3993 bp, Artificial Sequence
  Description of Artificial Sequence: Synthetic coding sequence
atggaagacggagggctaacagcctttgaggaggatcagaggtgcctgtcccagtctctcccgctgccagtgagcgccgagggcccagcagcccagactacggcagagccaagccgtagcttctcctccgcacacagacacttgtcaaggcgtaatggtttgtcacggttgtgccaaagtagaacagccctttctgaggaccgctggagcagttattgtttgtcgtccctggccgcacagaacatttgcacctctaagctccactgtccggctgctcctgagcacactgatccaagcgaacctagaggatcagtcagttgttgcagcctgttgcgtggccttagttcagggtggtcaagccccctcctacccgcccctgtatgcaacccaaataaagcgatctttaccgtggatgcaaagacaacagagattcttgtcgctaatgataaagcctgcggactgctgggctacagctctcaggatctgattggccaaaagctcacccagttctttctgcggtcagactccgacgtggtggaggccttgtcagaagaacatatggaagctgacggccacgcagccgtggtatttggtacagtggtggatatcatctctcggagtggcgaaaagataccagtctcggtgtggatgaagcgcatgagacaggaacgacggctttgctgtgttgtcgtcctggaacctgtcgagagggtaagcacgtgggtggcattccagagcgacggcacagtcacatcctgcgacagcctgtttgcgcacctccacggttacgtctccggcgaagatgttgccggacaacatatcaccgatcttatcccgagcgtgcagcttccaccatctgggcagcacatcccaaagaatctgaagattcagcgcagcgttgggagggcaagagatggcacaacgttcccactcagtctgaagctcaagtctcagcctagttccgaagaggcgaccaccggtgaggctgcccccgtgagcggctaccgagcaagcgtctgggtattctgcacaatctctggactcatcacccttctgcctgatggcaccatccacgggattaaccactcatttgccctgacattgtttggctacggcaaaacagaactgctgggtaaaaatataacattcctgattcccggattctatagctatatggatctggcttacaattcaagcctgcagttacctgacctggcatcatgccttgatgtagggaatgagtccgggtgcggcgagagaacgttggatccctggcaaggacaagaccctgccgaaggtggccaggatccacgcatcaacgtggtactggctggtggccacgtggttcctagagacgagattcgcaagctcatggaatcccaggacatctttacaggaacacaaaccgagttgatcgcaggtggtcaacttctcagttgcctgagcccacagcctgcaccaggcgtagataatgtgccggaagggagccttccggtgcacggtgaacaggcgctgcccaaggaccaacagatcacagcgctgggtcgcgaagagcccgtggcaattgaatctccaggccaggatttactgggcgagtctaggtccgagcctgtggacgtgaagcctttcgctagctgcgaagactcagaggcacctgtacccgccgaggacggaggtagcgacgcagggatgtgcggcctttgtcaaaaggcccagctcgagcgcatgggggtttcagggccttctgggagtgacctgtgggcgggagcagcggtggccaaacctcaggcaaagggtcaactagcaggtgggtcactccttatgcattgtccctgttatggtagcgagtgggggctctggtggaggtcgcaggatctcgcgccgtctccttccggaatggcaggactgtcatttgggacccccacacttgacgaaccttggctcggggtggagaacgatcgggaggaactgcagacttgcctgatcaaagaacaattatctcaactctctttagccggtgccttggatgtccctcatgctgaactcgtccccacggagtgccaagctgtcaccgctcccgtgtcctcttgtgaccttgggggcagagatctctgcggaggctgtacgggcagctccagtgcctgctatgccctcgccacagacttgcctggaggactggaagccgtagaggctcaggaagtggatgtgaacagtttcagctggaatcttaaggagctgtttttttccgatcagaccgatcaaacatcttcgaattgcagttgcgctacctcagagctgcgagagactccatcatctctggccgtcggaagcgaccccgatgttggttcactgcaagagcaaggcagctgtgtgctagacgatcgtgaactcctcctgttgacaggtacttgcgtggacttaggacaggggagaagatttagggaatcttgcgtgggtcacgatccaaccgaacctctggaggtttgcctggtgtcctcagagcattatgccgccagtgacagagaatcccccggccacgttccttccacactggatgccgggcctgaggacacgtgcccatcagccgaagaaccgcgactgaatgtgcaggtgacttccactcctgtaatcgttatgagaggtgccgcaggactgcagcgggagatccaggagggcgcctacagcggtagctgctaccacagagatggattgcgcctgagcattcaattcgaggtccggcgtgtcgagcttcaggggcccacgccactgttctgctgctggctggtcaaggacctgctgcacagccaacgcgactcagcagctcgtactcgacttttcctggcgtctctacctgggagtacccatagtaccgcggccgagctcacaggccccagtcttgtggaggtactgcgcgcacggccctggtttgaggaaccacccaaagccgtggagctggaggggctggccgcatgcgagggcgaatattcccagaaatacagcactatgagccctctagggtccggagcatttgggtttgtctggaccgcagtggacaaagaaaaaaacaaggaagttgtcgtgaaattcattaaaaaagagaaggttctggaggattgttggatcgaggaccctaagctgggcaaggtaacgctcgagatcgctatcttgtcccgcgtggagcacgcaaacatcattaaggtcttggacatcttcgagaaccagggtttctttcagctggttatggagaaacacggtagtggcctcgatctgtttgcctttatagacagacatccacggctggatgagcccctggcgtcctatatttttagacaagtccgcgcgggacagtctcgattagtatctgcagtaggctacctgaggctgaaagacatcatacaccgggatatcaaggatgagaatatcgtgatcgccgaagatttcactattaagctgattgactttggaagcgctgcctacttagagcggggtaagcttttctacacattttgtgggacgatcgaatattgtgcgccagaggtcttgatgggcaatccctacaggggtcccgaactggagatgtggtccctgggagtcacattatacaccctggtgtttgaagaaaaccccttctgtgagctggaagagaccgtggaggctgctatccatccgccgtacttggtcagtaaggaactgatgagcctggtgtccggcctgttacagcccgtgcccgagcgcaggaccacactggagaagttagtgactgatccctgggtgacgcaaccagtgaatctggccgactacacctgggaggaggtgtttcgcgtgaacaagccagaatctggtgtgctcagcgccgctagcctagagatggggaaccggtcccttagtgatgttgctcaggctcaggaactgtgtggaggacccgttccgggcgaggctcccaatggtcagggctgtttacatcccggggacccgcggttattaacatcttag

SEQ ID NO: 127933 - DNA, 3972 bp, Artificial Sequence
  Description of Artificial Sequence: Synthetic coding sequence
atggaggatggagggttgaccgcctttgaggaagaccaacggtgcctctcacaatctctgccactgcccgttagcgccgaggggcccgctgcgcaaaccaccgctgaacctagcagatccttcagcagtgcccacaggcacctctctcgacggaatggattgagccgcttgtgccagtcacgcacggctctgtcagaggataggtggagctcatattgcttgagttcattagccgctcagaacatatgcacctccaaactccactgtccagcagcccccgagcacaccgaccccagcgaaccaagagggtccgttagctgttgcagtctgctccggggcttgtcttcaggatggagtagcccactgctgcctgcgcccgtgtgtaacccgaataaagccattttcaccgtggacgcgaaaaccactgaaattctcgtggcaaatgacaaggcttgcggcctgctcggatattcaagtcaggatttgattggtcagaaactgactcagttttttctcaggtctgattccgacgtggttgaggcactgtcggaggaacacatggaagcagatggccatgctgcggtcgtctttggcaccgtggtggacattatttccaggagcggtgagaagatccctgtgagtgtgtggatgaagaggatgaggcaagagaggaggctttgttgtgttgtagtgctggagccagttgagagagtctcaacctgggtcgcttttcaaagcgacggaactgttacgtcttgcgattctctgtttgcccacttacatgggtacgtgagtggggaggatgtggctggacagcatataacagacctgatcccaagcgtgcaactcccgccatcggggcaacatatcccaaaaaatttgaaaatccagaggtccgtggggcgagccagagacggtactacattccccctgtccctcaagctcaagtcccagcccagttccgaggaggcaacaacgggcgaagcggcccccgtgagcgggtaccgggcttccgtgtgggtgttttgcacaatctccggccttattacactgctgcctgacggcaccatccatggaatcaaccattcgtttgccctgacactgttcgggtatggaaaaactgagctcctggggaaaaatataacattcttgatacccgggttctactcctacatggatttggcctacaactcctccctgcagctacctgacctggcctcctgcctggacgttggtaatgaaagtgggtgtggtgaaaggaccttggacccatggcaggggcaagatcctgccgagggagggcaagatccaagaatcaatgtggtactggccggagggcacgtagttccaagagacgaaatcaggaagttgatggagtctcaagatatcttcactggaacccagaccgaactcattgcgggcggccaacttctttcttgtttgtctccccagcctgcccccggcgtggataatgtgcccgaagggagcctgccagttcacggggaacaagccttgcccaaggaccagcaaatcacagccctaggcagggaggaaccggtggctatcgaatctcctgggcaggacttactcggtgagagtcgatccgagcccgtcgacgtgaagccatttgcgagctgtgaggacagcgaagcacccgtcccagccgaagacgggggatcggatgccggtatgtgcggcctctgtcagaaagcacagcttgagagaatgggtgtctctggtccctcaggaagcgacctgtgggctggcgctgccgtcgctaagccccaagcaaaggggcagctggccggaggtagccttctcatgcactgtccatgctatgggtccgaatggggtctttggtggagatctcaggatttagcgcctagtcctagtggcatggctggcctctctttcgggactcctacactcgatgaaccttggctgggcgtcgaaaacgacagggaggagcttcaaacttgcctgatcaaagagcagctgtcccaactatccctcgctggcgccctggacgtcccccatgctgaactggtgcccactgagtgccaggctgtgaccgcccctgtgtcctcctgtgacctcggtggtagagacttgtgtggagggtgcaccggcagctctagcgcttgttatgccttggctacagacctgccgggaggtctggaggctgtcgaggcccaggaggtagacgtcaactcgttttcgtggaacctcaaggagctgttctttagtgatcagacagatcagacctcttctaattgttcttgtgctacatccgaactgagagagaccccttccagcctcgccgtgggctctgaccctgacgtgggaagtttgcaggagcagggcagttgtgtcctggacgatagggagctgttgcttctgactgggacctgtgtggatctcggacaaggccgacgttttagggaatcctgcgttgggcacgatcccacagagccgcttgaggtgtgtttggtgtcctcagagcactacgccgcaagtgaccgagagagccctgggcacgtgcctagcacgttagatgcggggcccgaggacacctgcccgtccgcggaagagccgcggctgaacgtccaggttactagcactccggtgattgtgatgcgtggcgcagccgggctccaaagagagatccaggagggtgcctactcaggaagttgctatcaccgcgacgggcttagactatccatccaattcgaggtgcgccgggtggaactgcaaggccccacgcctctcttctgctgctggctagtgaaagacctcctccatagccagcgtgatagcgcagcccgcactagactgtttttggcctccctccccggcagtacccatagcacggccgctgaactcactgggccttcacttgtggaagtgctgcgagcacggccttggtttgaggagcctccaaaagctgtggaattggaggggctggccgcttgtgaaggtgaatattctcagaagtacagtaccatgtcacccctaggctcgggtgcttttggctttgtgtggacggccgtggacaaggagaaaaacaaagaggttgtggtcaaattcataaaaaaggagaaggtcctcgaagattgctggatagaggacccaaaactgggcaaggtgaccctcgaaattgcaatcctgagccgagttgagcacgctaacattattaaggtgctggacatctttgaaaaccagggcttttttcaacttgttatggagaaacatggatctggtttggaccttttcgcttttattgataggcacccgcgcctggatgagcctctggcttcctacatcttccgccagctagtgtcagctgtgggctatctccgtctcaaagatataatccacagggacattaaagacgaaaatatcgtcattgctgaggactttacaatcaagctaatcgacttcggcagcgccgcctatctggagaggggaaaactattctacacattctgcggtaccattgagtattgtgcgccagaggttctgatggggaacccttatcgtgggcccgaactggaaatgtggagcctgggtgtaacgctctacaccctggtgtttgaggagaaccctttctgcgaactagaggaaacagttgaagccgcaattcacccaccttacctggtgtcgaaagaacttatgagccttgtctcaggattgctgcagcccgtccctgaacggagaaccacactcgagaagctcgtgacagacccttgggtgacccaacctgtcaacttagctgattacacatgggaggaggtgttcagggtgaacaagcccgagtcaggagtgctctcagccgcctccctggagatgggaaaccgttcacttagcgacgtggcccaggcgcaggaactctgcgggggccctgtgccaggagaggcacccaatggacagggatgtttacacccgggcgatccacgtctgcttacctcatag

SEQ ID NO: 127934 - DNA, 378 bp, Artificial Sequence
  Description of Artificial Sequence: Synthetic coding sequence
atggaggacggcgggcttactgctttcgaagaagatcagaggtgccttagtcagtctttgccactgcccgtctcagctgaaggaccagccgcccagacaacagccgaacccagtcgctctttttcgagcgctcatagacatctcagtcgtcgcaatggcttatcgaggttgtgccagtcgagaacggcactttccgaggaccggtggagttcttactgcctgtctagcctagctgcccagaacatttgtacatcaaagctgcactgccccgcggcccccgagcatacagacccctccgagcctagaggctctgtgagttgctgcagcctgctgagggggctaagctcaggctggtcatcacctctcctgcctgcgtag

SEQ ID NO: 127935 - DNA, 3324 bp, Artificial Sequence
  Description of Artificial Sequence: Synthetic coding sequence
atgaagcgcatgcgtcaggaacgaagattatgttgtgtggtcgtgcttgaacccgttgagcgggtaagcacctgggtggcctttcagtccgatggcaccgttacttcctgcgattcgctcttcgctcacttacacgggtacgttagcggagaggacgtggctggccaacacattaccgatttgattcccagtgtacagctgccaccctcaggccagcacattcctaagaacttgaaaattcaacgcagtgtggggagagcccgcgatggaactacttttccattgtccctaaagctgaagtcacagcccagtagtgaggaggccactaccggggaagctgcgcccgtctcaggttaccgcgccagcgtttgggtgttttgtacaattagcggactgatcactctgctcccagacggcacaattcacggtatcaatcactcctttgccctgactttgttcggatacggcaaaactgaactgctaggcaagaacataaccttcctgattcccggattttacagctatatggatttggcctataactccagcctgcagctgccagacctcgccagctgtctcgatgtggggaatgagagcggctgtggggagaggacgttggatccatggcaaggacaagatccagccgagggtggtcaggacccacgaatcaacgtggtgctggcaggagggcacgtggtgcctagggacgagatccggaaactgatggagtcccaggacatctttaccggtacgcagacagagcttatagccggaggccaactgttgtcttgtctgtcgccgcagccagcgccaggggtggacaatgttccagaaggcagtctccccgttcatggggaacaagcactgccaaaagaccagcagattacagccctgggaagagaggaaccggttgctatcgagagccctggccaggacctgctgggggagtctcggagtgaacccgtagacgtcaaacctttcgcctcctgtgaggacagcgaggcgccagtccctgcggaggatgggggttccgatgccggcatgtgtggtctctgtcagaaggcccagctggagcggatgggggtgagcggcccatccggatccgatctatgggccggggccgctgtggctaaaccccaagcaaagggacagctggccggtgggagtctgttaatgcattgcccctgctacggctccgagtggggcctgtggtggaggtctcaagaccttgcaccctctcctagcggcatggccgggttaagtttcggaacacccactctggatgaaccctggctgggagtcgagaatgatcgggaggagcttcagacttgcctcatcaaggagcagctgagtcagctgagtctggcaggggcgctcgatgttccgcatgcagagctagtgccgacagaatgtcaggccgttactgctcctgtcagttcttgtgatctcggtgggagagacctgtgcggcggctgcaccgggagtagttccgcgtgttatgcccttgcgacggacctgcctggaggtctggaggccgttgaggcacaagaagtggacgtcaatagtttctcttggaatctcaaggaactgttcttttccgaccaaactgaccaaaccagttctaattgctcttgtgccacatccgagcttagggaaacccccagttcactggcggtcggcagcgatccagacgtgggttcgttacaggaacaagggtcttgtgtgctggacgatagagagttactgctcctgaccgggacttgtgtggacctcggacagggaaggaggtttagggaatcttgcgtggggcatgatcccactgagcctctcgaagtctgtttagtctcttccgagcactacgccgcttccgatagagagtctccgggccacgtaccgagcacgctggacgcaggccctgaggatacttgtccttctgctgaggagcctagactaaacgttcaagtaacttctacaccggtaattgtcatgaggggcgcggcagggttgcaacgtgagatccaagagggagcttatagtggatcctgttaccatagggacgggctccggctgtccatccagttcgaagtaagacgcgtagagctgcaggggcccacacccctcttctgttgttggttggttaaggacctcttacacagccaaagggactcggcagcccgtactcggttgttcctggcaagtttgccgggcagcacccactccaccgctgctgagctgacaggaccatcactcgtggaggtgctgagggcacggccatggtttgaggagccacccaaagccgtcgagctcgagggcctcgccgcttgtgaaggagaatatagtcaaaaatactcaaccatgagtccacttggaagcggtgccttcggttttgtctggaccgctgtcgacaaagagaagaataaggaggtcgtcgtcaagttcatcaagaaagagaaggtgcttgaagactgctggatagaggatcccaaactggggaaagtgacccttgagattgcaattcttagtcgcgtcgagcatgcaaacataataaaggtgctggatatattcgagaaccagggtttttttcagctagtcatggagaaacacggttccggcttggacctgttcgcctttatcgatcgacatccacgactggacgaacccttggcttcatatatcttccgccagctggtatcagctgtggggtatctgagactcaaggatataatccatcgcgacatcaaagacgagaatatagtaattgctgaggacttcaccattaaactaatcgactttggatccgccgcttacctggaacgggggaagctgttttatacattttgcggaactatcgaatattgtgctcccgaggtgctgatgggcaatccatatcgaggaccagagctagaaatgtggtcactcggcgtcacgctgtacacgcttgtgtttgaggagaacccgttctgcgaactggaggagactgtggaggcagcgatccatccaccctatttagtatcaaaggagctgatgtccctagtgagcggcctccttcagcccgtgccagagcgccgtaccactctggagaagctggtgacagatccctgggtgactcagcccgtaaatctagcggattacacttgggaagaagttttcagagtcaacaaacccgaaagcggcgtgctctctgcggccagtttggaaatgggcaataggtccctatcggatgttgctcaggcacaggagctgtgtgggggtcctgtacctggtgaggcacctaatggccagggctgcctccaccctggtgatccacgcttactgacatcctag

SEQ ID NO: 127936 - DNA, 3414 bp, Artificial Sequence
  Description of Artificial Sequence: Synthetic coding sequence
atgggattccccgactccgctcgagccggacaaaggtctttggtggatatcatatcaaggtcaggcgagaagatcccggtgtcggtatggatgaaaaggatgagacaggagcggaggttatgctgcgtggtcgtacttgaacctgtggaaagggtgtccacatgggtggctttccagtctgatggaactgttacaagctgtgatagcctgttcgcacacctgcacggctacgtgtccggtgaagatgtggcaggtcaacatatcactgatttgataccttctgttcagctgccacccagcggccagcatattcctaagaatttgaagatacaaaggagcgtgggccgagctcgtgatggaaccactttccctctttccctgaagctcaagagtcagccctcctcggaagaggccacaacaggcgaggctgccccagtgagcgggtatagggccagcgtatgggtcttttgcacaatctcaggcctgatcaccctgctacctgacggcaccatccacggaatcaatcacagcttcgcgttaacccttttcggatatggtaaaacggaacttcttggaaaaaatataaccttcctgattcctggtttctactcctatatggacttagcttataacagcagcctgcagttgccagatctagccagttgtctggatgtagggaacgagtctggctgcggggaacgcaccttggacccatggcaagggcaagacccggccgaggggggccaggaccccaggattaacgttgtactcgcgggtggtcacgtagtcccacgcgatgaaatccggaaattaatggagtcccaagacatctttaccggcactcaaacagaactcattgccgggggacagctgctcagctgtcttagtccccagccagcacccggagtcgacaatgtgcccgaaggatcccttcccgttcatggagagcaggcactccccaaggaccagcagataacagcactcggaagagaagagccggtggccatcgagtcacccggacaagatctactgggcgagtccagatccgaacccgtggacgtgaagccctttgctagctgcgaagactccgaagctccggtacccgccgaagacggagggagcgatgcgggaatgtgtgggctgtgccagaaggctcagctggagagaatgggtgtgtcaggacccagcggcagtgacctctgggccggtgcagctgtggccaagccccaggccaaggggcaattggctggtggctccctgctgatgcattgtccctgctatggatcagaatgggggttgtggtggcgctcccaggatctcgccccctcaccaagtgggatggcaggactttctttcggcacccccaccttggatgaaccgtggctcggcgtggaaaatgacagagaagaactgcagacgtgtttaattaaagagcaattatcacagttatcactggctggggctctcgatgtaccccacgcagaattagttcctacagagtgccaggccgtgaccgctcccgtgagcagctgcgacctcgggggacgtgacctgtgcggcggttgcactggatcaagctcggcgtgctatgccctggccaccgatctgccgggcggattggaggcagtggaagctcaagaggtggatgtgaatagtttttcttggaatctgaaggagctattcttttctgaccagacagaccagactagttccaactgttcatgcgccacaagcgagctgcgggagactccgagttccttagcagtggggagcgatccagacgtgggtagcctgcaggagcagggatcttgcgtgcttgatgacagggagctgttgcttttaaccggaacttgtgttgatctgggtcagggccggcgattccgagaatcttgcgtgggacatgatcctaccgagccccttgaagtttgtctggtgtcctctgagcattacgctgcctctgaccgcgagtctcctggccatgtccctagcacgttggacgccggaccagaggacacttgccccagtgctgaggaacctcgacttaacgtccaagtcacatcgactcccgtcatcgttatgcggggggccgccgggctgcagagagagattcaagaaggtgcatattccggctcctgctaccacagggatggactgaggctaagcatccaatttgaggtgagacgcgtcgagttgcaagggcctacccctctgttttgctgctggctggtcaaggatttgctacacagccagagagatagtgctgctagaacaagactttttcttgcctcccttccagggtccacacactccaccgctgccgagcttaccgggcccagcctggtggaagtcctgagagcccgcccgtggtttgaggaaccacccaaggccgtcgagttggagggcctcgctgcctgcgagggcgagtacagtcaaaagtactctacgatgagcccactgggaagcggagcttttggctttgtgtggaccgcagtagacaaagagaagaataaggaggttgttgttaaattcatcaagaaggagaaagtcctggaggactgttggatagaagaccccaagttggggaaggtaaccttggagatcgcaatcctcagtagagttgagcatgctaatatcatcaaagtgctggatatctttgagaaccaggggttttttcagctggtcatggagaaacatggctccggccttgacctattcgcctttattgatagacatccacgcttagatgaacccctcgccagttatatttttaggcagctcgtcagcgccgtagggtatctgcggctcaaggatatcatacatagggatatcaaggatgagaacatcgttatcgcagaggactttactattaagttgatcgattttggttctgccgcctacctcgaaagggggaaactattttacactttctgtggcacgatcgaatattgcgcccctgaggtcctgatgggcaacccttatcgcgggccggagttggaaatgtggagtttgggtgtcaccctgtatactctggtcttcgaggagaacccattctgcgagctcgaggagaccgtagaggcagccatccacccaccctacctcgtgtccaaggagctgatgtcgcttgtctccggcctgctacaacccgtaccggagaggaggacaactctggagaagcttgtcacagacccttgggtcactcaacctgttaatctggccgattatacgtgggaggaggtgtttcgagttaacaaacccgaaagtggagtgctgtccgccgcgtccctggaaatggggaacaggtctctcagcgatgttgcccaggcgcaggaactgtgcgggggcccagtgccgggcgaggcacctaacgggcagggttgtctgcaccccggggaccctcgcctcctgacctcctag

SEQ ID NO: 127937 - DNA, 3432 bp, Artificial Sequence
  Description of Artificial Sequence: Synthetic coding sequence
atggaagatggcggcttgaccgcctttgaggaggatcagaggtgtctgagtcaatctctgccactgccagttagtgctgaaggcccagcggcacagaccaccgcagagccatcccggtcgttctcctcggcccatcgccacctgtcccggcggaacggtctcagcagactgtgccagtctcgaacagctctgtctgaagataggtggtcgtcctactgcctatctagcttagccgctcagaatatctgcacctcaaagctccactgccccgcagcaccagagcacacagacccctcagaacccagggggagcgtgtcctgctgctccctcttacgcggattgtccagcggatggtcctcccctttactgccagcccctgtgtgcaatcccaataaggcgatattcactgtcgatgcaaaaacaaccgaaatacttgtggcaaatgataaggcatgcggattattaggctactcctcacaggatctcatcgggcagaaactgacccaattcttcctgaggagcgattccgatgtggttgaagccttaagtgaggaacatatggaggccgatgggcacgctgccgtggtattcgggaccgtagttgacatcatctcccggagcggtgagaagataccagtgtcagtttggatgaagcgaatgagacaggagcgccgactctgctgcgtcgtggtgttggagccagtggaaagagtgagcacctgggttgcattccagtcagatggaactgtcacttcttgcgactctctttttgctcaccttcatggatatgtgagcggagaggatgtggccggccagcatatcactgacttgattccgagtgttcaactgccaccaagcggtcaacatattccgaaaaatcttaaaatccaaagatccgtcggccgcgcaagggatggcaccacatttcctttaagtttgaagttaaagtcccagccatcaagcgaggaggctacaactggggaggccgcccccgtctccggataccgagccagtgtgtgggtgttttgtaccatttctggcctgattacgctcctgcctgatggcactattcatgggataaaccattcattcgccctgactttattcggatatggcaagacagagctactgggcaaaaacatcaccttcttaatccccggtttctactcatacatggatctggcatacaacagtagcctacaactccctgacttggcttcttgccttgacgtgggcaatgagtctggctgtggagagcggacactcgacccttggcaaggacaggacccggccgaaggcgggcaagacccacgcattaatgtggtgctggcaggcggtcacgtggtgccaagagacgaaattcgtaagctcatggagagccaagacatttttaccggaacacagacagaacttatagccggaggccagctcctctcttgcttgtcacctcaaccagctcccggtgttgacaacgtccccgaggggtcgctacctgtgcatggggagcaagcactgccgaaggaccaacaaattactgccctaggacgggaagagcctgtggccatcgagtcacccggtcaggatctgctgggggagagcaggagtgaaccagtggatgtgaagccgttcgcgtcctgtgaagacagtgaagcccctgttccggccgaggacggcggatcagacgccgggatgtgcggtctctgccagaaagcccaactggaacgcatgggggtgtcgggaccatcaggctccgacctgtgggccggggccgccgtggctaagcctcaggccaagggacaactggcaggcggtagtcttctgatgcattgcccctgttatggctcagaatggggactgtggtggcgctcacaggacttggccccatcacctagtggaatggctggactgagctttggtactcctaccctcgacgagccctggctaggcgtcgaaaacgatcgagaggagctccaaacttgccttattaaagaacagttaagtcagctgtcactcgcaggcgctctggatgtgcctcacgccgagctcgttcccaccgaatgccaggctgtaacagcacccgtctcttcatgcgacctgggtggtagggacctgtgcggcgggtgcaccgggtcctctagtgcctgttatgccctggccaccgaccttcctggcggcctggaggccgtggaggcccaggaggtggatgtgaattctttcagctggaatctcaaggagctgttcttttctgatcagaccgaccaaaccagcagtaactgttcgtgtgccacatctgagctcagagagactccaagttcactcgccgttggctccgatccggatgttggaagccttcaagagcaggggagctgcgttctcgatgaccgcgagctcctgcttttgacaggaacctgtgtggatctcggccaggggaggaggtttcgagagagttgtgtgggccacgatccgacagaaccactggaagtttgtcttgtttcatcagaacactacgccgcctctgatcgagagtccccggggcacgtccccagcacgctggacgccggcccagaagacacctgcccctcagcagaagagccccgactcaacgtacaagtgacctcaacgccagtgatagtgatgcgaggcgctgccggcctgcaaagagaaatccaagagggggcctattccggatcgtgctaccatagagacggtctgcgcctcagtattcagttcgaggtgcggagggtggagttgcaggggccaacaccactgttttgttgctggttagtgaaggacctactgcactctcaaagggactctgccgcacgtacgcggcttttcttagcatctttgcctggctcaacacactcaaccgcggccgaactgactggtccgagtctggtggaggtgctccgcgcccggccatggttcgaggaacctcctaaggcagtcgagctggagggcctggctgcttgtgaaggcgagtatagccagaagtactcgacaatgtcaccactaggatcaggcgccttcggatttgtctggacggccgtcgacaaggagaagaataaggaagtggtagtgaagtttatcaaaaaggagaaggtgctggaggactgctggatagaggatcctaagcttggaaaagtgaccctggagattgcgattctcagcagagtcgagcacgccaatattataaaagttctggacattttcgaaaatcaaggcttctttcagttggtgatggagaagcacggttcagggcttgacctatttgccttcatcgatagacatcctagattggatgagcctttggctagctacattttcagacaggtgcgcgcaggccagagccgggtgtctgtaaacgccggcctgggagcttgggtgcggtggctgcaacgcagcgtcattcatacgcgtttcagtctgtag

SEQ ID NO: 127938 - DNA, 1314 bp, Artificial Sequence
  Description of Artificial Sequence: Synthetic coding sequence
atggtgcagatgatgcgtcagtttctttacagggttttgcctgaagacagttacaaggtaacgacaggaaagttgcacgtcagtcttactcgcctgacagatggtgagaacgtagttgtgtccgagtttacaagtaaagaagagttgattgaagctctgtattgctcctgcttcgtacccgtgtactgcggtctaataccgcctacatacaggggcgtccgctacatagatggaggcttcaccggaatgcagccctgcgcattctggactgacgccatcacgatatccactttctctggtcagcaggacatttgccctagggactgccccgccattttccacgattttcgaatgtttaattgttcttttcagttctctttggagaacatagctaggatgacccacgcactctttcccccagatctcgtgatcttgcacgattattattatcggggctatgaagatgcggtcctttatctgagaaggctgaatgctgtgtatttaaatagctcttccaaaagggtcatatttccaagagtggaggtttactgtcaaatagagctcgcgcttgggaatgaatgccccgagaggagccagccaagcctgagagctaggcaggctagccttgaaggcgccactcagccccacaaagagtgggtgcccaaaggcgacgggagagggtcgcacggccccccggtttcccagcccgtgcagacactggagttcacctgtgagagccccgtgagcgctccagtgagccccctggagcagccaccagcacagcctcttgctagttcaactcccctttccctgtcaggtatgccacccgtgagctttcccgcagtgcacaaaccccctagcagtacaccagggtcaagcctgccaacaccaccccccggcttatcgccgctgagtcctcaacagcaggtccagccttccggaagtccggcgagaagccttcatagccaggcccctacttctcctagaccatcactgggccccagcactgtcggggcaccgcagactctaccccgaagctcactttcagctttccccgcacagcccccggttgaagaattaggtcaagagcagcctcaggccgtggccctgttggtgtcttccaagcccaaatcagcagtgcctcttgtgcacgtcaaggagacggtgagcaagccctacgtgacagaaagccccgcagaggattcgaattgggtgaataaggtcttcaagaagaataaacagaagacgagtgggacgcggaaaggctttcccaggcactcaggtagcaaaaagccttcgagcaaggttcagtag

SEQ ID NO: 127939 - DNA, 1599 bp, Artificial Sequence
  Description of Artificial Sequence: Synthetic coding sequence
atggaggaacaagtgtttaaaggtgatcccgacaccccacactcgatctctttcagcgggtcaggattcctgtctttctaccaggctggcgccgtcgacgccctgagggacctcgctccaagaatgttagagacagcccatcgatttgcagggacaagcgcaggtgccgtgatagccgctttggctatctgcggaattgagatggatgagtaccttcgcgttctgaatgtgggggtggccgaagtaaaaaagtcttttttgggtcctctaagcccctcctgtaaaatggtgcagatgatgaggcaattcttgtatcgcgtgctccccgaggattcatacaaagtcacaactggcaaactgcacgtgtcactcacacgcttaacagacggcgaaaacgtcgtggtgtcagagttcaccagcaaggaagaattaattgaggcattgtattgcagctgttttgtgccagtatactgtgggttgattccgccaacttaccgtggtgtcagatacattgacgggggatttaccgggatgcagccctgtgcgttctggactgatgccatcaccatatcaaccttctcagggcagcaagatatttgccctcgggactgccctgccatcttccacgatttcagaatgttcaattgtagctttcaattctctttggagaacattgctcgcatgacgcatgcactattcccgccagatctggttatcttgcacgactattactaccgcgggtacgaagacgccgtgctgtatctgaggcgtctgaatgcagtctacctgaacagtagttccaagcgtgtgatttttccccgagttgaggtctattgccagattgaactggctcttgggaacgagtgccccgaaagatcgcagcctagcctgcgggctcgccaggcctcacttgagggcgccactcagcctcacaaagaatgggtccctaagggggatgggcgcgggtcccacggtcctcctgtgtcccagcctgtgcagaccttagaattcacgtgtgagtccccagtaagcgccccagtctctcctctggaacaaccccccgcccagccactggccagtagcacaccgctgtccctgtccggcatgccccccgtgtcgtttcccgcagtacataaacctcctagcagcactcctggctcctccctccccactcctccgcccgggctatcgcctctgagcccccagcagcaggtccagcccagtggctcccctgcaaggagcctgcattctcaggcgcccacatccccgcggcccagcctgggaccatctaccgtgggggcacctcagaccctgcctcgcagctccttgtcagcttttcccgcacagcccccagtggaagagctgggccaggagcagccacaggctgtggcgcttctggtgagtagcaagcccaaatccgccgtaccactagtgcatgtcaaggagacagtatccaaaccttatgtgactgagagtcctgccgaggactccaattgggtgaacaaagtgttcaagaaaaataagcagaaaacctccggtacgagaaagggcttccctcggcacagcggctctaaaaaaccatcatccaaagtccagtag

SEQ ID NO: 127940 - DNA, 1602 bp, Artificial Sequence
  Description of Artificial Sequence: Synthetic coding sequence
atggaggagcaggtttttaagggcgatcctgatacccctcattctatctctttttctggcagtggtttcttgtctttctaccaggccggtgccgttgacgccctcagggatcttgctccccggatgctggagacggctcataggttcgcaggaaccagtgcgggtgcggtaatcgccgctctcgctatatgtgggatcgagatggacgaatatctccgcgtcctcaacgtgggagtcgctgaggttaaaaaaagcttccttggcccactctcccccagctgtaagatggtgcaaatgatgagacaatttctgtaccgagtgctgcccgaggactcttataaggttaccacaggcaagctccatgtgagtctcaccagactcacggacggtgaaaatgtagtcgtctcagagttcaccagcaaagaggagctgattgaggctgccttgtactgcagctgtttcgtccccgtatattgcggattgattccccccacataccggggggtccggtatatcgatggcggctttaccggcatgcagccctgcgctttttggacagatgccattaccatcagtaccttcagtggacagcaggacatctgtcctagggattgtcccgccatatttcacgactttcgaatgttcaactgcagttttcagttcagcctggaaaacattgcccgcatgacacacgccttgttccccccagatctggtcatcttacacgactattactacaggggatacgaagacgctgtgctgtacctgcggcgtttaaacgccgtctacctgaactcttccagcaagcgagtcattttccctagggtcgaggtctactgtcagatcgaacttgcattgggaaatgaatgccctgagcggtcacagccttccctgcgggcacgacaagcgtccctcgaaggcgccacacagccgcacaaagaatgggttccaaagggagacggtagaggctctcatggaccaccagtttctcagcctgtccaaacattagaatttacttgcgaatcacctgtttcggctccagtttcccccctggagcaaccccctgctcagcccttagcttccagcactcccctgagcttgtcaggaatgccaccggttagcttccctgccgtgcacaagcccccaagttcaaccccaggcagctccctgcctactcctccaccgggactttctcctctgtctccccaacaacaggtgcagcctagcggttccccagcccgctccttgcattcccaagctccaacatctccaagaccatctctgggcccaagcactgtcggcgccccacaaactctgcccaggtcaagcctcagcgcctttccggcccagcctcctgtcgaagagcttgggcaggagcagccacaggccgtggctctgctggtgtcatccaaaccaaaaagtgctgttccgctggttcacgtaaaagagactgtctcgaagccctacgtgactgaaagccctgcggaagacagtaattgggtaaataaggtgtttaagaagaacaagcaaaagacttcaggaactaggaagggtttcccaagacactctggttcaaagaagccgtcttcaaaggtacaatag

SEQ ID NO: 127941 - DNA, 1341 bp, Artificial Sequence
  Description of Artificial Sequence: Synthetic coding sequence
atggtccaaatgatgcgccagttcctttacagggtgctaccagaggattcttataaggtgacaacaggaaagctccatgtatccttgaccaggctgacagatggtgaaaacgttgtggtgtctgagttcacatccaaggaagagctgattgaggccctgtactgctcctgcttcgttccagtgtattgtggacttatccctcctacctaccgcggagtatgggcctttctcaccttaccgccacagaggtatattgatggcgggtttaccgggatgcagccgtgtgcattctggactgacgctatcacaatatcaacattttccggtcagcaggatatctgtcccagagattgcccagcgatattccatgattttaggatgttcaactgttcctttcagtttagcctcgaaaacattgcgcggatgactcatgcactcttcccaccggacctggtgatactacacgactattactatagaggctatgaagacgccgtcctgtacctccggcgcctgaatgctgtctacctcaattcaagcagtaaaagggttattttcccaagggttgaggtgtactgccaaattgaacttgccttaggcaacgaatgccccgagcggagccagccttcactgcgagcgagacaggcatccttggaaggagccacccaaccgcacaaggaatgggtgccgaaaggagatggccggggatctcacggacctccggtctcccagcccgttcagacactcgagtttacctgcgaatcccccgtctccgctcctgtgtcgcccctcgagcaaccgccagcacagcctcttgcgtcttctacccccctatcattgtcaggtatgccgcccgtgtctttccccgccgtgcataaaccaccatcgagcacccctggatcaagtttaccgacccctccgccgggcctgtctccgctttcaccgcagcagcaggtccagccctcaggcagtccagccaggagtctccatagccaggcgcctacttctcctaggccaagtctgggcccttctactgtcggggcccctcagacgcttccaaggagttcgctgtctgcctttcccgctcagccgccagtggaggagctaggccaagagcaaccccaggccgtcgcattgttagtgagtagtaaacccaagtcagccgtgccactggtgcatgttaaggaaaccgtgtctaaaccatatgtcacagaatctcccgccgaagactcaaactgggttaacaaggtgttcaagaagaataagcagaaaacatcagggaccagaaaaggctttccacgccatagtggttcgaagaaaccatcgtccaaggttcagtag

SEQ ID NO: 127942 - DNA, 1515 bp, Artificial Sequence
  Description of Artificial Sequence: Synthetic coding sequence
atgttccctcgagagaaaacctggaatatcagcttcgccgggtgcggatttctcggagtttactacgtgggagtggcttcatgtctaagagagcacgcacccttcttggttgcgaatgctactcatatctacggcgcatctgcaggagcactgacggcaacagccctggtgacaggagtgtgtctgggagaagccggagctaaattcatcgaagtgagtaaggaggccaggaaacgatttctcgggcctctgcatcctagctttaacctggtgaagatcatacgaagctttctgctcaaggtgctccctgctgacagccatgagcatgccagcggcaggctgggaattagcctgacacgcgtatccgatggggagaacgtgatcattagccactttaatagtaaagatgaactgatccaagcaaacgtgtgtagtggctttatccctgtgtattgtggactcatccctccctccctgcaaggtgttaggtacgtggacggaggaatttcagataacctcccattatatgaattaaagaacactatcacagtgtcccccttttctggcgaatcagatatctgtccccaggacagctccacgaacattcacgagctgcgtgttaccaatacttctattcagtttaacctgcgcaacctgtaccgtctgagtaaggccttgtttcccccggaacctctcgtacttcgggagatgtgtaagcagggataccgcgacggtctacgttttctccagcggaacgggttgctcaaccggcccaaccctctgctcgccctgccccccgcgcgtcctcacggccccgaagataaagaccaagccgtggagagcgcccaggctgaggattattcccagctgcctggcgaagatcatatccttgagcacctgccagctagactaaatgaggccctgctcgaagcttgcgtagaacctaccgacctgctgaccacactgagtaatatgctcccggtgaggctcgcaaccgccatgatggtgccttatactctcccacttgagagtgccctaagctttacaattcggctgctggagtggcttcccgatgtgccagaagacatccgctggatgaaggagcaaaccggctcaatctgtcagtacctggtgatgagagcgaagaggaaacttggccgccacctgccctcacgcctgccagagcaggtggagctaagaagggtgcagtctcttccctctgtacccctgagttgtgctgcatacagggaagctttgcctggctggatgcgaaacaacctctcactgggcgatgctctggccaaatgggaggaatgccaaagacagcttttactcggcctgttttgcacgaacgtagccttccctccggaagctctcaggatgcgtgctccggccgacccagccccagctcctgccgaccccgccagcccacagcaccagcttgccggccccgctcctctactgtccacacccgcccctgaggccagacccgtgatcggtgccctcggcctatag

SEQ ID NO: 127943 - DNA, 1290 bp, Artificial Sequence
  Description of Artificial Sequence: Synthetic coding sequence
atggggtttctggaggaagagggtcgttggaacttaagctttagcggagccgggtacttgggagcccaccatgtgggcgccaccgaatgcttacgtcagcgggccccgagactgcttcagggagccaggagaatctatgggtcttccagcggcgcactcaacgctgtgtcaattgtttgtggcaaaagcgtcgacttctgctgttctcatctgctcggcatggtgggacagctggagcgcctcagtctatccattttgcaccctgcctacgccccaatcgagcacgtgaaacagcagctgcaggacgcccttcctccagatgcccatgttctggcgtctcagcgcctggggattagtctgacccggtggccagatggcaggaacttcttggtcaccgactttgctacctgtgacgagctgattcaagccctagtgtgtaccctatactttcctttctattgtggtttgatccctcccgagtttcgcggcgagaggtatatcgacggcgccctgtctaacaatcttccttttgctgattgcccgtccacaatcaccgtgtctccctttcatggcaccgtggatatttgtcctcaaagtacttccccaaacttgcatgagctcaacgtgttcaacttcagcttccagatctctaccgaaaatttctttctgggcttgatttgtctgatccccccctctctcgaagtcgtggctgataactgccgacagggataccttgatgcgctccgcttcctcgaaagaaggggtttgactaaggaacctgtactgtggactctcgtcagcaaggagccacctgcacctgccgatgggaactgggacgcaggttgtgaccaaagatggaaggggggcctgtccctgaattggaaggtgcctcatgtgcaggtcaaggacgtccctaattttgaacaactgtcgccggagctcgaagcagcgctcaagaaagcttgcacacgggatccgtctcgttgggcacgtttctggcacagcgggcctgggcaggttctgacgtacctcctgctaccctgtaccttgccttttgagtatatttacttcagatcccggaggctggtggtgtggttgccagacgttcctgcggatctttggtggatgcagggccttctccgaaatatggctctagaagtgttctcacggaccaaggcccagctcctgggacccatttcaccccctgcaacacgcgttctggagactagtcctctgcaaccgcagattgccccgcaccgcgaggagctgggccctactcatcaagcgtag

SEQ ID NO: 127944 - DNA, 1515 bp, Artificial Sequence
  Description of Artificial Sequence: Synthetic coding sequence
atggcagcccagagacgatctctcttacagtctgagcaacagccgtcatggaccgacgacctgcccctctgccacttgagcggagtgggttctgcatccaacagatcgtacagtgctgatggtaaggggaccgaaagccaccctcccgaagattcatggctgaaattccggtcagaaaacaattgcttcctctacggcgtatttaacggatatgacggtaacagggtcacgaatttcgtggcccagcggctctctgcagagttgttgcttgggcagttaaatgcggaacatgcggaagccgatgttcgaagggtactgcttcaagcattcgatgtcgttgaacgctccttcctggagagtattgacgacgccctcgcagagaaagccagcttgcagtcccagctgccggagggcgtcccccagcatcagctgccaccacaatatcaaaagatcttagagcggctgaagacacttgagcgggaaatctcaggcggagcaatggccgttgtagccgtcctgctaaataacaagctgtatgtcgctaatgtaggcacgaatcgcgctctgttgtgcaagagcacagtggacggattgcaggtgactcagttgaatgttgatcacaccaccgaaaacgaggacgaactgttcaggctatcgcaactcggccttgacgcaggaaagatcaagcaagttggaataatctgcggccaggagtcgacacgtcgcatcggagattacaaggtgaagtacggctatactgacattgacctgttgagcgcagcaaaatctaagcctatcatagccgaacctgaaattcatggcgctcaacccttagacggcgtgaccggattcctggtcctaatgtccgaaggcctctacaaagccttggaggccgcccacggacccggccaagctaatcaggagatagccgctatgattgacacggagtttgccaaacagacctcattggacgccgtcgctcaggccgttgttgacagagttaagagaatccattctgatacctttgcctcgggcggcgaacgggcacgcttctgtcccagacacgaagacatgaccctgctcgttcgcaactttggatacccgctaggggagatgtctcaacccactcctagcccagcgcccgcagcggggggacgcgtttacccagtaagcgtgccctacagctctgctcagagcacctctaaaacaagcgtaacgctttccctcgtcatgccatcacagggacagatggtcaatggagcccactccgccagcaccttggatgaggctaccccgacattgacaaatcagtcacccactctaaccttgcagtcaacaaacacacatactcagtcctcctcatcctcctctgatggcggactgttccgttccaggcctgcccactccctgccccccggcgaagacggacgtgtggagccctacgtcgattttgcggagttttaccggctctggtccgtggaccacggagagcagagtgtcgttactgcgccctag

SEQ ID NO: 127945 - DNA, 948 bp, Artificial Sequence
  Description of Artificial Sequence: Synthetic coding sequence
atggggtttctggaggaagagggcaggtggaatctctccttctcaggggctgggtacctgggtgctcaccatgttggggctaccgagtgcctccggcaaagggcacctagactcctccagggggcgaggaggatttacggaagcagttcgggtgccttgaacgccgtgtccatagtgtgcggaaagtcggtggattgcccaagtaccataacagtgagtccttttcacggcaccgtggatatctgtcctcagagcacctcaccaaacctgcacgagctgaacgtattcaacttctcattccagatctcaaccgaaaatttcttcctggggctgatttgtcttattcccccgagcctggaagtggtcgcagataattgtcggcagggctatctggatgctttaaggtttttggagcgtagagggttaacaaaagagcctgttctgtggactctcgtgtccaaggagcctccggcgccagcagatgggaattgggacgccggctgcgaccagcgctggaaggggggcctgtctctgaactggaaggtgccgcacgtccaggtgaaggatgtgcccaactttgaacaactctctccagagctcgaagcagcactcaagaaagcatgtactagagatccctcaaggtgggctaggttttggcactcgggtcctggccaggttctcacatatctgctactcccgtgtactctcccatttgagtacatctactttcggtcaaggaggctcgtagtgtggctgcctgatgtgcctgctgacctttggtggatgcagggactactgcgcaacatggccctagaagtgttctctaggacaaaggcacagttactaggtcccatcagcccacctgctacccgcgtcctcgaaaccagccccctccagccacagattgcccctcacagggaggagcttgggcctacccaccaggcttag

SEQ ID NO: 127946 - DNA, 807 bp, Artificial Sequence
  Description of Artificial Sequence: Synthetic coding sequence
atgggctttcttgaggaagagggcaggtggaacctaagtttctccggggccggctatttgggagcccaccatgtgggtgccaccgagtgtctgcgtcagagggcaccccggctccttcaaggcgctagaaggatttacggcagcagcagtggtgcactgaatgctgtctctatagtatgcggcaagtcggtggatttctgttgctcccacctcctgggcatggtcggtcagttggaacggctgtcactcagcatactccatcctgcttacgcccccatcgaacacgtaaaacagcagctccaggatgccctgccgccggacgcgcacgtcctggctagtcagcggttgggtatatccctgactagatggcccgacggtaggaactttttagttactgattttgcaacctgtgacgaactcatacaagtagttgcagataactgtagacaggggtacctagacgccttgcgctttcttgagcgccgaggactcacaaaggagcctgttttgtggactctggtgtctaaagaaccaccagccccggccgacggcaactgggacgccggttgtgatcaacgctggaaagggggcctgagcctaaattggaaggtgccacacgtgcaggtcaaagacgtcccaaactttgaacagcttagtcccgaactcgaggccgcattgaagaaggcatgtacgcgggatccaagcagatgggctcgattttggcatagtgggcccgggcaggtccttacctacctgttgctgccctgcacactgccctttgagtatatctacttcagaagcagatag

SEQ ID NO: 127947 - DNA, 948 bp, Artificial Sequence
  Description of Artificial Sequence: Synthetic coding sequence
atgggttttctcgaggaggagggaagatggaatctgtcttttagcggggccgggtatctaggcgcccaccacgtcggggcgactgagtgcctgcgacagcgagcccctcggctgcttcaaggcgcccggagaatttacgggagcagtagcggggctcttaacgccgtgtccattgtatgtggcaagtcagtagactgtccttccacaataacagtgtcgccattccacgggacggtggacatatgtccccagtcaacctctccaaatctgcacgaactgaatgtcttcaattttagcttccaaatcagcacagagaacttcttcctcggccttatatgcctaatccctccgtcactggaggtggtggcagacaattgtcggcagggatatctggatgctctcagattcctggagaggagagggttgaccaaggagccagtcttgtggaccctcgttagcaaggaaccaccggctcctgctgacgggaactgggatgcagggtgtgatcagaggtggaagggaggcctctctctgaattggaaagtgccgcacgtacaagtcaaggacgttcccaatttcgagcaactcagcccagaactcgaggccgctctaaaaaaagcttgcactcgtgacccatcccgctgggctagattctggcatagtggccccgggcaagtgctgacctacctgctgttgccatgcacgctcccattcgagtacatttacttccgctcgcggcggttagtggtgtggctccctgatgtcccagcagatctgtggtggatgcagggcctgctgcgtaacatggccctggaagtgttttctcgcacgaaagcccagttgttggggccgatttcaccgccagctaccagagtgctggagactagccctcttcaaccacaaattgcacctcaccgcgaggagttgggcccaacacatcaggcctag

SEQ ID NO: 127948 - DNA, 708 bp, Artificial Sequence
  Description of Artificial Sequence: Synthetic coding sequence
atggaagaagagacccacacagacgcaaagatccgcgccgagaacggcacaggatcttctcctcgcggacctgggtgtagtttgcgccatttcgcgtgcgagcagaacctgttatcgcgtccagatgggtctgccagcttcttgcaaggggatacctccgttctcgccggtgtgtacggcccggccgaggtaaaggtgtcgaaagagatatttaacaaagcaacgttggaagttatactgagacccaagattggcctgccaggggtcgcagagaagtcacgcgaacgattgatccggaatacatgcgaggccgtggtgctgggaaccctgcaccctaggacaagcattacggtagtgctccaggtcgtctcagacgcagggagcttactagcatgctgtctaaatgctgcctgcatggccctcgtggacgccggggtcccaatgagggccctcttctgtggagtggcatgcgccctggacagtgatggtaccctggtgctcgaccccacttcaaagcaggaaaaagaggcgcgcgccgtcctgacctttgcgctcgattccgtggagcgcaagctgctgatgtccagcactaagggcctatactcagacactgagctccagcagtgcctggcagcggcacaagccgcaagtcagcacgtctttagattttatcgagagtcacttcagagacggtatagtaagagttag

SEQ ID NO: 127949 - DNA, 4128 bp, Artificial Sequence
  Description of Artificial Sequence: Synthetic coding sequence
atggaagcgcccctccagacgggcatgatgggcaccagctcacacggattggccacgaacagcagcggagccaaggtggccgaacgagacggcttccaagacgtcctcgcacccggagagggcagcgcaggccgtatatgcggagctcagccagtgccttttgtgccacaggtgttaggtgttatgataggcgccggcgtggctgtggtcgtcactgcagttctaattctgctggtggttcgccgccttcgcgttcccaagactccagcaccagacggtcctaggtatcggttccggaagagagacaaagtgcttttttatggaaggaagattatgcgaaaagtgtcgcaatccacctccagcctggtggacacaagtgtctccgcaacatcacgtccaagaatgcgtaaaaagttgaagatgttaaatatcgcgaagaagatactgcgcatacagaaggaaacacccaccttgcaaagaaaagagcccccacccgctgtgttagaggccgatcttaccgagggcgatctggccaactctcatctcccctctgaggtgctgtacatgctgaaaaacgttcgggtactcgggcatttcgagaagcctctgttcctagagctgtgccggcacatggttttccagcgcttgggccaaggcgattacgtctttagacctggtcagcccgacgcatccatttacgtggtgcaggacgggttactagaactgtgcctccctggccctgacgggaaagaatgtgttgtcaaggaggtagtgcctggggactcagttaactcgcttctttccatcctggatgtgattacaggacaccaacacccacagcgcactgttagcgctagggctgccagagatagtaccgtactgcggctgcccgtggaggcattcagcgccgtcttcaccaagtaccctgagtccttggtgcgggtcgtgcagattatcatggtgcgcctacagcgggtcacattcttggctctgcacaattatctaggactaactaacgaactgttttcacatgagatccagcccctgagactgtttccttcaccaggactgcccacccgcacatctcccgtgcgaggttcaaagcgcatggtcagcaccagcgcgacagatgaacccagagaaacccccggaagacctcccgatcctaccggcgcgcctcttccaggaccgaccggggatccagtcaaacccacttccctggaaaccccctccgcccctctgctatcaaggtgtgtcagcatgcctggcgacatttcagggctccagggtggcccccgctctgattttgatatggcctacgaacgggggcgaataagtgtctcgctacaagaggaggcgtcaggagggagcctggccgctccagccaggacgcccacccaagagccccgggagcagcccgccggcgcctgtgaatatagttattgtgaagatgagtctgcaacaggaggctgcccttttggtccttatcagggaagacagaccagctctattttcgaggctgctaaacaggaactcgccaaactgatgcgcatagaagacccttcgctccttaatagcagggtgcttctgcaccatgcaaaggccgggactatcatcgccaggcaaggtgatcaggatgtcagtttacacttcgtattgtggggatgtctgcacgtgtatcaacggatgattgataaagccgaggacgtgtgcctatttgttgctcaaccgggcgaacttgttggacaactcgctgtgcttaccggagagcctctaatattcaccctgagggcccagcgggattgtacttttctgagaattagtaaatccgacttctacgagatcatgagagcccaaccctctgtagtgctgagtgcagcccacactgtcgccgcgcgcatgtccccttttgtgcgccagatggattttgctatcgattggacagcagtggaagccggccgcgccttatacaggcaaggtgatagatccgattgtacatacattgtgctgaacgggcgtttgagatctgtgatccagcgtgggagcggtaagaaagaactggtcggcgaatatggaaggggcgatcttattggcgtagtcgaggccctgacccgccagcctagggctaccacggtgcacgcagtgagggacacggagctagccaagttgccagaaggaactttggggcatattaagcggcggtacccacaggtggtcacgagactgattcacctgttatcacaaaaaattctggggaatctacagcaactgcagggacctttccctgccggatcaggcctcggagtgccgccgcattctgagctgacaaaccctgcttcaaatctagccacagtcgccatattaccagtgtgtgccgaggtgcctatggtggctttcacactggagctgcagcatgccctgcaggccattggccctacgctgcttttaaactctgatattatccgcgcgcgcctgggagctagcgctctggattcaattcaggagtttaggttgtctggatggctcgcacagcaagaagatgcccaccgcattgtcctatatcaaaccgacgcttctttaaccccttggacagtgcgatgcctgcggcaggcagactgtatactaattgtgggtttaggagatcaggagcctactttggggcaactcgagcaaatgttggaaaataccgctgtcagggcattgaaacaactggtgctgctgcacagagaagagggcgctgggcccacccggacagtcgagtggctcaacatgcgtagttggtgctctggacatctgcacctgcggtgtcctaggcgactcttcagccggcgcagtcccgccaagctgcacgagctgtacgaaaaggtgttttcccggcgcgccgacaggcactctgatttcagtcggcttgctagggtgctaacaggcaatacaattgccttggttctcggcgggggcggggctcggggctgcagtcatattggtgtgctgaaggccctggaagaggccggagttcccgtcgacctggtcggtggcacctcaatcggcagcttcatcggcgccctttatgcagaggagagaagcgcgagcagaacaaagcagagagcccgggaatgggccaagtccatgaccagtgtcctggaacctgtccttgatctcacatatcccgtcacgtcaatgttcacagggtccgcttttaatcgcagtattcatcgtgtgttccaggacaagcagatcgaagacctgtggttgccttactttaacgtgacaactgacatcaccgcttcagcaatgagggttcacaaagatggctctctgtggcgatatgtgcgagccagtatgaccctctctggctatctaccgcctctgtgcgaccccaaggatgggcatctgctgatggacgggggttacattaataacttgccagccgatatcgcccgctcaatgggagctaagaccgtcattgcaattgacgtaggatcacaagacgaaactgacttgagtacatacggtgacagtctgtcaggctggtggctgctgtggaaacgactgaatccctgggcggacaaggtgaaggtccctgatatggccgagatacagtccaggctggcatacgtatcctgcgtgaggcagctggaagtcgtgaagagttcttcttactgtgaatatttaagaccccccatcgattgcttcaagacaatggatttcggaaagttcgaccaaatttacgacgttgggtaccagtatggtaaggccgtttttgggggatggagccgcggaaatgtcattgagaaaatgctgacagacaggagatctaccgatctgaacgagagcaggcgtgcagacgtgcttgccttcccttcttcggggtttactgatctggcagagattgttagccggatcgaaccacccacttcatatgtctctgacggctgcgcagacggtgaagagtcagactgtctcactgaatacgaagaggacgctgggccagactgcagtagagacgaaggagggtcccctgaaggggcatcgccaagtacagccagtgagatggaagaggagaaatctattctgcgccagagaaggtgcctgccacaggagcctcccggttccgcgaccgacgcttag

SEQ ID NO: 127950 - DNA, 3984 bp, Artificial Sequence
  Description of Artificial Sequence: Synthetic coding sequence
atggaggcaccactgcagactgggatggttctgggggtgatgataggggccggcgtggccgtggttgtgacggccgtcctgatcttactagttgtgagaagattgagggtgccaaagactcccgcccctgacggaccaagataccgtttccggaagcgggacaaagtgctgttctatgggaggaaaatcatgagaaaagtgagtcagtctacctcctcgctagtggacacaagtgttagtgccaccagtaggcccaggatgcgcaaaaaactcaagatgctcaatatcgccaagaagattctgcgaatccagaaggaaactcccactctgcaaagaaaagaaccacctcctgccgtgttggaggccgatctaactgagggggacctagcgaacagccatctcccttccgaggtcttatatatgctgaagaacgtgagggtcctcgggcattttgagaagcccctctttcttgagctgtgtcgccatatggtgttccagcgtctaggacagggcgactatgtgttcaggcccggtcagccagatgccagcatttacgtggtgcaggatggactactggagctgtgcttgcctggtccggatgggaaggaatgcgtggtgaaggaggtggttcctggggactcagtgaacagtctactgagcatcttggacgtgattactggccatcagcacccacagaggactgtctctgcacgggcggcacgcgacagtaccgtgcttaggctgccagtggaagcttttagcgcggtgttcactaagtatccagagtccctcgtgagggtagtgcaaataattatggtcaggttgcagcgtgtcaccttcctggccctgcacaactacctgggacttacaaacgaactgttttcacacgagatccagcctctccggctgttcccgtctcccggcttgcccacgcgcacctctcccgtaaggggaagcaaacggatggtcagcacctcagccactgatgaaccacgcgagactcccggaaggcctcccgaccccacaggggctcccttgcctggaccgacaggggatcccgtgaagcccacttccctggagacgcctagcgctcctctgctgtcaagatgtgtgagtatgcccggagatatttcaggtctgcagggcggccctcgaagtgattttgatatggcttacgagaggggccgtatctctgtatcgttgcaggaggaggcatccggaggctctctggctgccccagcaagaacccctacacaagaacctagagagcagccagccggggcctgtgagtatagctactgtgaagatgaatctgccaccggcgggtgtcctttcgggccatatcaggggcggcagacttcttcgattttcgaagccgccaaacaagaacttgctaagctcatgaggattgaggacccctccctgctcaattcccgggtccttttgcatcatgccaaagcagggacaataattgccaggcagggcgaccaggacgtgtcactccactttgtgttatggggttgtctgcatgtgtaccagcgcatgattgacaaggctgaggacgtctgcctcttcgtggcccagcccggcgagctggtgggtcagctggccgtcttgactggggagccgttgatatttacactccgggcccagcgggattgcacttttctccgcatctccaaaagcgacttctacgaaatcatgcgtgcccagccctccgtagtgctgagcgccgcgcacaccgtggctgctcggatgtctcccttcgtgaggcaaatggatttcgctatcgactggaccgcggtcgaggcgggcagggcactctatcgacagggcgaccgctctgactgcacctatatcgtattgaacggacgcctgaggagcgtgatccagcgcggctctggaaaaaaggagctggtgggtgagtatggaagaggtgacttgatcggggtagtggaagcccttacccgtcagccccgggccactaccgtccatgccgtcagggacaccgagctggcaaaactacctgaggggaccctcgggcatatcaagcgccgctacccccaggttgtgacaaggctgattcatctgctgtcacagaaaattctggggaacctgcaacaactgcagggtccctttcccgccggctccggcctaggggtcccaccccactctgaactcacaaatcctgcctcgaacttagccacagtcgcaatcctgccggtttgcgccgaggttcccatggtcgcctttaccctggagcttcaacacgctttgcaagccataggacctactcttcttctgaatagcgacattatccgagcaaggctgggcgcctccgcacttgactcaattcaggagtttcggcttagcggctggttggcacagcaagaagatgctcacaggattgttctctatcagactgacgcttcactgaccccatggacggtgaggtgtctgcgccaggccgattgtatccttatcgtcgggctcggcgatcaagagccaactctaggccaactggagcagatgctggagaatacagccgtgcgagctctgaaacagcttgtccttttgcatcgggaggagggagcagggcctacaaggaccgtggagtggctcaacatgcggtcttggtgttcgggacacctacacctccggtgcccaagaagactattttccagacggagcccagctaaactgcatgaactatatgaaaaagtgttttcccgacgagccgacaggcactcggacttctcgcgcttggccagagtgctgaccggcaacacaatcgcccttgtactgggtgggggtggtgctcgcggatgttctcacattggcgtcttgaaagcattggaggaagctggcgtgcctgttgatctcgtcgggggcacatcaatcggatcctttattggtgccctatatgccgaggaacggagcgcttcccgtaccaaacagagggccagggagtgggcgaaaagcatgacatctgtgctggagccagttttggacctgacatatcccgttacttctatgtttaccggatccgcattcaatagaagtatccacagggtctttcaggataagcagattgaagacctctggctaccctatttcaacgtgaccaccgatattacagcctctgccatgcgggtgcacaaggacggaagtttgtggaggtacgtgagggcctccatgacactgtctggttatctccccccactatgtgaccctaaagacggtcatctgttgatggacggagggtacattaataatctcccagcagatatcgccaggagcatgggggccaagacagtcatcgcaatcgatgtcgggtcccaggatgagaccgatttatcaacatatggggactccctctcagggtggtggctgctgtggaagcgactgaacccttgggctgataaggtgaaggtgcctgacatggcggagatccaatcacgcctcgcatacgtcagttgtgtgcgtcagctggaggtggtaaaatcgagttcatactgtgaatatctgcggccgccaattgactgtttcaagacaatggacttcggaaaatttgatcagatctacgacgtcggatatcagtatggtaaggcggtgttcggcggatggtcgagaggaaatgtcatcgagaaaatgctcacggaccgcagatccaccgatctgaacgaatctcgaagggccgacgtactggcattcccctcgagcggctttactgacctggcggaaatcgtcagtcggatcgagccacccacaagctatgtgagcgacggatgcgcggatggagaggagagtgattgcttaactgagtacgaggaagatgctggccctgactgctccagagacgagggcggctctcccgaaggagcctcaccatctacagcatctgagatggaggaagagaaatccattcttcgccagaggcgctgtttgccacaggaacctcccggtagcgctacggacgcgtag

SEQ ID NO: 127951 - DNA, 1371 bp, Artificial Sequence
  Description of Artificial Sequence: Synthetic coding sequence
atgcgcaaggtgagtcagtccacgagcagcctagtggacacgtctgtctccgcgacttcaagaccgaggatgagaaagaaactgaagatgctgaacatcgcaaagaagatcctcaggatccagaaggaaacccccactctgcaacgtaaagagccacctcctgccgtgctagaggcagatctaactgaaggtgacctcgcaaatagtcatttaccatccgaggtcttgtatatgctcaagaacgtccgggtacttgggcacttcgagaagcctttgtttttagaattgtgtcgccatatggtttttcagaggctgggacagggtgattatgtgttcaggccagggcagcctgatgcctctatctatgtcgtgcaggatggtctgctggagctgtgcctgcctggcccagacgggaaggaatgcgtcgttaaagaggtcgtgcccggcgactctgtaaattccctcttgtccattcttgacgtgattacaggacaccagcatccccagcgcacagtatccgctcgggccgctagggattcgacagtgttgcgactgcccgtggaggccttcagtgccgtattcactaaatatccggaatcactggtgagggtggtgcaaatcatcatggtcagattgcagcgggtgacatttcttgctcttcacaactacctgggcctcaccaatgagttgttttcacacgaaatccagcccctgcgactgtttccctccccagggctgcctactagaaccagcccggttagaggctctaagagaatggtgagcactagcgcaactgacgagccacgcgaaactcctggacggcccccagacccaacgggagccccgctgccaggtcctaccggggacccagtaaaaccaacctccctggaaacaccgagtgccccactgttgtccagatgcgtaagcatgccaggcgatatcagcggcctgcaaggcggcccacgttccgatttcgatatggcatacgagagaggacggataagtgtctctctgcaggaggaagcctctgggggttccctcgcagcacccgcgcggacccccacccaggaacctagggagcagcccgccggtgcatgtgaatactcatattgtgaagatgaatctgccaccggagggtgtccgtttggcccatatcaagggcgtcagactagcagcatctttgaggcagctaaacaggagttggctaagctgatgcggattgaggacccctccctcctcaactcaagggtcctgctgcaccacgccaaggcgggcactatcatcgctcggcagggcgatcaggacgtctcaggaccgcacaccgggctgacatgcccggagagaggatgcagcgtggctcttatgacttag

SEQ ID NO: 127952 - DNA, 3903 bp, Artificial Sequence
  Description of Artificial Sequence: Synthetic coding sequence
atggaggcccccttgcagacagggatggtcttgggagtaatgatcggagctggagtggcagttgtcgtgaccgcagtgctgatcttgctggtggttagacggctgagggtgcctaagacccctgcaccggatggtcctcggtaccgcttccggaaaagagacaaggtcctgttttatggcaggaaaataatgcgtaaggtttcccagagcacttcctccctggttgatacaagtgtgagcgccacaagccggccgagaatgcgcaagaagcttaaaatgctgaacatagcaaagaaaatcctgcgcattcagaaagaaactccaacgctgcaaaggaaggagcctccgcccgcggttcttgaggccgacttgacagagggagacctagctaacagtcatctgccttccgaagtgctgtacatgctcaagaacgtccgcgtcctaggtcacttcgaaaaaccactctttttggagctgtgtaggcacatggtttttcagagactgggacagggagattacgtcttcaggcccggccagcccgatgcttccatatacgtagttcaagatgggttgttggaactttgtctgcctgggccggacggaaaggaatgcgtcgtgaaagaggtggtccctggtgacagtgtgaacagtctgctgtccatcctggacgttatcaccggccatcagcacccccagcgtacggtgtcagcacgggctgcgcgtgactccactgtgctgagactcccagtagaggccttttccgcagtgtttaccaaatatcccgagtccctggttcgagtggtccagatcatcatggttaggttacagcgcgtgacctttctcgcccttcataactatctgggcctgacgaacgagctgttttcacacgagatccagcctctcagactattcccgagcccaggtctgccaacacgaacatcacctgtccgggggtccaaacgaatggtgagtacttctgctacagatgaacccagggagactcccggccggccgcctgaccccacaggcgcacctcttcctggcccaaccggtgacccggtcaagccaacgtcattagagaccccatcagctccattgctctcaaggtgtgtgagcatgcccggagatatatctgggctgcagggcggccctagatctgactttgacatggcttatgagaggggtagaattagcgtgtccctgcaggaggaggcttctggtggaagcctggcagcaccagcccggacgcctactcaggaacctcgtgagcagcctgctggagcctgtgagtattcctactgcgaagatgaaagtgcaacaggggggtgccccttcggcccttatcaaggacgtcagacctcaagtatctttgaagctgctaagcaagagctggctaagcttatgagaatagaggacgtctctctccactttgtgctctggggctgcctgcacgtctaccagcgcatgatcgataaggccgaggacgtttgcctgttcgtggcgcaacctggcgaattagtcggacagctggctgtgctgacaggagagccactgattttcaccctgcgtgcacaaagagactgcaccttcctcaggatttccaaatcagacttttacgaaatcatgagggcacagccgtcggtagtgttgtcagctgcgcataccgtcgcagcacggatgtcacctttcgtgaggcaaatggattttgcaatcgattggacggctgtcgaagcagggagagcactgtacagacagggagaccgttccgactgcacctatattgtcctgaacggcaggctgaggagtgtgatccagagaggaagcggcaaaaaggaattggttggcgagtacgggcggggggaccttatcggcgtggttgaagcgttgacacgccagcctagagctacaacagtgcatgccgtgagggatacagaactcgccaagctacctgaggggacattaggccacatcaaacggaggtatccccaggtcgtgactagactgatccaccttctgagtcagaagatactcggtaacttgcagcagctacagggaccatttcccgggagcggacttggggttcccccgcactctgaactgacaaacccggcctcaaatttagctaccgtcgccattttgcctgtttgcgcagaggttccgatggtagcttttaccctggagctgcagcatgccctccaagctatcgggcctactttactgctcaattccgatatcattcgcgcaagactgggggcctcagctcttgatagtatccaagaattcagattgtctggctggctggcccaacaggaggacgcccataggatagtactctaccagactgacgcttccttgactccctggaccgtgaggtgcctgcggcaggctgattgtatcctcatcgtggggctcggcgatcaagagccaacactggggcaactcgaacaaatgctggagaacacggctgtgagggcgctgaagcagctagtcttacttcatcgggaagagggtgctggccctacacgtaccgtcgagtggttgaatatgagaagttggtgctccgggcatctgcatctgcggtgccctcgaaggctgttttctcgtcggtcccccgctaagctgcacgagctctacgagaaagttttttcaagaagggcggaccgccattcagacttttctaggctggctcgtgtcctcacagggaataccatcgccctagtgctgggaggtgggggcgctcgcgggtgctcccacatcggagtattaaaagctctcgaggaagcaggtgtgcccgtggatctggtgggtggcacctcgatcggctcattcataggcgcactttatgcggaagaaaggtcagcctcccggaccaagcagcgggcacgcgagtgggccaagtcaatgacgtcagtactggagcctgttctagacctgacctacccggtcaccagcatgtttaccggctccgcgtttaatcgttctatccatcgcgtcttccaggacaaacaaatcgaggacttgtggcttccttatttcaacgtcacaacggatattacagcaagcgctatgagggtgcataaggatgggagcttatggagatatgtgcgcgcgagcatgacacttagtggctacctcccccctctgtgcgatcctaaggacggccatctactcatggatggaggatacataaataacctgccagccgatattgcccgctccatgggagcaaagacagtgatcgcaatcgacgttgggagccaagacgagacagacctgagcacatacggagattcccttagcggatggtggctcctgtggaagagactgaacccatgggcagacaaggtcaaggtcccggatatggccgagatccagagcaggctggcttatgtctcctgcgttcgccagttggaggtagtgaagtcttccagttactgcgaatacctccgtccgcccatcgactgtttcaaaacaatggattttggaaaatttgatcagatatatgacgtcggttatcaatacgggaaggccgttttcggtggctggtcaaggggcaacgtaatcgaaaagatgctaacagatcgacgcagcaccgacctgaatgagtctcgcagagccgacgtgttagccttcccgtcctcaggattcaccgacctcgctgaaatcgttagcaggatcgaaccaccaactagttatgtgtctgacgggtgtgccgatggcgaagagagcgactgcctcacagagtatgaggaggacgctggaccagattgtagcagagatgaaggtgggagcccagagggagctagtccgagtacagcctcagagatggaagaagaaaagagcatcttaaggcagaggcgctgcttaccccaggagcccccaggttcagcgacagatgcctag

SEQ ID NO: 127953 - DNA, 3954 bp, Artificial Sequence
  Description of Artificial Sequence: Synthetic coding sequence
atggaggaagagaaagacgactcaccccagctcacaggcattgcagttggcgcacttctggccctggcactggtgggggtcctgatactgtttatgtttaggcgattgcggcaatttaggcaggcccagccaacaccgcagtatcgttttcgaaagagagataaagtgatgttttacggcaggaaaattatgcggaaagttaccactctgcctaatacactggtggaaaatacggcactgccaagacagagggcacgaaaacggactaaagttctttcgttggccaagcgtatcttgcgatttaagaaagagtaccctgccttgcagccaaaggaaccaccaccctcgctgctcgaagctgatctgacagagttcgacgttaagaacagccacctccctagcgaagttctgtacatgctgaagaatgtaagagtactgggacacttcgaaaagcctttattcttggagttgtgtaagcatattgtgtttgttcagctgcaggaaggagaacacgtatttcagccacgggagccagatccaagcatttgtgtggttcaagacggaagacttgaggtgtgtattcaggacacagatgggacagaagtcgtcgtcaaagaagtgctcgccggggatagtgtgcactcactgctcagtattctggacattatcaccgggcatgccgctccttataaaacagtttcagtccgggccgccatccccagcaccatccttagactgcccgccgctgcctttcatggtgtctttgagaaataccccgagacgctggttcgcgtggttcagataattatggtcagactacaaagggtcactttcctggcactgcataactatctggggctgacaaccgaactatttaacgcagagagtcaagccatccccctggtgagtgttgccagtgtcgccgccgggaaagctaagaagcaggtgttctacggcgaggaagagagattgaaaaaacctccccggctgcaggaatcatgcgattccgatcacggcggtggaagacctgctgcagctggccctctcctgaagcggagccattctgtgcctgctccgtcaatccgtaaacagatcttggaagaactcgagaaacctggggcaggagatccagatccaagtgcaccacagggtggaccaggatccgccacgtccgatctcggcatggcgtgcgaccgagctagagtgttcttgcattccgacgaacaccctggctcctccgtggccagcaagagtcgaaagtccgtgatggtcgccgaaatcccgtccaccgtgtcccaacattccgaatcccatacagatgagacattggcatcacgtaagtccgatgcaatattccgagctgctaagaaggatctgctcaccttgatgaaactagaggattcatctttactggacgggcgtgttgccttgctccatgttcccgcaggcacagtggtcagtcggcagggcgatcaggacgcctccattctgttcgtggtgtcaggcctgttacacgtctatcaacgcaagataggcagccaggaagatacctgtcttttccttacccgacccggcgaaatggttgggcagttagcggtactcaccggagagcctttgatctttacagtaaaagccaaccgggactgttcttttctttcaatttccaaggcgcacttttatgaaattatgagaaagcagcccacggtagttcttggagtggctcatacagtggtcaaaaggatgagcagcttcgtccgccagattgatttcgccctggattgggttgaggtggaggccgggcgggccatctataggcagggagacaagtcagactgcacctacataatgttaagcggacggctccgctccgtgataaggaaggacgatggcaagaagaggctcgccggggagtacggaagaggtgatttggttggtgtggtggaaacattgacccaccaagcccgtgccacgactgtccatgccgtgcgagacagcgaactggccaagcttcctgccggtgctctaacctccatcaagaggagataccctcaggtcgtgacccgccttatccacctgctcggcgaaaagattctaggcagtttacagcagggtccagtcaccggtcaccagctgggcctgccaaccgaaggatcaaagtgggatctgggaaatcctgctgtcaatctgtctaccgtagccgtcatgcccgtgtctgaggaggtaccattgacagcttttgccttagagctagaacatgcattaagcgcaattggcccgaccctgctgttgacaagtgacaatattaagaggcgtttaggttcagcagctctcgactccgttcacgagtacaggttgagcagttggctgggtcagcaggaggacacccatcgcatcgtgctgtatcaggtggacgggactctcaccccctggacgcaaaggtgcgttaggcaggccgactgcattctcattgtgggtcttggagatcaggagccaactgtaggcgaactggaaagaatgcttgagagcacagcggtccgtgctcagaagcagttgatactcttacaccgtgaagagggccctgcacctgcccgcacagtggagtggctgaatatgcgcagctggtgctctggccacttgcacctgtgctgccccagaagggtgttcagccggagaagcttacccaaattagtggagatgtacaaacatgtgttccagcgtccaccagaccgccactcggacttctcccgtctggctcgggtgctcacagggaatgcaatcgccttggtgctaggagggggcggtgcccgggggtgcgctcaagtgggtgtgctcaaagcgctcgctgaatgtggcatacctgtagacatggtaggtgggacatccattggggcattcgtgggagctttgtacagtgaggagagaaactactcccaaatgcgaatcagggcaaaacagtgggctgagggcatgacttctctaatgaaggccgccctcgatctgacttaccctataacatctatgttctctggagccggttttaatagctccatcttcagcgtgttcaaggatcagcagatcgaggatctgtggattccatattttgccataacaacagacattaccgctagcgctatgagggtacataccgatggctcgctctggtggtatgtgcgggcaagtatgtctctatccggttatatgccaccactctgcgacccaaaggacgggcatctgttgatggatgggggttacattaacaatctccccgctgatgtcgcaagatctatgggggctaaagtggtgatcgccatcgatgtgggctccagggacgagaccgacctgacaaattacggcgatgccctatcagggtggtggctgctgtggaagaggtggaaccctctcgctacaaaggtcaaggttctgaacatggcagagatccagacccggctggcttacgtgtgctgtgtgcgccagctcgaggtggttaaaagtagcgactactgcgaatatctgcgacctcctattgatagctactcaactcttgacttcgggaagttcaacgaaatctgtgaggtgggctatcaacatggtcgcaccgtcttcgacatctggggccgatctggcgtactggaaaagatgctgagggatcagcagggtcctagcaagaaacctgcttccgcggtcctgacatgtccaaatgctagttttacagatctggcggagattgtgtcaaggatagaaccagccaaaccggcaatggtagatgatgagagcgattaccagaccgaatacgaggaagagctgctcgacgtacccagagatgcttatgccgattttcagtccacctctgcccagcaaggcagcgatctcgaggacgaaagcagtctgagacatcggcatcccagcctggcattcccgaagctctccgagggatccagcgatcaggatggatag

SEQ ID NO: 127954 - DNA, 2178 bp, Artificial Sequence
  Description of Artificial Sequence: Synthetic coding sequence
atggtcagattgcaacgcgttaccttccttgccctccataactatttgggtttaaccaccgagcttttcaatgctgaatcacaagccatcccactcgtctccgtggcatcagttgcagccggaaaagctaagaagcaggtgttttacggcgaggaagaaaggcttaaaaagccaccgagactgcaggaatcatgcgatagcgccgaccacggcggaggtaggccagccgcagctggccctctccttaaacgctcccatagtgtccccgccccctccattcggaagcagatcctggaagaactagagaagcccggcgctggcgacccggacccctccgcacctcagggccatcaattgggacttccaaccgaaggctccaaatgggatcttggtaaccccgcagtgaatttatctactgtggctgtgatgccagtgagcgaagaagttcctctgaccgccttcgctctcgaactcgagcacgctctgagcgccatcggccctaccctcctgttaacatctgataacataaaacggcgactgggatctgcggcactcgacagtgtccatgagtatagattgtcctcatggttggggcagcaagaagacacacatcgaatcgtcctgtatcaggtggacggcaccctaacgccgtggactcagaggtgtgtcagacaggcagactgcatcctgatcgtcggcctgggcgaccaggagcccacggtgggagaacttgagcggatgttggagtctactgccgttagagcccagaaacagctgatcctgctgcaccgcgaggagggcccagcgcccgctaggactgtggaatggttaaacatgcggagttggtgcagcgggcacctgcacttatgctgcccccgacgcgtgtttagtcgacgcagtttaccaaagctggtggagatgtacaagcacgtctttcaacggcccccagacagacatagtgattttagtaggctggcacgggtgctcactgggaacgccatcgcactggtgttggggggggggggtgccagagggtgcgctcaagtgggagtactcaaggccctagccgaatgtggcattcctgtggacatggtgggcggaacgtccataggggcatttgttggggccctgtactctgaagaacgcaactattcccagatgagaatccgggccaagcaatgggcagaaggcatgacaagcttgatgaaagctgcattggacctcacgtacccgattacaagcatgttttccggggcggggttcaacagctccatcttcagcgtgtttaaggatcagcagatagaggatctgtggattccctactttgctattacaactgatatcaccgcaagtgccatgagggtgcacaccgatgggtcactctggtggtatgtgagggcatcgatgtctctcagcgggtacatgccacctctgtgcgaccctaaagacggtcacctccttatggatggtggctacatcaataatctgcctgcagatgtggcacgctccatgggcgcaaaggtggtgatcgctatcgatgttggatcacgcgatgaaacagacttaacgaactatggtgacgccttgtccgggtggtggctcctgtggaaacgatggaatccattggctaccaaggtgaaagttctgaatatggccgaaatacagactaggttggcatatgtttgctgtgtgcgccagctggaagtcgtgaagagttctgattattgtgagtatctaagacctccgattgatagctactcaaccctggactttgggaaattcaacgaaatctgcgaggtggggtaccaacatggccggaccgtgtttgatatttgggggcgctccggcgtgctagagaaaatgctccgcgatcagcaaggccccagcaagaagccagcttccgcagtgctcacgtgtcccaatgcctctttcacagatctggccgagatcgtgtctcgaattgagcccgccaaaccagcaatggtagacgacgaatcagattaccagactgagtatgaagaggaactcctcgatgtccctcgcgacgcatatgccgacttccagtccacctcggcacagcagggtagcgatcttgaggatgaaagctccctgcgacacaggcatccttctctggccttccctaagctctccgaagggtcttccgaccaggacgggtag

SEQ ID NO: 127955 - DNA, 1377 bp, Artificial Sequence
  Description of Artificial Sequence: Synthetic coding sequence
atggaggaggagaaagatgactccccacaagccgacttttgcttaggtactgctctccacagttggggcttatggtttaccgaggaaggaagccccagcactatgctaaccggaatcgccgtcggcgcgcttctagccctggctctagtcggggtactgattttatttatgttccgtagactgcgccagttcaggcaggcccagccaactccacagtatcggttcaggaaaagagacaaagtcatgttttatgggaggaaaatcatgaggaaggtgacaacactgcctaatacactagtcgagaacaccgcgctgcctagacagcgagccagaaaacggactaaagtgctgagcctggccaaaagaatcctccggtttaagaaggagtaccctgccttgcagccaaaggagccccccccctccttactcgaggccgacctaaccgagttcgacgtcaaaaacagccacttaccgagtgaggtcctctatatgctgaagaatgtcagagtgttgggccactttgaaaaaccactgttcttggagttgtgtaagcatattgtgtttgtgcagcttcaggagggtgaacacgtgttccaacctcgcgagcctgatccgagcatctgcgtcgtccaggatggcagacttgaggtctgcatccaggacacagacggcacagaggtggtagtgaaagaagtgctcgccggcgacagtgttcactccctgttatccatcctcgacatcattactggccatgctgctccctataagacagtgagcgtgcgggctgccataccttctactatactaaggctgcctgctgccgccttccacggagtgtttgagaagtaccccgaaaccctcgtccgggtcgtgcagataattatggtacggcttcagcgggtgactttcctggcccttcataattatttggggttaaccacggaactcttcaacgccgaatcccaggctatccccttggtctcagtggcgtctgtcgctgccgggaaggccaagaagcaagtgttctatggcgaggaggaaaggttgaagaaacccccccgcctgcaggagagctgtgactccgatcacggggggggccgccctgccgccgccggaccccttctcaagcgctcccactctgtccccgcccccagcatcaggaagcagattctggaggagctggagaaacctggagcaggtgacccagacccctctgcaccacaggcccgcgtactatgtctgttgccgcaatgcctcggtggccttccaccaacagatacctccgtttactcctccgccagttccgattgctgcgggtgcagcatgccagtgctctgcatcatgggacacaagcctcacgtgactgtggacacatag

SEQ ID NO: 127956 - DNA, 3765 bp, Artificial Sequence
  Description of Artificial Sequence: Synthetic coding sequence
atggaggaagaaaaagacgacagcccccagcttaccggcattgctgtgggggctttgctggctcttgctcttgtaggcgttctgattctgttcatgtttaggagacttcgccagttcaggcaggctcagcctactcctcagtatagattccgcaagcgcgacaaggtgatgttttatggtcggaagatcatgcgtaaggtcacaaccttgcctaatacacttgtggaaaataccgcattaccccgacagcgtgctcgtaaacgtacgaaagtcttatccttagcaaaaaggattctgcgttttaagaaggagtaccctgcgctccagccgaaggaaccgccaccatctctgctagaggcggacctcactgagttcgacgtaaagaactcacatttgccaagcgaagtgctttatatgctgaagaacgtgagggttctgggccattttgagaaacccctgtttctggaactgtgtaaacacattgtgtttgtacagctccaggaaggggagcacgtctttcaaccacgggaaccagacccaagtatctgtgttgtccaagacggtcgcttggaggtgtgtatacaggacacagatgggacagaagtggtcgtgaaggaggtgttagccggggactcggtgcactccctgctttcaatactggatattatcactggacacgccgccccatataagacagtgagtgtcagggccgctatcccctccactattctgcgcctaccggccgcggcgtttcatggtgtgtttgaaaagtacccagaaactttagtgcgcgttgtccagataatcatggtcaggctgcagcgggttacttttctcgctttgcacaattacctcggcctgaccacagagctatttaacgcagagagtcaggccatacccctggtctccgtagctagcgttgcagccgggaaagctaagaagcaagtgttctacggagaggaggagcgcctaaagaaacctcccaggttgcaggaaagctgtgattctgatcacggtggtggtaggccggccgccgccggtcctctgttgaaacgatcccattctgttcccgcaccttccatccggaagcagatcttggaagaactggagaaacccggagccggtgaccctgatccctctgcgcctcaagggggccccggttctgcgacttccgatctgggaatggcctgcgacagagcacgcgtgttcttacactcagatgaacacccaggttcgtccgttgcctcgaaatctagaaaaagtgtgatggtggctgagatcccatctactgtgtctcagcactctgaaagccataccgacgagaccctggcgagccgaaaaagcgacgcaatttttagagcagcaaagaaagacttgcttacactaatgaaactggaggacagttccctcctggatgggcgggttgcgctactgcacgtcccggccggaactgtagtcagccgccagggagaccaggacgccagcatcttatttgtcgtgtccggtttgctccacgtgtaccagcgcaaaattggcagtcaagaggacacttgcttgttcctgacaagaccaggtgagatggtgggacagttggcggtgttgacaggcgagcccctgatattcaccgtgaaagcaaaccgggattgtagcttcttaagcattagtaaagcccacttctacgaaattatgcgcaagcagccaacagtggtgctaggagtagcccacaccgtcgtgaagagaatgtcatcgttcgtacgtcagatcgactttgccttggattgggtggaagtggaggctggtagggccatctacaggcagggcgacaaatccgattgtacttatatcatgttgtcgggtcggctcaggtctgtgatccggaaagatgatggaaaaaagaggttggcgggagagtacgggcgcggggatctggttggagtggtggaaactttaacgcatcaagcaagagccaccaccgtgcacgctgtgcgcgacagtgagcttgcaaagctgcctgctggagcacttacttcaattaagcgtcgatacccgcaggttgttaccagacttatccatctactgggagaaaagattcttggttcgctgcagcagggccctgtgactggccaccagctgggactgcctaccgagggcagcaagtgggatctggggaatccagcagtgaatctgtccacagttgcggttatgcctgtctcagaagaagtccccctcacagcatttgccctggagctggagcatgcgctgtccgccatcggacccaccctgctgcttacatccgacaatattaagcgcagactgggaagcgccgccttggactccgtccatgagtataggctgtcctcatggctgggccaacaggaggacacacacaggatcgttctgtaccaggtcgatgggactctcaccccttggacacagcgttgcgtacgacaggctgactgcatcctgatagtgggactgggcgaccaagaaccaactgtgggagagctggaaaggatgctagagtccaccgctgtgagggcccagaagcagcttatcctgctgcaccgggaagaaggccctgctcctgcacgcactgttgaatggcttaacatgcgttcgtggtgctcaggtcatctgcacctgtgctgcccccgcagggtatttagccgaagaagcctgcctaagctggtggaaatgtataaacatgtctttcagaggccaccagaccggcactcggacttcagccgactggcaagagtactgactggtaatgccattgccttggtgctgggagggggaggagctagaggctgtgcgcaagtgggcgtcctgaaggctctcgccgagtgcggcatcccagtggacatggtcggtggaacctcaataggcgcttttgtgggggctctgtactctgaagagagaaattatagccagatgcgtattcgggctaagcagtgggcagaaggcatgacatcattaatgaaggccgctctggatcttacctatcccattacctcgatgttctccggagcggggttcaactccagcatcttctcggtcttcaaagatcagcagatcgaggacctatggattccatattttgctatcactacagacattacagcgagtgcaatgcgcgtccacacagacggaagcttgtggtggtacgttcgggcctcaatgagcctgtccgggtacatgccccccctgtgtgacccgaaggacgggcatctgctcatggatggaggttacataaacaacctcccggcagatgtggctagatcgatgggagccaaagttgtgatcgctattgacgtcggctcccgcgacgagactgatcttaccaattacggggatgcgctttcaggatggtggctgttatggaagaggtggaaccccctggcaacaaaggtcaaggtgcttaacatggcagaaattcagacaaggctcgcatatgtctgctgcgtgagacagctcgaggtagtaaagagttccgactattgtgaatacctgcggcctcccattgacagctattctaccctagactttggaaagtttaacgaaatttgcgtgccagacgagagtgattatcaaacggaatatgaagaggaacttttggacgtcccgcgggacgcatatgccgacttccaatcgaccagcgctcagcagggatccgatcttgaggacgagtcctctttaagacacagacacccctcacttgcctttccaaagttgagtgaggggagctcggatcaggacgggtag

SEQ ID NO: 127957 - DNA, 2772 bp, Artificial Sequence
  Description of Artificial Sequence: Synthetic coding sequence
atggcttgcgacagagccagggttttcctgcactcggacgagcatcctggtagcagtgttgccagcaaaagtaggaagtctgtgatggtcgcggagatcccaagcactgtgagccagcacagtgaatctcacactgatgagactctcgccagccggaagtcagatgcaatctttcgagctgctaagaaagatctgctgacactgatgaaactggaggattcatcgctgttggatggaagggtcgccctgttgcatgtcccagcgggtaccgtagtgagtcgccaaggcgaccaagacgccagtatactattcgtcgttagcgggcttctgcacgtgtatcaacgcaaaataggaagtcaggaggatacatgcctgttcctaactcggccaggggagatggttggccagctggctgtcctgactggcgaacccctgatcttcacggtgaaagccaatagggactgtagtttcctgtcaatctccaaagctcacttctacgagatcatgcggaagcagcccactgtggtcctcggcgtggcacatacagtcgtgaaacgcatgagttcatttgtaaggcagattgattttgctttggactgggtggaggtggaggcagggcgtgccatttaccgccagggtgataaatctgattgcacctacattatgcttagtgggcgacttcgaagcgttatcagaaaggacgacggcaagaagcgactagccggagagtatggccgaggagatctcgtcggcgtcgtggagacgctaacacaccaagcgcgtgccaccacagtccatgctgtgagagatagcgagttagcaaagctgccagccggtgcattgacctctatcaaacggcgctatcctcaggtcgtcacaaggctgattcatctgctcggtgagaaaattcttggttcactccagcagggcccagttacaggccatcagctgggcttgcccacggaaggctcaaagtgggacctaggtaatcctgctgtaaatctgtctactgttgccgtaatgcccgtgtctgaggaggtgcccttaaccgcctttgccttggagctggaacacgccctctccgccatcggccctacgctactgcttactagcgataatatcaaacgccggctgggttcagccgcgcttgacagcgtccacgaataccggctgtcttcctggctcgggcagcaggaagacactcacagaattgtcctctatcaggtggacggcacgctgactccatggacccagcgatgcgtgcgccaggccgactgtatcctgatcgtggggcttggagatcaggaacctacagtgggtgagctcgagcggatgctcgagtctacggctgtaagggcacagaaacagttgattttgctgcatagagaagagggaccagcccccgcccgtactgtggagtggctgaatatgagatcatggtgttcaggccacctgcacctttgttgtccccgacgggtcttcagtagacgaagcctgccaaagctggtggagatgtacaaacacgttttccagaggccacccgaccgacacagtgattttagccgcctggctagagtattgacgggaaatgccatcgccctggtgttaggaggaggcggtgctcgggggtgtgctcaggttggggtcctaaaggccctggccgagtgcggcatccccgtggatatggtcggtggcacgagcattggtgcatttgtgggcgctctttacagcgaggagcgcaactattcccaaatgcggatacgcgcaaagcagtgggccgaaggcatgacatcactcatgaaggcggccttagacctcacctatccaattacgtctatgttttccggggctggcttcaactcatcaatcttttctgtttttaaagaccagcagatagaagacctgtggatcccgtactttgctatcacaacagatattaccgccagtgcaatgcgggtgcatactgacggctccttgtggtggtacgtgagagcctccatgagcctctcaggttacatgcctccactctgtgaccctaaggacggccatctgctgatggacggcggctacattaacaatcttccggccgacgtggcccgctccatgggagccaaggtggtaattgcaatagatgtgggtagcagagacgagacagatctcaccaactacggcgatgccttatccggctggtggctcctgtggaagcgctggaacccccttgctactaaagtgaaggtgttgaacatggcggagattcagaccaggcttgcatacgtctgttgcgtgcgccagttagaagttgtgaaaagctctgattactgcgagtacttgagaccacccatcgactcgtactccaccctcgattttggcaaattcaatgagatttgtgaagtaggctatcaacatggccgcacggtgtttgacatctgggggcggagcggggtgctggaaaagatgctgcgtgaccagcagggacctagcaagaagcctgcctccgccgtcctgacttgtccgaacgcatcttttacggaccttgccgaaatcgtgagcagaattgagcctgctaagcctgccatggttgatgatgaaagtgactatcagacagagtatgaggaggagctgttggacgtgccgcgggacgcttacgcagatttccaaagcacatccgcacagcagggcagcgacttggaagatgagtcttccctgagacaccgccatccttccctcgcatttcctaagctgagcgaggggtcaagcgaccaggatgggtag

SEQ ID NO: 127958 - DNA, 4029 bp, Artificial Sequence
  Description of Artificial Sequence: Synthetic coding sequence
atggaagaggagaaggacgactctcctcaggcggacttttgtctgggcacagcactgcactcctgggggttgtggtttaccgaggagggatccccgtctacaatgctgacaggcatagcagtaggggccctgttagcattagcactggtcggggtgctcattctgttcatgttccgcagactacgtcagtttcggcaggcgcagcccactcctcaatatcgcttcagaaagcgagataaggtgatgttttacggtcgaaagattatgcgaaaagttaccacactccctaacaccttggtcgagaacacagctctgcctcgtcagcgcgccaggaaacgcacaaaagttttaagcctggctaagaggatccttcggttcaagaaagagtatcctgctttgcagcccaaggagcctccaccaagcctgcttgaggcagatttaacagagttcgatgtgaagaactctcacttgccctccgaggtgctgtacatgttaaagaacgttcgcgtgctggggcacttcgaaaagcctttgtttttagaactttgcaagcacatcgtgttcgtccaacttcaagagggggagcatgtgttccaaccacgcgagcccgatccgtctatctgcgtagtgcaggatggaagattagaagtctgcattcaagacactgatggcaccgaggttgtcgttaaggaagtactggccggcgatagcgtccactctttgttgtcaatcctcgatattatcactgggcacgcggctccgtacaaaacggtgtcagtcagagcggctatcccttccactatcctcaggttacctgcagccgccttccatggggtttttgagaaatatcctgagacactcgtccgagtggtgcagatcattatggtgcgcttgcaacgagtcacgtttctggcactacacaactaccttggactcacaactgaactgtttaacgccgaaagccaggcaatccctctggtgtcggtagcatccgtggctgccggcaaggccaaaaagcaggtcttttatggagaggaagaaagactcaagaagccccctagactccaagagtcttgcgattccgaccacggtggagggcggccagcagccgccggacccctgcttaagaggtcccatagtgtgcctgctccatctattcggaaacagatcctggaagaactggaaaagcccggtgcaggcgaccctgacccatccgcccctcagggcggtccaggatcagctacctcagatctggggatggcgtgtgacagagctcgggtgtttctgcatagcgacgagcaccctggctccagtgtggcttcgaagtcccggaagagcgtcatggttgccgagatcccctctaccgtatcccaacactcagagagccatacagatgaaactctggctagccggaaatccgacgctatattcagagccgctaagaaagatctgctgaccctgatgaagttagaggactcctccttgttagacggtcgcgttgcccttctccacgtgcctgccggtaccgtagtctcaaggcagggagatcaagatgcaagtattctttttgtggtctccggcttgctgcacgtctatcagcgtaagattggctcccaagaggacacctgtctgttccttactcgacctggcgagatggttggtcagttagccgtcctgacaggggaacccttgattttcactgtgaaggctaatcgggattgctcttttttgtctataagtaaagcccacttctatgaaattatgcggaagcagcctacagtagttcttggtgtggcacatactgtggtgaagagaatgtcctccttcgtgcggcaaatcgacttcgcactcgattgggtggaagtggaggccggcagggccatataccgccagggggataagtcagattgtacatacatcatgctgtccggccgcttgcggagtgtgatcagaaaggacgacggcaagaaacggttagccggagagtacgggaggggcgacctggtgggcgtggtggaaacccttacccaccaggcgagagctactaccgtgcacgccgtgcgggactctgagctggccaaactcccggcgggggccctcacatcaataaaacggaggtatccgcaggtggtaactagattgatacaccttttaggagagaaaattctcgggagcctgcaacaggggcccgtgaccggacaccagctgggccttcccaccgagggcagtaaatgggatctgggcaaccccgccgttaacctgtccaccgtggctgtgatgcctgtcagcgaggaagtccccttaactgcctttgccctcgagctggaacacgcactgtctgctattggtcccaccctgcttctgacgagcgataatattaagaggcgactggggagtgcagccctggactccgtacacgaatatagactgagctcttggcttggccagcaggaggacacccaccggatcgttctctaccaagtggatggaacactgacaccctggacccagcggtgcgtgcgacaggccgattgcattctaatcgtggggctcggagatcaggagcctactgttggcgagctcgagagaatgcttgaaagtacagccgtacgtgctcagaaacagctaattcttctgcatagagaggaaggacccgccccggcccgaactgtcgagtggctgaacatgagaagttggtgctctggccatctccacctttgctgccctagaagagtgttcagccggcgctctctgcctaaattagtagagatgtacaaacatgtttttcagaggcctccagataggcactctgatttttcccgcttagcccgggtactgactggcaacgcgattgccctggtgttaggcggagggggggcaaggggttgtgcccaggtcggcgtgttgaaggccttggctgagtgtgggattcctgttgacatggtgggagggacctctatcggcgcgtttgttggcgctttgtactcggaagagaggaactatagtcagatgaggatcagggctaagcagtgggctgagggaatgacatcattaatgaaggctgcgttagatctgacctatccaatcacgtccatgtttagcggggccgggttcaactctagcatcttctccgtgttcaaagatcaacagattgaggacttgtggattccgtatttcgcaatcaccacagatatcactgctagcgccatgagagtacacacagacggctcactctggtggtacgtgagagcgtctatgagcctttctggttatatgcctcctctgtgcgacccaaaagatggtcatctgctgatggatgggggatacatcaacaacctgcctgccgacgtggctcggagcatgggcgccaaagtggtgatagccatagacgtgggtagcagagatgaaaccgatctaactaattacggggacgcattatccggatggtggctcctttggaaacgatggaaccccttggccactaaagttaaggtccttaatatggccgaaattcagacgaggctagcctatgtctgctgtgtccggcagctggaggttgtgaagtcaagcgactactgcgaatacctccggcctccgatcgattcatattctaccttggacttcgggaaattcaacgaaatttgcgaggtcggctaccagcatggcaggaccgtgtttgatatctggggacgaagtggagttcttgaaaagatgctgagagatcagcagggtccctccaaaaagccagcctccgccgtgttgacctgtccaaacgccagcttcaccgacctcgctgagatcgtcagcaggattgaacccgctaaacccgctatggttgacgatgagagcgattatcagacggaatacgaagaagagctcctggacgtccctagagatgcttatgctgactttcagagtacttccgcccagcagggcagtgatctggaagacgagagctctttacgccacagacatccctcccttgccttcccaaagctttccgaagggtcctctgaccaggatggttag

SEQ ID NO: 127959 - DNA, 3846 bp, Artificial Sequence
  Description of Artificial Sequence: Synthetic coding sequence
atgctcacgggcattgccgtgggcgccctcttagcactggcgctggtgggcgtgctcattctgttcatgttcaggcgactgcgccagttccgccaagcacagccaaccccccaatatcgattcaggaaacgcgacaaggtgatgttctatggtaggaagattatgagaaaagtgactactttacccaacacactcgtggaaaacaccgcgctgccaagacaaagagcacggaagagaactaaagtgctctccctggcaaaacgtattttacgcttcaagaaagaatatccggcactgcagcccaaggaacctcctcctagcctcctcgaagccgacctaaccgaatttgacgtgaaaaattctcatctacccagcgaggtactctacatgctcaagaatgttagagtgctaggacatttcgagaaacctctctttctcgagctttgtaaacatattgtttttgtccagctccaggagggagaacatgtgtttcagcccagagagcctgacccttctatttgtgtggtgcaggacggcaggctggaagtctgtatccaggatactgatggtaccgaggtggtggtcaaggaggtcctggcaggcgattcggttcattctttgctttctattttggatattattacagggcacgcagccccctataagacagtttctgtgcgcgcagcaatcccaagcacaatactgaggctgccagcggctgcgttccatggggtgttcgagaagtatcctgagaccctggtgagagtggtgcagatcatcatggtgaggcttcagcgggtgacctttctcgccctccataactaccttgggctcactacggagcttttcaacgctgaatcccaagccatccctctggtatccgttgcgagtgtagccgccggaaaggccaaaaaacaggttttttatggtgaagaggagcggcttaaaaaaccaccgcggctccaggaaagctgcgatagcgaccatggaggaggccgaccggctgcagcaggccccctactcaagcgcagtcactccgtcccagcgccatctattagaaaacagatactggaggagctcgaaaagccaggggccggcgaccccgatcccagcgctcctcaaggcggacccgggagcgccaccagtgatttgggcatggcctgtgatagagcaagggtgttcttacattccgacgaacacccaggctcaagtgttgctagtaagtcacgtaaaagtgtcatggttgccgaaattcctagtaccgtgtcgcagcacagcgagagccatacagacgagaccttggccagccggaaaagcgatgctatttttcgtgccgctaagaaagacctattgacactgatgaagctggaggacagttcacttcttgacgggcgagtcgctttattgcacgtccctgccggcacagtggtttcccggcagggagaccaggacgcatccatattgttcgtcgtgtctggtctgctgcatgtgtaccagagaaagatcgggtcccaggaggacacttgcctgttcctgactagaccaggtgagatggttggtcagctggccgtgctgaccggtgagccactaatttttacagtgaaggcaaaccgggactgtagtttcttgtcgatctccaaagcacatttttacgaaatcatgagaaagcagccaaccgtggtcctcggcgtcgcacataccgtagtgaaacgaatgtcctcctttgtgaggcagattgattttgcattagactgggtcgaggtggaagcaggccgtgctatctacaggcaaggagacaagtccgactgtacatatattatgctgagcggccggctgcgatccgttatccggaaggatgatggcaagaaacgcctggcaggagaatatgggcgcggcgacctcgtcggggttgtggaaactttaacacatcaagccagggctactaccgtgcacgctgtccgcgattcagagcttgcgaaacttcctgctggagccctgacatcgattaaacgccgctaccctcaggtggtaactagactcattcatctgctgggcgagaagatcctaggctccctacagcagggcccagtgacgggtcaccagttgggcttacccacagaagggagcaaatgggacctcggaaaccctgctgtcaacttgtctacagtggccgtcatgccagtttcagaggaggtgccacttaccgcattcgctcttgagctcgagcacgcccttagtgctatcggaccaaccctgctgctcacctcagacaacatcaagaggcgcttaggatcagcagccctggactccgttcatgaatatcgcttgtccagctggctcggtcagcaagaggacactcaccggatcgtgctctatcaagtggatggaaccctgaccccgtggactcagcgctgtgtgaggcaggcagactgtatactaattgttggcctaggagaccaggagcccactgttggggagttggagagaatgctcgaaagcacagccgtgcgcgcccagaagcaactaattctgctgcacagggaggaaggaccggctcccgctcgaacagtcgagtggctcaacatgagatcatggtgctctgggcacctccacctctgctgtccaaggcgggtcttctcccgcagaagccttcctaaacttgtggagatgtacaagcacgtgttccagcgtcccccggatcggcattccgatttctccaggctggctcgcgttctgaccggcaatgctattgccctggtgctcgggggcggtggagcacgcgggtgtgcacaggtgggtgtgctgaaagcactggcagagtgtggcatcccggttgatatggtgggtggaacatccattggggcctttgtgggagctctgtactctgaagagcggaactatagccagatgcgtatccgtgctaagcagtgggctgaaggcatgactagcttgatgaaggcagctcttgatctcacatacccaatcacgagtatgttcagtggcgccggatttaatagctccattttttccgtgttcaaagatcagcaaattgaggacttgtggataccatactttgctataaccactgatatcacagcttctgccatgagagtgcataccgacggcagcttgtggtggtacgttcgggcctcgatgtctcttagcggctatatgccgcccttatgcgatccaaaggatgggcatctactcatggacgggggctacattaataaccttcctgccgatgtggccagatctatgggagccaaggttgtcatcgccatcgacgttgggagtcgcgacgagactgatctcactaattatggggatgccctgtccggctggtggctgctgtggaaaagatggaatccactcgccaccaaagtgaaagttttaaacatggccgaaattcaaacaaggctcgcttatgtgtgctgtgtgcggcagctggaagtcgtcaaatccagcgattattgcgaatacttgagacccccaattgatagctacagcacactagacttcggcaaattcaatgagatctgcgaagtggggtatcaacacggccgaaccgtctttgatatttggggtcggagtggtgttttagaaaaaatgctcagggaccagcaaggcccctccaagaaaccagccagcgcggtgctgacctgtcccaacgcttctttcacagatctggccgagattgtgtctagaattgaacccgccaagccagcaatggtggacgatgaatctgactaccagaccgaatatgaggaagagctgcttgacgtgccaagggacgcatacgccgatttccagtccacaagtgcccaacaaggctctgatctctag

SEQ ID NO: 127960 - DNA, 2349 bp, Artificial Sequence
  Description of Artificial Sequence: Synthetic coding sequence
atgagcatcaatctcaccgttgatatttatatttatctactctctaatgctcggagtgtttgtgggaaacagcggtctaagcagttatactttctgttcagtcctaaacactattggagaatttctcacataagcctacagaggggtttccacacaaacataatccgatgcaagtggacgaagtccgaggcccatagttgctcgaaacactgctactctcccagcaaccacggtctccacatcggcattctgaaactgagcacttccgctcctaagggcctaaccaaagtgaacatatgtatgagtagaatcaaatctacactaaatagcgttagcaaggccgtttttggcaaccaaaatgaaatgatttcgaggctggcgcagtttaaaccctcgagtcagatattgcggaaagtgagtgattctgggtggctaaaacaaaagaatatcaagcaggcaataaagagcctcaaaaaatatagtgacaaaagcgcagagaagagtcccttccccgaggaaaaatcccacatcattgacaaagaagaggacatcggtaaacgctctctgtttcactacacatcctcgataacaactaaatttggtgactctttctactttctcagcaaccacatcaatagttactttaagcgaaaagagaagatgagccaacagaaggaaaatgaacactttcgcgacaaatcagaactggaagataagaaggtcgaagaagggaaactcagatctccagatcctggtatcttagcctataaacccgggagtgagtctgtgcataccgtggacaaaccaacaagcccttcagccatcccagacgtactgcaggtgtccaccaaacagtctatcgcgaactttctgagccgacccacggaaggggtgcaggctctggttggtggttatatcggcggactggtacctaagctcaaatatgattctaaaagccagtcagaggagcaggaggaacctgcaaagaccgaccaggccgtgtctaaagaccgtaatgctgaggagaagaagagactatcattgcagagggaaaagatcatagcccgcgtctcaatcgataacaggactcgggcacttgtgcaagccctcagacgaactactgaccctaagctctgcataacccgcgtggaggagcttacctttcatctcttggagtttcccgagggaaagggcgtggctgtgaaggagcgcattatcccatacctcctcaggcttagacagattaaggatgagaccttgcaggccgcagtgagagagattctcgcgctgattgggtacgtcgatccagtgaaaggtcggggcataaggatcctatctatcgacgggggcgggaccagaggggtggttgccctgcaaactcttagaaaactggtggaactgacgcagaagccagttcatcaactgttcgactacatctgtggggtgtcgaccggagctattttagcattcatgctgggattgttccacatgccactcgatgaatgcgaagagctgtatcggaaactcggaagcgacgtcttctcacagaacgtcatagttggtacggtaaaaatgtcttggagccatgccttctatgattcacaaacgtgggagaacatcttgaaagatcgtatgggatctgctctgatgatcgagaccgccaggaatccaacatgtcccaaagtggccgccgtgtcaaccatcgtcaataggggcattacccccaaagccttcgtcttcaggaactatggtcactttcctggaataaacagccactatttgggggggtgccagtacaaaatgtggcaggcaattagagcaagtagtgccgcacccggctacttcgctgagtacgcactcggaaacgacctgcaccaagatggcggcctcctcctcaacaatccatccgcccttgccatgcatgagtgtaagtgtctttggccggacgtgcctctggagtgcatagtgtcactcggcactggccggtatgaaagtgacgtaagaaatactgtcacatatactagtctgaaaaccaagctgagtaatgtcatcaattccgcgaccgataccgaggaagttcacataatgctggacggcctccttcctccagacacctacttccggtttaatccagtaatgtgcgagaatatccccctagacgagagtcgaaacgaaaagctcgaccagctgcagctggagggtcttaaatacattgaaaggaacgagcagaaaatgaaaaaagttgccaaaatcctgtcccaggaaaaaacgactctgcagaagattaatgactggataaagcttaagacggatatgtatgagggcttgccgttcttcagtaaactctag

SEQ ID NO: 127961 - DNA, 2163 bp, Artificial Sequence
  Description of Artificial Sequence: Synthetic coding sequence
atgtcgatcaacctaaccgtagacatatacatttacctgctgtcaaacgcccggagcgtgtgcggtaagcagaggtctaagcaactatatttcctgttttcaccaaagcattattggagaatttcccatatcagtctgcaacggggcttccacacaaatatcatacggtgtaagtggacaaagtctgaggcccatagctgtagcaagcattgctactccccttcgaaccatgggctccacattggtattctgaaactgtccacttcagcccccaaaggccttacaaaggtgaatatctgcatgagccggatcaagagcactctgaacagcgtgtcgaaagcagtgttcggaaaccagaatgagatgatttcaagattagcccagtttaagccttcgtcgcagattttaagaaaagtctccgattctggttggttaaaacagaagaatatcaaacaagccatcaagagcctgaagaaatacagcgataaaagtgccgagaagtcccccttccctgaggagaaatcccatattatcgacaaagaggaggacataggtaagagaagcctttttcactacacttcctccataaccacaaaatttggagacagcttctattttctcagcaaccacatcaattcctacttcaagcgcaaggaaaaaatgtcacaacagaaggagaacgagcactttagagataagagcgagctggaggacaaaaaagtcgaagaaggtaagctgcgcagccctgaccccgggattctggcctataagcctggttcagagagcgtgcacaccgtcgataagcccacgtcaccctccgccattcccgacgtgcttcaggtgtctacaaaacagtccattgcgaacttccttagccgacctactgagggtgtgcaggctctcgtcggtggttacataggcgggctcgtgccgaagttaaagtatgactctaaaagccaatctgaagaacaggaagaacccgctaagaccgatcaagcggtctcgaaggaccgcaacgcggaagagaaaaaacgccttagcttacagcgggagaaaattatcgctcgcgtgtctattgacaatcgaacacgagcgttagtacaggcccttaggagaaccactgatcctaaactgtgtattacgcgcgtggaagagttgactttccatcttcttgagttccctgagggcaaaggtgtagcagtaaaggagcggattatcccctacttgctcagactccggcaaataaaggatgagacccttcaggccgccgtaagggaaattttggcactcataggctacgtggatcccgtcaaagggcgcggcattcggattctcagcatcgatggcggcggcacccggggtgttgtggctttgcagacgctacgcaaactggtcgaactgacccagaaacccgtccatcagctcttcgattacatctgtggtgtgagtacaggggccattctggcgtttatgctcggcttattccatatgccactggacgagtgcgaagaactgtatagaaaactggggtccgacgttttcagccagaatgtgattgtaggcacagtcaagatgagttggtcccatgccttttacgatagccagacatgggaaaacatcctcaaagatcgaatggggtctgctcttatgatcgagactgcgcgtaatcctacttgccccaaggttcggaaggacggagggctgctgctcaacaatccgtccgcgctggcaatgcacgagtgtaagtgcctgtggcccgacgtgcccctagagtgcatcgtttcattgggcactggtagatacgaaagcgacgttcggaacacggtaacatacacttctctgaaaacaaaactgtcaaacgttatcaattctgccacagataccgaagaagttcacattatgctcgacgggctgctgccccctgatacttactttcgtttcaaccctgtgatgtgcgaaaatattcctctggatgagtctagaaacgagaagttagatcagctgcaactggagggactcaaatatatcgaacgaaacgaacagaaaatgaaaaaagtggctaaaatcctgtcccaggagaagacgaccctgcagaagataaatgactggattaagctaaaaacagacatgtatgaaggactgcccttctttagtaagctatag

SEQ ID NO: 127962 - DNA, 168 bp, Artificial Sequence
  Description of Artificial Sequence: Synthetic coding sequence
atgagcattaatctgaccgtcgatatctacatctacctgctgagcaacgcccggtctgtctgtgggaagcaacggtcaaaacagctatactttctgttctctccgaaacattattggagaatttcccatataagtctccagcggggcttccacacgaacataatctag

SEQ ID NO: 127963 - DNA, 2349 bp, Artificial Sequence
  Description of Artificial Sequence: Synthetic coding sequence
atgtccattaacctaaccgttgatatctacatctatttacttagtaacgcccggagcgtgtgcggtaagcagaggtctaaacagctttattttctattctcccctaagcactactggcgcattagccacatctcactccaacgaggcttccacacaaacattatcaggtgcaagtggactaaatcagaagcgcactcatgctcaaagcactgttactctcctagcaatcatggacttcacatcggaatccttaagctgagtacttcggcacccaagggattgaccaaggttaatatctgtatgagtagaatcaaaagcaccttaaattccgtgtcaaaagcagtcttcggaaaccagaacgaaatgatcagcagactggctcaattcaagccatcttcacagattctgagaaaagtgagtgacagtggttggcttaaacaaaagaatatcaagcaggccattaagtctttgaaaaagtatagtgataaatctgcagaaaagtcgccttttccggaagagaagtctcatatcattgacaaggaggaagacatcggcaaacgaagcctgtttcactatacttccagcattaccaccaagtttggcgactcattctactttctgtctaatcacataaactcatactttaaaagaaaagaaaaaatgtcgcaacaaaaggagaatgagcacttccgagataagtctgagctagaggataagaaggttgaagaagggaaactcagatcaccagaccctggaattctggcctacaagcccgggtccgagtccgtgcacacagtggataaaccaacctcaccctctgccatccctgacgttttgcaggtgtcaaccaagcagagtattgccaactttctgtcccggccaacagagggagtccaggccctggtggggggttacattggagggctggtccctaagcttaagtacgattctaaatctcagtctgaggagcaggaagagcctgccaaaactgatcaggcagtttcaaaggacaggaacgcagaggagaagaagaggttgagcttgcaaagagagaaaataattgccagggtgtcaatcgataatcgcacccgggctttggtgcaagcacttcgacgaacaaccgaccccaagttgtgcattactagagtggaggagctcaccttccacctgttagagttccctgaaggtaagggagtcgccgttaaggagcggatcatcccctacctcctgaggttgaggcagatcaaggacgagactttacaggccgccgtacgtgagatactggctcttatcggatatgttgatcctgtgaaaggccggggaattcgcatcctgtctatcgacggagggggaacccgtggtgtcgttgcacttcagacgctgaggaaattagtagagcttacacagaagccagtgcatcagttattcgattacatctgcggagtctccactggtgccatcttagcattcatgctcggcttattccacatgcccttggacgagtgcgaggaactttatagaaaattggggagcgacgtcttctcccagaacgtcatcgtgggaactgtgaaaatgtcctggtctcacgcattctacgactctcagacttgggagaacatactgaaggatagaatggggtctgcgctcatgatcgaaacagctagaaacccgacatgtcccaaggtagcggctgtctccacaatcgtcaatcggggtatcacccctaaggcttttgtctttaggaattacggacattttccaggaataaattcacactatttaggcggctgccagtacaagatgtggcaggccatcagggctagctctgccgctccaggttatttcgcggaatacgctctgggcaatgatctccaccaggatggaggcttgctgttgaataacccatccgccttggctatgcacgaatgcaaatgtctgtggcctgacgttccactggagtgcattgtttctcttgggacaggacgttatgagtcggatgtccggaatacagtgacctataccagcctgaagacaaagttatccaatgtcatcaatagcgccaccgacaccgaagaggtgcacatcatgctggacgggctgctgcctccggacacgtacttccggttcaacccagtgatgtgcgagaatatacctcttgatgaatcaagaaatgaaaaattggaccaattgcaactggaaggcctaaagtatatagaacggaatgaacagaagatgaagaaggtggcaaagatactcagtcaggagaagactacgcttcagaagataaacgattggatcaaattgaaaaccgacatgtatgaagggctcccctttttctcaaaactctag

SEQ ID NO: 127964 - DNA, 582 bp, Artificial Sequence
  Description of Artificial Sequence: Synthetic coding sequence
atgtccatcaacctaactgtggacatctacatatatctcctctcaaatgcacgcagcgtgtgtggcaagcagcggtccaagcaactgtattttcttttttcccctaagcattactggcgcatctctcacatttcccttcagagaggcttccacacaaacatcatcaggtgtaaatggacgaaatcggaggcgcattcatgctcaaaacattgctactcaccttctaatcacgggttgcatataggtatcctgaagctgtcaacgagcgcacctaagggactcactaaggtgaacatttgtatgtccagaataaagagcactctaaattccgtttcgaaggcggtcttcggcaatcaaaatgaaatgattagcagacttgcacagtttaagccaagttctcaaattctgcgcaaagtgtcagacagcgggtggctcaagcagaagaatatcaagcaggcgatcaaaagcctgaagaaatatagcgataagtcagcggagaaatcccctttccccgaagagaaatcacacatcatcgataaagaggaggatattggcaaacggagcttgtttcattacacttag

SEQ ID NO: 127965 - DNA, 2349 bp, Artificial Sequence
  Description of Artificial Sequence: Synthetic coding sequence
atgagcatcaacctgaccgtagacatctatatctatctcctgtcaaatgcacgcagcgtctgtggtaagcagaggagtaagcaattgtattttttgtttagccccaaacactactggaggatctctcacatatctctccagagaggttttcataccaacatcatacgctgcaagtggacaaagtccgaggctcactcctgctcaaagcactgttactcccctagcaatcacgggctgcatattggcatactgaaattatccacatcggcccctaagggcctgacaaaggtcaatatttgcatgtcccgcatcaaatcaaccctaaattccgtgagtaaagcagtgtttgggaatcaaaacgagatgataagcagactggctcagttcaagcccagtagccagatactccgaaaagtctccgactctggctggctcaaacagaagaacatcaagcaagccataaaatcactgaagaagtattctgacaagtctgctgagaagtccccgtttcccgaggagaaaagtcacataatcgacaaggaagaagatattgggaaacggagcttatttcactacaccagcagcatcactactaaattcggcgactcgttttactttctctcaaaccatataaacagctacttcaagaggaaggagaagatgtcacagcagaaggaaaacgagcacttccgtgacaaatctgagctcgaagataaaaaagtggaggaggggaagttgcggtctcccgatccagggatcctggcctataagcccggatctgagagcgtgcataccgtcgacaagcccactagtccatccgcaatcccggacgtcctccaggtgagcacaaaacagtcgattgcaaatttcctgtcaagaccaaccgagggcgtccaagctcttgtaggagggtatattggaggattggtccccaagttgaagtatgattcaaaatcacaatccgaagaacaagaagagccagccaagacagatcaagctgtgagtaaggatagaaacgcggaagagaaaaagcgactcagtctccagagggaaaaaatcattgctcgtgtgagtatcgataacagaacgagagcgttggttcaggcactgaggcgtaccacagatcctaaattatgtattacgagggtggaggaattgacatttcacctactcgagtttcccgaagggaaaggagtcgctgtgaaggaacggatcattccttatctgctgaggctgcgccagatcaaagacgaaacactgcaggctgctgtacgcgagattctggccctgatcggctacgtcgaccccgtcaagggacgagggattcgcatcctatctatagacgggggcgggacaaggggggttgtggccctgcagacgctgcgcaagctggtggaactgacacagaaaccagtgcaccaactgttcgactatatctgcggcgtctccaccggcgccatcctagcttttatgctgggtctgtttcatatgccattggatgaatgcgaggaattatatcgcaaattgggaagcgatgtgttcagccagaacgtcattgtgggtactgtaaaaatgtcatggtcacatgctttttacgattcacagacttgggagaacatcttgaaagatcgaatgggcagtgcccttatgattgagactgcacggaacccaacctgtcccaaggtcgccgctgtgagcaccatcgtgaatcgtggcatcacccccaaggcctttgtatttcgaaactatgggcattttcccgggatcaacagccattacctgggcggatgccagtataaaatgtggcaggctattagagcgagttctgcagcccccggttattttgctgagtacgcgcttggtaacgatctgcaccaggacggtggattgctgctcaacaatccttccgctctcgcaatgcacgaatgtaaatgcctttggcctgatgtccccctggagtgtatagtatccctgggaaccggccgttacgaatctgatgtcaggaacaccgtcacctataccagtttgaaaacaaagctctctaatgtgataaactcagccacagacacagaggaagtccatatcatgctggatggcctcctcccaccagatacatatttcaggtttaatccggtaatgtgtgagaacatcccgctggatgagagtaggaacgagaagctcgaccagctgcaattagaggggctaaagtacattgaacgtaacgaacaaaagatgaaaaaggtggctaaaatcttgagtcaagagaaaactaccctccagaagatcaacgattggattaaactgaagaccgatatgtatgagggattgccgtttttttctaagctctag

SEQ ID NO: 127966 - DNA, 2154 bp, Artificial Sequence
  Description of Artificial Sequence: Synthetic coding sequence
atgtccattaacctgactgtggatatttatatctacttgctctcaaatgcgcgctccgtgtgtggcaaacaacggagcaagcaactctacttcctgttcagtccaaaacactattggaggatctctcatattagtcttcagcgaggatttcatacgaatattattaggtgcaagtggacaaagtcagaggctcacagctgctccaagcattgttacagtcctagtaaccatgggctgcatatcggcatactaaaattaagcactagtgcccctaaagggctgaccaaagtcaacatctgtatgagcagaatcaagtctactctgaattccgtttctaaggcagtctttggaaaccagaacgagatgatttctaggttagcccaatttaaaccctcttcacagattctcagaaaggtcagcgactcaggctggcttaaacaaaagaacataaagcaggctatcaaatcgcttaagaaatacagcgacaagagcgctgaaaagagtcccttcccggaggagaaatcgcatatcatcgacaaagaggaggatatcggaaagagatcgttgtttcattatacatcctctatcacgacgaagttcggtgacagtttttatttcctctcaaatcatattaacagctacttcaagaggaaggagaaaatgtcgcagcaaaaggagaacgaacactttcgggataaaagcgaactagaagataaaaaggttgaggagggcaagctgcgatcacccgatcccggtattctcgcctacaaaccagggtctgaatcagtgcacacggtagataagcctaccagcccatccgccatccccgacgtgctgcaagtgagcacaaagcagtcaatcgcaaactttctgtcccgacctacagagggtgtgcaagccctggtcgggggatacatcggcgggttggtccctaagctgaaatacgattcgaagagtcaaagtgaggaacaggaggaaccagctaaaacagaccaagctgtatcgaaggataggaacgcggaagaaaaaaaaaggctctctctgcagcgggaaaagatcatcgcaagagtctccattgataacagaactcgcgccctcgtccaagcactgagaagaactacggacccaaagctgtgcatcacaagagttgaggagctaaccttccacctgctggagttcccagagggcaagggcgttgcggtgaaagaacggatcatcccttaccttctcaggctgaggcagattaaggacgaaacactgcaggctgctgttagagagattctagcgctgattggctacgtggaccctgttaaggggcgcgggatccgaattttgtcaattgacggtggaggaaccagaggagtggttgctcttcagacactgaggaaattggtggagctaacacagaaacccgtgcatcaattatttgactacatttgcggagtgagcacaggtgccatcttggcattcatgctcggactatttcatatgcccctcgatgagtgcgaggagttataccggaagttgggaagcgacgtgttctcccagaacgtcatcgtgggaactgtcaagatgtcatggtctcacgctttctacgacagccaaacgtgggaaaatatcctgaaagatagaatgggtagcgctcttatgatagaaacagccaggaatcccacttgtcctaaggacggagggctgctgttaaataatcctagcgcactggccatgcatgagtgcaagtgcctgtggccagatgtccctctggagtgcatcgtgtctcttggaactggccgctatgaaagcgatgtcagaaacactgtaacttacacatcactgaaaaccaaattgtccaacgtgatcaactcggccactgacacagaggaagtccatatcatgttggatggacttctgccccctgacacatattttcgattcaacccagtaatgtgcgaaaacatcccactcgacgaaagtcgaaacgagaaactggatcagctgcagctggagggcctgaaatacatagagagaaatgagcagaagatgaaaaaagtggccaaaattctttcacaggagaagacaactttgcaaaagatcaacgattggatcaagctcaaaacagacatgtacgaaggactgcctttctttagcaagctgtag

SEQ ID NO: 127967 - DNA, 2049 bp, Artificial Sequence
  Description of Artificial Sequence: Synthetic coding sequence
atgtcccggatcaagtctactctaaattctgtatcaaaggccgtgtttggaaatcagaacgaaatgatcagcagactagcccagtttaagccgtcttcccagatcctgaggaaggttagcgattcaggatggttaaagcagaagaatatcaaacaggctattaaaagtctgaagaagtattccgacaaatctgctgaaaagagtccatttccagaagagaagtcccatattattgataaggaagaagatataggtaagcgcagcctatttcactacacctcttctatcacaactaagttcggggattccttctacttcctgtccaatcacattaatagttacttcaaaaggaaagagaaaatgtcccagcagaaagagaatgaacatttccgagataaaagcgaattggaggataagaaggtggaagaaggtaaactgagatcccctgatcccggaatcctcgcctacaagccaggaagtgaatctgtgcatacagtggacaagcctactagtccttccgctattcctgacgttctccaagtgtcaactaagcagtctatcgcaaacttcttatctcgacccaccgaaggtgtccaggctctagttggcggatatatcggaggtctggtgcctaagcttaaatacgacagcaaatctcagagcgaggagcaagaggagcccgccaagaccgatcaagcagtgagcaaggacaggaatgctgaagaaaagaagcgcctctcgctgcagcgagaaaaaatcatcgcacgcgtgagcatagacaacaggacccgtgccctggtgcaggctctgcgccggacaactgatcccaaactgtgtatcacacgtgtggaggagctgacctttcacctcttggagtttcctgaaggtaaaggagtggctgtaaaggagagaatcatcccctacctgctgagactccgacaaatcaaagatgaaacattacaggctgctgtgagggagatattggccttaataggatacgtcgaccccgtcaagggacggggaattagaatactgtcaatcgatgggggcgggaccaggggagttgtcgcactccagaccttacgcaagctggtggaactgacccagaagccggtccaccagttgtttgattatatctgcggcgtcagtacaggggccattttagctttcatgttagggctctttcacatgcctttggacgagtgcgaagagctgtaccgcaagcttggcagcgatgttttcagccaaaacgtgattgtcggaaccgtgaaaatgagctggtcccatgccttttatgattcacagacatgggagaacatacttaaggaccgaatggggagcgcactgatgatcgagacagccaggaacccaacttgtcccaaggtggccgctgtctcaaccatcgtgaatcggggcatcacacctaaagcctttgtgtttcggaattatgggcatttccccggtatcaatagtcactatctgggcggctgccagtataaaatgtggcaagcgattagggcaagttcagcggcccctggatattttgccgagtatgccctggggaatgacctccaccaagatggaggacttctgcttaataatccaagcgccttagcaatgcatgagtgcaagtgtctgtggcccgatgtgcctctggagtgcatcgtgagcctggggacaggtaggtacgagagcgatgtgagaaatactgtcacctacacctctctgaaaactaagctttccaacgttattaacagcgccactgatactgaagaggtgcacattatgctcgacggactgctgcccccagacacatacttcagattcaatcccgtgatgtgcgagaacatacccctggacgagagtcgtaacgagaagctggatcagctgcagctggagggcctgaagtacattgagaggaacgaacagaaaatgaaaaaggtggcgaagatactaagtcaagagaaaacaaccttacaaaagatcaatgattggatcaagctgaaaaccgacatgtacgagggcctgcccttcttcagtaaactgtag

SEQ ID NO: 127968 - DNA, 3612 bp, Artificial Sequence
  Description of Artificial Sequence: Synthetic coding sequence
atgactaggagcccccccctgcgagaactccctcctagttacacacctcccgcccggactgcagcccctcaaatcctggccggtagtctaaaggctccattatggcttagggcctactttcaggggctcttgttcagtttgggatgtgggattcagaggcattgcggcaaggtgctgttccttggtctgcttgcctttggcgcccttgccctgggcctcagaatggcaattatagaaactaatctcgagcagttgtgggtagaagttggaagccgtgtgtcgcaggagttacattatacgaaagaaaagttaggggaagaggccgcgtacacatcacagatgctcattcagaccgcacgccaagaaggtgagaatattctgacacccgaggcactgggcttacatctccaggcagccctcacggcttccaaggtccaggtttcgctgtatgggaaaagctgggacctgaataaaatatgctacaaatccggagtgccgctgatcgagaatgggatgattgagcgcatgatcgagaagcttttcccatgtgtgatcctcacgcctcttgattgcttctgggaaggcgctaaactgcaaggaggatccgcctatctgccagggcgtcctgacatccaatggacgaatttggatccagaacagctgttggaggagttggggccattcgctagtttggaaggctttagggaactcctggacaaggctcaggtgggacaggcctacgtgggccgtccatgtctgcatcctgatgacttgcattgtcccccatctgccccaaaccatcattcaaggcaggcacctaatgtcgcacacgagctcagcggagggtgccatggatttagccacaaatttatgcattggcaggaagagctgcttctgggtggaatggccagggacccccaaggggagctcctacgtgccgaggccctgcaatcaacgttcctcctcatgtctcctcgtcagctttacgagcattttcggggtgattatcaaacgcatgacatcggatggagcgaagagcaggcctcaaccgttttgcaggcctggcaaaggcggtttgtccagcttgcccaggaggccctgcccgaaaacgcaagccaacaaattcacgcatttagttccaccacattagacgacatcttgcatgccttcagcgaggtctctgcagcccgagtggtgggcggctatctgctgatgctcgcctacgcttgtgtcactatgctgcgttgggactgtgctcagtctcaggggagcgtcggactggccggcgtgctgctggttgccctcgccgtagcttccggattaggtctttgcgccttgctcggaatcactttcaatgccgctacgacgcaggtcctcccatttctggccctcgggatcggggttgacgacgttttcttactggcgcacgcatttactgaagctcttccaggcacccctttacaggaaagaatgggtgagtgtttacagcgaaccggaacctcagtagtcttgaccagcattaataatatggcagcattcctcatggctgcactcgtccctattccagcgctgcgggcattctcgctccaagccgcaattgtggttggctgcacttttgtagccgtgatgctggtctttcccgccatcctgtcactggacctccgtagacgtcactgccagcgcctcgacgtgctgtgttgcttcagtagcccttgcagcgctcaggtgatccaaattctgccccaagaattaggtgacggcactgtgccagtcggcatagcgcatttaactgccactgtccaggcctttacacactgcgaggcctcctcacagcacgtggtgacaattctcccaccgcaggcgcacctcgtgccccccccctccgacccactcgggtctgagctgttcagtcctggcgggagcacccgggacctgcttggtcaggaagaggagacccggcagaaggccgcatgtaagagcctcccgtgcgcccggtggaacctcgcccacttcgctagatatcagttcgcccccttactgctgcaatcacacgcgaaggccatcgtgctcgtcctttttggagctctgttgggactctccctgtacggggccacgctcgtgcaggacggactcgcgctgacagacgtcgtgccccggggtactaaagaacatgccttcctctccgctcaactgcgatattttagtttatatgaggtggccttggttacccagggcgggttcgactatgcgcactcccaaagggccttgttcgatctccatcagaggtttagttccctgaaagctgttctgccacccccagccactcaggcacctcggacttggttgcattactacagaaattggctccaaggcatccaagccgctttcgaccaggactgggccagcggcaggatcaccagacacagctacagaaatggctccgaggacggcgccttagcttacaaattactgattcaaaccggggacgcgcaggagcccttagacttttcccagctgacaacccggaagctggtggaccgcgaaggactcatccccccggagctcttttacatggggctcaccgtttgggtgtcgagcgaccccttgggcttggccgcttcccaggccaatttttatcctccaccacctgaatggctgcacgacaaatacgatactactggagaaaacttacgcatacctccagcacagcccctggaattcgctcagtttccgttcctcctgagaggccttcaaaagacagcggattttgtcgaggctattgagggcgccagggccgcttgtgcagaggcagggcaagccggtgtgcatgcttacccttctgggtcacccttcctgttctgggagcagtacctgggcctccgccggtgcttcctgctggctgtgtgcatcctgctcgtctgcacgttcctagtgtgtgccttactgctgctcaatccctggacagctggcctcattgtgctcgttctcgccatgatgacagtggagctctttggcattatgggctttctggggattaaactgtcagccattccggtggttatactggtggcctctgtgggcattggcgttgaattcaccgttcacgtagcacttggctttttaacaacgcaggggtcacgtaatctgcgggccgcccatgcgctggaacatacctttgccccggtgaccgacggcgccatatccacactgttgggcctgctaatgctagctggtagtcatttcgactttattgttaggtacttcttcgcagcactgactgtgctcacgctgttgggcctgctgcatggtctggtgctactccctgtgctgttaagcatactcgggccccctcctgaagtcattcagatgtacaaagaatctccagagatcctgtctccgcccgcccctcaaggcggtggtctgaggtggggagcatcaagcagtttgccccagtcatttgctcgagtgacaaccagcatgactgtggctatccatccccctcccctgcccggggcttatatccatcctgcccctgatgagcctccttggtctccagccgctacatcttctggtaatttgtctagtaggggcccagggcctgcaaccggatag

SEQ ID NO: 127969 - DNA, 267 bp, Artificial Sequence
  Description of Artificial Sequence: Synthetic coding sequence
tagttcgactttattgtgcggtatttttttgctgctctgaccgtccttacccttctgggtctgctccatggtctcgttctgctgccggtcttgcttagcattctgggcccaccgcctgaggtgattcagatgtacaaggaatcacctgagattcttagccctcctgcccctcagggaggaggtcttagggtgggctctctgcaagttaatatctcgtattggaaggagctgctctggtgccaagatctccgacccgaagaaatatag

SEQ ID NO: 127970 - DNA, 3441 bp, Artificial Sequence
  Description of Artificial Sequence: Synthetic coding sequence
atgactaggtctccccccctgagagagcttcctccatcctacacgcctcctgcccgaactgccgctccacagatcctcgccggaagcctgaaggcgcccctatggctgcgtgcttacttccaaggtctgctcttctccttggggtgtggcatccagcgccattgtggcaaggtgctctttctgggattgctggcatttggcgcactcgcactgggattgcgcatggcaatcatcgagactaacctggaacagctctgggtcgaagtgggctcacgcgtgagccaggagctgcattacaccaaggaaaaacttggggaagaggccgcttacactagtcaaatgctgatacaaaccgcccgccaggagggcgagaatatccttacgcccgaggcccttggcctccacctccaggcggcgctgacggccagcaaggtccaggtgtccctgtacggcaagagttgggacctaaataagatctgctataagtcgggagtgccgctgatcgaaaacggcatgatcgaaaggatgatcgagaaactttttccatgcgtcatcttgacacctttggattgcttttgggagggggccaaactccagggcgggtctgcctacctgcctgggcggcccgacattcagtggaccaacctggatcccgagcagctcttggaggagctcggcccctttgctagccttgaaggctttagggaactcttagacaaagcccaagtcgggcaggcttatgtgggccgcccctgtttacatcctgacgacctgcattgtccaccatccgctccgaatcaccattcaaggcaggcacccaacgtggcacacgagctgtcaggcggctgccacggattttctcataagttcatgcattggcaagaggaactgctcctaggcgggatggcccgcgatcctcagggtgagttgctgcgtgcggaggcattgcaatccactttcctgctgatgtcaccaaggcagctctatgaacactttaggggagactaccaaacgcacgatatcgggtggagtgaagagcaggcatcaactgtcctacaggcctggcagaggcggttcgtgcagctcgcgcaagaagccctgccagagaatgcttcccaacagattcacgcattcagctccaccactctggatgacatcctccacgcttttagtgaagtctccgcagccagagtggtgggaggatacttgctcatgcttgcttacgcttgtgtgaccatgcttcgctgggattgtgcacagagtcagggatctgttgggttagcgggcgtattactggttgccctggcagtggcttctggcctaggcctgtgtgcactgttaggcatcacgttcaatgcggcgactacccaggtgctgccgtttctggcccttgggatcggggtggatgatgtcttcctgctcgctcacgcattcaccgaggctttgcctggtacccccttgcaggagaggatgggggagtgcctccaacgtacagggacctctgtggtgcttactagcatcaataatatggccgctttccttatggctgccctcgttcctatccccgctctgcgcgcattctcgcttcaggcggctatagtggtcggctgtacatttgtggcggtaatgcttgtctttcccgctatcttgtccctcgaccttcgtaggcggcattgccagaggctggatgtcctgtgctgtttcagcagtccttgctctgcccaggtgatacagatactcccccaagagctcggtgatgggacagtgccggtcggaatcgctcatcttacagctactgtccaggcttttactcactgcgaagcctcatctcagcacgttgtgacgatattacccccacaagctcacttggtcccacccccgagcgatcctcttgggtcagaattgttctctcctggaggctcaacacgtgacctcttgggtcaagaggaagagacaaggcagaaagcggcatgcaaatccctgccttgtgccaggtggaatctggctcatttcgcacgataccagttcgcccctttgctgctgcaaagccacgcgaaagctatagtattggtgttgtttggagccttgctcggcctaagtttgtacggtgcgaccctggtgcaggacggtctggctcttaccgacgttgtgcctcgcggtacaaaagagcacgccttccttagtgctcagttgcgctatttcagtctgtacgaggtggcactggttacccagggagggttcgattacgctcacagtcagagggcattgttcgatctccaccagcgattcagctccctaaaagccgtgttgccacctcctgccacccaggctcctaggacctggctgcactactataggaactggcttcaggggattcaagccgcattcgatcaggactgggccagtggacggattaccaggcactcttacaggaacggatcggaagatggcgctctagcctacaaactgctcatccagacaggggatgctcaggaaccactggatttcagccagcttacgactcgaaagttggtggacagagaagggcttatcccgccagagttgttctatatgggcctcactgtctgggtttccagcgatcccctcgggcttgccgcaagccaggcgaacttttacccaccaccccctgaatggctccatgacaaatacgacaccacaggggagaatctccgcatcccacccgcccagccactcgagtttgctcagtttccgtttctgctgaggggactgcaaaaaacagcggatttcgtggaggctatcgaaggggctcgcgccgcctgcgccgaggctggccaggctggtgtccatgcatatccctccgggtccccctttttgttttgggagcagtacttgggactccggagatgctttctgctggccgtctgtattcttctggtgtgtacttttctcgtttgtgcgttgctgttgttgaacccttggaccgctggcctcattgtactcgtgctggccatgatgacagtcgaattattcggaatcatgggctttctggggataaaactgtccgctattccggtggtgatcctcgtggcctcagtgggcatcggggtggaattcacagtgcatgtcgctttaggatttttgaccacacagggctccagaaacctgagggctgcgcacgcactggaacacacgtttgcacccgttaccgacggggctatatctaccctcctgggattgttgatgctcgccggttcccactttgacttcattgtaaggtacttctttgctgcgcttaccgtcctgactttgctggggctgttgcacgggcttgtcctccttcctgttctcctgagcatcctgggcccgccccccgaggtgattcagatgtacaaagaatctccggaaattctcagccctcccgcacctcagggcggggggctgcgacccgaggaaatatag

SEQ ID NO: 127971 - DNA, 2667 bp, Artificial Sequence
  Description of Artificial Sequence: Synthetic coding sequence
atgctccggcaggtactgcacagaggacttagaacgtgtttctctaggctgggtcacttcattgccagccaccccgtctttttcgctagcgcccctgtgcttatatccattctgctgggggcatcgtttagtcggtaccaggtggaggagtcggtagagcatctcctggccccacagcacagtttggcaaagatagagcgaaacctcgttaattcgctctttccggtgaaccggagtaagcatcggctgtactcagacctgcagacacccggcaggtatggacgcgtgatcgttacttccttccagaaggccaatatgcttgaccagcatcacacggatttgattctgaagctccatgccgccgttacaaagattcaggtcccccgccctggcttcaactacacatttgctcacatctgtattctcaataatgacaaaacctgtatcgttgacgatattgtgcatgtgctcgaagagctgaagaacgccagggcaactaaccggactaacttcgcgatcacctatcccataacacatctaaaggatggaagggctgtctataatgggcatcagcttggaggagtgaccgtgcatagtaaggatagggtaaaatcagccgaggccattcagttgacttactacctacagagtattaacagcctcaatgatatggttgcggagaggtgggaatcttccttctgcgacacagtacgcctcttccagaaaagtaactccaaagtaaagatgtacccgtacacgtcatcttctctgcgggaggacttccagaaaacttctcgagtcagtgagagatatctggtaactagcttgatcttagtcgtgacaatggccatcttgtgttgtagtatgcaggattgtgtgagatctaagccatggctcggactgctgggactggtgacaatttcactggctactcttacggctgcaggtattatcaacctgactggggggaaatataacagtactttcctgggtgtgccctttgttatgcttggccacgggctgtatggcactttcgagatgctcagtagctggcgaaagacacgggaggaccagcacgtgaaggagcgcacggctgcagtgtatgccgactcgatgttatccttctccttaaccacagccatgtatctggttacgttcggcatcggggcctccccttttactaacatcgaagcagcccggatcttctgctgcaactcctgcatcgcaatcttctttaactacctttacgtgcttagcttctacggatcgagccttgtcttcaccggctacattgagaataactatcagcactctatcttttgccgcaaggttcccaagccagaggcgctccaggaaaagccggcctggtatcgtttcctgctcaccgccagattcagcgaggacactgccgagggcgaggaagccaatacttacgagtctcatctgctggtctgcttcctgaaacggtactattgcgactggatcaccaacacttatgttaaacccttcgtggtgctgttctatcttatctacatcagttttgccctgatgggctacctgcaagtgtctgaggggtccgatctcagtaatatcgtcgcgactgctacccagaccatcgagtatacaactgcccagcagaaatacttcagcaactactcccccgtcattggattctatatatatgagtcaatcgaatactggaacacgtcagtccaggaagacgttttggaatataccaagggattcgtgcggatctcttggttcgagagctatctaaactacctgcggaagttaaatgtgagtacaggtttgcctaaaaagaacttcacagatatgctgagaaacagctttctcaaagcacctcaattctcccatttccaggaggacattatcttttcaaaaaagtataatgatgaggtcgacgtggtggctagccggatgtttttggtggctaagaccatggaaacgaaccgtgaggagctttacgaccttctagaaacactcagacgtctgtcagtcacctcgaaagttaagttcattgtgttcaatccctccttcgtctacatggacaggtacgcatcttctctgggagcccccctgcacaactcctgcatttccgccctgttcctgttgtttttctctgctttcctggtagccgatagcctgattaacgtctggattacactgaccgtggtttctgtggagttcggagtgattggattcatgactctctggaaggtggaattggattgtatttctgtcctgtgccttatctacgggatcaactacacaatcgacaattgtgccccgatgctatcaacattcgtccttggtaaagattttacccgcactaagtgggtaaaaaacgcactggaagtccacggagtcgctattcttcagagctatctgtgctacattgtaggcctcatccccttagctgcggtaccttccaacctgacatgtactttgtttcggtgtttgttcctgattgcttttgtgacattcttccactgtttcgcgatcttgcccgtgattctgacatttctccctcctagcaagaaaaagcgcaaagagaagaagaaccctgaaaatagagaagaaattgaatgtgtggagatggtcgacatcgattcaacacgcgtcgtggatcagatcacgaccgtttag

SEQ ID NO: 127972 - DNA, 4179 bp, Artificial Sequence
  Description of Artificial Sequence: Synthetic coding sequence
atggatactgaggacgacccattactccaggatgtctggctggaggaggaacaggaggaggaggaagcaaccggagagacattcttgggcgctcagaaaccaggaccccagccaggggccggtggacagtgttgttggcggcactggcctttagcgagcagaccccccgcgagtggcttttggtctaccctgggctgggccttcacaaacccttgctgcgcagggctagtcctctttcttggatgctctattcctatggcgctgtccgcattcatgtttctttactacccacccctcgacattgacatctcatataacgcttttgaaataagaaatcacgaggcaagtcagaggtttgacgcactcacattagcccttaagtcacaatttggttcatggggccggaataggcgcgatctcgctgacttcacaagcgagactctccagcggcttatctccgagcagcttcaacagttgcatcttggaaatagatctagacaggcctctcgagcaccacgcgtgattcccgcagcctccctgggagggcctgggccatatcgagataccagcgctgctcagaagcccacagctaatcgcagtggacgtctgcggcgggaaaccccccccctggaggaccttgcggcgaaccaaagtgaggatcccagaaaccaacggctctcgaaaaacggtaggtaccagccatcaatcccaccacatgccgcagttgctgctaatcagtcccgcgctcgacggggggcttcgcgctgggattacagccgggcctatgtcagtgcaaacacccaaacccacgctcactggagaattgagctcatcttcctcgcgagaggtgacgctgagaggaatatatttaccagtgaacgactggtgaccattcatgaaatagaaaggaagattatggaccaccccggtttccgcgagttctgctggaagcctcatgaggtgctcaaagacctgccacttggatcatactcatactgttctccccctagtagcctcatgacatacttcttcccaaccgagaggggcggtaaaatctactacgacggcatgggtcaggatttggccgacattagagggagtcttgaattagccatgacacatcccgagttctactggtacgtagacgaaggactgtcagcagataacttgaagtccagcctgttgcgctctgagattctgttcggagctccgctgccaaattactactcggttgacgacaggtgggaagagcaacgcgcgaaatttcagagctttgtggtaacatacgtcgcaatgctggccaagcaaagcacttccaaggtacaagtattatacggaggcacggacctctttgattacgaggtacgaaggaccttcaacaatgatatgttgttggctttcatttcttcatcatgtatcgctgctcttgtgtatatcctgacgtcctgttcagtctttctttccttctttgggatcgcatccattgggctgtcctgcctagtggcacttttcttgtatcacgtggtgttcggaatccaatatctcgggatcttgaacggggttgccgccttcgtcattgtcgggataggcgtcgacgatgtctttgtcttcattaacacctacagacaggctacgcatctggaagatccccaactgagaatgattcataccgtgcaaactgcaggtaaggcgaccttctttacctcgcttactaccgccgctgcctacgccgccaacgtgtttagtcagattcctgccgtgcatgacttcggcttatttatgagcctgatcgtatcgtgctgttggctggctgtactggtcactatgccagccgcactgggcctctggtctctgtacctcgcccccctcgaatcttcctgccagactagttgtcatcaaaattgcagcaggaaaactagtctgcatttcccaggggatgtatttgccgctcccgaacaggtcggtgggtcaccagcccagggacctataccgtatcttgatgacgatattcccctgttggaagtggaggaggaacccgtgagtctcgagctcggagatgtgtccctggtctcggtgtctcccgagggcctgcagcctgcctcaaacactgggtcccgcggccatctgatcgtgcagttgcaggaactcctgcaccactgggtattgtggtccgccgtcaagagccgttgggtgatcgtaggcctgttcgtttcaattttaattctgtctctcgtgtttgccagtaggctgcgcccagcgtccagagcaccgctgctgttccggccagatacaaacatccaggtgctcctcgacctgaagtacaacttaagcgcagagggcatttcttgcataacatgctcagggctgtttcaggaaaagccacacagtctgcagaacaacattaggaccagcttggagaaaaaaagaagggggagcggggtgccatgggccagccggcccgaagccactcttcaggattttcctggcacagtttacatcagtaaagttaagtcccaggggcacccagcagtgtaccgcttgagtctcaacgcttctctccccgccccctggcaggctgtgtcccctggtgacggcgaggttccttccttccaagtgtatcgcgcaccgtttggcaactttaccaaaaagctgactgcctgcatgtccaccgtagggctactgcaggccgctagccccagcaggaaatggatgctgacaacactggcttgcgacgccaaacgaggctggaagtttgatttctcgttctatgtggctaccaaggaacagcagcacaccagaaagctctattttgcccagtctcacaagccaccattccatgggagggtctgtatggcaccaccgggatgtctgttgtcctcctcccccgatggacccactaagggtttcttcttcgtaccgtcagaaaaagttcccaaggcccggctttccgctacattcggattcaatccctgtgtgaacactgggtgtggaaaacccgcagtacgccctctagtcgataccggtgccatggtttttgtggtctttgggataatcggcgtaaatcggaccaggcaagtcgataatcatgttatcggagaccctggtagcgtagtatacgattctagcttcgacttgtttaaggagattgggcacctgtgccatctgtgtaaagctattgcggcgaattcagaactggtgaaacccgggggagcccaatgcctccctagcggctacagtatctccagcttcctccagatgttgcatccagaatgcaaggagcttccagagcctaacctgctgccggggcaactttctcacggcgctgtcggggtgagggagggccgggtacagtggatatcaatggcctttgagtccacaacatacaaagggaaatcctccttccaaacctactcggattatctgagatgggagagcttcctgcaacaacagctgcaggctctccccgagggcagcgtcttgaggcggggttttcagacatgcgaacattggaagcagattttcatggaaattgtaggggttcagagtgcactctgcgggctggtgctatccctcctcatctgtgttgcagccgtcgccgtttttactacccacatcctcttgctactgccagttctgttatcaattctcggtatcgtatgcctggtggtgacaatcatgtactggtccggatgggagatgggcgcagtggaagcaatctccctgtcaatactggttgggagttctgtagactattgtgtgcatctggtagaagggtacttgcttgcgggcgagaatctgcctcctcaccaggccgaggacgcccggacccagcgccaatggagaaccttggaggccgtgcgccacgtcggagtggccatcgtgagctccgctctgaccactgtcattgctacagttccactgttcttttgtatcatagcaccatttgccaaattcggcaagatcgttgcccttaatactggcgtgagtatcctctacaccctaacggtctcaaccgcgttgctgggaataatggccccctcttcctttacaaggacgcgtacatccttcctgaaggccctgggtgccgtgctgctggctggcgccctcggactgggagcctgcctcgtgcttctgcagtcggggtataaaattccgctcccggccggagcttcgctgtag

SEQ ID NO: 127973 - DNA, 4179 bp, Artificial Sequence
  Description of Artificial Sequence: Synthetic coding sequence
atggataccgaggatgacccgttactccaggacgtctggcttgaggaggagcaagaagaggaagaggccacaggggaaacattcctgggagcccagaagcccggcccacaacccggcgccgggggtcagtgctgttggcggcattggcctctcgccagccgcccaccagcctcgggcttctggtctactcttggctgggccttcaccaacccttgttgtgccggactcgtgttattcctcgggtgctccatcccaatggcactttccgcttttatgtttctctactacccacccttggacattgacatatcatacaatgcttttgagatcaggaaccatgaggcctcacagaggttcgacgctctgacactggctctcaagtcgcaatttggaagttggggacgcaaccggcgagaccttgccgactttacgagtgaaaccctgcaaagattaatctctgagcagctgcagcaactgcacctggggaatcgaagccggcaggcctcaagagctccacgagtcatcccagccgcctcgctgggagggcccggtccttatcgtgatacctccgctgctcaaaaaccaacagctaaccgcagcggaaggttgcggcgcgagacgcctcccctggaagatttggcagccaaccaatctgaggatccccgtaaccaacggctttccaagaacgggcgatatcagccaagcatacccccccacgctgctgtggcagcgaaccagagccgcgcacgacgcggagctagtagatgggattacagtcgagcttacgtgagtgccaacacacagactcacgcacactggagaatcgagctaattttcctggctcgcggtgacgctgagaggaatatattcactagtgaacgactcgtcactatccacgagatcgaaagaaaaattatggaccacccgggattcagagagttctgctggaagccacatgaggtattgaaagatcttccactgggctcctattcgtactgttctccaccctcgtccttaatgacgtacttcttccccactgagagggggggcaagatctactacgacggaatggggcaggatcttgccgacatccgcggatccctggaactggctatgacacaccctgagttttactggtatgtagatgaaggcctgagcgccgataatttgaagtcaagcttattgcgcagcgagatcctgttcggagctccactgcctaattactattctgtagacgataggtgggaagagcagagagccaagtttcagtcttttgtcgttacatatgtggccatgctcgcaaaacagtcaacatcaaaggtgcaggtgttgtacggggggaccgacttgtttgattacgaagtacgcaggacatttaataatgacatgctgttagctttcatcagttcatcttgtatagccgccttggtatacattctcacttcttgttcagtgtttctcagctttttcggtattgcatccatcgggcttagttgtttggtggcactttttctgtatcatgttgtgtttggcatacagtacctcgggattctgaacggggtcgccgctttcgtgatagtcgggataggtgtggatgacgtttttgtttttattaatacataccggcaggctacccatctagaagatccacagttgcgtatgatccacacagtgcaaactgctggtaaggccactttcttcacttcccttacaaccgctgcagcttacgcggctaacgtcttctcccagataccagccgttcatgactttggtctattcatgtccttaatcgtctcctgctgctggttggccgtgctggttacaatgcccgcagccctcggactgtggtctttataccttgctcccctggagtcgtcctgtcagacaagctgtcatcagaactgttcacggaagaccagcctccattttccaggagacgtatttgccgcacctgaacaggtggggggcagtccagcccagggtccgattccctacctagacgatgacattcctctgctagaggtggaagaggagcccgtgagcctggagcttggggacgtctcactggtcagcgtgagtccagagggcctacagccggcatccaacaccggctcacggggacatctcatagtccagctgcaggagctactgcaccattgggtcctgtggagcgcagtgaagtctcgttgggtaatcgttggactgtttgtcagcatcctgatcctgagtctggtatttgcatcacgattaaggcccgcctctcgtgccccgttgctgttccgcccagatactaacattcaggtccttcttgatctgaagtacaacttatctgcagaagggatcagttgtataacatgcagcggcctcttccaggagaagcctcactccttacagaacaatatcagaacatccctggagaagaagcgccgcggatccggcgtaccttgggcgtcaagaccagaggcgacgttgcaggattttcccggaaccgtgtatatttctaaagtgaaatcccaggggcatcctgccgtctaccgtctcagcttgaacgcgtcactccccgccccatggcaggctgtcagtccgggagatggggaggtgccgtcttttcaggtttaccgcgcgccctttggaaattttaccaaaaagcttacggcatgcatgtcaaccgtaggactgctccaggcggccagccctagcaggaagtggatgcttactacacttgcctgcgatgccaagcgcggctggaaattcgacttttccttctacgtggccaccaaagaacagcagcatactaggaagctgtatttcgcccagagtcacaagcccccgttccatgggagggtgtgtatggctccgcctggatgcctgctcagtagctctcccgacggcccaacaaagggatttttctttgtcccatctgaaaaagttcctaaagcccgcctttcagcgactttcggcttcaatccctgcgtgaatacaggatgcggtaagcccgctgtgagaccactcgtggatactggggccatggtgttcgtagttttcggaataattggtgtgaacagaacaagacaggtagataaccacgtgataggggaccctggatcagtggtttatgattcaagcttcgacctctttaaagagatcggtcacctttgtcacttgtgcaaagcaattgccgcgaattccgagctggtgaaaccaggaggggcgcaatgcctgccttcgggctactccatttcttccttcctgcaaatgttgcatccggagtgcaaagaactgccagagcccaatctcctgccggggcaactcagccatggcgccgtcggggtacgagagggccgagtgcagtggattagcatggccttcgagtctactacatacaaagggaaaagctctttccagacttacagcgattaccttagatgggagagtttccttcagcagcaactccaggccctgccagagggctcggtattgcgtcggggcttccaaacttgtgagcactggaaacagatcttcatggagatcgctggggtgcagagtgctctgtgcggattggttctgtcactgctgatatgcgtcgcagctgtggcagtcttcacgacacatattcttcttctgttacctgttctgctgtcgattctggggatagtctgcttggtagtgactataatgtactggtccgggtgggagatgggagcagtagaagcaatcagtctgtcaatcttagttggctcttcagttgactactgcgtccacttggtagagggttacctgctggccggggaaaacttacctcctcatcaggcagaggacgctaggactcagcgccagtggagaacattagaagcagtccgacacgtgggcgtggcaatcgtctcctcagcgctgacgaccgttatagccactgtcccgctcttcttttgtatcatcgcaccctttgcaaaatttggaaagatcgtggccctgaacacaggggtgtcaatcctgtacaccctcacggtgtcgaccgcgttgctcgggatcatggcccctagcagtttcacacggacccggacatccttccttaaggcactgggggccgtcttactggctggagctctgggactgggtgcctgcctggttctccttcagagcgggtataaaatccccttgcccgccggggcctctctctag

SEQ ID NO: 127974 - DNA, 2304 bp, Artificial Sequence
  Description of Artificial Sequence: Synthetic coding sequence
atgccctgggttgagccaaagcccaggcccgggcctgagcagaaaccgaaactcactaagcccgatagcgccaccggtcctcagtggtaccaggaatcccaggagtcagaatctgagggaaaacagcccccccccggacccctggctcctcctaaaagtccggagccgagtggtccactggcttccgagcaggacgcgcctctacctgagggggacgacgctcccccaagaccaagcatgttggacgatgcccctaggctccctttggaactcgatgacgctcccctcccagaagaagaaacacctgagcctacagcgatctgtaggcacagacatagatgccacacagactgcctagagggactcctcagcagaacctttcagtggttgggatggcaagttggggcgcacccctggatcttcctgttagcacctctgatgctgaccgctgctctcggcacgggctttctctatctccctaaagatgaggaggaggatctcgaagaacactataccccagtcggaagccccgctaaagccgagcggcgattcgtgcagggccacttcacgaccaacgattcctaccggtttagcgcctcaaggcgcagtactgaggcaaatttcgtatcactgcttgtcgtctcttactccgacagcctgttggaccctgccacattcgcagaggtgagcaagctggatggcgccgttcaggaccttcgtgtggctcgcgaaaaggggtcccaaattcaataccagcaggtttgtgcgcggtacagggcgctttgtgtacctccaaaccccatcctctatgcgtggcaggttaacaaaaccttgaacctgtcatcaatcagttttccagcctataaccacggacgccatcctttatatctgacaggattttttggcggctatattctcggcggctccttgggcatggggcagcttctgctgcgggccaaagctatgcgccttctgtactatttgaagaccgaagatccagaatacgacgtccaatccaaacagtggctcacgcacctgttggatcaattcacaaatataaagaatattttggccctaaaaaaaattgaggtggtccactttacaagcctttctagacagttggaatttgaagccacttccgtgactgttatcccagtttttcatctggcgtacatccttatcatcttgtttgcagtcacaagttgcttccgcttcgattgtatccgaaataaaatgtgtgtcgctgccttcggggtgatctcggccttcctcgccgtggtgagcggcttcgggttacttctgcatattggcgtgcctttcgtcatcattgtcgccaattcaccttttctgatcctcggtgtcggcgtcgatgacatgttcataatgattagcgcatggcacaagacaaatttggcagatgatatccgtgagcggatgtcgaatgtttatagcaaagctgcggtgtccattactattacaaccattaccaacatccttgctctttacacagggataatgagctctttccgttcggttcagtgtttttgcatttataccggaatgacacttctgttctgctacttctacaatataacctgtttcggcgcttttatggctctggacggaaaaagggaagtggtctgtctgtgctggctcaagaaggcggatccgaaatggccttcttttaagaaattttgttgctttcccttcgggtctgtaccggatgaacatgggactgatattcaccccataagtttatttttcagggactactttggcccattcctgaccagaagtgaatcaaagtattttgtagtgttcatctatgtcttgtacatcatctcctctatctatgggtgttttcacgtgcaagaggggctcgacctgagaaacctcgcgtctgacgactcatatatcaccccttactttaacgtcgaggaaaattactttagtgattacggcccacgggtcatggtgatcgtgacgaagaaggtggattactgggataaagatgtgaggcagaagctggagaactgtactaagatttttgagaagaacgtatatgtggacaagaacttaacagaattttggctggatgcatatgtacagtacctgaaaggcaacagccaggatcccaacgagaaaaatacgttcatgaacaatatccccgactttctatccaacttcccaaactttcaacatgatataaacatatcttcaagtaacgagatcatctcttcaagaggcttcattcagacgactgatgtgtctagctccgcaaagaagaaaatactactgttttag

SEQ ID NO: 127975 - DNA, 978 bp, Artificial Sequence
  Description of Artificial Sequence: Synthetic coding sequence
atgacggaacgaagacgtgacgagctctctgaggaaatcaacaacctgcgggagaaagtgatgaaacaatcagaggaaaacaacaatctccagtcacaggtccaaaagctaacagaggagaacactacccttagggaacaggtggagccaacacctgaagatgaggatgatgatatagagcttcgtggagccgcagcagccgctgcgcccccccctcctatcgaggaagaatgtcctgaggaccttcccgagaaatttgacggaaatcccgatatgcttgccccattcatggctcaatgtcagattttcatggagaagagtacgcgggacttctccgtcgacagagttagagtgtgtttcgtgacttccatgatgactggacgggccgctagatgggcatctgcaaagctagaacgcagtcattacctcatgcacaattatccggcgtttatgatggagatgaaacacgtatttgaggatccacagaggcgagaggtggctaaacgcaaaatcagaagactgcgccaaggcatgggctcagttattgattacagcaatgcctttcagatgatagctcaggacctggattggaatgaacccgccttaatagatcaataccacgaggggctgtcagaccatatccaggaagaattgtctcatctcgaagtggctaaatcactctcggccctcatcgggcagtgcatccatatagaaagacggctcgcgagggctgccgcagccagaaagccgaggagtccacctcgtgccctggtgctgccccacatagcttcacaccatcaggtggatccaactgaacccgttggtggcgcacggatgcggctgacccaggaagaaaaggagaggcggcggaaactgaatctgtgtctctattgtggaaccggcgggcattacgccgataattgtccagcaaaagcatccaaatctagtccagctggcaactcacccgctcctctttag

SEQ ID NO: 127976 - DNA, 978 bp, Artificial Sequence
  Description of Artificial Sequence: Synthetic coding sequence
atgaccgaaaggagacgtgacgagctgagtgaggagattaataaccttagggagaaagtaatgaagcagtccgaagagaacaataacttgcagtcccaggtgcaaaaactcactgaggaaaacaccacgctccgcgaacaggtggagcctaccccagaggatgaggacgatgatattgaactgaggggggctgccgctgccgccgccccccctcccccaatagaagaagaatgtcctgaagatctcccagagaaattcgatggaaatccagacatgctggcaccatttatggctcagtgtcagatctttatggagaaatcgaccagagacttcagtgttgatcgggtcagggtttgtttcgtgacttcaatgatgacagggcgtgctgcccgttgggcatctgcaaaactagagaggtctcactatctgatgcataattatcctgcctttatgatggagatgaaacatgtgtttgaagatcctcaacgaagagaagttgctaagcgcaagattaggcggctgagacaagggatgggttcagtgatagattatagtaatgccttccagatgatcgctcaggatttggactggaacgaacccgcactgatcgaccagtatcatgaggggctgagcgaccacatccaggaggagctaagtcaccttgaggtcgccaaatcattatcggcgcttattgggcagtgcattcacattgagagacggctggcacgggccgccgcggcaagaaaaccccggtctcccccaagagcactggtgcttcctcatattgcctcacaccaccaggttgacccaaccgagcccgtgggcggggcgagaatgcgcctcactcaagaggagaaggaacggcggagaaagcttaacctgtgcttgtactgcgggacgggcggtcactatgcagataattgccctgctaaagcgagcaaatcaagtcctgcaggtaacagccccgctccattgtag

SEQ ID NO: 127977 - DNA, 1311 bp, Artificial Sequence
  Description of Artificial Sequence: Synthetic coding sequence
atgatggcaacccagactctgtctattgactcctaccaggacgggcaacaaatgcaggtggtgaccgaacttaagacagagcaagaccccaactgtagtgaaccagatgctgagggggttagcccacctcctgtagagagccagacacctatggacgtcgacaaacaggctatctatagacatcccttattccccctgctcgcgctgctcttcgaaaagtgcgaacagagcacacagggcagtgagggcaccacttctgcatcgtttgatgtggacatcgaaaatttcgtccgcaagcaggaaaaggaggggaagccattcttttgcgaagaccctgaaactgacaacctcatggtaaaggctatccaggtactccgtatccacctgctagagctggaaaaggtaaatgagctatgtaaggatttctgctctaggtatatcgcctgtctcaaaaccaagatgaactcagagaccctgctgagcggcgaacccggtagcccttatagtcctgtccagtcacagcaaatccagtctgccattacaggaactatctccccccagggcatcgtggtgcctgcgtccgcgctccagcagggaaatgttgcgatggctacagtggctggcggcacagtgtatcagcccgtgaccgtagtaactccccaggggcaggtcgtaacacagacactgtctccaggcacaattaggatccagaatagccagttacagctgcaacttaaccaggatttaagcattctccaccaagacgacggcagctccaaaaacaagcggggcgtcctccccaaacacgccacaaacgtgatgcggagctggttgtttcagcatattgggcacccctaccccacagaggacgaaaaaaagcaaattgccgcgcaaactaacctgacacttttgcaagtgaacaattggttcatcaacgcacgccggcggatactccaacctatgctcgactcatcctgttctgaaacaccaaagacaaagaagaagaccgcacagaaccgaccagttcagcgcttctggccagacagcatcgcatctggcgtggcacagcccccaccatcggaacttactatgagcgaaggagccgtagtgaccatcactacaccagtgaacatgaatgtcgacagcctgcaatcactctcctcagatggggccactctcgccgtccagcaggttatgatggccgggcagtcagaggacgaatctgtggattccactgaggaagacgccggtgccctcgcccccgctcacatttctgggttggtcctcgaaaactccgatagtcttcagtag

SEQ ID NO: 127978 - DNA, 960 bp, Artificial Sequence
  Description of Artificial Sequence: Synthetic coding sequence
atggtcaaagccatacaggttcttcgtattcacttgcttgaactggaaaaagttaatgaactatgcaaggatttctgctctaggtatatcgcttgtttaaaaactaaaatgaactcagaaaccctgctgtccggagagccgggctccccttatagccccgtgcagtcccagcaaattcagtccgcgatcacaggtactatttcaccccaggggattgtggtgccagcaagtgccttgcagcagggtaacgtcgcaatggccaccgtcgccggcggcaccgtgtaccagccagtaactgttgtcactcctcagggccaggtggtaacccagactctctcgcccggcactatccgtatacagaacagtcagctacagctccagttgaatcaagacctgtctattctgcatcaggatgatggcagcagtaaaaacaagcgaggagttcttccaaagcatgctacgaacgtcatgcggagttggctgttccaacacattggacatccgtacccaactgaagatgagaagaaacagatcgcagcacaaacgaatctgacactgctccaggttaacaactggtttattaacgccaggagacgaatccttcagcccatgctcgacagcagttgcagcgagacgcctaaaacaaaaaaaaaaacagcacagaataggcccgtgcaaaggttctggcctgactccatcgcttctggagtggcacagccacctccgtctgagctgaccatgtcagaaggggccgtggtgaccattactactcccgtgaatatgaacgtcgatagtctgcagtccctgagttcggacggtgctaccctggcggtgcagcaggtgatgatggccggtcagtctgaggatgaatcggttgacagtacagaagaagacgccggagcgcttgctcccgctcacatttccggtctcgtgctcgagaattccgactcactgcagtag

SEQ ID NO: 127979 - DNA, 1260 bp, Artificial Sequence
  Description of Artificial Sequence: Synthetic coding sequence
atgatggccacccaaacactgagcattgatagctatcaggatggccagcaaatgcaggtggtgacagagcttaaaacagaacaggatccaaactgttccgagcctgatgccgagggggtgagcccccccccagtggagtctcagacacccatggacgtggacaagcaagccatttatagacatccactttttcctcttcttgccctattattcgagaagtgtgaacaaagtacacaaggctccgagggcaccacttccgcctcatttgacgtggacatcgagaactttgtcaggaaacaggaaaaggagggaaagcccttcttttgtgaagaccccgaaaccgataaccttatggtgaaagcgatccaggtcctgagaatccatctccttgagctcgagaaagtgaatgagctgtgcaaagacttctgctcccgctatatcgcttgcttgaagactaagatgaactcggaaaccctcctgtccggagaaccaggctccccctactcacctgttcagagccaacagatccagtcagcgatcacagggacaatctctccccaaggcatagtggttcccgcgagtgcgctccaacaaggcaacgtggccatggccactgtggcagggggaactgtctatcagcccgtaactgtggtgactccacaggggcaggtggtgacacagaccttgtccccgggaactatccggattcagaacagtcagctgcagcttcagctgaaccaagacctgtcaatcctccaccaggacgacgggagcagcaagaacaagcgcggtgtccttcctaaacacgctactaatgtcatgaggagctggctcttccagcatatcggccatccgtatcccacagaggacgaaaagaaacagatagctgctcagaccaatttgacactcctccaggtgaacaattggttcatcaatgccaggagaaggatcttacagcctatgttagattcgtcgtgtagcgaaaccccaaagaccaaaaagaaaacagcccaaaatcgccctgtccagcgattttggcctgactccatcgcctctggggtggcacaaccacccccttcagagctgaccatgagcgagggaactggggggcgcccccgaccagatatggtcgaccacggcgtagggattatgaataagaggccgggctctggtctccttgcacccccccgcccggccgagaacgacattttgaaacccccattgcggtcaagctttgtgaattgtcttctaatcttctag

SEQ ID NO: 127980 - DNA, 1419 bp, Artificial Sequence
  Description of Artificial Sequence: Synthetic coding sequence
atgatgcagcatgccagcccggccccggcattgacaatgatggccacccaaaacgtcccccctcccccctaccaagactcccctcagatgactgccactgctcagcccccgtcaaaggctcaagcggtgcatatcagtgcgccaagtgccgctgcatctacgcccgtgcccagcgcgccaattgacccgcaggctcagctggaggctgacaaacgggccgtttacaggcatcctctctttcccttactgactctgttgtttgagaagtgcgaacaggccacacaaggatctgaatgcataacttccgcaagcttcgacgtggacattgagaattttgttcatcagcaggaacaggagcacaagcctttctttagtgatgaccctgagctggacaatctcatggtgaaagctatacaagtgctgaggattcacctgttggagctggagaaggttaatgaactttgcaaagacttttgtaacagatatattacgtgtctgaaaaccaagatgcactcagacaacctactgaggaacgatctggggggtccctacagcccaaaccaacctagtattaaccttcactcgcaagacctgctccaaaactcccccaatagtatgtcaggagtttccaataatccccaaggcattgtggtacccgcttcagcactgcagcagggcaatatcgccatgaccacagtcaactctcaggtggtctccggaggtgccctgtatcaaccagtgaccatggtgacctcacaggggcaagtggttacccaggctattccccaaggcgccatccagatccaaaatacccaagtgaatcttgacctcaccagcctgctggataacgaggataagaagagtaagaacaaacggggcgtgctgcccaaacatgccacaaatattatgcggagctggctatttcagcacttaatgcacccgtaccctaccgaagacgagaagcgacaaattgctgctcagacaaacctgactctgcttcaggttaacaattggtttatcaacgctagaagaagaattctccagccaatgcttgacgccagcaatcctgaccccgccccaaaggctaaaaaaatcaagtctcagcatagacctacccagcgcttttggcccaattccatcgccgcaggagtgctccagcagcaagggggggcccccgggacaaaccccgacggctcaatcaatctggacaacctccagtctctgtcaagcgactccgctacaatggcaatgcaacaggcaatgatggccgcccacgacgactctctggatggcaccgaggaggaagacgaggatgagatggaggaagaagaggaagaggagctggaggaggaagtcgacgaactgcaaacgactaacgtaagcgacctgggcctggagcactccgatagcctcgaatag

SEQ ID NO: 127981 - DNA, 120 bp, Artificial Sequence
  Description of Artificial Sequence: Synthetic coding sequence
atgatgcagcacgcaagcccggccccggccttgacgatgatggccacacagaatgtcccccccccaccttatcaggatagtccacagatgactgctaccgcccagcctccttccaaatag

SEQ ID NO: 127982 - DNA, 1332 bp, Artificial Sequence
  Description of Artificial Sequence: Synthetic coding sequence
atgaccgctaccgcccagccccctagtaaagctcaggccgtccacatttccgccccctcagccgccgcaagcacacccgttccctccgcccccatagacccgcaagcgcagctggaagccgacaagagggcagtgtaccgccatcctctgttccctcttttaacactgctttttgaaaagtgcgagcaggccacccaaggatccgagtgcattacctctgcctcattcgacgtcgacatcgaaaactttgtgcatcagcaggagcaggaacacaaacccttcttttcagatgaccccgaactcgataacctgatggtgaaggctatccaggtactccgcatccacctcctcgagcttgaaaaggtaaatgagctctgtaaggacttctgtaacaggtatatcacctgcctgaaaactaaaatgcattctgataacctcttgaggaacgatctcggggggccgtactctccaaaccaaccatctattaacctgcattcccaagacctgctccagaattctcctaattcaatgtctggggtgtcaaacaatcctcagggaatcgtcgtaccagcctctgcactgcagcaagggaatatcgctatgacaacggtgaactcccaggtagtgtctggtggtgctttatatcagcctgtcactatggtgaccagccagggccaggtggtgactcaagcaattcctcagggggccatccagattcagaacacccaagttaacctcgacctcacttctctgctggataatgaagacaaaaaaagcaagaacaagagaggagtcttgccaaagcatgccactaatatcatgcgctcgtggctattccagcatctcatgcacccctaccctaccgaagacgagaagagacagatagccgcccagaccaacttaacgctgctgcaggtcaacaattggttcatcaatgccagaagacgcattctgcagccaatgctggacgcgtccaaccccgaccccgcacctaaggcgaagaaaattaaaagtcaacatcggcctacacagcgcttctggcccaattccattgcagccggagtgctccagcagcagggcggagcccccggcactaatcccgatgggtccataaatctggacaatctgcaatccctgagcagcgactccgcaaccatggccatgcagcaagctatgatggcggcgcacgacgactcccttgacggtactgaggaggaggacgaagacgaaatggaggaagaggaggaggaagagctcgaggaggaagtggacgagctacagacaacaaatgtgtccgacctaggacttgagcattctgattcactcgagtag

SEQ ID NO: 127983 - DNA, 1332 bp, Artificial Sequence
  Description of Artificial Sequence: Synthetic coding sequence
atgaccgccaccgcccagccaccgtccaaagctcaggcagtacacattagcgcgccctccgcagccgcatctacacctgtcccatctgctcccatagacccgcaggctcagctcgaagccgacaagcgggctgtctaccgtcaccctctttttccactgctaacgctgttgtttgagaaatgcgagcaggccactcagggatcagagtgcattacctctgcctctttcgatgtcgacatcgaaaacttcgtgcaccagcaggagcaggagcataagcctttcttcagcgatgatccagagctggacaacttaatggtcaaagccattcaagtcctccggatccatctactggaactagagaaggttaatgagttgtgcaaggacttctgtaatcggtacataacctgtctgaagacaaagatgcactccgacaatcttctgagaaacgaccttggggggccttactccccaaatcagccatccattaatctgcattcacaggaccttctccagaactcccccaattccatgtcaggcgtaagcaataatcctcagggcattgtggttccagccagtgccttgcaacaagggaatatcgccatgaccacagtgaattctcaggtggtgtccggtggtgccctgtatcagcctgtaactatggttactagccagggtcaggttgtaactcaggcaataccacagggcgcaatccagatccagaatacacaagtcaacctcgacctcaccagcttacttgataatgaggataagaaaagcaagaacaaacgaggagttctgcctaaacatgccactaacattatgagatcctggctgtttcagcacctgatgcacccctacccaactgaagatgagaaacggcagatcgctgcccagactaatctgactttactgcaagttaataactggttcatcaatgctagacgcagaattctgcagccaatgcttgacgctagtaacccagatcctgctccaaaggccaaaaagatcaagtcccagcatagaccaacccagcggttttggcccaattccattgccgcaggagtgttgcagcagcagggaggtgctcctggcaccaatcctgatggttccataaacttagacaatctgcagtctctgtcttccgacagcgccactatggccatgcagcaggccatgatggcggctcatgacgattcactggacggaacggaggaagaagatgaagatgaaatggaggaggaggaagaggaggaactcgaagaggaagtggatgagctacaaacgaccaatgtctctgatttagggctggagcattcggactctttggaatag

SEQ ID NO: 127984 - DNA, 123 bp, Artificial Sequence
  Description of Artificial Sequence: Synthetic coding sequence
atgatgcaacacgcatccccagcaccagcgttgactatgatggcgacccagaacgttccgccgcccccataccaagatagcccccagatgacggctactgcgcagccaccttcaaaggcctag

SEQ ID NO: 127985 - DNA, 921 bp, Artificial Sequence
  Description of Artificial Sequence: Synthetic coding sequence
atgatggccactcagaacgttccgccaccaccatatcaagattcacctcaaatgacggccacagcacagcctccgtctaaggcccaggcagtgcacatctcagctccatcagcggcggctagcaccccagtccccagtgcgcccattgacccacaggctcagctggaggctgataaacgcgcagtgtatcgtcaccccctgtttcctcttctgactcttctcttcgaaaaatgtgagcaggcgacccaagggtcagaatgcatcacgagcgcatcttttgacgtggacatcgagaattttgtgcaccagcaggagcaggagcacaaaccgttcttttcggacgaccctgagctcgataatctcatggtcaaagcaattcaagtgctacgcattcacctgttagagctggaaaaggtgaacgaactgtgcaaagatttctgcaacaggtacatcacgtgtcttaaaacaaaaatgcacagcgacaacctgctgcggaacgatctggggggcccgtacagccctaatcagccctctatcaatctacactctcaggacctcctccaaaatagccccaattcgatgtcaggagttagcaataaccctcaaggaatagtcgtccctgcatccgctctacagcagggaaacattgccatgactacagtgaatagtcaggtcgtatcgggcggggccctctaccagcccgtcaccatggtgactagccagggacaggtggtcactcaagccattcctcagggtgcaatccagatacagaacacccaggttaatctggaccttaccagccttctggacaacgaggacaaaaaatctaaaaacaagcgcggagtgcttcccaaacatgctaccaacatcatgaggtcctggctgtttcaacatcacgcaccgttacctcacggagggtag

SEQ ID NO: 127986 - DNA, 1227 bp, Artificial Sequence
  Description of Artificial Sequence: Synthetic coding sequence
atgagtcggcctcatccaactcgcacagcccaccgccatcccctgttccctctcctcacattgctgttcgagaaatgtgagcaggccacacagggcagcgagtgcattacctccgcaagttttgacgtggacattgagaatttcgtccaccagcaggagcaggaacataagccttttttttcagatgatcctgagcttgacaatctgatggtgaaggctattcaggtgttacgcattcacctactcgagctggaaaaagtcaatgagctatgtaaggacttctgcaacaggtacattacttgcttgaagacgaagatgcattccgataatctgctcaggaatgacctaggggggccttacagccccaaccagccatcaatcaacttacattcccaagatctattgcagaacagtcccaacagcatgtctggggtctctaataacccccaaggtatcgttgttcccgcctccgcacttcagcaaggcaatattgcaatgacaaccgttaattcccaggttgtgtccgggggagcactctaccagccagtcacgatggtgactagtcaaggtcaagtggtgactcaggctattccccagggtgccatccagatccagaatacacaagtgaatcttgatttaacgtctctgctggacaatgaggataagaagagcaagaacaagagaggcgtgctgccaaagcacgcaaccaacataatgcgcagttggctcttccagcatcttatgcatccctacccgacagaggatgagaaaaggcagatcgcggcgcagactaatttaacgctgctgcaggtgaataactggttcatcaatgcaaggcgtagaatcttacagcccatgctggacgctagcaatccagaccccgctcccaaagcaaaaaaaatcaagtcccagcaccggccaacgcagagattctggcccaactcaattgccgccggggtcctacagcagcaggggggggcaccaggaaccaaccctgacggatctattaatttggacaatctgcagagtctctcctccgactccgccacgatggccatgcagcaggctatgatggcggcgcacgacgacagcttagacggaaccgaggaagaagacgaggacgaaatggaggaagaagaagaggaggagctcgaagaggaagtggacgaactccaaaccaccaacgtgtcagatctggggcttgagcacagcgatagcctcgagtag

SEQ ID NO: 127987 - DNA, 297 bp, Artificial Sequence
  Description of Artificial Sequence: Synthetic coding sequence
atgatgcagcacgcgtcaccggctccagccctgacaatgatggccactcagaacgtccccccccctccttatcaggacagccctcagatgaccgccaccgcccagccccctagcaaggcacaggcagttcatatctcagcccctagtgccgcagcaagtacccctgtccctagcgctccaattgacccacaggcacaactggaagccgataaacgcgccgtttaccgccaccctctttttccactattgacattattattcgagaagtgtgagcaggctactcagggctcggagtag

SEQ ID NO: 127988 - DNA, 234 bp, Artificial Sequence
  Description of Artificial Sequence: Synthetic coding sequence
atgatgcaacatgccagtcctgcccccgccctgaccatgatggcgacacagaacgtgccgccaccaccttatcaggactcccctcaaatgaccgcaacggcccagccacctagtaaagcccaggcagtacatatctccgcaccgtcagccgctgcatccacgccagtcccgagcgcccccattgacccacaagctcaattagaggcagataaaagggccgtgtatagatggtag

SEQ ID NO: 127989 - DNA, 990 bp, Artificial Sequence
  Description of Artificial Sequence: Synthetic coding sequence
atgacacgggattttaaacctggcgatctgatattcgctaaaatgaaaggttacccccactggcccgctcgagtggatgaggtcccggacggagccgtaaaaccccctacgaacaaactccccatcttcttcttcggcacgcatgagacagcctttctgggaccaaaggacatctttccatactccgagaataaggagaaatacggaaaacccaataagcggaaaggttttaatgaggggctctgggagattgacaacaatccgaaagttaaattttcttcccaacaagctgcaaccaagcagtcaaatgcaagctctgatgtggaagtggaagagaaagaaacgagcgtgtcgaaggaggatactgatcacgaggaaaaagccagcaatgaagacgttacgaaggctgttgatattaccactcctaaggcagcgaggcgtggacgaaaaaggaaagccgagaagcaagtggaaacagaggaagctggagtggttacgaccgccaccgcatccgtgaatttaaaagtgtctcctaagcgaggcaggccagctgcaacggaggtgaaaatcccaaaaccccgaggacgtcccaaaatggtcaagcaaccatgcccatccgagtctgatatcatcactgaggaagataagtccaaaaagaaggggcaagaagaaaagcagccaaagaagcaacccaagaaggacgaagagggacagaaagaagaagataaacctaggaaggaaccggacaagaaggaggggaagaaggaggtggagtctaaaaggaagaacctcgctaagactggggtcacaagcacctccgacagcgaggaagagggtgacgaccaggaaggtgagaaaaagcgtaagggcggccgcaactttcagacggcccacaggagaaacatgctgaaaggccaacacgagaaggaagcagccgatcggaaacggaagcaggaggagcaaatggagactgagcattttgcattgtag

SEQ ID NO: 127990 - DNA, 1002 bp, Artificial Sequence
  Description of Artificial Sequence: Synthetic coding sequence
atgacgcgggacttcaaaccaggggatcttattttcgcaaaaatgaaaggatatccccattggcctgcccgagtcgacgaagtacctgatggggctgtaaagccaccgactaacaagctgcctatttttttcttcggtacccatgaaaccgcctttctgggacccaaagacatttttccctatagcgagaataaggagaaatatgggaagcctaataaacggaagggtttcaatgaggggctatgggagattgataataatcccaaggtaaagttctcttcccagcaggccgccacgaagcagtcaaatgcaagcagcgacgttgaagtggaggagaaggaaacttctgtaagtaaggaggatacagaccacgaggaaaaggcttcaaatgaagacgttactaaagctgtcgacatcaccactcccaaggccgcacggagagggagaaagcgtaaggccgagaaacaagtggagactgaggaagcaggcgtcgtcaccaccgcgacggccagcgtcaatctgaaggtgagccccaagcgcggaagacctgccgcgacagaagttaagattcctaagccccggggccggcccaagatggtgaagcagccttgcccatcggagtctgatattattaccgaagaagataagtctaaaaagaagggccaggaagagaaacagcctaagaagcagcccaagaaggatgaggagggacagaaagaggaagacaagccccgtaaagagcctgataagaaggagggcaagaaagaggttgaaagcaaacgaaagaatcttgctaagacaggagtcacttcaacatcggatagtgaagaagagggcgacgaccaggagggcgagaaaaagcgaaagggcggaaggaactttcagacagcccacagaaggaacatgctcaaaggtcagcacgaaaaggaggctgcagaccgcaaaaggaagcaggaggagcagatggagacggaacaccaaacaacttgtaatctgcagtag

SEQ ID NO: 127991 - DNA, 1593 bp, Artificial Sequence
  Description of Artificial Sequence: Synthetic coding sequence
atgacacgtgatttcaagccgggagacctcatatttgcaaaaatgaaagggtaccctcactggccagctcgggttgacgaagtccctgacggagccgtgaaaccacctacaaacaaactgccaatcttcttttttggaactcacgaaactgcttttcttggccccaaagatatatttccctactctgagaataaagagaagtacgggaagcctaataaaaggaagggcttcaatgaaggtctgtgggaaatcgataataatcctaaagttaaattctcctcacaacaggctgccaccaagcagagcaatgcctcaagtgatgtagaggtcgaggaaaaggaaacctcagtgagcaaagaagacacagaccacgaagagaaggcttccaacgaggatgtgacaaaagccgtggatatcactacaccaaaggcagccaggcggggaaggaagaggaaagcagagaagcaggttgaaaccgaggaagcgggagtggtgacaactgccaccgctagcgtgaacctcaaagtaagtcccaaaaggggacgcccagctgcaacggaagtgaagattcccaaacctcgcggcaggccaaaaatggtgaagcagccttgcccctcggaatcagacataatcacagaggaagacaaatctaagaagaaaggccaagaagaaaagcagcccaaaaagcaacctaaaaaggacgaggagggccaaaaggaagaagacaagccacggaaagagcctgataaaaaggaaggaaagaaggaagtagaatcaaagaggaagaaccttgccaagaccggggtaactagtactagcgacagcgaggaagagggcgacgaccaggaaggggagaaaaagcgaaaaggtggacggaactttcagaccgctcaccgtcggaatatgttgaaaggacagcacgaaaaggaggcggcagacagaaaacgaaaacaggaagagcagatggaaacggaacagcagaataaggacgaaggcaagaaaccggaggttaaaaaggtggaaaaaaagagagaaacaagtatggacagccgactgcagcgcatccacgcagaaatcaaaaactcactgaagattgataacctggatgtgaataggtgtattgaagctctggacgagctcgcttcactgcaggtgacgatgcaacaagcccagaaacacacagagatgattaccacgctcaaaaagattcgcaggttcaaagtcagccaggtgatcatggagaagagcacgatgttatataataagtttaagaatatgtttctggtgggggagggggactccgtcatcacgcaggtccttaataaaagcttagctgaacagcgccaacatgaagaggctaacaaaaccaaggaccaaggaaaaaaagggcctaacaagaagctcgagaaagaacagaccgggagcaaaacactgaatggcgggtccgacgcccaagacggcaaccagccacaacataatggagagagcaacgaagacagcaaagacaaccacgaggctagtacgaagaagaaaccatctagtgaggaaagagaaaccgaaatctccttgaaggattcaactttggacaactag

SEQ ID NO: 127992 - DNA, 1593 bp, Artificial Sequence
  Description of Artificial Sequence: Synthetic coding sequence
atgacccgggacttcaaacctggcgaccttatcttcgccaaaatgaaggggtatccccactggcctgcccgggtggacgaagttcccgatggcgccgtaaaaccccccacgaacaagctgcccatcttcttcttcgggactcatgagaccgcgttcttgggcccaaaggatatatttccgtattctgaaaacaaggaaaaatacggcaagcccaataaaaggaagggcttcaacgaaggtctgtgggagatagacaacaatccgaaagtgaaattctcaagccagcaggctgcgactaaacaaagcaatgcaagctccgatgtcgaggttgaagagaaggaaacctcagtgagcaaagaggatacggatcacgaagaaaaggcctccaatgaggatgtgactaaagcagtggacattaccacacccaaagccgcaaggcgggggcgcaaacgcaaggcagaaaagcaagtggaaaccgaagaggccggagtagttacaactgcgaccgcctctgtaaatttgaaggtgtcacctaagcgcggtcgccccgctgctactgaagtaaagattccaaaaccccgcggtcggccaaagatggtaaagcaaccatgcccatctgagagtgatataattactgaagaagacaagagtaagaagaaagggcaagaggagaaacagcctaagaagcagccgaagaaagatgaggagggccagaaggaagaggacaagcctaggaaagaaccggacaaaaaggaaggaaagaaggaagtggagtccaaacgaaagaaccttgccaagacaggcgtcacgagtaccagtgactccgaggaggagggtgacgatcaggagggtgaaaagaaaaggaaggggggccgtaacttccagacggcccacagaagaaatatgctaaaggggcaacatgagaaggaggcggccgatagaaaacggaaacaggaggagcagatggagactgaacagcagaataaagacgagggcaagaagccagaggtgaagaaggtggagaagaagcgcgagacctctatggacagcaggctgcagagaatccatgcggaaataaaaaattcgttaaaaattgataacctggacgtgaatcgctgcattgaagctctggatgaactcgcgtcccttcaggtgaccatgcagcaggctcaaaagcacaccgaaatgattactactttaaagaaaatccggaggttcaaggtcagccaggtgattatggaaaagtcaaccatgctgtacaacaaatttaaaaatatgtttctcgtcggtgagggagactctgtgattacccaggtcctgaataaaagcctagcagagcaacggcaacacgaggaggcaaacaaaacaaaggatcagggcaagaagggacctaacaagaagctggagaaagagcagacaggcagtaagacactcaacggtgggtccgacgcccaagatggcaatcagccacaacacaatggcgagtcaaacgaagatagcaaggataaccatgaagctagcaccaagaaaaaaccgagctccgaagagcgggaaacggagatcagcttaaaagactcaactctggacaattag

SEQ ID NO: 127993 - DNA, 1002 bp, Artificial Sequence
  Description of Artificial Sequence: Synthetic coding sequence
atgaccagagacttcaagccaggcgacctgatttttgccaagatgaaaggctatccacattggcctgcacgcgtggatgaggtaccggatggagcagtgaagccacctacaaacaaattgcctatcttctttttcggcacgcacgagacagctttcctcggccccaaggacatctttccttactccgaaaacaaggagaaatacggaaagcccaataaacggaaaggctttaacgaaggactctgggaaattgataataaccccaaggtgaaattttcctctcaacaggcagccactaaacagagcaatgcctcctccgacgttgaagtcgaggaaaaggagacttccgtttccaaagaggatacagatcacgaagagaaggcaagtaatgaagacgtgaccaaggccgtcgatataaccactcctaaagccgctcgtagaggacggaagcggaaagccgaaaaacaggtggaaactgaagaagccggggtcgtgacaactgctacggctagcgttaatttgaaggtttccccaaaaaggggcaggccggctgctacggaagttaagataccaaagccccgaggcaggcccaaaatggtcaaacagccttgtcccagcgaaagcgacattataaccgaggaggataagagcaagaaaaaaggacaagaggaaaaacaacctaagaaacagccaaagaaggacgaagagggccagaaagaagaggataaacctaggaaagagcccgataagaaagaggggaagaaggaagttgagtcaaaacggaaaaatctcgctaaaacaggcgtgacatccactagcgattcggaggaggagggtgacgatcaggagggcgagaaaaaaaggaaaggtggaagaaatttccaaacagcccaccggagaaacatgctaaaaggccaacacgagaaggaagctgccgatcgcaagcgcaaacaggaagaacagatggagacagagcaccagactacatgcaacctacagtag

SEQ ID NO: 127994 - DNA, 1362 bp, Artificial Sequence
  Description of Artificial Sequence: Synthetic coding sequence
atggcacatatcactatcaatcagtacttgcagcaggtgtatgaagccatcgattcgcgtgacggggcttcttgcgctgagctcgtatcatttaaacatcctcatgtcgctaacccaagacttcaaatggccagccctgaggaaaagtgtcagcaggttctcgaaccaccatacgacgaaatgttcgccgcccatctgcgttgcacctacgccgtcgggaatcacgatttcatcgaggcctacaagtgccagacagtaattgtgcaatacccattgtctttcatggctgccgtcccacataggacccacgccgttgactacctaggcttggagactcgaaagcactgggcctcctgctcctttctccagctagagcgtaacgacagcgtgttagagcagaagctggtgagcgctctatccctgggtacgagtttcctgagggcatttcaggctcacaaagaggagaattgggctctccccgtgatgtatgccgtggccttagatcttagagtgttcgctaacaacgccgatcagcagctggtgaagaagggaaagtccaaggtcggggatatgctggagaaagcggctgagctccttatgtcatgtttccgcgtctgtgcatctgatacgcgggcagggattgaggattccaaaaagtggggcatgctgttcctggttaatcagctgtttaagatttattttaagattaataaactgcatctgtgcaagccgctcattcgggccatcgactcaagtaacttaaaggacgactattctacagcccagagggtgacatacaaatattacgtaggccgaaaagccatgtttgactctgatttcaaacaggcggaggagtatcttagcttcgcctttgagcactgtcacaggtcttctcagaagaacaagagaatgatactcatatacctgctgcctgtaaaaatgctgctgggacatatgcccacggttgagctgctgaaaaagtatcatctcatgcagttcgccgaagtgacccgagcagtgagcgagggcaacctgcttctgttgcatgaggcactggctaagcacgaggctttttttattagatgtgggatatttctgatccttgaaaaattaaagatcataacttatcgcaaccttttcaaaaaggtctacctgttgttaaagacgcaccagctgtcactggatgcttttcttgtagcactgaaatttatgcaggtggaggacgtcgacattgacgaggtgcagtgtattctggccaacttaatttacatggggcatgtgaagggctacatctctcaccagcatcaaaagctggtggtaagtaaacagaacccttttcctcctctgagtacagtgtgctag

SEQ ID NO: 127995 - DNA, 1200 bp, Artificial Sequence
  Description of Artificial Sequence: Synthetic coding sequence
atgcgcttaaccgatgtcgtccagcaattggtttacgaagctattgatagccgcgacggtgctagctgcgctgagctggtatccttcaagcacccccacgtagcaaacccacgactccagatggcatccccagaagaaaaatgccagcaggtgttagagcctccgtacgatgagatgtttgccgcccacttacgctgcacatatgctgtgggcaaccacgactttatcgaagcatataaatgtcagaccgtgattgtccagtacacatctttccttagagcgttccaggcacacaaggaggaaaactgggcgctgcccgtgatgtatgctgtggctctggacctgcgagtcttcgccaataacgcagaccaacagttggtgaagaagggcaagtccaaggttggggacatgctggaaaaggctgctgaactcctgatgtcctgttttagggtttgtgcgtcagacacaagggcaggtatcgaggacagcaaaaagtgggggatgctgtttctcgtgaaccagctgtttaagatctacttcaagatcaacaaactgcacctttgtaaacctctcatccgtgctatagactcttcaaatttgaaagacgactattcgacagcccaacgggttacctacaagtattatgtgggaagaaaggctatgttcgatagcgattttaagcaggccgaggagtacctgagcttcgctttcgaacactgccacaggagcagtcagaagaacaaaagaatgatacttatctatcttttaccggtcaaaatgcttctggggcatatgccaactgtcgagcttcttaagaaatatcatcttatgcagtttgccgaggtgactcgggccgtatctgagggcaacctgctgctccttcatgaggcgctcgctaagcacgaagccttttttattcggtgtggcatcttcctgatcctggagaaacttaagattattacatacagaaacctgtttaagaaagtgtatctgctgctgaagactcaccaactctctctcgacgctttcctagttgcactgaagtttatgcaggtggaagatgtagacattgacgaagttcagtgcatcctcgcaaacctaatttatatggggcacgtgaaggggtacataagtcatcagcaccagaagctggtagtgtctaagcaaaacccatttcctccattatctaccgtttgttag

SEQ ID NO: 127996 - DNA, 1200 bp, Artificial Sequence
  Description of Artificial Sequence: Synthetic coding sequence
atggcacacataaccatcaatcaatatctccagcaggtctatgaggccattgactcccgcgatggcgcatcttgcgcagagctggtgagttttaagcatccccatgttgccaaccctcgactgcagatggcatccccagaggaaaaatgtcaacaggtattggagccaccttatgatgagatgttcgccgcccatttgcgctgtacgtacgccgtcggcaaccatgacttcattgaagcctacaagtgccagacagtgattgtgcagagctttctcagagcctttcaggcacacaaagaggaaaactgggcccttcccgtgatgtatgccgtggctctcgacttacgtgttttcgccaacaatgccgatcagcagctggtgaaaaagggaaaatccaaagtcggggacatgttggaaaaggcagccgaactactgatgtcctgttttcgagtctgcgccagcgacactagggctggcatcgaggattcaaaaaagtggggcatgctgttcctagtgaaccagctcttcaagatatactttaaaattaacaagttacacctctgcaagcccctgatccgggctattgattctagcaatcttaaagatgattattccactgcccagagagtgacctataaatactatgtcggtcggaaggccatgttcgattctgacttcaagcaggccgaggaatatttgagcttcgcgttcgaacattgccaccgctcttcccagaagaacaaaagaatgatcttaatatatctgttgccagtgaaaatgctgctcggtcatatgcctactgtggagttacttaagaagtatcacttaatgcaatttgccgaggtgacgcgtgcggtgtccgagggaaacctactgctgcttcatgaagccctcgctaaacacgaagctttcttcatacgatgtggcatttttttaatcctcgaaaagttgaagattatcacttatcgcaacttgtttaaaaaagtgtacctgctgttaaagacccatcaactgagccttgacgcctttttggtagccctcaagttcatgcaggtggaagatgtggacattgacgaagttcaatgtattctagccaatctcatttacatgggacacgtaaagggttacataagccaccagcatcagaagctggtggttagtaagcagaacccatttcctcccttgtctactgtctgttag

SEQ ID NO: 127997 - DNA, 1131 bp, Artificial Sequence
  Description of Artificial Sequence: Synthetic coding sequence
atggcccatattactataaaccaatacctgcagcaggtgtacgaggccattgattcacgggacggcgcatcttgcgctgaactggtttcttttaaacatcctcatgtcgccaatccgcgccttcaaatggcctctcccgaagaaaagtgccaacaggtgctcgaaccgccctatgacgaaatgttcgcagcccacctccggtgcacctacgccgttggaaaccacgattttatagaagcttacaagtgtcagaccgtcatcgttcagtatcctcttagcttcatggcagcagtggccgatcagcagctggtcaagaagggtaagtcgaaggtgggagatatgctggaaaaggcagccgaactcctgatgagctgtttccgggtttgcgctagtgacacccgtgctggcattgaggatagtaaaaaatgggggatgctgttccttgtgaaccagctgtttaagatctattttaaaattaacaaactgcatctgtgcaagccactcattcgagcaatcgacagcagcaatctaaaggatgattactctactgcccagcgggtgacctataagtattacgtgggcagaaaggccatgtttgatagcgattttaagcaggctgaagagtacctaagtttcgctttcgaacactgccacagaagttctcagaaaaacaagagaatgatccttatctacctcctgccagtaaagatgctactaggccatatgcctacagtggaactactaaagaagtaccacctgatgcagttcgcggaggtgacgcgcgctgtatccgaaggtaacttgctgttgctgcatgaggccctcgcaaaacacgaggccttctttattcgctgcgggatctttttgatactggagaagctgaaaattatcacttacagaaacttgttcaagaaggtttatcttttacttaaaacccatcagcttagtctggacgcctttctggttgcccttaagttcatgcaggtggaagatgttgatattgacgaggtgcaatgtattctggctaacttgatctacatgggacacgtgaaggggtacatttcacaccagcaccagaagttagtggtgtctaaacagaatcctttccctccactttctacagtctgttag

SEQ ID NO: 127998 - DNA, 1200 bp, Artificial Sequence
  Description of Artificial Sequence: Synthetic coding sequence
atggcgcacattaccatcaatcagtacctgcagcaggtgtacgaggccattgactccagggatggcgcgagctgcgctgagcttgtctcctttaagcatccgcatgttgccaatcctcggcttcagatggcctctcccgaagaaaaatgccagcaggtgcttgagcctccttacgatgagatgttcgcagcccatctgcgatgtacttatgcagtgggaaaccacgattttatcgaggcctacaaatgccagactgtgattgtacaaagctttcttcgggcgttccaggctcacaaggaagaaaactgggccttaccagttatgtatgcggtcgctctggacttgcgcgtgttcgccaacaacgcagaccaacagctggttaagaaggggaagtctaaagtgggcgacatgctcgagaaggcggccgagctcttgatgagttgcttccgagtttgcgccagcgacacaagggccgggattgaggacagcaagaaatgggggatgttgtttctcgtgaatcaactttttaagatctactttaagatcaacaagctccatctgtgtaaaccgctcatccgcgccattgatagttctaacttgaaagacgattattcaacagcccagcgtgtgacatataagtactacgtaggaagaaaggcaatgttcgattctgatttcaaacaggccgaggagtacctcagcttcgcttttgaacattgccaccggagcagtcagaagaataaaaggatgatcctcatatatttactgccagtgaaaatgcttctaggccacatgcccactgtggagttgctgaagaagtaccatctaatgcaatttgctgaagtgaccagggccgtgagtgagggcaaccttctcctcctccatgaggccctggccaagcatgaggccttttttatcagatgcggcatctttctgatccttgaaaagttaaagataattacttacaggaacctttttaagaaagtgtacttgctattgaaaacccaccaactgagtctcgacgccttcctcgtcgcgctgaagtttatgcaggtcgaggacgtcgacatcgatgaggtgcagtgtatactcgccaatcttatctatatgggccatgtaaagggttatatctcacatcaacaccagaagttggtcgtgagcaaacagaatcccttccccccactgagtacagtgtgttag

SEQ ID NO: 127999 - DNA, 1200 bp, Artificial Sequence
  Description of Artificial Sequence: Synthetic coding sequence
atggcacacattactatcaaccaatacctccagcaggtgtatgaggccattgactctcgagatggtgcatcctgcgcagagcttgtgtccttcaaacacccccacgtcgccaaccctcgacttcagatggccagtccagaagagaagtgccagcaggttctcgagcctccttatgacgagatgttcgcagcccacttgagatgcacatatgctgttgggaaccacgactttatcgaggcctataaatgccagacagtaattgtccagtccttcctacgggcctttcaggcacacaaggaggaaaactgggccctccccgtcatgtacgctgtggccctcgatcttcgggtattcgccaataatgcagaccagcaactggttaaaaagggtaagagcaaagtgggggatatgcttgaaaaggctgcagaactactgatgtcttgtttccgtgtttgcgcctccgataccagggctggcatcgaagactccaaaaaatggggcatgctttttctggtgaatcagttatttaagatttattttaagatcaacaaactgcacttatgtaagcctctcatccgcgctattgacagcagcaacctgaaggatgattatagcactgcccagcgggtcacctataagtactacgtgggccgcaaagccatgtttgactctgattttaaacaggccgaggaatatttgtcatttgcttttgagcattgtcacaggtccagtcagaaaaataaaaggatgattttgatttatctgcttccggtgaaaatgctgctaggacacatgcccaccgtggaattgttgaaaaagtatcatttgatgcagttcgcagaggtgacacgggctgtgtccgagggcaacctcctgcttctccatgaagccctggccaagcacgaggcattctttattcggtgtggaatctttctaatcctcgaaaagcttaaaatcatcacttaccggaacttgtttaaaaaagtgtatctcctgctcaagactcaccagctgtcacttgacgcattcctagtagcactcaagtttatgcaggttgaggacgtggatatcgacgaagtccagtgtatcttagcaaacctcatctacatgggtcatgttaagggatatattagtcaccagcaccagaaactcgtagtgtctaaacaaaacccatttccacctctgtcgaccgtgtgctag

SEQ ID NO: 128000 - DNA, 1194 bp, Artificial Sequence
  Description of Artificial Sequence: Synthetic coding sequence
atgcgcctgacagacgtggtccagcaactggtgtacgaagctattgactctcgggatggagcatcatgtgcggaattggtgtcttttaagcatccacatgtcgccaacccacgtcttcagatggcatctcctgaagaaaagtgccagcaggttctggaacctccctatgacgagatgttcgctgctcacctgagatgtacttatgcagttggcaaccatgacttcatagaagcttacaagtgccagactgtcatcgttcagagcttcctgcgagcctttcaggcacacaaggaagagaattgggctctgccagtcatgtacgccgtggcactggacctcagggttttcgctaataacgccgatcagcaactggtgaagaaaggtaaaagcaaagtgggcgatatgcttgaaaaggcagctgagctcctgatgagttgttttcgggtctgtgcatccgatacacgcgcggggatcgaggattccaagaagtggggaatgctgttcctggttaaccagctgttcaagatatactttaagattaataaacttcatctgtgcaagccactgatacgtgcgatcgatagttctaatttgaaagacgattattctactgcgcaacgagttacctacaagtattatgtgggtagaaaagctatgttcgacagtgacttcaaacaggccgaagagtacttatctttcgctttcgagcactgtcaccgatcaagccagaagaacaaaagaatgatactgatatacttgctgcccgtgaaaatgttgctggggcacatgcccaccgttgagctgctgaaaaagtatcatctcatgcagttcgcagaggttacccgagcagtgagtgagggcaatctgctcctactacacgaggccctggctaagcatgaggcattcttcatacgctgtggcatcttcctgattctggagaagctgaaaattattacctacagaaatttatttaaaaaggtatatctgctgctgaagacacatcagctgtccctggatgcgtttctggtcgctcttaagttcatgcaggtggaagacgttgacatcgatgaagtgcagtgtattctcgctaacctgatctacatgggccacgtgaaaggttatatatctcaccagcatcagaagctcgttgtgtctaagcaaaatccattcccacccctcagcacagtttgttag

SEQ ID NO: 128001 - DNA, 546 bp, Artificial Sequence
  Description of Artificial Sequence: Synthetic coding sequence
atgcctaaaggtgggcggaagggaggccacaaaggccgtgctagacaatacacatctcctgaggaaatcgatgcccagcttcaagccgagaagcaaaaggcacgggaagaggaagagcaaaaagagggaggtgatggggccgcgggcgaccctaaaaaagagaagaaatctcttgactcagacgaatccgaggacgaagaggacgactaccaacagaagaggaagggcgtggaaggactgattgacattgagaatccgaatcgtgttgctcagactacgaaaaaggtgacgcagttggacttggatgggcccaaggagcttagtagacgggaaagagaggaaatcgagaagcagaaggctaaggagaggtacatgaagatgcacctcgcaggcaaaacagagcaggcaaaagctgatctcgccagactagcaataattaggaaacagcgcgaggaagcggcacgcaagaaggaagaggaaagaaaagccaaggacgacgcgacactgtccggcaagcgcatgcagagtctctctctgaacaagtag

SEQ ID NO: 128002 - DNA, 1026 bp, Artificial Sequence
  Description of Artificial Sequence: Synthetic coding sequence
atggtgtcttcccaaccaaagtatgatctcattcgggaagtagggcgcggatcctacggggtggtctatgaagcagttataaggaagacatctgccagagttgcagtgaagaagatccgatgccacgcaccggaaaatgtagagttagcactgagggagttttgggccctaagctccattaaatcccagcatcctaatgtgatccatctggaagaatgtatcctgcagaaagatggtatggtgcagaagatgagtcacggcagtaactcatcattatacctccagctcgttgaaacgtctctgaaaggtgaaattgctttcgacccaaggtcagcatactacctctggtttgtgatggatttctgtgacggcggcgacatgaatgaatacctcctaagcaggaaacccaatcgcaaaactaatacaagtttcatgctccagctctcaagcgcactggccttcctacacaagaatcagattatccatcgcgacctgaaacccgataacatccttatctcacagacccgactggacacttcagacctggagcccaccctgaaggttgctgacttcggcctgtccaaagtatgctctgcgtcaggtcaaaatccagaggagcctgtatctgtgaacaagtgcttcctttctacagcatgtgggacagacttctatatggctccagaggtttgggagggccactacaccgccaaggccgacatctttgctctcgggatcattatttgggccatgttggagcgcattacctttattgacacagaaaccaagaaggagctgttgggcagctatgttaaacaggggacagaaatcgtcccagtcggtgaggcactacttgagaatcccaagatggaactgcttattccagtaaaaaagaagagcatgaatggaagaatgaagcagcttattaaagagatgttagccgctaatccacaagatcgacccgacgcgttcgaactcgaactgagacttgtccagatagccttcaaggacagttcctgggagacctag

SEQ ID NO: 128003 - DNA, 1026 bp, Artificial Sequence
  Description of Artificial Sequence: Synthetic coding sequence
atggttagcagtcaaccgaaatatgacttgatccgcgaagtcggccgcggctcttacggggtggtgtacgaggcggttatacgaaagacaagtgctcgggtagctgtgaagaaaattcggtgtcatgcgcctgaaaatgtggagttggctttgagggaattttgggcactgagctcaatcaagagtcagcatcctaatgtaatccaccttgaagagtgcattctgcagaaagacggcatggtccagaagatgagtcatggctctaactcgtctttatacttgcagctggtcgagactagcctgaaaggtgaaatcgcttttgatcccagatccgcatactatctgtggtttgtgatggatttctgcgatgggggtgacatgaatgagtacctgctttctcgcaagcccaatcgcaagacaaatacgtcctttatgttgcagttgtcttcagctctggccttccttcacaagaaccaaataatccacagagacctcaaacccgacaacatattgataagccagactagactggacacaagcgacctcgaacccactttgaaagtcgcagattttggactgagcaaggtctgctcggctagcgggcagaaccccgaagagccagtttcggtgaacaagtgcttcctgagcaccgcttgtgggacggatttttacatggcccctgaggtgtgggagggacattataccgctaaggcggacattttcgctctcgggatcattatttgggcaatgctggagagaattacattcatcgatacagaaacaaagaaggaactgctgggcagctatgtcaagcagggtacagagattgttccggtgggggaggctttgctggaaaatccgaaaatggaattgctcataccggtcaagaagaagtccatgaacggtcggatgaagcaactgattaaagaaatgctcgccgcaaatccccaggatcgaccagatgccttcgagctggaactccgactggtgcagatcgcattcaaagatagtagttgggaaacgtag

SEQ ID NO: 128004 - DNA, 576 bp, Artificial Sequence
  Description of Artificial Sequence: Synthetic coding sequence
atggtgagctcccagcccaagtatgacctcattcgcgaggttggaagaggcagctatggagtggtgtatgaagccgtcatccggaagacatccgcgagagtggcagtgaagaaaatcaggtgccacgcacctgagaatgtggagctagcgttaagggagttctgggccttgtccagcatcaaatctcagcacccaaatgtgattcatctggaggagtgtattttacagaaggacggaatggtgcaaaagatgtcgcacgggtctaacagctccctctatctgcagctggtcgagacgagcctaaaaggagagattgcctttgaccctcgatctgcatactatttatggttcgtgatggacttctgcgacggaggggatatgaacgagtacctgctgtcgaggaagcctaatagaaagactaatacatctttcatgctacagctgtccagcgccctggcctttctgcataagaaccaaattatccatagggacttaaagcctgacaatatccttatttctcagactcgcctcgacacttcagacttggagccgactcttaaagtcgccgacttttag

SEQ ID NO: 128005 - DNA, 4014 bp, Artificial Sequence
  Description of Artificial Sequence: Synthetic coding sequence
atggacttcaccgcccagcctaaaccagctactgctctgtgcggcgtggtctctgccgacgggaaaatcgcctatccacccggcgtcaaagaaattaccgataagataacaacagatgagatgattaagaggctgaaaatggtggtgaagacttttatggatatggatcaagatagcgaagatgagaagcaacaatatctgcccctcgctctgcatcttgcgtcggaattcttcctgagaaatccaaataaggacgtaagacttctcgtcgcatgctgcctggccgacatttttcgcatttacgctcctgaggcgccttacacttctcatgataagttaaaggacatattcctgttcattacccgccagctgaaaggcctcgaggacaccaaaagtccacagtttaatcgatacttttacctgttggagaacctagcatgggtgaagtcttacaacatctgctttgagctggaggattgcaatgaaattttcatccagctctttcgaacattgttcagcgtcattaataactcccataacaagaaggtgcaaatgcatatgctggatttgatgagcagcattattatggagggcgacggggtgacacaagagcttctggactcaattctcattaatctgatccctgcccacaagaacctcaataagcagtcatttgatctcgcgaaggtgctgctgaagcgcactgtacagacaattgaggcctgtatcgcaaatttctttaaccaggtgttggtgctcggacgctcaagcgtgagtgatctctcagaacacgtcttcgatttaattcaggagctctttgcaatcgaccctcatttactgctctcagtgatgccacagttagaattcaaactgaagagtaacgacggagaagagcggctggctgtggttagactgttagccaagttattcggcagcaaggacagcgacctggctacacaaaatcggcctctgtggcaatgtttcttgggacggttcaatgacatccatgtgcccgtccgactcgaatctgtgaagttcgcatcacattgccttatgaaccaccctgacctggcaaaggacctcactgagtatctgaaagtgagatctcacgaccccgaagaggcaatccggcacgatgtcatagtaaccatcatcacagccgccaagcgggatttagcgttggtgaatgatcagctactggggtttgtgcgcgagaggaccctggacaaacgatggagagttagaaaagaggccatgatgggcctcgcccagttatacaagaagtactgtctgcacggagaagcaggaaaggaggctgccgagaaggtatcatggattaaagataagttgttacacatatattaccagaattctatcgatgacaagctcctggtggaaaagatatttgcacaatacctggtcccccacaacctcgaaacggaggagcgtatgaagtgtctctactacctgtacgcatctctcgaccccaacgccgtcaaggccctaaatgagatgtggaaatgccagaacatgcttcgatcacatgtccgggagctgctggatcttcataaacagccgacatcagaggcaaactgctcagcaatgttcggaaaactgatgaccatagcaaagaatctgcccgatcccggaaaggcgcaggatttcgttaagaaattcaaccaggtcttgggcgatgatgagaagctgagaagccagctggagctcctaatctcccccacctgctcctgtaagcaagcggacatctgcgtgagggaaatcgcccgcaagctagcaaacccgaaacaaccaaccaacccattcctcgaaatggtcaaattcctgctcgaaagaatcgcaccagtgcacatcgattctgaggcaatttctgctttagttaagctcatgaacaaaagtatcgaaggcactgctgacgacgaggaagagggcgttagccccgatactgcgatccggtctggcttggagttgctgaaagtactgtcttttacgcatcccacctcctttcactccgctgaaacttatgaatcacttctgcagtgcctgcggatggaggacgacaaagtggccgaagcggcaattcaaatatttcgcaataccggccacaaaattgagaccgacttgcctcagattcgatcaacactgatcccaatcctgcaccagaaggcaaaacggggtacccctcaccaggcaaagcaggcggtgcactgtattcatgccatctttaccaacaaagaagttcagcttgcacaaatctttgaaccgctttcacgctcactgaacgcggacgtacctgaacagcttatcacacccttggtgtctctgggccatatcagtatgttagccccagaccaatttgccagcccaatgaagagcgtggttgcaaattttatcgttaaagatctgctcatgaacgacagaagtaccggtgaaaagaatggcaaactatggagccctgacgaagaggtctctcctgaagtcctggcaaaggtccaggcaataaagcttttggtgaggtggctccttggtatgaagaacaaccaatcaaagagcgccaattccaccctgaggcttctgtccgcgatgttggtatccgaaggcgacttgacagaacagaagaggatctccaaatcagacatgagtaggctgaggctggccgccggatctgctatcatgaaattggcacaggagccctgctatcacgaaataatcaccccagagcaattccagctgtgcgcccttgtcataaacgatgagtgctatcaggtgcggcagatattcgctcagaagctccacaaggctctcgtgaagctcctgcttcccctggaatacatggctatatttgcactgtgcgcaaaggatccagttaaagaaagacgggcccacgcccgacagtgtcttctcaaaaacattagcattagacgagaatatataaagcagaacccaatggccactgagaaactgctgagcctgttaccagagtatgtggttccatacatgattcacctgctggctcatgatcccgacttcaccagatcacaggacgtagaccagctccgggacatcaaagagtgtctctggttcatgttagaggtcctgatgactaagaatgaaaataattctcacgcattcatgaaaaaaatggccgagaatattaagctgaccagagatgctcagagcccagatgaatccaagactaacgagaagctgtatacagtgtgtgacgttgcactctgcgtgattaacagcaaaagcgccctgtgcaacgccgattcaccaaaagatccggtgctccccatgaaattcttcactcagcccgaaaaggacttctgcaatgataagagctatatatctgaggagacccgtgtgctactgctgactggcaaacccaaacccgcaggtgtgttgggcgccgtgaacaaacccctgagtgctaccggaagaaagccatacgttcggtctaccgggacggaaacaggatctaacattaatgtgaactccgagttgaatccttctacgggaaatcggtcgagggaacagtcgtctgaagcggctgaaacaggggtctcggaaaacgaagagaatccagtccgtatcatctcagtgacccctgtcaaaaacattgaccctgtaaagaacaaggaaataaacagcgatcaggccactcagggtaacatatcttcagatcggggaaaaaagcgtacagtgaccgctgccggagccgagaacatccagcagaaaactgacgaaaaggttgatgagagcggtcctccagcaccgtctaagccacggagaggacgacgacccaagtccgagagccaggggaatgctacgaagaacgacgacctcaacaagccaatcaataagggtagaaagcgggccgccgtgggccaggaaagccccggcgggttagaggccggcaatgccaaagcgcccaagctccaagacctggccaagaaagctgcgcccgccgagcgccaaatcgacttacaacggtag

SEQ ID NO: 128006 - DNA, 1803 bp, Artificial Sequence
  Description of Artificial Sequence: Synthetic coding sequence
atggattttaccgctcagccaaagcccgcaacagcactctgcggcgtggtgtcggcggacggcaaaattgcttaccctcccggagtgaaagaaatcacagataagataaccaccgacgaaatgatcaaaaggctcaagatggtggtgaagacctttatggatatggaccaagacagcgaggacgagaaacaacagtacctgccactggccctgcacctggcaagcgagttctttctgaggaaccctaacaaagacgttagactcctggttgcctgctgcctggctgacatctttaggatatatgcccctgaagctccatatacatcccacgataagctcaaggacattttcctttttatcaccagacagttgaagggactcgaagacactaaaagccctcaattcaataggtacttttacctcctggaaaacctcgcctgggtcaaaagttataacatctgctttgagctggaagattgtaacgagattttcatacaactcttccgcacgttgttctccgtgatcaataacagccataataaaaaagtacagatgcacatgctggacttgatgagcagtattatcatggagggggacggggtgacacaggagcttttagacagcatcctgatcaacctgattcctgcccataagaacttgaacaagcaatccttcgacctggctaaagtacttctaaagcgcaccgttcagaccattgaggcgtgtatcgcgaacttctttaatcaggtcctggtgctcggcagaagcagtgtgagcgacctgagtgagcatgtattcgatttgatacaggaactcttcgctatagacccccacctgctgctttcagtgatgccccagttagagtttaagcttaagagcaacgacggcgaggagcgtctggcggtcgtgcggctgctagccaagctgtttggcagcaaagactctgatctggcgacgcagaacaggccactttggcagtgcttcttgggtcgcttcaatgatatacacgtcccagtgcgtctggagtcagtcaagtttgcctctcactgtttgatgaaccaccccgatctggccaaggacctcacagaatacctgaaggttcgtagccatgaccctgaggaggcaatcagacacgacgtcattgttacgattattaccgccgccaagcgagatctggccctggtgaatgatcaactgttagggtttgtgcgcgagcggacacttgacaagagatggcgggtgcggaaggaggctatgatgggactggcccagttgtataagaaatactgtctgcacggcgaagccggtaaggaggccgcagagaaagtgagctggattaaggacaaacttctgcacatctactaccagaattcaatcgacgacaaactacttgtggagaagatttttgcgcagtacttggtcccccacaaccttgaaactgaagaaaggatgaagtgcctgtactatttgtatgcatctttggatcccaacgcggtgaaggctctcaacgaaatgtggaagtgccagaatatgcttcggagccacgtgcgggaactcctggacctgcataaacagcccacctctgaagcaaactgcagcgccatgttcggcaaactgatgactatagcgaagaacctcccggatccaggtaaggcccaggactttgttaagaagtttaatcaggtcttaggagacgacgaaaaattgagatcccaactcgagctgttgatctctcctacctgctcctgcaagcaagcggatatttgtgtggtctcaaagagctactttacattgttcctgtag

SEQ ID NO: 128007 - DNA, 990 bp, Artificial Sequence
  Description of Artificial Sequence: Synthetic coding sequence
atgaccactcagcaaattgacttgcagggccctggcccttgggggtttcgcttggtgggcggaaaggacttcgaacaaccgctggccattagccgtgtgaccccagggagtaaggccgctctcgccaatttgtgtattggtgacgtgatcaccgctatcgacggtgagaatacatctaacatgacacaccttgaagcacagaacagaatcaagggctgcacagataacttgacactgaccgtggcaagatccgagcataaagtatggtctccgttagttaccgaggagggcaagagacacccgtacaaaatgaacctcgcttcggagcctcaggaggtcctgcacatcggaagcgcacataacaggagcgccatgccctttaccgccagccccgcctccagcaccactgcccgagtgatcacaaatcagtataataatcctgcaggtctgtactcaagtgagaatatttcgaactttaacaacgcacttgagtctaagactgccgctagcggcgtggaagcaaacagccggcctctggaccacgcacagccacccagttccttggtgatcgacaaggagtctgaggtgtataagatgctacaagagaaacaggagttgaacgagccccctaagcagtccacctcttttctggtcctgcaggagatcctggagtcagaggagaagggcgaccctaataaaccttcaggattccgctctgtgaaggcccctgtgactaaggttgcggcctccatagggaacgcccagaaattgcctatgtgcgataagtgcgggacgggaatagtaggggtgtttgtaaaactccgagatagacatcggcaccctgaatgctacgtgtgcaccgactgcggcactaaccttaaacagaaaggacatttcttcgtagaggaccagatctactgcgagaaacatgctagggagagagttacaccaccagaaggctacgaggtcgttactgtcttccctaagtag

SEQ ID NO: 128008 - DNA, 1101 bp, Artificial Sequence
  Description of Artificial Sequence: Synthetic coding sequence
atggccctcaccgtggacgtcgccgggccagctccgtggggctttaggataaccggggggcgcgacttccacaccccaattatggtgactaaggtggctgagcgggggaaggcgaaagatgctgatctgcgccctggggatataatcgtggccattaacggtgagagtgcggagggtatgctccacgcggaggcacagtctaaaattaggcagtctccttctccactgaggcttcaactggacagaagtcaagcgacatctcccggacaaacaaatggggattccagtttggaggtgctggcgacaaggtttcaagggtcagtacgcacatatacagagagccagtctagtctgagatcaagctatagcagtccaacctccctcagccctcgagctggttcgccattctcgccacccccgtcatcaagtagcttgacaggcgaagccgctatatctaggagctttcaatccctagcatgtagccccggcttaccagccgctgaccggctttcctacagcggccgcccggggagccggcaggccggactgggcagggctggggactcggcggtactggtgctcccaccaagccctggcccacgctcctccaggcctagtatggacagtgaaggtgggtcactcttgttagatgaagacagtgaggtctttaaaatgttgcaagagaacagagaggggcgggccgcccccagacaaagctcatcttttcggctactgcaggaagcacttgaggctgaagagcgaggtggcacccctgctttccttcctagcagcctctccccacaatccagcctgcctgccagcagggccctggccacacctcctaagctgcatacttgcgagaaatgttccacttctatcgccaatcaagccgtgagaattcaagaaggccgttaccggcatcctgggtgctacacatgtgcagactgtggcctgaacctgaaaatgcggggtcacttctgggaggacgcatgtgccatggagggcatgagactgtcactggaggccctcgagggtatggtcgaaggcgccaaacgccgagacaggcggaaaacgagaaggcctattcagccttcatggtag

SEQ ID NO: 128009 - DNA, 1809 bp, Artificial Sequence
  Description of Artificial Sequence: Synthetic coding sequence
atgagaggaggccgagcccgtccggcttgggaatcattcatggggcttccccctagatcctccgctaaatggggggcaggacagagcctggacaggctttgctgtgctccaggcagccgggggctggcaggcgcacctggccgcatgcgtgccccaccggctggaaggtctcagccggcaggggggcctggcgatagtctgcctcacccccccggcggattgggcccaggaggcagcgcgtgggccagaagagctgaagcagctgccagtcgtgcacgggggggaggccgcgggggccccgggatcacctgggctgaagcaggaccaggcgcaccaggcgggctgtcccccgaaagcgggcgtcggcaacgggaacgttggcggctgccagcattccccccctccagagcatgggcaccatcccggactggcgagaggcaacccggggagcgggcccatctgagattgtccgctaggcccgcactgccgggcgcgggactcctgtctgcacccttgagcgctcgaaaccccggcctagtgcgaggtcctgcaccatggagtctggcctcggctggggcccccccgagggccgccctgagccccgctggggcactgctgcttcagcctcccgctcggagggttctatgcccaagatctgagggtggatcccggaccggacgcgctgggccgtccggatgggcccctcctcggggtgctcgctccgccgaaagcactgacagactgaaggggatggccttaacggtcgacgtcgccggtcccgccccctggggctttcgcataacaggcgggcgggacttccatacacccataatggtgacaaaggtcgcagagcgcggcaaggctaaggatgcggacctgcggcctggcgatattattgtggcaattaatggcgagtctgcagaagggatgctgcatgctgaggctcagtcaaagattagacagtccccaagtcctctgagactacaactcgaccgcagtcaagctaccagtcccggacaaacgaatggcgactcatctttagaggtcctggctacccgcttccaagggagcgtgcgcacttataccgaatctcaatcatccttacgatctagctactctagccccaccagcctgtctccgagggccggctctcctttcagcccccctccttcctctagttctctgaccggcgaggccgccatttcgcggtcctttcagagtctcgcatgctccccggggttgcctgccgccgataggctgtcttactccggccgtccaggctcccgccaggcgggtctcggaagggccggggattccgccgtcctggtgctccctccttctccgggaccccgctcttccaggccatcaatggacagcgaggggggctctctgctgctcgacgaagattcagaggtgtttaaaatgcttcaagaaaacagagaaggacgggccgctccccggcagtcctcctcctttaggctgttgcaagaagccctcgaggcagaagaaagagggggcacccctgcatttcttccttcttctctgtccccccagtctagtttgcccgcgagtagggctttagctacaccaccaaagctccacacctgtgagaaatgctcaactagcattgctaaccaggccgtcagaatccaggagggcagatataggcaccctgggtgttacacctgcgcggattgcggactcaacctcaaaatgcgaggtcatttttgggtgggcgacgagttatattgcgaaaaacacgccagacagaggtattccgcccctgccaccctgtcttcaagggcatag

SEQ ID NO: 128010 - DNA, 837 bp, Artificial Sequence
  Description of Artificial Sequence: Synthetic coding sequence
atggcactgacagtagatgttgccggtcctgccccctggggtttccgcattactggcgggcgagactttcataccccaataatggtgacgaaagtcgccgagaggggaaaagccaaagacgccgatctgcgaccaggagatattatagtggctataaacggggagtcagcagaaggaatgcttcacgctgaagcacagagcaaaatcaggcaatccccaagccccctgagactccagctggacaggtcgcaggccaccagtccgggacagactaacggagatagttctctagaggtcctagccactcgcttccagggcagtgtgagaacttataccgaaagccagtcctctcttcgatctagctactcttcaccaacttccctaagcccacgggcagggagcccatttagtccccctccttcgagtagcagtttgactggggaagctgctataagccgatccttccagagcctggcctgcagtcctgggttgccagccgctgataggcttagttattctggtcgccctgggagcaggcaggccggtttaggcagagcaggggatagtgctgtgctcgtgctccctccctcgcccgggcccaggagctcccgtccctccatggacagcgagggaggatccctgctgctcgatgaagatagcgaggtgttcaaaatgctgcaggaaaatcgcgaggggcgggctgccccacgccagagttcaagtttcagactccttcaggaagccctggaggctgaagagcgcgggacgagactgtgtgcatctaggcgggccggaaccgcgactcccgctgccacacccgtgcctactgtgggatag

SEQ ID NO: 128011 - DNA, 675 bp, Artificial Sequence
  Description of Artificial Sequence: Synthetic coding sequence
atggccctgactgttgatgtggccggcccagccccatgggggttcagaatcacgggaggaagagacttccacacccctatcatggtgaccaaagtagccgagcggggcaaggctaaagacgctgacctgcggccaggtgacattatcgtggcgatcaatggcgaatccgcagagggtatgctgcacgctgaagctcagtctaaaattcgccagtctcctagtcccctgcgactccaattagacaggtcccaagccacatcccccggacagacgaacggtgacagtagtctcgaagtattggccactcggtttcagggcagcgtcagaacatatactgaaagccaaagcagccttcggtcatcctacagcagtccaacaagcctgtcaccccgagctggcagccctttctcccctccacctagcagctcctccctcactggcgaagcagcaatttcaagatctcgcccccggcctagatggcgacttgggggagccggcgctgccgcttttcctggcccgagcttcctgcaggcccaacacggcctcggtagaggtaagccccctcccggtcgtggcttgggctctctccaagacgccgctggtaaaagtcgtgggaccggcggaccaccaacggttcaactcctaagtgcactcgctggctcacctggcggctag

SEQ ID NO: 128012 - DNA, 1059 bp, Artificial Sequence
  Description of Artificial Sequence: Synthetic coding sequence
atggccttaacagtcgacgtggctggcccagccccgtggggctttcgtataaccggcggaagagactttcatacacccattatggttaccaaagtagcagaaagggggaaggctaaagacgccgaccttaggccaggagatattattgtggctattaatggcgagagcgccgagggtatgctgcacgccgaagcacagtctaagattagacagagccctagccctctgagactgcagctggaccgctcccaggctacatcaccaggacagacaaacggtgattcaagcttggaggtcctggcgactagattccaaggctctgtgcgcacatacacagagagccagtcttcgctccggagcagttattccagccccacgtctctgagcccacgtgccgggagcccattttcaccgccacctagttccagcagcctgaccggagaggctgccatctccaggtcttttcagagcctcgcgtgtagtcctggattgcctgcagctgatcgtctgtcatattcggggcgcccagggtcccggcaggctgggctgggacgcgcaggtgactccgcagtcttagtgctgccccctagccccggtcctcgatcttcaaggccctccatggattctgagggggggtctctgctcttggacgaggatagcgaggtgtttaaaatgctgcaggaaaatagagaaggcagggccgccccgagacagtcatcttcttttaggttgctgcaggaggccttggaagccgaggagcggggaggcaccccagcctttctacctagcagtctgtcacctcagtcatctctgcctgcctctcgggccctggctacaccgccaaaattgcatacatgcgagaagtgttctacctccatcgccaatcaggctgtcaggatccaggagggtagataccgccacccgggctgctacacttgtgccgactgcgggctgaatctgaaaatgcgcggccacttctgggtcggcgacgagctgtattgcgaaaagcatgcacgacagcgctattccgcaccagccaccctttcttcacgcgcgtag

SEQ ID NO: 128013 - DNA, 1059 bp, Artificial Sequence
  Description of Artificial Sequence: Synthetic coding sequence
atggctttaacagtcgatgttgcgggtcctgccccttggggtttcagaatcaccggtggaagagacttccacacccccataatggtcacaaaggtggccgagagaggtaaagcaaaggacgctgatctgaggccgggcgacattatcgtggccatcaatggggagagcgccgagggaatgctgcacgccgaggctcaatcgaagataagacagtcgccatccccacttaggctgcaactagacaggtcccaggcaacgtcccccggacagaccaacggagatagctcgctggaagttttggcaacacgcttccagggcagtgtgcgcacatacacagagtcccagagctctcttcgctcctcctatagcagtcccacatcactgagtcctcgggctgggtcgccttttagtccccccccctcatcctcatcactaactggggaggctgccataagtaggtcatttcagtctctagcatgttcccccgggctgcctgccgctgaccggttgtcttactctggtcgcccagggagtcggcaggccggactcggtagggctggggacagcgccgttctggttctgcctcctagtccaggccctagatcatcccgaccgtccatggatagtgaaggcggctccttattactggatgaggattcggaggtgtttaaaatgttgcaggagaatcgcgagggacgagccgccccacgccagagttccagctttaggctgctacaagaggctttagaggccgaagagcgaggcggaacccctgccttcctgccatccagtctgtcacctcagagctcccttccagcatcaagagccttggccacgcctccgaaactgcacacatgcgagaagtgctctacttccatcgcgaaccaagctgtccggatccaagagggtcggtatcgacatcccggctgttatacatgcgcagattgtggactgaatctgaagatgcgtggacacttttgggtgggggatgagctctactgcgagaagcacgcccggcagcggtacagcgcaccggctacattaagtagcagagcctag

SEQ ID NO: 128014 - DNA, 837 bp, Artificial Sequence
  Description of Artificial Sequence: Synthetic coding sequence
atggcactgactgtcgatgtagccggtcctgccccttgggggttccgaatcacaggcggcagggacttccacaccccaatcatggtgacgaaggtggcagaaagaggtaaggcaaaggacgccgatctcaggcctggagatataatcgttgctatcaatggggaaagtgccgagggaatgctacatgctgaagcacaatcaaaaatccgccagagcccctctcccctgcgactgcagttggacagatcacaggctactagtcccggacagaccaatggggacagttcgctagaggtgttggctacccgattccaaggcagcgtgaggacatacactgaatcacaaagtagcctgaggagctcctactcttcaccgacgtccctgtcccctcgggcggggagcccttttagcccgccccctagcagtagctctctgacgggtgaggcggctatctcccgttctttccaatctctggcttgctcccccggactgcctgcagctgacaggctgagctattccggtcggccaggctcacgccaagccggactgggccgcgcgggcgatagcgctgttctggtgctgccacctagtccaggtccaagaagctccaggccaagtatggattctgaaggcgggtctctcctcttggacgaagatagcgaagtatttaagatgctgcaggagaatagggaaggacgggccgccccccggcagtcttcctcctttcggcttttgcaggaagccctggaagcagaggaacgcgggactcgactgtgtgcctcccggcgggccggaaccgctactccagcagcaacacctgtgcctacagtcggctag

SEQ ID NO: 128015 - DNA, 1059 bp, Artificial Sequence
  Description of Artificial Sequence: Synthetic coding sequence
atggcccttacggtggacgtggcaggcccagcaccctggggatttcggatcacggggggacgcgatttccacactcccatcatggtgactaaagtggctgaacgcggaaaagccaaagacgcagacctgcgtccgggagatatcatcgtcgcgataaacggcgaatcagcagagggtatgcttcatgccgaagcgcagtccaagatcagacagtctccatccccgctgcggctccaactggataggtctcaggcaactagccctggacagacaaacggagatagttctctggaggtgctggcgactagattccaagggagcgtgcgaacgtatactgagtctcaaagttctctcagatcttcttactcttctccaacatcactctcaccgcgcgcaggaagccccttctctcccccaccttcctcctcatcccttacaggtgaggctgccatcagccgaagttttcagagcctcgcctgctcacctggactgcctgctgccgatcgtttaagttactctggtcgtcctggcagtcgacaggccggcctgggccgggccggtgactctgctgtgctcgtacttcctcccagccctggccctcgttcttctagaccttccatggactccgaaggagggtccctgctgctggatgaagactcggaagtgtttaaaatgttacaggagaatagggagggacgcgcagcacccagacaaagctcttcattcagactgcttcaagaagctctcgaagcagaagaacgcgggggtactcctgccttcctcccaagtagcctgagtccccagagcagtttacctgccagtagagctctcgccacaccacctaaacttcacacatgtgagaaatgttctacctcgatcgccaatcaagcagttagaattcaggagggtcggtaccggcaccccgggtgttacacctgcgctgactgcggcctgaatctaaaaatgagagggcacttctgggtgggagacgaactgtattgcgagaagcacgcaagacaacgatacagcgcgccagcaactctttcatctcgagcctag

SEQ ID NO: 128016 - DNA, 1560 bp, Artificial Sequence
  Description of Artificial Sequence: Synthetic coding sequence
atgacctcgacttttaatccaagggagtgtaaactgtccaaacaggagggccagaactacggcttctttctgagaattgagaaggacactgagggccatctggtgagagtcgtcgaaaaatgttccccagcagagaaagccggtctgcaagatggagacagggttcttagaataaatggagtctttgttgacaaagaggagcatatgcaggttgtagatctggttagaaagtccggaaattccgtaacattacttgtattggatggagatagctatgagaaagccgttaaaaccagagtggatcttaaggaactgggtcaatcgcagaaagagcaggggctctccgacaacatcctctcacccgtgatgaatggaggtgtccagacttggacgcaacccagactttgctacttggtgaaagaaggaggtagctatggattctccctgaagaccgtacagggaaagaaaggcgtctatatgacggatattactccacaaggtgtggctatgcgtgctggcgttctggccgatgaccacctcattgaagtcaacggtgaaaacgtcgaggacgccagccacgaagaggtcgtcgagaaagtgaaaaaatccggctctagagttatgttcctccttgtagataaggaaacagacaaacggcacgtggagcaaaagatccagtttaagcgagagactgcctccctcaagttgctcccacatcagccacgcatcgtggagatgaaaaaaggatctaacggctatggattttatctgagagccggaagtgagcaaaaagggcagattatcaaggacattgactccggctcccccgcagaagaggccgggctgaagaacaatgacttggtggtggccgttaacggtgagtctgtagagaccctggatcatgatagcgttgtcgaaatgatccggaaggggggcgatcaaacctcacttctcgtggtggataaagagactgataacatgtaccggcttgcccacttttcacccttcctttattatcagagccaggagctgcccaacggctctgtgaaagaggcaccagcaccaacgcccacctccctggaagtgtcaagcccacctgacactacagaggaagtcgaccataaaccaaaactgtgtaggttggctaaaggcgaaaacggctacggcttccacttgaatgcaatccggggactgccggggtcgtttatcaaggaagtccaaaaaggaggtcccgctgacttagccgggctagaagatgaagatgtcatcattgaggtcaatggggtaaacgtactggatgagccttacgaaaaggtcgtggacaggatccagtccagcgggaaaaatgttacgctgttggtttgcggtaaaaaagcatatgattacttccaagctaaaaaaattcctattgtgtcgtccctggccgacccgctggatacacctcccgactccaaggaaggaattgtggtggagtccaatcacgattcacatatggcaaaggagagggctcactcaactgcatctcacagcagctccaacagtgaggatactgaaatgtag

SEQ ID NO: 128017 - DNA, 1560 bp, Artificial Sequence
  Description of Artificial Sequence: Synthetic coding sequence
atgacgagcaccttcaatcctcgcgaatgtaagttaagcaaacaggaggggcagaattatggctttttcctgcgcattgagaaagacaccgaaggccacctggtgagagttgtcgagaagtgctcccccgctgaaaaggccggccttcaggatggtgaccgagtgttgcgtattaacggagtcttcgtcgacaaggaggagcacatgcaggtcgtcgacctggtccgcaagtcaggaaatagcgtaactctgctcgtgctcgatggagattcgtacgaaaaagcagtgaagacccgcgtcgacttgaaagaattggggcagagtcagaaggagcaggggctgtcagacaacatcctttctcctgtgatgaacggcggagtgcagacttggacgcagcccagactatgctaccttgttaaggagggtgggtcttatggcttttctctgaaaacagttcagggaaagaagggcgtgtatatgactgacataactccccagggggtcgccatgagagcaggagttttggctgatgaccacctgattgaggtcaacggagagaacgttgaggacgccagtcacgaggaagtggttgagaaagttaagaaaagcgggagccgggtcatgtttctgctggtcgacaaagagacagacaaaagacacgtagagcaaaagattcaatttaagcgcgagactgcctcgcttaagctgctcccccaccagccaagaattgtggaaatgaaaaaaggatcaaatggctatggcttttatctcagagccggatccgaacagaaaggccagatcattaaagatatcgactccggaagtcccgctgaagaggccgggttaaagaacaatgatctggtcgttgccgtcaacggcgaaagtgtagagaccctggatcatgattctgtggttgagatgatcagaaagggcggggatcaaacaagtctgttagtagtcgataaagagaccgataacatgtaccggcttgcccacttcagtccgttcctatattaccagtctcaggaacttcctaatggaagtgttaaagaggcacccgcccctacaccaacctcgttagaggtgtcgtcgccccctgacacgactgaggaggtggatcacaagcctaagttgtgccgcctggcaaaaggagagaatggatatgggttccaccttaacgccatccgaggtctgcccggcagttttattaaggaggtacagaaaggtggtcccgcagatcttgccggtctggaagacgaagatgtgatcattgaggtcaacggtgtcaacgtcctggatgaaccttacgagaaggtggtcgatcgtattcagagctccggtaagaatgtgacccttctagtgtgcggaaagaaggcatacgattacttccaggctaagaaaattcctattgtatcatcgctcgccgaccctctggacactccaccagattcaaaggaagggatcgtggtagagagcaaccacgactcccacatggccaaggagcgtgctcactcaacggcgagccattcctcttctaattccgaggacaccgagatgtag

SEQ ID NO: 128018 - DNA, 795 bp, Artificial Sequence
  Description of Artificial Sequence: Synthetic coding sequence
atgacctcgactttcaaccctcgagagtgcaaactatcaaaacaggaggggcaaaactatggattctttttacgcattgagaaagacaccgagggccacctggtgagggtggtcgaaaaatgtagccccgccgaaaaagctggcttacaggacggagatcgcgttctccggattaacggcgttttcgtcgacaaggaggaacacatgcaggttgtggacttagtgcgcaaatcaggcaatagcgttacgcttctggtactcgacggagactcttacgaaaaggctgtgaagacccgggttgatttgaaagaactcggccagtcccagaaagagcaaggactgagcgataacatccttagtccagttatgaacggcggtgtgcagacctggacacaacccaggctctgctacctggtaaaggagggtggatcctatgggttttctttaaaaacagtgcagggcaaaaagggggtctacatgacggatatcaccccacagggcgttgcgatgagggccggtgtcctggcggatgaccatctcattgaggtgaacggcgagaacgtggaggacgctagccacgaagaagtagtagaaaaggttaaaaagagcggatctcgggtcatgttcctgctggtcgacaaggagaccgataagaggcatgtggaacagaagatccagttcaagcgggagaccgcctcgttaaaactgctgcctcaccagccgagaatcgttgagatgaaaaaaggcagtaacggatatgggttctatttgagggcaggctccgaacagaagtag

SEQ ID NO: 128019 - DNA, 1227 bp, Artificial Sequence
  Description of Artificial Sequence: Synthetic coding sequence
atgacatccaccttcaatcctagggagtgcaaactttcaaagcaggaaggccaaaactacggcttctttctccgcatcgagaaggacaccgaaggccacctggtaagggtggtggagaaatgttcccctgcagagaaagccggcctccaagacggagatagagtcctgcggataaacggcgtcttcgtagacaaggaggaacatatgcaagtcgtggacttggtaagaaaaagcgggaattccgtgaccctgctggtcctggatggcgacagctatgaaaaagccgtcaaaacccgggtggaccttaaagagctgggtcagtctcagaaagagcagggtttatccgacaacatactgagtcccgtcatgaatgggggcgtgcaaacctggacacaaccaaggctgtgttacctagtgaaggagggcggatcatatggctttagtctgaaaaccgttcagggacagatcattaaagatattgactctggaagtcctgcagaagaagcgggccttaagaacaacgacctggtcgtagccgtcaatggcgagagcgtggagactctagaccacgatagcgttgtggaaatgattagaaaaggaggagaccaaacctcactgcttgtggtcgacaaagaaactgataacatgtaccgccttgcacacttttcccctttcttgtactatcagagtcaggaactgccgaacggatccgtaaaggaggctcctgccccaactcctacctccctggaggtctctagtccgcccgatactacggaggaggtcgaccacaaaccaaaactgtgccggcttgcaaagggggagaacggatatggatttcaccttaacgcaattaggggtttacccggatccttcatcaaggaggtacagaaggggggcccagccgacctggctggactcgaggacgaggacgtgatcattgaagtaaacggagtcaacgtccttgatgagccctacgagaaagtggtcgaccgaatccagagcagtggcaaaaatgttaccttgctggtctgtgggaagaaagcgtatgactactttcaggccaagaagatccccatcgtctccagcctggcagatccactagatacaccacccgacagtaaagagggaatcgtagtggagtctaaccatgacagccacatggccaaggagagagcacattccacagctagccattcatcatcaaatagtgaagataccgaaatgtag

SEQ ID NO: 128020 - DNA, 423 bp, Artificial Sequence
  Description of Artificial Sequence: Synthetic coding sequence
atggattctcggatcccctacgacgactatcctgtcgtcttcctacctgcttacgaaaatccacctgcgtggatccctcctcacgagcgagttcaccaccccgattacaacaatgagcttactcagttcctccctagaacaatcaccctcaaaaagccaccaggagcacagctaggatttaatattcgcggaggaaaggcatcccagctcggtatattcatctctaaggtgatccctgattctgatgcacacagagccggcctgcaggagggggaccaggtgctagccgtgaatgatgtggattttcaggacattgaacatagcaaggccgtggagattcttaaaactgcacgggaaatttctatgcgcgtcagatttttcccatacaactaccatcggcagaaagaacgcactgtccactag

SEQ ID NO: 128021 - DNA, 423 bp, Artificial Sequence
  Description of Artificial Sequence: Synthetic coding sequence
atggactccagaatcccatacgacgactaccccgtggtgtttctacctgcttacgagaacccaccggcctggatcccaccccacgagcgggtgcatcaccctgactacaataatgaattgacacaattcctgccacggaccatcacgcttaaaaagccgcccggggcccaacttggctttaacattcggggaggaaaagcaagtcagcttgggatttttatcagcaaggttatacctgattccgatgcgcacagggctgggttacaggaaggggaccaggtattggccgtaaatgacgtcgattttcaggacattgagcactctaaggccgtcgagatcttgaaaactgccagagagataagcatgagggtgcgattttttccttataattatcatcgccagaaggaacgcacggtgcactag

SEQ ID NO: 128022 - DNA, 8520 bp, Artificial Sequence
  Description of Artificial Sequence: Synthetic coding sequence
atgcctatcactcaggacaacgcagtactacacctacctctgttatatcagtggctgcaaaactctctgcaggaagggggggatggccctgaacaaagactgtgccaagccgctattcagaagctccaggaatacattcaactcaactttgccgtcgatgaatcaacagtgcccccagatcacagtcctccagaaatggagatttgtaccgtgtatttgactaaggagctgggggacaccgaaacagtcggtctctcatttggcaacatccccgtgttcggggattatggcgaaaaacggcggggtggaaaaaagagaaaaacccaccaggggcccgtcctcgacgttgggtgcatctgggtcacagaactcagaaagaattcaccagccggtaaaagcggcaaagtgaggctgagagatgagatcctcagcctgaacggtcagctcatggttggggtggatgtgagtggggcatcctaccttgcagaacagtgttggaatggagggtttatttatttgattatgctacgacggttcaagcataaagcccacagcacttataacggtaattctagtaactcctcagaacctggagaaacgcccacactggagttaggagacagaaccgcaaaaaagggcaagaggacacggaagttcggcgtaatcagtagacctccagccaacaaggcccccgaggagagtaaaggaagcgcagggtgtgaggtgagtagcgaccccagcactgagcttgaaaacggacctgatccagagctgggcaatgggcacgtttttcagctcgagaatggacccgatagcttgaaggaggtcgcagggccacacctggagcggagtgaggtcgatcggggcacagagcatagaattccaaaaaccgacgcccctctaaccaccagcaacgacaaaaggcgcttctcaaaaggtgggaagacagattttcagtctagcgattgtctcgctagagaagaggtcggacgaatctggaagatggaactcctcaaagagagtgacgggttaggtattcaggtgagcggaggacggggctccaagaggtctccacatgccatcgtcgtcactcaagtaaaggaaggaggcgccgctcatagggacgggaggctgtccctcggcgacgagttgctcgtcattaacggtcatttgctcgtgggactgagccacgaggaggccgttgcaatactcaggagcgcaaccggaatggttcagctggtagtggcatcgaaagagaattcagccgaagacctgctgaggctgacctctaagtctctgccagaccttacttccagcgtggaagatgtatcctcctggactgataatgaggaccaggaggcagacggcgaggaggacgaagggacaagctcctctgttcagcgtgctatgcctggtactgacgaaccccaagatgtgtgcggggccgaggagagcaaaggtaacctggaaagccccaaacagggaagcaacaaaataaaactgaagtcccgcctgtccgggggcgtgcaccggctggagtcagtggaagagtataacgaacttatggtacgcaacggagatcctagaatccgcatgctggaagttagccgagatggtagaaaacacagtttgcctcagctgcttgactcctcaagtgcctcccaggagtaccacattgtgaagaaatcaaccagatcgttgtccaccacccaggtggagagcccatggcgactgattcggccctccgtgatttcaatcattgggctatataaagaaaaggggaagggtctgggcttctcaattgccgggggtcgggattgcatcagaggacagatgggcatatttgtcaaaaccatcttccccaatggatctgccgccgaagatggaagacttaaagagggcgatgaaatcctagacgtgaatggcattcccataaaggggctgactttccaagaagctatacacacgtttaaacaaattagaagtggcttgttcgtgctgaccgtccggacaaaacttgtctccccaagcctcaccccgtgttctacccccactcacatgagtagaagtgcaagccccaacttcaacaccagcggaggcgccagtgccggtggaagtgatgagggttcttctagctcattgggtaggaaaactcccggccccaaggatagaatcgttatggaagtgaccctgaacaaggagccgcgagtcgggctgggaattggcgcctgctgtctggcgctggagaacagccctcctggcatttacatccactccctggcccccgggtcagtggccaagatggaatccaacctgtcccggggagatcagatcctggaagttaacagtgtcaacgtaaggcatgccgcactatctaaggtccatgcaatcctgtcgaagtgtccacctggcccggtgcgattggtgattggtcgccaccccaaccccaaagtgagtgagcaagagatggacgaggtgatcgctcgcagtacgtaccaagaatcaaaggaggcaaactcttcccctgggttgggaactccccttaagtcgccaagcttggcgaagaaggactccttaatttccgaaagcgagctttcccagtactttgcacatgacgtgcccggccccctgagcgatttcatggtggccggatccgaggatgaagatcacccagggtctggctgtagcacctccgaggaggggtctctgccgccttccaccagtactcacaaggaacctggcaaaccccgggccaatagtttggttacactgggctcccatcgggcctccggattatttcacaagcaggttacagtggctcgtcaagcaagtctgcctggatctccgcaggccctgagaaatcccctccttcgccagcggaaagtgggttgttacgatgccaatgatgcttccgacgaagaggaatttgatagggagggggattgtattagcctcccgggggcccttccaggccccatcaggcctctatcagaggatgatcctaggcgagtgtctataagctcctcaaagggaatggacgtgcacaatcaagaagagcgccccaggaagaccttggtgagcaaagccatttctgctcctcttctgggcagttctgtggacctcgaggaatccattccagagggcatggttgatgccgcatcttatgctgccaaccttacagactcagccgaagctcccaaaggaagtccaggaagttggtggaagaaagagctgtctggttcctctagcgccccaaagttagagtacactgtgcggacggacacgcagtcccccactaatactggctccccaagttcaccacagcagaagtcagagggactaggatctcggcaccggcctgtggcgcgagtgagtccacattgcaagcgtagcgaagctgaagccaagcccagtgggtcccaaaccgtgaacctcaccggcagagcaaacgacccctgcgacctggactcaagagtgcaggccacctctgtgaaagtgactgtagcaggttttcaacccggcggtgctgtggagaaggaatcattaggcaagcttactaccggtgacgcttgcgtgtccacgagttgcgaattggcgtccgccctgagtcacctcgacgcctctcaccttaccgaaaatctgccaaaggccgcctcagagctggggcagcagcctatgaccgaactggattcttccagcgatctgatctctagtccaggcaagaaaggtgcagcacatcccgaccctagcaaaacctcagtggataccggccaggtgtccaggcctgaaaacccttcccaacctgcgtctccgcgcgtgacgaagtgcaaggcgagatcaccagtacgtttgcctcatgagggatcacccagtcccggcgagaaagctgcagctcctcctgattattccaaaacacgctctgcctctgaaacttctacaccccataatacccgccgggttgccgccctgcgcggagcgggtccaggggctgagggcatgactcctgctggtgctgttctcccaggcgaccctttaacatctcaggagcagcggcagggggcccctggaaatcactccaaggccctggagatgacaggaatacacgctcctgagtcatcacaggaaccctccctgttagaaggtgctgacagcgttagctcccgggccccccaggcctctctttccatgttacccagcacagataatacaaaggaggcttgcggccatgtgtctggccactgttgtcccggcggcagccgggaatcccctgtgacagatatcgattccttcattaaggaactggacgcatccgccgctaggtccccttcctcccagactggcgatagtggtagccaggagggatccgcccagggtcatccgcctgcaggcgcagggggcgggtcgagctgtcgtgccgagccggtacctggcggccagacaagttcccccagacgggcttgggccgcaggagctcccgcttatcctcaatgggccagccaaccatccgttctggattctattaatcccgacaaacatttcaccgtaaacaagaacttcctctccaactacagtagaaacttctcctcgttccatgaagactccacctcactgtctggcctcggggatagtactgagcccagtctgagctctatgtatggagacgcggaggactcaagctcagaccctgaatccttaactgaggctcctcgggcatccgcccgcgacggctggtcgcctccgaggtctcgcgtgagccttcacaaagaagacccctcagaaagcgaggaggagcagatagaaatttgctctactcgggggtgcccaaatcccccctcctcacccgcacatctgcccacgcaggccgcaatctgtcccgctagtgcaaaggtgttgagtcttaagtattcgacgcctcgcgagagcgtcgccagtccacgtgagaaggcagcatgtcttccaggctcctacacttcaggcccggacagctcacagccttcctcactcctcgagatgtccagtcaagagcacgagacacacgccgatatatccacttcccaaaatcaccgtccctcgtgcgcagaagagaccactgaagtgacctccgcttcgagtgccatggagaactcccccctgtctaaggtggcccggcacttccacagccctcccatcatactgtcatcccctaacatggtcaacggcttggagcatgatcttctggatgacgaaacacttaaccagtatgaaacttcaattaacgcagctgctagtctttcttcatttagcgtggatgtgcctaaaaacggcgagtcggtcctagaaaatctccatattagtgagtcgcaggacctggacgatcttcttcaaaaacccaagatgatcgcgcgaaggccaatcatggcctggttcaaggaaattaacaagcataaccaaggcacccatctccgatccaaaactgagaaagaacagcctctcatgcctgcccggtcgcctgactccaagatacaaatggtgtcatcatctcagaagaaaggagtgactgttccccattctcctccacagcccaagacaaatttagaaaacaaggacctctcaaaaaagtcccccgccgaaatgctgttaactaacggccagaaggcaaaatgcggccctaagctgaagagactgtcactgaagggaaaggctaaagtgaactcggaggcccctgctgctaatgcagtgaaggctggaggaaccgaccataggaaacccttgatttccccccaaactagccacaaaacactgtctaaagccgtatcccagagacttcatgtggcagatcatgaggacccagaccgaaacacgaccgccgcgccaagatcccctcagtgcgtcctggaatccaaacctcccctagcaacaagtggaccacttaaacccagcgtcagcgacacatcaatccggaccttcgtctcccctttgactagccccaagccagtgcctgagcaaggcatgtggtccagatttcacatggcagttctgagcgagcctgacagaggctgtcctactaccccgaagtcacctaaatgccgggccgaaggcagagccccgcgagcggactctggcccagtgtcacccgctgcctcccgcaacggcatgtctgtcgctggcaatcgccagtccgagccccgtctcgctagtcacgtcgcagcggacactgctcagcctaggcccactggtgagaaaggaggtaacatcatggcttctgaccgcctggaaagaaccaaccagctaaagatagtggagatatccgccgaagccgtcagcgaaactgtttgtggaaacaagcccgctgagtcagataggcgcggtggctgtttggcacagggaaactgtcaggagaagtcagaaatccgcctgtatagacaagtggcggagagctccacaagccaccctagctccctcccatctcatgcctcccaagctgagcaggagatgagtcgatcattttccatggctaagctcgcctcgtccagctctagtctgcagaccgccatacgcaaggcagaatactcccagggcaagtcatccctgatgtccgattctcgaggtgtgcctaggaactcaattccaggtggaccaagcggagaggaccatttgtattttacacccaggcctgccacgcgcacttacagcatgccagcccaattttcaagccatttcggccgagagggtcacccaccacatagcctgggccggtcaagagattctcaggttccagtgacttccagtgtagtcccagaagctaaagcttcccggggaggccttccttcccttgcaaatgggcaaggcatttactcagtcaagcccctcctggatacctctcgaaacctgcccgccacagacgagggcgatattatatccgttcaggaaacaagctgtctggtgacggacaaaattaaagtaactcggaggcactactgctacgaacagaactggccgcatgagtctactagttttttttcagtgaaacagaggatcaagtcatttgagaatcttgctaacgcagaccggcccgtagccaagagtggtgcctccccgtttctgtctgtcagttcgaagcctccgataggacgccgtagcagcggatccattgtctctggcagtctggggcatccaggtgatgccgctgcccgactgcttcgaagatcgctgtcctcgtgttctgaaaatcaaagcgaagccggaacactcttgccacagatggcaaaatcaccctccattatgacgctaaccatttctcggcagaatccacccgaaacatcctccaaaggctccgatagtgaattgaaaaagagcctgggtccactcggcattcctacacccaccatgactctggcctcccctgtaaagaggaataaatctagcgtgaggcatactcagccatcaccagtcagccggagtaaactgcaagaactgagggctctctctatgccagatctcgataaattatgcagcgaggattacagcgctggtcccagcgctgtgttatttaaaactgagctggaaatcacaccccgacgcagtcctggacctcctgcaggcggggtgtcctgtcccgagaagggggggaaccgtgcttgccctggaggttccgggcctaaaacctccgctgcagagaccccctcgagcgcgtccgacactggagaggcagcccaggacctcccattcagaaggagctggagcgtgaatctggaccagctcctagtctccgcaggcgaccagcagcgactgcaatcggtgttaagcagcgtgggatctaaatctactattctcaccctaattcaggaagccaaagcccagtctgaaaatgaggaggacgtctgtttcatcgttctgaataggaaggagggctcaggtctaggattttcggtggctggaggaaccgacgtagaacccaagtctattacagtccatagggttttcagtcagggagctgcctctcaggaggggaccatgaatcgtggtgactttttattgtcggttaacggcgcctccttggcaggcctggcccacggaaacgtgctgaaggtgctacatcaggcacaattgcacaaggacgccctggttgtcatcaaaaaaggtatggaccagcctcgccctagcgcacgtcaagagccccccacagcgaatggtaaaggcctgctgagtcggaaaaccattccgctagaaccagggatcggtcggagtgttgcagtgcacgacgcgctgtgcgtcgaagttctcaagacgagcgctggccttgggctctctttggatggcggtaagtcatcagtgaccggtgatgggcctctcgtcataaaaagggtttataaaggtggcgccgctgagcaggccggtattattgaagcaggcgatgagattttggctatcaacggaaagccactcgtggggttaatgcattttgatgcatggaacatcatgaaaagtgtaccagagggacctgtccagctgttgattcgcaaacatcgtaactctagctag

SEQ ID NO: 128023 - DNA, 7923 bp, Artificial Sequence
  Description of Artificial Sequence: Synthetic coding sequence
atgccgatcactcaagacaacgcagtgttgcacctgccactcctgtaccagtggttacagaacagcctgcaggagggtggcgacggtcctgaacaaagactttgccaagctgctattcaaaaacttcaggaatatattcaactcaattttgctgtcgacgaatctacagtgccccctgaccactctccgcccgagatggaaatttgcactgtttacctgacaaaggagttaggcgacaccgagacagtaggcttgtcatttgggaacataccagtgttcggagattatggtgagaaaaggcgcggcggcaagaaacggaagactcaccagggtcctgtcttagacgtcgggtgcatctgggtgactgagctacgtaagaacagccccgccgggaagtctggaaaggtccgcctcagagatgagattctgagtctcaacgggcagcttatggtgggggttgacgtgtcaggcgcctcttacctggccgagcaatgctggaatggaggttttatctatctgataatgctccggcgcttcaaacataaggctcattctacttataatggtaattcatccaattcgtctgagccaggtgaaacgcctacccttgaattgggagaccgaaccgccaaaaaagggaaacgcactcgcaaattcggtgtaatttcacggccacccgccaacaaggccccggaagaatctaagggttccgcggggtgtgaagtgtcatccgacccatctactgagctggagaatggccccgaccccgaactgggtaacggacacgtgtttcagttagaaaacgggccagactctcttaaggaggtggcaggcccacatctggagagaagtgaagtggacaggggcacggagcatagaattccgaagactgatgcaccattaacaacctccaacgataaaaggcgctttagtaaaggcggcaaaactgactttcagagctcggattgtctagctagagaagaagtgggaaggatttggaagatggaattgctgaaagagagcgatggactgggcatccaggtatctggaggtcgtgggagtaagcggagtccacacgcaattgtggtcacacaggtgaaagaaggcggggccgcacaccgtgagtaccatatagtgaaaaagagcacccgctccctgtccacaactcaagtggaatctccatggcgcctcatccgaccatctgttatctctataattggtctgtacaaggagaaggggaaaggactcggcttctccattgccgggggcagggattgtattcggggccaaatgggcatcttcgtaaaaacaatcttcccaaatgggagcgcagccgaggatggccgcctgaaggaaggcgacgagatccttgacgtcaatggtatcccaatcaaaggtttgactttccaggaagcaattcatacatttaaacagatccgatccggacttttcgttctcacagtcaggactaaactcgtgagcccgtctctgactccgtgctcgacacccacccacatgagtcggtctgcatcccccaattttaacacctctggcggcgctagcgcaggggggtcagacgagggctcatcctcctccctgggcaggaagactccagggcccaaagacaggatagtgatggaagtaacccttaacaaagaacctagagtggggctggggatcggcgcctgttgccttgccctagagaattcgcctcccgggatctatatccacagcctagcaccaggctcagtggccaagatggagtctaacctttcgagaggtgatcagattctggaggtgaactccgtgaatgttagacacgccgcactgtcaaaggtacacgcaattttgtcgaaatgtcccgttagtgaacaggagatggacgaggtgattgcgcggtcaacatatcaagagtcaaaggaggcgaactcctcacctgggttgggcacgcctctgaagagtccgtccctggccaagaaggattctctcatcagcgaatcagaattgtcacagtactttgctcacgacgttcccggccccttatccgacttcatggtcgccggctctgaggatgaagatcacccaggctccgggtgcagtacctcagaggagggcagcctgcccccttccacatccaaggagccgggcaagcctcgggccaacagtttagtcactctgggctctcatcgcgcttccggtttattccacaagcaagtgacagtagctaggcaggccagcctgccaggaagtccgcaagcattgcggaatcctctcttgcgtcaacggaaagtagggtgctatgatgcaaatgacgcaagcgatgaggaggaattcgaccgcgaaggagattgcatctctctgcccggtgcattacctggacccattcggccgctatctgaagatgatccgcgaagagtatcaatcagcagttcaaaagggatggacgttcacaatcaggaagaaagaccacggaagactctggtgagtaaggcgatctctgcgcccctgcttggatcaagcgtggatcttgaagagtcaatccctgaagggatggtcgacgccgcttcctacgccgcaaatctcacagactctgctgaagcccctaaagggagtcctggaagttggtggaagaaggagctttcagggagtagctctgccccgaaactagagtacaccgtgaggacggatacacagagccccaccaatacaggaagtcccagttcccctcaacagaaaagtgaaggacttgggtcaagacacagacccgtggcaagagtgtcaccgcactgcaagcggtccgaggcagaggcaaaaccctccgggagccagaccgtcaaccttaccggacgggccaatgatccttgcgacttggattctcgggtgcaggccacctctgttaaggtcaccgtggccgggtttcaacccggaggcgccgttgagaaactatgccaagagagtctgggcaagctcaccactggagatgcgtgtgtcagcacatcttgtgaactcgccagtgccctttctcacctcgacgcgtcccatttaaccgagaatttgccaaaggctgcaagcgagctgggccagcaacccatgaccgctagtgatttgatatcctccccaggcaaaaagggcgccgcccaccccgacccctccaaaacttcagtggacacaggtcaagtgtcacgccctgagaaccctagccaaccagcgtctcctcgtgtcactaaatgtaaagcccgctcaccagttcggctgccccatgagggatcccccagtcccggggagaaggctgcggctccgcctgattattcgaagacgcgctcggcctccgaaactagcacacctcacaatacaagacgggtcgccgcactcaggggagcaggacccggggccgaggggatgacgcctgcaggagcagtgctgcctggtgatcctctgacctcacaggaacagcgccagggcgctccgggaaaccactccaaggccctcgaaatgaccgggatccatgcccccgaaagcagccaggaaccgagcctgttagaaggggccgattccgtgtcctcccgggccccccaggcctcactgagtatgctgccctcgaccgataacactaaagaggcctgcggtcatgtatcaggacattgctgccctggagggagccgggaaagccccgtcacagacattgacagtttcattaaggagctggatgcctccgccgcccgcagcccctcttcgcagaccggggattccggatcacaagagggttctgctcaaggccacccccccgcaggagccggtggaggtagctcatgccgggcagaacccgttccagggggacagacaagttcaccacgccgtgcttgggccgcaggcgcgccagcttatcctcagtgggcgagccagcctagcgttctggacagtatcaatcccgacaagcacttcacagttaacaagaactttttgtctaactacagtcggaacttcagctcttttcacgaggattctaccagtctgtcgggtctgggtgatagcactgagccatcactgagttccatgtatggtgatgccgaagactccagttctgatcccgagagtcttactgaagctcccagggccagcgctcgggatgggtggtcccccccaagatcacgcgttagcctgcacaaggaggaccccagcgagagcgaggaagagcaaatcgagatctgctctacacggggatgtccgaaccctcctagctcccccgcccacttgcctactcaggctgccatttgccctgcctccgcaaaggtgctgtctctgaagtattctacgcccagggagtctgtcgctagtcctcgcgaaaaagctgcctgcctgccggggtcctacacgagcggtcccgattcctctcagccatcctccttgctagagatgtccagccaggaacatgaaacccacgccgacatcagtacaagccagaaccaccgccccagctgcgcagaggagaccacggaggtgacgagcgcatctagcgctatggagaacagtccactctcgaaagttgctagacatttccattccccacctatcatactgagcagccccaacatggtgaatggattggaacatgacctgttagacgatgaaacccttaaccagtacgagacaagcattaacgcagcggcttcacttagctctttctccgtagacgtccctaaaaacggcgaatccgtgctggagaatcttcacatttctgagtcacaggatttggacgacttgcttcagaagcctaaaatgatcgccaggaggcctattatggcctggtttaaggagattaataagcacaatcagggaacccacttaagaagtaagaccgaaaaggaacagccacttatgccagctagatcacctgactccaaaattcaaatggttagtagtagccagaaaaagggagtgaccgtcccccattcaccccctcaacctaagacaaatctggagaacaaagacctaagcaagaaatcccccgctgagatgctccttacaaatggacagaaagctaagtgtgggcctaagctgaagcgattgtcactgaaagggaaagccaaggttaattccgaggcacccgccgcaaatgccgtcaaagccggcggtacagatcatcgcaaacccttgatcagccctcagacaagccataagacactgtcaaaagcggttagtcagagactgcatgtagcggaccacgaggatcctgatcggaatactacagccgccccgagaagtccgcagtgtgtgctcgagtcaaaacccccgctggctaccagcggacccctcaaacctagcgtctcggacacaagcattagaacttttgtgtccccactgacatctcccaagcccgtcccagagcagggaatgtggtcccgattccatatggcagtccttagcgagcccgaccggggctgcccaacgaccccaaaatctcctaagtgcagggccgaggggagagcaccacgagccgatagcggtcccgtgtctcccgctgccagccgcaatggaatgagcgtagcaggcaacagacagagcgagccccgcctagccagtcacgttgctgctgataccgcccagcctaggccaacaggcgaaaagggtggaaacattatggcgtccgataggctggagagaacaaaccaattaaaaatcgtggagatatcagccgaagccgtgagcgaaaccgtgtgcggaaataaacctgctgagtctgatcgcagaggcggatgtctggcacaggggaactgccaagagaagtccgaaatccgtctctacagacaagtggcagagtcgagcactagtcacccaagctccctgccctcgcatgcctctcaggctgaacaagagatgtctaggtctttttctatggctaagctcgcctcttcttcaagctccctgcagactgccatcagaaaggcggaatattcgcagggcaagtcgtcactaatgtcagattcaagaggtgtgccaagaaacagtatcccgggtggacctagtggcgaagatcacctttacttcaccccacgacccgccacccgcacctattcgatgccagcccagttttccagccattttggtagggagggacacccaccacacagtctcggcaggagcagggacagtcaggttccagtgacgtcctctgtggtgcccgaggccaaagcgtcccgaggcggcttacccagcctcgcaaacggccaaggcatatactccgtgaagccactgctggatacctctagaaatctccctgctaccgatgagggtgatattattagcgtgcaagagaccagttgtctcgtcacagataagataaaggtgaccaggcgtcattactgctatgagcagaattggccccatgaaagcacgtccttcttctctgtaaaacagagaatcaagtccttcgagaatttagccaatgccgatagacccgtcgcaaagtctggtgcctcgccattcctctcagtgtcttccaaacccccaattgggaggcgcagctcaggttccatcgtgtcgggctccttgggccacccgggagacgccgcggcacggctcctacgaagaagtctctcatcctgctcagaaaaccagtcggaggcaggcacgctgctgccacaaatggcaaagtccccatcaataatgacactgaccattagtcggcaaaatccccctgagaccagctctaaaggatctgactcagagctgaagaagtccctgggaccactgggtatcccaacccccacaatgaccctagcttcccccgtgaagcggaataaatcgtccgtgcgccacacacagccttcacccgtgtccaggagcaaactgcaggaactgcgagccctgtccatgcctgaccttgacaagctatgttctgaagactactccgccgggccgagcgccgtgctgtttaaaaccgagctcgaaattacgccccggcgaagcccgggtcctcccgctggtggcgtttcatgtcccgaaaaggggggtaatagggcctgccccgggggctccggcccaaagacaagcgccgcggagacccccagttccgcctcagacacaggcgaggccgcacaagatctgccctttagacgcagttggtctgtgaacctggatcagctgctcgtgagcgcaggtgaccagcaaagactgcaatcagtactctcttcggtaggatccaaaagtacaatcttgaccttgatccaggaggctaaagcccagagcgagaacgaggaagatgtctgcttcatcgttctcaacagaaaggagggctccggcctgggtttttcagtagctggaggcacagacgtggagccaaagtcaattaccgtgcatcgggtttttagccagggcgctgcaagtcaggaggggactatgaataggggggatttcctgctgtccgttaatggggcctccttagctgggttagcacacggaaatgtgcttaaagttctacatcaggctcaattgcacaaagacgctctggtagttattaagaagggaatggaccagccacggccatccgcccgtcaggaaccgcctacggctaatgggaaaggactcctgtcccgaaagactattcccttggagccaggcataggaagatcagtcgctgtgcacgatgccctgtgcgttgaggtactaaagacatctgccggccttggcttgagtctggatggcggcaagagttcagtcaccggggatgggcccctggtgatcaaaagagtctataaaggcggcgctgctgaacaagccggaataatagaagctggcgacgagatcctggctatcaacggtaagccccttgtgggcctcatgcacttcgacgcttggaatatcatgaagagcgtacccgaaggaccagtccagcttttgatacgaaaacaccggaattcctcgtag

SEQ ID NO: 128024 - DNA, 8520 bp, Artificial Sequence
  Description of Artificial Sequence: Synthetic coding sequence
atgccaatcactcaggacaatgcagtgctgcatctgccgctgctttatcagtggctgcaaaatagcctgcaagagggaggtgacggcccagagcaaagattgtgccaggcagccattcagaagctccaggagtatatccaacttaatttcgccgtagacgaatccacagtgcctcctgatcactctccacctgagatggagatctgtactgtatatctgactaaggagcttggcgatacagagacagtgggtctgtctttcggaaatatccccgttttcggagattacggagagaaacgaagaggcgggaagaagaggaagactcatcagggaccagtgcttgacgtgggatgcatctgggtgacagaacttagaaagaactccccagccggtaagagcggaaaagtgaggttgcgcgacgaaattctgtcccttaatggccagctgatggtaggagtggacgtgagtggagcttcctatctcgccgaacaatgctggaatggtgggttcatatatttgattatgctgcggagattcaagcacaaagcccattcgacatataacggaaactcttccaactccagcgagccaggggagactcctacattagaactgggcgacagaactgcgaaaaaaggcaaaaggacacgaaaatttggcgttatcagtcgaccacctgcaaataaagcgcccgaagagtccaagggatccgccgggtgcgaagtgagtagcgaccccagcaccgagctggagaatggcccagatccagagctgggaaatggccacgttttccagttagagaatggaccagattccctgaaagaagtcgccggaccacatctagagaggtccgaggtggatcgaggtaccgagcatcgtattcccaagacagatgcccctctcaccacctccaatgataagaggcggttctcgaagggaggaaaaacagacttccagagtagcgactgcttggctagagaggaggtcggaagaatatggaaaatggagctcctgaaggaatcagacggactgggaatccaagtatctggtggaagggggagcaaaaggtctccgcatgcaatcgtcgtgactcaggtgaaagagggtggagccgctcaccgagacggaaggctgagcctgggtgatgaactcctggtgatcaacggacacctgctggttggactgtcccatgaggaggcagtagcgatccttcggtccgccaccggtatggtgcaactggtagttgcctctaaggagaacagcgccgaggatctcctgagactgaccagcaagtcgcttcccgacctgacatcatcagtggaggacgtgagctcttggaccgacaacgaggatcaggaggcagatggagaggaagatgaagggacctcctcaagtgtgcagcgagcgatgccaggtacagacgaacctcaggacgtctgtggggccgaagagtcaaaaggcaacttggaatctccaaaacagggtagtaataagataaagctcaagtctcggctgtcggggggagtgcataggctcgaaagtgttgaggaatacaacgagcttatggttaggaacggagatcctagaatccgcatgctggaggtctccagagacgggcgtaagcatagccttccccagttgttagacagtagcagcgcgtcccaggaatatcatattgtaaagaagagtacaaggagtttgagcaccacgcaggtggagtctccatggagactgatccgacctagtgtcattagtattattgggttgtacaaggagaaggggaagggcttgggattttctattgccggggggagagattgcatccgcggacagatgggaatttttgtgaagacaattttcccaaatggatccgccgccgaggatggacggctgaaggaaggtgacgagatcttggatgtcaatggcattcctataaaaggtctgacttttcaggaagcaatccacacattcaagcaaattcggtccggattgttcgtcttgactgttagaacaaaactggtttccccaagcctcacgccttgctcgacaccgacacacatgagcagatccgctagcccgaactttaatacatccggtggcgctagcgctggcggttctgacgaaggatcaagtagctccctaggacgcaaaactcccggccccaaagataggattgttatggaggtcacccttaacaaagaacctcgcgtaggtctggggatcggagcatgttgtctggcactggaaaatagtcctccgggcatctacatacatagtcttgcaccaggctctgtcgctaagatggaaagcaatctgtcccgcggcgaccagattctcgaggtcaactcagtaaacgtgagacatgctgccctctccaaagtacacgccatccttagtaagtgccctccgggcccagtgcgactggtaatcgggagacatcctaacccaaaggtttctgagcaggagatggatgaagtgatcgcgagatcaacataccaggaatccaaagaggctaactcctcccccgggttgggaacaccccttaagtcgccttctttagctaaaaaagattccctgattagtgaaagcgagcttagtcagtactttgcgcatgacgtacccgggcccctgagtgactttatggtggctgggtccgaggacgaggaccaccccggcagcggctgttccaccagcgaggaagggtcactgcctcccagtacatccacccacaaagagccggggaaaccacgggccaacagcttggtcactctcggctctcaccgggcctctggcctctttcacaaacaggtcactgtcgcccggcaggcctctctccccggctctccgcaggcgctcaggaaccctcttcttcgtcaaaggaaggtgggctgttacgatgccaacgacgcctcagatgaagaagagttcgaccgcgagggtgattgcatttcactccccggggcacttccggggcctataagaccactgtcggaagacgaccccaggagggtatcgataagctcatcaaaggggatggatgtgcataatcaagaggagaggccccggaagactctggtgagcaaggcgatctccgcccccttactggggtcctccgtcgacctggaggaaagtattccagaaggtatggtagacgcggcctcttacgccgctaacctgacagatagcgccgaggcacctaagggatctcccggcagctggtggaaaaaagagctgagcggatcaagctctgcgcctaaactggagtataccgttcgaacggatacacaaagtcctacaaatacaggctcccccagttcacctcaacagaaatctgaaggcctgggaagtaggcatcgaccagttgctcgagtgtctccccattgtaagcgatccgaggctgaggccaaacccagcggctctcagaccgtaaaccttaccggcagagctaacgacccgtgcgacctcgactcccgggtgcaggcaacatccgtaaaagttactgtggcgggtttccaaccggggggagctgtggaaaaggaatccctgggcaaactgacaacgggggacgcttgcgtgagcacaagctgcgagctggcgtctgcgctgtctcatttggatgcttcccatttgactgagaacctccccaaggctgcctcagagttgggccagcagccaatgacagaacttgattccagttctgacctgatcagctcccccggaaaaaagggtgcagctcaccccgaccctagcaaaacgtcggtagatacagggcaggtctctagaccagagaacccatctcagccagcttcacctagggtcaccaaatgcaaggcccgatcccccgtacgcctccctcatgaggggtctccttctccgggtgagaaggccgcagcccccccagattattcaaagacaaggagcgcaagtgaaacaagtacgccacacaacacacgccgagtggcagcactgcgaggcgccggtcctggggcagagggaatgactccggctggcgcagtactgcccggcgaccccttaacttcccaagagcagcgccaaggggctcctggaaatcactcgaaagcactcgagatgacgggcatccacgcgcccgagtcttctcaggaacctagcctgttagagggcgccgattcagttagcagtagagccccgcaggcatccctgtccatgttacccagcacggataacaccaaagaggcttgcgggcacgtgtctggacattgttgcccaggaggtagccgcgaatcccctgtgacagacattgacagctttattaaggagcttgacgcatccgccgccaggtctccatcaagtcagacaggggactccggctcgcaagagggttctgcacaagggcatccccctgcgggcgccggcggggggagttcctgcagggctgaacctgtgccaggtggacagacctcatccccccgtcgtgcttgggccgccggcgccccagcatatccgcagtgggcctcccagccttcggtgttggatagtatcaaccccgacaagcactttacagtgaataagaattttctgagcaattatagtcgaaattttagcagtttccatgaggactcgacttctctgagtggtcttggagattcaaccgagccctcactctcctccatgtacggggacgctgaagactcttcctcggaccctgagagcttgacggaagcgccccgcgcgagtgcccgggacgggtggagccctccaagaagtcgagtcagtttgcacaaagaagaccccagcgagtcagaggaagagcagatagaaatctgctcaacccgtggctgccctaacccgccctcttctcctgcccacctgcccacgcaagctgccatctgtcctgcttctgccaaggtcttgtcactgaaatattcaacaccacgagagagtgtggctagccccagagagaaggcggcttgcctgcccggtagctacacaagcggccctgattcatctcagccaagctcgctgttggagatgtcttcacaggaacacgaaacccacgctgatatctctacatcacagaatcaccgcccatcctgcgccgaggagactaccgaggtgaccagcgcgagctctgccatggagaacagtccactgagtaaggtggctcgccacttccactccccgccaattatcttaagctcccccaatatggtcaacggactggaacacgatcttctcgatgacgagaccctgaaccagtacgagacgagcatcaatgcagccgcctccctttcaagcttctccgtggacgtccccaagaatggcgagagcgtgctggagaacctgcatatcagcgaatcccaagatttagacgacctgctgcaaaagcctaagatgatagcccgtcgtcctattatggcctggttcaaggaaattaataaacacaaccaggggacacatctccgttccaagactgaaaaggaacagcctctgatgcctgcccgcagcccggactctaaaatccaaatggtttcaagcagtcagaaaaagggagtcaccgttcctcatagcccaccacagcccaagaccaatctcgaaaacaaagacctgagtaagaaatcccctgccgagatgctgttgacaaacggacagaaggcgaagtgcggacctaaactgaaaaggctgagcttaaaaggaaaggctaaggttaacagcgaagcacctgctgcaaatgccgttaaagcggggggtactgaccatagaaagccattgatttcccctcagacttctcataagacactgagtaaggctgtctcgcagcggctgcacgtcgcagatcacgaagacccagataggaacacaactgccgccccaagatcccctcagtgtgtgctcgagtccaagccccctctcgcaaccagcggcccactcaagcctagcgtctccgacacctccattcgcaccttcgtctcccccttgacatccccaaaaccagtccccgagcaaggcatgtggtcacgtttccatatggccgtactgtcagagccagatcggggatgtccgactaccccgaagtcccctaagtgtagagccgaggggcgggctccgcgggccgattcgggccccgtctcacctgctgcctcacgaaatggcatgagtgttgcgggtaatcgccagtccgagcccagactcgcttcccatgtagccgctgatactgcccagcctcggcccacaggcgagaaggggggcaacattatggccagcgacagactggaacgtacgaaccaactgaaaatcgtggagatatccgccgaggctgtgagtgagaccgtgtgtggaaacaagcctgccgagtcggaccgcagaggcgggtgtcttgcccagggcaattgtcaggagaaaagcgaaattagactctatcgccaggtggcggagagcagtacatctcacccgtcctctctgcccagccatgcgtcccaggctgaacaggagatgtccaggtccttcagcatggcaaaactcgcctcatcctcaagttcactacagactgctatccggaaggccgaatatagccagggtaagagctcgctgatgtcagatagtaggggtgtgccaaggaatagtatccccgggggaccctccggagaggaccacctctactttacaccaagaccagccacccgcacttactctatgccggcacagtttagttcgcactttggacgggaaggacatcctcctcatagtctgggacgatctagagactctcaagtcccagtcacaagtagcgttgtcccagaagcaaaggcctcgagagggggcttgccaagccttgccaacggccaaggcatctattctgttaagccgctgctggatacatcacgcaatttgcccgctactgacgaaggggatatcatttccgtgcaagaaacatcctgcctggttaccgacaagatcaaggtgacccgacggcactattgttatgagcaaaattggccccacgagtctacaagctttttctctgtaaagcagcggataaaatccttcgagaacctcgccaatgcggatagacccgttgcaaagtcaggagccagcccctttctttccgttagcagcaagccacccattgggaggagaagcagcggctctatcgtctccggctcactgggccaccccggtgacgctgctgcccgcctgctacgacggtctctgtcttcttgctccgagaatcagtctgaagctggcacgctactccctcagatggccaagtccccatcgatcatgacgctgacaatcagccgtcaaaacccccctgaaacatcatctaagggctctgactccgagctgaagaaaagcctcggaccattgggaatccccacccccactatgacactcgccagcccagtaaaaaggaacaagtctagcgtacgacacactcagcctagtccagtgtctcgcagcaaattgcaggaacttcgtgctctaagcatgccagacctggacaagctttgttctgaagactacagtgccggcccatctgccgtgttgtttaaaaccgagcttgagatcacgccacggcgaagccctgggccgcccgctgggggagtctcatgccctgaaaagggagggaaccgcgcctgcccaggtgggagtggccctaagacttcagctgccgaaacaccttcatctgcgtcagatacaggcgaagccgcgcaggatcttccatttcgaagaagttggagtgtgaacttggatcagctgctggtatctgcaggcgaccagcaaaggctgcagagcgtactcagcagcgtcgggtctaagtccaccatcctcacgctcattcaggaagccaaggcacaatctgagaatgaggaggacgtatgttttatcgtgctcaaccggaaggaaggatcaggactgggattcagcgtggcgggtggtaccgacgtggagccgaaatccattaccgttcacagggtgttttcccagggggccgcctctcaagagggaaccatgaaccggggagacttcctgctttccgtgaatggagccagcctggctggtctggcccacggtaacgtgctcaaggttctacatcaggctcagctccacaaagacgcccttgtcgttattaagaaaggcatggatcagcccagaccgagtgcccgccaagaaccgcctactgctaacggcaaaggcctactgagtagaaagaccatacctttggagcccggaatcggcaggtccgtcgccgtacacgatgccctatgcgtcgaggtactgaaaacatcggccggtctcggcctttccctggacggggggaagagcagtgtgaccggcgacggtcctctggtcattaagagagtatacaagggcggggccgccgagcaggccggtatcatagaagcgggagacgagatcctcgcaatcaacggaaaacccctcgttggtctgatgcactttgacgcctggaatattatgaagtcagtgccagaaggtccagtgcagctattaattagaaagcaccggaattcgagctag

SEQ ID NO: 128025 - DNA, 45 bp, Artificial Sequence
  Description of Artificial Sequence: Synthetic coding sequence
atgcctatcacccaggacaatgcagtgttacacctcccactttag

SEQ ID NO: 128026 - DNA, 1476 bp, Artificial Sequence
  Description of Artificial Sequence: Synthetic coding sequence
atggaaaaagcagctgacctgcaagacaccgctagcttgacgctcaaatttaagtttaaccctaagttgggtatcgataatcccgtgctcagcttagccgaagatcatgacccatacgacccatggtcactggaacggccaaggttttgcctcctctcaaaggaagaggggaaatccttcggatttcacctgcagcaggaactggggagggcaggacacgtggtgtgccgagtcgatcctggaaccagcgcacaacggcaaggcctgcaggaaggggatagaatcttagcagtcaacaatgacgtcgttgagcatgaggattatgcagtcgtggttcgtcgcatccgagcctcatctccaagagtgctgttaaccgtattggcccgacatgcacatgacgtggcccgggcacagcttggcgaggacgcacacttgtgtcctaccctgggaccaggggtacggcctaggctatgtcacattgtgaaagatgagggtggctttgggttctccgttacacatggcaatcagggtcccttttggctggttctttctacgggcggggccgccgagagagcaggagttcctcctggggcacgattgctggaagttaatgggctgtggcagtcaggccagcaggtgacactgttggtcgccggacccgaggtggaggaacagtgtaggcagcttgggctgcccctcgccgctcccctcgccgagggttgggccctgcccacaaaacccagatgtcttcaccttgagaaaggtccccagggatttggctttctactccgcgaggagaaaggactggatgggcggccaggccagtttctatgggaagttgaccccggtttgcctgctaaaaaggccggtatgcaggctggcgataggcttgtcgcggtggctggtgagtccgttgagggcctaggacacgaggagactgtctcaaggatacagggtcaaggtagttgtgtgagcctgactgtggtcgacccagaggcagatcggttctttagtatggtgaggttgtcacccctgttgtttttagaaaacacggaagctccagcctcgcctcgtggcagcagtagtgctagtctcgttgaaacagaggaccctagcctggaagatacatcagtgccttccgtccccctggggtcacgccaatgcttcctataccccgggccaggcggaagttacggatttcggctcagttgtgtggccagcggtccccgtctgtttatttcccaggtcaccccaggaggctctgcagcgagagcgggactgcaggtcggagatgtaattctcgaggtgaatggctaccccgtaggtggacaaaatgacctggaaaggctgcaacagctccccgaggctgaacccccgctctgcctgaagcttgctgccagatctcttaggggtctcgaggcctggatcccccccggtgcagcagaagattgggccctggcgtccgaccttctgtag

SEQ ID NO: 128027 - DNA, 1518 bp, Artificial Sequence
  Description of Artificial Sequence: Synthetic coding sequence
atggagaaggctgcagacctgcaggatacagccagcctgacactgaaattcaaatttaaccccaaactgggtattgataatcccgttttgagcctagcagaggaccacgatccttatgatccgtggtcactggaacgccccagattctgcctgctaagtaaggaggaaggcaaatcctttggcttccatttacagcaggagctaggcagggctggacacgttgtttgcagggtggatcctgggacatccgcgcagcgtcagggcctccaggagggggataggatcctggccgttaataacgacgtggttgagcacgaggattatgccgtggtggtgcggaggatacgtgcttcaagccccagagttctgctgacagtgttggcccgccatgctcatgatgttgctagggctcagcttggggaagacgctcatctttgccctaccctgggaccaggcgttaggcccaggctatgtcacatcgtgaaagacgaaggcggcttcggattctccgtgactcacggaaatcaggggccgttctggctcgtgctgtcaaccggcggtgccgctgaacgggcaggcgtcccgcccggggccaggctgctggaagtgaacggggtgtcagtcgaaaagttcacgcataatcagctaacacgcaaactctggcagtcggggcagcaggttacactgctcgtcgccggacccgaggtcgaagagcagtgtcgacagctgggtctgcccctcgccgcgcccctggcggaaggatgggcactgccgacaaagccgcgctgtctccatctggaaaaaggtcctcagggtttcggtttccttctgcgcgaggagaagggcctggatgggcgacctgggcaattcctgtgggaagtggacccaggcttgcctgccaagaaggctgggatgcaagctggtgaccgcctcgtcgcagtagcaggagaatcagtcgagggattagggcacgaggagaccgtcagtcgtatccaaggccaggggagttgcgtgagcctgacagtggtggatcctgaagcggatagatttttttccatggtgaggctgtcccccctgttatttctcgaaaatacagaggctccggccagcccccgcggcagcagtagtgcgagcctggttgagacagaggatccttcactggaggacacaagcgtgccgagcgtgcctctggggtcccggcagtgcttcctttacccaggaccgggcgggtcctacgggtttaggctctcatgtgtagcttctgggcctcggctctttattagccaagtgacccctggggggtccgcagcacgagctggcctgcaagttggagatgtaatactcgaagttaacggctatcctgtcgggggtcagaatgacttggagcgtctccagcagttaccagaggccgagccaccactatgcctaaagctggccgcccgttcactccgtgggctagaggcttggattccgcccggagcagccgaggattgggctctcgcctccgacctgctctag

SEQ ID NO: 128028 - DNA, 1716 bp, Artificial Sequence
  Description of Artificial Sequence: Synthetic coding sequence
atggtcactcctagtcccccaggaaaccactctctatcactggaggcccccagactccataccgcatcagaccttctggggaaccactctctggggctccccctgatcacggcccttgtcggttcaagggacaggaggggaagggtgtttagtccggtgcctgttcccttgcctactaacccaacaacccagcaccctacacgccagaagctcccatcaacgttgtctggacatagggtgtgtcaggcccatggcgaacctgtcctcgggctgtgtccactattgcctctcttttgctgccctcctcacccaccagatccatggtccctcgagcgcccacggttttgtctgctgtctaaagaagagggaaagagttttgggttccacctgcagcaggagctggggagggccggtcatgtggtgtgccgagtggatccagggacctcggcccagcggcagggccttcaggaaggcgatcggattctggccgtgaataacgatgttgtcgagcacgaagactacgctgtcgtggtgcggcgcatcagggcgagctcacctcgagttttgctgaccgtgctggccagacatgctcatgacgtggcccgggctcaactgggcgaagatgcccacctgtgtccaacgctcggccccggagtcagacccaggctgtgtcacattgtgaaagacgaaggaggattcggtttcagcgtaacacacggtaaccagggacctttctggttggtgctctcaacggggggcgctgctgagcgtgccggagtgcctccaggggccagattactggaggtaaatggggtctccgtggaaaagttcacccacaatcagctgacccgtaaactctggcagagcgggcagcaggtgacactgctggtggctggccctgaagtcgaggaacagtgtcggcagcttggcctacctctcgcggccccccttgccgaagggtgggcgctccctactaagccacggtgtctccacctggaaaaaggacctcaggggttcggttttctgttgagggaggaaaaaggtttggatggtcgcccaggccaattcctgtgggaggttgacccagggctgcccgccaaaaaagccggcatgcaggcgggtgatcgtctcgttgccgtggcaggcgagagtgtggagggtctcggtcacgaggaaactgtaagtcgcatccagggtcaggggagttgtgtcagcctgaccgtggtcgaccctgaagctgatcggtttttttccatggtacggttatcaccacttcttttcctcgagaacacagaagctcccgccagcccacgcgggagctcctctgcctctctagtggaaacagaagatccctcccttgaagatacttccgtgccatcagtgcccttaggctctagacagtgcttcctttaccccgggcctggcggctcctatggatttagattatcctgtgtggcttccggcccccgtctgttcattagccaggttacaccagggggttctgccgcacgcgccgggctgcaggtcggagatgtaatcttagaggttaatggatatccagtcgggggtcagaacgacttggagcggctacagcagttgcccgaagccgagccccccctctgtctgaaactggcggccagatccctccgcggcttggaagcttggatacctcccggcgctgcggaggactgggccctggcctccgatctcctgtag

SEQ ID NO: 128029 - DNA, 1518 bp, Artificial Sequence
  Description of Artificial Sequence: Synthetic coding sequence
atggaggaagccctggatctccaggacaccgcctcgcttacactgaaattcaagttcaatcccaagttgggaattgataatcctgtcttaagcctagccgaagaccacgacccctacgacccttggtcactggagcgccctcgcttttgtctgctaagtaaggaagaagggaagagtttcggctttcatctccagcaagagttggggcgcgccggtcacgtcgtgtgtagagtggacccaggcacaagtgcccagaggcagggcctgcaggaaggtgatagaatattagcagtcaacaatgacgtagtggagcatgaagactatgctgtcgtggtgcggcgcattcgtgcatcttccccacgggtgcttctgacagtgctcgcaaggcacgctcacgatgtcgctcgcgctcaactgggcgaggacgcccacctatgccctaccttggggcctggagtgcgccccaggttgtgccatatcgtgaaagatgaaggcgggttcggcttcagcgtgacacacggaaaccaaggccccttctggctggtcctgtccacaggtggcgccgccgagagggccggagtacctccaggggcccggttgctcgaggttaacggtgtaagcgttgaaaagtttacccataaccagctgactagaaagctttggcagagtggtcagcaggtaactctgctggtcgccggccctgaggttgaagagcagtgtaggcagctgggtttgcctcttgctgccccactcgctgagggttgggcactgccaacgaaacccaggtgccttcacttagaaaagggccctcaggggtttggtttcctccttcgcgaggaaaagggcctagatgggaggccgggacagttcttatgggaggtagaccctggtctgcccgcgaagaaagctggcatgcaagctggcgaccggctggtggcagtggccggcgaaagcgtggagggtctgggacatgaggagacggtctctcgaattcaaggacaaggatcatgtgtcagcctgaccgtagtcgaccccgaggcagataggttctttagcatggttcgactatcccccctcctctttttagagaataccgaagcccctgccagccctagaggcagttccagcgccagtctggtggagacagaagacccaagtctggaggacacgagcgtgccctccgtacctctgggtagtaggcagtgcttcctctacccagggcctggtgggtcatatggctttcgattatcttgtgtcgcttcaggtcccaggttgtttatttcgcaggtgacaccaggcggctcagcagctcgcgctgggctgcaggtgggagacgttatcctggaggtcaatgggtatcccgtcggcggtcaaaacgacctggaacggctgcagcaactgcccgaggccgaacctccactgtgcctgaagctcgccgcacgcagcttacgggggttggaggcatggattccaccaggggcagccgaggactgggccctcgcatcagacctactctag

SEQ ID NO: 128030 - DNA, 1716 bp, Artificial Sequence
  Description of Artificial Sequence: Synthetic coding sequence
atggttactccaagcccgcccggcaaccatagtctgtctctcgaggccccccgtctgcacacagcctcagacttgctgggaaaccattccttgggactgccgttgattactgcgctcgtggggagtcgagatcggagagggcgcgtgttcagtcctgtgcctgtaccgctgcctacaaatcccacaacacagcaccccacaaggcagaaactccccagcacactttcaggacaccgcgtgtgccaggcccatggagaacccgtcctggggttatgcccccttctgcccctgttctgctgcccacctcacccgcccgatccctggagtcttgagagaccaagattctgtctgttaagtaaggaggaaggtaaaagcttcgggttccaccttcagcaagaactggggcgcgctgggcatgtcgtgtgtcgcgtggatcctggtacctcagcccaaagacagggcctgcaggaaggggaccgcattctcgctgtaaataacgatgtggttgaacacgaagattatgctgtggttgtgcgtaggatccgggcatcatcccctcgcgtactgttgaccgtccttgcaagacacgcccatgacgtcgcaagggcccagctaggcgaggatgctcatctctgtcctacactggggcccggtgtacgacccaggctgtgtcacatcgtaaaagatgagggcggcttcgggttcagcgtcacacacggaaatcaaggcccattctggctggtcctcagcacaggaggcgctgccgagagggcaggagttcctcccggcgctaggttacttgaggttaatggcgttagcgtggaaaagtttacacacaaccagctgacccggaagctgtggcagtcaggccagcaggtgacactcctggtcgctggacccgaggtcgaagagcagtgccgccagttggggttgcccctcgccgctcccctagccgaaggatgggccctgccaacgaagcctaggtgcctgcatcttgagaaggggcctcagggcttcggcttcctgctccgggaagaaaaaggccttgacgggagacccggacaattcctctgggaggtcgatcccggtcttccagcgaagaaagccggcatgcaggctggagacagactagtggccgtcgccggcgagtcagtggagggcttaggtcatgaagagaccgtcagcagaatacagggccagggtagctgcgtctccttaacggtggtagacccggaagctgatagattcttttccatggtccggcttagtcctctgctgtttctggagaacaccgaggccccggcttcccccagaggttcatcctctgcgagcctggtagaaactgaggaccctagtctggaagacacctccgtgccctccgttcctctgggcagtagacaatgtttcctttacccaggaccaggtggctcctacgggtttcgtttgtcatgtgtagcgtctggaccacgactgttcatatcccaagtgacccccgggggcagtgccgcccgtgctggcttacaggtcggagatgtgatactagaggtgaatggatatccagtcggaggtcagaacgaccttgaaagacttcaacagctaccagaggctgaacctcccctctgcctgaagctggccgcgcggagcctccgggggctcgaggcctggataccgcccggcgccgcggaagactgggccctcgcctccgatctcttgtag

SEQ ID NO: 128031 - DNA, 2310 bp, Artificial Sequence
  Description of Artificial Sequence: Synthetic coding sequence
atgggttgtaacatgtgcgtggtgcagaaacctgaggaacagtacaaggtgatgctccaggtcaacggcaaagagctgtctaaattgagtcaggagcagacccttcaggcattgagaagctctaaggagcctttggtgattcaggtccttaggcggtccccacggctgagaggggactctagttgccacgacctgcagcttgtcgattcaggaacccaaaccgatattacatttgagcacataatggccttaggcaagttacgaccccctaccccaccaatggtaatcctcgagccccctccaattagccatgagtattacgatccggctgaattcatggagggcggtccacaagaggcagatcgactagacgaactagagtacgaagaagtggagttgtataagagcagccaccgggataaattgggtctgatggtatgttacagaactgatgacgaggaggatctgggcatttatgtgggagaagtgaaccctaactctatagccgctaaagacggccgcattcgcgaaggggacagaataattcagattaacggtgtggacgtgcagaacagggaagaggcggtcgccattttaagtcaagaggagaatacaaacatctccttgctggttgcacggccagaatcacagctggccaaacgctggaaggatagtgatcgagatgatttcttggacgacttcgggtccgaaaacgaaggagagctgagagctcgtaaactcaagtctccccccgcgcagcagcccggcaatgaggaagagaaaggtgctcccgacgccggccccggcctgtcaaattcacaggagctcgactccggggttggcaggactgacgagtccacacgaaacgaggagagctccgagcatgacttgctcggggatgagcctccatcaagcactaatactccaggcagcctgagaaaattcggactgcaaggagatgccttgcaaagccgagattttcacttttctatggacagccttctggccgaaggggctggtctggggggcggggacgttccaggactcactgatgaggagtacgagcgataccgagagctccttgagatcaagtgtcacctcgaaaatggcaaccagctcgggctcctgttccctcgcgcttctggtgggaattctgcactggatgtgaatcgcaatgagtccctaggacatgaaatggccatgctggaggaggagctgcgacacctggagtttaagtgtcggaacatcctgcgggcccaaaagatgcagcaactcagagaaaggtgtatgaaggcctggcttctcgaagaggagagtttgtacgatcttgccgcttcagagccaaagaaacatgagctgtcggacattagtgaactgcctgaaaaaagcgacaaggactctacaagtgcgtacaacaccggggagtcctgcagatcaacgccattgttagtagagcccctgccagagtctccgctacggcgtgcaatggcaggcaattccaatttaaaccgtactcctcctggacctgcagtagctacgccagccaaagcagcccccccacccggctctcctgcgaagtttcgaagtctgtcgcgtgaccccgaggccggacggcggcagcacgcggaggaaaggggcaggaggaaccctaagaccggcttgacactcgaacgcgtgggccccgagtctagcccatatctctctcgaaggcatagggggcaggggcaggagggcgagcattaccactcgtgcgtacagttggcccctacacggggcttggaggagctgggacatggtccactctccttagcaggcggtcctcgggtgggcggagtagcagccgcggctactgaagcacctcgaatggagtggaaagtgaaggtacgttccgacggaaccagatacgttgcaaagcgcccagtcagggacaggctgctgaaggcaagagccttgaaaatccgcgaagagaggtcaggaatgacaaccgacgacgacgcagtgtcggaaatgaagatgggcaggtattggagcaaagaggaacgaaaacagcatctaattcgcgcccgagagcagcgcaagcggagggaattcatgatgcagagccgcctcgagtgcctcagagagcagcagaatggtgactctaaacccgagctgaatataatcgcacttagccatcgtaagacaatgaaaaagagaaataagaagatcctcgataattggatcacaattcaggaaatgttagctcatggagcgagatccgccgacggtaagcgagtctataatcctctcctctcggtaactacagtctag

SEQ ID NO: 128032 - DNA, 2085 bp, Artificial Sequence
  Description of Artificial Sequence: Synthetic coding sequence
atggctcttggcaagttgaggcctcctacaccacccatggtcattctggaaccatacgtattgagcgaattgcccccgatcagccacgaatactatgacccagctgagtttatggaaggcggtccgcaggaggccgatcggctcgacgaattagagtacgaggaagttgaactgtataagagcagccaccgagacaaactaggactgatggtatgttaccggacggatgacgaagaagacttaggaatctatgtcggagaggtgaacccgaacagcatcgccgcaaaagatgggcggatccgagagggagatcggatcatacagatcaacggggtggatgtgcagaaccgagaagaggcagtggccattctgtctcaggaagaaaatacaaacatctcgttactggtggctcgacccgagtctcaactggcaaagagatggaaggatagcgatagggacgacttcctggacgattttgggagtgagaatgagggagaactaagagcccggaagctgaaatcccctccagcccagcagcccggcaacgaggaggagaaaggagcacccgatgccggtcctgggctgagcaacagtcaggagctggactccggcgtgggaaggaccgatgagagtacccggaacgaagagagtagcgagcacgatttgctgggtgacgaaccaccctcgagcaccaataccccaggatccctgcgaaagttcggcctgcaaggtgacgccctgcagagccgcgatttccatttcagtatggattccctactggcagaaggggccgggctaggcggcggtgacgttcccgggctgaccgatgaggaatatgaaaggtatcgtgagcttctagaaattaagtgccatctggagaacggcaatcaacttgggctgctgtttccgagagctagcggtggcaattccgccctggacgtaaataggaatgaatctcttggccacgagatggccatgcttgaggaggaactaaggcatctcgagtttaagtgtcggaacatcctgcgcgcccagaaaatgcaacaacttcgagagcgatgtatgaaggcctggcttttggaagaagaaagtctgtacgacttggcagctagtgaacctaaaaagcatgagctgagtgacatctcagaactgccggagaaatccgacaaagactccacatcagcatacaatactggcgaatcatgtcgctctactcccctgttggttgagcccctccctgagtctcctctccgccgggctatggccggtaatagcaatcttaatcgcacaccgccaggcccggccgtcgccactcctgctaaggccgcaccgcctccaggcagtccagcgaagttccgctctctgtcacgtgatcccgaagcaggccgaagacagcacgctgaagagagaggaaggagaaatcctaagacaggcttgacactggagagggtgggacctgagtcatcaccctacctttctcggcgtcaccgcggtcagggtcaggagggcgagcactaccacagctgcgtccagctggctcccacacggggtctggaagaacttgggcacggccccttgtcattagctggggggcctcgtgtggggggcgttgccgccgctgcaaccgaagcaccaaggatggagtggaaggtgaaggtgcggtcagacggaacaagatatgtggcgaaacgcccggtgcgtgaccggctactgaaagctagggccctgaagattcgcgaggagagatccggcatgaccaccgacgatgatgctgtcagcgagatgaaaatgggccggtactggagtaaagaggaacgcaaacagcatctgattcgcgctcgggagcagagaaagcggagggaatttatgatgcagagtagacttgaatgcctccgcgaacaacaaaatggcgattccaagccggaactcaacattattgcactcagccatcgtaagaccatgaagaaaagaaacaaaaaaattctagacaattggattacaatccaggaaatgcttgcacacggtgccagatcggctgatggaaaacgcgtttacaatccacttctatctgtgacgacagtatag

SEQ ID NO: 128033 - DNA, 2022 bp, Artificial Sequence
  Description of Artificial Sequence: Synthetic coding sequence
atgactgcacctcccatctcccatgaatactatgacccagccgaatttatggagggagggccccaagaagctgaccggctggacgaactggagtacgaagaggtcgagctgtataaaagcagccacagggataaattgggactgatggtctgctatcgcactgatgatgaagaagacctcggcatctacgttggggaggttaatcctaacagcatcgccgcgaaagacgggagaatcagggaaggagaccgaatcatccagattaacggtgtggatgtccagaatcgagaggaggctgtcgccatcttatcccaggaagaaaacaccaacatttcactgctggtagctcggcctgaatctcagctggcgaagaggtggaaggacagtgacagagacgatttcttggatgacttcggaagcgagaatgagggcgaactgcgtgcccggaaattgaaatcccctccggcgcaacaacccgggaatgaagaggaaaaaggagcccccgacgctgggcctggactctctaactctcaagagttggactccggagttgggagaacggatgaaagcactcgcaatgaagaatcttctgaacatgatcttctgggagatgaaccccccagcagtacaaatacgcctggttcccttagaaagtttgggctccaaggggatgccctgcagtctagagacttccatttctctatggatagcctgctggccgagggcgccggactcggagggggcgacgtccccggcctgactgatgaggagtatgaaagataccgcgagctgctggagattaaatgtcatctggagaatggcaatcaactggggcttctgttcccccgggcctccggtggaaattcagcgctggacgtcaatagaaatgaaagcttaggccacgagatggctatgctcgaggaggagctgaggcatcttgaatttaagtgcaggaacatcctcagagcccagaaaatgcagcagctccgggagcgatgcatgaaagcctggttacttgaagaagagtcgctttacgacttggcagctagtgagcctaagaaacacgagctttcagacatctctgagttaccagaaaagtctgataaggactctacctcagcgtacaatactggggagagttgccgttccacccccctgctcgtcgagccactgccagagtcaccactgcggcgtgccatggccggcaattctaatctcaaccgtacccctcccgggcctgcggtcgccacccccgcgaaagcagcccctccgccgggctctcccgctaagtttcgaagcctgtcaagagatcccgaagcaggcaggcggcagcacgctgaagagagaggtcgcaggaacccaaaaacaggactcacactggaaagggtgggccccgagagttccccttaccttagccgtcgccaccgagggcaggggcaagagggcgagcactatcatagttgcgtacagttggccccaacccgggggctcgaagagctggggcatgggccgttaagcctggcgggtggaccccgtgttggtggcgtcgctgccgcggccaccgaggccccccggatggagtggaaggttaaggtgcgctccgatggcacccgctatgttgcgaagaggccagttagagacaggctactcaaagcgcgggcgcttaagattcgcgaagagaggtccgggatgacaaccgatgatgacgccgtgagcgaaatgaagatgggtcggtattggtcgaaagaagagaggaaacagcatctgattagggcccgagagcaacggaagcgccgagaattcatgatgcagtcccggctcgagtgcttgcgggagcaacagaatggggactccaagcctgagttgaatatcatcgctctgtcacatagaaagaccatgaagaagaggaacaaaaagattctagacaactggatcacgattcaggagatgctggcccacggcgccaggtcagcagatggcaaacgtgtctacaaccctctgctttccgtgacaactgtatag

SEQ ID NO: 128034 - DNA, 1983 bp, Artificial Sequence
  Description of Artificial Sequence: Synthetic coding sequence
atgggatgtaacatgtgcgtggtacagaagcccgaagagcagtacaaggtcatgctacaggaagttgagttatataagagtagtcatagggacaagctcgggctcatggtgtgctatagaacagatgacgaggaagatttgggtatctacgtgggagaggtgaatccaaattccatcgctgcgaaggacggccgaattagggagggcgatagaattatacagattaatggcgtggatgtgcagaaccgcgaagaagcagtggccattttgtcccaagaagaaaacactaacatttctttactcgtagcaaggccagagagccaactggctaagcgctggaaggatagtgatagggatgattttctcgatgattttgggtctgaaaacgagggcgagctgcgcgcaaggaagttgaaaagcccccctgcacagcagccgggaaatgaagaggagaagggcgcgccggatgccggtcctgggctgagtaactcccaggagctggacagcggggtgggaaggaccgacgaaagcacaagaaatgaggaatcctctgagcatgatttgcttggcgacgagccaccaagcagcacgaacaccccgggatctctgagaaagttcggcttgcaaggcgacgccctgcaatcaagggattttcacttttccatggattccctgctggccgagggcgcaggcctgggagggggcgacgtccccggcctgaccgatgaggagtacgagcggtatcgagagctgctggaaatcaagtgccatcttgaaaacggcaaccagctggggttattattcccaagagcatccggcgggaattcagctttagacgtgaatcggaatgaatccctggggcacgaaatggccatgctcgaagaagaactgcggcacttggaatttaagtgtagaaacatcctgcgggcacagaagatgcagcagttgcgagagagatgcatgaaggcttggctgcttgaggaggagtcactttacgatctcgctgctagtgagcccaaaaagcacgaattgagcgacatctcggagctccccgaaaagtctgacaaggactctacaagtgcctacaacacaggagaatcgtgcaggtcaacacccttgctggtcgagccgcttccagagtcaccactgcggagggcaatggccgggaattccaaccttaataggaccccccccggtcccgccgtagccaccccagctaaagcagcaccaccccctggctctcccgctaaattccgatccctcagcagagacccagaggctggccgaaggcagcatgccgaggagcggggacgccggaaccccaaaacaggcctgacactcgagagagtaggaccagagagtagcccttacctgtcacgccgccaccgcggacaaggccaggagggagagcactatcattcctgcgtccagctggctcccacgcgcggcctcgaagaactggggcatggccccctttcattggccggaggcccaagagtgggaggcgtggccgcagcggctacagaagcccctagaatggaatggaaagttaaagtccgttctgacggaacgcggtacgtagccaagcggcccgtgcgcgatcgcctcctgaaagctcgggcattgaaaatcagggaggagcgaagcggcatgactacagatgatgacgctgtgtccgagatgaaaatgggccggtactggtcaaaagaagaaaggaagcaacatctcatccgagccagggagcagaggaaacggcgcgagttcatgatgcagagtcggctggagtgcctgagagagcaacagaacggcgattctaagccggagctcaatataatcgccttgagccaccgcaaaactatgaaaaagcgcaacaaaaagatacttgacaattggattaccatccaggaaatgctcgcccatggcgcaagatctgcggatggaaagcgcgtgtataaccctcttctgagtgttacaaccgtttag

SEQ ID NO: 128035 - DNA, 1554 bp, Artificial Sequence
  Description of Artificial Sequence: Synthetic coding sequence
atggcccagggattcgccgtaggctttgatccactaggacttggagatctcagctccgggtccctgtccagcctgagttcgcgtggccatcttggatccgactcagggtcaaccgcgacgaggtatctgcttagaaagcagcagcgcctgcttaatgggccccccaggggtattagggcctcaagccctatgggccgcgtgatcctcattaacagccctatcgaggccaacagcgacgagagcgacatcatacattccgtccgcgtggagaaaagccctgccggcaggttgggattttctgtaaggggcggcagcgagcacggcctcggtattttcgttagcaaagtggaggagggatcttcagcagaacgagctggcctttgcgtgggagataaaataactgaggtgaatggactcagccttgagagcactactatgggaagtgcggtgaaagtgctgacctcctcatctaggctgcatatgatggtgcgcagaatgggtagagtgcctggtattaaattctcaaaggaaaagaccacctgggtagatgtagtaaatagacggctcgtcgttgagaagtgcggatctacacctagtgataccagcagcgaggacggtgtgaggcggattgtacacttgtatactactagcgatgatttctgcctgggcttcaacatcaggggaggaaaagagtttgggctgggcatctacgtaagtaaggtggatcacggcgggctggcagaagagaatggcatcaaggtgggtgaccaggtgttggccgctaatggcgtgcgctttgatgatatcagccacagccaagcagtcgaagtgctgaaaggacaaacgcacattatgttgacaattaaggaaactgggcgataccccgcttacaaagagatggtgagcgagtactgctggcttgaccggctctctaacggggtgctgcagcaactatcacccgccagcgaatcttcttcctcagtgtccagctgcgcatcatccgcgccgtacagcagcgggtccttgccaagtgacagaatggacatttgcctgggccaggaagagcctggtagtaggggccccgggtggggacgggctgacaccgcaatgcagaccgagcccgatgctggggggagggtggagacgtggtgcagcgtccgaccaactgtgatcctgagggataccgccatccgatccgatggtccccatccaggacggcggctggacagcgccctgtcagaatcacctaagacggcgctccttctcgccctgtctcggccacgtccccctattacgcggtctcagtcataccttacactatgggaggagaaacagcagaggaagaaggaaaagtccggttccccaggcgagaagggcgcactgcagcgcagtaagactctgatgaatctctttttcaaaggtggacggcaaggacggctggcccgcgacggaaggagagaggcgtggaccctagattccggttctctcgctaaaacataccctagactggacatagagaaggaaatgggcgtgtccccctgttgtccaggctag

SEQ ID NO: 128036 - DNA, 3102 bp, Artificial Sequence
  Description of Artificial Sequence: Synthetic coding sequence
atggcccagggctttgcagtcggattcgacccgttgggtctcggggacctgtcttctggaagtctgtccagcttatcgtctaggggccatctggggtccgattctggctccacagctacaaggtatcttctcagaaagcagcagaggctactgaatggacctcccaggggtattcgcgctagctcccctatgggtcgcgtcattttaatcaactcccctattgaagccaactctgacgaatctgacattatacatagtgtgcgtgtcgaaaaatcaccggccgggcgactgggttttagcgtgcgtgggggttctgagcacggactcgggattttcgtgagcaaggtagaggaggggtcgtcagcagaacgcgctgggctctgcgtgggggataagataactgaagtgaatggcctgagtcttgaatctaccaccatggggagtgccgtcaaagttctgacgtcgagtagtaggctccacatgatggtgaggagaatggggagggtcccggggattaagtttagtaaagagaaaacgacttgggtcgatgtggtgaacaggcggctcgtcgtggaaaagtgcgggtctaccccttctgacacgtctagtgaagacggagtcaggcgcatcgttcatttatacaccacgtcagatgacttttgcttaggatttaacattcgcggtgggaaggagtttggtctgggcatatacgtttccaaagtggaccatggcggactggccgaggagaacggcatcaaggtcggggaccaggtacttgcggccaacggtgtgaggtttgacgatatcagccactctcaggccgtggaagttcttaaggggcaaacccacatcatgctgacgatcaaggagacaggacgataccctgcatataaagagatggtgtccgagtactgctggttagatagactctccaatggcgtgctgcagcagctgtcgccagcttccgagtctagcagtagtgtgtctagctgcgcatccagcgctccgtacagttcagggtctctgcccagcgaccgcatggacatctgccttggacaagaagaacccggctccagaggaccaggatggggacgtgccgacacagccatgcagacggaaccagacgccggcggtcgcgtggagacatggtgctctgtccgcccaaccgtcattttacgcgacacagcgatcaggagcgacggcccgcacccgggacgccgattagattcagctctcagcgagagccctaaaaccgcacttctcctcgcactgtcaagacctcggccccctattacccgatctcagagttacctgacactgtgggaggaaaagcaacagaggaaaaaggagaaatccggctctccgggagaaaaaggcgctctgcagaggtcaaagactttaatgaatttgtttttcaaggggggccgacaggggagactggcaagagacggacgacgtgaagcttggacactggacagtggctctttggctaagacctatccgcgcctggatatcgagaaagctggtggagtcggccctgtacagaaatttgtgacttggcgtcttagaagagatcaggaaagaggcagggctttgttatcagcacgttctggcagccccagctctcagttgcctaatgtggacgagcaggtccaggcatgggagagcagacgaccgttaatccaggacttggcccagcgcctgctgactgacgacgaggtcctcgcagtgaccaggcactgtagtaggtacgtgcatgagggaggcatagaagatttagtgaggccgctccttgccatcctggaccgaccagagaaactgcttcttctgcaggacattagaagcgtcgtcgccccaacagaccttggtcggttcgattcgatggtaatgcttgtggagttagaggcttttgaagcgcttaagtctcgcgccgtgagacctcctgccctgaggccggcccgacaggataccccccctaagagacatttaattactcctgtgccagacagtcgtggcgggttctacctcctgccagtcaatggctttcccgaagaagaggacaacggggaactgcgggagcgcctgggcgctctgaaggtgagtccttcagcctccgcacccaggcacccccataaggggataccgcctcttcaggacgtgcccgtagatgcctttacacccctgcgaatcgcttgtactcccccccctcagctgccccccgtagcacctaggcccctacgtcctaactggctgttgacagagccactgagcagagagcatcctcctcagtcacaaatccggggcagagcccagtcacgtagtcgtagccgctcgcgatccagatcgagatctagccgtgggcagggaaagtcacccggtcgcagatccccatcaccggtgcccacaccagcccccagtatgacaaacgggcggtatcataaaccccgcaaagctcgtccccctctgccaaggcccctggatggcgaagcagcaaaggtgggtgctaaacagggacctagcgaatccggtacggaggggactgcgaaagaagcagccatgaagaacccttccggcgagctgaagactgtcaccttgagtaaaatgaagcagtcattaggaatatccattagcggagggattgagtccaaggtccagccgatggtgaaaatagagaagattttccccggcggagctgcattcctgtccggcgcactgcaggcgggcttcgaactggtggcagtagacggcgaaaatttggagcaagtcacacaccaacgcgccgtggatactatcagaagggcctatcgcaataaagcacgcgagccaatggagctcgtagtgagagtgccagggccgtctcctaggccatctccgtccgatagcagtgcactcaccgacggtggcctccctgcggaccatttgccagctcaccaacccctggacgctgcacctgttcccgcacactggctgcccgagccccccaccaatccacagacccctcctactgatgcccgcctcctgcagccgacaccatcacccgcccctagccccgcactgcagactcccgattcaaagcctgccccttcgcccagaatcccatag

SEQ ID NO: 128037 - DNA, 627 bp, Artificial Sequence
  Description of Artificial Sequence: Synthetic coding sequence
taaccccgacctccgatcactcggagccaatcatacttgaccctgtgggaggagaagcaacagaggaagaaggaaaagtccgggtcacctggcgagaagggcgctctgcagaggtccaagaccctgatgaacctcttcttcaaggggggcaggcaaggaagactggcccgcgacggtcggagagaagcatggacattggacagcgggagcctggcgaagacatatcccaggcttgacattgaaaaggctggcggggtcggtccagtccagaagtttgtgacatggcgcctgaggagggatcaagagagaggcagagccttgctttcggctcgctcaggctccccctcgagtcaactgcccaacgtcgacgagcaggtacaggcatgggaatctagacggcccctcatccaagatctggcacagaggctgctgacggacgacgaggtcctggctgtgacgcgccactgctcgcggtacgtgcacgagggcgggatcgaggacctcgtccgtcctctcttggccatcctggatcgccctgaaaagctgttattactgcaggatatcaggagcgtggtcgctcccactgatctaggcaggttcgattctatggtgatgttggtggaatag

SEQ ID NO: 128038 - DNA, 3465 bp, Artificial Sequence
  Description of Artificial Sequence: Synthetic coding sequence
atgggtctgctcctgatgatcctggcctctgcggtgctgggatccttcctgaccctgctcgcacagtttttcttgttgtacaggcggcaacctgagccaccagctgacgaagctgccagagccggcgagggcttccggtatatcaagccagtgccggggttactgttacgcgagtatttatacggggggggcagggatgaggaaccaagcggagccgcaccggagggtggggccacccctaccgccgccccagagacaccagcaccccccactcgtgagacctgttacttcctcaatgctactattctgttcctgtttcgtgagctgcgcgacactgccctgaccagaaggtgggttacaaagaagatcaaggtggaattcgaagagcttctgcaaaccaaaactgcagggcggctcctggaggggttaagtctcagagacgtgtttcttggagagactgtgcctttcatcaagactatcagattagtgaggcctgtcgtgccatcagccactggcgagcccgacggacccgaaggggaggccctacccgcagcctgcccagaggaattagctttcgaggccgaagtcgaatacaacggcgggttccatttggctatcgacgttgacctcgtttttggaaaatccgcgtacctgttcgtgaaacttagccgggtggtgggccggctccggctggtctttacacgcgtgcccttcacacattggtttttttcattcgtcgaggaccctctaatcgattttgaggtgcgcagccaattcgaaggacgaccaatgccacagctcacaagcattattgtgaaccagctgaaaaagattataaagcgaaaacacaccctgcccaattataaaatccggtttaaacctttctttccttatcagaccctgcagggtttcgaagaggatgaagagcacatacatattcaacagtgggcgcttaccgaaggcagactgaaggtgacacttctggagtgctcccgactcctcatatttggaagctatgacagagaggctaatgtgcactgcacactggaactttcttcaagcgtgtgggaggaaaagcagcggagttctattaagaccgtggagctcattaagggtaacttgcagtcagtcggtctaacccttcgcctggtgcagagtacagatggatatgctggacacgtaattatcgagactgtagcccctaacagccctgctgctattgcggatctgcagcgtggcgataggttaattgcgattggaggtgtcaaaatcaccagcaccctgcaggtcttgaagctgataaagcaggccggggaccgagttctcgtctactacgaacggccagtaggccagtctaaccaaggcgcagtgcttcaggacaactttggacagcttgaggaaaattttttatcatcctcttgtcagtccggctacgaagaggaggcagccggcctgaccgtcgatacggaatccagagagctggactctgaatttgaggaccttgcgagtgacgtccgagcacagaatgagtttaaggatgaggcacagtctctgagtcattccccaaaacgagtgccaacaacgcttagtataaaaccattaggtgccatctcacctgtcctaaataggaagctggccgttggatcacatccacttccgccgaaaatccagagcaaggatggtaacaagccgcctccattgaaaacatctgaaattaccgacccagctcaggttagtaagcccactcagggctcagccttcaagcctcctgtaccaccccgaccacaggctaaggttccactgccgagcgcagatgccccaaatcaggccgagccagacgtgctagtggagaagccagagaaggtcgtacccccccccctggtggacaagagtgctgaaaaacaggctaagaatgtggacgcaatcgatgacgccgcagcccccaaacagttcctcgcaaaacaggaggtagctaaagatgtgacttctgaaacatcctgccctacaaaggacagtagcgacgaccgccagacctgggagtccagcgaaatcttataccggaataagctcggcaagtggaccaggacacgtgcctcctgcctgttcgatattgaggcttgtcacagatatctcaacatagccctgtggtgccgagacccgttcaagcttggcgggctcatctgtctgggccatgtatctctcaaactcgaagatgtggctttaggctgtctggctacctccaataccgaatacctgagtaagctgcgactcgaagctccctccccaaaggccatcgtcacccggacagccctccggaatctctcaatgcagaagggcttcaacgataagttctgctatggagatattaccatccacttcaaatacctcaaagagggcgaatctgaccaccatgttgtgacgaacgtcgagaaagaaaaggaaccccatttggtggaggaagtttctgttctgccaaaggaggagcagtttgtggggcaaatgggtctcactgaaaacaaacactctttccaggacacgcagtttcagaatcctacctggtgcgattactgcaaaaagaaagtgtggaccaaagccgcctctcaatgcatgttctgcgcatatgtatgccataagaagtgtcaggaaaaatgcttagccgagaccagcgtgtgcggcgccaccgaccgacggattgataggacactgaaaaatctccgcttagagggtcaggagacgctgcttggcctgccaccccgggtggatgccgaggcgagcaagagtgtgaataagacaacagggttaactcgacatattataaacacatcctccagactcctcaaccttcgccaggtctcaaagacacggctgtctgaaccaggaacagatctcgtggagccatctccgaaacacacccccaatacatcagacaacgagggctccgacaccgaagtttgcgggccaaactccccctctaaaaggggcaacagcactggcatcaaactcgtacggaaagagggtggattagacgactcagtgttcatcgctgtgaaggagatcggacgggatctgtacagagggttgcctaccgaagagcgtatccagaaacttgagttcatgctggacaagctacaaaatgagatcgaccaagagcttgaacacaacaatagccttgtgcgggaagagaaagagaccaccgatacccggaaaaagtctttactgtccgcagccttagcaaaatctggcgaaagactgcaagcgctaaccctgttgatgatccattaccgcgcaggcatcgaggatatcgagacactggaatcattgagtctggaccagcatagcaaaaagatttcaaaatatacagatgacactgaagaagacctggacaatgaaatctcccagctgattgatagccagccgttctcatctatctctgacgacctgtttggaccctcagagtccgtgtag

SEQ ID NO: 128039 - DNA, 3201 bp, Artificial Sequence
  Description of Artificial Sequence: Synthetic coding sequence
atgggctttgagctggataggttcgacggggacgtggatcccgacctgaaatgcgccctgtgtcataaggtcttagaggatcccctcaccaccccctgcgggcacgtgttttgcgccggctgcgttttaccctgggttgtgcaggagggcagttgccctgctagatgccgcggacggctctccgcaaaagaattgaaccatgttctcccccttaagaggctgattctcaaattagatatcaagtgcgcatatgctacccgtggatgtggcagagtggtgaagctacaacagctgcccgaacacctggagcgatgcgactttgcacccgcacgttgcagacacgcagggtgtggccaagtgctcctacgccgcgacgtggaagctcatatgagagacgcctgcgatgcacggcccgtcggtcgctgccaagaaggatgcgggctcccactcacccatggcgaacagagggcgggggggcattgctgcgcccgcgccctgagggcccataatggcgccctgcaggcgaggctgggcgctttgcataaagctcttaagaaggaggcgctgcgcgctgggaaacgggaaaaatcactagtggcccaactcgccgccgcacagctagagctgcagatgacagctcttcggtaccagaagaagtttacggaatactctgcgcgactggactctctctccaggtgtgtcgccgcccctccaggcggcaaaggtgaagaaactaagtccctgactctggtcttacaccgcgactccgggtctctgggctttaacatcattgggggacggcccagtgtcgataaccacgacggctcctcgtctgaaggcatttttgttagcaagatcgtggacagtggcccagccgcgaaggaaggcggactccagattcatgacaggattatcgaggtgaatggccgggatctcagcagagcgactcatgaccaagcagtcgaggcattcaaaaccgcgaaagaacctatagtggtacaggtcttgcggcggacacctcgcactaagatgttcactcccccatcagaatctcagttagttgacacagggactcagaccgacattacattcgagcacataatggccctgacaaaaatgagtagcccatctcccccggttcttgacccttatcttctgcctgaagagcaccccagtgcacacgaatattatgaccctaacgactacatcggtgacatacaccaggaaatggatagagaagagctggagctggaagaggtggacttgtacagaatgaattcccaagacaagcttggtttgactgtatgctaccggaccgacgatgaggatgatatcggaatctatatttccgaaatagacccaaattcgatcgccgccaaagatggaagaatcagggaaggcgaccgaataatccagatcaacggcatcgaggtgcaaaacagagaagaggctgttgctctgcttacatctgaggagaataagaactttagtttgctcatagctcgtccagaactgcaactggacgaaggttggatggacgacgaccgcaatgattttttggacgatcttcacatggacatgctcgaagagcagcaccatcaggccatgcagttcaccgcctccgtgcttcaacagaagaaacatgatgaggatggcggcaccaccgataccgccacaattctcagtaatcagcacgagaaggacagtggagttggcaggaccgatgagagtacccgcaacgacgaatcatccgagcaagagaacaacggcgatgatgccactgcgtcttccaaccccctcgccggtcagaggaagctgacctgtagccaggatacattaggatctggagatcttccattctctaacgagagcttcattagcgccgactgcaccgatgctgactatctggggattcctgtggacgagtgcgagcgtttccgagaacttcttgagcttaagtgtcaggttaagagtgcaacaccttacggcttgtattatcccagtggccccctggacgccgggaaatcagacccagagtctgttgacaaagaattagaactattaaacgaggagctgcgatccattgagctggagtgcctctccattgtgagagcccacaaaatgcagcaattgaaggagcagtaccgcgaaagttggatgttacacaattctggtttcaggaactataatacctcgattgatgttcggagacatgagctgtcggacatcacagagctcccagaaaagtcagataaggacagttcttccgcctataataccggcgagagctgtcggtcaactccactgaccctggaaatatctcccgataactcgctccgacgggcggcagaaggaatctcgtgcccatcttctgagggagcagtgggaacaacagaagcatacggaccagcatctaaaaaccttctttccatcacagaggaccccgaggtcggaactccaacctactctccaagcttgaaagaactcgaccccaaccagccattagaatctaaggaacggcgtgcctccgacggttctagaagtccaacaccctcgcagaaactggggtccgcttacctgccatcataccaccattccccttacaagcacgcccacatacctgcgcacgctcagcactatcagtcttatatgcagcttattcaacagaaatcagcagtggaatacgcccagtcacaaatgagcctcgtgtccatgtgcaaagatcttagcagtcctaccccttccgagcctcggatggaatggaaagtgaagatccgctctgatggcacaaggtacataacgaagcggcccgtccgggacagattgctcagagagcgggcactgaaaatccgtgaagagagatctgggatgactacggatgatgacgcagttagcgaaatgaaaatgggtcggtattggtctaaggaagaacgcaaacaacacttagtgaaggctaaagaacagagaaggcgtcgcgagtttatgatgcagagccggttggattgcttaaaggaacagcaagcggcagacgaccggaaggagatgaacatattagagctgtcacacaagaaaatgatgaaaaagcgtaataaaaagatttttgacaactggatgactatacaggaactgctgacacacggaacaaagagtcccgatggcacgagggtttacaactctttcctgagcgtgacaaccgtgtag

SEQ ID NO: 128040 - DNA, 2190 bp, Artificial Sequence
  Description of Artificial Sequence: Synthetic coding sequence
atgggctttgagctcgaccgcttcgacggcgatgtggatccagatttgaagtgtgcactgtgccacaaggttctggaggaccctcttacaacgccgtgtggccatgtcttctgcgctggctgcgtgttgccatgggtggtgcaggagggcagttgcccggcccgctgtcgagggagactatctgctaaagagcttaatcacgtcttacctctgaaacgacttatcctgaagctagacatcaaatgtgcctacgccaccaggggctgcggacgagtggtgaagctgcaacaactccccgagcacctggaacggtgtgacttcgcaccagccagatgtaggcacgcaggttgcggccaggtgctgcttcgccgcgatgtggaagcccacatgagggacgcgtgcgacgcaaggcctgtgggccgttgtcaggaaggatgtgggctgcctcttacacacggggaacagagagccgggggtcattgctgtgccagagcactgagggcgcacaatggagctcttcaagctagactgggagcgctgcataaggccctcaagaaagaggcactgagagctgggaagagggaaaagtctttagtggcacagctggctgccgctcaactggaactccagatgacggccctccggtaccagaaaaagttcaccgagtacagcgctcgcctggattccttgtctcgctgtgtggctgctcccccgggggggaagggggaggaaaccaagagtctcactctggttttacaccgggactccggatccttgggattcaatattattggcgggcgaccaagcgtagacaatcatgacgggtctagcagcgaaggtatattcgtcagcaaaattgttgatagcggacctgcagcgaaagaaggcggcctacagattcacgaccgtatcattgaagtgaatggccgggatctgtctcgtgctactcacgaccaggcagtagaggcattcaagaccgctaaggagcccatcgtggttcaggtactccggcgcacgccgcgcactaaaatgttcacacctcctagtgaaagtcagttagtggacactggtacacagaccgatatcacgtttgaacacataatggccttgaccaagatgtcctcccccagcccaccggtcctagacccttacctcctccccgaggagcacccatccgcccatgagtattacgatcccaatgactatattggggatatacatcaggaaatggaccgggaggagttagaactggaggaagtggatctctaccgaatgaactctcaggacaagttaggcctaacagtgtgctataggaccgacgatgaggacgacatcggaatttacataagcgagattgatccgaactctatcgctgcaaaggatgggagaattagagagggagataggataatccagatcaacggaattgaggtgcagaatagagaagaggccgtggccctgctgacatcagaagaaaacaagaacttctctctgctgatcgcacgccccgaacttcaactagacgaggggtggatggacgacgataggaatgattttcttgatgacttacatatggacatgctggaagagcagcaccatcaggctatgcagttcacggccagcgttctgcaacagaagaagcacgatgaggacggcggaaccaccgacaccgcgacaatcctgagcaatcagcatgagaaggatagtggcgtaggccgcaccgatgagtctactcggaacgatgagtcttcagaacaggagaataacggcgatgacgcaactgcatccagcaacccactcgcaggtcagcgtaagctgacatgtagccaggacacactcgggtcaggagatctgcccttcagcaatgagagctttattagcgcagactgcaccgacgcggattatctgggtatccctgtggaaggtgaagacccccagcggcgtgacgcactgcaccaccaagaagcgagggccggaccacccgccgccggggcaaggcctgaagaccccgggcgggcccagagacacgatcatagacggcggaggggggaacgagacgaagatggggccctgctggaacagggtggggaggaggccgcaccaggcgagggccagggggctgccgccgctgctagagttcacgacgctgagcaggttggcctttcacagggcgcagctagctccagatag

SEQ ID NO: 128041 - DNA, 2352 bp, Artificial Sequence
  Description of Artificial Sequence: Synthetic coding sequence
atgggatgcagtttgtgctccttgcagaagcaggaagagcaatacaagctgctgtacgaggtttgccaagtgaacggacgcgacctctcccgcgccacccatgatcaggccgtggaagcttttaaaaccgcgaaggagcctatagtggttcaggtgctgaggaggacgcccaggacaaaaatgtttaccccaccttcggagagccagctggtcgacaccgggacacaaacggatatcacatttgagcacatcatggccctgaccaaaatgtcttcaccgtcccctccagttctggacccctacctgttacctgaggaacatccaagcgcccacgagtattacgacccgaacgactacattggcgatatacatcaagaaatggaccgggaggagttggaactggaagaagtcgacttgtatcgcatgaactctcaggataaactggggctgacagtgtgttataggacggacgacgaagatgatatcgggatctatattagcgagatagatccgaattcgattgcagccaaggacggacgcattcgggagggcgacaggattatccagatcaacggaatcgaagttcagaaccgggaggaggccgtcgccctcctgacatctgaggagaataaaaacttttccttgttgattgcgcgtccagagctacaactcgatgagggatggatggatgacgacaggaatgacttcctggacgacctacacatggacatgttggaagagcaacatcaccaggctatgcagtttacagcaagcgttctacaacagaaaaaacacgatgaagacggaggaacaaccgacaccgctaccatcttgagcaatcaacacgagaaggactctggcgtcggtcgaactgatgaaagtacaagaaacgatgaatcttctgaacaggaaaataacggggacgacgccaccgcttcctccaaccctctggccggccagcgcaaactcacttgcagtcaggatactctaggcagtggagatctacctttcagtaatgagagttttatcagcgccgattgcaccgatgcagattatctgggcataccggttgatgagtgtgagaggtttcgagaactgctcgagctgaaatgccaggtgaagtccgcaactccatatgggctctattatccgtccggccctttggatgccggtaaatctgacccggaatcagttgacaaagagctcgaactcctaaatgaggagctacggagcatagagctggagtgcttgagcatcgttagggctcacaagatgcaacagttgaaggagcagtaccgggagtcttggatgctgcataactccgggttccggaattacaacacatccatcgacgtcaggcggcacgaactcagcgacatcaccgaactaccagaaaagtctgataaagattcctctagcgcgtacaatactggtgagtcctgtaggtccactccactgaccctggaaatctcccccgacaactctctgaggagagccgcggaaggtatctcgtgtcctagttcagaaggagctgtgggcacgacagaggcctacggaccggcctccaaaaacctgctctccataacagaggaccctgaagtcggcacccctacttattcgccctcattgaaagagcttgaccctaaccagcccctggagagtaaggaacgtcgagctagcgacggatcccgatctcccactcccagtcaaaaactgggcagtgcttacttgcccagctatcaccatagcccatataagcacgcacatattccagctcacgcccagcactaccagagctacatgcagctgatccagcaaaagagtgcggttgagtatgctcagtcacaaatgagtctggtttccatgtgcaaagacctatccagccctacgccatccgagcctagaatggaatggaaggtgaagatccggagtgatggtactagatacataacaaagaggccagtgcgcgaccgtctactgcgggagcgggccctgaaaatcagagaagagcggagtgggatgaccacagacgacgatgcggtatcggagatgaagatgggaaggtactggtccaaggaagaacgtaagcaacatttggtaaaggccaaggagcagcggagacgcagagaatttatgatgcagtcccggcttgactgcttgaaagaacagcaggccgccgatgatcgtaaggagatgaacattttagagttaagccacaaaaaaatgatgaaaaagcggaataaaaagattttcgataactggatgaccatccaggaattgctgactcatggcacgaagagtcctgatggtaccagggtctacaactcattcctctccgttaccaccgtttag

SEQ ID NO: 128042 - DNA, 2367 bp, Artificial Sequence
  Description of Artificial Sequence: Synthetic coding sequence
atgaagatggagcataagcgcatgattcttctgttctcaaagtttacgctgattcataagccccacggggggagatggtatctggtgaacgggagagatctgtccagggctactcacgatcaagccgttgaggcatttaaaacggccaaagagccaattgttgtgcaggtcctacgtagaactcccagaactaagatgtttacacctccctctgaatcccaacttgtcgatactggcacgcaaacagatatcacattcgagcacataatggccctgactaaaatgagctcaccgagccccccggtactagatccgtaccttctgcctgaggagcacccgagtgctcacgagtattacgaccccaatgactatattggggatatacatcaggaaatggaccgtgaggaattggagcttgaagaagttgatctgtatcggatgaattcccaagacaagctcggcctcactgtatgctacagaaccgacgatgaagatgacatcggtatctacattagcgagatcgaccccaacagcattgctgctaaagatggtcggatacgggaaggtgacaggatcatacagattaatggtatagaagtccagaatagagaggaagccgtcgcgctcctgacatctgaagaaaacaaaaacttcagtctcctaattgcacgccctgagttacagcttgacgagggttggatggacgatgataggaacgacttcctcgacgacctgcatatggatatgcttgaagagcagcaccatcaggcaatgcagtttacggcctctgtactgcagcagaagaaacatgacgaagatggaggaaccacggacactgccacgatcctcagcaaccagcacgagaaagattctggcgtggggcgtactgatgaaagcactaggaacgacgaatcttccgagcaggagaataatggtgatgatgccactgcttcatccaatccactggcaggccaacggaagctgacatgctcccaggatacactcggcagcggcgatctccccttcagtaacgagtccttcatatcggcagattgtactgatgctgactatctcggtatccccgttgatgagtgtgaacgatttcgagagttactggagctgaaatgtcaagtgaagtcggccactccatatggcctgtactatccgtcaggacctctggatgcaggcaagtctgacccggaatccgtcgataaagagctcgaactgctgaatgaagaattacggtccattgagctggaatgccttagtatcgtgagagcacacaagatgcaacagctgaaggagcagtaccgcgagtcttggatgctgcacaatagcgggtttcgcaattacaacacaagcattgatgtgcggaggcacgaactgagcgatatcacagagctgcccgagaaaagcgacaaggatagctcctctgcttacaacacaggagagtcctgtcgcagtacccctctaacgctcgagatttctccagataattcgctccgtcgtgccgccgaaggaatttcctgtcctagctcagaaggcgcggttggcacaacagaggcctatggccccgcctccaagaatctgctgtcaattactgaagatccagaagttgggactcccacctactccccatctctcaaggaactcgatcccaatcagccacttgaatctaaggaacgccgcgctagtgacggctccagatcccctactccgagccagaagctggggagtgcttacctgccgtcttaccatcattccccttacaagcatgcccatatcccagcccacgcacagcactaccagtcgtacatgcagctcatccaacagaagagcgctgttgaatacgcccaatcgcaaatgtcactggtgagcatgtgtaaggacctgtcatctcctaccccctctgagcctcgcatggagtggaaggtgaagattagatccgacgggacacggtacatcaccaaacgacctgttcgtgacagactgctgagagagagggccctcaaaattagagaagaacggagtggtatgactacggacgacgatgccgtgagcgaaatgaaaatgggccggtactggtcgaaggaagagcgaaagcagcaccttgttaaggctaaggagcaaagaaggcgcagggagttcatgatgcagagccggctagattgtctgaaagagcagcaagccgccgacgatcgaaaggagatgaatattctcgaactcagccataaaaaaatgatgaaaaagagaaataaaaagatcttcgacaattggatgactattcaggaactgctaacgcacggcaccaagtcccctgacggaactagagtctataatagtttcctcagcgtcacgaccgtgtag

SEQ ID NO: 128043 - DNA, 2331 bp, Artificial Sequence
  Description of Artificial Sequence: Synthetic coding sequence
atgtctggaaagcgccagttttttctcaaaccactggcactgctcacgtgctggccctccacagtgaatgggaaagacctctctaaagccactcacgaggaagcagtggaagcgttccggaatgcgaaggagcccatcgtggtccaggttcttcggcgaacacccttgtcccgaccggcttacggcatggcttcagaggtacaattgatgaatgcttctactcagaccgatatcactttcgagcacatcatggcgctggcaaaattgcggcctccgaccccccccgtgcccgacatttgtccatttctgctatccgacagctgccacagcctgcatcctatggaacacgaattctacgaagataatgaatatatcagctcactccccgcggacgcggatagaaccgaagattttgaatatgaggaagtggagctgtgccgcgtgagtagtcaggagaagctggggctgaccgtgtgttatcgtacagacgatgaggaagacacaggcatctacgtgtctgaggtcgacccaaattccatcgctgctaaggacggaaggattagagaaggtgaccgcatcctgcaaatcaatggcgaggatgtacagaacagggaggaagccgtggctttactgtcaaatgatgaatgcaaaaggatcgtgttgcttgttgcccggccagagatacagttggacgaggggtggttggaagatgaacgcaatgaatttctcgaagagctgaacctcgagatgctggaggaagagcacaacgaagcaatgcagccaaccgcgaatgaggtcgaacagcctaaaaagcaggaggaggaagaaggtacaaccgataccgcaacgagctcgtctaacaaccacgagaaggacagcggcgttgggcgcaccgatgaatccttgaggaacgatgaaagctctgagcaagagaacgcagctgaagatcctaatagcacttctctcaaaagtaaacgtgatttaggtcaatctcaggataccctgggatccgtagagctccagtataatgaaagcttggtcagtggagagtatatcgatagtgattgcattggaaatcccgacgaggattgtgagaggtttagacaactactagagctcaaatgcaagatcagaaatcacggtgaatacgacctttactattccagtagcaccatcgaatgcaaccagggagagcaggaaggagtcgagcacgagctgcagttgctcaatgaagagcttaggaacattgagctggaatgccagaacattatgcaagcccaccgtctccagaaggtgaccgaccagtacggcgatatctggactttacacgatggcggattccgcaattataatacttccattgacatgcagcgcggtaagcttgacgatatcatggaacaccccgagaagtccgataaggattcttctagcgcgtacaataccgctgagtcctgccgtagcacccctctcaccgtagacaggtctcctgacagctctctgcccagggtcatcaatctcaccaataagaagaacctgcgatcaaccatggcagcgacccaaagttctagcggtcagagcagcaaggaaagtacgagtaccaaggccaaaacaactgaacaaggctgtagcgctgagagcaaggaaaaggtgctggaggggtcaaagctgcctgatcaagagaaggctgttagcgagcacatcccatacctgtccccttaccactctagttcctataggtacgcgaatatacccgcccacgctcgacactatcaatcatacatgcagctgatccagcaaaagtctgcagtcgagtacgcacaaagccagctgagcttggtcagcatgtgcaaggagtcccagaaatgtagcgagccaaagatggaatggaaagtgaaaatccggtcagatggcacccgatatatcacgaaacgacctgtgcgcgatagaatattaaaggaacgggcgctcaaaattaaggaggaacggtccggtatgacgacagatgacgatacaatgagcgagatgaagatgggaagatactggtcaaaagaggagcggaaacaacatctcgtgcgagcgaaagagcaacgacgccgccgcgaatttatgatgcggtctaggcttgaatgtttgaaagagtcgccccaatcagggagcgagggcaagaaagagataaacataatcgagttgtctcataagaagatgatgaagaaaaggaacaagaagattctagacaattggatgactatacaagaactgatgactcatggagctaaatctcctgatggcactagggttcataatgcttttctttctgtaacaacagtatag

SEQ ID NO: 128044 - DNA, 3111 bp, Artificial Sequence
  Description of Artificial Sequence: Synthetic coding sequence
atggggttcgccctggaacgttttgctgaggcagtagatcctgcactggaatgcaagctctgcggacaagttctggaggagcccttgtgtacaccatgcggccatgtgttctgcgcctcttgcctgcttccctgggctgtgagacggcggagatgtccgctccagtgccagccgctggcccctggggaactgtaccgagtgctacctctgcgatctctgatccagaagctgagggttcagtgcgattacagggccagaggctgtggccactccgtccgacttcacgagctggaagcccatgtagagcattgcgactttggtccagccaggagacttcggtccaggggcggatgtgcctccgggctgggaggcggagaggtgccagcaagggggggttgtggccctacaccgagagccggaagaggcgggggtgccagaggcggcccccctggcggacggtgggggcgtggacggggacccggaccccgggtgttagcctggcgtagaagagagaaagccctgctggcccagctgtgggccctgcagggggaggtccagcttaccgcccgcagatatcaggaaaagttcacccagtacatggctcacgtacgcaacttcgtgggcgacttgggaggcggccatcgcagagatggagagcacaagccctttaccattgtactggaaagagaaaacgatacactgggtttcaatattattggcggacgtcccaatcagaataatcaagagggcaccagcacagagggaatctacgtgtcgaaaatactcgagaacggccctgccgatcgggccgatgggctggaaatacacgataaaattatggaagtgaacgggaaggacttatccaaagctactcacgaagaggctgtagaggctttccgcaatgcaaaagaacccatcgtagtgcaggtgcttagacgcactcccctctctcgccctgcgtatggcatggcaagcgaggtacagctaatgaacgctagtactcagactgacatcactttcgaacatatcatggcgttggctaaattgagaccaccgactccccccgtgccagatatctgtccattcctgctgtctgactcctgtcactcacttcatccaatggagcacgagttttacgaggataatgagtatattagttccctgcctgctgatgcagaccggactgaggattttgagtatgaggaagtggaactatgccgcgtgtcatcccaagaaaagctcggcctgacagtctgttacagaaccgacgatgaggaggataccggcatctatgtgtccgaagtagatcctaacagcatcgcagccaaagatggaaggatccgtgagggggatagaattttgcagattaatggtgaggacgtgcagaatcgtgaggaggctgtggctttactgagcaatgatgaatgcaagaggatagtgttgctcgtagctcgcccagagatccagctcgacgaggggtggttggaggacgagaggaatgaatttctcgaggaactgaatctggagatgttggaggaggaacataacgaagcgatgcagcccacagccaacgaggttgagcagccgaagaaacaggaggaagaggagggcacaaccgacaccgctactagtagcagcaataatcatgaaaaggactccggtgtggggaggactgacgaatccttacgaaacgatgagagctcagaacaggagaacgctgccgaggaccccaattccacctcacttaagtcaaaacgtgatctgggacagagtcaggataccttagggtctgttgaacttcagtacaacgaatcactggtgagcggcgaatacattgattcggattgcatcggaaatccagacgaggattgtgagagattcaggcagctgctggaattaaagtgtaaaattcgtaatcacggcgagtatgacctgtactacagttcctccactatcgagtgcaaccagggagaacaggagggggtcgaacatgaactccaactactgaacgaggaactgcggaacattgagttggaatgtcagaacattatgcaagcgcatagactgcagaaagttactgatcaatatggcgatatctggactctgcatgatggcgggttcaggaactacaatactagtatagatatgcagagggggaagcttgatgacatcatggagcacccagagaagtctgacaaagactccagctctgcctacaacacagccgaatcctgtcgttctacccccctgactgtggatcgatccccagactcgtccctcccaagggtgataaatttaactaataaaaagaatctcaggtctactatggcagctactcaatcatccagtggccaatcctcaaaggagtccaccagtacaaaggcgaagaccacagagcaggggtgttccgccgagtccaaggagaaagtgttggaggggtctaagctccccgatcaggaaaaggcagtgtccgagcacattccttacctcagtccatatcacagctcaagctacagatacgcaaatattcccgcccatgctagacattatcagtcctacatgcagctcattcagcagaagtcagccgttgagtacgcccagagccagctctctctcgtgtccatgtgcaaagagtctcaaaaatgctctgagcccaagatggagtggaaagtgaagatcaggtccgacggaacgaggtatattaccaaacgtccagtgcgggatagaattctgaaggagagagcgcttaaaatcaaagaagagcgatccggaatgaccaccgacgacgatacaatgagcgagatgaagatgggcaggtactggtccaaagaggagcggaaacagcatctggtgagggctaaagaacagcggcgccgaagagaattcatgatgaggtcaaggttagagtgtcttaaagaatctcctcagagcgggagcgaaggaaagaaggaaattaacatcatcgagctgtcccataagaagatgatgaaaaaaaggaataagaagattttagataactggatgacaatccaggaactgatgacgcatggagctaagtcgccagatgggaccagagttcataatgcgtttctgtccgtaactaccgtctag

SEQ ID NO: 128045 - DNA, 2337 bp, Artificial Sequence
  Description of Artificial Sequence: Synthetic coding sequence
atggggtgtaatttatgtacattccagaagcgggaggagcactacaagctgttatacgaggtgtctcaggttaatggaaaggacctgagcaaggctacacatgaagaagctgtggaggcattccgtaacgcaaaggaacctattgtggtgcaggttctgcgtagaactcctttgagccggccagcttacggcatggcgtctgaggtccagcttatgaatgcttccacacaaacggatattactttcgagcatattatggcactagcgaaactgcgcccacccacgcccccggtgccggatatttgcccctttcttctctccgactcctgtcactcactccacccaatggagcatgagttttacgaggataatgagtacataagcagcctacctgctgatgcagataggactgaggactttgagtacgaggaggtggagctttgcagggtctcttctcaggagaagctgggactcacagtgtgctacaggaccgacgatgaagaggacactggaatctacgtgtctgaggtagatcctaacagtatcgcggccaaggatggacgcataagggagggtgaccggatccttcagattaatggcgaggatgtccagaatcgggaggaggcggttgcattgctctctaacgatgagtgtaaaaggatcgtgctcctcgtagcaaggcccgaaatccagttagatgagggatggcttgaagatgagcgaaacgagtttctcgaggaacttaacctggagatgctcgaagaagagcacaatgaggccatgcagcccaccgccaacgaggtcgaacagcctaagaagcaggaggaagaagagggtactacagataccgctacctcctctagtaacaaccatgaaaaggattccggtgtaggtagaacagatgagtctcttcggaacgatgagtcatcggagcaggagaacgcagctgaagatccaaattctaccagcctaaagtctaagcgtgatctgggacagtcccaagatacactgggttcagtcgaactgcagtataatgagtctttagtttcaggcgagtatatcgatagtgattgcatcggaaatcctgacgaggattgcgagaggtttcgacagctgctggaactgaaatgcaaaatccgcaaccatggggaatatgacttgtactattcttccagcacgattgaatgtaatcagggcgaacaggagggcgttgaacatgaactgcagctgttgaatgaggaactcagaaatatcgagttggagtgtcagaacatcatgcaggcacaccggctgcagaaagtgactgaccagtacggagatatatggacactccatgatggcggcttccgcaattacaatacttccatcgacatgcagcgtggtaagcttgatgatatcatggaacatccggaaaagtctgataaggacagctccagtgcttacaatactgctgaaagctgccggagtacgccgctcactgtggaccggagtcctgattcttcgctgccacgcgtgattaacttgacgaacaagaaaaatcttaggtccaccatggccgctacacaaagctccagtggccagagttctaaggagtcaactagcactaaagcaaagacaacagaacaagggtgcagcgccgagagcaaagagaaagtgttggaaggttccaaactccctgaccaggagaaagcagttagcgagcatattccatacctgagcccctaccatagcagttcctaccgctacgcaaacattcctgcccacgctagacattatcagagctatatgcagctgatccagcagaaaagcgcagtggagtatgcccaaagccagctgtctctggtgagtatgtgcaaggaatcccagaaatgctctgaacctaaaatggagtggaaagtcaaaatccgcagtgatggaacacgctatattacaaagcgacccgtgagggacagaattcttaaggagagagcactgaaaatcaaagaagaacgatccggcatgaccaccgacgacgacaccatgagcgaaatgaagatgggaaggtattggagcaaggaggagagaaaacagcatcttgtgcgggcgaaagaacagaggcgacgcagagagtttatgatgagaagccggcttgagtgtctgaaagagagcccccaaagcggatccgagggcaaaaaggagatcaacatcatcgagctgtcgcacaagaaaatgatgaagaaacgaaacaaaaagattctggataattggatgacaattcaggagttgatgactcatggtgcaaagtctcccgacggtacccgtgtccacaacgccttcctgagtgtgaccactgtgtag

SEQ ID NO: 128046 - DNA, 1158 bp, Artificial Sequence
  Description of Artificial Sequence: Synthetic coding sequence
atgaagctcgtgagaaagaacatcgaaaaggacaacgccggacaggttacgctcgtacccgaggagccagaggacatgtggcacacatacaatctcgtccaggttggcgatagcctcagggccagcacaattagaaaggtgcaaacagaatcatctactgggagtgtggggtccaatcgcgtgcggacgacactgacattgtgcgtggaggcaatcgacttcgactctcaggcctgccagcttcgcgtaaaaggcactaatattcaggagaacgagtacgttaagatgggcgcctaccatacaatagagctcgagccgaacagacagtttaccctggccaagaagcaatgggactcggtcgtcctggagaggatcgagcaagcctgcgacccagcatggagtgctgacgtcgcagccgtcgttatgcaggagggactcgctcatatatgtttggttaccccctcaatgacattgacacgggcaaaagtggaagtgaatatcccacggaagagaaagggcaactgctcccagcacgatcgcgctctggagaggttctatgagcaggtggtccaagccatacagaggcacatacactttgacgtggttaaatgtattctcgtcgcgtcaccaggtttcgtcagagagcaattttgcgattacctgttccagcaggccgtaaagactgacaataagctgttactggaaaacagatctaaattcctgcaggtccacgctagttccggccacaaatacagcttgaaggaggccttatgcgatcctaccgtggcctctaggttaagtgatactaaggccgctggcgaggtgaaggcgctcgatgatttctacaaaatgcttcagcacgagccagaccgcgctttctacggattgaagcaagtcgagaaagctaacgaagcgatggcaattgatacactgctcatctccgacgagttgtttaggcaccaggatgtcgcaactcgttcccgatacgtgcgtctcgtagacagcgttaaggagaacgctggcactgtaagaatatttagtagtttacacgtctctggagaacagctgagtcagctaactggggtcgccgctatcttacgcttcccagtcccagaacttagcgatcaggagggggactcctcttcagaagaagactag

SEQ ID NO: 128047 - DNA, 855 bp, Artificial Sequence
  Description of Artificial Sequence: Synthetic coding sequence
atggcttcttatccatacagacaaggctgcccaggtgcagctggtcaggcccccggggccccccccggtagctactaccccgggccacccaactctggaggtcaatatgggagtgggctgccgccgggcggaggatatggggggcctgccccaggtgggccttacggtccaccggccggcggtggaccatatggacacccaaaccctggtatgtttccttcgggaacgcccggagggccatatggcggagctgcacctggcggcccgtatggacagcctcctccatcatcgtatggagcccaacagcctggactgtacggtcagggaggcgccccccccaatgtcgatcccgaagcatactcttggtttcaatccgtggatagcgaccattccggatacatctcaatgaaagagctaaaacaagctctggtgaattgtaattggagctctttcaatgatgagacttgtctgatgatgatcaacatgtttgacaaaaccaagagcgggcggatcgatgtttatgggttttctgcattatggaagttcatacaacagtggaaaaacctgtttcagcagtacgatcgagaccgaagcggctcgatcagttatactgaactacagcaagccctgtcccaaatgggatacaacttgagccctcagttcacccagttgctcgtctctcgatattgccctcgctcggccaacccagccatgcagctggacagattcatacaggtctgcactcagctgcaagtactgactgaagctttccgggaaaaagacaccgccgttcaggggaatatccgactgtcattcgaagattttgttaccatgactgcgtcccgcatgctgtag

SEQ ID NO: 128048 - DNA, 423 bp, Artificial Sequence
  Description of Artificial Sequence: Synthetic coding sequence
atggcctcttatccctacagacagggctgccctggagctgctggccaggcgcccggagccccaccgggaagttactacccaggtcctccaaactcaggaggacagtacggttctggtctgccacccggcggggggtacggaggccctgccccaggcggaccctacggccctcctgcaggcggcggaccctatggccaccccaatccagggatgtttcctagcggaacccctggcggaccatatggcggagccgcacctggtggtccctacggacaaccaccaccctctagctatggcgcccagcagcctggactttacgggcagggcatacatgcggaaggagccgctcccgtttgggacatgttgtccctgtggcagagagaaggggccggcgagctggccagaatgcacaacgcctcatag

SEQ ID NO: 128049 - DNA, 1146 bp, Artificial Sequence
  Description of Artificial Sequence: Synthetic coding sequence
atgcacctcctcgccatcctgttctgcgcgctgtggtcagccgtcctcgccgagaactctgatgactacgacttgatgtatgtgaacctcgataatgagattgacaacggcctccaccctacagaggatcccaccccctgcgcctgcggccaggagcattctgagtgggataagctattcattatgttggagaactcgcagatgcgggaacgaatgttgctgcaggcaacagacgacgtactccggggggagttgcaacgactgcgcgaagaactaggccggcttgccgagagcctagcccggccatgcgcaccgggcgcacctgccgaagcaaggttgacgtcagccctcgatgagctgctgcaggctacgagggatgctggcaggaggctggcccgaatggaaggggccgaggcccagaggccagaggaagcaggcagggcattggccgccgttctcgaagaactgaggcagacaagagctgacctgcacgccgtacagggctgggcagcccggagctggctgcccgccggctgcgaaaccgcaatcctcttccccatgagatctaagaagatctttggaagcgtacatccagtgaggccaatgagattggagtccttctcagcttgtatatgggtgaaggcgacagacgtgttaaataaaacaattttattcagctatggaacgaaaagaaatccctacgaaattcagctgtacctgtcataccagagcatagtcttcgtcgtgggaggagaagagaataagcttgtggctgaggcgatggtctctttaggcagatggacgcatctatgcggcacatggaacagtgaagaggggctaaccagtctgtgggtgaacggtgagctagccgccacgaccgtcgagatggccactgggcacattgttcctgagggtggaatcctgcagatcggtcaagagaagaacggttgttgcgtcggcgggggttttgacgagaccctggcctttagtggacggctgactggctttaatatttgggattctgtgctgtccaatgaggaaattagggagaccggcggtgcggaatcctgccacatccggggaaatatcgtaggatggggcgtgaccgagattcagcctcacggtggggcacagtacgtcagctag

SEQ ID NO: 128050 - DNA, 1422 bp, Artificial Sequence
  Description of Artificial Sequence: Synthetic coding sequence
atggggtcagggaattgggaagtgacggggccgccttgcggctctcgttgtgagcggccaccaggcctcccgcggggcgtccacggccagttcagatctgccgtgggtctgagcgggctgcgctggtttcgaaggtttcaagaggttacctggacacatttgcaaaatatcgccagcaactataacgttagctataacgtggacgtgaggttcagaagtcttgccgaggagtcacaagctgtggcccaggccgtaaatcgctcacaggccagcgtgcagggtgaactcgcccagttaaaagcctgggtccggaagttacagaggcgcggccgcaaagtcgatacgagacttagagctttggacctgaccctcggcgagaggtcacagcaacgagccagggaacgaaaggcacacaaagctcagagagatgcactgcaagatagcctggctagactcgaaggactggtgcatagccagggcgcccggctggccgccctagagggcaggctgccagtggcgcaccccgggacagccgctctgggtcccgccttggtgcctacgcccacacaacctgaggagcttggtccaacttcgctgaagttgcagagggatcggcaggagctgcgtgcggcctccgagcacagaggaccgccacaagactccagtgcaccccttcaaggccgacgggagccccctgcgagcggatcccaccgtgtcctctccgggaccgcccctaaggatcctcgccagcaggcgtggtcgcctcaagtgcccggcgaaatctgcggcgtgggaccgactctggtgttccctaatgcaagtacacgcaacgtggtgtttctgagtcctggattcgttacagcattgagggctctcagtttctgctcgtgggtccgcaccgccagcggtcggctgggcacactcctctcttacgccacagaggacaacgacaataagctcgtgctccacggcagggacagcttgcttccaggtagcatccattttgtcatcggcgaccctgctttccgcgaactgcctttgcagctgctcttagatgggcaatggcaccacatctgtgtcatctggacatcaacacaagggagatattggctccacgtcgaccgccgcctggtggcgacggggtcacgttttagagaggggtacgagatcccccccgggggctctttggtactcgggcaggagcaagattccgtggggggaggctttgactctagtgaagcattcgtaggcagcatgtctggcctggccatttgggatcgagccctcgtcccaggtgaggtggccaatttagccattggcaaggagttccctacaggagcgatcctgacactagccaacgctgccctggccgggggctttgtccagggggctaactgtacctgtctcgaacgctgcccatag

SEQ ID NO: 128051 - DNA, 1437 bp, Artificial Sequence
  Description of Artificial Sequence: Synthetic coding sequence
atgggctgttcatggaggaaaacgcttagtttcttcttggtgttcgttccaatttacctgcacggcgcctctagtcaggaggcggccccagtcggaccccggaaaccgttctttgagaggctgaggaggttagaggagcagtttcggcgtttccaggaagtgacttggacacacctgcagaatattgccagtaattataacgtttcttataacgtcgatgtgcggttccgctccttggcagaagagagtcaagcagtcgcccaagccgtgaacaggagccaggcctcagttcaaggtgaactggcacagcttaaggcctgggtacgcaaactccagagacggggaagaaaggtcgatacacgtctacgagctttagacctgacgctgggggagcggagccagcagagagcaagggagaggaaggcccacaaagctcagcgcgatgccctgcaggactccctcgctaggttggaggggctcgtgcactcccaaggagcgagactggccgcgctggaaggacgactccctgtggcacacccagggactgccgccctgggtccagccttggtaccaacacctacacagcctgaggagttgggcccaacttcactaaaattgcaaagggaccggcaggaactgcgagctgccagcgagcaccgcgggccgccacaggattcttctgcaccactgcaggggagaagggagccacctgcatccggctctcatcgcgtgctctccggcaccgcaccaaaggatccgcgccagcaggcttggtctccacaggtgccaggagagatctgcggtgtgggaccgactctggtcttccccaacgcatcaactaggaacgtggtgtttctgagccctgggttcgtgaccgctctgagggccctgtccttctgttcatgggtgcgcaccgcctccggtcgcttaggaaccttactgagttacgcaacagaggacaatgataataagctagtgctgcacgggagggattcgcttctgccgggtagcattcattttgtcattggggatcccgcgttccgcgagttgcccctgcagctgttgctcgatggccagtggcatcatatttgtgttatctggacctcaacacaggggagatactggctgcacgtcgaccgacgcctcgtggcaactgggagtcggtttagagaaggatatgagataccgcctggaggtagtctcgtattaggccaggagcaggattctgtcggcggcggctttgactccagcgaggcctttgtgggctctatgagtggtctggcaatttgggatcgagctctggtacctggagaggttgccaacttagccatcgggaaagagtttccgactggtgccatcctgacccttgccaatgcggcccttgctggagggtttgtgcaaggcgcgaattgtacttgtctggaacgctgcccttag

SEQ ID NO: 128052 - DNA, 1167 bp, Artificial Sequence
  Description of Artificial Sequence: Synthetic coding sequence
atgaaatggctactgctgcttgggctcgtcgcgctgtcagaatgtataatgtacaaagttccactgattcgaaagaagtccttacgcagaacactatctgaacgcgggcttcttaaagactttctcaagaagcacaacctaaatccagcccggaagtatttcccacagtggaaagcgcccactctcgtcgacgagcagcccttagaaaattatctcgacatggagtactttggaaccataggaattgggacaccagcgcaggatttcaccgtggtctttgacacaggcagctccaatttatgggtgccttcggtctactgctccagcctggcgtgtactaatcataaccgattcaacccagaagattctagcacataccagtcgactagtgagaccgtgagtatcacttacggcaccggttcaatgacaggaattctgggctatgataccgtgcaggtgggcggtattagtgacacgaatcagatcttcggtctgagtgagacagagccaggttcctttctgtactatgcccccttcgacggaatcctaggcttggcctacccctcaataagttctagtggtgccaccccggtgttcgataatatctggaaccagggcttagtaagtcaggacctgttcagcgtttacttgagtgcagatgaccaaagcgggtcagtggtgatcttcgggggtatagatagttcctactacactgggagccttaattgggtgcccgtgactgtagagggctattggcagattaccgtcgattccatcaccatgaatggggaagctatagcctgcgctgaggggtgccaggcaatcgtcgacaccgggacctccctattaacaggccccacgagcccaatcgccaatatccaaagcgatattggagccagcgagaatagcgacggcgatatggtggtgagctgcagcgccatctctagcctgcccgacatcgtcttcactatcaacggagtgcaataccctgtgcccccctccgcgtatattctacaatctgagggatcctgcatctctgggtttcaggggatgaacctcccaactgagtccggcgaactgtggatactcggggatgtgttcatcagacagtactttacagtgtttgacagggcaaacaaccaggtcggccttgcacccgttgcctag

SEQ ID NO: 128053 - DNA, 849 bp, Artificial Sequence
  Description of Artificial Sequence: Synthetic coding sequence
atgaagtggctgttgctgctgggcctggtggccttgtcagaatgtataatgtacaaagtccctttgatcaggaagaagagtctccgtaggacgttaagtgaaaggggattgcttaaagatttcttaaagaagcacaatctgaatcctgcccgtaagtattttccccagtggaaagctcccaccctcgtggatgagcagcctttggaaaattatctcgacatggaatatttcggaaccatcggcatcggtacacctgcccaagacttcactgtagtcttcgatacaggctcaagtaacctgtgggtgcccagtgtctactgttccagtctggcctgcacaaatcataacagatttaaccctgaagactcatccacttaccagagcacttccgaaaccgtgtcaatcacttacgggactgggagtatgactggaattcttggttatgatacagttcaaactgtcgcaatttggagatccgccgctatggggttggtaagtcaggacctgttctcggtttatctcagcgccgatgaccagtcgggttcagtcgttattttcggaggcatcgattctagctactacacaggttctttgaactgggtgcctgtaacagttgaggggtactggcaaattaccgtggattctataactatgaacggcgaggcaatagcttgcgcagagggttgtcaggctattgttgatactggaacaagcctcctgacagggccaaccagccctattgcgaatattcagagcgacatcggtgcgtcggagaacagcgacggggatatggtcgtgagttgctccgccatctccagtctcccagacatcgtcttcacgataaactag

SEQ ID NO: 128054 - DNA, 750 bp, Artificial Sequence
  Description of Artificial Sequence: Synthetic coding sequence
atgacgggtattttaggatatgacacggtgcaggtgggtggcatctctgataccaaccagatctttgggctgtcggaaaccgaaccaggcagtttcttgtactacgctccatttgatggcatcttgggacttgcctaccccagtatttcttcgtcgggggcaactcctgtgttcgataatatctggaaccagggtctcgtgtcccaggatctgttctccgtgtatttgtctgccgatgatcagagcggttccgtagtcatattcgggggaattgatagctcctattacaccggttctcttaactgggtgcccgttaccgtggagggctattggcagatcacagtggactccattaccatgaatggcgaggcgattgcgtgtgctgagggctgtcaggctatagtcgacacaggcacttctctgctaaccggtcctacgtcaccaatcgccaatattcagtctgacatcggggccagcgaaaatagtgatggtgatatggtcgtatcctgctctgcaatatccagcctgccggatattgtgtttacaattaatggtgtacagtatccggtgccaccatccgcttacatattgcaactgcccagtgaggggagctgtatcagtggctttcagggcatgaatttgcccactgaatcgggcgagctttggattttgggggatgtatttatacggcagtattttaccgtgttcgatagagccaataaccaggtagggctcgcacccgtggcttag

SEQ ID NO: 128055 - DNA, 1167 bp, Artificial Sequence
  Description of Artificial Sequence: Synthetic coding sequence
atgaagtggttgctgctgttgggtctcgtggctctttcagaatgcatcatgtacaaggtcccactgatccgcaagaagtccctcagaaggaccctctctgagagaggccttctgaaagattttctgaagaagcacaatctcaaccctgcccgtaagtatttcccacagtgggaggccccaaccctggtggacgagcagccactggaaaactatctggacatggagtattttgggacaatcgggatcggtacccccgcgcaagacttcacagtggtctttgacacgggctctagcaatctatgggtgccttctgtgtattgcagttccctggcctgtaccaatcacaatcgattcaaccctgaggattcttctacgtaccagtctacgtccgagaccgtgagtatcacttatgggacaggatccatgactggcatccttggttacgataccgtgcaggttggaggcattagcgacaccaaccaaattttcgggctctccgagacagaaccaggttcgttcctgtattatgcccccttcgatggtatcctcggattagcatatccatctatttcctcctctggggcaaccccggtgttcgacaacatctggaaccagggactcgtcagtcaggatttgttcagtgtatacttgtcagccgacgaccagagtggatcggtggtcatttttggaggtattgattcatcatattacacaggctcgttaaactgggtacccgtaactgtggaaggctattggcagattacagtcgactctatcaccatgaacggcgaggccattgcttgcgcagaggggtgtcaggccatagtcgataccggaacatccctgctgaccggaccgacaagtcctatcgctaatatacaatctgatattggggcttcagagaacagcgacggggacatggtcgtgtcatgctccgcaatcagcagtcttcccgacattgtgttcactattaacggcgtgcaataccctgtgcctccctcggcttacatcttacagtccgagggttcctgcatttccggattccaggggatgaaccttccaaccgagagtggcgaactatggattctgggggatgttttcatacggcagtactttacagtgttcgaccgcgctaacaaccaggtgggactggccccagtcgcatag

SEQ ID NO: 128056 - DNA, 1167 bp, Artificial Sequence
  Description of Artificial Sequence: Synthetic coding sequence
atgaagtggcttctgctgcttggccttgttgctctttctgagtgtattatgtataaggttcctctgatccggaagaagtcgctgcggcggactctgtccgaaagaggcctactgaaagattttctgaagaaacacaacttaaacccagctagaaagtacttccctcagtgggaagctcccacactcgtggatgaacagccactcgagaattacctggacatggaatatttcggcaccattggcattggaacccctgcccaagattttacggtggtatttgatacaggcagttcgaacctttgggtgcctagcgtgtactgctcatcccttgcgtgtactaaccataataggttcaaccctgaggattctagtacttaccagtcaacatctgaaaccgtctccataacttatggaaccggatcgatgacaggaatccttggttacgacacagtgcaggtgggaggaatcagcgatactaatcagatcttcggcctgtctgagaccgaacctggctccttcctgtattacgcaccctttgatggtatactggggttagcctaccctagcatctcaagctcaggagctaccccagtcttcgacaatatctggaaccagggtttggtcagtcaggatctttttagtgtctatttaagcgctgatgacaagagcggatccgtggtgatttttggcggaattgattcttcctactatacaggatccttaaattgggtgcccgttaccgtggaagggtactggcagatcacagttgattctatcactatgaacggcgagaccattgcctgtgcagagggttgtcaggctattgtagacacgggaacttcattattgacaggacctacaagtcctattgcaaacatccagagtgacatcggagcatcagagaacagtgatggagatatggtcgtctcctgctctgccatttcatcattgcccgatattgtgttcactattaacggggtacagtacccggtcccaccctcagcatatattctacagagtgagggctcgtgtatcagtggcttccagggcatgaatgtacccactgaatcaggcgagttatggatactaggggacgtgtttattcgacagtatttcacagtttttgatcgtgctaacaaccaggtggggctcgcacctgtggcttag

SEQ ID NO: 128057 - DNA, 849 bp, Artificial Sequence
  Description of Artificial Sequence: Synthetic coding sequence
atgaaatggctgctgttgcttggattagtggctttgtccgagtgcataatgtataaagtgcctctcataaggaagaagtccctgagacggaccttgtctgagcggggattgctaaaggattttcttaaaaagcataatctaaatccggccaggaagtactttccccagtgggaggcccctacacttgtggatgaacagcctctggagaactacctcgatatggaatacttcggaaccattggaatcggaacccctgctcaggatttcactgtggtgtttgatacaggatcctccaacctgtgggtaccgtctgtgtactgcagctctctggcatgtacgaatcacaaccgttttaacccggaggactcaagtacatatcagtctacctcggagacagtgtcgatcacatacggaacaggcagcatgacaggaattctaggctacgacaccgtgcagacagtggccatctggaggagtgctgcaatgggtctggtctctcaagatcttttctcagtctacctcagtgcagacgatcagtctggtagcgtggtaatcttcggcgggattgacagcagctactacactggctcacttaactgggtgcccgtgaccgtggagggttattggcaaatcactgtcgactccatcactatgaacggggaggctatcgcttgtgcagaagggtgccaggcaattgttgacactgggacgagcctccttacaggaccgactagccccatcgcgaatatacaatccgacattggcgcttcggaaaattccgacggagacatggtggtgtcttgtagcgcaatcagtagcctgcctgacattgtatttactattaactag

SEQ ID NO: 128058 - DNA, 750 bp, Artificial Sequence
  Description of Artificial Sequence: Synthetic coding sequence
atgacaggcatattgggctacgatactgttcaggttgggggcatcagcgatactaaccagattttcggattgtcggaaactgaaccagggagctttctttattatgcgccgttcgacggtatcctaggccttgcctacccctcgatttccagttccggcgcgacgcccgtgttcgacaacatttggaaccagggcctggtgtctcaagatttgtttagtgtctatttgagcgcggacgaccaaagtgggtccgtggtgatcttcggcgggattgattcatcgtattacaccggaagcttgaattgggtgcccgttaccgttgagggatattggcaaatcacagtcgattctatcaccatgaatggggaggcaattgcctgcgccgagggttgtcaggcaattgtcgatactgggacaagcctgttgactggtcctacaagtccaatcgcgaatatccagtccgatattggcgcctccgagaacagtgatggagatatggtggttagttgttccgctatttcaagtctgccagatattgtgtttaccatcaacggagtccagtatcctgtccccccttccgcctacattctccagctgccctctgaggggagttgtattagcgggttccagggaatgaatctgccgacagagagtggcgaactgtggatcctgggagatgtcttcattcgacaatacttcaccgtattcgatcgggccaataatcaagtgggcctagctcccgtggcttag

SEQ ID NO: 128059 - DNA, 1167 bp, Artificial Sequence
  Description of Artificial Sequence: Synthetic coding sequence
atgaagtggctgctgctgctgggcctggtcgctctaagcgaatgcatcatgtacaaggtacccttaattcggaaaaaaagcctccgaaggacgctgtctgaacgtggtctgctgaaggacttcctgaaaaagcataacctcaatccagccaggaagtattttccgcaatgggaggcaccgacgctcgtggacgagcagcctcttgaaaactatctcgatatggaatactttggcacaataggtatcgggacacctgcgcaggactttacggtcgtgtttgacactggttcgtctaacttgtgggtcccatctgtctactgtagttccctggcatgcacgaaccataaccgcttcaacccagaagactcatcaacatatcagtcgacctccgaaaccgtcagtatcacttatgggacgggtagcatgactggaatactggggtatgacacggtccaagtaggcggaatctctgatacaaaccagattttcggtctgtccgaaacagaaccggggagctttctgtactatgcaccttttgacggcattttaggcctcgcttacccctcaatcagttcttcaggcgctacgccggtgttcgacaatatctggaaccaggggctagtctctcaggatctctttagcgtgtatctgtcagccgacgacaagtccggctcagtagtgatcttcggggggattgattctagctactacacaggatcgctaaactgggtgcctgtgacagtggagggctactggcaaattaccgtggattccattacaatgaacggcgagaccatcgcttgtgcggaaggctgccaggcgatcgtggacacgggcacaagtctactcacaggccctacatcgcctattgccaatattcagagcgacatcggggctagcgagaactcagatggggatatggtggtatcctgttcggccatcagctcactgccagatatcgtgtttacaatcaacggagtgcagtaccctgtcccgccgtccgcctacattctccaatcagaggggagctgcatctccggcttccagggaatgaacgtgcccaccgaatccggggaactatggatactgggggatgtgttcattcgccagtactttacggtgttcgaccgagccaataaccaggtggggctggctcccgtcgcatag

SEQ ID NO: 128060 - DNA, 849 bp, Artificial Sequence
  Description of Artificial Sequence: Synthetic coding sequence
atgaaatggttactgctgctcgggctggttgcactctcagaatgtattatgtacaaagttcccctgatccgtaaaaaaagcctccggaggacattgagcgaacgaggtctgctcaaagatttcctcaaaaaacataacttgaacccagctaggaaatacttcccacagtgggaggctccaaccctggtggatgagcagccgctggagaactacctggatatggaatacttcggaaccatcggcatcgggacaccggcacaggattttactgtggtctttgatacaggcagctccaacctctgggtgcccagcgtttattgtagctcccttgcgtgtacaaaccataaccggttcaatccagaagactcctccacttaccagtctacctcagaaacggtgagcatcacttatggaactggcagcatgacagggatcttagggtatgacaccgtgcaaacagtcgctatatggcggtctgcagcaatgggtctcgtctcccaagaccttttcagcgtgtacctgtccgccgatgacaaatcaggctctgtggtaattttcggaggtatcgactcatcctactacacagggagtttgaattgggtaccagtgaccgttgagggatactggcagatcacagtggattccatcacaatgaacggtgagactattgcctgtgcagagggatgtcaagcaatcgttgacaccgggacctccctgctgaccgggcctacaagccccattgccaacatccagtcagatataggagctagcgagaacagcgacggggacatggtggttagttgttctgctataagctccctgcctgacatcgtgttcacaattaactag

SEQ ID NO: 128061 - DNA, 750 bp, Artificial Sequence
  Description of Artificial Sequence: Synthetic coding sequence
atgactggtatcctcgggtacgacacagttcaggtgggaggaatctccgatacaaaccagattttcgggctcagcgagaccgagcccgggagtttcctgtactatgctccatttgatggtatcttgggactcgcctacccaagcataagttctagcggtgcaacacccgtgttcgataatatatggaaccagggcttggtgagtcaggacttgttcagcgtgtatttgagtgccgatgataaatctggatcggttgtgatctttgggggcattgactcaagctactataccggatccttgaactgggtgcccgtgacagtagaggggtattggcagatcaccgttgatagtatcaccatgaatggagagaccatcgcctgcgccgaaggctgtcaagcaatcgtcgacacaggcacatctttactgactggccctacgagccccatagctaacatccagtctgatattggtgcttcagagaatagcgacggcgacatggttgtctcttgctcggccatcagctcacttccagatattgtgtttactatcaatggggtgcagtatcccgttcctccaagcgcgtacatccttcaactgcctagcgagggcagctgcatttctggttttcagggcatgaacgtgccgactgagtctggcgagctatggattctgggagatgtattcatccgccagtacttcaccgtgtttgacagggcaaacaatcaagtgggtctagcgcccgtagcatag

SEQ ID NO: 128062 - DNA, 1578 bp, Artificial Sequence
  Description of Artificial Sequence: Synthetic coding sequence
atggccgcagtcgtgttggccgccactagattactgcgaggcagtgggtcctggggttgttcgcgcctaagattcgggccacctgcctatcgcagatttagcagcggcggagcctacccaaacataccactcagctcccctctcccaggggttccaaaacccgtgtttgccaccgtagatggacaggagaagttcgaaacaaaggtcacaactcttgataacggtctgagggtggcatcacagaataagttcggtcagttttgtaccgtggggatcctgatcaacagtggctctagatacgaagccaagtacctatccggaattgcacactttcttgaaaagttggccttcagttctactgcaaggttcgactcaaaagacgaaatcttgttgaccctcgagaaacatgggggcatctgcgattgccagacctcccgtgataccactatgtacgcggtttctgcagactcaaaagggttagacaccgtcgtagctttgctcgccgacgtagtccttcaaccccgcctgaccgacgaggaggtggagatgacgcgcatggcagtccagttcgaactcgaggatctaaatttacggccagatcctgaaccgctgcttaccgagatgatccatgaggccgcatacagggaaaataccgtcggcctgcacagattttgccctaccgagaatgtagccaaaatcaatagagaggtgctccactcttatctcagaaactattatacaccagaccgtatggtcctggccggagttggtgtcgaacatgagcacctggtggattgtgcacgtaaatatctgctgggagtgcagcccgcctgggggagtgccgaagctgtcgatatcgacaggtccgtcgcgcagtataccggtgggattgctaagctagaaagagatatgagcaacgtttccctggggcccactcctatcccagagcttacacatattatggtgggtttagagagttgtagcttccttgaggaggacttcattccttttgcagtgttgaacatgatgatggggggaggcggtagtttctccgcaggtggaccaggaaagggcatgtttagccgcctgtacctgaatgtcctgaatcgtcaccactggatgtataatgccacatcctaccaccattcttatgaagataccgggctgctgtgcattcacgcaagcgccgatccgaggcaggtgcgtgagatggttgaaatcattaccaaggagtttatcctcatgggtgggacagtggataccgtcgaacttgagcgggctaagacacagctgactagtatgcttatgatgaatctggaatccaggccggtgattttcgaagatgttggccgacaggttctggctacaagatctcggaagttgccgcacgaattgtgtaccctgatccgaaatgtcaagcccgaagatgtgaagcgggtagcttccaaaatgctccgtgggaaaccagccgtagccgcactgggcgatctgacagatctccctacatacgaacatatccagaccgccctgtcctccaaagacggtcggcttccccggacatatcggttattccggtag

SEQ ID NO: 128063 - DNA, 441 bp, Artificial Sequence
  Description of Artificial Sequence: Synthetic coding sequence
atggcagccgtggtgctcgcagccactaggttgttgaggggaagcggatcctggggttgctcacgtctgcggttcgggccccccgcttacaggcgattttcctctggaggagcctacccgaacattcctttgtctagtcccctccccggcgtgccgaagcctgtgtttgccaccgtggacggccaggaaaagttcgaaacaaaggtcaccaccctcgacaatggcctgcgggtggcttcacagaacaaattcggccagttttgtactgtcggcattctgatcaattctggtagccggtacgaggcgaagtacttgtctggcattgcacactttctggagaaactggcctttagctcaacagctcgctttgacagcaaagacgaaatcctcttgacgctggagaagcacggcgggatctgtgattgtcagacttcaagatag

SEQ ID NO: 128064 - DNA, 1185 bp, Artificial Sequence
  Description of Artificial Sequence: Synthetic coding sequence
atgaagcgcaacactttggtggaactgttgacattctggaaaaattggcacttcagactgttgttggatttgacagccaagatgaaattttgcctcaggtggaagagcatgggcgtcagtgtgaccgccaggcatcaggatgaagaagtcgagatgacccggatggcagtccagtttgaactggaagacctgaacctacgtcccgatccagagccattgttgactgagatgattcacgaagccgcatatcgtgagaatacggtgggactgcataggttttgccctacggaaaatgttgccaaaattaacagagaggtgctgcacagttatctccgcaactactacacaccagatcgcatggttctggccggcgttggagttgagcatgagcacctggtcgactgcgctcgtaaatatctgcttggtgtccagcccgcctgggggagtgccgaggctgtggatatagatcggtcagtcgcccagtacacggggggcattgccaagctcgagagggatatgtctaacgtgtccttgggcccgaccccaatcccagagctcacccatattatggtgggtctggagtcctgttctttcttagaggaagacttcatccctttcgccgttctgaatatgatgatggggggtggggggtcattttccgccggcggccccggcaaaggcatgttttcacgtctctatctgaatgttcttaatagacatcattggatgtataacgctacatcctatcatcattcctacgaggacaccggactgctctgcatccacgcctccgccgatccccggcaggttagggagatggtggagattatcacgaaggagttcatcctcatgggcggcactgttgatacggtagaacttgagcgggcaaagacgcaattgacatccatgctcatgatgaatctggagagccggcccgtcattttcgaggacgttggacgtcaggtgctggcgaccaggtcccgtaagctgccacatgaactttgcactctcatccggaatgtgaagccagaggacgtaaagagggtggcttccaagatgctgaggggcaagcctgcagtcgcggcactgggggacttgacggatctcccgacctatgaacacatacagaccgcattgtcttctaaggatggacgtctgcctaggacctacaggctgtttagatag

SEQ ID NO: 128065 - DNA, 816 bp, Artificial Sequence
  Description of Artificial Sequence: Synthetic coding sequence
tacaccgggggcattgccaagctggagcgtgacatgtccaatgtgtcccttgggccgacaccaataccagaacttacccatatcatggtcggcttggagagctgttcctttttagaggaggatttcataccattcgcagtgctgaatatgatgatgggcggcggtggcagtttctcagcaggaggccctggaaagggcatgttttctaggctgtacttaaacgtattgaatagacatcactggatgtacaacgcaacctcctaccaccattcgtatgaggataccgggcttctatgcatccatgcaagcgctgatccaaggcaggttagggaaatggtggaaattattacaaaagaattcatactgatgggggggaccgttgataccgtggaactcgagcgtgcaaaaacacagctgacgagtatgttgatgatgaacctcgagtctagacctgtgatttttgaggacgtcgggaggcaggtactggcaacccggagccgcaagctgccccacgagctatgcacactcatccgcgagtatcggaggggcagcgagggcctgcctcaagcttcggcacgactccgtggtggccggttagctctcccacaagcagtggtcggcctgtggtatgttcatcatacccaaaatctcggaccttctcccgtcgtactcagcagggggggacagggacagggccgcggcgtggctgacctggtgtccctacccgggccaacaatgcatctgcttccaccttggcaggtcaccccaccgtctgcccctctcggtggtgccgtgaccactgctcagtcttgttag

SEQ ID NO: 128066 - DNA, 1482 bp, Artificial Sequence
  Description of Artificial Sequence: Synthetic coding sequence
atggccgctgcaactggcccgagcttttggctgggcaatgagacgcttaaggtacccctcgcactcttcgctctcaacaggcagcgcttatgtgagaggctgcgaaaaaaccctgctgttcaggcagggagcatagtagtccttcagggcggagaggagactcagcgatattgtactgatacgggcgtgcttttccgccaagagagcttctttcattgggcctttggtgtaacagagcctgggtgctatggcgttattgatgtggatactgggaagtccactctgttcgttccgaggcttcctgcatctcacgccacatggatgggcaagattcacagtaaggagcatttcaaagagaagtacgctgttgacgatgtgcagtacgttgacgaaatagccagcgtgttaacatctcagaagccctcggttctgcttacgctgcgcggagtgaacacagacagcgggagcgtgtgcagggaggcctctttcgatggtatttcaaagttcgaggtgaataatacaattctccatccagaaatagtagagtgcagggtcttcaagacagacatggagttggaggtcctacgatatactaacaaaatatctagtgaagcgcaccgggaggttatgaaggctgtgaaggtgggcatgaaagagtatgagctcgaaagcctcttcgaacattattgctactctcgaggcggcatgagacactcatcatacacatgcatctgcggctccggggagaatagcgccgtgctacattacggtcacgccggcgccccaaatgaccgcacgatacagaatggcgatatgtgtttgtttgatatgggtggcgagtactactgcttcgccagcgacatcacctgttctttcccagccaacgggaagtttacagccgaccagaaagctgtgtatgaggccgtgttacgctcctcacgcgcagtgatgggcgcaatgaagcccggggtgtggtggcccgacatgcacagacttgctgaccggattcacttagaggagctggcccacatggggattctctccggaagcgtggacgctatggtgcaggcacatctcggggctgtgtttatgccccacggcctgggacacttcctgggcatcgatgtgcatgacgtaggaggttaccctgagggggtggagaggatcgatgaacctggcttgagaagcctgcgaacggctcggcatcttcagccaggcatggttttgacagtcgagccgggcatatattttatcgatcacctcctggacgaagcgcttgctgaccccgccagagcatcatttcttaatcgcgaggtgctgcagagatttaggggcttcggaggtgtgagaatagaagaagacgtcgttgtgacagattccggcattgagttactaacatgtgtgcccagaaccgtcgaggagatcgaagcgtgcatggccggttgtgacaaggcattcactccgttttccggaccaaagtag

SEQ ID NO: 128067 - DNA, 1359 bp, Artificial Sequence
  Description of Artificial Sequence: Synthetic coding sequence
atggcagccgcaacaggtccttccttctggctgggcaacgaaaccttgaaagtgccactcgccctcttcgctctaaatagacagagactgtgcgaaaggcttcggaagaacccagctgtccaggcaggttccatcgtggtgctgcagggcggcgaggaaactcagcgctactgcacagatactggcgtactatttcgacaggagagcttcttccattgggcgttcggagtgacagaacccgggtgctacggcgtgatcgacgtagacacaggaaaatccacactcttcgtgccaagattgccagcttcacacgctacatggatgggaaagatccactcgaaggagcactttaaggagaaatacgccgtggacgacgtgcagtatgtagatgagattgcatctgtccttacctcccagaagccatccgtacttcttactctccggggtgtaaacacagactctggatcagtatgtagagaagcaagtttcgacggtattagcaaattcgaggtgaataacacaatactccaccccgagattgtggagtgcctcttcgaacactattgctattctagaggcgggatgaggcactcatcctacacttgtatctgcggctcgggagaaaacagcgcagtgctccattacgggcacgccggagccccgaatgaccgtaccatccagaacggcgacatgtgcctatttgatatgggcggagagtattattgtttcgctagtgacatcacctgtagcttccctgctaacggcaagttcacagccgaccagaaggctgtctacgaggctgtgctgagaagctctagagctgtgatgggtgctatgaagcctggcgtttggtggccagacatgcacaggctagccgacaggattcacctggaagaacttgctcacatgggaattctctctggatctgtcgatgccatggtccaggctcatttgggcgcagtatttatgcctcatggtctggggcatttcctggggatcgacgtgcacgatgtgggcggctatccagagggggtggagcgcattgacgaacccgggctgcgaagcctgagaacggccagacatctgcaaccagggatggtacttactgtggagccgggcatttattttatcgaccatctgttggacgaggcgctcgccgatccagccagagccagctttcttaatcgggaggtgctccaaaggtttcggggatttggaggagttcgcattgaggaagacgtagtcgtcacagacagcggcattgaactgctgacttgcgttccgagaactgtggaggaaatcgaggcatgcatggcaggatgcgataaagcatttacacctttttcaggacccaagtag

SEQ ID NO: 128068 - DNA, 1290 bp, Artificial Sequence
  Description of Artificial Sequence: Synthetic coding sequence
atggcagccgccaccgggccatccttttggctcggcaatgagactttgaaggtcccactggcattgtttgccctcaacagacaacgcctatgtgagcggctgagaaagaatccagcggtgcaggcagggtccattgtcgttttgcagggcggtgaagagacgcaaaggtactgcaccgacacaggagtcttgtttcgccagattgctagcgtgctgacatctcagaagccatctgtcctcctgacactgcgaggggtgaacactgactctgggtccgtttgccgtgaagcctctttcgacggaatcagtaagtttgaagtaaacaataccattttgcacccggaaatcgtagaatgccgggtatttaaaactgatatggagcttgaggtactgcggtatactaacaaaattagctccgaagcacacagagaagtgatgaaggccgtgaaagtgggcatgaaggagtacgagctagaaagcctgtttgagcactattgctattctcgcggcggtatgagacactcgagctacacctgcatttgtggttccggggagaactctgccgtcctacattatggccatgctggagcccctaatgacaggaccattcagaatggggatatgtgtttgttcgacatggggggagaatattattgttttgcaagcgacattacgtgttccttccctgccaatggaaaatttaccgccgatcagaaggccgtttacgaggcggttctgcgctcctcgagagcggtcatgggcgccatgaaacctggggtgtggtggcccgacatgcatcgcttggccgatcgaattcacctcgaagagctggcacatatgggcatcctgtctggcagcgtcgatgcgatggtccaggctcatttgggggcagtctttatgccacatggtctgggtcattttctcggtattgacgtccatgacgtgggaggctaccctgagggcgtggaaagaatcgacgagccaggcctccgatctctgagaacagcgcgccacctacagccaggtatggtgctgactgtggagcctggcatctatttcatagaccatctgctggacgaagccctcgctgaccccgcacgagctagttttctcaaccgggaagtgctgcaaagattccgaggatttggtggcgtaaggattgaggaagacgtcgtggtgacagatagtggaattgagctgcttacctgcgtaccccgcacggtcgaggaaattgaggcttgcatggcaggatgtgataaggcttttacgcccttcagcgggcctaagtag

SEQ ID NO: 128069 - DNA, 354 bp, Artificial Sequence
  Description of Artificial Sequence: Synthetic coding sequence
atgcgcgcgagcagtttcctgatcgtggtcgtgttcctgatcgcaggaactctggtgctggaggctgccgtcactggggtacccgtcaaagggcaagatacagtgaagggaagagtgccctttaatgggcaggatcctgtcaagggtcaggtaagcgtgaagggacaggacaaggtgaaagctcaggaaccagtgaaagggcctgtgtcgaccaagcccggttcatgccctatcatactgattagatgcgctatgttgaatcccccaaaccggtgcctgaaagacactgactgccctggcatcaaaaaatgctgtgaaggcagctgcgggatggcctgcttcgttccccagtag

SEQ ID NO: 128070 - DNA, 732 bp, Artificial Sequence
  Description of Artificial Sequence: Synthetic coding sequence
atggccaggctgtggggcgccttaagcctgtggcccctctgggcggctgtgccctggggaggagccgcagccgtgggcgtgcgggcctgttcttccaccgccgccccagacggggtcgagggcccagctctaagaagatcctattggaggcaccttcggcggctggtgctgggccccccagagcctcccttctcccatgtttgtcaggtcggcgatccagttctgcgaggggtcgccgcacctgttgagagagcccagctgggcggccctgagttgcaaaggctgacccagcgactggtgcaggtgatgagaaggcggcgatgtgtggggctctctgccccccagctgggagtcccaagacaggtactggctctggagctccccgaggctctgtgccgcgaatgcccccctaggcaacgtgctctgcgccagatggagcctttccccctgcgggtgtttgtgaacccttcacttagggtactcgacagtcgactcgtgacttttcccgagggctgtgagtcagtggcgggatttctggcttgcgtgccccggtttcaggccgtccaaatcagtggtttggacccgaacggggaacaggtggtgtggcaggcgtctggctgggctgccaggataatccagcatgaaatggatcacctgcaggggtgcttgttcatcgacaagatggatagtcgcacattcacaaatgtttactggatgaaggtcaatgattag

SEQ ID NO: 128071 - DNA, 294 bp, Artificial Sequence
  Description of Artificial Sequence: Synthetic coding sequence
atggtgtttgttagacgaccctggcctgcactgactactgtgctgctcgccttgctggtgtgcctgggagcactcgtggatgcatatcccatcaaacccgaggcccccagggaagacgcttcccctgaagagctaaacagatactacgctagccttcgacattacctgaatctggtaacacggcagcgttatggcaagagggatgggcctgatacccttctgtcaaagactttcttccccgatggcgaagacaggcccgtacggtctcgatcggaggggccggacttatggtag

SEQ ID NO: 128072 - DNA, 1992 bp, Artificial Sequence
  Description of Artificial Sequence: Synthetic coding sequence
atggcaccaaaaagagtagtgcagctttctctgaagatgcccactcacgctgtatgcgttgttggcgttgaggcccacgtggatattcactctgatgtcccaaaaggagctaactcgttcagagtgtcgggcagttccggcgtggaggtgttcatggtgtacaacaggacacgcgtgaaggagcccatcggcaaggccaggtggcccctcgataccgacgccgacatggtcgtttcagtgggcacggcatctaaggaactgaaagattttaaagtgcgggtgagttatttcggcgagcaggaggaccaagctctaggacgatccgttctgtacctgactggcgttgatatttcacttgaggtggacacaggcaggactggaaaagtgaaaagatcacaaggggataagaaaacctggcgttggggacctgagggatacggcgccatactgctcgtgaattgcgatagagacaaccacaggagtgcagaaccagatttgactcacagctggctgatgtcgctagccgacctccaggacatgagcccgatgctactcagctgtaatggtccggataagctgtttgactcacacaaactggtgttgaacgttcctttctctgattcaaagagagtgagagtgttttgcgcacgggggggcaacagcctctctgactacaaacaagtgctgggcccacagtgcttatcgtatgaagtagaaagacaaccaggagaacaggaaatcaagttctatgtagaaggcctgaccttccctgatgctgacttcttaggacttgttagcctcagtgtcagcttggttgaccctgggactctgcctgaggtgacgttattcaccgatactgtgggcttccgtatggccccttggatcatgacacccaacacccagcccccagaggagctgtatgtttgccgcgtcatggatacccatggcagcaacgagaaatttctcgaggacatgtcttacctgaccctgaaggctaactgtaaacttacaatatgtccccaggtagagaatcgcaatgaccgttggattcaagacgaaatggagttcgggtacatagaagccccacataagtctttcccagtggtattcgattcccctagaaaccgcggattgaaggactttccctacaaaagaatcctggggccagacttcggctatgtcactagagaaatccctttaccagggccttcgtcactggactccttcggaaacttagatgtgagcccccctgtgacagttggggggacagaataccctctgggcagaattttgatcggatcatcatttccaaaatcaggagggagacagatggcaagggccgtgcgtaattttttgaaggctcagcaggttcaggcgcctgtggagctttattccgactggctctccgtggggcatgtggatgagttcctcacttttgtgcccacatctgatcagaagggttttagactgttgctggcttccccttctgcttgtttaaaactgtttcaagagaaaaaggaagagggttacggggaagcggcccagtttgacggattaaaacaccaggccaagcgtagtatcaacgagatgttagccgaccggcacctgcaacgcgataatctccacgcacagaagtgtatcgactggaataggaatgttctcaagcgcgaacttggactagcagagtccgatattgttgatatccctcagctgtttttcctaaagaatttctatgccgaagccttcttccccgacatggtgaacatggttgtattagggaaatacctcggcatccccaaaccttacggcccaattattaacgggcggtgctgcctagaggagaaagtgcaatcactattggagccactgggtctccactgtattttcatagacgattatttgtcctatcatgaactacagggcgagatccactgcggtaccaatgtgagaagaaagccctttccgtttaagtggtggaatatggtcccatag

SEQ ID NO: 128073 - DNA, 537 bp, Artificial Sequence
  Description of Artificial Sequence: Synthetic coding sequence
atggcccgcgctgtccggaatttcttaaaggcccagcaggtgcaagcccctgttgagttgtactctgattggctatcagtggggcatgtggacgaattcttaacctttgtgccaacctcagaccagaaggggtttcggttgctgctggcaagcccatctgcttgtctaaaactctttcaggaaaagaaggaggagggctatggcgaagcagcacagttcgatggccttaagcaccaagccaagcgaagcatcaatgagatgctggcggacagacacttgcagagagataaccttcacgctcaggtaaatatggtcgtgttgggtaaatatctaggaatcccaaaaccatatggaccgatcattaacgggagatgctgtctggaggaaaaagtccagtccttgttagagcccctaggcctgcattgtatttttattgacgattacttatcctatcatgagctgcagggggaaattcactgtggaaccaatgtgcgcaggaaaccattcccgttcaaatggtggaacatggtgccctag

SEQ ID NO: 128074 - DNA, 405 bp, Artificial Sequence
  Description of Artificial Sequence: Synthetic coding sequence
atgttggcagatcgacacttacagagagataaccttcatgcccagaagtgcatagactggaaccgcaatgtccttaaacgagagcttggactggctgagagcgacattgtggacatccctcaactcttttttctgaaaaatttctatgctgaggcatttttcccggacatggtcaatatggtggttctcggcaagtatcttgggattcctaaaccctatggccccattatcaacgggagatgttgtcttgaagagaaggttcaaagcctactggagcctttgggactacactgcatattcatcgacgattacctttcttaccacgaactccagggcgagatacactgtggcactaatgtacgccgcaagccattcccgtttaaatggtggaatatggtcccatag

SEQ ID NO: 128075 - DNA, 663 bp, Artificial Sequence
  Description of Artificial Sequence: Synthetic coding sequence
atggctagagctgttagaaattttctcaaagcacagcaggtgcaggcgcctgtcgaattgtactccgattggctcagcgtggggcatgttgacgagttcttaacctttgtaccaacctcagaccaaaaggggtttcggcttctgttagcctcaccctccgcctgtcttaagctgttccaggaaaagaaggaagaggggtacggcgaagccgctcagttcgacggtcttaagcaccaggcaaagcgatccatcaacgagatgctggctgacagacacctccagcgggacaacttgcacgcccaaaaatgcattgactggaatcggaatgttctaaagagagaactcggtctcgcagagtcggacattgttgacatcccccagctgttctttcttaaaaacttttacgcagaagcattttttccagatatggtgaatatggtcgtgctgggcaaatatctgggaattccaaaaccctacgggcccataataaacggtaggtgctgccttgaagaaaaggtgcaatctctgctggaaccacttgggctgcactgcatttttatcgatgactacctgtcttatcacgagctccagggtgagattcattgcggaacaaacgtgcggcgtaagccatttccgtttaaatggtggaacatggtgccctag

SEQ ID NO: 128076 - DNA, 1314 bp, Artificial Sequence
  Description of Artificial Sequence: Synthetic coding sequence
atgcttagggaacggacagtgaggctgcaatacggctctagagtcgaggccgtatacgtgctgggaacctacctctggaccgacgtgtattctgctgcgccagccggcgctcagaccttctcactgaagcatagcgagcacgtgtgggtggaagtggtgcgtgacggtgaagcggaggaggtagctaccaatggcaagcagcgatggctgctttctcccagcacaacactccgagttactatgtcccaggcctcgacagaggcctcatccgacaaggtcacagtgaattattatgacgaagaaggcagtattcctatcgaccaagcaggtttgttcctgacggccattgaaattagcttggacgtcgacgcggaccgtgacggcgtggtggaaaagaataatcctaaaaaagcctcgtggacttggggaccagagggccaaggtgccattctcctggtgaattgcgatcgggagacaccctggctgccaaaagaggattgtagggatgagaaggtgtacagcaaggaggaccttaaagacatgtcccaaatgattcttagaactaaggggcccgatagactgccagctgggtatgagatcgtcctgtatatttctatgtcagatagcgataaagtgggagtgttttacgttgaaaacccgtttttcgggcaaaggtatatccatattctgggccggagaaagctctaccacgttgtgaagtacaccggaggtagcgcagagctcctcttttttgtggaggggctatgctttccggacgagggcttcagcggcctggtctctatccacgtaagcctgttagagtatatggcacaggatatccctttgacaccgattttcactgacaccgtaattttccggatcgctccctggattatgacaccaaacattctacctccggtgtccgtttttgtctgttgtatgaaagataattacctgtttctcaaagaggtaaaaaacttggtggagaaaacaaattgtgagctgaaagtatgtttccaatatctgaatcggggcgaccggtggattcaggacgagattgaattcggctatatcgaggccccacacaagggcttccctgtcgtgctggatagcccacgggacgggaatctcaaggattttcccgtaaaagaactgctgggccctgacttcggatatgtcacaagggaaccactgtttgagagtgtcacaagtctggactcctttggcaacttggaggtaagcccccccgtgacagtgaacggaaagacatacccactgggccgcatattgatagggagcagcttccctctgtag

SEQ ID NO: 128077 - DNA, 1998 bp, Artificial Sequence
  Description of Artificial Sequence: Synthetic coding sequence
atgcttcgcgaaagaaccgtgcgtctgcagtacgggtctagggttgaggctgtctatgtgctggggacttacctgtggacagatgtgtactccgctgcccccgctggagcccagacgttttcactcaaacactccgagcatgtttgggtggaagttgttagggatggggaagctgaggaggtggcaaccaacggtaagcaacggtggttgctcagtccctccactaccctcagagttacaatgtcacaggcctcgaccgaggcatcatcagacaaggtgacagtgaactactacgacgaggaggggagcatacctatcgatcaggccggcctctttttgaccgctattgagatctcacttgacgtggacgcagatagagacggagtagtggagaagaataacccgaaaaaggcatcatggacctggggccctgaaggccagggggctatactccttgtcaattgtgaccgggaaactccgtggctgccaaaggaggactgcagggatgaaaaggtgtactcaaaggaggacctgaaggatatgtcccagatgattctgcggacaaaaggacccgacaggcttcctgcaggctatgaaattgttctatacattagtatgtcggatagcgacaaagtcggtgtgttttacgtcgaaaaccctttctttggtcaacgatacatccatattctcggccgccggaagctctaccacgtggtcaagtatactggagggtctgctgagttattgtttttcgttgaagggctctgttttcccgacgagggattttccggcctcgtgagtattcacgtatccttacttgaatacatggcacaggatatccctcttaccccaattttcaccgatacagtgatctttaggatcgctccgtggatcatgactcccaatatcctgccccctgttagcgtcttcgtgtgttgcatgaaagataactacctgtttcttaaggaagtgaagaacctggtggagaagacaaactgtgagttgaaggtatgtttccaatatctcaatcgtggcgatcggtggattcaggacgagattgagtttggctacattgaagctcctcataaggggttccccgtggtcttggattcgccacgggatgggaatcttaaagatttccccgtgaaagagctcctgggcccggatttcggctacgtgaccagggagcctttgttcgaatcggtcacatctttggattcttttggcaacctggaggttagcccaccagtcacagtgaacggtaagacgtatcctctggggcgcattctcattggatcttctttccctctctctggcggaagacggatgactaaagtagttcgcgactttttgaaggcccagcaggtgcaagcccctgtagaattgtactccgactggctgacagtaggtcatgtcgatgagttcatgtcctttgtgccaatcccagggacgaaaaagtttctcttgttaatggcttcaacttccgcgtgctacaagctgtttcgagaaaagcagaaggatggccacggagaggcaatcatgtttaagggactgggaggcatgtcttccaagcgaattaccattaacaagattctcagtaacgaatccctggtccaggagaatttgtatttccagaggtgcctcgactggaatcgcgatatcttaaaaaaagagctaggccttacagagcaggacatcatcgacctgccagcgctattcaagatggacgaggatcaccgcgccagagcatttttccccaacatggtgaatatgatcgtcctggataaggatctcgggattccaaagccctttggccctcaggtcgaagaggagtgttgcctcgaaatgcacgtgcgcggcctgttggagccgctgggactggagtgtaccttcatcgacgacatcagtgcctatcataagtttctgggagaagtgcattgcgggacgaacgtgagaagaaaaccttttacgttcaaatggtggcatatggttccatag

SEQ ID NO: 128078 - DNA, 1650 bp, Artificial Sequence
  Description of Artificial Sequence: Synthetic coding sequence
atgctgcgggagcgcactgtgcgcctccagtacgggtctcgcgtggaggccgtatatgttctgggcacgtatttatggacggatgtgtactccgccgcacctgccggagcccaaacgttcagcctgaagcatagtgagcatgtttgggtagaggtggtcagagatggagaggcggaagaggtggcaacgaacgggaaacagagatggctactctcaccttccaccacacttcgggtgaccatgtctcaagcgtcaacggaggcttctagtgacaaggttactgtaaactattatgacgaagagggcagcatccccatcgaccaggccggtctctttttgactgccattgaaatttcactggatgtggatgccgaccgggacggagtggttgagaaaaacaaccctaagaagaccaggtcgtctgccaatgcaatctctaccagctgggctggcggatccagtaccatgtggagtagcacaagggtagctcccagatcatgttgctcctcatggaaagcctctgtgtctcccaccagagcgtcccaggcctggagcccctctatgtctgcatgctggtcgacatggccgagtatgaaggacaattatttgtttctcaaagaagtgaaaaatctggtggagaagacaaactgcgaattaaaagtgtgcttccagtatctgaataggggcgaccgatggatccaagacgagatcgagttcgggtatattgaagcaccccacaaaggcttccctgtagtactcgatagccccagagatggtaacttgaaagatttccccgtcaaggaactgctggggccagattttgggtacgtcaccagggaaccattgttcgaaagcgtgacgtccctggactcatttggaaacctcgaggtttccccgccagttacagtgaacggtaagacctatccactgggtaggattctgatcgggtcctctttccccttaagcgggggacgacgaatgaccaaggtggtcagggatttcctgaaggcccaacaggtgcaagcaccggtcgaactttatagcgactggttaacagtcggccacgtagacgaattcatgtccttcgtccctatcccgggcaccaagaagtttctgctgctgatggcgtccacatcagcctgctataagctgttccgagagaaacaaaaggacgggcacggcgaggccatcatgttcaagggcttgggaggaatgtccagtaagcggatcactattaataagatactgtctaatgagagtttggtccaagagaacttgtacttccagaggtgcctggattggaatagagacatcctgaaaaaagaactcggtctgaccgaacaggacatcatcgacctgccggctctgttcaagatggatgaggatcatcgcgctagggccttttttcccaacatggtaaatatgatcgtgctggacaaggacctcggaatccctaagccgttcgggccacaggtggaggaggagtgttgtctggaaatgcacgtacgaggcctgctggagcccctcgggctggagtgcactttcatagacgacatttccgcctatcacaagttccttggtgaagtgcactgcggcacaaacgtccgccgaaagccattcaccttcaaatggtggcacatggtgccatag

SEQ ID NO: 128079 - DNA, 1995 bp, Artificial Sequence
  Description of Artificial Sequence: Synthetic coding sequence
atgtcccttcagagaatcgtgagggtttctttggagcatcctacaagcgctgtgtgtgtggcaggggtggaaacactagttgacatctacggcagtgtgcctgagggtaccgagatgtttgaagtgtacggcactcccggagtcgacatctatatcagtcccaatatggaaaggggccgggagcgggcagatacccgccgctggcgctttgacgccaccttagagatcattgttgttatgaacagcccaagcaacgatctgaatgattctcatgtgcaaatctcctatcatagtagtcatgaacccctcccattagcctacgcagtgctatatttgacatgcgtcgatatttccctggactgcgacctgaattgcgagggccgccaggaccggaatttcgtagacaaaaggcagtgggtgtggggcccttccggctatggaggaatattattagtcaattgtgacagagatgatccaagctgcgatgtacaggacaactgtgaccaacacgttcactgcctccaggatctggaagatatgtctgtgatggtcctgagaacacagggtccagctgctctcttcgatgaccataagctggtcttacacacttctagctatgatgcaaaacgcgcccaagttttccatatttgcggaccagaagacgtgtgtgaggcttataggcacgtactcggccaggacaaggtaagttatgaggtgccacgcctccacggcgatgaagaacggttttttgtcgaaggcctgtcttttccagatgctggttttacaggcctgatctcgttccatgtgacattgctggacgatagcaacgaagacttctctgcgagtcccatctttaccgacaccgtggtgtttagagtagcgccctggattatgaccccctccactctgccgcctctggaggtttacgtatgccgggtgaggaacaatacgtgttttgtcgacgccgtcgcggaactggcccgcaaggcaggttgcaagctcaccatttgccctcaggctgagaatcgcaacgatagatggatccaagatgaaatggagttgggatacgtgcaggcccctcataagacgctccccgtggttttcgatagccccaggaatggtgagctccaggactttccgtacaaacgtattttaggacctgatttcgggtatgtcaccagagagccacgcgaccgaagtgtgtctgggcttgacagtttcggcaatcttgaggtatcacctccggtggtagccaacggcaaagaatatcccttaggtcggattctcattggagggaaccttccggggtccagtggaaggagagtcacccaagtggtacgggattttttgcatgctcaaaaggtgcaacctccagtggagttatttgtagactggctagctgtcggacatgtggacgaatttctgagctttgtgcctgccccagacgggaaagggtttcgaatgctgctggcatcacccggagcgtgcttcaagctgttccaggagaaacagaagtgtggtcacggaagagcccttctgttccagggcgtggtagatgatgaacaagtgaaaaccataagcattaatcaggtgctctcaaacaaagacctcatcaattataataaattcgtgcagagctgtattgattggaacagggaagtgctcaaaagagagctggggctcgcagaatgcgatatcatcgacatccctcagctattcaagactgagcgcaagaaagctactgccttttttcctgacttagtgaatatgctggtgcttggtaagcatcttggaataccaaagccgttcggcccaatcattaacgggtgttgttgcctggaggagaaggtccgttccctgttggaacccttgggccttcactgtaccttcatagatgacttcaccccctaccatatgctgcatggtgaggtccattgcggaactaacgtctgtcgtaagcctttttctttcaaatggtggaacatggtcccttag

SEQ ID NO: 128080 - DNA, 645 bp, Artificial Sequence
  Description of Artificial Sequence: Synthetic coding sequence
atggcacagggcacacttataagagtcacccccgagcagcctacccacgcagtctgcgtcctcggtacactcacacaattagatatctgtagcagcgccccagaagattgtaccagcttctctataaacgcctctcctggggtagtggttgacattgcacacggtcccccagccaaaaaaaagtccaccggatcgagcacgtggcctctcgaccctggagtggaagtgacactcacaatgaaagttgcaagcggatccacaggtgatcagaaagtccagatttcttactacgggccgaagaccccacccgtgaaggctttactgtatttgactggggtagatggggtgtcaccctgccatcccggctggtctgcgatgcatgatctggcccactgtaaccttcgcttgcaggtgcaggcaattctttgcttcagtgtgccgagttcatggacaacaggggcatgccaccacgcatggctgatcttcgtcttcctggtggagatggaattccatcacgtagggcaggcaggtctcgaattgcttaccagtggggatctaccagcctcagggtcccaaagcgcgagaatcactggaatgaatcattgcgctaggcccagtatcttcctgatacttaagtatctgtag

SEQ ID NO: 128081 - DNA, 1992 bp, Artificial Sequence
  Description of Artificial Sequence: Synthetic coding sequence
atggcccagggaaccctgattcgcgtaacgcctgagcagcccacgcatgcagtgtgtgtgctggggacactgacacaattagatatatgctcgtctgctcctgaggattgcacctccttcagtataaacgcctctccaggcgttgtagtcgatattgcacacggccccccagccaagaaaaagtcgaccggttctagtacttggccgctggatccaggggtggaggtgacgctcactatgaaggtggcctcagggagtacaggagaccagaaggttcaaatatcctactacggtccaaagaccccacctgttaaagccctcctctatcttaccggtgtggaaatttccctgtgcgctgatataacccgaaccgggaaggttaaacctactagggccgtcaaagaccaacgcacttggacttggggaccctgtgggcagggagccatcctgctagtgaattgcgaccgggataatctcgagagttctgccatggactgcgaggacgatgaggtgcttgactccgaagacctgcaggacatgagtctcatgacactgtctacgaaaacccccaaggatttttttaccaaccatacgctcgtgctgcatgttgcaagaagcgaaatggacaaggttcgtgtattccaggctacccgaggcaagctttccagcaagtgttctgtggttcttgggcccaagtggccaagccactacctgatggtgcctggcgggaaacataatatggatttttacgttgaggcgttagcctttccggacaccgactttcccggtctcattacattgaccattagcctgcttgacacatccaacctggagctccccgaggctgtggtgtttcaggactccgtggtgtttagagtggcaccatggataatgacgccaaacacacagcctccacaggaggtctatgcatgttcgattttcgagaacgaagattttttgaagagcgtaacaaccctagccatgaaggctaaatgcaaactaacgatctgccccgaagaggaaaatatggatgaccagtggatgcaagatgaaatggagatcggctacattcaagctccgcataagaccctccccgtagtcttcgattcccctaggaatcgaggactcaaggagttccctatcaagagggtgatggggccagattttggctacgttacccggggtccccagaccggaggtattagtggcctggactctttcggtaacttggaggtgtcgccgccagtcacggtccgtggcaaggaatatccactgggacggattctatttggcgatagttgttatccctcaaacgattcccgccagatgcatcaggctctacaggactttctgagcgcacaacaggtgcaggctcccgtgaagctgtactccgattggctgagcgtcggccacgttgatgagtttctgtcttttgtacctgcgccagacagaaaaggttttcgcctgctgctcgcctctcccagaagctgctataaacttttccaggagcagcagaacgaaggccacggcgaagcactcctttttgaggggataaaaaagaagaaacagcagaagattaaaaatatcttgtccaacaaaacacttcgggaacataacagcttcgtggaaaggtgtattgattggaatagggagttactgaagagagaattaggccttgccgagagcgatatcatagacattccacagctctttaagctcaaggaattttccaaagcggaggcttttttccccaacatggttaatatgctggtccttggcaaacatctgggcattcctaaaccttttggtccagtcattaacggcaggtgttgtctggaggaaaaggtctgctccttgctggagccattaggattgcagtgcactttcattaacgatttctttacatatcatattaggcacggggaggtgcattgcggcactaacgtaaggcgtaaaccttttagcttcaaatggtggaacatggtgccctag

SEQ ID NO: 128082 - DNA, 384 bp, Artificial Sequence
  Description of Artificial Sequence: Synthetic coding sequence
atggctcaaggtactcttatacgagtaactccggagcagcctacacacgcagtctgtgtactgggaacactgacgcaattagacatttgttccagtgcgcctgaggattgtacgagtttcagcataaatgcgagcccaggtgtcgtggtagacatcgcccatgggccccctgccaagaaaaaaagcactggctcctctacttggcccctggatccaggtgtggaggtgactttgaccatgaaggtggcctcaggaagtaccggggatcaaaaagtccagatcagttattacggcccgaaaacaccacctgtgaaggccctgctgtacctgacgggcgtcgatggcgtgagtccttgtcacccaggctggagcgctatggcttag

SEQ ID NO: 128083 - DNA, 2628 bp, Artificial Sequence
  Description of Artificial Sequence: Synthetic coding sequence
atggacactgtccaccatatgttgctgtttgggtgcaatatgccatcaagtaccgggagctactggttttgtgatgaggggacttgtacggataaggcaaacatactctacgcgtgggctcgaaacgcgcctccaacccggttaccgaaaggcgtgggctttcgcgtgggaggcgagaccggcagtaagtacttcgtcctccaagttcattatggagacatcagtgctttccgggataataacaaagactgtagcggtgtttctttacatctgactagactccctcagccactgattgcagggatgtacctcatgatgagcgtggacaccgtgataccagcaggggagaaggtagttaactccgacatttcctgtcactacaagaactaccctatgcatgtttttgcctatagggtgcacacacatcatttgggaaaagtggtttctggctatagagtacggaacggacagtggacgctgatcggtaggcagagtcctcagcttcctcaggccttttacccagtgggacaccctgtcgacgtcagctttggggatctattggctgctcggtgcgtgtttacaggcgagggtcgaactgaggcaactcacataggggggaccagttcagacgaaatgtgcaacctgtatattatgtactacatggaagcaaaacacgccgtgtctttcatgacctgcactcagaatgtggctccagacatgttcaggactatcccccctgaagcgaacatccctattccagtgaaatcagatatggtgatgatgcacgagcaccacaaggagaccgagtacaaagacaaaattcctttgctccagcagccgaagcgagaggaagaggaggtcctggatcagggcgacttttactccctgctgtcgaaactactgggggagagagaggatgttgtgcatgtgcacaaatacaaccccaccgaaaaagcagaaagtgagtctgatctagtggcggaaatcgctaatgttgttcaaaaaaaggatcttggccgctccgacgctcgtgaaggggctgagcatgaaaggggtaacgctatcctggtcagagatcgcatccataagtttcatcgcctggtgtcaactctacgccccccagaaagtcgcgtgttcagcctacagcaacctcctccaggggaggggacttgggagcccgaacatacaggagattttcacatggaggaggcactagattggcctggagtgtacttattacccggccaggtctccggcgtggctcttgatcccaaaaataatcttgttattttccaccgaggtgaccacgtgtgggatggaaactcctttgattccaaatttgtgtaccagcagatcggccttggccctatagaggaggataccattcttgttatcgaccctaataatgctgccgtgctgcagagctcggggaagaatctgttttatctgccccacgggctcagcattgataaagatggcaactattgggtcaccgatgtggcgttgcaccaggttttcaaacttgatccaaacaataaggagggcccagtcctgatcctagggagaagcatgcagcccggcagcgatcagaaccacttctgccagcccaccgacgttgccgtggacccagggaccggggccatctatgtgtctgacgggtattgcaattctcgcattgttcaattctctcccagtgggaagttcataactcagtggggtgaagaaagcagcggttcttcccctctgcctgggcaattcactgtacctcactccttagccctggtcccccttctgggtcagctgtgcgttgctgatcgggagaatggcaggatccagtgctttaagactgataccaaggaatttgtgagggaaatcaaacactcatcgttcggcagaaacgtgtttgctatctcttacattcctggactgcttttcgcagtgaacggaaaacctcattttggggatcaagaacctgtgcaaggatttgtcatgaatttcagcaatggtgagatcatcgacattttcaagccagtccgcaagcacttcgatatgccgcatgacattgtagcctccgaggatggaaccgtgtacataggcgacgcgcacaccaatactgtatggaagttcactctaacagagaaactggagcacaggagcgtaaaaaaagcagggatagaagttcaggaaataaaggccgaagcagtcgtggagaccaagatggaaaataagccaaccagcagtgagctgcagaagatgcaggaaaagcagaagctgatcaaggagcccggcagtggggtgcccgtggtcctcattaccactctcctcgtgatacccgtcgtagtactgctggccattgccatcttcatccgatggaagaagagtagggctttcggtgactctgaacacaaattggagaccagctcgggccgcgtgttagggaggttcagaggaaagggctccggggggctgaatcttgggaatttttttgcgagccgaaagggatatagtcgtaaagggtttgaccgtctgagcactgaagggtctgaccaggaaaaggaagatgatggaagcgagtccgaagaggaatactccgcccccctccctgctttggccccttcgagcagctag

SEQ ID NO: 128084 - DNA, 2925 bp, Artificial Sequence
  Description of Artificial Sequence: Synthetic coding sequence
atggcgggccgggtgccgagtcttctggtgttactggtttttccttcctcttgcctcgccttcagaagtcctctgtcggtgttcaaaaggtttaaagagactacgcgacccttctccaacgaatgcctcggcacaacaaggccagtggtgcccatcgacagctcagacttcgctttagacatcaggatgcccggagtgactcccaaacaaagcgatacttatttttgcatgtctatgaggatacccgtggacgaggaagccttcgtgatcgattttaaaccacgggcctctatggataccgtacatcacatgttgctcttcggatgcaacatgcctagtagcaccggatcttactggttctgcgacgaggggacctgtaccgacaaggcaaacattctgtatgcctgggcacgtaatgcgccaccaacacggctgccaaagggggtcggctttcgggtcggaggtgaaaccggaagcaagtatttcgttctgcaggtacattacggtgatatttctgccttcagagataacaataaggattgctccggagtgagccttcacttaaccagactaccccaacccttaatcgccgggatgtatctgatgatgagtgtcgacaccgttatccccgctggcgagaaggttgttaattctgacatcagttgtcactacaaaaactacccaatgcatgtgttcgcctaccgggtgcatacccatcatctgggcaaggtggtgtccggctaccgtgtcaggaacggacaatggaccctcatcggccgccagtcacctcagctaccacaggccttctatccagtgggacatcccgtggatgtgtccttcggcgacctgctagcggcccgatgcgtgtttacaggtgaaggaagaactgaagccacacacattggaggaaccagctcggatgagatgtgcaacctctacataatgtactacatggaagccaagcacgctgtctctttcatgacttgtacccaaaacgttgcacctgacatgtttcggaccattccaccagaggctaacattcctattccagtgaagagcgacatggtgatgatgcatgaacaccacaaagagacagagtacaaggataagatcccattacttcagcagccaaaacgtgaggaagaggaggtccttgaccagggcgatttttactccctgttatccaaactgctcggggagagagaggacgtcgtgcacgtgcacaaatataatccgaccgaaaaggcagagagcgagtcagacctggtggccgagatcgccaacgtggtgcaaaaaaaggacttgggacgtagcgacgcccgcgaaggggctgaacatgagcgcggcaatgcaatcctcgtcagggaccggatccacaaatttcataggctggtctcgactctgcggcccccagaatcgcgagtcttctcactccagcagccacccccaggcgagggaacgtgggagccagagcatacaggcgacttccacatggaagaggctctggattggccaggtgtgtatctgctacccggacaagtttccggcgtagccctggaccccaagaacaacctagtgatctttcacaggggggatcacgtctgggatggtaatagttttgattctaaatttgtgtatcagcagatcggactcggcccaattgaagaagatacaatcttggtgattgatccgaataacgctgccgtgcttcaaagtagcgggaagaacctgttttatcttccacacggcctgtctattgacaaggatggtaactactgggttacagatgtggcattgcaccaggtgtttaaactcgatccaaacaataaggaagggcctgtcctgattctcggccgatccatgcaacctgggtccgaccaaaaccatttctgccagcccacggacgttgctgtcgatcctggaaccggcgccatttatgtaagcgacggctattgtaactccaggattgttcaattctctcctagtgggaaatttattacacagtggggggaggagagttccgggtcaagcccactgcccggccaattcaccgttccgcactcactggccttggttcctttgttaggccagctgtgcgtggcagatcgggagaacggcagaatacagtgtttcaaaacagacactaaagaattcgtccgtgaaattaagcacagctcttttggcaggaatgtcttcgcgatttcatacatacctgggctcctctttgccgtaaatggaaagccccacttcggcgatcaggagcccgtgcagggctttgtgatgaacttctccaacggggaaatcatcgatatcttcaagcccgtgagaaaacattttgatatgccccacgatattgttgccagcgaagacgggacggtgtatattggcgacgctcacaccaacaccgtttggaagttcacattaaccgagaagctcgaacatcgtagcgtgaagaaagctggaattgaagtacaagagatcaaagaggctgaggctgtcgttgagaccaagatggagaataaacctaccagcagtgagctacaaaagatgcaggagaagcagaaactaatcaaggaaccgggtagcggcgttcctgtggtcctaattactactttgctggtcatcccagttgtggtgctgctagccatcgctatctttatccgttggaagaaaagtagggcctttggagccgacagcgagcataaactggagacttctagtggaagggtgttaggacgttttaggggaaagggctctgggggtttaaacttaggcaatttctttgcctcacggaagggctattcccgcaaagggttcgacaggctctctacagaggggagtgaccaggagaaggaagatgacggatccgagtctgaggaagagtattccgccccactgccagcacttgctccatcatcgtcatag

SEQ ID NO: 128085 - DNA, 2664 bp, Artificial Sequence
  Description of Artificial Sequence: Synthetic coding sequence
atggctggcagagtcccctcacttttggtgctcctggtgtttcctagcagttgtttggccttcaggagcccactgtccgtctttaagcgatttaaggagacaacaaggcccttcagcaacgaatgtttggggactaccagaccagtcgtgcccatagattctagtgactttgctctcgacatcaggatgcctggagttactcccaagcagtcggacacttatttttgtatgagcatgagaatccctgtcgatgaggaagctttcgtcatcgatttcaagcctagggctagcatggatacagtgcatcatatgctgttgtttgggtgtaatatgccatccagcacaggaagttactggttctgcgacgaaggcacctgcaccgacaaggcgaacatactgtacgcttgggcgagaaacgctccacccacccgattgccaaaaggagtgggattccgcgtcgggggtgaaacagggagtaagtatttcgtgctacaggtccattatggggatatcagtgcatttagggacaacaacaaggattgtagcggcgtcagcctccacctaaccagactcccgcagcctttgattgctggtatgtatcttatgatgtccgtcgacactgtgatccctgctggcgaaaaggtagtcaattctgatataagctgccactacaagaactaccctatgcacgtgtttgcctatcgagttcacacacaccatctcggcaaagttgtttccgggtacagggtgcgaaatggacagtggacactgatcgggcggcagagccctcagctgccccaggccttctacccagtgggccatcctgtagatgtctccttcggagacctcctcgccgcaaggtgtgtgtttacaggggaggggagaaccgaagctacacatattggcggtacctcaagtgatgagatgtgtaacctgtatattatgtattacatggaagcaaagcacgccgtgagctttatgacatgtacccaaaatgttgctccagatatgttccgcaccattccccccgaagcaaatatccctatcccagtgaagagcgatatggttatgatgcatgaacaccataaggagaccgagtacaaggataagattcccttgttgcagcagcctaaacgcgaggaggaggaagtactagatcaaggcgacttttatagcctgctaagcaaactgttgggagaacgtgaggacgttgtgcatgttcacaagtacaatcccacagagaaagccgagagtgagagcgatttggtggctgagatcgccaatgtggtccagaagaaggacctggggaggagcgatgccagagagggcgctgagcatgagaggggcaatgccatcctggtcagagataggatacacaagttccatcggttggttagtactttgaggcctcccgaatcacgcgtgttctctctgcagcagcctccaccgggggaagggacctgggagcccgagcacaccggcgacttccacatggaagaagcattggactggccaggcgtgtacctcctaccaggtcaggtctctggcgtggcgctcgatcccaagaacaatctggtcatctttcaccgaggcgatcacgtatgggatggcaatagtttcgatagcaagttcgtctaccagcaaatcgggctggggcctatcgaagaggacactatcctggtcattgaccctaacaacgccgcggtactacagtccagtgggaaaaatctattttatttaccacatggcttgtccatcgacaaggacgggaactactgggtgactgacgttgcgttgcaccaggttttcaagctcgaccccaataacaaggaaggtccggtgctgatcctgggccgcagtatgcagcctgggtcggaccagaatcacttctgccagccaaccgatgtcgccgttgatcccggtactggagcgatctatgtctcagatgggtattgcaacagtcgtatcgtacagttcagcccctcaggtaaattcatcacacaatggggggaggaatcatccggatcaagcccgctgcccggtcagtttactgtcccccactctctggccctggtgccactgttaggtcagctgtgcgtagccgatcgcgaaaatggaagaattcaatgtttcaaaaccgatactaaagagtttgtgagggagatcaagcactccagttttgggagaaatgtatttgccatttcctatatcccagggttattgtttgccgtcaatggaaagccacactttggcgatcaggaaccagtgcagggattcgtaatgaacttttccaatggagaaatcattgatatttttaagcccgtacggaaacatttcgatatgccgcatgacatcgtagcctcggaggatgggaccgtatatattggagatgcccatactaatacagtgtggaaattcacactcacagagaagttagagcaccggtcagtgaaaaaagcgggcatagaggtgcaggagatcaagggaaagggatccggaggccttaacttgggcaacttcttcgcgagccggaaaggatactcccgaaaggggttcgaccggctcagcacggagggcagcgaccaggagaaagaggatgatggcagtgaatcagaagaagaatatagcgccccactgccagcgctcgcacctagtagttcttag

SEQ ID NO: 128086 - DNA, 2601 bp, Artificial Sequence
  Description of Artificial Sequence: Synthetic coding sequence
atggccgggcgggtaccttccctgcttgtcctgttggtttttccctccagctgtctcgcctttagatctcccctgagcgtgtttaagcggtttaaagagacaacccggccatttagtaacgaatgcctggggacaacccgccctgttgtgccgatcgactcatctgatttcgcactcgatattcgcatgcccggggtcactcctaagcagagcgacacttacttttgcatgtccatgcggatccctgtcgatgaggaggcatttgtgatcgatttcaaacctcgagcctctatggacactgtgcatcacatgctccttttcgggtgtaacatgccatctagcactggaagctactggttctgcgatgaaggtacatgtactgataaggccaatatcctgtacgcttgggcccgtaatgcacccccaacccgattgcctaagggagtcggattcagagtcggcggagagaccggcagtaaatatttcgttcttcaggtccactacggagacattagcgccttcagagataataacaaggactgttcaggcgtttccctgcacctgaccagacttccacaacctcttattgctggaatgtacctgatgatgtccgtcgacaccgtgatcccagctggcgaaaaggtagttaactccgatatttcatgtcattataagaactaccccatgcatgttttcgcctatcgcgttcacacgcatcacctcggtaaggtggtctcgggttatagagttcggaatggtcaatggaccctcatagggagacagagtccacaactgcctcaggctttttatccagtgggacaccctgtggatgtgagctttggagacctgttagccgctaggtgcgtttttacaggggagggcagaacagaggcaactcatattggtggcacatcaagtgatgaaatgtgcaacctgtatataatgtactacatggaagcaaaacacgctgtgtccttcatgacgtgcacgcaaaacgtggccccggatatgtttaggacaattcctcctgaggctaacataccaattcctgtgaagtctgatatggttatgatgcacgagcaccacaaagagacagagtacaaagataaaatacccctcctccagcagcctaaacgcgaggaggaagaggtcttagaccaagatttccatatggaggaggctctggactggccaggcgtgtacctcctgcctggccaagtgagtggcgtagccctggacccaaagaataatcttgtgatctttcaccggggagatcacgtctgggacggaaattccttcgatagcaagttcgtgtatcagcaaatcgggctgggcccaatagaggaggataccatcctcgtcatcgatcctaacaatgcggcagtccttcagagctcagggaaaaacctgttttacctcccacacgggctgtccattgacaaagacggcaattactgggtaacagatgttgctctccaccaggtttttaaactggaccctaacaacaaggaaggacctgttcttatcctcgggcggagcatgcaacctggttctgaccagaaccatttttgccagccaactgatgttgccgtggatcctggtactggagccatttacgtttctgacggatattgcaattcacgtatagtccagttctcccccagtggtaaatttattactcagtggggcgaagagagttcaggaagtagtccccttcccggtcaattcacagtcccccattcactcgccctagttccactcctgggccaactttgcgtcgcagaccgcgaaaacggtcgcattcaatgtttcaaaaccgacacgaaggagtttgtcagggaaattaagcacagttccttcggtaggaacgtctttgctatctcctacatacccgggctgcttttcgctgttaatggcaaaccacacttcggagaccaggagcctgtgcagggttttgtcatgaatttcagcaatggcgagatcatagacatcttcaagcccgtccgtaaacactttgatatgcctcacgacatcgtggcttctgaagacgggacagtgtacatcggcgatgcacataccaacacagtgtggaagtttacactcaccgaaaaacttgaacatcgttcggtcaagaaggctggcatcgaagtccaggagataaaagaggcagaggccgttgtggagacgaaaatggaaaacaagcccacaagctccgagctccagaagatgcaggagaagcagaaactcataaaggagcccggatcgggggtgcccgtagtgttaatcaccaccctgctggtgataccagttgttgtgctgttagccatcgctattttcatccgctggaagaagagccgggcttttggtgattctgagcacaagttagaaactagtagcgggcgcgtcttggggcgcttccgtgggaaggggagcggcggcctgaacctaggtaatttcttcgcgtcgcgtaagggttacagccgaaagggcttcgaccggctttctactgaggggagtgatcaggaaaaagaagacgatggatcagaatccgaagaggagtactctgcccccctgcccgcactggcgccctcaagctcatag

SEQ ID NO: 128087 - DNA, 1008 bp, Artificial Sequence
  Description of Artificial Sequence: Synthetic coding sequence
atgcagccaggatccgaccagaaccacttttgccagcctaccgacgtggcagtggaccccggcactggagcgatctacgtgagcgacggttactgcaacagcagaatagtccagttttccccctctggcaagtttatcactcagtggggagaagaatcgtcaggcagttctccattgcctggccagttcacagtgcctcacagcctggcgctcgtgcccctcctcgggcagctctgtgttgccgatcgcgagaatgggagaatacaatgtttcaagacagatactaaggagttcgtgcgtgagattaagcatagcagctttgggcgcaatgtcttcgccatcagttatattcccggcctgttgtttgcagttaatgggaaaccccacttcggggaccaggaaccggtccaggggtttgttatgaatttcagcaatggagaaattattgacatcttcaagccagtccggaaacactttgacatgccgcacgacatagtggcatcagaagacgggaccgtgtacatcggcgacgcgcataccaatacagtgtggaagttcaccctgactgagaagttggagcaccgttctgttaaaaaggcagggattgaggtacaggaaattaaggaggcagaggcagtggtcgaaacaaagatggagaacaaacctaccagcagcgagcttcagaagatgcaggaaaagcagaagttgatcaaggagccaggttctggagtacctgtggtcctgatcaccaccctgctggtgatccctgtggttgttctcctggcaatcgccatctttatccgatggaaaaaaagtcgcgcctttggtggaaagggttctgggggcctcaacctggggaatttctttgcctctcgtaaagggtattctcgtaaggggtttgaccgactgagcaccgaagggagcgaccaggagaaggaggatgacggaagcgaatcggaggaggagtacagcgcccccctgcccgccctagctcccagcagtagttag

SEQ ID NO: 128088 - DNA, 468 bp, Artificial Sequence
  Description of Artificial Sequence: Synthetic coding sequence
atgcacgagcatcacaaggagaccgaatacaaagataagattcccctgttacagcaacccaaacgagaggaagaggaggtactcgaccagggagatttctatagcctgttgagcaagcttctgggtgagcgggaggacgtcgtccatgtccacaaatacaatcctaccgaaaaggccgagtcagagtccgatctcgtggccgagattgcgaacgtggtgcagaagaaggacctgggccggtcagacgccagagaaggagcagaacacgagcggggcaatgctatactcgttcgtgatcgcattcacaagttccatagactggtgagcaccctgaggccgcccgaaagccgtgtgtttagccttcagcagccaccgcctggcgagggtacttgggagcctgaacacacaggcgctcgacgcgaggacatgaagtgcttccagtgtaaagagatgatttctgtccagtag

SEQ ID NO: 128089 - DNA, 2922 bp, Artificial Sequence
  Description of Artificial Sequence: Synthetic coding sequence
atggccggcagggtgcccagcttactcgtgcttctggtcttcccttccagctgcttagcatttcggtcccccctctctgtatttaagaggtttaaggagaccactcggccatttagcaatgagtgccttgggaccacgagacccgtcgtacctattgacagctctgacttcgcactggatatcaggatgcctggggtaacccccaaacagagtgatacttacttctgcatgagcatgcgcattcctgtcgacgaagaagcattcgtgattgactttaaaccgcgcgcttccatggatacagtccaccacatgttactgtttgggtgcaatatgccgtcctctaccggctcctactggttttgcgatgagggcacctgcactgacaaagcgaatattctctacgcgtgggcccgaaatgctccaccaacgaggcttcccaaaggcgtgggatttcgcgtgggaggggagacaggaagcaaatatttcgtactgcaggtccactatggtgacatcagcgcctttcgcgataataacaaagactgctcaggtgtttctctgcatctcacccggttgccacagccactcatagccgggatgtatttgatgatgtccgtggatacggtgatccctgccggtgagaaggtggtcaattccgacatatcgtgccattacaagaattaccctatgcacgtattcgcataccgggtgcatactcatcacctcggaaaagtcgtcagcggctaccgggtgcggaacggtcaatggaccctgatcggcagacagtcccctcaacttcctcaggccttctaccccgtgggacaccctgtagacgtttccttcggcgatctcctggccgcccggtgcgttttcaccggggagggaagaactgaggctacccacataggaggaaccagttccgacgaaatgtgcaacctctatatcatgtactatatggaggctaagcatgccgtgtcttttatgacttgtacccagaacgttgctcctgacatgttcagaacgattcctcctgaagcaaacattccgatcccagtgaagtctgatatggtgatgatgcacgagcaccacaaggagactgaatataaagacaagattccactattacaacagccgaaaagggaagaggaggaggtgttagaccagggtgatttttacagtttactcagcaaacttctgggtgaacgcgaagatgtcgttcatgtacacaaatataacccaacagagaaggctgaaagtgaaagtgatctggtggcagaaatagccaatgtggtgcagaaaaaggatttgggccgatccgacgcgagggaaggtgcagagcacgagaggggcaacgcaattttggtgagagatagaattcataagtttcaccgcctcgtgtcaacattacgaccacctgagagcagagttttttctttgcaacagccaccacctggcgagggcacttgggagcccgagcacactggggatttccacatggaggaagccctggactggcctggcgtttatcttctcccaggacaggtctctggggtggctttagaccccaaaaacaacttggtgatttttcatcgcggagatcatgtgtgggacggaaacagtttcgactccaagttcgtctatcaacagatcggcctcggccctatcgaggaggatacaattctcgtgattgaccccaacaacgccgccgttctgcagagctcaggaaagaaccttttttacctgcctcacgggctgtccatcgacaaggacgggaactattgggtgacggatgtggcgctccaccaagtgttcaagttagatcccaataacaaagaaggccctgtgctgatactgggtcggtccatgcagcctggctccgaccagaaccacttctgccagccaaccgatgttgctgtagaccctggtaccggggctatttacgtgtccgacggttactgcaatagccgtattgtgcagttcagtccgtccgggaaattcatcacccaatggggcgaggaaagcagtggttcatcccctctacccggccaatttacggtcccccacagtttagctctcgtgcccctgctcggccagttgtgcgttgctgatcgggagaatggaaggattcaatgtttcaagacagataccaaggaatttgtacgagagatcaagcattcaagtttcgggcgtaacgtgtttgccatctcttatatccctgggctgcttttcgctgttaatgggaaaccccactttggtgaccaggagccggtgcagggattcgttatgaatttttctaacggcgaaatcattgacatttttaagccagttcggaagcattttgacatgccccatgacatcgtcgctagtgaagatgggacagtgtatataggtgatgctcacactaacactgtttggaagttcacgctgactgagaagctcgaacaccgatcagtaaaaaaggccgggatcgaggtgcaggagatcaaagaggcggaagcggttgtggaaaccaaaatggagaataaacccacttcttccgaattgcaaaagatgcaggagaagcaaaaactcataaaagagcctggatccggggtgcccgtggttcttattactaccttactggttatccctgtggtagtcctcttggccatcgcgatttttataagatggaaaaaatctcgagcctttggagacagtgagcataagttagagacatcttcagggcgggtgctggggaggttcaggggcaaaggaagcggcggacttaatctgggcaactttttcgcctcgaggaaggggtactcccggaagggctttgatagactgagcacagagggctcggaccaggagaaagaagacgacggaagcgaaagcgaggaagagtatagtgcgccactaccagcactagcccctagcagtagctag

SEQ ID NO: 128090 - DNA, 2718 bp, Artificial Sequence
  Description of Artificial Sequence: Synthetic coding sequence
atggccggtagagttccatctcttctagttttactggttttcccctcctcctgtctggccttccgctcacccctgagcgtttttaaacgatttaaggaaactactcgcccatttagcaatgagtgtttggggaccactagacctgtggtcccgattgattcctctgattttgccctggacattaggatgccgggagtcacacctaagcagtccgatacttacttctgcatgtcaatgcgcattcccgtggacgaggaggccttcgtgattgatttcaaaccacgcgcaagcatggacaccgttcaccacatgctcttgtttggctgcaacatgccctcttccactggcagttactggttctgtgatgagggaacatgtacagacaaagctaacattctgtacgcttgggcgcggaacgcaccccccacgcgactccccaaaggagtcggattccgtgttggcggtgagacagggtctaagtacttcgttctgcaggtccactacggagacatctcagccttccgggataacaacaaagattgttctggcgtgagtctccacctgacaaggttgccccagcctctaattgctgggatgtacctgatgatgtctgtggacacggttatcccagcaggcgaaaaggtggtgaacagtgatattagctgtcattacaagaactatcccatgcatgtgtttgcctacagggtgcacacacatcatctcggcaaggtggttagcggctatcgggtgcggaatgggcagtggactctaatcggaagacaaagtccccagcttcctcaagcattttatcctgttgggcaccccgttgacgtatctttcggcgacctgctggccgctagatgcgtcttcacaggcgaagggcggacagaagccactcacatcggggggaccagttcagatgagatgtgcaacctctacattatgtattatatggaggctaagcatgctgtgtcttttatgacgtgtacacaaaacgtggccccggacatgtttcgtactatcccaccggaggctaacattcctattcccgtgaagtcagacatggttatgatgcacgagcaccacaaagagaccgaatataaagacaagataccactgcttcagcaaccaaaacgcgaggaggaggaagtcctcgaccagggtgacttctattccctgttgtcgaaactcctgggagaacgggaggacgtcgtccatgtgcacaagtataatccgacagaaaaagctgagtccgaatccgatctagtggctgagattgccaacgtggttcaaaagaaggatctgggtcgctccgatgcccgcgagggggcagaacacgagagaggtaacgctatactggtacgagacagaatccacaaatttcaccgtctcgtgtctacactgcgcccccccgagagccgggtgtttagcctacaacagccaccgcctggcgagggcacttgggagccagagcacacgggcgatttccatatggaagaggcactggactggcccggagtgtatcttctccccggtcaggtttcaggggtggccctggatccaaaaaacaacctggtgatttttcatcgaggcgatcatgtttgggatgggaactcttttgatagcaagtttgtctaccagcagattggactgggcccaattgaggaggataccatcttggtcattgatccgaacaacgccgctgtgctccagagctctggtaaaaacctgttctaccttccacatggactttccatcgacaaggacggtaactactgggtaacggatgttgccttacatcaggtgttcaagctcgacccaaataataaagaggggcctgtgctaatactcggacggtcaatgcagccagggtccgatcagaaccatttttgccaaccaactgacgttgcggtggacccgggcaccggggctatttacgtaagcgatggatattgcaacagtcgtatagtgcagttttctccatccgggaagttcatcactcagtggggggaggaatcttcaggctctagcccactgccaggtcagttcacagtgccccattccctggcgttggtccccctgctcggacagctctgtgtggctgatcgtgaaaacggacgaattcagtgtttcaagaccgatacgaaagaatttgtaagagaaattaaacatagttcctttggcaggaacgtgttcgccatctcgtatattccaggcctgctgttcgccgtgaacggcaaaccccacttcggggaccaggaacctgtccagggctttgttatgaatttcagcaatggcgaaataattgatatttttaagcccgtgagaaaacacttcgatatgccacacgatatcgtggctagcgaagatggaaccgtatacatcggcgatgcacacaccaacacagtttggaaattcacgctgacagagaagctggagcaccgaagtgtgaagaaagccggcattgaagtccaggaaatcaaagacagcgagcacaagctcgaaacctctagcggccgagtgttggggcggttccgaggcaagggctctggggggctaaatctgggcaacttcttcgcctcacgcaaagggtacagccgaaagggattcgatcgactgtctacagaaggttcagaccaagagaaggaagatgatggttctgagagcgaagaagaatattcagcccccctgccagcactcgccccatccagctcctag

SEQ ID NO: 128091 - DNA, 90 bp, Artificial Sequence
  Description of Artificial Sequence: Synthetic coding sequence
atggcagggcgtgttcctagccttctggtattactggtgttcccctctagctgcctggcgtttaggagccccctctccgtttttaagtag

SEQ ID NO: 128092 - DNA, 87 bp, Artificial Sequence
  Description of Artificial Sequence: Synthetic coding sequence
atggctggacgcgtgccaagcctcctggtgctgttagtgttcccttcctcctgtctggcttttcggagcccgctctccgttttttag

SEQ ID NO: 128093 - DNA, 162 bp, Artificial Sequence
  Description of Artificial Sequence: Synthetic coding sequence
atggcagggagagtaccgagcctcctcgtcctgctggtgttcccatcttcctgtctagcattccggtctcccttgtcagtgttcaagaggtttaaggagactactcgaccattctctaatgagtgccttgggacaactagacccgtagtccctattgattag

SEQ ID NO: 128094 - DNA, 129 bp, Artificial Sequence
  Description of Artificial Sequence: Synthetic coding sequence
atggccgggcgggtcccttctctcctcgtgctcttggtatttcccagttcctgcctcgccttcagatcacctctcagtgtctttaagcggtttaaggagacaactcgtccattcagcaacgagtgttag

SEQ ID NO: 128095 - DNA, 207 bp, Artificial Sequence
  Description of Artificial Sequence: Synthetic coding sequence
atggccggtagagtcccctctctgctcgtgctgcttgtttttccatcatcttgtctcgccttccgatcgcctctgagtgtgtttaagaggttcaaggaaacgacacgtccgttctccaacgagtgtctggggacaactagaccagtagtgccaattgacagctctgattttgccctcgacatacggatgccaggggtgaccccgtag

SEQ ID NO: 128096 - DNA, 78 bp, Artificial Sequence
  Description of Artificial Sequence: Synthetic coding sequence
atggcgggcagggtgccaagcctgctggtattactagttttccctagttcatgcctcgcttttcgaagccccctgtag

SEQ ID NO: 128097 - DNA, 501 bp, Artificial Sequence
  Description of Artificial Sequence: Synthetic coding sequence
atggcagccatcccccctgatagttggcagcctccaaacgtgtacttagagacgtccatgggtatcattgtactcgaactgtattggaaacatgcgcctaaaacctgcaagaatttcgccgagctggctagacgtggatactacaacggaaccaagtttcatagaatcattaaagatttcatgatccaagggggcgatcccactggcaccgggcgtggaggcgcttctatctacggaaagcagtttgaggatgaactgcacccagatctgaaattcacaggagccggaattctggcaatggctaatgcaggcccagacactaatggcagccagttttttgtgacgctagcacccacacagtggctcgatggcaagcataccatctttggtagggtttgtcagggaattgggatggtgaatagagtgggcatggtggaaaccaacagtcaggaccgacctgtggacgacgtgaaaataataaaggcatacccatccggatag

SEQ ID NO: 128098 - DNA, 1563 bp, Artificial Sequence
  Description of Artificial Sequence: Synthetic coding sequence
atgggcaagcggcagcaccagaaagacaagatgtacatcacctgcgctgagtacactcatttctatggtggaaagaaacctgatcttccccagactaacttcaggcggcttccctttgatcattgtagtctgtctctccagccctttgtctatccagtatgcacaccagacggtattgtcttcgatttgcttaatatcgtgccctggcttaaaaaatatggcactaatcctagtaatggcgagaagctcgatggtcgcagcttgatcaagctgaacttttctaaaaacagcgaaggaaaataccattgccctgtgttgttcactgtgtttaccaataacacccatattgtcgccgtaaggacaacgggaaacgtgtacgcatacgaggctgtggagcagctaaatattaaagccaagaattttcgggacctgttaaccgacgaaccttttagtaggcaggatattataactttacaggacccaaccaacctggacaaattcaatgttagcaatttctaccacgtgaagaataacatgaagattatcgacccagatgaggagaaggctaaacaggaccctagttattatttaaaaaacacaaacgccgagacaagggagacgctccaagagctttacaaggaatttaagggggacgaaatcctggctgccacaatgaaggctcctgagaagaagaaggtggacaagctgaatgccgcccactactcaacgggtaaggtatccgcttctttcacttcaaccgcaatggtaccagagacaacccacgaagccgcagctatcgacgaagacgtgctgcgttaccagtttgtcaaaaaaaaaggctacgtgcggttacatactaacaagggagatctaaacctcgagctgcattgtgatctcacacccaaaacatgtgaaaacttcattaggctgtgtaaaaagcattattacgacggcacgatttttcacaggtctattcggaacttcgtaatccaaggtggagacccaaccggcacaggcactggtggcgagtcctactggggtaagccattcaaggacgaatttcggcccaacctatcccatactggcaggggaatcctatcgatggctaacagcggacctaattcaaatagaagccagttcttcatcacattcagatcgtgcgcctatctggacaagaagcataccatctttggcagggttgtcgggggatttgatgttttgactgccatggagaatgtggagagtgatcctaaaacagacaggcccaaggaagagattcgcattgatgccacaacggtgttcgtagatccttacgaagaagccgacgcccaaatagcccaggaaaggaaaacacagctaaaggttgctcctgagaccaaagtgaagagcagtcagccacaggcgggctcccagggtcctcagactttccgccaaggggtgggcaaatacattaatcccgccgccacaaagcgcgccgctgaagaagaacctagcacgtcagctactgtgcccatgtccaagaagaagcccagcagaggctttggggatttttccagttggtag

SEQ ID NO: 128099 - DNA, 1563 bp, Artificial Sequence
  Description of Artificial Sequence: Synthetic coding sequence
atgggcaagagacagcaccagaaggataaaatgtacataacttgcgctgagtacacccacttttatggaggtaagaagcccgacctgcctcagactaacttcagacgcctcccgtttgaccattgttccctgtcattacagccctttgtgtacccagtgtgcacaccagacggcatcgtgttcgacttactaaatattgtgccatggctgaagaaatacggaactaacccttccaatggggagaaactcgacggtcgatccctgattaaactaaatttctccaagaattccgaaggcaagtatcattgccccgtgctgtttaccgtattcaccaataacacacatattgtagctgtgaggacgaccggcaatgtgtatgcctatgaggcagtcgaacagctcaatatcaaagctaaaaatttcagagatctgctgacagacgaacctttcagtcgccaagatatcatcactctgcaggacccaacaaatctggacaaatttaatgtgagcaacttctatcatgtcaagaataatatgaagattatcgacccagacgaggagaaggcaaaacaagaccctagttattacctgaagaataccaacgcggaaactagagagacacttcaggagttgtacaaggagttcaaaggggacgaaattctagcggcaacaatgaaggcacctgaaaagaaaaaggttgataagttaaatgctgctcattattctacaggcaaggtatcggccagctttaccagtacggctatggtgcctgagactactcacgaggctgcagccattgatgaagatgtcctgcggtaccagttcgttaagaagaagggatatgtgaggctgcatactaacaaaggcgacctgaacctggagttacactgtgatctaactcctaagacatgcgaaaacttcattagactgtgcaagaagcactactatgacggaacaattttccaccgatcaatacggaatttcgtgattcagggtggagacccgactggaactggcacaggcggggagtcctactggggcaagccctttaaagacgaattccggcccaatctcagccatactgggagaggcatcctgtcaatggccaattcgggacccaactccaaccgatctcagtttttcattacctttagatcctgtgcatatcttgacaagaagcacaccatattcggccgcgtggtgggcgggttcgacgtgctgaccgccatggaaaacgtcgagtccgacccaaaaaccgatcgacctaaagaggaaattcggattgacgccaccacagttttcgtggacccttacgaggaggccgacgcgcagatcgcgcaggaaagaaagacacagttgaaggttgctcctgagactaaggtgaaaagttcccagccccaggctggatcccaaggcccacagactttccgccagggggtaggcaagtacatcaatcccgccgctaccaaacgggccgccgaagaagaacctagcacctctgcgaccgttcctatgtcaaaaaaaaaaccgagccgcggatttggggatttttcctcttggtag

SEQ ID NO: 128100 - DNA, 1563 bp, Artificial Sequence
  Description of Artificial Sequence: Synthetic coding sequence
atgggaaagaggcagcatcagaaggacaaaatgtatataacatgcgcagaatacactcacttctacggaggaaagaagcccgatctcccacagactaacttccgaagactgccgtttgaccactgttcgctttcccttcagcccttcgtctacccagtctgcactccagacggcatcgttttcgacctgctcaatattgtgccatggctcaagaagtatggcaccaatccctctaatggggaaaagctcgacgggcgatctcttattaagcttaactttagcaagaatagcgaaggaaagtaccactgtcctgttcttttcactgtcttcaccaataatacccacattgtcgctgtgcgcacaacagggaacgtatacgcttatgaggctgttgagcaactgaatattaaggcaaaaaacttccgtgaccttctgacggacgaaccattcagtaggcaggatatcattactcttcaggaccccacgaacttggataagtttaacgtgtcaaatttctaccacgtcaagaataatatgaaaatcatagaccccgatgaagagaaagccaagcaagacccttcatactacctgaagaacacaaacgccgagacgagggagacacttcaggagctttataaggagtttaagggtgacgaaattcttgccgccactatgaaagcacctgaaaaaaagaaagtcgataagctcaatgctgcacactatagcaccggaaaagtgtccgctagttttacctctacagccatggtgcctgagacaacacacgaggcagccgccattgacgaagacgtcctgcggtaccagtttgtgaagaagaagggctatgtccgacttcacactaataaaggcgacctaaacctggaacttcactgtgaccttacccccaagacctgcgagaacttcatcaggctgtgcaagaaacactactacgacggcacgatttttcatagaagtattcgaaacttcgtgatccaaggcggggaccctaccgggactgggactggcggcgaaagctattgggggaagccattcaaggatgagttccgacctaacttgtctcataccggacgggggattctctcgatggctaattctggcccaaattccaaccgaagccagttcttcatcacgttccggagctgtgcatacttagataaaaagcacaccattttcggcagggtggttgggggatttgacgtcttaacagcgatggagaacgtcgagtcagacccaaagacagaccgaccaaaggaagaaatacggatagatgccactactgtctttgttgatccatatgaggaggccgacgctcagatcgcccaggagaggaaaactcagctgaaagtggctcccgagacaaaggtcaaatctagccaaccccaggcgggtagccaggggccacagacgtttagacaaggagtgggaaaatacattaacccagctgctacaaagcgagctgcggaggaggagccctctacatccgctaccgtgcccatgtctaagaaaaaaccatcacgcgggtttggagatttttcctcgtggtag

SEQ ID NO: 128101 - DNA, 1584 bp, Artificial Sequence
  Description of Artificial Sequence: Synthetic coding sequence
atgggcaagaggcagcatcagaaggacaagatgtacattacgtgtgcagagtacactcatttctatggaggcaagaaacccgacttaccgcagacaaactttcgtcgcctgccgtttgaccactgcagcctgagcttacaacctttcgtgtatccggtttgcacccctgatggaattgtgttcgacctcctcaacatcgttccatggctgaagaagtacggcacgaacccctcaaatggggaaaagttggacggcagatccctgatcaaattgaacttcagcaagaatagtgagggaaagtaccattgtccagtcctgtttaccgtattcactaataacacccacatcgtcgcagtgcggactacaggtaacgtctacgcctatgaagcagtcgagcagctcaatatcaaagccaaaaactttagggacctgctgacggacgaaccattcagcagacaggatatcataaccctgcaggatcccaccaatctcgacaagttcaatgtatctaatttttaccacgttaaaaacaatatgaagattatagaccccgacgaagaaaaagctaaacaggatcccagctattacctgaaaaacaccaatgccgaaacacgcgagactcttcaggaattatacaaagagtttaagggtgacgagatcctggcagccaccatgaaagctcccgagaaaaagaaagtggataaactgaacgccgcgcattactcgaccggaaaagtctccgcatcatttacatcgacagccatggtgcctgaaacaactcatgaagccgctgctattgatgaagacgtgctacgataccaatttgtgaagaagaaggggtatgtgagactccacacaaataagggcgacttgaacctggagctgcattgcgacttaaccccaaagacatgcgagaatttcatcagactgtgcaaaaaacattactacgacggaacaatctttcatcgctcaatacggaacttcgttatccaggggggcgaccctacaggcactggaacagggggtgagtcttattggggtaaaccgttcaaggacgaatttcgaccgaacctctcccacacaggcagaggaattctgagcatggccaatagtggcccaaattctaatcggagccagttctttataacattcaggtcatgtgcctatctggataaaaagcacactatcttcggcagagtggtcggaggctttgacgttcttaccgctatggaaaacgtcgaatccgatcctaagacagaccgaccaaaagaagagatccgcatcgatgccacaactgtgtttgtggatccttacgaggaagctgatgcccaaattgctcaggaacggaagactcagctaaaggtagctcccgaaacaaaggtcaagtcgagtcagccgcaggccggatctcagggcccgcagacctttagacagggcgtcggtaaatacatcaaccctgcggccaccgagcagcagcgtaagagcccccaaccagtgcctcttagcccctgtcccaggcggtccccagttggtgtattgggcacttccgctccaggctcctcacgtcttcctgatgaccattag

SEQ ID NO: 128102 - DNA, 1470 bp, Artificial Sequence
  Description of Artificial Sequence: Synthetic coding sequence
atgggtaagcgccagcaccagaaggacaagatgtacatcacatgtgccgagtacacgcatttctatggaggaaagaagcctgaccttccacagaccaactttcggaggctgccatttgaccattgcaggaacatcgtcccctggttgaaaaaatatggcacaaaccccagcaatggggaaaagctggacgggcggagcctcattaaactgaacttttctaagaatagcgagggcaagtaccattgcccagtactgtttactgtgttcactaacaatacgcacatcgtggctgttaggaccactggtaatgtgtacgcctacgaggccgtggagcagctgaatattaaggccaagaatttccgagatctgttaactgatgaacctttctcaaggcaggacatcatcacactacaagatcccaccaaccttgataagtttaacgtatcaaacttctatcacgttaagaataatatgaaaataatcgatcctgacgaggaaaaagcaaaacaagatccttcctattatctgaaaaatactaacgctgaaaccagagagacactgcaggaactttacaaggagtttaaaggcgatgaaattctggccgctactatgaaagcaccagagaaaaagaaagtggacaaactgaacgctgcacactattctactggaaaggtgagcgccagctttacgagtactgccatggtccccgaaactacccacgaggctgctgcgatcgatgaagacgtgttaagataccagttcgtgaagaaaaaaggctatgtgagactccacacaaacaaaggggatttgaatctggagctccactgcgatcttacgcccaagacatgcgaaaacttcatccgtctgtgtaaaaagcattactacgatggcaccatattccatagatcaattcggaacttcgtaatccagggaggtgaccccaccggcaccgggacaggcggcgaaagttattggggaaaaccatttaaagacgagtttcgacctaacctaagccacaccggcaggggcattttgtctatggctaacagcggccctaactccaacagatcacagttcttcataaccttcaggagctgcgcgtatctcgacaagaaacataccatttttggccgcgtggtaggcgggtttgatgtccttaccgccatggagaacgtcgaatcggatcctaagaccgaccgccctaaagaggaaattaggatcgatgctaccaccgtttttgtcgacccttatgaagaagcggatgcgcagattgcgcaggaacgcaagacacagttaaaggaggcctcaagccgaggacgcgcgctaaatcagtgccattgtccacatgtacaggaagaggcacagagtgggttttggggtctccagcttttagtggcagccgcgacttgtaggctgtacttatgcccatctttcagccatcagagcttgatgttgaagctccaggcttag

SEQ ID NO: 128103 - DNA, 1563 bp, Artificial Sequence
  Description of Artificial Sequence: Synthetic coding sequence
atggggaaaagacaacaccagaaagataagatgtacatcacatgcgcagagtatactcatttttacggaggaaagaagcccgacctgccgcagaccaacttcaggcggctgccgttcgatcactgttcactgtccctgcaacccttcgtgtatccagtgtgcacccccgatggaatcgttttcgatttgctcaatatcgttccatggctgaagaaatacggcactaacccctctaatggcgaaaaactggacggccgaagcctgattaagctgaatttctctaagaattctgagggtaaataccactgtcccgttctgtttactgtctttacgaataatacacacatcgttgctgtcagaactaccggcaacgtctacgcttacgaagctgtcgaacagctgaacattaaagccaagaatttcagggatctcctgacagacgagcccttttcacgacaggatattataacccttcaggatcccactaatttggataagtttaatgtgtccaacttttaccatgtgaagaacaacatgaaaataattgatcctgatgaagaaaaggcgaagcaggatccttcatactatctaaaaaataccaatgcagagacaagagaaacactgcaggagctgtacaaggaatttaaaggggatgaaattttggctgccaccatgaaggcacctgaaaagaaaaaggtggacaaacttaacgctgcccactacagtacgggcaaggttagtgcctcctttacctccacagccatggtacccgaaacaacccatgaggcggcggccatagatgaagacgttctgaggtatcagtttgtcaaaaagaagggttacgtgcgattgcataccaacaaaggtgatttgaacctggaactgcattgcgatctaacgccgaaaacctgcgagaatttcattcgcctgtgcaagaagcactactacgatggaacaatctttcacaggtcaatacggaacttcgtgattcaagggggagacccgaccggaacaggcaccggcggcgagtcctactggggaaagccgtttaaagacgagttccggcctaatctgagccatacaggccgtgggatcctatccatggctaatagtggacccaactctaacaggtcccagttttttatcactttcaggtcctgcgcgtatctggacaaaaaacatacaattttcggccgcgtggtaggaggctttgatgtgctgacagcgatggaaaacgtggaaagtgaccccaagaccgaccggcctaaggaggaaattcggatcgacgccactaccgtgtttgtggatccttatgaggaggccgatgcgcaaatagcccaggagcgcaagactcagctcaaggtcgcacccgaaaccaaagtgaaaagtagccaaccccaggccggttcacaagggccccagacatttagacagggagtgggaaaatatatcaatccagccgccaccaagcgcgctgccgaggaagagccctctacttcagcgacagtccctatgtcgaagaagaaacccagtagaggattcggtgacttcagttcatggtag

SEQ ID NO: 128104 - DNA, 1479 bp, Artificial Sequence
  Description of Artificial Sequence: Synthetic coding sequence
atggctgtgctcttggagactaccctgggggatgtggtgatcgatctgtacacagaggagaggcctcgagcatgcctgaattttttaaagctttgtaagatcaaatattacaattactgccttatccacaacgtgcagagggactttatcattcaaacaggagatccaacaggtaccggacgtggcggcgagtccatttttggccagttgtatggagatcaggctagcttctttgaggccgagaaggtgccacgaataaagcacaagaagaagggtaccgtgagcatggtcaataacgggagcgaccagcatgggtcacagttcctgatcaccaccggtgagaatcttgattacctggatggggtccataccgtgttcggagaggtgaccgaggggatggatatcattaaaaaaatcaacgaaacatttgtggataaggatttcgtcccgtaccaggatatccggatcaatcacactgtcatcctcgatgacccctttgacgatccaccagatctgcttatccccgaccgttctccagaacccactcgagagcagctggattctggaaggatcggcgctgatgaggagatcgacgatttcaagggccgcagcgctgaagaggtggaagaaatcaaggcggagaaggaggcaaaaacccaggcaatcctgctggagatggtaggagaccttcctgatgccgatataaaaccacccgagaacgtactcttcgtttgtaagctgaaccctgtaacaactgacgaagatctggagattattttttccagattcggcccaatacggagttgtgaagtcatccgggactggaaaactggtgagagcctgtgctacgcttttattgaatttgagaaagaggaagactgcgagaaggcgtttttcaagatggataacgtgctcatcgatgacaggaggattcacgtggacttctctcagagcgtcgccaaggtgaaatggaaaggtaaaggcggaaaatacaccaagtccgactttaaggaatacgaaaaggaacaagacaaaccacccaacctggtcttaaaagataaagtgaagccgaagcaagataccaaatacgacctcatcctggacgagcaagctgaagacagtaagtcaagtcacagccatacatccaaaaaacacaagaaaaaaactcaccattgctccgaggagaaggaggacgaagactacatgcctattaaaaacacaaaccaagacatctaccgtgagatgggctttgggcactacgaggaggaggagtcttgttgggaaaaacagaagagcgagaaacgtgatcgcacccagaaccgatctaggtcaaggtcaagagagcgggatggacactactctaactcacataagtccaagtatcaaacggacctgtatgagcgagagcgcagcaagaagagggatcggtctcggtcaccgaaaaagtcaaaggataaagaaaaatcaaaatatcgatag

SEQ ID NO: 128105 - DNA, 384 bp, Artificial Sequence
  Description of Artificial Sequence: Synthetic coding sequence
atgtctcgcccaaagacgcaaaaccaggtaactcatacgcaagttaagaatacacgccggaaaccaattacggttttgaaacggaagaaaatgaggactacctgtcagtccaaaatcctgatccgaattagcattgagaagtgggggctggttacgatgaagaaaaagaaagctgttgggagaaacaagagagtcaaacgcgagacggaactgaggacagaggtcgtcgccgaccttgaacgggggatggctattatcgtgatcgtgatcaaccagaacacgaaacagatctttatgaaagagaaaggagtcaaaagggagacggaggctgaagtccagcggagccctaagattaagaaaaatctgagcattgatgaaaggtag

SEQ ID NO: 128106 - DNA, 318 bp, Artificial Sequence
  Description of Artificial Sequence: Synthetic coding sequence
atgtgccaggggggtgattttacaagacacaacgggacaggcggtaagagtatttatggcgagaaattcgaagatgaaaatttcatcctaaagcacaccggacccggcatcctcagcatggctaacgcagggccaaacactaatggttcccagttttttatttgcactgcgaagacagagtggctggatgggaagcatgtggtgttcggcaaggtcaaagaaggtatgaacatcgtggaggcaatggagcgttttggcagcagaaacggcaagacatctaagaaaatcactattgctgactgtggacagctggaatag

SEQ ID NO: 128107 - DNA, 390 bp, Artificial Sequence
  Description of Artificial Sequence: Synthetic coding sequence
atggtgaatccgacggtgttctttgatatcgctgtcgacggagaacccttgggcagagtgtcttttgagctcttcgccgacaaagtgccgaaaactgccgagaatttccgtgcactctccacaggcgagaagggctttgggtacaagggatcttgctttcacaggataatccccgggttcatgtgtcaaggtggtgacttcaccagacataatggcacaggcggcaagtcgatctgcacagcaaagacagagtggcttgatgggaaacacgttgtcttcgggaaggttaaagaggggatgaacattgttgaagcaatggagcgcttcggatcaaggaacggcaagacaagcaaaaaaattactattgccgattgcggccagctggagtag

SEQ ID NO: 128108 - DNA, 498 bp, Artificial Sequence
  Description of Artificial Sequence: Synthetic coding sequence
atggtgaacccaactgtgtttttcgacatcgccgtcgacggagagcccctcggcagggtgtcgttcgagctgtttgccgacaaagtcccgaagaccgccgagaactttcgggcactgtctacaggcgagaaaggctttggctacaaagggagctgcttccatcgcatcattccaggatttatgtgccaagggggggattttacccgccacaacgggaccggagggaaaagcatctacggagaaaaatttgaagatgaaaactttatcctgaagcacacaggacctggaattttaagcatggcaaacgccgggcctaacacgaatggttcgcagttttttatttgtactgccaagacagagtggctggacggcaaacatgtggttttcgggaaagttaaagaggggatgaacatcgtggaggccatggagcgcttcggcagccgcaacgggaaaacctctaaaaagattacaatcgccgactgcggccagctggagtag

SEQ ID NO: 128109 - DNA, 495 bp, Artificial Sequence
  Description of Artificial Sequence: Synthetic coding sequence
atggtgaattctgtggtctttttcgacatcactgtcgacggaaaaccattggggcgcattagcataaaattatttgctgataagatcctgaaaaccgcggaaaactttcgggccctgtcgacaggagagaaaggttttcgctataaggggagttgcttccacagaattatccccggcttcatgtgtcagggcggggacttcacacggcacaacgggaccggcgacaagtctatctatggcgaaaagttcgacgatgaaaatctcattcggaagcacacaggcagcggtatcctcagcatggcaaatgccggcccaaacacaaatggaagccagttcttcatttgtgcagccaagacggagtggcttgatggtaagcacgtagcttttggcaaggttaaagagagggttaacatcgtggaagctatggagcactttggttatcgcaactctaaaacttctaagaaaattactatcgcagattgcggccaattttag

SEQ ID NO: 128110 - DNA, 651 bp, Artificial Sequence
  Description of Artificial Sequence: Synthetic coding sequence
atgctgcgcctgtcagaacgaaacatgaaggtgctactggctgccgcacttatagctggcagcgtgttctttctcctgctaccggggccaagcgctgccgacgagaagaagaagggcccaaaagtcacagtgaaggtctacttcgatctccgcatcggggatgaggacgttgggcgggtgatcttcggcctgtttgggaagactgtccctaaaactgtcgacaattttgtcgccctcgctactggcgaaaagggtttcggctataagaacagcaagtttcacagagttatcaaggattttatgatacaaggcggagattttacccggggcgatgggaccgggggtaagagcatctatggcgagaggttccccgacgagaacttcaaactcaagcattacggaccggggtgggtaagtatggctaacgccggtaaagacacaaatggatcacagttctttatcacgactgtgaaaactgcatggttggatggcaaacatgtcgtcttcggaaaggtcttggaaggcatggaagtggtgaggaaggtggaatccaccaagacggattctagagacaagccgctgaaggatgtgatcattgctgactgcggcaagatcgaggttgaaaagcctttcgctattgccaaagagtag

SEQ ID NO: 128111 - DNA, 639 bp, Artificial Sequence
  Description of Artificial Sequence: Synthetic coding sequence
atgggtccaggacctcggctgctcttgcctttagtcttgtgcgtgggcctgggcgccttagtgttcagttctggcgctgaggggttccggaagagagggccttccgtcaccgctaaggtatttttcgatgttcgaataggggacaaagatgtcggcagaatagtgataggcttgttcggcaaagtggtgcccaagaccgtggaaaattttgtggctttggcgactggcgagaaaggctatggctataaggggtcgaagttccatagagtgataaaggactttatgatccaaggcggagacattacaactggtgatgggacgggtggggtgtcgatctatggagaaaccttccccgacgaaaatttcaagctaaaacactacggcattggttgggtctcgatggccaatgccgggccagatactaatggcagccagttcttcatcacacttaccaaacccacttggcttgatggtaaacatgtggtctttggcaaagtgatagatggtatgacagtggtgcactccatcgaacttcaggcaacagatggccacgacagacccctgaccaattgtagcataatcaattctggcaaaatagatgtcaagacaccgttcgtcgtcgaaatcgctgactggtag

SEQ ID NO: 128112 - DNA, 1113 bp, Artificial Sequence
  Description of Artificial Sequence: Synthetic coding sequence
atgagccatcccagtccgcaggcaaaaccatccaacccgagcaacccacgcgtgtttttcgacgttgacattggcggcgagcgggtggggagaattgtattagagttgttcgccgatattgtcccgaagaccgcagaaaattttagagccctgtgtaccggtgagaagggcatcggacatacaactggcaagcccctgcattttaagggctgtccgtttcacagaatcatcaagaagtttatgatccaggggggggatttcagcaaccagaacgggaccggcggtgaatccatctacggagaaaaattcgaagatgaaaacttccactacaaacatgacagggaaggactcctgtccatggcaaatgccggacgcaatactaacgggtctcagttctttattactacagtccctactccacacctcgacggaaaacacgtagtgttcggtcaggttataaagggtatcggcgtagcaaggattttggagaatgtggaggtcaagggagagaagcccgctaaattgtgtgttattgccgagtgtggcgagctgaaggaaggggatgacggcggaatttttccaaaggacggatcaggggatagccaccccgattttcctgaagatgcagacatcgacctgaaggatgtggataagatccttcttatcacagaggacctaaaaaacatcggcaacactttcttcaaaagtcagaactgggagatggcgatcaagaaatacgctgaggttctgcgatatgtggatagcagcaaggcagtgatcgaaaccgcagatagggccaaacttcagcctatcgccctctcatgcgtgctcaacattggggcttgcaaacttaagatgtcaaattggcaaggagcgatcgactcttgtctggaggcgctggagctggatccctcgaataccaaagccctgtatcgcagggcccagggatggcagggcctgaaagaatacgatcaggcattagccgacctgaaaaaagcccaagggattgccccagaagacaaggccatccaggcggaactgctgaaggttaagcaaaaaattaaggcgcagaaagataaagagaaagccgtctacgcaaaaatgttcgcctag

SEQ ID NO: 128113 - DNA, 597 bp, Artificial Sequence
  Description of Artificial Sequence: Synthetic coding sequence
atggacgccatcctgaactaccgctcagaggacactgaggactactacactctgctggggtgcgacgagctgagcagcgtggaacagattctcgctgagtttaaggtgcgtgctctggagtgccacccggataagcatcccgagaaccccaaggccgtcgagacattccagaaactacagaaagccaaggaaattctaaccaacgaagagtcacgcgcaaggtacgaccattggcgccggtctcagatgtctatgccgttccagcagtgggaggctctcaatgatagcgtgaaaacatcaatgcattgggtagttcgggggaagaaggaccttatgctcgaagagtctgataagacccacacgaccaaaatggagaacgaggaatgcaacgaacaacgcgagaggaaaaaggaagaattggcaagtaccgctgagaagacggaacagaaggaacccaaacctcttgagaagagtgtcagtcctcagaactctgattccagcgggttcgctgatgtaaatgggtggcacctccggtttaggtggtccaaagatgctccttctgagctgctgagaaaattcagaaattacgaaatttag

SEQ ID NO: 128114 - DNA, 468 bp, Artificial Sequence
  Description of Artificial Sequence: Synthetic coding sequence
atgctagcccttagatgcggcagcaggtggctcggccttctgtccgtccccaggtcggtgcccctaagattgcccgcagcccgggcgtgttcgaaggggtcgggagacccttcttcatcctcttcttccggtaaccccctcgtctacctggatgttgacgctaacggtaagcccctcgggcgcgtagtgctggagctgaaagccgacgtggtacctaaaacggctgaaaattttcgcgccttgtgtacaggcgagaagggctttggctacaaaggcagtacctttcaccgggtgattccatcttttatgtgccaagcaggcgatttcacaaaccacaatggcacagggggcaaatcaatatacggttctagattccccgacgaaaatttcacactcaaacacgtcgggccaggatggatggcctccatgctctgcagtgttacctctaagcgggcgtggacaagttag

SEQ ID NO: 128115 - DNA, 498 bp, Artificial Sequence
  Description of Artificial Sequence: Synthetic coding sequence
tagtcatcctcaagttcgtcaggcaaccctctcgtgtaccttgatgtggacgccaacggtaaacctttaggacgagttgtgctggaattgaaggccgatgtggtgccaaagaccgccgagaactttagagcgctttgcactggggaaaaaggatttggctacaaaggtagtaccttccacagggtgattccaagtttcatgtgccaggcaggagatttcaccaaccataacggaacaggcgggaagtcaatttacggcagtagattccccgacgagaatttcacgttaaagcatgttggtcctggagttcttagcatggctaacgctgggccaaatacaaacgggtcccagttcttcatatgtaccataaagactgattggagtatggcgttggacgacatagccctccactgctgcagtcctggcagccctgtgctgacggggtggatggcttcaatgctatgctcagtcacctctaagagggcttggacaagttag

SEQ ID NO: 128116 - DNA, 2265 bp, Artificial Sequence
  Description of Artificial Sequence: Synthetic coding sequence
atggggattaaggtccagagacccagatgctttttcgacatcgcgatcaacaatcagcctgcgggtagggttgtgtttgaactgttcagcgacgtttgtccaaaaacgtgcgaaaactttaggtgcctctgtactggcgaaaaaggaacaggcaagtccacacagaaacctctgcactacaaatcttgtctgttccaccgagtggtgaaggatttcatggtccaaggcggcgacttttccgaaggcaacggaaggggaggcgagtctatctatggcggattcttcgaggacgagagtttcgccgtcaagcataacaaagaatttctccttagtatggctaatcggggtaaggacacaaacggaagtcagttctttattaccaccaaaccaacgcctcatctggacggtcatcatgttgtcttcggccaggtgatatcgggtcaggaagtggtgagagaaatcgaaaatcaaaagactgacgctgcatctaagcctttcgctgaagtcagaattctgtcctgtggagaactgattccaaaatccaaagtaaaaaaggaggagaaaaaacgccacaaatcaagttcgagctcttcctcaagctcatccgattctgacagcagctctgactcccagtctagctccgatagtagcgattccgaaagcgccacagaagagaagagtaagaagcggaagaagaagcacaggaagaattccagaaagcacaagaaggagaagaaaaagcgcaagaagtccaaaaaatctgcatccagcgagtcagaagctgaaaatctggaggcccaaccacagtctacagttagacccgaggaaattcctcctatccctgaaaaccgcttcttaatgaggaagtcccctcccaaggcagatgagaaggagaggaagaatagagaaagggaaagagaaagggagtgtaatccgcccaactcccagcccgcatcataccagcgaagattactggtgacacggagcggccgcaagataaagggtagaggacctaggagatacagaactccgtctagaagtcggagtagagatcgcttcaggcggtctgagacccctcctcactggcgacaggaaatgcagcgagctcagagaatgcgcgtctcatcgggtgagaggtggattaagggagacaagtcagagcttaacgagataaaggagaatcaaaggtctcctgtccgcgttaaggaacgcaaaattaccgaccacagaaatgttagtgaaagccctaaccgcaagaacgagaaggagaagaaagtgaaagaccataaatcgaacagcaaggaaagagatatccggaggaactctgagaaggatgataaatacaagaataaagtcaagaaacgcgccaagtctaagagtaggtctaagagtaaggagaaaagcaagtccaaggagagagattcaaaacacaaccggaatgaagaaaagcggatgcgcagccgcagcaaaggacgcgatcatgagaacgtgaaagagaaagaaaaacagtctgacagtaaaggcaaggaccaggagagaagccgcagcaaggagaaatctaaacaactggagtcgaaatcgaacgagcatgaccactcgaagtcgaaagagaaagacagaagagctcagagtaggtcaagagagtgcgacataacgaaaggtaaacacagttacaactcccgcaccagagagcgcagtaggagtcgagataggagccgacgagttaggagtagaacccacgatagggatagaagtaggtccaaggaatatcaccgataccgagaacaagaatacagacgaaggggaaggtctaggagccgcgagcggagaacccccccaggccgtagtaggagtaaagatcgacggaggcgccggagggattccagaagctcagagcgggaggagtcccagtcccggaacaaagacaagtatagaaaccaggaatccaagtcttctcaccgcaaagaaaattcagagtcagagaagcggatgtactccaagagccgggaccacaactcttctaacaacagcagggagaagaaggccgatcgggaccagtcccccttctctaagattaaacagagctcacaagataacgaacttaagtcctccatgttgaagaacaaagaggatgagaaaattaggagttccgtggagaaagagaaccagaaaagcaaaggtcaggaaaatgaccatgtgcacgaaaaaaacaaaaagttcgaccatgaaagctcacctggcactgatgaggacaaaagcggatag

SEQ ID NO: 128117 - DNA, 741 bp, Artificial Sequence
  Description of Artificial Sequence: Synthetic coding sequence
atggggattaaagttcagaggccgagatgtttcttcgatattgctattaataaccagccagcaggacgcgtggtgtttgagctgttcagcgacgtatgccccaagacgtgcgaaaacttccggtgcctctgcacaggggagaaggggacaggtaaaagcacacaaaaaccactgcactataagtcttgcttgtttcatcgggtggtaaaggacttcatggtgcaaggcggagacttttctgaaggcaacggccggggaggggagagtatctacggggggtttttcgaagacgaatcttttgccgttaaacacaataaagagttcctcctgagtatggccaatagagggaaagatacaaacggctctcagtttttcatcaccacaaaacccaccccccatctggacggtcaccacgtggtctttgggcaagtgatttccggccaggaggtcgtcagggagattgagaatcaaaagacagacgccgcatccaagccatttgctgaagtacggatcctgagttgcggagaactgattcctaaaagcaaagtaaagaaggaggagaagaaacgccataaatcatccagctcctcgagcagcagtagctccgactccgacagctcatcagacagccagtcttcctccgattcatccgattccgaatccgctactgaggagaagagtaagaaacggaaaaagaaacaccggaaaaacagcaggaagcacaaaaaagagaagaaatag

SEQ ID NO: 128118 - DNA, 180 bp, Artificial Sequence
  Description of Artificial Sequence: Synthetic coding sequence
atggggattaaggtgcaaagaccccgctgctttttcgacattgctatcaataaccagcccgccggccgggtcgtgttcgaactgttttccgacgtctgtcccaagacctgcgagaattttcgctgcctctgcacaggagaaaaaggtaccggtaagtccactcagaagcctctccattag

SEQ ID NO: 128119 - DNA, 2265 bp, Artificial Sequence
  Description of Artificial Sequence: Synthetic coding sequence
atggggatcaaagttcagagaccacgctgtttcttcgatatcgcaatcaacaatcaacccgccggcagggtggtgtttgaactgtttagtgacgtctgcccaaagacctgtgaaaattttcgctgcctctgtaccggggaaaagggtaccggaaagtcaactcaaaaacctctgcattacaagtcctgccttttccacagggtggtcaaagattttatggtgcagggaggcgatttcagcgaaggtaacggccgcggcggtgaatcgatttacgggggtttctttgaggacgagagtttcgcagtgaaacacaataaagaattcctgctttctatggccaaccgcgggaaagacactaatggttctcagttctttattaccactaaacctacgccccatttggacggacaccacgttgtgttcggacaggtgatttctggtcaagaggtggttcgtgagatcgaaaatcagaagaccgacgccgcttcgaagccttttgcagaggtgaggatactaagctgtggggaattgatcccaaaatctaaggtaaaaaaggaggagaagaagcgtcacaagagttcaagctccagcagtagttcatcaagtgattccgactcctctagtgactcacagagctcctcagacagtagtgattcagagagtgctacagaggagaaaagtaagaaacgaaaaaagaagcacagaaaaaattccagaaaacacaagaaggaaaagaagaagagaaagaagtccaaaaagtcggccagctccgagtctgaggccgagaacctcgaagcccagccccagagcactgtcaggcccgaagaaatcccacctattcctgagaatcggtttctcatgcgcaaatctccacctaaggccgacgagaaagaaagaaaaaatagggagagagaaagggaacgcgagtgcaaccctccaaactcacagcccgcctcgtatcagaggcggttgcttgtgacccgctcaggacgaaaaatcaaggggcgggggcctcggcgctaccggactccttctagatcaaggtcacgagatcggtttagacggagcgaaacccctccacattggcggcaagaaatgcagcgggctcagaggatgcgtgtaagcagcggagagagatggataaagggagataaaagtgagcttaacgagataaaggaaaaccagcgttcccctgtgagggtcaaggagagaaagattacggatcataggaacgttagtgagtcccccaaccggaagaatgaaaaggagaagaaggtgaaagaccataagtccaattcgaaagaacgcgatattcggagaaacagcgagaaggatgacaagtacaagaataaggtaaaaaagcgcgctaagagcaaatcccggtccaaatccaaagagaagtctaaatcaaaagagagggattccaagcataaccgaaatgaagagaaacggatgcgttcccgaagcaaaggcagggaccacgagaacgtgaaagagaaggagaaacagagtgatagcaagggcaaggatcaggaaaggtcaagaagcaaggagaagtcgaaacagcttgagagcaaaagcaacgagcacgaccattctaaaagcaaagagaaggataggagggcacagtcacggtccagagagtgtgacattaccaaaggaaaacattcatataactcacgcactagggaaagaagccgtagccgtgaccggagcaggcgtgtgaggtccagaacccatgaccgcgatagatctcgttcaaaagagtatcaccggtacagggagcaggagtatcggcggagggggagatctaggtcacgggaaagaaggactcctcctggtaggtcccgctcaaaagataggaggcgcagaaggagggattctaggtcttccgagagagaagaatctcaatctcggaacaaagacaagtatcgaaatcaggagtctaaaagctctcatcgcaaggagaactccgagtcagagaagcgcatgtattcaaagtcccgcgaccataactctagtaacaactcaagggaaaaaaaagccgatagagatcagtcccctttcagcaagattaaacagtccagccaggataacgagctgaagtcttctatgcttaagaacaaggaggacgagaagattcggtcatcggtcgaaaaggaaaaccagaaatctaagggccaggaaaacgaccacgtgcacgagaagaacaaaaagttcgatcatgaaagctctcctggcacagatgaagacaagtctggctag

SEQ ID NO: 128120 - DNA, 1347 bp, Artificial Sequence
  Description of Artificial Sequence: Synthetic coding sequence
atgggtattaaagtgcagaggccccgctgttttttcgatattgctattaataaccagccagctggacgcgttgtatttgagctgttttcagatgtctgccccaagacatgcgagaattttaggtgtctgtgtaccggcgagaaagggacagggaaatcaactcagaaacccctccactacaaatcatgtctcttccatcgagtagtgaaagattttatggtacagggtggtgacttcagcgaggggaacgggagagggggggagtccatatatggcggattttttgaggacgagtcattcgccgtcaaacataacaaggaattcctgctctctatggccaaccgggggaaggacaccaacggcagccaattttttataaccacaaagccaacgcctcatctcgatgggcaccacgtggtcttcgggcaggtcataagcggccaggaggtggtacgggagatcgaaaatcagaagacggatgctgcctccaagccttttgctgaggtgagaatcctgtcatgcggagagctcatcccaaagagcaaagtgaagaaggaggagaagaagaggcataaaagctccagctctagttcctccagctcaagcgacagtgacagctcctccgactcccagagctcttccgatagttccgatagcgaatcggcaaccgaggagaaatctaaaaaacggaagaagaagcataggaagaactcaaggaaacacaagaaagaaaagaagaaaagaaagaagtcaaaaaaatccgccagcagtgaaagcgaggccgaaaacttggaggctcagccacagtccaccgtaagaccagaggaaatcccccccattccagagaacagattcctgatgcgaaagtcccctcccaaggcggatgagaaggagaggaagaaccgggaacgcgaaagggagcgcgagtgtaacccaccaaattcgcagcccgcttcatatcagaggcgcctactggttactaggagcggaaggaagattaagggccgtggccctagacgatatcgcacacctagccgcagccgctcccgtgatcgcttccgacggtcggaaacaccaccacactggcgccaggagatgcagcgggctcaaagaatgagagtctcctcaggagaaagatggatcaagggtgataagtccgagctgaacgagatcaaagagaaccaacgcagccccgtgcgggtaaaagaacggaaaattacagatcaccggaacgtctctgaaagccccaaccgaaaaaatgagaaggaaaaaaaggtgaaggatcacaagtccaatagcaaagagcgcgacatcaggaggaaaaaaaaaaagaagaaaaagaagtag

SEQ ID NO: 128121 - DNA, 534 bp, Artificial Sequence
  Description of Artificial Sequence: Synthetic coding sequence
atggccgtcgcgaactccagccctgtgaacccagtagttttcttcgatgtaagcattgggggccaggaagtcggaaggatgaagatcgagttgttcgctgacgtcgtacccaagactgccgagaacttccggcagttctgtaccggggagtttcgcaaggacggggttcccataggatacaaaggcagcacttttcatcgggtgattaaggatttcatgatccaaggcggcgattttgttaacggtgatggcacaggggtcgctagtatctaccgcggtccttttgccgacgaaaactttaagctgcgccactccgccccaggactgcttagtatggcaaacagcggcccttctacaaacggctgtcagtttttcatcacctgcagtaaatgtgattggctggatggaaagcatgtggtcttcggaaagatcatcgatgggctgctggtaatgcgaaaaatagagaacgtgcccaccggacctaacaataagccaaagttgccagtggttatctctcaatgtggggagatgtag

SEQ ID NO: 128122 - DNA, 174 bp, Artificial Sequence
  Description of Artificial Sequence: Synthetic coding sequence
atgaaaattgaactgtttgcggatgtggtccccaaaacagcagaaaacttccgccaattctgtaccggggaattccgatcagtgtcagacgtattcgacttcttcgcctgctcgcgtggggtgttttggggatgcagtgaaggtataggagaaccacccgcgggcctggagtag

SEQ ID NO: 128123 - DNA, 405 bp, Artificial Sequence
  Description of Artificial Sequence: Synthetic coding sequence
atgatcgctggcgactctgacagaaggaaggatggtgtaccgatcggctataaaggaagcacatttcaccgtgtgattaaggacttcatgatacagggcggcgactttgtgaacggcgacggtacgggtgttgcatccatctaccgcggcccttttgccgacgaaaatttcaagttgcgtcattcggctcccggcctgttgtcgatggccaacagtggcccaagcaccaacggttgccagttctttattacctgtagtaaatgcgactggctggatgggaagcacgttgtatttgggaagattatcgatggactccttgtcatgcggaaaatagaaaacgtgccaaccggaccaaataataagcccaagctgcctgttgttatttctcaatgcggagagatgtag

SEQ ID NO: 128124 - DNA, 207 bp, Artificial Sequence
  Description of Artificial Sequence: Synthetic coding sequence
atggttaattggaagggtttggtgctccctgcagtcactccctccctctttctttttggctaccgcaaagacggggtccctataggatacaaaggcagcacattccaccgggtgattaaggattttatgatccagggtggggacttcgtgaatgtctctactatcccattcctgtcgaaaaccagatctttctccttctgctgttag

SEQ ID NO: 128125 - DNA, 435 bp, Artificial Sequence
  Description of Artificial Sequence: Synthetic coding sequence
atgaagatcgagttatttgccgatgtggtgccgaaaacagctgaaaatttccggcagttttgtaccggcgagtttcggaaggatggcgttcctataggttacaagggaagcacatttcatagggtgatcaaggactttatgatccagggcggagactttgtgaacggagacggcaccggcgtggcgtctatctatagagggccatttgctgatgagaacttcaagctacggcactccgccccagggctgctgagtatggccaactctggtccctctaccaacgggtgccagttttttattacttgctcaaagtgtgattggctcgatggtaagcatgttgtgttcggaaagatcattgacggcctccttgtaatgcgaaagattgagaacgttcctacggggccaaacaataagccaaaactaccggtagtgtag

SEQ ID NO: 128126 - DNA, 405 bp, Artificial Sequence
  Description of Artificial Sequence: Synthetic coding sequence
atgatcgccggcgacagtgaccggagaaaggatggggtgcccatcggctacaaagggtccactttccacagagtgattaaggactttatgattcagggcggagattttgtaaacggcgatggcactggggtagcttcgatctacagggggccctttgcagacgagaattttaagttaaggcactcggcaccaggactcctctctatggccaacagcggcccttccacgaatgggtgccagttcttcattacatgttcaaaatgcgactggctggacggaaagcatgtggtttttggcaagatcatcgacggcttgctcgttatgcgtaaaattgaaaacgtccccactggcccaaacaataaacctaaactgccggtggtaattagccagtgcggcgagatgtag

SEQ ID NO: 128127 - DNA, 540 bp, Artificial Sequence
  Description of Artificial Sequence: Synthetic coding sequence
atgccctctaagtcgctagtcatggaatatctcgcccatccatcgacattgggtctcgccgttggtgttgcatgcggcatgtgccttgggtggagcctgcgagtctgcttcggaatgctgccaaaaagtaaaacttctaaaactcacacggatactgaatctgaggccagcattttgggagacagtggcgagtacaaaatgattctcgtggtgcggaacgatctgaagatgggcaaaggcaaggtcgccgcccagtgctctcatgccgctgtctccgcttacaagcagatccagaggcggaaccccgagatgctgaagcagtgggagtactgtggtcagccaaaggtagtcgtaaaagccccggatgaggagactctgatcgccctgctggcccacgcaaagatgcttgggcttaccgtgagcctcatccaggacgcagggagaacccagattgccccagggagtcagacagtgctaggcatcggtcctgggccggccgatctcattgataaggtaactggccatctgaaactgtactag

SEQ ID NO: 128128 - DNA, 543 bp, Artificial Sequence
  Description of Artificial Sequence: Synthetic coding sequence
atgatgccgagcaagagcctggtgatggaatatctcgctcacccatccacactgggcttggccgtgggtgtggcatgtggcatgtgcctcggctggagcctgcgggtttgttttgggatgcttcctaaatcaaagacctcaaagacccatacagatacagaatcagaggccagtatcctcggagacagtggggagtataagatgatactggtggtgagaaacgacctcaagatgggcaagggtaaggtggctgcacaatgttctcatgctgccgtgtccgcttataagcagattcagcggcgcaatcctgagatgcttaagcaatgggaatattgcggtcagcccaaagtggttgtgaaagcaccagatgaagagactctgatagccctgcttgctcatgctaaaatgttaggcctgacggtgagcctcatacaagacgctggccgtactcagatcgcccctgggtcacaaaccgtcctcgggatcggacctggccctgcagacctaatcgacaaggtcaccggccacctgaagctgtattag

SEQ ID NO: 128129 - DNA, 540 bp, Artificial Sequence
  Description of Artificial Sequence: Synthetic coding sequence
atgccatccaagtctcttgtgatggaatacctggcacacccttcaactttggggcttgctgtgggagtggcatgcggaatgtgtctgggatggtccctccgggtttgtttcggaatgctcccaaaaagcaagaccagcaagacccacacggataccgaatccgaggcttcaatccttggtgacagtggggaatataaaatgatcttagtcgtgagaaacgatttgaaaatgggaaagggtaaagtcgccgcacagtgtagccacgctgccgtgtcggcatacaaacagattcagaggcgaaacccggaaatgctgaaacaatgggagtattgcggacagcccaaggtcgtcgtaaaggcccccgacgaggaaactcttatagcccttctggctcatgccaaaatgttaggccttacagttagtctgattcaggatgccggcaggactcaaattgctccggggagtcagacggtcctgggaatcggccccggcccagccgatctgatcgataaggtaaccggtcatcttaaactgtactag

SEQ ID NO: 128130 - DNA, 1668 bp, Artificial Sequence
  Description of Artificial Sequence: Synthetic coding sequence
atggccgctagattgttactgttgggcattcttctcctcctgttgcccctacccgttccagctccctgccacacggccgccagatcagagtgtaagagatcccacaaatttgtgccaggtgcctggttggctggggagggcgtggatgtaactagcttgcgcagatccggttctttccctgttgacacacagcgctttttgcggcctgatggtacgtgtacgctttgtgagaatgcacttcaggaggggacattacagcgtctgccactggccctcactaattggagggcacaggggagcggctgtcagagacacgtgaccagggccaaagtctcatcaaccgaggcagtcgccagagacgccgcacggagcattcgcaatgattggaaggtgggccttgacgtgacacccaagccaacatcgaacgtccatgtgtccgtggccggtagtcactctcaggcagctaatttcgccgcacaaaagacgcaccaagaccagtactcttttagcacagacacagtagaatgccggttttactctttccacgtggtacatacacccccactgcaccccgatttcaagcgagcactcggcgacctgcctcatcacttcaacgctagcacgcagccggcttatctgagattgatctcgaactatgggacacactttatccgcgccgtcgagctgggcggtcgaatcagtgctctgaccgctctgagaacgtgcgagctggccctggagggcctgaccgacaacgaggtagaggattgcctcacagtggaggcccaggtgaatatcgggatacacggctctatatctgccgaggccaaagcatgcgaagagaaaaaaaagaaacacaagatgactgcaagctttcatcagacataccgggagcggcacagcgaggtggtgggcggtcatcacacctccatcaacgatctgttattcggtatccaggctggcccagagcagtactcggcctgggtgaattccctgcccggctctccggggctcgtggattatactctcgagccgctgcacgttcttcttgactcacaggatcccaggcgagaggccctaaggcgggcactttcacaatatctaacagatcgcgccaggtggagggactgttccagaccgtgtcctccgggcagacagaagagcccccgagacccttgccagtgcgtgtgccacgggagcgcagtcacaactcaggattgttgtccgaggcagcgggggcttgcacaactggaggttacgttcattcaggcatggggactctggggcgactggttcaccgcaactgatgcttacgtcaagttattttttggaggccaggaactgcggaccagtaccgtatgggacaataacaatcccatatggagtgtgcggctcgattttggagacgtgctgctggcgaccgggggcccactgcgacttcaggtgtgggatcaagacagcggcagggacgatgacctgctcggcacctgtgaccaggcccctaaatcggggtctcatgaagtccggtgtaacttaaatcacgggcacctgaaatttcgttatcatgcacggtgtctcccccacctgggcggcgggacgtgtctggattatgtaccccagatgcttctcggagaaccccctggaaaccgtagcggtgcagtgtggtag

SEQ ID NO: 128131 - DNA, 1668 bp, Artificial Sequence
  Description of Artificial Sequence: Synthetic coding sequence
atggccgcaaggttattactactggggatactgcttctactactcccattgcccgtgccggctccatgccatactgccgcccgttccgagtgtaaacgttctcacaaatttgtgcctggtgcctggctggctggcgagggagtagatgttacttccctacggcgtagcggctcttttcctgtcgacacacaaagatttctgcgaccagacggcacttgcactctgtgcgagaatgcattgcaggagggtactctccagcgtttgcccctggccttaacaaactggcgtgctcagggctcagggtgccagcgtcacgtgacgcgagctaaagtgagctctactgaagccgtggcacgggatgctgcccgcagcattaggaacgactggaaagttggcctggatgtgactcccaagcccaccagtaacgttcatgtatctgtcgccggcagtcattcacaggccgcaaacttcgcggcccagaagacccaccaagaccagtactcgttttccactgacacagtcgaatgcaggttctacagcttccacgtagtgcacactcctcccctccaccctgacttcaaaagagcactgggagatctgccccaccatttcaacgcctccacacagcccgcctacttgagactcataagtaactacggtacccattttattcgagcagttgagctcggagggcgaattagcgccttgaccgcactgcggacctgcgaacttgcgctagagggactgacggacaacgaggtagaggattgcctgactgtcgaagcgcaggtaaacattggaattcacggcagcatctccgccgaagcaaaggcatgtgaggaaaagaagaagaagcataaaatgaccgcctcctttcaccagacctatcgcgaaagacattctgaggtcgtgggaggccatcatacatctattaatgatctgttgtttggaattcaggcgggacccgagcagtatagtgcttgggtgaactctctgcctggatctccaggcttggtcgactacacactcgagcctctacacgtgctgttagatagtcaggacccgaggagggaagcacttcgccgagcactgtcccagtatttgactgaccgggcacgttggagagattgttcccgtccttgtccccctgggcgccagaaatcacctagagacccatgccagtgtgtttgtcatggctctgctgtgactacacaggactgctgcccgaggcaaaggggcctagcccagcttgaggtgacctttattcaggcctgggggttgtggggcgactggttcaccgccacagatgcttatgttaagttattttttggcggtcaggagctgcggacaagcacggtgtgggacaacaacaatcccatatggtccgtcagactggatttcggggacgtactcctcgccacaggtgggccactgaggttgcaagtttgggaccaggattctggccgtgacgatgacttgctgggaacctgcgatcaagcccccaagtccggtagccatgaggttcgctgcaacctgaatcacggtcacctgaagtttagataccatgctcgctgcctgccccatctaggcgggggaacgtgcctcgactacgtgccgcagatgttgctgggcgaacctcctggtaaccgaagtggcgccgtgtggtag

SEQ ID NO: 128132 - DNA, 1668 bp, Artificial Sequence
  Description of Artificial Sequence: Synthetic coding sequence
atggctgcccgtctactgctcctgggcatcctcctccttcttctgcccttaccagtcccagctccctgtcacactgcagccaggagcgagtgtaaacggagtcacaagtttgtgcccggagcctggttggcaggcgaaggggtggacgtaacatctctcagacgctcgggctctttcccagtggatacgcagaggttcttacgaccagatggcacttgcactctatgtgaaaacgcactgcaggaagggactctgcaaaggctaccccttgctctgaccaactggcgtgcccagggctcaggttgccagcgtcacgtcacaagggcaaaagtgagctctaccgaagctgttgcacgagacgctgcacgctctatcaggaacgattggaaggtagggctcgacgtaacccccaaaccgaccagcaacgttcatgtttccgttgcaggaagtcacagccaggccgccaattttgctgctcaaaagacccatcaggatcagtacagtttctccaccgacacggtagaatgtaggttctatagttttcacgtagttcacacgccccctttacatcccgattttaaacgagcgctgggggatctgcctcatcatttcaatgcgtcaacacagccagcctatctccggctgatctccaattacgggactcacttcattagggctgtcgaactgggtgggaggatcagtgcgctcactgcgctcagaacttgtgaactggctctggaaggcctgactgataacgaagtcgaagattgcctcacagtagaggcgcaggtaaatatcggaattcatgggagtatatccgcagaagctaaagcatgcgaggaaaaaaagaagaagcataagatgacagccagtttccaccagacttaccgcgaacggcactctgaagtcgtcggcggccaccatacctccatcaacgacctcctatttggcatccaggcaggcccggagcaatacagcgcttgggtgaattcactcccaggcagcccgggcttggtagactacacactggaaccgctgcatgttctgctagacagtcaagacccccgaagggaggccttaagaagggcgctatcccaatatctcaccgatcgtgctcgctggagagactgttcaagaccttgcccgccaggacgacagaaatcccctcgggacccgtgccaatgtgtatgccatggatcggccgtgacgacacaggactgttgtccgcgtcagcgcggcctagcccagcttgaggtcacatttatacaggcttgggggctgtggggtgactggtttaccgcaacggacgcatatgtgaaactcttctttggcggacaagaactccgcacaagcaccgtctgggacaataacaaccccatttggagcgtgcgccttgacttcggcgatgtactgctggccacgggcgggccactccgcctgcaggtgtgggaccaggactcgggtcgtgatgatgacctcctgggaacatgcgatcaggcaccaaagtctgggtcccacgaggtgcgctgtaacctaaaccacggccacttgaagttccggtatcacgcaagatgccttccacacctgggcggtggaacatgtctggactacgtgccgcagatgctgctgggcgaacctcccgggaacagaagcggagccgtgtggtag

SEQ ID NO: 128133 - DNA, 444 bp, Artificial Sequence
  Description of Artificial Sequence: Synthetic coding sequence
atggaggctaggtctcggagtgctgaggagctgcggcgggccgagctcgtggaaatcattgtcgaaactgaggctcagaccggagtgtcaggcataaacgtggcggggggtggcaaggaaggcatcttcgtgagagagctgagagaagactctccggctgccagaagcttgtcgctgcaggaaggcgaccagctcttgtcagccagagtctttttcgagaacttcaaatatgaagacgcactaaggctacttcagtgcgccgaaccatacaaggtttcattttgtctgaaacgtaccgtacctacgggggacctcgctctcaggccaggaactgtgtctgggtacgagattaagggaccccgcgcgaaggtggccaagctggtgagggtgttgagccctgcgcccgccttggattgcccaagcgatcctgtgagcgctccctag

SEQ ID NO: 128134 - DNA, 4386 bp, Artificial Sequence
  Description of Artificial Sequence: Synthetic coding sequence
atggaggcgaggtctagaagcgccgaggaacttcgccgcgcggagctggtggaaatcatcgtagagactgaggcccaaacaggcgtctccggaataaatgtggccggaggagggaaagaaggaatcttcgttcgtgaactccgcgaggattcacccgcagcgcggtccctgtctctccaagaaggggatcagctcttaagcgcccgcgtcttctttgaaaacttcaaatacgaagatgcactgcggctgctccaatgcgctgaaccttacaaggtgtccttctgtctgaagaggactgtgccgaccggggacctggctttgcgccctggtactgtttccggatacgagatcaaaggcccccgggccaaggtggcaaaactgaatatacagagtctctctccagttaaaaaaaagaaaatggtgccaggcgctctcggagtgccagccgacttagcacccgtggatgtcgagtttagcttccccaagttcagccgccttcgtcggggactgaaagctgaggccgtgaagggtcccgtccccgccgcccctgcgagacggaggttacagctgccacgcttacgagtgcgggaagtggcagaagaggctcaggctgctcggctggccgctgcggcccccccaccccggaaagctaaggtcgaagctgaagttgccgccggcgctaggttcacggcaccacaggtcgaacttgtcgggcctagactgcccggcgcggaagtgggggtgccacaggtgtcggcccctaaggcagccccgtccgccgaagccgccggggggttcgccctacacctgcccactctgggtctcggagcccccgcgccccccgcggtcgaagcacctgctgttgggatacaagtacctcaggttgagctgcctgcactgccgagtttgcccactctccccaccctcccgtgccttgagaccagggaaggcgcggtctctgtcgtcgttcctacgctggacgtagcagcaccaaccgtgggagttgacttggcgctacctggagcggaggtggaagcacggggtgaagctcccgaggtggccctgaagatgccaagattaagtttccctaggttcggggccagagcaaaagaagtcgcggaggcaaaagtggcaaaggtgagccccgaggcccgggtgaagggccctaggttgcgcatgcccacgttcggattatctctgctagagcccaggcctgctgcccccgaggtcgtcgaatcaaaactaaagttaccaacaatcaagatgccctccctgggcatcggggtgagtggccccgaagtgaaagttccgaaaggacccgaagtgaagttgcccaaagcaccagaggtgaaactgcccaaggtccccgaggccgcactgcctgaggtgcgactgcctgaggtagaactgccaaaggttagtgaaatgaagttgccaaaagtgccggaaatggcagtccctgaggttagactgcccgaggttgagttgcctaaagttagtgagatgaagttaccaaaagtccccgaaatggccgtgcccgaggtcaggctaccggaggttcaattgctgaaggtctccgagatgaagcttcctaaagtgccagaaatggccgtacctgaagtgcgcctacctgaggttcaactgccaaaagtctcagaaatgaaacttccggaggtctcggaggtggccgtgcccgaggtgaggctccctgaagtgcagctgcccaaggtgcctgaaatgaaggtaccagagatgaagttgcctaaggtccccgaaatgaaactgcccgagatgaagcttcctgaagtccaacttcccaaggtcccagagatggctgtgcccgatgtccacctgccagaagtgcagttgcccaaggtgcccgaaatgaaactcccggaaatgaagttacccgaagtgaaactgccaaaagtgccagaaatggcagtccccgatgtgcatctgcctgaggtgcaactgcccaaggtcccagaaatgaagcttcccaaaatgccagagatggccgtccctgaggttcgcctaccagaggtacagctgccaaaggtgagcgagatgaagctccctaaagtcccggagatggcagttcccgacgttcacctcccagaagtgcagttgccaaaagtgtgcgagatgaaggtaccagacatgaaacttcctgaaatcaaactgcctaaagttcccgagatggccgttccagacgtccatcttcccgaggttcaattacccaaagtgagcgagatccgattacctgagatgcaggtgccaaaagtgcctgatgtgcacctgccgaaagcccctgaggtcaaactacctagggcacctgaagtgcagctcaaggctacgaaggctgaacaagccgaaggtatggagttcggctttaagatgccaaaaatgacaatgccaaaactgggccgcgcagagtccccctctagaggcaaacccggggaagccggagccgaggtgagcggcaaactggtcaccctgccctgccttcagcctgaagtggatggagaggcacatgtcggcgtcccctctctgacgttgccatctgtggaactggatttacctggggccctgggtttgcagggacaggtgcctgccgccaagatgggcaaaggggagcgggtggagggcccagaggtcgctgccggtgtacgggaggtaggtttccgcgtgccaagcgtagagatcgtgacaccccagcttcctgccgtggagatcgaggaaggaagactcgagatgatcgagacaaaggtcaagccctcaagcaaattttccctccctaaatttgggctcagcggtccgaaagtcgctaaggcagaagcggagggcgccggaagagcaacaaagctgaaggtgtcaaagtttgctataagcctgccgaaagcccgcgtgggggcggaggcagaggcaaaaggcgccggtgaggctggtctgttacccgccctggaccttagtatcccacagcttagcttggatgcacacttgccgtcaggcaaagttgaagtcgctggcgcagacctgaagttcaaaggcccccgcttcgcgctgcctaagttcggggttagggggcgggataccgaagccgcagagctggtaccaggagtagccgagctggagggcaaggggtggggctgggacgggcgcgttaagatgcctaaattaaagatgcctagctttggactcgcccgcggcaaagaagccgaggttcaaggtgatagagcaagcccgggtgaaaaagctgagtcgacagctgtgcagctgaagattcccgaagtcgaactggttacgctcggcgcgcaggaggaaggccgtgcagagggcgccgttgccgtgagcggcatgcagctatctggactgaaagtgtcaaccgcaggacaggtggtgaccgagggacatgatgccggactccgcatgcccccgctaggcatctccctcccacaggtggaactcactggattcggtgaggcaggtaccccaggccagcaagcgcagtcaactgtgccttcggcagaaggcactgcagggtatcgcgttcaggtaccgcaggtaactctgtctctgcccggagcgcaagtggccggaggcgagctcctggtcggagaaggcgtctttaagatgccaaccgtgacagtgccacagctcgagctggatgtgggtttatctcgagaagcccaggctggagaagctgcaactggtgagggcggcctacggctaaaactgccaacgctcggagccagagccagagttgggggtgaaggcgccgaagagcagccaccaggcgctgagaggacattttgtttgagcctccctgatgtggagctgtctccgtcggggggcaatcacgcggagtaccaggtggccgagggtgagggcgaagcaggtcacaagctaaaggtgcggttgcccagattcggcctcgtccgcgccaaagaaggagctgaagaaggagagaaggcgaaatcaccaaaattgcgacttccacgggtgggattctcccagtccgaaatggtcaccggggaaggaagtccaagtcccgaggaggaagaagaggaggaggaggagggttccggggagggggccagcgggcggcgaggaagagtcagagtgcggctaccacgggtaggcttggccgcaccctccaaggcaagcaggggacaggagggggatgcagcaccaaaatcccccgtgagagaaaagtctccgaagttcagatttccacgggtcagcctcagtccaaaggcccgctccgggagtggggaccaggaagagggcgggctgcgtgtgagactcccatctgtgggattctccgaaaccggggcccctggtccggcaaggatggaaggcgcccaagctgccgctgtttag

SEQ ID NO: 128135 - DNA, 4191 bp, Artificial Sequence
  Description of Artificial Sequence: Synthetic coding sequence
atggaagcccgcagcagaagcgctgaggagttaaggagagcggagttagtggaaatcatcgtagagactgaggcccaaaccggagtgagcggcatcaacgtcgctggaggcggaaaagaaggcatctttgtgcgtgaactcagagaggactccccagcagcgcgaagcctctctttgcaggagggtgaccagctgctgtctgcacgggttttttttgaaaatttcaagtacgaggatgccctgaggcttctgcagtgtgccgaaccgtataaagtatcgttctgcttgaaaagaaccgtacctacgggggatctggccttgagaccaggaacagtatctggctacgaaattaaaggcccgagagctaaagttgccaagttgaacatacaatcactaagtccggtcaagaagaagaagatggtgcctggggcattaggggtgcctgcagacctcgcaccagtggatgtggaattcagcttccctaaattttctagacttaggcgcggacttaaagcggaggccgtcaagggccccgtccccgcggccccagccagaaggcggctgcagcttcctaggcttcgcgtacgcgaggtggccgaagaggcgcaggcagcgcgactggccgccgctgctcccccccccagaaaagccaaggtggaggctgaggtggcagcaggggcaaggttcaccgcccctcaggttgagctagttggaccccggttacccggcgctgaggttggagtgccccaagtgtcagcccctaaggcagccccatcggcagaagctgcgggcggattcgccctgcacctgcccacgctcgggctcggcgcaccagcaccccctgctgtggaggcacccgctgtagggattcaagttccccaggtcgaattgcctgcgttgccgtccctgccaaccctacctaccctgccatgtcttgaaacccgagagggagcagtgtcagtcgtcgtgcccacgttggacgtggctgcgccgacagttggtgtcgacctggcactccccggcgccgaagtcgaagcccgcggggaggcccctgaggtcgcccttaagatgccacgcctctcgtttcctcggttcggggcacgggcaaaggaagtggccgaagcaaaggtagccaaggtctctccagaggccagggtgaaggggcctagattaaggatgccaactttcgggctgtctcttctcgagccccggcccgctgcccccgaggtcgtggaaagtaaattgaaactccccactattaaaatgccaagcctcggtattggcgtgagcggccccgaggtcaaagtgcccaagggacccgaggtgaagctccctaaggcccccgaagtcaaacttcccaaggttcctgaggcagcattgcccgaggtccggcttcctgaggttgaattacctaaggtgtctgagatgaagctgcccaaggtaccagaaatggccgttcccgaagtacgacttcccgaggttgaattaccaaaggtgagtgaaatgaaactgcccaaagtccccgagatggctgtcccggaagtgagactccctgaggttcagctgttgaaagtcagtgagatgaagctaccaaaagtgccagagatggccgtgcccgaggtacggctgccggaagtgcagctcccgaaggtcagcgagatgaaactgcctgaagttagcgaagtggccgtgcctgaggtcagacttccagaagttcaacttccaaaggtgccggaaatgaaagtgcctgagatgaaactgccgaaggtgccagaaatgaagctgccagagatgaaattgcccgaggtccagctacccaaagtcccggaaatggctgtcccagacgtgcatctcccagaagtccagctgccaaaagtcccggagatgaaactgcctgaaatgaagctaccggaggtgaagctcccaaaggtgcctgaaatggctgtccccgacgtgcatcttccggaagtgcagctgcctaaagtgcctgagatgaagctacccaaaatgcctgagatggccgtgcccgaagttcggttgcccgaagtccagctccccaaagtctctgagatgaagctgcctaaggtccctgaaatggctgtcccagacgttcatctgcctgaggtgcagctgccaaaggtgtgtgagatgaaggttcccgacatgaagctccctgagattaaactccccaaagttcctgaaatggctgtgcccgatgtccaccttcctgaagtgcagttgcctaaggtcagcgagatcaggttgcccgaaatgcaagtgcctaaggtgccagatgtgcacctgcccaaagctccggaagtgaaactgccaagagcacctgaggtgcagctgaaagctacgaaagcagaacaagctgaaggaatggaatttggtttcaagatgcccaagatgaccatgccgaaactggggagagccgagtctccatcccgcggaaaaccaggggaagccggggccgaagtatccggcaagctggtcactctgccctgtcttcagccagaagtggacggagaggctcacgttggggtaccatccctcaccctccccagtgtggaactggatctaccaggtgccctgggtctgcagggacaagtgcctgctgctaagatggggaaaggagagagggttgaaggacccgaggttgccgccggcgttcgagaggtgggattcagagtaccttcagtggaaatagtgaccccacagctccccgccgtcgagatcgaggaaggtagactcgaaatgattgagactaaagttaagcctagtagcaaattttctctgccgaagttcggactctctggcccgaaggtggcaaaagccgaggccgaaggcgccgggagggcgacaaaactgaaggtgagcaaattcgccatatctctgccaaaagccagagtaggcgctgaggcggaagctaagggtgccggagaggcaggattgcttcccgccctcgatttgtctattccccagctgagcctggatgcgcatttgccatcaggtaaagtggaagtcgccggcgccgacctaaagtttaaagggccaagatttgcgctgccaaaattcggagtacgcggccgggataccgaagccgcagagcttgtgccaggcgtggccgagctcgaagggaagggatggggttgggacggacgcgtcaagatgccgaagctaaaggtttctactgctgggcaggtggtcaccgagggtcacgacgctggcctgagaatgcccccattgggaatttccttgccacaagtagagttaacaggcttcggggaggccggaacaccgggtcagcaggcccaatccacagttcccagcgcggagggtaccgctgggtatcgggtccaagtcccccaagtgactttgagcttaccgggggcccaggttgcaggcggcgaactattagtgggcgaaggcgttttcaagatgcccacggtcacagtgccacagctggagctggacgtggggctgtcacgggaggcacaggccggggaagctgccacaggggagggcggcttgaggctcaagctgcccactttaggcgctagggccagggtggggggggaaggcgccgaagagcagccccctggtgcagagcgcaccttctgcctgagcttgcccgatgtcgagctctcaccctctggcggcaatcacgctgaataccaggtggccgagggagaaggcgaggcagggcataaactgaaagtgcgcctaccacggttcggactcgtccgcgccaaggaaggcgctgaagaaggtgaaaaggctaagtcccctaagcttaggctgccccgggtaggcttcagccagagtgagatggttacaggtgagggaagcccgtcccctgaggaggaggaagaggaagaggaagaagggagtggggaaggcgcttcggggcggaggggcagggtcagagtgcgcctaccacgggtggggctggcagctccctctaaggccagccggggccaggaaggagatgccgctcccaaaagccccgtgcgggaaaagtccccgaaattccgttttcccagggtaagcctgtcaccaaaggctagatcggggtccggagaccaggaggagggggggctgcgggtgagactgcccagcgtgggtttctctgagacgggagccccgggaccagcccgaatggaaggcgctcaagctgccgccgtgtag

SEQ ID NO: 128136 - DNA, 2214 bp, Artificial Sequence
  Description of Artificial Sequence: Synthetic coding sequence
atggaggtggagcaggaacaacgccggagaaaagttgaggctggacggacaaaactggcccactttcggcagcgaaagacaaaaggggattctagccattcagagaaaaagacggccaaaagaaaggggtctgcggttgatgctagcgtgcaggaggaatctcctgtcacaaaggaggactccgccctctgcggggggggagatatctgtaagtcgaccagttgcgacgacaccccagacggcgctggcggagccttcgctgcgcagccggaggactgcgacggggagaagagagaggatcttgagcagcttcagcagaagcaggtgaacgaccaccctccagagcaatgtgggatgttcaccgtttcggatcaccctcccgagcaacacggcatgttcacggtgggcgaccaccctcccgaacaacgggggatgtttacagtatccgatcatcctcctgaacagagggggatgtttacaataagtgatcatcagcccgagcagcgtgggatgttcacggtgtctgaccacacacctgaacagagagggatattcacaatcagtgaccatcccgccgagcaacgaggcatgtttactaaggaatgcgagcaggaatgtgaactggccataacagatctggagtccggacgtgaggatgaagcagggcttcatcagtcacaagccgtccatggactcgagctggaagcccttcggttaagcctgtctaatatgcatactgcccagctagaactgacacaggccaatcttcagaaagaaaaagagacagccctgaccgagttacgggagatgttgaatagccggcgtgcccaggaacttgcccttctacaaagccggcagcaacacgaactagagctgctgagggagcagcacgcccgggaaaaagaggaagtggtccttcgatgcggccaggaagccgctgagctaaaagagaagctgcaatccgaaatggaaaagaatgcccagatcgtgaagactctcaaggaagactgggaatctgaaaaggatctttgtctcgaaaatctgaggaaggaactgagtgctaaacaccagtccgagatggaagatctgcaaaaccagttccaaaaggaactagccgagcagagagcggagttggagaaaatcttccaggataagaaccaagccgaacgggccctgcggaaccttgagtctcaccaccaggccgccatcgagaagcttcgcgaggacctgcagtccgaacacgggcgatgcctcgaggacttggaattcaagtttaaggaatccgagaaagagaagcagctggaactagaaaatctgcaggcttcatacgaggatttgaaggcgcagtcccaggaggagatccgtaggctgtggtctcaactggattcagcccgaacctccaggcaggagctctccgagctccatgagcaactgcttgcaagaacttcgcgtgtggaagatctcgaacagctgaaacagcgcgaaaaaacccagcacgagagtgagctggaacaattaaggatttactttgaaaagaaattgagggacgctgaaaaaacttaccaggaagatttgaccctgctccaacaacgacttcagggcgcccgggaggacgcgctgttagactctgtggaagtgggactaagttgtgttggactggaagaaaagcctgagaaaggccgaaaagaccatgtggacgagttagagcccgagagacataaggaatccctgccccgttttcaggcggagctggaggagtcccaccggcaccagctggaggccctggaatctcccctctgcattcagcatgaagggcacgtgtctgaccgatgttgtgttgagacaagcgccctgggtcacgaatggcgtttagagccctcagagggacactctcaggaacttccatgggttcatctacagggggtgcaagatggggacctggaagcggataccgagagggcagctcgggtgctggggcttgaaaccgaacacaaagttcagctgtcactgttgcagaccgaattgaaagaagagattgagttactaaaaatagagaacagaaatttatatgggaaacttcaacacgaaaccagactgaaagatgacctcgagaaggtgaaacataatctgatcgaggatcaccagaaagagcttaataatgctaagcagaagactgaattgatgaaacaggaattccagcggaaagaaacatag

SEQ ID NO: 128137 - DNA, 10011 bp, Artificial Sequence
  Description of Artificial Sequence: Synthetic coding sequence
atggaggtcgaacaggagcagaggcggaggaaggttgaagcggggcggacgaaactggcccactttcggcagcgcaagactaaaggagattcatctcactccgaaaagaagacagccaagcggaaaggcagcgcagtagacgccagcgttcaggaagagtcgccagtcaccaaggaggacagcgccctgtgcggcggaggggatatttgcaaaagcacttcctgtgacgacacccctgatggggcgggcggggcgtttgccgcccagccagaagactgtgatggggagaagcgcgaggatcttgaacagctgcagcagaagcaggttaacgaccatccccctgagcagtgtggcatgtttaccgtcagcgatcaccccccagaacagcatggtatgtttactgtgggcgaccacccccccgagcagcgcggtatgtttaccgttagcgaccaccctcccgagcagcatggaatgttcactgtaagtgatcatcccccagagcagcgcggaatgtttacaatttccgatcaccagcctgagcagagagggatgttcaccgtaagcgatcataccccagagcagagagggatttttaccatctctgaccatccggccgaacaaagagggatgtttacgaaggagtgtgaacaagaatgcgaactggccattactgatcttgaatccggacgcgaagacgaggcaggactgcatcaaagccaggctgttcatgggctcgaactcgaagcactccgcctgtccttgagcaacatgcacaccgcccagctggagctgactcaggcaaacctacagaaggagaaagagaccgcacttacggaacttagggaaatgctcaatagccgcagggctcaagaactggccttgcttcagtctcggcaacagcacgaactggaactacttcgcgagcagcacgcccgtgagaaagaggaggttgtactgaggtgcggccaggaggccgcagaactgaaagaaaaactgcagtccgagatggagaagaacgcccagatcgtcaaaactttgaaggaggattgggaaagcgagaaggatttatgtcttgagaaccttcggaaagagttaagcgccaagcaccagtccgaaatggaagatctccagaaccagttccagaaggagttggctgaacaacgcgccgaattagaaaaaattttccaagacaagaaccaggctgaacgcgcactgcggaatctggaatcacatcaccaggcagccattgagaagctaagggaggacctgcagagtgagcacggacggtgcttggaggatttggagttcaagtttaaagagtctgagaaggaaaaacagctggagctagaaaacctccaggcctcttacgaagacctcaaggctcaatctcaggaggagataagacgcctgtggtcgcagcttgatagcgcccggacgtctcgccaggaactttccgaattgcacgagcaattactggcaagaaccagtcgagtggaagatctcgaacagttgaagcaaagagaaaaaacccaacacgagagcgaactcgagcaattacgaatctattttgagaagaagctacgggatgctgagaaaacctaccaagaggacctcactctcctccagcagcgcttgcagggtgctagggaagatgctttactggattcagttgaggttggactgagctgcgttggcttagaagaaaagcccgagaagggacggaaggaccacgtagatgagctcgagccagaacggcacaaggagagtttgcccagatttcaggccgagctcgaagaaagccacaggcatcagcttgaggctctagagagtccactgtgcatccagcacgaggggcatgtttccgatcgatgttgtgttgaaacatccgctcttgggcacgaatggagactcgagccttcagagggacattcccaggagctaccctgggtgcatctccagggagtgcaggatggcgacctggaagccgacactgaaagagctgcccgggtgcttggtcttgagaccgagcacaaggttcaactcagcttgctgcagacagaactgaaagaggagattgagttattgaagatcgagaatcggaacctatatggaaaactacaacatgagacccgcttgaaggacgacctcgagaaggtcaaacacaatcttatcgaggaccatcagaaggagctgaataatgcgaagcagaaaactgagctgatgaaacaggaatttcagcggaaagagactgattggaaggtcatgaaggaagagctccaacgggaggcagaagaaaagcttactctgatgctgctggagctacgagagaaagctgagagtgagaaacagactatcattaacaaatttgagcttagagaggccgaaatgcgccagctgcaagaccaacaggccgcacaaatactggatctggaaaggtctttgaccgaacagcaaggacgcttgcagcagcttgagcaggatcttacgagcgacgatgctctccattgctcacaatgtgggcgtgagccgcctacagctcaagatggtgagctggccgcactgcacgtcaaggaggattgtgccctccagcttatgctggcccgcagtcgatttctcgaggagcgcaaggaaataacggagaagttttctgcggaacaggacgcattcctccaggaagcacaggagcagcacgcccgcgaactacagctcctgcaggagcggcatcagcagcagctgctgtccgtgaccgctgagctcgaggccaggcaccaggctgctctgggtgagctgaccgcttcactggagagcaagcagggcgcactcctcgcagccagggtggcggaactacagactaaacatgcagctgatctcggggccctggaaaccaggcacctgagcagcttagattccttggagagttgttacctgtccgaatttcaaacaatccgcgaggagcacaggcaggcgctagagcttttgcgggctgactttgaagaacagctgtggaagaaggattctctgcaccagacaatcctcacgcaggaactggaaaagttaaagcgcaagcacgagggagagttgcagagcgttcgcgatcatttgagaaccgaagtctccaccgaactcgctggcacagtggctcatgaactacaaggagtgcatcagggagagtttggttctgagaagaagaccgctctccacgaaaaggaggagaccttgcggctgcagtccgctcaagctcaaccatttcaccaggaggagaaggaaagcctctcgttacagttacagaagaaaaaccaccaggttcagcagttaaaggatcaggtgctgtctttaagccatgagatcgaagagtgcagatctgagctagaagtcttacaacagcgccgggagcgggagaatagggagggtgcaaatctgttaagcatgctgaaagcagacgtgaacctgagccacagcgaacggggtgcactgcaggatgcattgcgaaggcttctcggtctctttggcgagacactgagggctgcagtgacacttcgatcccgtatcggcgaaagggtcggtttgtgtctggacgacgcaggggccggacttgcccttagtacagcacccgctctggaagaaacttggagcgatgtggcactgcccgaacttgatagaacgctctccgaatgcgccgaaatgtcatcagtggcagagatttcatcacatatgcgggagtccttcttgatgagccccgagtccgttagagaatgcgaacagcccatacgccgcgttttccagagtctaagtctggccgtcgatggtctgatggagatggccttagatagctcacgacagcttgaggaggccagacagatccatagtcgattcgagaaggagttctcattcaagaacgaggaaacagcccaagtggtgcgcaagcaccaggagttgttagaatgtctgaaggaagaaagcgcagctaaggcagaactggcactcgagctgcataaaacccaaggaacgctggagggcttcaaggttgagactgccgacctcaaggaagtgctagcaggcaaagaggactccgagcaccgcctagtcctcgagctagagagtctccggcggcagctgcagcaggcagctcaggagcaggccgctctcagggaggaatgcacgagactgtggagtagaggggaggcaaccgccaccgatgccgaggcaagggaagcagcacttaggaaggaagtggaggatcttaccaaggagcagagtgagacaaggaaacaggcagagaaagataggtctgccctgctgagtcagatgaaaattttggaatccgaactagaggagcaactatcccaacaccgcgggtgtgctaagcaggcagaagccgtgaccgcacttgagcagcaagtcgcctctctagacaaacatcttaggaaccagagacagtttatggatgagcaagcagcggaaagggagcacgagagagaggaatttcagcaggagattcaaaggttagaaggacagctcaggcaagctgctaaaccccagccctggggaccccgtgattcacagcaagcacccctcgatggagaggttgaattgctccaacagaagctcagggaaaagcttgacgaatttaacgaactggccatccagaaggagtctgcagatcgccaggtgttaatgcaggaagaggagatcaagagactggaagaaatgaatataaacataagaaaaaaagtagcccagttacaggaggaagttgagaaacagaagaatatagttaagggactggagcaggataaggaagtgctcaagaagcagcagatgtcaagtctgctcctagcctctaccctgcagagcaccctggacgcaggaaggtgcccagaacccccgagcggctctccccctgagggaccggagatacagctggaggtgacccagcgcgcactgttgaggagggagtcggaggtcctcgatttaaaggagcagctggaaaaaatgaaaggagatctggaatctaaaaatgaggagattctgcaccttaacttaaagctggacatgcagaactcacaaaccgcggtctcactacgggagctcgaggaggaaaatactagcctgaaggtgatatatacccgaagctctgaaatcgaggagctaaaggccacgatcgagaacctccaggaaaatcaaaagcgtttgcagaaagagaaagcagaagaaatagaacaactgcacgaggtgatagagaaactgcaacatgagttgtcactcatggggccagtcgtccacgaagtctcagattcgcaagcaggttctcttcagagtgaactcctgtgttcccaggctggagggcctagagggcaggcactgcagggcgagctcgaggcagctctcgaagcgaaggaagcattgagtagactgctggccgatcaagagcggagacattcccaggccctggaagccctccagcagcgtctgcagggggctgaggaggcagcagagcttcaattggccgaattggagcggaacgtggccctacgtgaagccgaagtcgaagacatggcatcccggatccaggagttcgaagccgctctcaaggccaaggaagctactatcgccgagagaaaccttgaaattgatgccctcaatcagcggaaagcggctcactccgccgaactagaggccgtcctgctagctcttgccagaatccgccgggcgttggagcagcagcctctggccgccggagctgcacccccagaactccaatggctcagggcacaatgcgccagactctcgaggcagcttcaagtcctccaccagcgcttccttaggtgccaggtggaattagataggaggcaggcaaggagagccacagcacacacccgtgtgccaggtgcccacccccaaccccggatggatggcggggccaaggctcaggtaactggggacgtggaagcaagtcatgacgcagccctggagccggtggtcccagatccacagggcgacctccagcctgtcctcgtcaccttgaaagatgccccactgtgtaaacaggaaggagttatgtcagttttgactgtgtgtcaacgccagctacaaagtgagctgctgctcgtgaaaaacgaaatgagactttcgctagaggatgggggcaagggaaaagagaaggtcctggaagattgccaacttccgaaagttgatctggtggctcaggtgaaacaactccaggaaaaactaaacaggcttctatactcaatgactttccagaatgtggacgctgcagacaccaagagtctgtggcctatggccagcgcccatctgctggagagctcatggagcgatgattcctgcgacggggaggagccggatatctcgccccatattgatacttgtgacgcaaacacagcaacaggtggagtgacggacgtgatcaaaaaccaggctattgatgcatgtgatgccaacacaacacccggaggtgttactgatgtgatcaaaaactgggacagcttaatacctgacgaaatgcccgattccccgattcaggaaaagtctgaatgccaggacatgtccttaagttcacccacatcggtgctcgggggatctagacaccagagccatacagcagaggccggaccccgaaagagtccagtgggaatgcttgacctgtctagttggagctccccagaagtgttgaggaaagattggacactcgagccttggccaagcctacctgtgactccacattccggcgcattgtctctgtgctccgctgatacctccctgggggatcgcgctgacacttcgttgcctcagactcaaggcccaggcctgctctgtagcccaggtgtgtccgctgctgccctcgcgttacagtgggccgaaagcccccctgcagatgaccatcatgtgcagcgaacagctgtggagaaagatgtggaagacttcatcacgacaagctttgactcccaagagaccctctcaagtcctccacccggcttggagggtaaggcagacaggagcgagaagtcagatggcagcggcttcggcgccagattgagccccggcagtggcggtcctgaggcacagacagccggccctgtgacccccgcttcaatatccggcagattccagccattgccagaagctatgaaagagaaagaagttagaccaaagcacgtgaaggctttattgcaaatggtgcgggatgagtcacatcagatcctggccctgtccgaagggttggctcccccatcaggcgaaccacacccacctaggaaggaagatgaaattcaagacatcagtctccacggaggcaagacacaggaagtgcccaccgcttgtccggactggaggggcgatctgttgcaggtcgtgcaggaggcattcgaaaaggagcaggaaatgcagggtgtggagcttcaacctcggctctccggttccgacctggggggccattcctcattattagaacgcctggagaagattatccgggaacagggtgacctccaggaaaagtctttagaacaccttaggttacccgaccggagcagtcttctgtcggagattcaggctctgagagctcagcttagaatgacgcacctccaaaatcaggaaaagctgcaacacttgcgcacggccttgacaagcgccgaggcacggggatcccagcaagaacatcagttgcgccgacaggtggaactgctggcatacaaggtagagcaagagaagtgtatagccggtgacctgcagaaaaccctgtctgaggagcaagagaaggctaactcagttcagaagctgctggctgccgagcaaacagtagtgcgggatcttaaaagcgatctgtgcgagtctagacagaaaagtgagcagctgtcgagatccctgtgcgaggtgcagcaggaggtgctccagttgcgctcgatgctgtcctccaaggagaatgaactaaaagccgcccttcaggagcttgagtcagagcaggggaaaggccgggccctgcagagtcagttagaggaggagcagctacgccacctgcagcgggagtcccagtccgcgaaagcccttgaggaactgcgcgcctccttggaaacccagcgcgcacagagcagtaggctgtgcgtggctctgaaacatgagcagaccgccaaggacaatctacagaaggagctccgcatcgaacattctaggtgtgaagccttactggcccaggagagaagccagcttagtgaactccagaaagacctagcagccgagaaatcccgcactctggagttgtcagaggctctgaggcatgaaaggctcctgacagagcagctgtcccaacggacacaggaagcatgtgtgcatcaggacacccaggctcatcacgctctactgcagaaattaaaagaagaaaagtcccgggttgtcgatctgcaggccatgctagaaaaggtacagcagcaggcccttcactcacaacagcagctcgaggctgaggcgcagaagcattgtgaagccctccgccgggaaaaagaggtttctgccactctgaaatctacagtggaggccctgcacacacagaagagggagctgcgttgcagcctcgaaagggagcgcgagaaaccagcatggctccaggcagaactcgaacaaagccatcctcggttgaaagaacaggaagggaggaaggccgccagacgatctgccgaagctcggcaatcccccgcagccgcagagcagtggaggaagtggcagcgggacaaggagaagctgagagaactagagctgcaacggcagcgagacctgcacaaaatcaaacagctgcagcagacggtgcgggacctggaatccaaggacgaggtgcccggtagcagattgcatctcgggtcggctcgacgggcagcaggtagcgacgccgaccacctgagggagcagcaaagagagttggaagcaatgcgccaacggctcctctctgccgcgaggctcctgacatcatttaccagtcaggccgttgatagaacggtgaacgattggacctcttccaacgaaaaggccgtaatgtcactgctgcacacattggaagaactgaagagcgacctttctcgcccaaccagctctcagaagaagatggcagccgagctgcaattccaattcgtggacgtactcctcaaggacaacgtatccctgacgaaagccctgagtactgtaacccaggaaaagttggagctctcccgagctgtgtcaaaactcgagaaattgctcaagcatcatctccagaaaggatgttcgcccagccgaagtgaacgcagcgcctggaagccagacgagaccgccccccagtcatctctgaggcggccagaccctggacggctcccacctgctgcttcggaagaggcccatacgtccaacgtgaagatggagaagctttatctgcactacttgcgtgccgaatcgttccggaaagccttaatatatcagaagaaatatcttctgctccttattggtgggttccaggacagcgagcaggaaactttaagcatgatagcacacttgggagtcttcccttcgaaggccgagcgcaaaatcacaagcaggcctttcacccgttttcggacagctgttcgcgttgtcattgcgattctgcgattgaggtttctcgtgaaaaaatggcaagaggtagatcgcaagggtgccttggcccagggtaaagcccctaggcctggacctagagctcgacaaccacagtctccgcctaggactcgggaatcacctcctaccagagatgtgccgtccggtcacaccagggaccccgcccgaggaaggaggttggctgccgcggcgtctcctcacagcggcggcagagctactcccagtcctaatagtcgcctggagaggagcctgacggccagtcaggacccagagcactcactcactgaatatatacatcacttggaggtaatccagcagagacttggcggtgtgcttccagatagcacctcaaagaagtcctgtcaccccatgatcaaacagtag

SEQ ID NO: 128138 - DNA, 6075 bp, Artificial Sequence
  Description of Artificial Sequence: Synthetic coding sequence
atggctaccggcggcggtccctttgaggacgggatgaacgaccaggatcttcccaattggtctaatgaaaacgtggatgaccgacttaataatatggactggggcgcacagcagaagaaggccaacagaagttctgagaagaacaaaaagaagtttggggtcgaaagcgacaagcgcgtgacaaacgacatttcacccgaaagcagccctggcgtgggaagacgtcgaaccaagaccccccacacattcccgcacagtcgttatatgtcacaaatgtccgtccccgagcaggccgaattggagaagttgaagcaacggatcaatttttccgacctggaccaacgatccattggtagcgacagtcaggggcgtgccaccgcagcaaacaataaacggcagctatccgagaacagaaagcccttcaattttctccctatgcagattaacaccaataaaagcaaggacgcaagcaccaatccccctaaccgcgagactatcgggtctgctcaatgtaaggaactgttcgcctcagccctgagcaatgacctcctgcaaaactgtcaagtcagtgaagaagatgggagaggcgagcctgccatggagtcttctcaaattgtctcacggttggtccagatccgcgactacattactaaggcctcatctatgcgtgaggacctggtcgagaagaatgaaaggagcgccaacgtcgagagattgacgcatttgatcgaccaccttaaagaacaggagaaaagctacatgaaattcctgaaaaagatactcgcccgggatccacaacaggagcccatggaagagatagagaatctgaagaagcaacacgatctgctgaaaagaatgctacagcaacaggagcagctgagggccctgcaggggcggcaggccgctctgctggcgctgcagcacaaggccgagcaggctatcgctgttatggatgactccgtcgtcgctgaaacagcaggcagtctatctggggtgagcattacgtctgaactgaatgaagagttaaacgatctaatccagcgtttccataaccaattacgggattctcagccgccagcggttccggataatcgtcggcaagcagagtctctcagtttgactcgcgaggtgtcgcagagtcggaagccaagtgccagcgagcggctgccagatgaaaaggtggaactcttctctaaaatgagagtgcttcaggagaagaaacagaagatggataagctcctgggtgagctgcacactctacgcgaccagcatcttaataactctagcagcagccctcagaggtcggtggatcagcgttctacgtctgccccatcggcctcagtgggactggctccagtcgtcaatggcgagagtaacagcctgacgagcagcgtcccatatcctacagcttccctggtcagccagaacgagtcagagaatgaggggcaccttaatccatctgaaaagttgcagaagctaaatgaagtgcggaaacggttaaacgaactccgcgagctcgtgcactactatgagcagacaagcgacatgatgacagacgcggtcaacgagaaccgcaaggacgaggagacggaggagtctgagtacgactccgaacacgaaaattctgagccggtaacaaatattcgcaacccccaggtggcctccacctggaatgaagtgaatagccattctaacgcacagtgcgttagtaacaatcgcgacggacggaccgtgaattccaactgcgaaatcaacaatagaagtgcagctaatattcgagcacttaacatgccaccatccctggactgtaggtataatagggagggcgaacaggagatccacgttgcacagggcgaagacgatgaggaggaagaagaggaggctgaagaagagggcgtgagcggcgcttcgctctccagtcataggagctcactggtggatgagcatcctgaagatgccgagttcgaacagaagataaaccgcctgatggctgcaaagcagaaactccgccagctccaggatcttgtggctatggtacaggatgacgacgcagcccagggtgttatttctgcatctgccagcaatctggatgatttttaccctgcagaagaggataccaaacaaaacagcaataacacgcggggaaacgccaataaaacccaaaaggacaccggtgtgaacgaaaaggccagagaaaagttttacgaggcaaaattgcagcagcagcaacgggagttaaaacagctacaagaggaaagaaagaagctgatagacatacaggaaaagatccaggctcttcagactgcttgccctgatctgcagttgtctgccgcgtccgtgggaaattgcccaactaagaaatatatgccagcggtgacctccacccctactgtgaaccagcacgagactagtacgtccaagtccgtctttgaacccgaagatagctctattgtggacaatgagctttggtccgaaatgagaagacacgagatgttgagagaagaactgcgacaacgcaggaaacagctggaggcccttatggctgagcatcagcgaaggcagggactggctgaaaccgccagcccggttgccgtgtcattgagaagcgacgggagcgagaacctttgcactccccagcagagtcgaacagagaaaaccatggccacatggggggggtctacccagtgcgccttagacgaggagggtgatgaggacggttatctaagtgagggaatagtccgcaccgacgaggaagaggaagaggagcaggatgcttcaagcaacgacaatttttcagtctgccctagcaactctgtaaatcacaatagctataacggaaaggagaccaaaaatagatggaaaaataattgcccattttcagctgacgagaattaccggcccctggctaaaacacggcaacagaacatttccatgcaaagacaggagaacctccgctgggttagcgaattgagctatgtcgaggaaaaagagcagtggcaggaacagataaaccagctgaaaaaacagcttgatttctcagtgtccatctgccagactttaatgcaggaccagcagacgctgtcatgccttctccagaccttgctgaccggtccatactctgtcatgccctcaaacgtcgcgagtccacaggtacacttcatcatgcatcagcttaatcaatgttacacacagctcacctggcaacagaacaatgtgcaaagactcaagcaaatgcttaatgaactcatgcgccaacagaaccagcaccccgaaaagcctggaggcaaggagaggggaagtagtgcttcccacccgccttccccatccctgttttgcccattctcattccccactcagcccgtcaacctgttcaacattccaggattcacaaatttcagctcttttgctcccggcatgaacttctcaccactctttccttcgaacttcggggacttcagccagaacatctccactcccagtgagcaacagcagcccctggcccagaacagctccggaaagacagagtacatggcttttccaaaaccatttgagagttccagctcgataggggcggaaaagcctcgcaataagaaactccctgaagaggaggtcgagagctccaggacaccatggctttatgagcaggaaggcgaagtagagaaacctttcataaaaacaggctttagcgtgtctgtcgagaaaagcacaagttcaaaccgcaagaaccagctcgacaccaacggccgcagacggcagttcgacgaggaatctctcgaatcattcagctctatgccagaccccgttgacccgacgaccgtaacaaagacgtttaagactaggaaggcttcagcccaggctagtctagcaagcaaggacaagactccaaaatctaaaagtaagaaacgcaatagcacccagctcaagtcgcgggtgaagaatatccgatatgagtcggcaagcatgtcgtcaacttgcgagccctgcaaaagccggaatagacattccgcacagacggaggaacctgtgcaagcaaaggttttcagccggaaaaaccacgagcagctagaaaagattatcaaatgtaaccggtcgaccgaaatctcaagtgagacaggcagcgacttctctatgtttgaggcgcttagagacacaatttatagcgaagtggccaccctgatctctcaaaatgaaagtcggcctcacttcttaatagaactctttcacgagctgcaactgctcaataccgactaccttcgtcagagggccctgtacgccctgcaggacatcgtgtccagacatatatcagagagccatgaaaagggggagaacgtgaagtccgtcaatagtggcacctggatcgctagcaattcggaactgactccttcagaatcactggccactaccgacgatgagacgttcgagaagaacttcgaaagggaaacacataagatatcggagcaaaatgatgccgacaacgcaagcgtgttaagtgtgagctctaactttgaaccctttgctacggacgatttaggtaataccgtgattcatctagaccaagccctggctcggatgcgcgagtacgagaggatgaaaaccgaggcagagtctaactctaatatgcgatgcacatgccgtattatcgaggatggcgacggcgcaggggccggaaccacagtaaacaatctcgaggaaacaccagtgatagagaaccgatcatctcaacaacccgttagtgaggtcagtactattccttgcccccgtattgatacacaacagctggatcggcagatcaaggccattatgaaggaggtgattccctttctcaaggagcacatggacgaagtgtgtagttcccagctgttgacatcagttagacgaatggtgctgacattgacccagcagaacgatgagagtaaggagttcgtgaagttctttcataaacagctcgggtccattctccaagactcactggccaagttcgcaggtcgcaagttgaaggactgcggggaagacttattggtggagatctctgaggtactctttaatgagctggccttcttcaagcttatgcaggaccttgacaacaactcaataacagtgaagcaaaggtgtaaacgtaaaattgaggcaacgggtgtgatccagtcctgcgccaaggaggccaaacggattttggaggatcatggctcacccgctggggagatcgatgacgaggacaaggataaagatgaaacggagactgtgaaacagactcaaacctcagaagtttacgacggtcccaagaatgtgagatccgacatctcggatcaggaggaagatgaggagagtgagggctgccccgtgtctatcaatctctccaaggccgaaactcaggctttgaccaattacggatctggcgaagatgagaacgaggatgaagaaatggaggaattcgaagagggacccgtggacgtccagacatctcttcaggccaacactgaagcaactgaggaaaacgagcacgatgaacaagtgttgcagagagactttaaaaaaacagctgagagcaaaaatgtccccctcgaacgcgaggcaaccagcaagaacgatcagaataactgccccgtcaagccttgttacctaaacatactcgaggacgagcaaccgctgaattctgcagcccataaagagtccccgcccacggttgattccactcagcagccaaaccctctccccctacgactgcctgaaatggagccacttgtgcctcgcgtgaaagaggtaaagtctgcccaggagactccagaatccagccttgccggttcccccgatacagagtccccagtgctcgtgaacgattatgaggcagagtcaggtaatattagtcagaagtccgatgaggaggactttgtgaaggtggaagatttgccgctgaaactcaccatctatagcgaagctgatcttcgcaagaaaatggtggaggaggagcagaaaaatcacctctcaggcgagatttgtgagatgcagacagaggagctggctgggaatagcgagactctcaaagagcctgagacggtgggggcacagtctatctag

SEQ ID NO: 128139 - DNA, 1590 bp, Artificial Sequence
  Description of Artificial Sequence: Synthetic coding sequence
atggctactggaggcggacctttcgaagacggcatgaatgaccaggatcttcctaactggagcaacgagaacgtagacgatagactgaataatatggactggggcgcccagcagaaaaaagccaatcgctcttccgaaaagaacaaaaaaaaatttggcgttgaatcagacaagcgagtaacaaacgatatctccccggagtccagccccggggtggggcgtcggaggacaaaaacccctcatacctttccccatagtaggtacatgtcccaaatgtcggtgccggagcaggctgaactggaaaagcttaagcaaagaatcaactttagcgatctggaccagaggtctataggcagtgactcgcaggggcgcgccaccgctgccaacaataagcgacagctttcagaaaatcgcaagccctttaacttcctgcccatgcagataaacaccaacaaatcaaaggacgctagtaccaatcctccaaatcgagaaaccatcggaagcgcccagtgtaaagaactcttcgctagcgccctgtctaacgacctgctgcagaattgtcaggtgtcagaggaggacggtaggggcgagccggccatggagtcaagccagattgtgagccgtctcgttcaaataagagattatattactaaagcttcttctatgcgggaggatttggtagaaaaaaacgaaaggtctgctaacgtcgaacgcctaacccatctcatcgatcacttaaaggagcaggagaagtcatacatgaaattccttaaaaaaatccttgctcgggaaaatgaggaggaggatgtgcgcactattgactcagccgtcggttccggatcagtggccgaaagtacctccctcaatatagatgtgcagtccgaggcttccgatactaccgcccgtgatccccagcaagaaccaatggaggaaattgagaaccttaaaaaacagcacgacttgctaaaacgaatgctgcagcagcaggagcaattgagggctcttcaagggaggcaggctgctctgttagccttacagcacaaggccgagcaagcaatcgctgttatggatgattcggtggttgcggagactgctggcagcctctccggcgtcagcattacgtccgagttgaacgaggagctaaatgatttgatacagaggttccataatcagctcagggatagtcagccacctgcagtgccagacaacaggcgccaagccgagagtttgtcgctcacgagggaggtgagtcagtcaaggaaaccaagtgcctccgagcgccttcctgacgagaaggttgaactgtttagcaaaatgcgagttctgcaggaaaagaaacaaaagatggataaattgcttggagaactacatacattgcgggaccagcatctgaacaacagctcttctagtccccagcggtccgtcgaccagagatctactagtgccccaagcgcctccgtgggactagcgcccgttgttaacggggagtcaaactctctaacatcctctgtcccctatccgaccgccagcctggtctcgcagaatgagagtgagaacgagggccacctcaaccccagtgaaaaactgtag

SEQ ID NO: 128140 - DNA, 2172 bp, Artificial Sequence
  Description of Artificial Sequence: Synthetic coding sequence
atgagcagcacatgtgaaccctgcaaatcacgcaacaggcactcagctcagacagaggaaccagttcaggccaaagttttttctagaaagaatcacgaacagcttgagaaaattatcaaatgcaaccggagtacagaaatcagcagtgcacacgctcgcagaattcttcaacagtctaatagaaatgcgtgcaatgaggctcctgagacaggctctgatttctcaatgtttgaggcactccgtgacactatctattccgaagtagctactttgatttcccagaacgagagcaggccccacttcctgattgagctattccacgaattgcagcttttgaatactgattacctacggcagcgagctctgtatgcactgcaggatattgtgagcaggcacatctccgaaagtcacgagaagggagaaaatgtgaagagcgtaaatagcggaacatggattgccagcaactctgaactgacgccaagtgagtcactggccaccactgacgacgagacattcgagaagaactttgagagagaaacccataaaattagtgaacagaacgacgccgacaatgcatctgtgctcagtgtctcatcaaatttcgaaccgtttgcaaccgacgatctaggaaacacagtgatacacttggaccaggcacttgcacgaatgcgggaatacgaacgcatgaaaacagaggcagaatctaactccaatatgcgttgcacttgtaggatcatcgaggatggcgatggtgccggagctggaactaccgttaacaatctcgaggaaactccggtcattgagaatcgtagcagtcagcagcccgtttctgaggtcagcaccatcccctgtccgcggattgatacccagcaactggacagacagatcaaagccatcatgaaggaggttattccattcttgaaggagcatatggatgaagtgtgtagcagccaactccttacttctgtgagacggatggttctgaccctgactcagcagaatgatgaaagcaaggagtttgtgaagttctttcacaaacagctgggaagcatcttacaggatagcctggcaaaatttgctggccggaagctgaaggattgtggtgaggacctgctggtcgaaatcagcgaggtgctcttcaacgaactagcattcttcaagctgatgcaagacctggataataactctattacagtaaagcagcgttgcaaaagaaagattgaggcaacaggcgtgatccagtcttgcgcaaaggaggctaagcgaattttggaggatcatggctcccccgccggcgaaatcgacgatgaagacaaagacaaagatgagactgagaccgtgaagcagactcaaacctctgaggtgtacgacggaccgaaaaacgtgagaagcgacatatccgatcaagaggaagacgaagagagcgagggctgcccagtgtccatcaatttatccaaggccgagactcaggcacttaccaattacgggagcggcgaggacgagaatgaggatgaggaaatggaagaattcgaggaaggccctgtcgacgttcaaactagtcttcaggctaataccgaggctacagaggagaatgagcacgacgaacaggtgctgcaacgggattttaaaaagactgccgagagtaaaaacgtccctcttgagcgcgaggcgacctccaagaacgaccaaaacaattgtcctgtcaaaccctgctatctgaacatactggaggacgaacagcccctgaactccgcagcccataaggaaagtcctcctactgttgatagtactcagcagcctaaccccctgccccttcggctgccagagatggagcccctcgtgcctcgcgtgaaggaggtgaaaagcgcccaggagacgcccgagtcgtcactcgcaggatccccggacactgaatcaccagttctggtcaacgactacgaggccgagagtggtaacatcagccaaaagtccgacgaggaagacttcgtgaaagttgaggacctgcccctcaaactcacaatttatagtgaggccgatcttcgaaaaaaaatggtggaggaagaacagaagaaccacttgtcgggcgaaatttgcgagatgcagaccgaggagctggccggtaacagtgagacactgaaagagccagaaacagtaggagcgcaatccatttag

SEQ ID NO: 128141 - DNA, 2295 bp, Artificial Sequence
  Description of Artificial Sequence: Synthetic coding sequence
tagaaagcttccgcccaggcctctctcgcatccaaggataaaactcccaagtccaaatcaaaaaaaagaaattctacacagctcaagtccagagttaagaatatcaggtatgagtccgcctctatgagctccacttgtgaaccatgcaaaagcagaaatcggcacagcgcgcagaccgaagagccagttcaggcgaaagtgttttcccggaagaaccacgaacaactggagaaaattattaagtgcaatagaagcaccgagatttcatcagcccatgcccgacgcatcctacagcagtcaaatcgaaacgcatgcaacgaagcacccgagaccgggagcgactttagtatgttcgaggctttgagagataccatctactctgaagttgctactctgatttcacagaatgagagtcggccacactttctaatagagttgtttcacgagcttcagcttctgaataccgattatctgagacagagagcattatatgcccttcaggatattgtatccaggcacattagcgaaagtcacgaaaagggcgaaaatgtgaaatctgtgaattccggcacatggatcgcttccaactcagagttaactcccagtgaatccctggccacgacagatgacgaaactttcgagaaaaattttgagagggaaacccacaaaatcagtgagcaaaatgatgcagacaatgcatccgtgctgtccgtgtcgtctaactttgaaccctttgctacggatgacctcggaaacaccgtcatccacctcgaccaggcacttgcacgcatgagggagtatgagcggatgaagacagaagcagagagcaactcgaacatgagatgcacctgccgcatcattgaggatggagacggcgctggcgccggtactactgtgaataaccttgaagaaacccccgtcattgaaaaccgaagcagccagcagcccgttagcgaggtttcaaccattccctgtccaagaattgatacccaacagctagacaggcagatcaaggcaattatgaaggaagtaatacctttccttaaggagcacatggatgaggtgtgctcttctcaactgttgaccagcgtgcggcggatggtactgacactgacccagcaaaatgacgagtcaaaggaattcgtgaaattctttcacaagcagctcggaagcatcctccaggacagtctggcaaaatttgctgggcggaaactgaaggactgtggggaagatttgcttgtggagatctcagaagttctgttcaatgaattagcattctttaaacttatgcaggatctcgataataatagcattacagtgaagcaaagatgcaagcggaagattgaggccaccggagttattcagtcctgcgccaaagaggcaaaaagaattttggaggatcatggatcacccgctggtgagattgatgatgaggacaaggataaggacgaaacagagactgtgaaacaaacacagacctctgaagtgtacgatggccccaagaatgtacgtagcgacatttccgaccaggaagaggatgaggaatcagagggatgtcccgtttcaatcaatctctcaaaagctgagacacaggccttgacgaattacggctctggagaagacgagaatgaggacgaggagatggaagaattcgaggaggggcctgtagatgtgcaaacaagcctacaagctaacaccgaggctaccgaggagaacgagcatgatgaacaggttttacaaagagactttaaaaagaccgctgagtcgaaaaatgttccgctggaacgagaggcaaccagcaagaacgaccagaacaattgccctgtgaaaccatgctacctgaatatcttggaggacgaacaaccgctcaattctgccgctcacaaggaatcaccccccacagtggacagtacgcagcagcccaaccccctgcccttgcgcctccctgaaatggaacccctggtgcctcgcgtgaaggaggtgaaatccgcccaagagactcctgagagtagcctggcaggatcacccgacacggaatctcctgtgctcgttaatgactacgaggcggaaagcggaaacatcagtcagaagtcagatgaagaggattttgtcaaggtggaggacctgcccctcaagctaacaatctactcagaagcggatctgcggaagaaaatggtggaagaggaacagaaaaatcatctgtccggtgaaatctgcgagatgcagaccgaggagctggctggaaattctgaaactctcaaagagcccgagacggtgggggctcagtccatttag

SEQ ID NO: 128142 - DNA, 1227 bp, Artificial Sequence
  Description of Artificial Sequence: Synthetic coding sequence
atggcaaccggcggaggcccattcgaagacgggatgaacgatcaagatctccccaattggtccaacgagaacgtggacgatcggctcaataacatggattggggggcccagcagaaaaaagccaatagaagcagcgaaaagaataagaagaaattcggagttgagtccgacaaaagagtgaccaacgacatttcaccggagagctcacccggagtggggagaagaagaacaaaaaccccacacacctttcctcattcaagatacatgtcccagatgagcgtgcccgaacaggccgaactggagaagctgaaacagcgcatcaacttctccgacttagatcagcggtctatcggctcagatagccaggggagagctactgcagctaacaacaaaagacagctatccgagaatagaaaaccattcaactttcttcccatgcagatcaacactaataaaagtaaagacgcttctaccaaccccccaaacagagaaacaattggcagcgctcaatgtaaggagctcttcgcaagtgctctgtctaatgatctgttgcagaattgccaggtctctgaggaagacggacgcggcgagcctgccatggaatcgtcacagatagtgtcacggctggtgcaaattcgcgactatatcacaaaagcttctagcatgagggaggatcttgtggaaaaaaatgagcgaagcgcaaatgtggaacgcttaacccacctgatcgatcatttaaaggagcaggagaagagttacatgaaatttctcaagaagattctggcgagggatccgcaacaggagcctatggaagaaatcgagaatctcaaaaagcagcatgatcttctgaaaaggatgctgcagcaacaagagcagctaagggccctgcagggaaggcaagcagccctcttggccctgcaacacaaggcagagcaggccattgctgttatggatgattcagtcgtcgccgagaccgccggttccctcagcggcgtgtctattacctccgagttaaatgaagaactgaatgacttgattcagagattccataaccagctccgggatagtcaaccacctgccgtgcccgataatcggcgccaggctgagtccttgtctctcacaagggaggtatctcagagtcggaaaccttctgcctccgagcgactgccggatgagaaggtggagctcttctcaaagatgcgggtgcttcaagaaaagaaacagtag

SEQ ID NO: 128143 - DNA, 1569 bp, Artificial Sequence
  Description of Artificial Sequence: Synthetic coding sequence
atggccgtaaacaagggactgaccctgctcgacggagacctgcctgaacaggaaaatgtgctgcaaagagtgctacagctgccagtggtttcaggaacctgtgagtgcttccagaagacatacacctcaactaaagaggctcatccactggtggctagcgtctgtaacgcttatgagaagggcgttcaaagcgcctccagcctggccgcctggtcgatggagcctgttgttcggaggctgagcacccagttcacggctgcgaatgaactggcctgcagagggctcgaccaccttgaggaaaaaataccagctctccagtatccacccgaaaagattgccagtgagcttaaagatacaatctctacgagactgcgctccgcgagaaacagtattagcgtgcccattgcttctacaagcgacaaggtgctgggggccgcactggccggctgcgaacttgcctggggagtggccagagacacggcagaattcgctgcaaatacacgggcaggccgtcttgcctccggcggtgccgatctggcactcggatctattgagaaggttgtggagtacctcctgcctccggataaggaggaaagcgctcctgcccccgggcaccaacaggcgcaaaagagtcctaaagccaagcctagtctgctttcacgagttggagccctgacaaacaccctatcgcgatacaccgttcagaccatggccagggctctggagcagggtcacacagtcgcgatgtggatccccggtgttgtacccctgagtagcctggcacaatggggagcctccgtagcaatgcaggcagtgtcccgtaggagatccgaagttagggtgccgtggctgcacagcctcgcggcagcccaagaggaagatcacgaagaccagactgatacagagggggaggacaccgaggaggaggaggagcttgagactgaagaaaataagttctctgaagtcgctgctcttcctggcccgcggggtctccttggcggagtcgcccacacactccagaagaccttacagaccaccatttctgccgttacctgggccccagccgcagtgctgggcatggctggcagggtgctgcatcttacacccgcgcctgctgtctcttctaccaaagggcgggccatgtctctgtccgacgccctgaagggcgtgactgataacgtcgttgacaccgtcgtgcattacgtccccctcccgcgcctgtccctaatggagccagaaagcgagtttcgcgatattgacaatccgcccgcagaggtcgaaaggcgggaggcagaaagaagggcctccggcgcaccctccgctggacccgagccagcaccgaggctggcccagcccaggcggtccttgcgaagtgctcaaagcccaggagctccccctggacccggccttgaggacgaagtggcaactccagcagcgccccgaccagggttccccgccgtgccacgtgagaaacccaaacggagggtgagtgattcgttcttcaggccatcggtgatggaaccaatcctggggcgcacccattacagtcagctgaggaaaaaatcttag

SEQ ID NO: 128144 - DNA, 1569 bp, Artificial Sequence
  Description of Artificial Sequence: Synthetic coding sequence
atggctgtgaataaaggattgacgctactggacggcgaccttccagaacaggagaatgtgctgcaacgggttctgcagctgcctgtggtgagtggaacctgcgagtgtttccagaagacctacacttctactaaagaggcgcaccccctagtggctagcgtctgtaacgcttatgaaaagggagtgcagtcagcctcctcactggccgcttggagcatggagcccgtggtcaggaggctgtccacccagttcaccgccgcgaatgaactcgcatgccggggactcgatcatctggaagagaagattcccgccttgcagtatcctcctgaaaagatcgcctcagagctgaaggatacgatttctaccaggctgcggtcagcacgaaattcaatatccgttcccatagcgtctacatctgataaggtcttaggtgccgcccttgccgggtgcgagctggcctggggagtggcccgagacactgccgaattcgcagctaacacccgcgccggacggctagcgagcggaggagcagacctggcgcttggcagtatcgagaaagtggttgaatacctgctcccaccggacaaggaggaatcagccccggcccctggccaccagcaggcacagaagtcaccaaaagctaagccgagcctcctttcaagagtgggagctcttaccaacactctgtccaggtacaccgtgcagaccatggcacgcgctcttgagcaaggacatactgttgctatgtggattcccggtgtcgtccccttgagctcattggcacagtggggcgcttcagttgctatgcaggccgtgtctagacgcagatccgaggttcgggttccctggctgcatagtttggccgcagcccaggaggaggaccacgaggaccagacagacaccgagggcgaagatacagaggaagaggaggaattggagactgaggagaacaaatttagtgaagtcgccgccctgccaggcccacgcggcctgcttggtggggtcgcacacactctgcagaagacccttcagacgacaatcagcgctgttacctgggccccagctgccgtgctgggcatggctggccgggtgttgcatctaacacccgctccagctgtgagttccaccaaaggcagggccatgagtctttctgacgcccttaagggcgtgacagataatgtggtagacacagtggtgcactatgtgccgttaccccggttgtccttaatggaacccgagtccgagttccgggacatcgacaatccacccgcggaggtcgagcgaagagaggcggagcggagagccagtggggccccgagtgctggccctgaacctgcacccaggctggctcaacccagacgcagcttacggtccgcccaaagccctggggcgcctcccggtccagggctggaagatgaggtggccaccccggctgccccacggcctggattcccggccgtcccccgagagaaaccaaaaagaagggtgtccgactctttctttcggccctccgtaatggagcctatactgggcaggactcactattctcagctgcgcaagaaatcctag

SEQ ID NO: 128145 - DNA, 1314 bp, Artificial Sequence
  Description of Artificial Sequence: Synthetic coding sequence
atggcgagtgttgctgttgatccccagccatccgtagttactagggtggtcaatttgcctctggtctctagtacatatgacctgatgtcttctgcatacctcagcactaaggaccagtacccttatctcaaatctgtttgcgaaatggcagagaatggtgttaaaactatcacgagcgtagccatgacctccgctttgccaatcatacagaaactcgagccccaaatcgccgttgccaacacttacgcatgtaagggacttgatcgaattgaggaacgcttaccaattctcaatcagccctccacccagatagtggcgaatgccaagggcgcggtgacgggcgcaaaggacgcagtcaccactaccgtcacaggggcgaaagacagcgtggcgtccacaattacgggggtcatggataagactaagggggcagtgaccggcagtgtggaaaagacaaagtccgttgtttctgggtccatcaacactgtgcttggcagtaggatgatgcaactggtgtcctctggtgtggaaaacgcccttacaaagtcagaactgctcgttgagcagtacctgcccctcactgaggaagagctggagaaggaggccaagaaggtcgaggggttcgacctcgtccagaagcccagttactacgtgaggttggggagtctgtcaacaaagcttcacagccgtgcttatcaacaggctctatcccgagtaaaagaggctaagcagaagagccagcagaccatttcccaactgcattccacagtacaccttattgagttcgccaggaagaacgtgtactccgctaatcagaagattcaggatgcccaagacaagctgtacctgagttgggtcgaatggaaacgctccattgggtacgatgataccgacgaatcccactgcgctgagcatatcgaaagcagaacactggctatcgcccgtaatctgacacaacaacttcagacaacctgtcatacgttgctgtccaatatacagggggtcccacaaaatatccaggaccaggcaaaacatatgggggtgatggcgggtgatatttactcggtttttagaaatgcagcgtcatttaaggaagtcagcgatagtctcctgacctcttccaagggccagctccagaagatgaaagaaagcctggacgacgtaatggactacttggtcaataacactccgctgaactggctggtgggaccattttacccacagctgaccgagtctcaaaacgcccaggaccagggcgccgagatggataaatcaagtcaagagactcagcggagcgaacataagactcactag

SEQ ID NO: 128146 - DNA, 333 bp, Artificial Sequence
  Description of Artificial Sequence: Synthetic coding sequence
atggcatcggttgcagtcgacccacagcctagtgtcgttacccgcgtcgtaaacctaccattagtgagcagtacatacgatcttatgtccagcgcctatttgtccactaaggatcagtatccttatctgaagtctgtgtgcgagatggccgagaatggcgtaaaaacaataacatcagttgccatgacatccgccctgcccattatccagaagctggaacctcagattgccgtggcgaatacctacgcatgtaagggcttggaccgtattgaagagaggctgccaatcctgaatcagcccagcacacaggtgtctcttgggcaaaaatgctag

SEQ ID NO: 128147 - DNA, 381 bp, Artificial Sequence
  Description of Artificial Sequence: Synthetic coding sequence
atggccagcgtcgcagtggatccgcagccctcagtggtcacaagggttgtaaatctgcctttggtgagctccacttatgacctgatgtcctctgcctatctgtcaactaaagaccagtacccatacctcaaatccgtctgtgaaatggcagaaaatggtgttaaaactatcacatctgtggccatgacaagtgctctccctataatacaaaaactagaaccacagatcgccgtggcgaatacctatgcctgtaaggggctggatcgaattgaggaacgcctgccgattttaaaccagccgtcaacgcaggcgaatacgtgcttccccaatttggatctggacgtgtgcctgaaaaacaatggccactttctgaccagctag

SEQ ID NO: 128148 - DNA, 1071 bp, Artificial Sequence
  Description of Artificial Sequence: Synthetic coding sequence
atggcaagcgtggccgtggacccccagccctcggttgtgacaagggtagttaatctgccactggtgagttccacctatgacctcatgagctcagcctatctctcgacgaaagatcagtacccctatttgaaatccgtgtgcgagatggcagagaacggagtgaagacaatcacctcagtggctatgaccagcgccttaccaatcatccagaaactcgagccacagatcgcagtcgcaaatacgtacgcatgtaaggggttggatcgaatagaggagaggttgccaatactcaaccaacctagtactcagatcgtggctaacgctaaaggagctgtcaccggagccaaggatgcagtgacaaccacggtgaccggggccaaggactcggtcgctagcacaatcactggggtcatggacaaaaccaagggagccgtgacaggatcagtcgaaaaaacaaaaagtgtgaagaagaaacagaaaaagcttaaggatcttatctggtttcgctcccagcttcactccaccgttcacctaattgaatttgcgcgcaaaaatgtgtattcagccaaccaaaagatccaggacgcccaggataaactctacctgtcttgggtcgagtggaaaagatccattggctacgatgacacggacgaatcccactgtgccgaacatatcgagagtcgtacccttgcgattgcgcggaatcttacgcagcagttgcagacgacatgtcatacacttctgagtaatattcagggtgtgccccagaacatccaggatcaagctaagcatatgggagtaatggccggagacatctattccgtctttagaaacgctgccagtttcaaagaggtctcagattccctgctgacttccagtaaaggccaactgcaaaagatgaaggaaagcctcgacgatgttatggattaccttgttaataatacaccgttgaactggttggtagggccgttttacccacaactgaccgagagccagaacgcacaggaccagggcgccgagatggataaatcttcccaggaaactcaaaggtcggaacacaaaacacattag

SEQ ID NO: 128149 - DNA, 378 bp, Artificial Sequence
  Description of Artificial Sequence: Synthetic coding sequence
atggccagcgtggccgtggaccctcagcccagtgtggtgactcgcgtggttaatctacccctggtcagttcaacctatgacctgatgagcagtgcttaccttagcactaaagaccagtacccttacctgaaatctgtttgtgagatggcagagaatggcgttaagaccatcaccagtgtggctatgacctcagcccttcctatcattcagaaacttgaaccccaaatcgcggtggcaaacacgtacgcctgtaaaggccttgatcggattgaagagcggctaccaatccttaaccaaccatctacgcaaatcgtggctaatgctaagggcgcggtgaccggggcaaaggacgccgtcacaactacagttactggttag

SEQ ID NO: 128150 - DNA, 735 bp, Artificial Sequence
  Description of Artificial Sequence: Synthetic coding sequence
atgggaccaccttcagccgcaccacgcggaggacacaggccttggcaagggctgctgattacagccagcctgctgacattctggcatccaccaacaacagtccagtttaccatcgaagcgctcccgtcttccgcggccgagggtaaagatgtgctcctcctggcctgcaatatctctgagaccattcaggcctactactggcacaagggcaaaacggccgaaggctcccctttgattgccggctacatcactgacatccaagccaatatcccgggtgctgcctatagcgggagggaaacagtctaccctaatgggtctctgctctttcagaacattacgttggaggacgctgggagctatacgcttagaacaatcaatgccagctacgactctgatcaggccaccggccagctgcacgtgcatcagaataacgttcccggcttaccggtgggggccgtggccggaattgtgacaggagtcctggtcggtgttgccttggtggccgcactggtctgctttttgctgcttagtaggactggtagggcttcgatccagagagacctgcgcgagcagcctcctcctgcatccacacccggtcatggcccttcacaccggtctacttttagcgccccattgccaagcccccgtacagcaactccaatctacgaagaactgttgtattccgacgctaatatctactgtcagatcgatcataaagctgatgtggtgagctag

SEQ ID NO: 128151 - DNA, 1269 bp, Artificial Sequence
  Description of Artificial Sequence: Synthetic coding sequence
atgtctgcagacggcgccgaggcggatggatcaacccaggttactgtggaggagccggtccagcagccgagtgttgtggacagagtggccagtatgcctctgatttctagcacttgcgacatggtgtcagcggcgtatgcttctaccaaagaaagctaccctcatatcaaaacagtctgtgacgcagccgaaaagggagtgagaacactgactgcagctgcagtctcgggtgctcagccaatcctgtcaaaactggagccgcagatcgccagtgcttcagagtacgcacacaggggccttgacaaactggaagagaacctccctattctgcagcagccgacggaaaaggtcagtggcgcccaagagatggtttcttcagctaaagataccgtggcaacacaactctcagaagcagtcgatgccaccaggggggctgttcagagcggggttgacaaaacgaagtcagtggtaactgggggagtccaaagcgtgatgggcagcaggctcggccaaatggtgctttcaggtgtcgacacagttctgggcaagagtgaggaatgggccgacaaccacctgccgctaacggacgccgagctggcgcgcatcgctacttcactggacggttttgatgtcgcatcagtgcaacagcagaggcaggagcagtcttactttgtcaggttgggttcactttcggaaaggctgcgtcagcacgcttatgagcactcgctcgggaagctgcgtgccacgaagcagcgtgctcaggaagctctcctgcagctatcccaggtgctttcactgatggagaccgtcaagcagggagtggatcagaaactcgtcgaggggcaggaaaaactccatcagatgtggctgtcctggaaccaaaagcagttgcagggcccggagaaagagcctccgaagcctgagcaggtggaatcacgggcattgaccatgtttcgcgacatcgcacaacagttgcaggccacatgcacatccctgggcagcagtatacaaggactgcctacaaatgttaaggatcaggtgcaacaggctagacgccaggtggaggatctgcaagccactttcagctctattcactcttttcaggatctcagcagttcgattctggcacagtctcgcgagagggtggcatcagcgcgagaagctctcgatcatatggtggaatatgtagctcaaaacaccccggttacctggctggtgggcccgttcgcgcctggaataaccgagaaagcgcctgaggagaagaagtag

SEQ ID NO: 128152 - DNA, 1392 bp, Artificial Sequence
  Description of Artificial Sequence: Synthetic coding sequence
atgtcagaggaagaagcagcccagattccacgaagctctgtttgggagcaagaccagcagaacgtggttcaacgtgttgttgccctgccactcgtacgagccacttgcacggccgtgtgcgacgtctattccgccgccaaggatcgccatccactgctcggatctgcctgccgattagccgagaattgcgtctgtggattgacgacaagggccctggatcacgcccagcctcttctggagcatctgcaaccccagctcgctactatgaattctctagcctgcagagggctcgacaagctcgaagaaaagctcccctttctgcagcagcccagcgaaaccgttgtgacctcggcaaaggatgtggtcgcaagtagtgtgaccggtgtggtcgacctcgccaggcgcggtcggcggtggagcgtggagctcaaacggagcgtgtcccacgcagtagacgtggttctggagaaatccgaggagttagttgatcattttttgcccatgacagaagaagaactggccgcattggccgccgaggccgagggtcccgaggtggggagtgtggaagaccagaggcgccagcaaggatatttcgtgcgtttgggatccttgtccgccaggattagacacctcgcatatgagcattccgtgggaaaacttaggcagtccaagcacagggcccaggacacattggcccagctccaagaaactctggagttgatcgatcatatgcaatgcggcgtgacccccaccgctcccgcatgtccgggcaaggtgcatgagctatggggcgaatgggggcagaggcccccagaaagcagacgacgttcacaggctgagctcgaaaccctggtcctgtcccgaagcctgactcaagagttacaggggaccgtggaagccctggagagttctgtgcgggggctgcctgccggagcacaggagaaggttgccgaagtacgcagaagcgttgacgcactacagaccgcctttgctgacgcaaggtgctttcgggacgtgcccgccgccgccctggcggaaggcaggggaagggtggctcacgcacatgcctgcgtagacgagttgcttgaactggttgttcaggctgttccgctgccatggctggtcggtcctttcgcccccatacttgttgagagacccgaaccactcccagatctagcagacttagtagatgaggtgattggtggccccgatccgcggtgggcacacctggactggccagcccagcagcgcgcctgggaagcagagcacagggatgggagcggaaacggtgatggcgataggatgggtgtggccggcgacatctgcgaacaggaacccgagaccccctcctgccccgtgaaacataccttgatgccagaattagacttctag

SEQ ID NO: 128153 - DNA, 3768 bp, Artificial Sequence
  Description of Artificial Sequence: Synthetic coding sequence
atgaacggttatgccgagtttccaccaagcccatccaatccaaccaaggaaccggtggaaccgcagcccagtcaggtgccactgcaggaagatgtggacatgtcctccggaagcagtggccacgaaaccaatgagaactgctcaaccggacgggatagtcagggatcagactgtgacgattctggtaaggagctgggtatgctggtggagcccccggacgcaaggcagagccccgataccttttcactgatgatggcgaaatctgagcataacccgagtacgagcgggtgcagctcagatcagtctagtaaggttgacacccataaggagctgattaagacattgaaggaattgaaggtgcacttaccagccgataagaaggcaaagggaaaggcctcaacccttgccaccctgaagtacgccctgcgctcagtgaagcaagtgaaagccaacgaggaatattatcagttgttaatgagctcggaggggcatccctgtggggccgatgtcccctcctataccgtagaagagatggagtccgtcaccagcgagcatatcgtgaagaacgcagacatgtttgccgtggctgtgagccttgtaagcgggaagatcttatatatctcggatcaagtggcctccatatttcactgcaagcgggatgccttctcggacgctaagtttgttgaatttttggcaccacacgatgttggagtcttccactcctttacttccccctataaactacctctttggagtatgtgttccggtgcagattcctttacacaggaatgcatggaagagaagtcttttttttgtagggtgagcgtgaggaaaagccacgagaacgagatccggtatcaccccttcaggatgacgccctacctggttaaagtgagagaccagcagggagccgaatcacaactctgctgtctgctattggctgaaagggtccactccggctacgaagctccaaggatcccccctgaaaaacgaatcttcacgaccacacacacaccaaactgccttttccaagatgttgatgagagagctgtgccactcctgggctaccttccacaagacctgatcgaaactcccgtcctcgttcaactgcatccttctgatcggcccttgatgttggccatccataagaaaattctccagagcggcggtcagcccttcgattacagtccaattagattccgtgctcgaaacggagagtacattacattggatacttcatggtctagcttcatcaatccctggagccgaaagattagcttcatcataggacggcacaaggtgagagtaggccccctgaatgaagatgtgttcgcagcccacccttgtacggaagagaaggctttgcacccctccattcaggaactgacggaacagattcatcggctgctgttacagcccgtgccccactctgggtctagcgggtacgggtccctggggtccaatggctctcacgagcacctgatgtctcagacctctagttccgactctaatggccacgaagatagtcgtcgccggagagccgaaatttgcaagaatggtaataagacaaagaacagatcccattacagccacgagtccggagagcagaaaaagaagtctgtcactgaaatgcagactaatccgcccgctgaaaagaaagctgtgcccgccatggagaaggatagtctgggcgtgagcttccccgaggaacttgcgtgcaaaaatcaaccgacttgctcttatcagcaaatcagctgcctggacagtgtcatccgctatctggagtcttgcaatgaggccgccacactgaaacgcaagtgtgagttccccgctaacgttcctgccctgaggtcttctgacaaacggaaggctaccgtatctcctggcccccacgctggagaggccgagccaccatcccgggtcaattctagaaccggcgtcggaacccacctcacttccctggccctccccggcaaggctgagtctgtagcatctctgacatcacaatgctcctactcatccacaatagtacatgtgggagacaagaaacctcagccggaactggaaatggtcgaagatgccgcttccgggccagagagcctcgactgtctcgccgggccggcacttgcctgcgggctctcccaggaaaaggagccgtttaagaaactgggactgacgaaggaagtgctcgcagcccacacccaaaaagaagagcagagcttcctgcagaaatttaaagagataaggaagctgtctatttttcagagtcactgccactattacctgcaagaaagatctaaggggcagccaagcgagcggactgcacctgggttgcgtaacacatctggaatagattccccttggaaaaaaacaggaaagaacagaaagctcaagtccaagagagttaagcctcgcgatagctctgaatctacaggcagcggcggcccagtctctgccagacctcctctggtgggccttaacgcaaccgcctggagtccctctgataccagtcagtcttcttgcccagctgtgccatttccagcaccggtgccagcggcatacagccttcccgtgtttcccgccccaggcacggtggctgcaccccccgcacctcctcatgcatcctttaccgtaccagccgtaccagtggacttgcagcatcagttcgccgtgcagccacctccgtttcctgcgccactagcgcctgtgatggcttttatgctgcctagttactcatttcctagcggaacacccaacttaccgcaggcatttttccctagccagcctcagttcccatcccacccaaccttgaccagtgaaatggctagtgcaagtcagcctgaatttcctagccggacttcaattcccaggcaaccgtgcgcatgccccgctacacgagccacacccccatcggctatgggaagggccagcccccccctgtttcagagccgatcctcatcacccctgcagctgaatctgcttcagctcgaggaggcccccgaaggcggaaccggagcaatgggaaccacaggcgctactgagaccgcagcagtgggagctgattgtaaacctgggacatccagggatcagcagcctaaagccccactcaccagagacgaaccgtccgatacccagaatagcgatgcactaagtactagctccggactcttaaacctgctgctgaatgaggatctgtgctccgccagcggttccgccgcctccgagagcctgggaagcggctctcttggttgcgatgcgagcccctctggcgccggctcgtcagacacatctcacacttcaaaatattttggctccatcgacagtagcgaaaataatcacaaggcaaaaatgaatacggggatggaagaatccgagcactttattaaatgcgtattgcaggacccaatctggttgttgatggcagacgccgacagctctgtgatgatgacataccagctcccatctaggaatctcgaagctgtgcttaaagaagatagggagaagctgaaactcctacaaaaactacagccacggttcaccgaaagccagaaacaggagctccgggaggtacatcagtggatgcagactgggggactccctgcagctatcgacgttgccgaatgcgtctattgtgagaataaggagaagggcaatatctgcattccctacgaggaagacatcccttcactgggactcagcgaagtgagtgacacaaaggaggacgagaacgggtcccctctcaatcacagaatcgaggaacagacttag

SEQ ID NO: 128154 - DNA, 1215 bp, Artificial Sequence
  Description of Artificial Sequence: Synthetic coding sequence
atgaacgggtatgctgaattcccgccctcgccttccaacccgacaaaagaaccagttgagccacagccttctcaggtgcccctgcaggaggacgtggacatgtcttcaggtagctccgggcatgaaacaaacgaaaactgcagcacgggaagggatagccagggaagtgattgtgacgattccggaaaagagctgggtatgcttgttgaaccacccgacgccagacaatcaccagacaccttttccctgatgatggctaaaagcgagcacaacccaagcacctctggttgctcaagcgaccaatcatctaaggtggacacacacaaggagcttattaaaacattgaaggaactgaaggtccacctacccgccgacaagaaggcaaagggcaaggccagtacactagccacactgaagtacgccttgaggagtgtgaaacaagtcaaggccaacgaggagtactatcagctgcttatgtctagcgaggggcatccttgtggagctgatgtgccttcctacaccgtggaggaaatggaatcggtgacctcagaacacatagttaagaatgcggatatgtttgccgtcgccgtttcactggtttctggaaaaatcctgtatatcagcgaccaggtcgcttcaatcttccattgcaaacgcgacgcattttctgacgccaagtttgtcgaattcctggccccccacgatgtcggcgtcttccactcgtttactagcccgtacaaacttccattgtggtcaatgtgcagtggtgccgatagcttcacgcaagaatgcatggaggagaagtccttcttttgcagagttagcgtgagaaaatcgcatgagaatgaaatcagatatcaccccttccgcatgacaccctacctggtgaaggtccgtgaccagcagggcgcagagagccagctttgctgcctgctcctggccgaaagagttcactccggatacgaggcacctagaattccccccgaaaagcgcatctttaccacgacccataccccaaattgcctctttcaggacgtagatgagagtcctgccgtgagacgtgcagcttttcgcctgttctcccatagcgtgtcacgtccggaacggagggtgcatcacgtgggccaccagctcgtgcagctgcaccagcctatggaacaggaaaatctgctgcaccactgggaagcccagtcacaggggggaccctttgaatag

SEQ ID NO: 128155 - DNA, 1215 bp, Artificial Sequence
  Description of Artificial Sequence: Synthetic coding sequence
atgaacggttacgccgaatttcccccttcccctagcaatcctacgaaagagccagtcgagccacaaccttcccaggttcccttgcaggaagacgttgacatgtccagtggatcaagcggtcacgaaacgaacgaaaattgtagcactggccgcgactcgcaaggttcagactgtgatgattctggcaaggagctgggcatgcttgtagaaccgccagacgccagacagagtccggatacattttccttaatgatggcaaagtctgaacacaacccgtctacctcaggttgttctagtgatcagtcgagtaaagtcgatacacacaaagagttaatcaagaccctgaaggagttgaaagtccatctgcccgccgataaaaaggcaaaggggaaggcctcgacactggccactctcaagtacgcactgcgctcagtcaagcaggttaaagccaatgaggagtattaccagctcctcatgagttctgagggccacccttgtggagcagatgtgcctagctacaccgtggaagaaatggaatccgtgacgtcagaacacattgtcaagaacgccgatatgttcgccgtcgccgttagccttgtgagtggaaagattctgtacatatcggaccaagtagcttcaatctttcattgtaagcgagacgctttcagtgacgcaaagttcgtggagtttctggcgccccacgatgtgggagtgttccactcctttaccagtccctacaaactgccactctggtccatgtgttctggggccgactcattcacacaggaatgcatggaggagaagagcttcttttgccgcgtatcagtcaggaagtcacatgaaaacgagatccgctaccacccttttaggatgacgccatatctggtgaaggtgcgcgaccagcagggcgccgagtctcagttgtgttgtcttctactcgccgaacgagtacactctgggtacgaggccccgagaatccctccggagaagaggatatttactaccacccatacccctaactgcctgtttcaggacgtggatgagagccccgctgtccgtcgcgccgcctttagactttttagtcacagcgtgtccagacccgaaagacgggttcaccacgtgggccatcagctggtccaactgcaccagccaatggagcaggagaacctacttcatcattgggaggcacagagccaggggggaccctttgagtag

SEQ ID NO: 128156 - DNA, 330 bp, Artificial Sequence
  Description of Artificial Sequence: Synthetic coding sequence
atgaacgggtatgccgagtttccccctagcccaagtaaccccactaaggagccagtggagccccagcctagccaggtacccctacaagaggatgtagacatgagctcaggatcttccgggcatgaaaccaacgaaaactgtagtactggacgggacagtcagggatctgattgcgacgattcgggtaaggagctaggaatgctcgtcgaacctccagatgctagacagagtccagatacattttctctcatgatggcaaagagcgagcataaccctagcaccagtgggtgctcttctgatcaaagctctaaagtggacacacataaatag

SEQ ID NO: 128157 - DNA, 1452 bp, Artificial Sequence
  Description of Artificial Sequence: Synthetic coding sequence
atgaacggatacgctgagtttcctccatcaccatccaatcccaccaaggagcccgtcgaaccacagccttcgcaggtgccactgcaggaggacgttgacatgtctagcgggtcctccggccacgaaaccaacgagaactgctccactggccgcgacagccaggggtccgattgtgatgactcaggaaaggaactcggtatgttggtcgagccgccagacgcacgtcagtctcctgacacgttttctctgatgatggcgaagtcagagcacaaccctagtacaagcggctgcagctccgaccaatccagcaaggtagacacacataaagagcttatcaaaacgctgaaggaactgaaggttcacctgcccgcagataagaaagccaaggggaaagcgtccacgctggccactctgaaatacgccttacgaagcgtaaaacaggtcaaagctaacgaagaatactatcagttgctcatgagttccgaaggtcacccatgtggagctgatgtgcctagttatactgtggaggagatggaatctgtgactagtgaacacattgtgaagaacgccgacatgtttgcagttgccgtgtctttggtgagcggcaaaatcctctatataagtgatcaagtcgcttctattttccactgcaaacgcgacgccttctcagatgcaaaatttgttgagtttctggccccacacgatgttggagtgttccattcctttacgtccccttacaaactgccattgtggagtatgtgtagtggggccgatagcttcacccaggaatgtatggaggagaaaagttttttttgtcgcgttagcgttcggaagagccatgagaacgagattcgctatcatcccttcagaatgacgccctacctggttaaagtacgagaccaacagggagccgaaagccagctgtgttgcctgctactcgccgagagagtccacagcgggtatgaggctccgaggatcccgcccgaaaagaggatcttcaccactactcacacacccaactgcctctttcaggatgtggatgagcgcgcagtgccccttttgggctatctgccccaagaccttatcgagacccctgttctggttcaactgcacccttcagacagacctctcatgttagccatacacaagaagatactgcagagcggaggccagccatttgattattctcccataagatttagggccagaaatggcgaatacattacgctggatacttcatggtcctcttttattaacccgtggagccgaaagatttcttttatcatcggacgccacaaagtgagagttggcccactgaatgaagacgtctttgccgctcacccatgtacagaggaaaaggctcttcatccttcaatccaggagctgactgaacagatccacagactgctcctccaagtaggcgtggttccagcctgccctcccccccgttag

SEQ ID NO: 128158 - DNA, 2340 bp, Artificial Sequence
  Description of Artificial Sequence: Synthetic coding sequence
atgatccccttcttacccatgtttagccttctgctgctgttgattgtcaatcccattaacgccaacaaccactacgataagattctggcgcactccagaattcgtggcagggaccaggggccgaatgtgtgtgcattacaacagatcctaggcacgaagaagaaatactttagtacgtgtaaaaactggtacaagaagagcatctgcggccagaagacgactgtcctctacgagtgttgccccgggtacatgaggatggaaggaatgaagggatgtcctgccgtactgccaatcgatcacgtttacggaaccttgggaatagttggagcgactacaacccagcggtatagtgatgcaagtaagttacgcgaggagatcgaaggcaagggttcgttcacctatttcgcacccagtaacgaggcctgggataacttggacagcgatattaggaggggcctggaatcaaacgtgaacgtggaactgttgaacgctttgcactctcatatgataaacaaaaggatgctgacaaaagatctcaaaaatggcatgatcattccttctatgtacaacaaccttggcctgtttataaaccactacccaaacggagtggttacagtcaactgcgctaggattatccatggaaatcaaatagccacaaacggggtcgttcacgtcatcgaccgggtactcactcaaatcggaacatccatacaagactttattgaggccgaggatgatttatctagtttccgagctgccgccatcacctctgatatcctggaagctttagggcgcgacgggcattttactctgttcgcccctaccaacgaggccttcgagaagcttccccggggagttcttgaacggatcatgggagacaaggtggcttctgaggcgctaatgaaataccacatccttaacaccttgcagtgcagcgagtccattatgggtggtgccgtgttcgaaacattggagggtaataccatcgaaattgggtgtgatggggactcaatcactgttaacgggatcaaaatggtcaataagaaagatatcgtgacaaacaacggagtaatccacctgattgaccaggtgctgattcccgattccgcaaaacaggtgatcgagctggccgggaagcagcaaactacgttcacggacctcgtcgcacagctgggcctcgctagtgctctgcgtcctgacggggagtacactttgctagccccagtaaacaatgccttttccgacgacacactctcaatggaccagcgcttactaaaactgatactacagaaccatatactgaaggttaaagtaggcttaaacgaactgtacaacggacaaatactcgagaccattggcggcaagcagcttagggtttttgtctatcgcaccgccgtttgcatcgagaactcctgcatggagaaaggcagtaagcagggacgtaatggagctatccacatcttccgggaaatcattaagcctgcagaaaagtccctgcatgaaaaactgaaacaggacaagagatttagtacattcctgtcccttctcgaggctgctgacctcaaggaattactaacccagcctggagactggaccttattcgttcccaccaatgacgcatttaagggcatgactagcgaagagaaagaaattcttatcagagacaaaaatgcattgcagaatattatcctttaccatctgactccgggagtttttatagggaaaggattcgaaccaggagttacaaacattctgaaaactacgcaaggatcaaaaatctttctgaaggaggtcaatgatactctgttggtgaacgagctgaaaagcaaggagtctgatattatgacaacgaatggagtgattcacgtggtggataaactcctctatccagcagacacccctgtcggcaacgaccagcttctggaaatactaaacaagctcattaaatacattcagatcaagttcgttcgcggatctactttcaaggaaatacctgttacggtttacaagccaataatcaagaaatacaccaagataattgacggggtgcctgtggagattactgagaaagaaacaagagaagaacggattattacaggaccagaaatcaagtatactagaatcagcaccggggggggggagactgaagaaaccctgaagaagctactgcaggaagaagtgaccaaggtgaccaagttcattgagggaggagacggacacctgttcgaggatgaggagatcaagaggctgttacagggcgatacccctgttcgtaagctgcaggccaataagaaagttcaggggtctcgacggagactgagggaaggacgtagtcagtag

SEQ ID NO: 128159 - DNA, 2430 bp, Artificial Sequence
  Description of Artificial Sequence: Synthetic coding sequence
atgattccatttctgcctatgtttagtctgctactgcttctcatcgttaatcctattaatgccaataatcactacgataagatccttgctcattctaggatacggggcagggatcaggggcccaacgtatgcgcactgcaacaaatactcggcacgaaaaagaaatatttctcaacatgtaaaaattggtacaaaaagtcaatatgtgggcagaagaccacagtcctgtacgaatgctgtcctggctatatgcgcatggagggcatgaaagggtgtccagccgtcctccctattgaccatgtctacggcacgttaggaatcgtcggcgctacaactactcagcggtattctgacgcctccaagctgcgggaagagattgaggggaagggctcttttacatacttcgccccgtcaaacgaggcctgggacaacctggactccgatatccgccggggtttagaaagcaacgtcaatgtggagctactaaacgcattacactcacatatgattaataaacggatgctgacaaaagatttgaagaacgggatgatcattccgagcatgtacaataaccttggcttgttcatcaatcactatcccaatggcgtcgtcacagtcaactgcgcacgtattatccacggaaaccaaattgccactaatggcgtggtgcacgtcatcgacagggtcctgacacagatcggcaccagcattcaagactttattgaggcggaggatgatttaagttcgttccgggccgctgctatcacaagtgacattctggaagcattgggaagagacggacactttacactgttcgcacccacgaatgaggcgttcgaaaagctgcccagaggcgttttggagcgcattatgggggataaggtggcctccgaagctcttatgaaataccatatcctaaacactttacagtgcagcgagagcattatggggggggctgtctttgagacgttggagggcaacactattgagattgggtgtgacggggactccattacagtcaatggcattaaaatggtcaataagaaagatatagtgactaataacggcgttatccacctcatcgatcaggtgctgatcccagattcagctaagcaggtcattgaattagcggggaagcagcagacaactttcactgacctggtggctcagctggggctcgccagcgcactgagaccagacggggagtacactctgctcgcccccgtgaacaacgctttctctgatgataccctgtctatggatcagcggctcctcaaactgatacttcagaaccacattttaaaggtcaaggtcggccttaatgagctgtataacggccaaatcctcgagaccatcggtggtaagcagctccgcgtcttcgtctatagaacagctgtctgtattgagaactcctgtatggagaagggaagtaagcaaggacgtaacggcgctatccatattttccgtgaaatcatcaagcctgctgaaaaatcactgcacgaaaagctgaaacaggacaaacggttctcaacattcctgagtctcctcgaagccgccgacctcaaagagctcttaacccagcccggagattggacacttttcgtcccaaccaacgacgcgtttaaggggatgacttctgaagagaaagagatcctgatccgggataagaatgctcttcagaacattatcctgtaccacctgacaccaggagtgttcattggcaaagggttcgaacctggggtgacaaacattttgaagacgacgcaggggagcaagattttcttaaaggaagtgaacgacacactgctggtcaacgaacttaaaagcaaggagtcggacataatgacgacaaacggcgtaatacacgtcgtggacaagctgctctatcccgccgacacacccgtagggaatgaccaattactagaaattctgaacaaacttataaaatatatccagatcaagtttgtgcgagggagcaccttcaaggaaatcccggtaaccgtgtaccgtccaacactgacaaaggttaagatcgagggagagcctgagtttagactgatcaaggaaggagagacaataactgaagtcattcacggagaaccaattatcaagaaatacactaagataattgacggagtgccggtggagatcaccgagaaggagacgagagaggaaaggatcatcacaggccctgagatcaaatacactaggatctccactgggggaggtgaaaccgaggagacgctgaaaaagttgctacaggaggaggtgacaaaagtcactaagttcattgaaggcggcgatgggcatctttttgaggatgaggagatcaagcgtctgctgcaaggggatactcctgtgaggaagctccaagccaacaaaaaggtgcaaggttcacgccgacgcttgcgcgaagggcgttcccagtag

SEQ ID NO: 128160 - DNA, 2511 bp, Artificial Sequence
  Description of Artificial Sequence: Synthetic coding sequence
atgattccctttctgcctatgttctcattgctccttctactgatagttaaccctattaatgctaacaatcattatgataagattctcgctcactctcgtattcgagggcgcgaccagggccccaatgtctgtgccctgcagcaaattttgggaaccaagaagaagtactttagcacctgtaagaattggtacaaaaagagtatttgcggacaaaaaaccactgtcttatacgaatgttgcccgggatatatgcgcatggagggtatgaagggctgtcccgccgtccttcccatagatcacgtatacgggacactggggattgtcggagcgacaaccacccagcgctactctgatgcctccaaactgcgagaagagatcgaaggaaagggttcattcacatactttgctcctagcaacgaggcgtgggacaacttggatagtgatatccggcgtgggctggagtcaaatgtgaatgttgaactcttgaacgccttacatagccacatgatcaataaaaggatgctgaccaaagatctcaagaatggtatgatcataccctccatgtataacaatctggggctgtttattaatcattatcctaatggcgtcgtgaccgtgaactgcgccaggattatccatggcaatcaaatcgccactaacggagttgtgcacgtgattgatcgcgtgctcacccagatcgggaccagcattcaggactttattgaagcggaggatgacctctcctccttccgcgcagccgccattacctctgacatccttgaagctctgggacgggacggccattttaccctcttcgcacctacaaacgaagcgttcgagaaactgcccaggggggtgctggagcgcattatgggtgacaaagtggctagtgaagcgttgatgaagtaccatatcctcaacaccctccagtgctcagaatcaataatgggcggcgcagtctttgagaccctggagggcaatactatcgagatagggtgcgatggggacagcattaccgtcaatggcataaagatggtcaacaagaaggatatcgtgactaacaatggggtgatccatcttatcgaccaggtgcttatccccgattcagccaagcaggtgattgagctggctggaaagcaacaaactacatttactgatctggttgcacagctcggcctggcttctgcgttgcggcctgatggcgagtatactctgctggcacccgtgaacaacgctttcagcgacgacacactcagtatggatcagcgtctgctaaaactgatcctacagaatcacatcttgaaggtgaaggtcggtttgaatgagctgtacaatggtcaaattctagagacaatcggaggaaagcagctccgtgtgtttgtctatcgcactgctgtttgtattgagaacagttgtatggagaagggttctaagcagggaagaaatggcgcaatacatatcttccgggagattataaagcctgccgagaaatctctccacgagaagctgaaacaggataagcgcttcagtactttcctctcattactggaagctgcagaccttaaggagctccttacccaaccaggagactggactctcttcgtacctaccaatgacgcgttcaagggaatgaccagcgaagaaaaggagattctcattagggacaagaatgccctgcaaaacattatcctgtaccacctgacacccggtgtgtttattggcaaaggatttgaacctggcgtcaccaacatcctcaaaaccacccagggctctaagatttttttaaaggaggttaacgatacgctgctagtcaatgaattaaagagcaaggaatcagacattatgacaaccaatggcgtgattcacgtcgtcgacaagctcctctatcccgccgacactccagtgggtaacgaccagctgctggagatactcaacaagttgatcaaatacatccagatcaagtttgtgcgtggctcaaccttcaaggaaataccagttaccgtttatacaacaaaaattattaccaaagtggtagaacccaagatcaaggtgattgagggctcactccaacctataattaaaaccgaaggacccacactgacgaaggtgaagatcgaaggtgagcctgagttccgcctgatcaaagagggggagacaatcactgaggttattcacggagaacctatcataaaaaagtataccaagatcatagacggggtcccagtggaaattaccgaaaaagaaacgcgcgaggagaggattataacaggcccagagataaagtacaccagaatttctaccggcggaggggagaccgaggaaacactgaagaagctgcttcaggaggaagtcacaaaggtgactaagtttatcgaagggggagatgggcacctctttgaggacgaagagattaaaagactcttacagggagatacaccagttcgtaagttacaagcgaacaaaaaggtacagggctccagacggcgcctccgcgaaggaagatcccagtag

SEQ ID NO: 128161 - DNA, 2427 bp, Artificial Sequence
  Description of Artificial Sequence: Synthetic coding sequence
atgattccctttctccccatgttttcccttctgttgctcttaatcgttaatcctatcaatgccaacaaccactacgacaaaattttagcacactccaggatccgcgggcgtgaccagggccccaatgtgtgcgctctccagcagatcttgggcacgaaaaaaaaatacttctccacctgcaaaaattggtataaaaagtcgatatgcgggcagaaaacgacagtcctctatgagtgttgccctggctacatgcggatggagggaatgaagggatgtcctgcagtcttgcccatcgaccatgtgtatggcactctcggtattgttggtgccactacaactcagcgctactcagacgccagcaagctccgggaggagatcgagggcaaaggctctttcacatattttgccccttctaacgaggcgtgggataacctggattctgatattagacggggtctggaaagcaacgtgaatgtcgaactgctgaacgcgctgcatagtcatatgattaacaaaagaatgctgaccaaagacttaaagaatggcatgatcataccttcaatgtacaataatcttgggctgttcatcaatcattaccctaatggagtggttaccgttaactgtgccagaatcattcacggtaaccaaatagccactaatggagtcgttcatgtcatagatcgggtgttgacacaaatcgggacctctatccaagattttattgaggcagaggatgacttgtcgtctttcagagcggccgcgatcaccagcgacatcctggaggccctgggaagggacggacacttcaccctctttgccccaacaaatgaagcctttgaaaagctcccgcgaggcgtgctcgagaggattatgggggacaaggtggcctcggaggctctgatgaagtatcatatactgaatacactgcagtgcagcgagtctataatgggaggtgccgtgtttgagactctcgagggcaataccatagaaatcggctgtgatggcgactccattaccgttaacggaataaaaatggttaacaagaaagacatcgtaaccaacaatggtgtgattcatctcatagaccaggtgctcatacccgactcggcaaaacaagtgattgaactcgcaggaaaacagcagacgaccttcacagacctggtcgctcaattgggcttggcttctgcactgcgccccgatggagagtacacactgttagcacccgtgaacaacgctttctctgacgacacactctccatggaccagagattgctgaaactcatcttacagaaccacattcttaaggtgaaggtgggactgaatgaactgtacaatggccagatacttgagaccatcggcggtaagcagctgcgggtgtttgtttatcgtactgccgtgtgtatcgagaatagctgtatggagaagggttctaaacagggccgaaatggagcgatccacatcttccgggaaattatcaagcccgccgaaaagtctctacatgaaaaactaaagcaggataagagatttagcactttcttaagcctactggaagccgctgatctgaaagaactcctgacacaaccaggggattggacattgttcgtcccaacaaacgacgccttcaaagggatgacctcagaggagaaggagattcttatcagagataagaacgctcttcaaaacatcatcttataccacctcactcccggagttttcattggtaagggatttgagcccggcgtgactaacatactgaaaactacacagggcagcaagattttcctgaaagaagtcaacgacactctactcgtgaatgagctgaagtcaaaagagtccgacatcatgaccacaaatggagttattcacgtggtcgataagttgctctaccctgccgacacacccgtcggtaatgatcaactcttggaaatcttgaacaagctgataaagtacatccagatcaaattcgttcgggggtccacttttaaggagatacctgtgaccgtttataccacgaagatcataacaaaggtcgtggagcccaagattaaagtgatcgaggggagtctccagcccatcatcaaaacagaaggccctaccctgaccaaggttaaaatcgaaggcgaacctgagttcagactcatcaaggagggggaaacaatcactgaagttatccacggcgagccgattatcaaaaaatatactaagatcatagacggcgtgcctgtagagattaccgagaaggagaccagagaggagcggattataaccggacccgagattaagtacactcggatcagcaccggcggcggcgagacagaggagaccttaaaaaaactcctccaagaggacacgcctgtgcggaaactgcaggccaacaaaaaagtgcagggatcacgaagacgtctgcgggagggcaggagccagtag

SEQ ID NO: 128162 - DNA, 834 bp, Artificial Sequence
  Description of Artificial Sequence: Synthetic coding sequence
atgcggatggaggggatgaaaggatgcccagccgtcttgccgatagaccacgtatacggaaccttggggatcgtgggtgcaaccaccacccagagatacagcgatgcgtccaaactcagggaggagatcgaagggaaaggcagtttcacctactttgcgccgtctaatgaagcgtgggataacctagactcggatatccgaagggggctggaaagtaacgtcaacgtagagttactgaatgccctccattcccatatgatcaataaaagaatgctgaccaaggatctcaagaatggcatgatcattccgtccatgtataacaacctcggcctttttatcaaccattaccctaatggcgttgttactgtaaactgcgcaaggatcatccacggcaatcaaatcgctacgaacggtgtcgtgcacgtgatagatcgtgtattaacccagattggtacctcaattcaagattttattgaggctgaggatgacctaagcagctttcgggccgccgcaatcacatctgatatcctcgaagcattaggtcgggatggacattttaccttattcgcgcctacgaacgaagcctttgagaagctgcccagaggcgtgttggaacggattatgggagataaagtggctagcgaggctttgatgaagtaccacatcctgaacacactccagtgctcggagtctatcatgggcggcgctgtcttcgaaacactggaaggaaacaccattgaaattggctgcgacggcgacagcatcactgtcaacggaatcaaaatggttaacaaaaaggacattgtgactaattggtgtgatccttttgactag

SEQ ID NO: 128163 - DNA, 2346 bp, Artificial Sequence
  Description of Artificial Sequence: Synthetic coding sequence
atgatacccttcttgccaatgtttagcctcttgctactccttattgtaaatccgatcaatgctaataaccactacgacaagatcctggctcatagccggattaggggaagggaccagggtcccaacgtgtgtgctctacagcagatcttggggaccaaaaagaagtattttagcacatgcaagaactggtataagaaatccatttgtggacagaagactacagtactctatgagtgttgtccagggtacatgcggatggaggggatgaagggatgtcctgcagtactgcccatcgaccacgtgtacgggaccctaggtattgtcggcgctactactacacaacgctacagcgacgctagcaagctgagggaggaaattgagggaaagggttcttttacctactttgctccttcaaacgaggcctgggataacttggactccgatatcagaagggggctggaatcaaatgttaatgtggagctactaaatgccttacactcacacatgataaataagaggatgttgacgaaagacttgaagaacggaatgatcatccctagcatgtataataatttaggattgtttatcaatcattacccaaacggggtggtgacagtcaattgcgcacgtataattcacggtaaccaaattgcgaccaatggtgtggttcatgtgatcgaccgcgtcctcactcagattgggacctccattcaggatttcatagaggctgaagacgatttatcatcgtttagagctgccgctattaccagtgatattctggaagctctgggcagagatgggcattttaccttattcgccccaaccaacgaggctttcgagaaattgccaaggggggtgctcgaaagaatcatgggagataaggtggcttccgaggctctgatgaaataccacattctgaatactctacaatgctccgagagtatcatggggggcgctgtattcgagacactggaaggtaacactatagagattggatgtgatggcgactctattaccgtaaacggcataaaaatggtgaacaagaaggacatcgttaccaacaatggcgtaattcatttaattgaccaagtgttgatccccgattccgccaagcaggttattgagctagcaggcaagcaacagaccacattcacagatcttgtggcccagctcggcctggccagtgcgctgaggcctgatggagagtatactctcctggccccagtaaacaatgctttcagcgatgacacactgagcatggaccagagattactgaaactaattctgcaaaaccacattctgaaggtgaaggtgggcctcaatgagctgtataatggacaaatcctggaaaccattggggggaaacaacttagagtattcgtgtaccgaactgctgtgtgcattgaaaactcatgtatggaaaagggctcgaaacagggccgtaatggagccattcatatattcagggaaataatcaagcccgctgagaagagtttgcatgagaaacttaagcaggacaaaagatttagtacgtttcttagcctcctagaggcagctgacctgaaggagctactgacccagcctggggattggaccttatttgtccctaccaatgacgcattcaaggggatgacctccgaggaaaaagaaatactaataagagataaaaacgctctgcagaacattattctgtaccacttgactcctggcgtgttcattggtaaaggattcgaacctggagtgacaaacatccttaagactactcagggatccaaaattttcctcaaagaggtaaatgacacgctgctagtgaacgagttgaagagcaaggaaagcgatataatgaccacaaatggcgtgattcatgtcgtcgataagctcctgtacccggctgacactcctgtaggtaacgaccaattgttggagattctcaacaaactgatcaagtatatccagattaagtttgtgcgcggttcgaccttcaaggagattcctgttaccgtctatcggccaacccttaccaaagtgaagatcgagggagagccggagtttaggctcatcaaagaaggcgaaaccataaccgaagtgatccacggcgagccaataatcaaaaagtatacaaagataatcgatggggtgcccgtggaaattactgaaaaagagacacgcgaagagaggatcattacaggcccagaaatcaaatacacccgaatctccacaggcggcggagaaaccgaggagacattgaagaagctactccaggaagatactcctgtgcgtaagctgcaagccaataagaaggtgcaagggagcaggcgaagactacgtgaaggacgaagtcagtag

SEQ ID NO: 128164 - DNA, 2250 bp, Artificial Sequence
  Description of Artificial Sequence: Synthetic coding sequence
atgataccatttttgcccatgttctccctgctgcttcttctcatcgtcaatccaatcaatgcaaataaccattatgataaaatcctggctcattcacgcataagaggcagagaccagggccctaatgtctgcgcactccagcagatactgggcacaaagaagaagtacttctccacctgcaaaaactggtacaagaagtctatatgcgggcaaaagacaaccgttttgtacgagtgctgtcccggatacatgcgcatggaggggatgaagggctgtcctgcagtgctacccattgaccatgtttacgggaccttggggattgtcggcgctacaacaacacagcgctactctgatgcttctaagcttagggaggaaatagaaggcaaaggaagttttacttacttcgccccatctaatgaagcctgggacaatttagactcagacatccgtagaggtctcgaatccaacgttaatgtggagttactaaacgcactgcattcccacatgatcaacaagcgaatgctcactaaagacctgaaaaatggaatgattatccccagcatgtataacaaccttgggctgtttattaaccattatcccaatggcgttgtgacagtcaactgtgctaggattatccatggcaaccagattgcaacaaacggtgtggtccacgtgatagacagggtcttgacacagatcggaacatctattcaggactttattgaggcggaggacgacttgtcgtcgtttagggcggccgcaataacttctgatattctagaggcgttgggccgggatggacacttcacactgttcgctcctactaatgaagcatttgaaaaacttccccggggcgttctggagaggatcatgggtgacaaagtagcctctgaggcactgatgaaataccacattctaaatacattgcagtgttctgagagcatcatgggcggggcagtctttgagacactcgagggaaacaccatagaaattggctgtgacggcgactccatcaccgtgaacggaatcaagatggtgaacaagaaagatatcgttactaacaacggtgtgatacacttaatcgatcaggtcctgattccagattcagcaaagcaagttatcgagcttgctgggaagcagcaaaccaccttcacggacctggttgcccagcttggactggctagcgctctgcggccagacggcgaatacaccctgctcgcacccgtaaataatgctttctcagatgatacattatctatggaccagaggcttctgaaacttattctgcagaaccacatcctcaaggtgaaggttggcctgaatgagttatataacggccagattttagagacgatcggaggaaaacagctccgcgttttcgtgtacagaacggcggtgtgtatcgagaactcttgcatggagaagggaagcaagcagggaagaaatggggctatccacatctttagggaaatcattaaacccgctgagaagtcgctccacgaaaaactgaaacaggacaagcggttctctacgtttttatcattgctcgaagccgcggatttgaaagaattactgacacagcctggtgactggaccctgttcgtgccgacaaatgatgccttcaagggaatgacaagcgaggaaaaagaaatcctgatccgggacaagaatgccctccagaacatcattctctaccacctcacacctggagtcttcataggaaagggatttgaacctggagtcacaaacatcctgaagaccacccaaggttccaagatcttcctgaaagaagtcaatgatactttactggttaatgagctcaaaagtaaagaaagtgatattatgaccacaaacggtgtgattcacgtggttgataaactgctgtacccggccgacactcccgtaggtaatgatcaactcctcgaaattcttaacaaattaatcaagtatattcagatcaaattcgtgaggggctcaacttttaaagaaatccctgtcactgtgtatagcccagagatcaaatacacccgcatttctacaggtgggggggaaaccgaagagactctcaaaaaattactccaagaagaagtgacgaaggtgaccaaatttatcgaggggggtgatggccacctgttcgaggatgaagagatcaaacggctgctgcagggggataccccagttaggaaactgcaggctaacaagaaagtgcaggggtctaggaggcgcctgagggagggcaggagccagtag

SEQ ID NO: 128165 - DNA, 399 bp, Artificial Sequence
  Description of Artificial Sequence: Synthetic coding sequence
atgagtaataagtttctgggaacctggaaactggttagctcagaaaactttgacgactatatgaaggctttaggcgtgggcttagcgacaagaaagctcggtaaccttgcgaagcccacagttattatatccaagaaaggtgatattattacaattcgaactgagtctactttcaagaacacagaaataagcttcaagctggggcaagaattcgaggagactaccgctgacaataggaaaaccaagagcatcgtcaccctgcagaggggcagcttgaatcaggtgcaacgatgggacgggaaggagacaactattaagaggaagctggtaaacggcaaaatggtggccgaatgtaagatgaaaggcgtggtctgcactaggatctatgagaaagtatag

SEQ ID NO: 128166 - DNA, 483 bp, Artificial Sequence
  Description of Artificial Sequence: Synthetic coding sequence
atgctcctgctgctcttatcaatcatcgtgctgcatgtggccgtactggtcctgctgtttgtctcaacaatcgtctcccagtggatagtgggcaacggacacgcaaccgatttgtggcagaattgtagcacatcgagctccggcaatgtccaccattgcttctccagttctcccaacgaatggttgcagagcgtccaggctaccatgatcctgtccatcatatttagcatcctgagccttttcttgtttttctgtcagctctttactctaaccaagggcggacgattctatatcacgggtatcttccagattctcgctgggctgtgcgtcatgtccgccgcggctatctacacagtgcgtcaccccgagtggcatctcaactcggattactcgtacggatttgcttacatacttgcctgggtggcttttccactggcactgttgagtggcgttatttatgttattttgcgaaagagggagtag

SEQ ID NO: 128167 - DNA, 357 bp, Artificial Sequence
  Description of Artificial Sequence: Synthetic coding sequence
atgctgctgctcctgctctctattatcgtgctgcatgtcgctgtgcttgtgctcctcttcgtctctacaatcgtctcacagtggattgtgggcaacggtcacgctaccgacctctggcagaattgttcaacctcctcctcgggcaatgtccatcattgcttttcttctagccctaatgagtggttgcaaagcgtgcaggctacgatgatcctcagcattatcttttcgattctctccctattcttgtttttttgccagcttttcaccttaaccaaaggtggccggttctatattactggcatctttcagatccttgcagaaagtaacagctcccagatgtgcggttacagagattag

SEQ ID NO: 128168 - DNA, 483 bp, Artificial Sequence
  Description of Artificial Sequence: Synthetic coding sequence
atgctgctgctgctgttgtcgatcattgtcctccatgtagccgtcctggtgcttctctttgtgagtactatcgtttctcagtggattgtggggaacgggcatgccaccgacctctggcaaaactgttccaccagttcatccggtaacgtacaccactgcttctcttccagtccaaatgaatggctgcagtctgtccaggccactatgatactcagcattatcttttccatcctgtcattgttcctctttttttgtcagcttttcacactaacaaaagggggacggttttatattaccggaatatttcaaattctggcaggcctctgcgtcatgtcagccgccgctatttacacagtccggcacccagagtggcatcttaatagtgattactcctatggatttgcctacatactggcgtgggtggcattcccactcgctttattaagtggagtgatttacgtgatcctccggaagagggaatag

SEQ ID NO: 128169 - DNA, 450 bp, Artificial Sequence
  Description of Artificial Sequence: Synthetic coding sequence
atgttgctgctgctgctctctataattgtgctgcacgtcgcggttctggtgctgctctttgtaagtaccattgtcagccaatggatcgttggcaacggtcatgctaccgatctgtggcagaactgttccacgtcaagctcaggaaacgtacaccactgcttctcctcaagtccaaatgagtggctgcagtctgttcaggccaccatgatattgagcatcatattctcaatcctcagtctcttcctcttcttctgtcagctgtttacactcactaagggaggcagattctatatcactggtatatttcagattttggcaggactgtgtgtgatgtctgcagcggcaatctatactgtgcgtcaccccgagtggcacctgaactctgattatagcttcccgcttgcactgctctcaggagttatctatgtgatactgcggaagagagaatag

SEQ ID NO: 128170 - DNA, 1413 bp, Artificial Sequence
  Description of Artificial Sequence: Synthetic coding sequence
atgagccatcacccctctgggctgagggcgggcttcagttctactagctaccgaagaactttcggtcctcccccatcccttagtccaggggcattcagctattcaagctcttctcgattcagttcaagtcgcctattgggcagcgcttctccctcttcctccgtcagactgggcagttttcgctcgccacgggcaggcgcaggtgccctgctccggctgccatctgagaggctggacttcagtatggctgaggccctgaaccaggagtttctggccacccggtctaacgaaaaacaggaactccaggaactgaacgaccgcttcgcgaatttcatcgaaaaagtgagattcttagaacagcaaaatgcagcccttaggggggaattgtcccaggcacgcggtcaggagcctgccagagctgaccagttgtgccagcaggaactccgggaattgagacgcgaacttgaactacttggacgcgaaagggatagggtccaagtcgaacgcgacggtctagcggaggacctagccgccttaaagcagagactcgaagaagagaccaggaaaagggaggatgccgaacacaatctcgtgctgttccggaaggacgtggacgacgctacgctcagtcgcttggaactggagcggaagattgaatctctcatggacgaaatagagttcctgaagaagctgcatgaggaggaactccgcgatctacaggtgagtgtcgagagtcagcaagtccagcaggtggaagttgaggccacagtgaagccagagctgactgctgcgctgagagacattcgcgcccaatacgagtcaattgcggccaagaatctacaagaagcagaggagtggtacaagtcgaagtatgctgacctgtcagacgccgctaatcgaaaccacgaggcactccgccaggcaaaacaagagatgaatgagtctcgtagacagattcagagtcttacctgtgaggtagatggactgagaggcactaatgaagccctgctgaggcaactccgcgagttggaggaacagtttgctctggaagccggaggctaccaggcaggcgctgctaggctcgaggaagagctgcgccagctaaaggaagaaatggctaggcacctcagagaataccaggagcttttgaacgtgaaaatggccttagacatcgagattgcaacttaccgaaagttacttgagggtgaagagtcacgcataagcgtgcctgtccatagtttcgcgtccctcaacatcaaaaccacagtccctgaggttgaaccacctcaggatagtcatagccggaagactgtcttaatcaagaccatagagacaagaaatggagaagtggtcaccgagtcccagaaagagcaacgctctgaactcgataagagcagcgcgcattcctactag

SEQ ID NO: 128171 - DNA, 603 bp, Artificial Sequence
  Description of Artificial Sequence: Synthetic coding sequence
atgggacaggagttctcctgggaggaagccgaggctgctggggaaatcgacgttgcagaactccaggagtggtataaaaagttcgttatggaatgtccttctggaacgctcttcatgcatgagttcaaacgcttcttcaaagtgacagacgatgaagaagcttcccaatatgtcgaggggatgtttcgggcatttgacaaaaatggtgacaataccatcgattttctggagtatgttgcggctctcaacctggtcttaagagggactcttgagcacaaactgaagtggactttcaagatctacgacaaggacggcaacgggtgcatcgaccgtctggagctgctaaacattgtggagggcatttatcagctgaagaaggcatgccggcgggagctgcaaacagaacaaggccagctattgacacctgaggaagtggtggaccgcatctttcttctggtggatgaaaatggagacggccagctatccctgaacgaattcgtcgaaggggccaggcgggataagtgggtgatgaagatgttacagatggacatgaacccaagcagctggcttgcccagcaaagacggaagtctgctatgttctag

SEQ ID NO: 128172 - DNA, 1104 bp, Artificial Sequence
  Description of Artificial Sequence: Synthetic coding sequence
atgtggagtgaaggacgctacgagtacgaacgcattccccgggaaagggcccccccccggagtcatccatccgacggttacaaccgcctggtgaatatcgtgcctaagaaaccaccactgttagatcgtcctggcgaggggtcctacaacagatactactctcacgttgactatagagactacgatgagggccgctctttcagtcatgaccgtcgctccggccctccacataggggagacgagtctggctatcgatggacgagagacgaccactccgcgtctcggcagcccgagtatcgcgatatgcgcgacggctttagacggaagagcttctattcttcgcattatgcccgagaacggtccccctacaagcgtgataatactttctttcgggagtccccggtaggacggaaggattccccacactcccggtccggctcaagtgtgtccagtcggtcctactcccctgagagatctaaatcatactcgttccaccagtctcagcacaggaaatccgtgcggcctggggccagttataaacggcaaaacgaaggaaatccagaaagagataaagaacgccccgtgcagagcttgaaaacctcacgcgacacctcgcccagtagcggaagcgctgtttccagcagtaaagtgttggacaagccatcacggctgaccgaaaaagagctcgctgaagccgcctccaagtgggcagcagagaagctggaaaagagcgacgagtctaaccttcctgagattagcgaatacgaggcagggtccacagcaccattatttacagaccagcctgaagagccagaaagcaatacgactcacggtatcgagctcttcgaggattcgcaactgactacaaggagcaaggccatagcttcgaaaacgaaggagatagaacaggtgtatcgccaggattgcgagacctttgggatggtcgtgaagatgctgatcgagaaagatccgtccctggaaaagtctatacagtttgcgctgaggcagaatctccacgaaataggagagcggtgcgtggaagagcttaaacacttcattgcggaatacgatacttcaacccaggatttcggtgaacctttctag

SEQ ID NO: 128173 - DNA, 1377 bp, Artificial Sequence
  Description of Artificial Sequence: Synthetic coding sequence
atgtggtctgagggaaggtatgagtatgaacgaattccgagggagagggccccccctcgcagccatccaagtgatggctataaccggctcgtaaacattgtgcctaagaagcccccactcctcgatcggcccggcgagggctcctacaatcgctactactcccacgtggactatcgtgattacgatgaaggaagatcctttagccacgataggcgttccggaccccctcacagaggcgatgagagtggataccgctggacacgcgatgatcatagcgcaagtagacagcctgaatatcgcgacatgagggatggatttcgcaggaagtctttttactcatcacattacgctagggaacggtctccatataagcgcgacaacacttttttcagggagtctccagtgggacgtaaagattctccccactcaaggagtggaagctcagtgtcctcacgatcgtacagcccagagaggtccaaaagttatagctttcaccaatctcagcacagaaaaagcgtcaggcctggtgcaagttataagaggcagaatgagggaaatcctgaacgagataaggaacggcccgtacaatcacttaagacttccagggatacttctccctcatccgggtctgccgtcagcagctccaaagtgctcgacaagcctagccggcttacagaaaaggaactagcagaggccgcgtccaaatgggccgccgagaaattggagaaatccgacgagtctaacttgccggaaattagtgagtatgaagctggctctacagcccctctgtttacagaccagcctgaggagcctgaaagcaatactactcatggaatcgaactgttcgaagactcccagttgaccacccgctccaaggccatcgcgagcaagacaaaggagatcgaacaagtgtacagacaggattgtgagaccttcggaatggttgtgaaaatgctgatcgagaaggacccctctcttgagaagagcattcagttcgcgcttcgccagaatctacacgaaattgagagcgcaggccagacctggcaacaagtgcccccggtcaggaataccgagatggatcatgacggtacccctgagaacgagggcgaggagacagctcagtccgctccacaacctcctcaagccccccaacctctgcagccacgcaaaaaacgggtccgccggactacccaactcaggcggaccacgggagcaccagacataacctgggggatgctgaagaagacgactcaggaggcagaaaggattctccttcggacacaaaccccctttacacccgaaaacttgttcctggcaatgctctctgttgtccattgtaatagtcggaaggatgtgaaaccggaaaacaaacaatag

SEQ ID NO: 128174 - DNA, 1125 bp, Artificial Sequence
  Description of Artificial Sequence: Synthetic coding sequence
atggcgtacaggcgggacgagatgtggtccgaggggcgttacgagtacgaacgcatacctcgtgaaagagccccgccccggtcacacccatccgatggatataaccgcctggtgaatatcgttcctaagaaacctccactcctggaccgaccgggcgaaggaagttacaatcgatactatagtcacgtggattaccgagactacgatgaagggcggagctttagccacgatcgccggtctggccctccacacaggggagacgaatccgggtatcgctggacaagagacgatcactccgccagcaggcagccagagtatcgtgacatgcgggacggattcaggcgaaagagtttttactcctcccactacgctagggagagaagcccttataagcgggataatacattcttccgggaaagtccggtgggaagaaaagactctccccactctcgatccggaagctcagtaagttcgcgctcatatagtcccgagagaagtaagtcatattcgttccaccagagccagcataggaagtccgtaaggcctggagcatcatacaagcgacaaaatgagggcaatcccgagcgggacaaggagcgcccagtccaatcactgaagactagccgagacaccagtccatcctcagggagcgccgtgagctcatcaaaggttttggataagccgagccgtctcactgagaaggagctagcagaggcagctagtaagtgggctgcagagaaattagaaaaatctgacgagtctaatctgcctgaaatctccgaatatgaggctgggagtactgcccctctgttcacagaccagcctgaggagccagaatccaataccacccatggaatcgagctcttcgaggactctcagctgactacacgctcaaaggctattgcctcgaagactaaggagatcgagcaggtgtatcggcaggattgcgagactttcggcatggtcgtgaagatgcttatcgaaaaagatccaagccttgaaaaatctatccagtttgccttacgccagaatcttcatgagattggcgagcggtgcgtggaggagctgaaacactttatagccgaatacgacacctccacacaggattttggagaacccttttag

SEQ ID NO: 128175 - DNA, 1305 bp, Artificial Sequence
  Description of Artificial Sequence: Synthetic coding sequence
atgtggtcagaggggagatacgagtacgaacgaatccctcgggaacgagccccccctaggtcccatccgtctgatgagagtgggtaccggtggacccgggacgatcactccgctagtcgccagccagaataccgggacatgcgggacggattcagaaggaagtctttttatagtagccattatgctcgggaacgcagtccttataagcgggacaatacattcttccgggaatcacctgtaggtaggaaggactccccccatagtaggagcggctcttccgttagcagcaggtcgtactcccccgaaaggtcaaaatcctatagcttccaccaatcacagcatagaaagtccgtgagaccaggggcctcgtacaagaggcagaatgaaggtaaccccgagcgcgataaggagcgccccgtgcaatctctcaagacctcaagagacacaagcccatcgtccggcagcgcggtcagctcttctaaggtattggacaaacccagcaggctgaccgagaaagagctggcagaggctgcctctaagtgggcagcagaaaaactagaaaaaagtgatgaatctaacttgccagagatcagcgaatacgaagctggcagtacagcccctctgttcacagatcaacccgaggaacccgaaagcaataccacccacggcatagaactcttcgaagattctcagttaacaactcgctctaaggcaatcgcatccaagacaaaagaaatcgaacaggtgtatcggcaggattgcgagacctttggcatggtagtgaaaatgcttatcgaaaaggatcctagccttgaaaaatctatccagtttgcactccgtcagaatttgcatgagattgaatctgctgggcagacctggcagcaagtgccgcctgtccgaaacacagagatggatcacgacggaactcccgagaatgaaggtgaagagaccgctcagtcggcgctttttggattccaacatgacgcttctaaccacacgatcgtggggctggggcctaatcaggtgccagaaatgaaggagactacgcttcaggccccacagccaccgcaagccccccagccactgcagcccagaaagaagcgagttcggaggaccacccagcttcgccggaccaccggggccccggatattacctgggggatgttaaaaaagacgacccaggaggctgaaagaattctcctcagaacacagactccctttaccccggaaaatttgttcctggcaatgttgtctgtggtgcactgtaattccagaaaagacgtaaagcctgagaataaacagtag

SEQ ID NO: 128176 - DNA, 1047 bp, Artificial Sequence
  Description of Artificial Sequence: Synthetic coding sequence
atgtggtccgaaggaagatacgaatatgagagaattccacgcgaaagggcccctcccaggtcacacccctccgacggctataataggctagtcaatattgtgcccaagaagccaccactgctggacagaccaggggagggttcctataatcgctattactctcacgtagattatcgagactacgatgaagggcggtctttcagccatgatcgccggtctggccctccacatcgtggggacgaatcaggctaccgctggacaagagacgatcacagcgcctcgcgccagccagaataccgcgacatgagggacggtttcagacggaagagcttctatagttctcactacgccagagaacggtctccctataaacgcgacaacacatttttcagggagtccccagtgggaagaaaggatagcccccacagtaggtccgggagctcagtttccagcaggtcttattcccctgagaggtccaagtcgtactcctttcaccaaagccaacacagaaacaaggagagacctgtgcagtccttgaagacgtcacgagacacgagcccatcaagtggcagcgcagtctcctcctcgaaggtactcgataaaccatctcggcttactgaaaaagaactagccgaggccgcatcaaaatgggcagcagagaagctggaaaagagcgatgagtccaacctgcccgaaatctctgagtacgaggccgggagtacagcccctcttttcactgatcagccagaagagcccgaatctaatacaactcatggcattgaactgtttgaagattcacagttaaccaccaggtccaaggctatcgccagcaaaacaaaggagatcgagcaggtgtaccgccaagactgtgaaaccttcggcatggtggtaaaaatgcttatcgaaaaagatccctccctggaaaaatcaatccaatttgccttaaggcaaaatcttcatgaaattggggaacgttgtgtggaagaacttaaacacttcattgccgaatacgatacatccactcaggactttggcgaacccttctag

SEQ ID NO: 128177 - DNA, 486 bp, Artificial Sequence
  Description of Artificial Sequence: Synthetic coding sequence
atggcatatcgccgagatgagatgtggtcagaggggaggtacgaatacgaacggatccccagggaaagggctccccccagaagccacccaagtgatggatataatcggttggtcaacattgtccccaagaaacccccccttctcgataggcctggggaaggttcttacaaccgatactactctcatgtcgactaccgtgattacgatgaagggcggtcgttttcacatgaccgccgcagtggacctccacatagaggtgatgagtccgggtaccggtggactcgggacgaccattccgcctcccgtcagcctgagtacagagacatgcgcgacggatttcgtcggaagtcgttttattcctcccactacgctagggagcggtctccttataaaagagacaacactttcttcagggaatccccggtcgggcgtaaagactcccctcactcccggtctggctcaagtgtatcatctagaagttattag

SEQ ID NO: 128178 - DNA, 507 bp, Artificial Sequence
  Description of Artificial Sequence: Synthetic coding sequence
atgtggtccgagggacggtacgaatatgaacgcataccaagggagagggctccaccgagatcccacccctctgatggctataacaggctggtaaacatcgtgcccaagaaacctcccctgctcgaccgacccggtgagggctcctataaccgctattattcccatgtggattatcgcgattatgacgagggacgatcattctcccacgaccgacgatctggccctccacatagaggagacgaaagtggttatcggtggacccgggacgaccattctgcgtcccggcagcctgagtaccgtgatatgcgtgacggatttcgacgaaagtcattttattctagccactacgcgcgggagaggagtccatacaagagggataataccttctttagggagtctccagtaggacggaaggactccccccacagcaggagcgggagctccgttagttcacgcagctattcccccgagcggtcaaagtcatattcttttcaccagtctcagtag

SEQ ID NO: 128179 - DNA, 960 bp, Artificial Sequence
  Description of Artificial Sequence: Synthetic coding sequence
atggcttatcgacgagatgagatgtggtctgagggtaggtacgagtatgagaggattccaagggaacgtgcccccccccgctcccacccaagcgacgagtctggttataggtggactcgcgacgatcactcagcatcccggcaaccagaatacagggatatgagagacggctttagaagaaagtccttctacagctcacattacgcaagggagagatccccctacaaacgcgataataccttcttccgcgaaagccctgtgggccggaaagatagcccacacagtcggagtggatcctcagtaagtagccgctcatatagcccagaaaggtccaaaagctactcatttcatcagtctcagcataggaagtctgtcagaccgggcgcttcctataaaagacagaatgagggcaatcctgaacgtgataaggagaggccagttcagagcctgaaaactagccgtgacacgagcccctcttccgggagcgcagtatcttctagcaaagtgctggacaagccaagcaggctgacggaaaaggaactcgcggaggctgcttccaagtgggcagcggaaaaattagagaaatcagatgaatccaacctgccagagattagcgaatacgaggccggatctactgccccactttttaccgatcagcctgaagaacccgagtcaaatactacccatgggattgagttattcgaggattcccagctgactactagatccaaggctatcgcaagtaaaaccaaggaaatagaacaagtctataggcaggattgtgaaaccttcggcatggtcgtgaagatgctgattgaaaaggatccctccctcgaaaagtctatccaatttgcgctgaggcagaatttacatgaaatcggcgagagatgtgtggaggaacttaaacacttcatcgccgagtatgatacatccacacaggacttcggcgaacctttttag

SEQ ID NO: 128180 - DNA, 5271 bp, Artificial Sequence
  Description of Artificial Sequence: Synthetic coding sequence
atgaattctctgtttcggaagagaaacaagggcaaatacagcccaactgtgcagactcggtccataagcaataaagagttgagtgagctgatcgagcagctgcaaaagaatgccgatcaggtggagaaaaacattgtggatactgaagccaagatgcagagtgacttagcaaggctacaggaaggccgccagcccgaacaccgcgatgtgacactgcagaaggtcctggattccgagaaactgttgtacgtgctggaagctgacgctgccattgctaaacatatgaagcatccccaaggtgacatgatcgcggaggacatacgccagttgaaagagcgcgtaacaaaccttcgcgggaaacataagcagatttatcggttggccgtcaaggaggtggatccccaggtgaactgggctgccctggtggaggagaagctggacaagttaaacaatcagtccttcggtacggaccttcctttagttgatcaccaggtggaggagcacaacatttttcacaatgaggtgaaagctattggacctcacctggccaaagatggggacaaggaacagaactcggagctgcgcgctaaatatcagaaattactagctgcatcccaggccagacagcagcatttatcaagcctgcaagattacatgcagcggtgcaccaatgagttgtattggctggaccaacaggctaagggacgtatgcaatatgattggagcgaccggaacttggattatccaagccggcgcagacagtacgaaaacttcataaatcggaacttagaagccaaggaagagcgcataaacaagctacactccgagggtgaccagttgttagcagcggaacatcctggtaggaattcaatagaagcccatatggaggcggtccacgccgactggaaggagtacctgaacctgttgatttgtgaggagtctcacttgaagtacatggaagactaccatcagttccacgaggatgtgaaagatgctcaagagctgttgagaaaggtcgatagtgacctcaaccaaaagtacgggccggactttaaggatagataccagattgagttgctcttaagagagttggacgaccaggaaaaagtattggataagtacgaagacgtggtgcaagggttacagaaaaggggacagcaggtcgtgcccttgaagtaccggcgcgaaaccccactcaagcctatccctgtggaagctctgtgcgatttcgagggcgaacagggcctgatctccagaggctattcgtatactttgcagaagaacaatggcgagagctgggaactgatggattcagccggtaacaaactgatcgcgcctgctgtatgtttcgtgataccaccaactgatcccgaggcactggccctggctgattccttgggctcccaatatcgatcagtgaggcagaaagccgcggggagcaaaaggacactgcaacaaaggtacgaagttctgaagactgaaaacccaggtgacgcctccgacttacagggaaggcagttgctggccgggctggacaaggtagcttctgacctcgatcggcaggagaaggctatcactggaatcttgagaccaccactcgagcagggaagagccgtacaggatagcgccgagagggctaaggatctgaaaaacattaccaatgaactgttacggatcgagcccgagaaaacacggtccacagcggaaggggaggcttttatacaggccctgccaggaagcggaactacccccctcctaaggacccgcgtcgaggatacaaataggaagtacgaacacttattacagctcttggatctggcccaggagaaggtggatgtggcgaaccggctggaaaaaagcctgcaacagagctgggaactcctagctactcacgaaaatcacctgaaccaggacgacacagtcccagagtcaagtagggtcctggactccaagggccaagaacttgccgccatggcatgtgaactgcaggctcagaagagtttgctgggtgaagtggagcagaacctgcaggcagcaaaacagtgcagctcgacgctggcgtctcgattccaggagcactgccctgatctggaacggcaggaggccgaggttcacaaattggggcagcgattcaacaatctgcgccagcaggtggaaagacgagcccaatccctccagagcgcaaaggctgcttacgagcacttccaccgcggtcacgatcacgtcctgcagttccttgtttccatcccatcatatgagccccaagaaaccgactctctgagtcagatggaaactaagctcaaaaaccagaagaacctcttggacgaaattgccagccgggaacaggaggtgcaaaaaatctgcgcaaattcacaacagtatcagcaggctgtgaaagattacgagctagaagccgagaagttaagatcattactcgatctcgaaaacggccgccgatcccacgtcagtaaaagggcccggctccagagcccggctactaaggtcaaggaggaggaagccgctctggcagcaaaattcacggaagtgtacgctattaaccgacagcgccttcagaatctggagttcgccctgaacctgttacgccagcaacccgaagttgaggtaacacacgaaaccctgcaaagaaatcgtcctgactccggcgtcgaagaagcctggaagataagaaaagagcttgacgaggaaactgaaagacgccgccagctcgaaaacgaagtaaagagcactcaggaggaaatctggacactaaggaaccaggggccccaggagagtgtcgtgagaaaagaggtccttaagaaagtccctgacccagtgcttgaagaaagctttcagcagctccaacgcacgttggccgaggagcagcacaagaatcaactgctgcaggaagaattggaggccctccagctgcagttgagagcactggagcaagaaaccagggatggaggccaagaatatgtcgtaaaggaggtcttacgtatcgagcctgatagggcccaagccgatgaggttctccagctgagagaagaattggaagcgctgaggcggcagaagggggcaagggaggctgaggtactgcttctacagcagcgcgtggccgccctggccgaagaaaagtcccgcgctcaggagaaagtcaccgagaaggaagttgtgaagctgcaaaacgatccccagctggaggcagaatatcagcagctccaggaagaccaccagcgacaggaccagctaagagagaagcaagaagaggagctgagttttctgcaggacaagttaaaacgcctagaaaaggagagggcgatggctgaaggcaaaataacagtgaaagaggtattgaaggttgaaaaggatgctgcgaccgaacgcgaagtgtcagacctgacacgccagtatgaggatgaagcggcgaaagccagagcttcccaacgcgagaaaacagagctgctgaggaagatttgggccctggaggaggagaatgccaaggtcgtggttcaagaaaaggttagagaaatagtgcgccccgatccgaaggctgagtctgaagtggctaacttgcggctggaactggtagaacaggaaagaaagtatcgaggcgccgaggagcagttgaggtcataccagtctgaacttgaggccctccgccgaaggggaccacaggtcgaggtgaaggaggtgacaaaggaagtcattaagtataagacggacccagagatggagaaggaactgcaacggctgcgagaggagattgtggacaaaactcgtctgattgagcgctgcgatctggagatttatcaacttaagaaggagatccaggcccttaaggacaccaaacctcaagtgcagacgaaggaggtggtacaggaaattctgcaatttcaggaagatcctcaaactaaggaagaggttgcctctctccgagccaaactgtctgaagagcaaaaaaaacaagtcgacctggaacgggagcgggcctcccaggaagaacagatcgcaagaaaagaggaagaattatctcgtgtaaaggagcgggtggtccagcaggaagtcgtccggtatgaagaggagcccggcctgcgcgccgaggcgagtgcattcgctgaatccattgatgtggagctgcgtcagattgacaagctgagggccgagctgaggcgtctgcagaggaggcgtactgagctcgagaggcaattggaggaactggaaagggaaagacaggccaggcgcgaagctgagagggaggtgcagcggctgcagcagagactggccgctctggaacaggaggaggcagaggcccgggagaaagtgacacacacacagaaagtcgtgctgcagcaggatccacagcaggcacgggagcatgccctactcaggctacagctggaggaagaacagcaccggcgtcagttgcttgaaggcgagctggaaacactcagacgcaagttggcggcattggagaaagctgaggtgaaggaaaaggtcgtcctctctgagtcggtccaggtcgaaaagggggacaccgagcaggagatccagagactcaaaagttctctggaagaagaatcaaggtcaaaaagagaattggacgtggaagtctcccgacttgaagcacgcctctctgaactggaatttcataactctaaatccagcaaggagctagacttcttgcgagaggagaatcataagttgcaactggaaagacagaacctacagttagaaacccgcagactccagagcgagatcaatatggccgctacagagacccgcgacctgagaaatatgacggttgccgattctgggactaaccacgattctagattatggtctcttgaacgggagctggacgatctaaagagactctctaaggacaaggatctcgagatcgacgagctgcagaagagattgggctcagtggccgttaagagggagcagagagagaatcatctgcggcgctccattgttgtgatccacccagacacgggtagggagctgtccccagaagaggcacatagggctggtctcatcgactggaatatgttcgttaagttgcggagtcaggagtgcgactgggaggagataagcgtaaaggggccaaatggtgagagctccgtcatccacgaccggaaatcaggcaagaagttttcaattgaggaagccttacagagcggacgcttgacccctgctcaatatgaccggtacgtaaacaaagacatgagtatccaggaactggcggtgttagtcagcgggcagaagtag

SEQ ID NO: 128181 - DNA, 4440 bp, Artificial Sequence
  Description of Artificial Sequence: Synthetic coding sequence
atggcgaagcgatccagagggcctggccgccgatgcctgcttgctctcgttctcttctgtgcgtggggtaccctggcagtggtcgcacagaaaccaggggcgggatgccccagtaggtgtctttgtttccgcaccacagtgagatgcatgcacctcctcctcgaggccgtgcccgcggttgcccctcaaacctcaatcttggatctacgctttaatcgaattagagaaatccagcccggcgccttcagaaggctgagaaatttgaatacactgttactgaataacaaccaaattaagcgtataccttcgggcgctttcgaggatcttgaaaatctgaagtacctgtatctgtacaagaatgaaattcagagcatcgatagacaggcttttaaggggttagcctcacttgaacagctttaccttcacttcaaccagatagagacactagatccagacagtttccaacacctgcctaagctggagcgcctgttcttacataacaaccggatcacacatctggttccaggtactttcaatcacttggagagcatgaagagactgaggctggactctaacacattacactgcgattgtgaaatcctttggctcgctgacctgttgaaaacctatgccgagtcgggtaacgcccaggccgccgccatctgtgaataccctcgcaggatccagggccgtagtgtggcaactatcacccctgaagaactaaattgcgagcgaccacgcatcacctcagagccacaggatgccgatgtcacctccggcaacaccgtctattttacttgtcgagccgaaggtaatcccaaaccagaaataatttggctcaggaacaataacgagctctcaatgaagactgactctaggctgaatctgctggacgacggtactctgatgattcagaacacgcaggagaccgatcaagggatctaccagtgcatggcaaagaatgtggcaggggaggtcaaaacgcaggaagtcactcttcggtacttcggaagtcctgctcgacccacgtttgttatccaaccccaaaataccgaggtccttgtgggtgagtcagtgacgctagaatgtagtgccaccggacacccacccccacgtatcagctggactcggggcgataggaccccactgccagtcgacccccgcgtgaacattaccccatccggagggttgtatatccagaatgtggtacagggagatagcggagagtacgcttgttctgctacaaacaatattgactcagtgcatgccaccgcctttattattgttcaggcactgcctcagttcacggtgaccccacaagatcgggtggtcattgaggggcaaactgtcgactttcagtgtgaagctaaaggaaatccaccaccagtgatcgcctggaccaagggtggttctcagttgtccgttgaccggcgccatctggtgctgtcctccgggacccttcggatcagcggcgtggccttacacgatcaaggccagtacgaatgtcaggccgtaaatattatcgggtcccaaaaagtagtcgcccaccttacagtgcagccccgcgtaacaccagtgttcgcctccatcccatccgataccacagttgaagtgggcgcgaacgtacaacttccatgttcatcccagggcgagccagaacccgccatcacgtggaacaaagatggtgtgcaggtgacagaatccgggaaatttcatatcagtcccgaaggcttccttaccattaatgacgtaggcccagctgatgcaggcagatacgaatgcgtggctagaaatacaattggaagcgcctccgtaagcatggtcctgtccgtcaacgtgcctgatgtgtccagaaacggggacccttttgtggccacctccatcgtggaggctattgccacagtggatcgggcgatcaattctacacgcacacaccttttcgacagccgcccccgcagccctaatgatttactcgccctgtttaggtaccctcgtgacccctatacagttgaacaggcacgagccggagagatcttcgagcggacacttcagctgatccaagagcacgtgcagcatggcttgatggtggacctgaacggcacttcatatcactacaacgatcttgtctccccacagtacctcaacctgattgctaatcttagcgggtgtactgcccatcggcgcgttaacaactgctcagacatgtgctttcaccagaaatatcgaacccatgatggtacctgcaataatctgcaacaccctatgtggggagcctccctgaccgctttcgagcgattgctaaaatcggtatatgagaatggctttaataccccccgcggcatcaatccacaccgcctgtataacggacatgctttgccaatgccacggctggtctcgaccactctgataggcaccgagactgtcacccccgatgagcaattcacccacatgctcatgcaatgggggcagtttttggaccatgaccttgatagcactgtggtggccttatcccaggccaggttctctgacggtcagcactgttccaatgtgtgctccaatgatcctccatgttttagtgtaatgatccccccaaatgattctcgggcccgctcaggagcaagatgtatgttctttgtgagatcaagcccagtttgcggtagcgggatgactagcctgctaatgaatagcgtctacccacgggagcagatcaaccagctgacctcttacattgacgcttccaacgtgtatggctcaaccgagcatgaagcacgctcgatacgcgacctggcctcccaccgcggcctgctgcgacagggaattgtccaacggtcaggcaagccgctattaccttttgccaccggccctcccaccgagtgcatgagggatgaaaacgagtcccccatcccctgttttctggcaggcgaccatcgggcaaacgagcagcttggacttacatctatgcacacactctggttccgggagcacaatcgcattgctaccgaacttctgaaactcaaccctcattgggatggggatactatctattacgaaactcgtaaaatagtaggggcagaaattcagcacatcacttaccagcactggctcccaaaaatccttggggaggtaggcatgcggacactgggggagtatcatggatatgaccctggaattaacgctgggatctttaatgccttcgccacagctgctttcaggtttggacacactctggtcaacccacttttatatagacttgacgaaaatttccagcctatcgcccaagatcaccttccgcttcataaggcatttttttcaccattccgcatagtaaacgaagggggaattgatcccctgcttaggggcctgtttggcgtcgctggaaaaatgcgggtgcccagtcagctgctgaacaccgagctcactgaacggttgttctcgatggcgcatacagtcgcactggatttggccgctattaatatccaacgcgggcgagaccatggaatacccccttaccacgactaccgcgtgtactgcaatctgtcagctgcacacacattcgaggatttgaagaatgaaatcaaaaacccagagatacgcgaaaaactaaagcgcctatacgggtctaccttgaacatcgacctgttcccggcactggtggttgaagatctagtgcccggtagtcgactcggtcctacgctcatgtgcctcctttcaacgcagtttaaaagactgagagacggtgataggctttggtatgaaaaccctggggtattctctcctgcgcagttaacacaaattaagcagacctcattggctaggatcctctgtgacaatgccgacaatataaccagggtgcaatcggacgtgtttcgggtggctgaattccctcatggatatgggtcatgcgacgagattccccgggtcgaccttcgagtttggcaggattgctgcgaggactgccgtacacggggacagtttaacgctttctcatatcattttcgcgggaggaggagcctggagttttcctaccaggaagataagcccacgaaaaagacgcggccaaggaagattcctagcgtagggcgacaaggcgaacacctcagcaatagtacatccgccttcagcacccgctctgacgcctcagggaccaacgattttcgcgagttcgtgctggaaatgcagaagactattaccgatctgcgaactcagataaaaaaactggagagccggctaagcacaacagaatgcgttgatgctggcggggagtctcacgcaaataacaccaagtggaaaaaggatgcctgtacaatttgcgaatgcaaagacggccaggtgacatgctttgtggaagcctgtccgcccgccacttgcgcagttccagtcaatatccccggcgcctgttgccctgtctgtcttcagaaaagagcagaagagaaaccatag

SEQ ID NO: 128182 - DNA, 2172 bp, Artificial Sequence
  Description of Artificial Sequence: Synthetic coding sequence
taaagggggcccgggaggaggtgtctgcttgctcttgtcctgttctgcgcctggggaactctcgcggtcgtggctcaaaagccaggtgccgggtgccccagcagatgcctctgctttaggactacggtgcggtgtatgcacttgttgcttgaggccgtgccagccgtcgctcctcagaccagtatcctcgatcttagattcaatcggattagagagattcagccgggggcatttagaagactgcggaatctgaacacattgttactgaataacaatcagataaagagaattcccagtggcgcatttgaggatcttgaaaatctgaagtacctgtatctgtacaagaacgagatacagagtattgaccgccaagccttcaaaggactggcaagtctggagcagctttacctgcatttcaaccagatagagacgctcgatcccgactcctttcagcacctcccaaaactggaaagactcttcctccacaacaaccgcataacccacttggtgccagggacgtttaatcatttggagtcaatgaaacggttgcgactggactctaacaccctgcattgtgattgtgagattttatggctggcggacttgctgaagacttatgctgagagcggaaatgcacaggccgctgctatctgcgagtatccgaggcggatccagggcaggagcgtggccacaatcacacccgaagagctgaactgtgagcgcccccgcatcacatccgaaccccaagacgcagacgtcaccagcggaaatacagtgtacttcacatgcagggccgaaggcaaccccaagcctgagatcatctggctacgcaataataacgagctttctatgaagaccgatagtcggttaaatctgctagacgatggcaccttgatgatccagaatactcaggagaccgaccagggcatctaccagtgtatggccaagaacgtggctggcgaagtaaaaacgcaagaggttaccctgaggtacttcggctctccagcacgtcctactttcgtcattcagccacagaacactgaagtgctggttggagaatccgtgacattggaatgctcggctactggccacccacctccaagaatatcatggactcggggtgaccgaaccccgcttcctgtcgatcctcgcgttaacataactccatcaggaggtctctacatccagaacgtggttcagggcgactccggtgaatacgcatgctccgctaccaacaatatagatagcgtccatgccactgccttcatcattgtgcaggccctccctcagtttaccgtgacaccccaggatagagtcgtgattgaaggccagacagtcgattttcagtgtgaggcaaagggcaatccaccccctgtaatcgcctggaccaagggtggctcccagctcagcgtcgaccgtcgtcacttggtgctcagcagcggcaccttgcgcatcagtggagtggcactgcacgatcagggacagtatgaatgtcaagcagtgaatatcatcgggagccaaaaagtcgttgcccaccttaccgtccaacctcgggtcaccccagttttcgctagcattccctcggataccacagtcgaggtgggcgccaatgttcagctgccttgtagctcccagggggagcccgagccagcgattacttggaacaaagatggcgtccaggtgacagaaagcggtaagttccacatatcaccggagggcttcctgacaatcaacgatgtgggacctgcagatgcaggtagatatgaatgcgtggcccggaacactataggatccgctagtgtttcgatggtcctcagcgtgaatgtgccggacgtgtctaggaatggtgatccttttgttgcaacctccattgtggaggccatagccactgtggatcgtgctattaacagtactcgaactcacctgttcgacagcaggccacgttcacctaatgatctgttggcacttttccggtatccaagagacccttacactgttgagcaagctcgcgctggcgagatcttcgagagaacattgcagctgatccaggagcacgtccagcacgggcttatggtggatttgaacggcacaagtcagtgccagagcttgttctttctgctgcacggtctcagcaacggtgtcgagcacgcctccgtgaagtcccactcctag

SEQ ID NO: 128183 - DNA, 771 bp, Artificial Sequence
  Description of Artificial Sequence: Synthetic coding sequence
atggcagccgccgtcggccgactgctcagagcctctgtagccaggcatgtaagcgcaataccatgggggatttcggcaacagccgctctgcggcccgctgcatgcgggagaacttcactgactaacctgctttgctccggctcgagtcaggcgaaactgttttctacctccagttcctgtcatgcccctgccgtgacccaacatgccccctactttaagggaaccgccgtcgtaaatggggaatttaaggacctgagcctcgacgattttaaaggcaaatatcttgtgctattcttttacccgttggattttacatttgtgtgtccgaccgagattgtggcctttagcgacaaggccaatgaatttcatgacgtaaactgtgaggttgtggccgtcagtgtggactcccacttcagccatttagcctggattaatactcctcggaagaacggtggccttgggcacatgaatatagccctgttgagtgatttgacaaagcagatcagcagggactatggcgtgcttctagagggcagtggtctggcgctcagagggctgttcatcattgaccccaatggcgtaattaagcacctgtccgtaaacgatctgccggtcggccgatctgtggaggagaccctgcggcttgtgaaggcgtttcagtacgtggaaacccacggcgaagtgtgccctgcgaattggacacctgattctcccacaatcaagccctccccagcagcttccaaggagtacttccagaaagtcaaccagtag

SEQ ID NO: 128184 - DNA, 717 bp, Artificial Sequence
  Description of Artificial Sequence: Synthetic coding sequence
atggctgcggctgtggggcgcctgctgcgagcctccgtggctagacatgtgtccgctattccatggggtatctccgccacagccgccctgcgacccgccgcttgcggcaggacatcgctgactaacttgctttgttctggctccagtcaggccccgtactttaaagggacggcagttgtaaatggggaattcaaagatctcagcctcgacgattttaagggcaagtacctggtcctctttttttaccctctcgatttcaccttcgtgtgtccaaccgaaatcgtcgcattcagcgataaggccaacgagttccacgatgtgaactgcgaggtagtagccgtgagcgtggatagccatttttcccacctggcatggatcaacacccccagaaagaatggaggcctcgggcacatgaacatcgccctgctaagcgacctgaccaagcaaattagcagggattacggagtgctcttggagggtagcgggctggcactcagaggacttttcattattgatcctaatggtgtcatcaaacacctgtccgtgaatgacctgccagtggggcggagtgtggaggagacattgaggctagtaaaggcctttcaatatgtggaaacacacggggaagtatgtccagcaaactggactccggactctccaactataaaacccagtcccgccgccagcaaggaatatttccagaaagttaaccaatag

SEQ ID NO: 128185 - DNA, 645 bp, Artificial Sequence
  Description of Artificial Sequence: Synthetic coding sequence
atgggacttgctggggtctgcgccctcaggcggtccgcgggttatattttggtggggggtgccggagggcagagtgcagctgcagctgcccgccgatattctgagggagagtgggcttcaggtggcgtacggtctttcagccgagctgccgctgccatggcaccaattaaagtaggagatgccatcccggcggttgaggtttttgaaggggagcccggtaacaaggtaaacctggcggagttgttcaagggcaaaaagggagtgctgttcggggtgccaggtgccttcacaccaggctgcagcaaaacacatctccctggatttgtggagcaggccgaggcacttaaggccaaaggcgttcaggttgtggcctgcttgagcgtaaacgatgccttcgttactggtgagtggggccgggcccataaagcagagggaaaagtccgtctgctcgctgatccaaccggcgcctttggcaaggaaacagacctgctgctcgatgatagcctggtcagtattttcgggaatcgcaggctgaaaagattcagtatggtggttcaggatgggatcgtgaaagctctcaatgtggagcccgacggcactggacttacttgcagccttgcaccaaatattatatcacagctgtag

SEQ ID NO: 128186 - DNA, 378 bp, Artificial Sequence
  Description of Artificial Sequence: Synthetic coding sequence
atggggctggccggtgtgtgcgccctccgcaggtcggccggatacatactggtcggaggagccggtgggcagagtgctgccgcggcggctaggaggtactccgagggcgaatgggcttctgggggagtccgatcatttagcagagcagccgcagcaatggcccccattaaggtgcgcctcttggccgatccaacaggagcttttggcaaagaaactgacctcctgttagatgacagtttagtgagcatttttgggaacaggcggctgaaacggttttccatggtggtgcaagacggcattgtcaaggccctgaacgtagagccggatgggacaggtttaacctgttcactggcccctaacattatctcacaactctag

SEQ ID NO: 128187 - DNA, 513 bp, Artificial Sequence
  Description of Artificial Sequence: Synthetic coding sequence
atgggcctggccggtgtatgcgctctacgcagaagcgccggctatatcctggtgggcggcgccggtggccagagcgcagccgctgcagctaggcgatattctgagggagagtgggcttccggcggcgttcgatctttttcccgggctgctgcagcgatggccccaatcaaggtgggagacgccatacccgccgtcgaggtcttcgaaggcgagccgggaaacaaagtaaacttagccgaattgttcaagggcaagaagggtgttctgttcggagttcctggcgcctttacaccaggatgtagcaaggtgagattactagccgacccaactggagcctttggtaaggagaccgacctgctactagatgattccctggtctctatctttggaaacagacgtctaaagcgcttctcaatggttgttcaggatggcattgtcaaggcgctgaacgtcgaacccgatggcaccggcctaacctgttcactggcccccaatatcatcagccaactctag

SEQ ID NO: 128188 - DNA, 675 bp, Artificial Sequence
  Description of Artificial Sequence: Synthetic coding sequence
atgcctgggggcctattactaggggatgtggctcctaatttcgaagccaataccaccgtgggacgcataaggttccacgacttcttgggcgattcttgggggatcctgttctcacacccaagagattttacgcctgtttgtaccactgagcttggccgcgccgccaagctggcccccgagtttgcgaagcgaaacgtgaagcttatcgctctgtctatcgactccgtggaggatcatcttgcatggagtaaagatattaacgcctacaactgcgaggaacctactgagaagctgcccttccctatcatcgatgaccgcaaccgcgagctggcaatcctgctggggatgttggaccctgctgaaaaggacgaaaaagggatgcctgtaactgccagagtggtgttcgttttcggccctgataaaaaactcaaattatcgatattgtaccctgccaccacaggcagaaacttcgatgaaattttacgagtggtcataagtctgcagctcactgcagagaagagagtggctactcccgtcgattggaaagacggagactcggtgatggtgctgcctacaattccagaggaagaggcgaaaaaactgtttccaaaaggagtgtttaccaaggagcttcctagcggcaagaaatatctgaggtatactcctcagccctag

SEQ ID NO: 128189 - DNA, 3852 bp, Artificial Sequence
  Description of Artificial Sequence: Synthetic coding sequence
atgtggggctctgatcggttagcaggagccggaggggggggcgctgcggtaactgtcgcattcacgaatgcaagggattgctttctacacttgccaaggagacttgtggcccaacttcatctgctacagaatcaggctattgaggtcgtatggtcccaccagcctgcattcctcagctgggtggaaggccggcacttttccgaccagggagagaacgtggccgagatcaacaggcaggtaggccagaagcttgggctcagcaacggcgggcaggtcttcctcaagccctgcagccatgttgtttcttgccaacaggtggaagtggagcccctgagtgcagacgactgggaaatcttggaactgcacgcagtatctctcgagcaacacttgctggatcagatcaggatagtctttcccaaagctatttttcctgtgtgggtggaccaacagacgtacatcttcatacaaatcgttgccctaattcccgcagcctcttatggacggctggagaccgacactaagcttttgatccaaccgaaaacccggcgggcaaaggaaaatactttttccaaggcagatgcggaatacaagaagctgcattcctacggacgcgatcagaagggaatgatgaaagagctgcagaccaaacaacttcagtccaataccgtcgggattaccgaatccaatgaaaatgagtccgagatccccgtggattcttccagcgtagcatccttatggacaatgatcggcagcatctttagctttcagtccgaaaagaagcaagaaacgtcgtgggggttgaccgagattaatgcctttaagaatatgcaatctaaggtcgtgccactggataatatctttagagtttgcaaatctcaacctccatcgatttacaatgcgtcagctaccagcgtgtttcacaagcactgtgcgatccatgtcttcccttgggatcaagagtattttgatgtggagccatcattcactgtgacatacggcaagctcgtgaagctgctaagccccaagcagcagcagtcgaaaaccaaacagaacgtgttaagtccagaaaaggaaaaacaaatgtccgagccgctggatcagaagaagattcgtagcgatcataatgaggaggacgagaaggcttgtgtgttgcaggtggtgtggaacggcttggaggagctgaacaatgccatcaagtacactaagaatgtggaggtgctgcatctgggcaaggtttggatccccgatgaccttcggaaaagactgaatatagaaatgcacgccgtggtcaggattaccccagtggaggtgactcccaagatcccacgaagcttgaagcttcagcctcgcgagaacctgccgaaagatatctcggaggaggatatcaagacagttttttacagctggcttcaacaatccacaacgacaatgctgcctctggtgatttccgaggaggaattcattaagctcgagacgaaagatggcctgaaagagttctcactgagcatagtgcactcctgggaaaaggagaaagacaaaaatatctttctgctgagtccaaacctcctgcagaaaactaccatccaagtgctgctggatcccatggtcaaggaagagaatagtgaagagattgatttcatcctcccattcctaaaactgtccagcctgggaggcgtcaattccctgggtgtaagttccctagaacatatcacacacagtctcttaggtcggcccctgagcagacagctgatgtccttggtggccgggctccgcaacggcgccctgttacttactgggggtaagggatctggcaagagtacgctcgcgaaggccatttgcaaagaggcatttgacaagctcgatgcccacgtggaacgggtcgattgcaaggctcttagaggaaaaagacttgagaatatccagaaaacactggaggtggctttctctgaggcagtgtggatgcaaccctctgtcgtcctcttggatgacctagacttaattgctggcttgcccgctgtacccgagcacgagcacagcccggatgcggtgcagagtcagcgcctggcgcatgcattgaatgacatgattaaagaattcatctccatggggagtctcgtcgctctgatcgccacatcgcagtcccagcagagcctccatccccttctggtctcggcccagggtgtgcacatattccaatgtgtccagcacatccagcctcctaaccaagagcagcgctgtgagattctttgcaatgtgattaaaaacaaacttgattgcgacatcaacaaatttacagatttggacctgcagcacgttgccaaggaaacggggggctttgtggctcgcgactttacggtacttgttgaccgcgcaatccacagccggcttagtagacaatctatttcaactagagagaagcttgtgctgactaccctggacttccagaaagctctgcgcggatttctgccggcaagcctacgatctgtcaacctgcataaaccaagggacctgggctgggataagatcggcgggctgcacgaagtgaggcagatcttgatggacactatccaattacccgccaagtaccccgagctgtttgccaatttacccatccgccagcggaccggaatcctgctctatggccctcccggcacaggtaagaccctgctcgccggagtgatcgctcgtgaatctcgcatgaatttcatctctgtcaaaggaccggagctgctcagcaaatacatcggtgctagcgaacaagccgtgagagacattttcatacgggcacaggcagccaaaccatgtatcctctttttcgatgaattcgagtccattgccccaagaaggggtcatgataataccggggtcaccgacagggtggtgaaccagctgctcactcagctggacggcgtggagggattacaaggggtctatgtccttgcggccacttcacggcccgaccttatcgatcccgccttgctccgaccagggcggctggataagtgtgtttattgtccacccccggaccaggtgagccggctggagatattgaatgttctgtccgatagcctccctctggccgacgacgtcgacctccagcacgtggcctctgtgaccgatagcttcacaggagcagacctcaaggcactgctgtacaatgcccagctggaagctctgcatggcatgctcttgagctccggactacaggatgggtcttccagctcggatagtgatctttctttgagtagtatggtgtttctgaaccactcctcaggctctgacgacagcgctggggacggcgagtgcggcctggaccagtccctcgtgtccctggaaatgtccgaaattcttcccgacgagtcgaaattcaacatgtatcgattgtacttcggaagttcatacgaatctgagctggggaacggcacatcaagtgatctgagctcccaatgtctgtccgctcctagttctatgacccaggacttgccaggtgtcccgggcaaagaccaattatttagtcagcctcccgtactgcgcacagcaagccaggaggggtgtcaagagctgacgcaagaacagcgagaccagctccgggcggacattagcattatcaaaggtcgctaccggagccagtctggcgaagatgagtctatgaatcaacccggcccaattaagactcgtctcgcgatcagtcagtctcatcttatgacagctttgggccacacccgcccttccatttctgaagacgattggaaaaatttcgcagaactgtacgagtcgttccaaaaccccaaacggagaaaaaaccagtccggtactatgtttcgaccggggcagaaagtcacattagcttag

SEQ ID NO: 128190 - DNA, 3681 bp, Artificial Sequence
  Description of Artificial Sequence: Synthetic coding sequence
atgtgggggagtgaccgcctggctggagcggggggaggcggcgctgctgtaaccgttgcattcaccaatgcccgggattgttttttacatctgccacggcgcctcgtggcacagctgcatttgctccaaaaccaggctatagaagtggtttggagccatcagcccgcctttctatcttgggtagagggacgccatttcagcgaccaaggggagaatgtggccgaaattaatcggcaggtgggtcagaagctggggctctctaatggcgggcaagtattcctcaagccatgttcacatgtggtttcctgtcaacaggtcgaagtggagccactgtctgcagatgattgggaaattctggagctccacgccgtgtccttggagcagcacctgttagaccaaataagaatcgtgtttcctaaagccatctttccagtgtgggttgaccagcagacctatatcttcattcagatcgttgccctgattccggcagctagttatggtcgtctagaaaccgacaccaagctgctgatacagccgaagacacgtcgtgctaaggaaaatacgttcagtaaggcagacgctgagtataagaagctccattcatacggaagagatcagaaagggatgatgaaggaattacagactaaacagcttcagtccaacaccgtgggcattactgaatccaatgagaacgagtcggaaatccccgttgattcctctagcgtggcaagtctgtggactatgatagggtccatcttttcctttcagtcggagaagaagcaggaaacctcatggggtcttaccgagatcaatgcttttaagaacatgcaatcaaaggtagttccattggacaacattttcagggtgtgcaagtctcagccaccatctatctacaacgcatcagcgactagcgtctttcataaacactgcgcaattcacgtctttccatgggatcaagaatactttgatgtggagccatcgttcactgtgacttatgggaaactggttaagctcctgtctcctaagcagcagcaaagcaagaccaagcagaacgtgctttcccccgaaaaggagaagcagatgtcagaacccttagaccagaagaagataagaagcgatcacaacgaagaggatgaaaaggcctgcgtcttacaggttgtttggaacggtctagaagagttgaacaacgccataaaatacaccaaaaacgtggaagttcttcacctggggaaggtttggatacccgacgatctgagaaaaagactgaacatagaaatgcatgcagtcgtgcgaatcaccccagttgaagtcacacccaaaatccctaggtctctcaagctgcagccaagagagaacctgccaaaagacatctctgaggaagatattaaaacagtgttctactcctggctgcagcaatcgacaacaacaatgttacccttagtgattagcgaagaagaattcattaagttggagaccaaggacggactcaaggagtttagcttgagcatcgttcactcatgggagaaagaaaaggataaaaacatcttcttactgagccccaatctgttgcaaaaaaccacgatacaggtactgctggacccaatggttaaggaagagaatagcgaggagattgatttcatcctgcctttccttaagctcagcagcctgggaggagtgaactctttaggtgttagttcacttgagcatatcacacactcactgttgggacgccccctgagtaggcagttgatgagcctggtggccgggctgaggaacggtgctctactccttactggaggcaagggcagtggtaagtccactcttgccaaagccatatgcaaagaagccttcgacaaactggatgcacacgttgagcgcgtcgattgcaaggcactcagagctttgaatgatatgatcaaggagttcatcagcatgggctctctcgtggccttgatcgcgacttcccaatcacagcaaagcctacaccccttgctggtgtcagcacagggcgtgcacatctttcagtgtgtgcagcacattcagccacccaatcaggagcagaggtgtgaaattctgtgcaatgtgattaaaaacaaattggattgcgatatcaacaaatttaccgacctggacctgcagcacgtcgccaaggagacaggaggattcgtggctcgggactttactgtgctcgtggatcgcgctatccacagtaggctgagccgccagagcatcagcactcgagaaaaattggttcttactacactagatttccagaaagcgttgagaggcttccttccagcctctttgcggagcgtcaatcttcataagcctagggacctggggtgggacaaaatcggcggcctgcatgaagtccgccagatcttgatggacaccattcagctgcctgccaaatatccagagctgttcgccaacctcccaatcagacagagaacagggattctgctgtatggaccaccaggcacaggtaaaaccctgctggccggagttatagctcgggagtcacgaatgaatttcatctccgtgaagggaccagaactcctttcgaagtacattggggctagcgagcaagctgttagggacatctttatacgagctcaggctgccaagccctgtattctgttctttgacgagtttgaaagtattgcgccgaggcggggacacgataacaccggggtcactgacagagtggtcaatcaacttctgactcagttagatggtgtggagggcctacagggcgtatatgttctcgccgcaacatctaggcctgacctgatcgatcctgccctcctgcgcccgggtcgcctggacaagtgtgtctactgtcctccaccagaccaagtctcacgactcgagatcttgaacgtgctcagcgactccttgcccctggccgatgatgtcgatctgcagcacgtagcttctgttactgattcattcaccggcgctgacctcaaggcattactctataatgcacagctcgaggctctgcatggaatgttgctgtccagtggcctccaggacggtagcagtagctccgacagcgacctgtcgctgtccagcatggtgttcctgaaccacagctctggaagtgacgatagcgccggcgatggggagtgtggtctcgaccagtcacttgtctccctagagatgtctgaaattcttcctgatgaaagtaaattcaacatgtataggttgtacttcggctcttcctatgagtccgagctgggtaatggtacgagcagtgacctttctagccagtgcctgagcgccccctcttccatgacgcaggaccttccaggagtgcctggaaaggaccagttattttcccagcctcccgtgctccgtacagctagccaggagggttgccaagaactcactcaagaacagagggatcaactccgggcagacatttccatcatcaagggaaggtaccggagccaaagcggggaagatgagagcatgaatcaaccaggtcccatcaagacccgcctggcgatctcacagagccatctcatgaccgccctgggacatactcgaccatcaattagcgaggatgattggaagaatttcgctgaactgtacgaaagttttcagaatccaaagcgtagaaaaaatcaaagcggcactatgtttcgtccgggccagaaggtcacccttgcatag

SEQ ID NO: 128191 - DNA, 483 bp, Artificial Sequence
  Description of Artificial Sequence: Synthetic coding sequence
atgagcctcgtcgctggactccgcaacggggcgttgctgctcactggaggaaagggctccggtaagagtacactggctaaggccatatgcaaggaggcattcgacaaactggacgcgcacgtagaaagagtggactgcaaggctctgagaggcaagcgcttagaaaatatccagaagacactggaggttgccttttccgaagctgtgtggatgcagccgtcagttgtcttgcttgatgatctcgatctgattgctggcctccccgctgtccctgagcacgagcatagtcctgacgctgtgcaatctcagcgactcgctcacgcgctaaatgatatgattaaagaatttatcagtatgggcagcttagtggcccttattgccaccagccaaagccagcagtccctgcacccgctgctggtcagcgctcagggggtgcacatctttcagtgcgtccagcacattcagccccctaatcaaaattag

SEQ ID NO: 128192 - DNA, 1899 bp, Artificial Sequence
  Description of Artificial Sequence: Synthetic coding sequence
atgtgggggagcgaccggttggccggcgctggcggaggcggagcggctgtcacagtcgccttcactaacgctcgcgattgcttccttcatttaccgaggcgccttgtggcacagctccatcttctgcagaatcaggccattgaggtggtgtggagccatcagcctgcattcctatcatgggtggagggtagacactttagcgaccagggggagaacgtggctgaaatcaaccgccaagtgggccagaagctgggactctccaacggtggacaggtgtttctgaaaccttgtagccatgttgtcagctgtcagcaagtggaagttgaaccactctcagccgacgactgggagattctcgagttgcacgctgtgtcactcgaacaacaccttttagaccagatcaggatcgtgtttcccaaggccattttcccagtgtgggtggaccagcagacctatatcttcattcagattgtggccctcattcccgccgcatcctatggccgattggagacggataccaagttgttgattcagcctaagacgcggcgcgctaaagaaaatactttcagtaaggccgatgctgaatacaaaaagctgcattcctacggccgcgaccaaaaaggcatgatgaaagagctgcagacaaagcagttacagtctaatacagtgggcattacagagagcaatgaaaacgagtctgagatcccagtggacagctcctccgttgcttctctgtggactatgatcggcagcatctttagctttcagtcagagaaaaaacaggagacctcctgggggctgaccgaaattaatgcttttaaaaatatgcagtccaaggtcgttcctctggacaatatctttagagtttgcaagagccagcctccaagcatatataacgcttcagccacaagtgtgttccataaacactgtgcaattcatgtgttcccttgggaccaggagtacttcgacgtggaaccttcatttacggtaacatacggaaagctggtcaaactcctgagtccaaagcaacaacagtctaaaactaagcagaacgttctcagtcctgaaaaggagaagcagatgagcgaacctctggatcagaagaagatccgtagcgatcataacgaagaagatgagaaggcatgcgtgttacaagtcgtatggaatggattagaagaactcaacaatgccatcaaatacaccaagaatgtggaagtcctgcatctggggaaagtttggattccagatgacctgaggaaacgcctgaatattgaaatgcatgcagtggtccggatcacgccagtggaggtaactccaaagattccgagaagtctgaagctgcaacccagggaaaatctccccaaggatataagcgaggaggatatcaagactgtcttttacagctggcttcaacagtcgactacgactatgcttccactggtgatttcagaggaggagttcattaagctagaaacaaaagacggtcttaaggagtttagcctgtcgattgtgcacagctgggagaaagagaaggacaagaacattttcctgctgtcccccaacttgctccagaaaaccacaattcaggtgctccttgatcccatggtgaaggaagaaaacagcgaggaaattgacttcattctcccgtttctcaagctcagtagcctaggtggggtgaatagtctgggagtgagtagcttagaacacattacgcattctttactcgggagaccacttagtagacaactgatgtctctcgtcgcgggcctcaggaacggagccctgctcctgacggggggaaagggcagcgggaaatccacgctggcgaaagctatctgtaaagaggcattcgataagctggacgcccacgttgaacgcgttgactgtaaagctctgtag

SEQ ID NO: 128193 - DNA, 1041 bp, Artificial Sequence
  Description of Artificial Sequence: Synthetic coding sequence
atggcccccgcagctgcttctcctcccgaggtcatacgagctgcacaaaaggacgagtactacagaggaggactgagaagcgctgctgggggcgcactgcacagccttgccggtgcgagaaagtggcttgagtggcgaaaggaagtcgagctactgtccgatgtcgcctactttggcctcacaaccctggccggctatcagaccctgggagaggagtacgtgtccattattcaggtagatccttcgcggatccacgtgccctcgtcacttcgacggggcgtgctggtcacactgcacgctgtactaccatacctgctggacaaagccttactgccgttggagcaggaactacaagcagatccggacagtggcaggcctctgcaaggcagcctcgggccaggcggaagaggctgcagcggggctagacgctggatgcggcaccacacagctactctcactgaacagcagcgtcgggctctgctccgcgcagtattcgtgttacgacagggcctagcgtgcctacagcggctgcatgtggcttggttttatattcatggcgtattttaccatttggccaagagattgaccggcatcacataccaggctcttagaccggatcctcttagggttctgatgtcagtggctccgtccgctctccagttgcgggtgcggagtttaccaggcgaggaccttagggccagagtgagttataggctgcttggcgtgatcagcctgctacatctggtattgtctatgggcctgcagctctacggcttcaggcaacgccagcgcgcgagaaaagagtggcggctgcatcgaggcctttctcaccggcgcgcatcactggaggagcgtgccgtttcacgcaaccctctgtgcaccctctgcttagaagaacgcaggcacccaacggcaacaccatgtggccacctgttctgttgggagtgtatcacagcttggtgctccagcaaggcagaatgtcctctgtgtcgggaaaaatttccccctcagaaactcatttacctgcggcattacagatag

SEQ ID NO: 128194 - DNA, 981 bp, Artificial Sequence
  Description of Artificial Sequence: Synthetic coding sequence
atggcacccgccgctgcctctcctcctgaggtaatcagggccgcccagaaggacgaatattaccgtgggggcctccgaagcgccgcaggaggggccttacactccctagcaggggcaagaaaatggctcgagtggcgcaaggaggtcgagctcctttccgacgtggcctacttcggtctcaccactctggccgggtaccagaccttaggagaagagtacgttagtattatacaggtcgatccatctaggattcacgtaccttcctcacttagaaggggagtgttggtgactttgcacgctgtgctgccttacctgctagataaggcactgttgccgctcgaacaggaattgcaggccgatcccgacagcgggagacctctgcagggatcattgggccctggcgggaggggctgtagcggcgctaggagatggatgcgacatcatacagccactttaaccgagcaacagcgaagggcactccttcgtgctgtgttcgtgctacgtcaggggctggcttgcctccagaggctgcacgtcgcttggttctatatccacggagtcttttaccacctggctaaacggctcacaggaatcacatacctgagggttaggagcttgccaggcgaagacctgagagctcgcgtgtcataccggctgctgggggtaataagtctattacaccttgttctatccatgggtctgcagctctatggttttcgccagcgccagagagcgcgcaaggagtggcgcctgcacaggggtctgtcccaccgtagggcctctctggaggaacgggcagtgtcacgaaatcccctctgcacactctgcctggaggagcgtcggcatccaactgcgacaccctgcggccatcttttctgttgggaatgtatcacagcttggtgttcgagcaaggcagagtgcccgctgtgtcgggaaaagttcccgccgcagaaactcatctacctgagacattatcgctag

SEQ ID NO: 128195 - DNA, 744 bp, Artificial Sequence
  Description of Artificial Sequence: Synthetic coding sequence
atggacgcatttacgagatttactaaccagacacaaggccgggatcgcctgtttcgtgccacacagtacacatgcatgctgctccgttatctgctcgagcccaaggccggcaaagagaaagtcgtgatgaaactcaaaaaactggaaagcagcgtgagcactggacgtaagtggtttaggcttggcaatgtcgtccacgccatacaagctaccgaacagagcattcatgccaccgacttagtccctcgcctttgcctgaccttggccaacttgaaccgggtcatttacttcatctgcgacactatcctgtgggtgcgatccgtcggcttgaccagtggaatcaacaaggagaagtggagaaccagagcggcccatcattactactatagcctgctgctgtccctggtcagggacctctatgaaatctctctgcagatgaaacgcgtgacgtgcgaccgggccaagaaggaaaaaagtgcttcccaagaccccctgtggttcagtgtcgccgaggaagagacagagtggctccagtccttcctcctgctgcttttccggtcgctgaagcagcacccaccacttctactggacacagtgaagaacctttgtgacattctcaatccccttgaccagctgggcatatacaagagcaatcctggtattatcggccttggcggtctcgtctcctccatagcaggcatgattactgtggcttatcctcagatgaagctgaagacacggtag

SEQ ID NO: 128196 - DNA, 1209 bp, Artificial Sequence
  Description of Artificial Sequence: Synthetic coding sequence
atgccatggaagctgtggcgcggcagtgtgggctgccctggggacctctcctctgacggtcttctattcaggttgggacctcctaaaccaccaacagaattagagccggaaccggaaatagagggtctgctcacacctgtgctagaagccggggacgtggatgaaggaccagtggcccgcccactctcaccaacacgcctgcagcccgccctgccgccggaggcgcagtccgttcctgagcttgaggaggtggcccgtgtcctcgctgagattccacgacccctgaaacggcgggggagcatggaacaagcacctgccgtggccttgccacccacacacaaaaagcagtaccagcagatcatatctcgactgtttcatagacatggaggccctggtcctggcgggcctgagccagaactcagtcctattaccgaagggtccgaggcaagggctggccctcctgcacctgcaccccccgcaccaattcctccacccgctccttctcagtcttccccacccgagcagccccagagcatggaaatgcgatcagttctgagaaaagctggctctcctagaaaggctaggcgagccagactcaatccgcttgtgttgctgctcgacgccgccctaactggcgagttggaggtcgttcagcaggctgtcaaagaaatgaacgacccctctcaacccaatgaagagggaataacagctctgcataatgccatctgcggtgctaattatagcattgttgacttcctgattaccgccggagctaatgtgaactcaccagactctcacggttggactcctttgcactgtgcagcctcatgtaacgataccgtgatctgcatggcacttgttcagcatggtgccgccatctttgcaaccaccttaagtgacggggccacagcttttgaaaagtgcgacccttatagagaaggttacgcagattgcgcaacttaccttgcggacgttgagcaatccatgggcctgatgaatagtggagctgtgtacgccctgtgggactactctgctgagttcggcgacgagctgtccttcagagagggcgaatccgtgaccgtgttacgacgggatggacccgaagagacagactggtggtgggcggctctgcacggccaagagggctatgtccctagaaattactttggcttgttcccacgcgtcaagcctcaacgatctaaagtctag

SEQ ID NO: 128197 - DNA, 507 bp, Artificial Sequence
  Description of Artificial Sequence: Synthetic coding sequence
taataccgcggccgggacaggctcattcgggtgctgggatattgttgccagctggtaggaggcgtgctggtggagcaatgtcctgcaagaagtgaggtggggacccgcttgctggtggttagcacacaattaagccactgtcgcaccatccttagactgtttgatgaccttgcaatgttcgtttatactaaacagtatggcctcggggcccaagaagaggatgcattcgtaagatgcgtctctgtgctgggcaatctggccgaccagttgtattacccttgcgagcatgtcgcctgggccgcagacgctagagtgctgcacgtggactcttcccgatggtggacactctcaacaactttatgggctttgtctttactcctgggcgtggcccggtctctatggatgctgcttaaactcagacagcgactgagatctcctacggctcctttcacctccatgtatcaggccgccagggccggtggccaagccgaggctactactccctag

SEQ ID NO: 128198 - DNA, 1212 bp, Artificial Sequence
  Description of Artificial Sequence: Synthetic coding sequence
atggcctctcagcctccccccccgccaaagccgtgggagacgaggcggatcccaggggccggacctggacccggcccaggccctacgtttcagtcggcagacctcggacccacactgatgaccagacccggccagcccgctctgactagagttccaccacctatacttccgaggccaagccagcagaccgggtcttcttccgttaacacattccgccccgcttactcaagtttcagttccggctatggcgcatacggcaactccttctacggaggttactcaccatacagttacggctacaatggcctcgggtataaccgcctgcgagtggatgacctgccccccagtcgcttcgttcaacaggccgaggagtcttccaggggagcgtttcagagcattgaaagcattgttcacgcattcgcgagcgtgtcaatgatgatggatgctactttctctgcagtttacaactcgtttagagctgttcttgatgtggcaaaccatttcagcaggctgaaaatccactttactaaagtgttctccgccttcgcgctggttagaaccattcgctacctctatcgtcgccttcaacgaatgctcggtttgaggaggggcagcgagaatgaggacttgtgggctgaatccgaaggtacagtggcatgcctgggagccgaggatagagcagccacctccgcaaagtcttggccgattttcttatttttcgccgttatccttggaggaccctacctgatctggaaattactatcaacgcactccgacgaggttacagacagtattaattgggcatccggtgaggacgatcacgtggtggcccgcgccgaatacgacttcgctgcagtttccgaggaggaaatctcctttagggcaggagacatgctgaaccttgctctgaaagaacagcagccaaaggttcggggctggctgctagcgagcctggatggccagacaacaggcctgattcccgcaaattacgttaagatcctgggaaagcgaaagggccgaaagacggtggagagctcaaaggtgagtaaacagcaacagagctttacaaaccctacacttacaaaaggcgccaccgtggccgattcactcgatgagcaagaggcagctttcgagtcggtgttcgtggagaccaataaggttcccgtggctcctgattcaattgggaaggatggagagaaacaggatctttag

SEQ ID NO: 128199 - DNA, 1134 bp, Artificial Sequence
  Description of Artificial Sequence: Synthetic coding sequence
atggccagcagcgagcaggctgagcaaccttctcagccctcatccacccccgggtccgagaatgttctgcccagggagccgctaatcgccacagcagtgaagttcttgcagaacagtcgtgtgcgccagtctcctcttgccacacgccgagccttcctgaagaagaaaggtctgacagatgaagagatagatatggcgttccagcagagcggaaccgccgcagacgaaccctcatcactaggccccgctacgcaagtagtgcccgtgcagccgccacatctaatctcccagccctatagccctgccggaagtcgctggagggactatggcgcactggccatcatcatggccgggatcgcctttgggttccatcagctgtacaagaaatatcttcttccccttattctgggcgggcgggaagatagaaaacagctggagagaatggaggctggtctatccgaactttccggatcagtcgcgcagactgttacgcaactgcagaccacactggcctcggtccaggaactgctaattcagcaacaacaaaaaattcaggagctagctcacgagctggccgccgctaaagctacaacctctactaactggattttggagagccagaacattaacgagctcaagtctgaaattaatagtcttaagggtttactgctcaaccgacggcagttcccgccttctccttctgcccccaagatccccagctggcagattcccgtgaaatctccttccccgtccagcccggctgcggttaaccaccactcctcatcggatatatcacccgtgagcaacgagtctacctccagcagtcccgggaaagaaggacatagccccgaaggctccactgtgacataccaccttcttgggccccaggaagaaggggagggcgttgtggacgttaaaggccaggtccggatggaggtgcagggcgaggaggagaagagagaagataaggaagatgaggaggatgaagaggatgatgacgtatcacatgtggacgaggaggattgcctgggtgttcaacgcgaggacaggcggggaggtgacggacaaataaatgagcaggtggagaaactccgacgccctgagggcgcctcgaacgagagcgaacgggactag

SEQ ID NO: 128200 - DNA, 942 bp, Artificial Sequence
  Description of Artificial Sequence: Synthetic coding sequence
atggcgttccagcagagcgggactgcagctgatgagccctcttccctgggtccagccacacaggtggtcccagtgcagcccccacacttaattagccaaccatattccccggctgggtccaggtggagagactatggtgcccttgctataatcatggccgggatcgcgtttggcttccaccagttgtacaagaagtaccttctgcctttaatactgggcggaagagaggatagaaaacagctggagcggatggaggcgggtctgtcagagctgagtggatcagtcgcacaaacagtgacccagctgcagacgactctggcctcagtacaggagcttctgatacagcagcagcagaagatccaggagcttgctcatgagctggctgcagccaaggctaccactagcactaactggattttggagtctcaaaatatcaacgagctgaaaagcgaaatcaactccctgaagggactgcttctcaatagaagacagtttccaccatcgcctagcgcgcctaagattcctagctggcagatccccgtcaagtccccctctccaagcagcccggcagccgtcaatcatcactcttcaagcgatatatcccccgtttcaaacgagtctactagcagctcccccggcaaggagggccacagccccgagggatcaactgtaacttaccacctgctagggccacaggaggagggagaaggcgtggtggacgtgaaaggtcaggtgcgcatggaggtgcagggcgaagaagaaaaacgggaggataaggaggacgaggaagatgaagaagacgacgatgtcagccacgtggatgaggaggactgtttgggggtgcagcgcgaggaccgacggggaggagatggccaaatcaatgagcaggttgaaaagctgagacggcctgagggagctagcaatgagtcagaaagagactag

SEQ ID NO: 128201 - DNA, 1041 bp, Artificial Sequence
  Description of Artificial Sequence: Synthetic coding sequence
atggagaaattgcggctactggggctgcgctaccaggagtatgtaactcgccatccggctgccaccgctcaactcgagactgctgtacgcgggttcagctatctgctcgctggtaggtttgccgattctcacgaactcagtgagttggtctacagcgcctccaatctcctggtgttgctcaatgatggcatcctccgcaaggagctgcggaagaaacttccagtaagtctgtctcaacagaaactactgacgtggctttccgtgcttgagtgtgtcgaagtattcatggaaatgggcgcagccaaagtttggggggaagtcggacgctggcttgttatcgcgcttgttcagcttgccaaggctgtgctgcggatgttgcttctgctctggttcaaagcgggactgcagacctctccacccatagttcctctggaccgagagactcaggctcagccaccagacggcgatcacagccccggcaaccacgaacagagttatgtcgggaaacgctccaacagggttgtgaggaccctgcagaacaccccctctctgcatagcaggcattggggagctccacaacagagagagggccgccagcagcagcatcacgaggagctgtcagccaccccaacacccttaggactgcaggaaaccatagccgagttcctctacattgctcgtcccctgctgcacctgctgagtttgggcctttgggggcagcgctcctggaaaccctggctgctggcaggagtggtggatgtcacctctctaagcctcctaagtgaccggaaaggattgaccagacgagaacgtcgggaactgcggaggcgaaccatccttttgctgtactacctgttgcggtctccattttatgaccgcttttcagaggcacgcatcttgtttctgttacagctgttagcggatcacgttccaggagtcggtctggtgaccacaagtcagcgggctgcctccccatgcctacccgcgcggccgcacacccagccatggagcccccctgccttcttgcccgggcatccatag

SEQ ID NO: 128202 - DNA, 1011 bp, Artificial Sequence
  Description of Artificial Sequence: Synthetic coding sequence
atggagaaactgcggctgctgggcctgaggtatcaggagtatgtcacacgccacccagccgccactgcccagctcgagaccgccgtgcgcgggttttcctacctactggccggaaggttcgccgatagccatgagctgtccgaactcgtatacagcgcaagtaacctcttggtgttactaaacgacggcatcttacgcaaggaactgaggaagaaactcccagtctccctgagtcagcagaagctgctcacttggctgtccgtcttagagtgtgtggaagtgttcatggagatgggagcagccaaggtctggggtgaagtgggccgctggctcgttattgccctggtacaacttgccaaggccgtgctacgtatgctgctgctgttatggtttaaagcgggcctgcagacctctccccccatcgtcccactagaccgcgagacacaggcccagccacccgacggggaccactcccctggcaatcacgaacagtcctacgtgggaaagcggagtaatagggtagttcgaactctccagaatactccaagcctccattcacggcactggggggccccacagcagcgcgaaggtaggcaacagcaacatcacgaggagctttcagctacgcctacacctctagggcttcaagagaccattgccgagttcctttatatcgcacgtccactacttcatttgttgagtttgggcttgtggggacagcgcagttggaaaccttggttgttggctggagtggtggatgtcaccagcttgtctcttctgtccgacagaaaaggacttacacgccgggaaagaagagagctgaggcgccggaccatcctgctgctttattatctgctgaggtccccattctatgaccgtttttccgaggcccggattctgtttctgctgcagctgctggctgatcatgtgcccggggtggggctcgtgactaggccgctgatggattatcttcccacttggcagaagatttacttctacagctgggggtag

SEQ ID NO: 128203 - DNA, 900 bp, Artificial Sequence
  Description of Artificial Sequence: Synthetic coding sequence
atggctgcggctgaggagggatgctctgtaggagcagaggccgacagagagctggaggagctgcttgagtccgccctcgacgacttcgataaagctaaaccctcccctgcccccccttcaaccaccacagcccccgatgcgagtgggccacagaaacggtcccctggtgacaccgcgaaagacgcgctttttgccagtcaggaaaagttcttccaggagcttttcgactcagaactggcctcccaggcaacagctgagtttgagaaggctatgaaagagcttgcggaagaggaaccccacttggtggaacaattccagaagctcagcgaggcagctggtagagtgggcagcgatatgacaagccaacaagaattcaccagctgcctcaaagagacattatcaggattagcaaagaatgccaccgatctgcagaactccagcatgtctgaggaagagctcaccaaagcgatggagggacttgggatggatgagggggacggggaaggcaatattttacccatcatgcagtctatcatgcagaatctcttgtcaaaggacgtgctatatccaagtctgaaagagatcaccgaaaagtatccggagtggctgcagtcacatcgcgagtctttgccccccgagcaattcgaaaaatatcaggaacagcacagcgtaatgtgcaagatctgcgaacagtttgaggccgaaaccccaacagactctgagaccacacagaaagcccgctttgagatggttctcgacttgatgcagcaactgcaggatctcggccacccccccaaggaactggctggtgagatgccgcccggactcaattttgacctcgacgccctcaatctgagtggacctcccggcgccagtggtgagcaatgtctcatcatgtag

SEQ ID NO: 128204 - DNA, 708 bp, Artificial Sequence
  Description of Artificial Sequence: Synthetic coding sequence
atggagtcaggtgcccttgatgacttcgacaaagctaagccttcccctgctccgcccagcaccacaactgccccggatgcaagtggaccacaaaagcgcagccctggcgacaccgctaaggacgcactctttgcttctcaggagaaattcttccaagagttatttgattctgaactcgctagccaggccacggcagagttcgagaaggccatgaaggagctggctgaagaagagccacacctcgtcgaacagtttcagaaactaagcgaggccgctggtcgggtgggttctgatatgacgtcccagcaagagttcacctcttgcctgaaggagactctgtccggcctggctaaaaacgcaacagaccttcaaaatagctccatgagcgaggaggagctgaccaaggctatggagggtctcggcatggatgagggcgatggtgaagggaatattctgccgattatgcagtccatcatgcaaaacctcttgtccaaagacgtcctctatcccagcctgaaggagattaccgaaaagtatccagagtggttacagtcacatcgagaaagtctgccgccggagcagtttgagaaataccaggagcagcactccgttatgtgcaaaatctgcgaacagtttgaagccgaaacaccaacggacagcgagacaactcagaaggctcgattcgagatggtgctggacctcatgtag

SEQ ID NO: 128205 - DNA, 840 bp, Artificial Sequence
  Description of Artificial Sequence: Synthetic coding sequence
atggagtctggcgctctggatgactttgataaagccaagccaagtcccgccccacctagtacaaccactgcacccgacgccagcggccctcagaaacgatcccccggcgatactgccaaggatgcccttttcgcttcacaggaaaagttctttcaggaattgtttgactccgagcttgcctctcaggctacagctgagtttgagaaggcgatgaaagagctggccgaggaggagcctcatcttgtggagcaatttcaaaagctgtcagaggccgccggccgggtgggctcagatatgacctcccagcaggaattcacctcttgtctcaaggagacgctctccggacttgccaagaacgcaacagacctgcagaactcatcaatgagtgaggaggaactgaccaaagccatggaaggtctcggcatggacgaaggtgacggcgagggtaatattctgccaatcatgcagtccatcatgcagaatctgctaagtaaggacgttctgtatccaagtcttaaggagatcacagagaagtatccagaatggctccagtcccatagagagagtctaccccccgaacagttcgagaaatatcaggaacaacattccgttatgtgcaagatctgtgaacagtttgaggctgagacccctacagactcggagacaactcagaaggctcggttcgagatggttttggatctgatgcagcagctgcaggatttgggccaccctccaaaagagttggctggagagatgccaccaggtttgaacttcgacctggatgccttaaacctttctggaccgccaggggcttccggagagcaatgcctgattatgtag

SEQ ID NO: 128206 - DNA, 630 bp, Artificial Sequence
  Description of Artificial Sequence: Synthetic coding sequence
atgaaggagctggcagaggaagagccccacctggtggaacaattccaaaagctgagtgaagccgctggacgggttggcagcgacatgacttctcaacaggagttcacctcgtgccttaaagagacattgtcaggcctggcaaagaacgctaccgacctgcagaattccagtatgagcgaggaggaactaactaaggcaatggaaggtctgggaatggatgagggcgacggagagggtaacatcctccccatcatgcaatctattatgcaaaatttacttagtaaagacgtcctctatccttccttgaaagagatcactgaaaaataccccgagtggctgcagtctcacagagagagtctgccaccagagcagttcgagaagtatcaggagcagcattcagtgatgtgtaagatttgtgaacaatttgaagcggagactcctacagatagcgaaactacacagaaagcccggttcgagatggtcctagacctgatgcaacagctgcaggatctggggcatcccccaaaggagctcgcaggagaaatgccccctggtctgaactttgacctggatgccctaaacctgtccggccctccaggggctagcggtgagcagtgcttgattatgtag

SEQ ID NO: 128207 - DNA, 561 bp, Artificial Sequence
  Description of Artificial Sequence: Synthetic coding sequence
atggccgcggccgaagagggctgttccgttggagcggaagctgatcgcgaattagaggaactgctggaatccgcactcgatgacttcgataaggccaaaccaagtcctgccccaccttcgactaccactgcacctgatgccagtggaccacagaaaagatctccgggggataccgctaaggacgctttatttgcatcacaggagaagttttttcaagaactgtttgattctgagctggcctctcaagccaccgcagaatttgagaaggcaatgaaggagctcgcggaggaggagccacatctggttgaacagtttcagaagcttagcgaagcggccggcagagtggagctgcagcacgtggggcgtagggccgatcaaggccacggtggcgcgaggcatgggaggcgcggctggggccgtgaacaccccccgcatcatgccgagtattacgcagagcctaccctgcaaggctgcgccgttcctatcaccgaaggggaccacagaaaagtcagcagaatggttgcagagagctccggcatttccactagtcgcgcagtatag

SEQ ID NO: 128208 - DNA, 918 bp, Artificial Sequence
  Description of Artificial Sequence: Synthetic coding sequence
atggctagcaggaaggagaatgctaaatcagctaacagagtgctgcgaattagtcagctggacgcactcgagctgaacaaggcccttgagcagctcgtctggagtcagttcacgcagtgtttccacgggtttaaacccggccttctcgcaagattcgaaccagaggtgaaagcatgcctctgggtcttcctgtggaggttcaccatctattccaaaaatgccaccgtgggccaatctgtgcttaacattaagtataagaacgacttttccccaaatctcagataccagcccccaagcaaaaatcagaagatatggtatgcagtctgtacaattggcggccgttggcttgaagagaggtgttacgatttatttcgtaatcaccatttagcgtctttcggaaaggtgaagcagtgcgtcaacttcgtgatcggtttactcaaactgggggggctgatcaatttcctcatcttcctccagcgcgggaaattcgcaacgctgacagaacgtctcctgggcatccatagtgtgttctgcaaacctcaaaacatttgcgaagttgggttcgaatacatgaaccgggagcttctgtggcacgggtttgccgaatttcttattttcctgcttcctctgataaacgtgcagaagctgaaggccaagctctcttcttggtgcattccactcactggagcacccaatagcgacaacaccctcgctacctctggaaaggagtgtgccctgtgcggagaatggcctaccatgccccatactattggttgtgaacacatcttttgttacttttgcgctaaatcttcgttcctgttcgacgtgtatttcacttgcccaaagtgtggtaccgaggtccactctctccaacctctgaaaagcgggattgagatgagcgaggtgaacgccttatag

SEQ ID NO: 128209 - DNA, 918 bp, Artificial Sequence
  Description of Artificial Sequence: Synthetic coding sequence
atggcctcaagaaaggaaaatgcaaagagtgcaaaccgcgttctgcggatctcccaactggacgctcttgagttgaacaaagcattggagcaactggtctggtcacaattcacccagtgttttcacggttttaagccgggccttctggcacggttcgagcctgaagtgaaagcctgcctgtgggtcttcctctggcggtttacaatctattccaagaacgcaacggtcgggcaaagtgtcctgaacattaagtataagaacgacttttcccctaacctccggtaccagccaccctcgaagaaccagaagatctggtacgcagtttgcacaatcggaggccgctggttagaggaaagatgctacgacctctttagaaaccatcatttggccagcttcggcaaagtaaagcaatgtgtaaactttgtaatcggcctcctaaaactgggcggcctaatcaattttttgatcttcctgcaaagaggtaagttcgcaaccctgacggagaggctactgggtatccattctgtgttctgtaaaccacagaatatctgtgaggtgggcttcgagtatatgaaccgggaactgctgtggcatgggttcgccgaattccttatttttctattaccccttataaatgtgcagaagctgaaagccaaactgtcctcatggtgcatccctcttactggcgcacctaattcagacaacactctggccacatcaggcaaggaatgtgcgctctgtggcgagtggccgactatgccacatacaattggatgcgaacatatcttttgctatttttgcgctaagtcctccttcctctttgacgtgtacttcacatgcccaaaatgtgggaccgaggtgcatagcctgcaacctttaaagagcggaatcgagatgtcagaggttaatgcactctag

SEQ ID NO: 128210 - DNA, 543 bp, Artificial Sequence
  Description of Artificial Sequence: Synthetic coding sequence
atggcttctcggaaagagaacgctaagtctgctaatcgggtcctgagaataagccagttagacgcactcgaactgaataaagcactggaacagctggtctggtctcagttcactcagtgcttccatggctttaagcctggcttgctggccagattcgagccggaagtgaaggcctgtctgtgggtgtttctgtggcggttcacgatctattccaaaaacgccactgtggggcagtctgtgctgaatatcaagtacaaaaacgatttcagccccaacctaagataccagccaccaagcaagaaccagaaaatttggtacgctgtctgtacaattggaggtcgatggctggaagaaaggtgctatgatctctttaggaatcaccaccttgcatcttttggcaaagtgaagcagtgcgtgaactttgtcatcgggttgctgaagctggggggcctgatcaatttcctcattttcttgcagcggggcaagttcgccactctaactgaacggctcctgggtatccatagcgtgttttgtaagccttag

SEQ ID NO: 128211 - DNA, 12 bp, Artificial Sequence
  Description of Artificial Sequence: Synthetic coding sequence
atggcaagctag

SEQ ID NO: 128212 - DNA, 918 bp, Artificial Sequence
  Description of Artificial Sequence: Synthetic coding sequence
atggcaagccggaaagagaatgccaagagcgccaaccgggtgcttagaatttcgcagctcgacgccctcgagctaaacaaggccttggagcagttggtgtggtctcaatttactcaatgcttccacggattcaagcccggcctgcttgccagatttgagcctgaggtgaaagcttgcctgtgggtgtttttatggcggttcacaatttacagcaaaaatgccacggtagggcaaagtgtgttgaatatcaaatacaagaacgatttttctcccaacctacgctaccaacctccgtctaagaaccaaaaaatctggtatgccgtctgtaccattggcggtagatggttggaggagcgctgctatgacctgttccggaatcatcacttggcctctttcgggaaagtcaagcagtgtgtaaattttgtgataggcttgttgaaacttgggggcctgattaactttctcatttttctccagcgcgggaaattcgcaactctcacagagcggcttctgggcatccactcggttttctgtaagccgcagaacatctgtgaggtgggttttgagtatatgaatcgagagctcctgtggcatggatttgctgaattccttatatttcttcttccactcattaacgttcagaagcttaaagctaaactcagctcttggtgtattccccttaccggggctcccaattctgacaacacgctggcaacctctggcaaggaatgcgcactgtgtggtgagtggcctaccatgccacataccatagggtgcgagcatatcttctgttacttctgcgccaagagcagcttcttgtttgacgtttatttcacatgccctaagtgtgggaccgaagtgcacagcttgcagccgcttaagagcggcatcgagatgagcgaggtgaacgccctgtag

SEQ ID NO: 128213 - DNA, 918 bp, Artificial Sequence
  Description of Artificial Sequence: Synthetic coding sequence
atggcgtcccgcaaagaaaatgctaagagcgctaatagagtcttgcggattagccagctggatgctctcgagctgaacaaagccctagaacaattggtgtggtctcaattcactcagtgctttcatgggtttaaacctggtttactggcacgcttcgagccagaggtcaaagcatgtttatgggtttttctttggaggtttaccatctatagcaagaatgcgaccgtgggccaaagtgttcttaacataaagtacaaaaacgatttctcaccaaacctcaggtaccagccaccttccaagaaccagaagatctggtacgctgtgtgcacaatcggcggtcggtggctcgaggagcgctgctacgatttgtttagaaaccaccatctggcttcattcggcaaggtcaaacagtgtgtgaatttcgtcattggccttctgaagttgggagggctcataaacttcctaatatttctgcagcgcgggaagttcgccaccctcacggaacggctgctgggtatccatagcgtcttctgcaagccacaaaacatctgcgaggtgggatttgagtatatgaaccgtgaattgttatggcacggatttgctgaatttctcatcttcctcctgccacttattaatgtccaaaagctcaaagcaaaactatcttcatggtgtataccgctcaccggtgcccctaacagtgacaacactctggccaccagcggaaaagaatgtgccctgtgtggagaatggccgaccatgccacacaccatcgggtgtgagcatattttctgctatttctgcgccaaaagctcattcctttttgatgtctactttacctgccccaagtgcggaacagaggtacacagcctgcagccccttaagagtggcattgaaatgtcagaggtcaacgcattatag

SEQ ID NO: 128214 - DNA, 918 bp, Artificial Sequence
  Description of Artificial Sequence: Synthetic coding sequence
atgaaaagtgacagctccacctccgcagctcccttacggggtctgggaggacccttgcggtcctctgagcccgttcgcgccgttccagcaagggcaccagcagtggacctgcttgaggaggccgcggacctgctggtcgtacacctagactttcgcgcggcactggaaacctgcgaacgcgcatggcagagccttgctaatcatgccgtcgctgaagagcccgcaggcacatcattggaagttaaatgctccttatgtgtggtgggtatccaggccctggcagaaatggatcggtggcaggaggttctttcttgggtgttacagtactaccaggtgccagagaagctgcctcctaaggtcctggagctgtgcattctcctgtatagcaagatgcaagagcctggcgctgttctggatgtcgtgggggcctggttacaggatccagcaaatcagaatttacccgagtatggagcacttgccgagtttcatgttcagagggtcctccttcccctggggtgtcttagcgaggctgaggaactcgtggttggttccgccgcttttggggaggagcggcgcctggacgtgctgcaggctatacacactgcgagacagcagcagaaacaagagcattccgggtcagaagaggcccagaaacctaacctggaagggagcgtgagccacaagtttctgtccctgcccatgctggtgcggcagctgtgggacagcgcggtgtctcatttcttcagccttccattcaagaagtcactgctcgctgctctgattctgtgtttattggtggttaggttcgaccccgcttcaccaagctcacttcatttcttgtataagctggcccagctcttcagatggattagaaaagcagccttttccagactataccaattaagaattcgggattag

SEQ ID NO: 128215 - DNA, 918 bp, Artificial Sequence
  Description of Artificial Sequence: Synthetic coding sequence
atgaagtctgactccagtacatccgctgccccactcagaggactgggggggcctctgagaagttcggaaccagtgcgcgctgtgccagcccgcgcccccgcagttgacctcctcgaggaagcggccgacctcctggttgtgcatctggactttcgcgccgcattggagacttgcgagcgcgcgtggcagtcgttggcaaaccatgctgttgcagaggagcccgctggcacatcgctcgaagtaaagtgctctctgtgcgtggtaggaatccaggccctggcagagatggaccgatggcaggaggtcctgagttgggtacttcagtactaccaggtccctgaaaagctgccccccaaggttctggagctgtgcatcctgttgtattcaaaaatgcaggagcccggtgctgtcctggacgtggtgggggcatggctgcaggaccctgccaatcagaacttgcccgaatatggtgcattagctgaatttcatgttcagagggtactgttgccactaggctgcttatccgaagcagaggagttagttgtcggttctgctgcatttggagaagagcgccgactggatgtgctgcaggcaatacacaccgctcggcagcaacaaaagcaggaacactctgggagcgaagaggctcagaaaccaaaccttgagggcagtgtgtcacataaatttctcagcctcccaatgctggtcagacagctgtgggacagcgccgtcagccactttttctctctaccattcaaaaagtcactgctcgccgctctgatcctctgcctccttgtagtgagatttgatccagcatctccttctagccttcactttctgtacaagctggctcagctttttcgatggatcaggaaggcagccttctccagactgtaccagctgaggatcagagattag

SEQ ID NO: 128216 - DNA, 1098 bp, Artificial Sequence
  Description of Artificial Sequence: Synthetic coding sequence
atgaaaagtgattcttccacctctgcagcgcccttgcgtgggctgggcggcccacttcggagttccgaaccagtccgcgccgtccccgcccgcgcccccgcagtcgacctgctggaagaagccgcagacctactcgtggtacacctggatttccgcgctgcactggagacatgcgagagggcatggcagagtctggcaaatcacgctgtggccgaagagcctgccggcacttctcttgaagttaagtgttctttgtgtgtggtcgggatccaggcactagcagaaatggataggtggcaagaagttctatcatgggtacttcaatattatcaagtgccggaaaagctaccccctaaagttcttgagctctgcatcctgctctacagcaagatgcaggagcccggtgcggtcctggacgtggtaggcgcctggttacaggacccagcgaatcaaaacctgcccgaatatggcgcactggcagaattccatgtgcagagggtgctcctcccacttggttgtctcagcgaggccgaggagctggtggtgggcagcgccgccttcggcgaagagagaaggctggacgtactccaggccatccatactgccagacaacagcagaaacaggagcattctggatccgaagaggcgcagaagcctaatctagaagggtccgtgtcacacaagtttctgtccctgccaatgttagtgagacaactatgggatagcgccgtctcccactttttctccctgccatttaaaaagtcccttctggcggcactgatcctgtgtctcctagtggtacgcttcgaccctgccagcccctcgtctctgcattttctgtataaacttgcacagctgtttgccggatccggtcgtctccatttcctggcaagcacttctagtgccagtgttactgaagggccctgtgccccacagcctctctgcagctcacgcccctggccgcagaaacagagcgatcgtgccacgcaccctcaggcacctctggggaaatgggaccagcctaatttggcagaatgcaccgtgtcgtgttgtctgggcgccctgtcctttgcaccttattttgggtggagccggtag

SEQ ID NO: 128217 - DNA, 771 bp, Artificial Sequence
  Description of Artificial Sequence: Synthetic coding sequence
atgaagtcagatagttctaccagcgcagctcccctgaggggattagggggccctctcagatcatccgaacccgtacgagctgtccccgcacgagcaccggctgtagacctgcttgaggaagccgcggaccttcttgtggtccacctggatttccgggccgccctcgagacttgcgagcgggcttggcaatcgctggccaaccatgcagttgcggaggagccagcgggcacttcactcgaggtgaagtgcagcttgtgcgtcgtgggcatacaggcacttgccgaaatggataggtggcaggaagtgctgagttgggtgctgcagtactaccaagtgccagaaaagttaccacccaaagtcctcgaattgtgtatcctgttgtactcgaaaatgcaggagccaggggctgtgctggatgtcgttggggcatggctgcaggacccagcaaatcaaaatctgcctgaatatggcgccctagctgaatttcacgtgcaaagggtgctgttgccgctggggtgcctgagcgaagcagaggaattggtggtgggatctgctgcgttcggtgaggaacgtagactggacgtgctgcaggcgatacatacagccaggcagcagcaaaagcaggagcattcgggcagcgaagaagcacagaagcccaacctcgaagcaagcccttcatccctgcatttcttatacaagttagcacaactgttcaggtggatcagaaaggcagccttcagcagactctaccaactccggattcgagactag

SEQ ID NO: 128218 - DNA, 549 bp, Artificial Sequence
  Description of Artificial Sequence: Synthetic coding sequence
atgttgagatccgtgtggaattttctgaaaaggcacaaaaaaaagtgcatcttcctcggcacagtgttaggcgtcctctctatgctgcccactctgcgggaggccctgatgcagcaactaaattcagagagcctgaccgcactgctgaaaaatcgaccgtcaaacaagctggagatctgggaagacttaaagattatttccttcaccagatccacggtggctgtatacagtacttgcatgctcgttgtgttactaagggttcagttgaatattatcggaggttatatatacctggataatgctgcggtggggaagaacgggactaccatactggcccccccagatgttcaacagcagtacttgagcagcattcagcatctgttaggcgatgggctgacagagttaatcacagtgataaaacaggcagtgcagaaggtgctgggcagcgtgagtctcaaacatagtctcagcctgctagatctggagcaaaaactgaaggagatccgaaaccttgttgaacagcataagtcttcttcttggattaattag

SEQ ID NO: 128219 - DNA, 1122 bp, Artificial Sequence
  Description of Artificial Sequence: Synthetic coding sequence
atgctcaggtccgtgtggaattttttgaaacgacacaaaaagaagtgcattttccttggaacggtgcttggtggtgtttacatcttggggaagtacggccaaaagaagatcagagaaatccaagaacgcgaggccgcagaatatattgcccaggcacgacggcagtatcacttcgaatccaatcagaggacgtgcaatatgacggtcttgtcaatgttgcccaccttgcgcgaggcactgatgcagcagctgaactcagagtctctgactgccctgctcaaaaaccgaccttctaacaaactcgaaatctgggaggatctcaagataatttctttcaccagaagcacagttgccgtgtactctacctgcatgttagtggttctgttgagggtacaactaaacattatcggaggctatatttatctcgataacgcggctgtggggaaaaacgggacaacaattctcgcaccaccagatgtgcagcagcagtacctctccagcattcagcacctcctcggcgacggactgaccgagcttattactgttattaaacaggctgtgcagaaggtgttgggctcggtgagcttgaagcattcccttagtctgctggacctggaacagaagctgaaggaaattaggaatctggtggagcagcataagagctctagctggataaacaaggatggatcaaaaccattgttgtgccattatatgatgccagacgaggagactcccttagccgtgcaagcgtgcggcttatcccctcgtgacatcactaccatcaagctactaaatgagacacgtgacatgctcgagtctccagacttcagcaccgtgctgaacacatgtttaaatagaggattcagccggctgcttgacaacatggctgaattttttaggccgacagaacaggatctgcagcacggaaactcgatgaattcactatcctcggtaagtctgcccttggcgaaaattattccaattgttaacggacagattcacagcgtgtgtagcgagaccccctctcattttgtgcaggatctgctcacaatggagcaggtaaaagacttcgctgctaacgtttacgaggcctttagcaccccccagcagctggaaaaatag

SEQ ID NO: 128220 - DNA, 549 bp, Artificial Sequence
  Description of Artificial Sequence: Synthetic coding sequence
atgttgagaagtgtgtggaacttcctgaaacggcataagaaaaagtgcatctttctagggacagtgttaggcgtgctgtcaatgttgccaacactgagagaggcactgatgcagcaactgaatagcgaatccctgaccgccctgctcaaaaatcgtcccagtaacaagcttgagatttgggaagatctcaagataataagcttcacccgaagcaccgtagccgtgtatagcacctgtatgctggttgtgctgctgagagttcagttaaatatcattggcggatacatttaccttgacaacgcggcggtgggtaaaaacgggactaccatcctagctcctccagatgttcagcaacaatatctgtctagcatccagcacctgctgggagacggattgacagaactcatcacagttattaaacaggccgtgcagaaggtgctgggttcggtctcactgaaacatagcctatctcttctggacttagagcagaagttgaaggaaattcgcaacctggtggaacagcataagtcgtcgagctggatcaattag

SEQ ID NO: 128221 - DNA, 1809 bp, Artificial Sequence
  Description of Artificial Sequence: Synthetic coding sequence
atggccatgcgggagctagtggaggccgagtgtggcggcgcaaatcccctaatgaaactggcaggtcacttcacccaagacaaggccctgcgtcaggaaggactgcgacccggcccatggccacccggggccccagcttccgaggccgcgtcgaagcctctgggggtagcgtcagaggatgagttggtggcggaatttctgcaggatcagaacgccccactagtgagtagggccccacagacatttaaaatggacgatctgctcgcggaaatgcagcagattgagcagtctaatttccgacaagcaccccagagggctcctggcgtcgccgacctggcgttaagtgagaattgggcacaggaatttctggcagccggggacgctgttgatgttacccaagactataatgagactgattggagccaggaattcatcagtgaggtgactgacccactatccgtatcccctgctcgttgggccgaagagtacctcgagcagtccgaagaaaagttatggctgggtgaaccggaagggactgccacggatagatggtacgacgaataccatccagaggaggatttgcaacacacagccagtgacttcgtggctaaagtcgacgacccaaagttggctaactccgaaggaacatctgacgcatgggtggaccagttcaccagaccagtgaacacctccgcattagacatggaattcgagcgagcaaaatctgcgatcgaaagcgacgtcgatttttgggacaaactccaggcggagctggaagagatggctaaaagggatgctgaggcgcatccatggctgagtgactatgatgacctgacatcagctacatatgacaagggatatcagtttgaggaagagaaccccttgcgagaccatccccagccatttgaggagggactgaggcggctccaagagggggaccttcctaatgctgtgttgttgtttgaggctgccgtgcagcaggaccctaagcacatggaagcgtggcagtaccttggtacaacccaggccgaaaatgagcaagagctgctggctatcagcgccctgcgtcgctgcctggaacttaagccggataatcagacggccttaatggccctagccgttagcttcactaatgagtctctccaaagacaggcctgtgagaccctgcgcgactggcttagatacaccccagcctatgcccatttggtaacccccgccgaagagggggcaggaggcgctggactgggaccatctaagagaatcttgggttctctactcagcgatagtctcttcttggaagtgaaagagctctttctggctgcagtgagacttgacccgactagcatagaccccgacgtccagtgtggtctgggtgttctgttcaatctgtctggcgaatacgacaaggccgtggattgcttcaccgccgccctaagtgtgcgcccgaatgactacctactgtggaacaagctgggagccactctggcgaatgggaaccagagcgaagaggcggtagcagcatatagacgtgctctggaactacagccgggatatattaggtctagatataatctggggatctcttgtatcaatttgggcgcccatagggaagctgtggagcattttcttgaggcactgaatatgcagagaaagtctagaggcccacggggggagggaggtgctatgtctgagaatatatggtcgactctgcgattggcactgtccatgctggggcagtctgatgcatacggcgcagccgacgcgcgagatctgtcaaccctactgacaatgtttggacttccccagtag

SEQ ID NO: 128222 - DNA, 1896 bp, Artificial Sequence
  Description of Artificial Sequence: Synthetic coding sequence
atggctatgagggaactggttgaagcagaatgcggaggcgctaatcccttgatgaagttggcaggccatttcactcaggataaagcgctgcgtcaagagggccttcgcccaggcccatggccccctggggcacctgcctcagaagctgctagcaagcccctgggcgtagcgagcgaggatgagctggttgcggaattcttgcaagatcagaacgctccattggtttcccgagcccctcagaccttcaaaatggatgatctgctggcagagatgcagcagattgagcaatctaatttccgacaggcgccacagcgtgctccaggggtggccgaccttgctctgagcgagaattgggcccaggagtttcttgcggccggcgacgcagtggacgtgacccaggattacaatgaaacagactggtcccaggaattcataagtgaagtgacagaccctttgtccgtgagccccgccagatgggcggaggagtacttagagcagagcgaggaaaagctttggctcggcgaacccgagggtacggccaccgataggtggtacgacgagtaccatcccgaggaggacttgcagcacaccgcttccgactttgttgcaaaagtggatgatcctaagcttgccaattccgagttcttgaaattcgtacggcagatcggcgaaggacaagtgtctctcgagagtggtgctggcagtggacgagcacaagctgagcagtgggccgcagagttcattcaacagcagggtacctccgatgcatgggtcgaccagttcacaagaccagtgaacacttccgcattagacatggagttcgaacgcgccaagtcagcaattgagctgcaggccgagctcgaggaaatggcaaagcgggacgccgaggctcacccctggcttagtgattacgatgacttgacctccgcaacttatgacaagggataccagttcgaggaggagaatccgcttagagaccatcctcagcccttcgaagaaggtctgcgtcgcctgcaggagggagatctgccgaatgccgtgctgctgtttgaagcagcagtgcagcaggatccaaaacacatggaggcttggcagtacctgggcacaactcaagctgagaatgaacaggaactgctcgccatcagtgcactgcggaggtgcttagaactgaaaccggacaaccagacggctctgatggcattggccgtttctttcactaacgaaagtctgcagcgccaagcgtgtgagacgctgcgcgactggctcagatatactccagcatacgcacatctcgtcactccagctgaagaaggagctgggggtgccgggctgggtccatcaaagagaatcctcggcagcctcctgagcgactcactgtttctggaggttaaggaattgtttctggcagcagttaggcttgaccctactagcattgacccagacgtgcagtgtggtctgggggtattgtttaacctttccggtgagtatgacaaagccgtcgattgcttcaccgcggctttgtccgtaaggcctaatgactatttactctggaataagctcggagctacgttggcgaacggcaatcagagtgaagaagctgtggcagcctatcgccgcgccctggaattgcagccaggctatattagatcacgctacaacctagggatttcgtgtattaatctaggggcacatcgcgaagcagtcgagcattttctcgaggcacttaatatgcagagaaagtctcggggcccccggggcgagggtggcgctatgtcagaaaatatctggagtaccctccgcctggcactaagtatgttaggacaatcggatgcctacggtgctgcagatgcccgggacctctctacccttttgacaatgtttggtttgccacagtag

SEQ ID NO: 128223 - DNA, 1233 bp, Artificial Sequence
  Description of Artificial Sequence: Synthetic coding sequence
atggcgatgcgagagcttgtggaagccgaatgtgggggagccaatccccttatgaagttagcaggtcacttcacccaagataaagcactcagacaggagggactgcgcccaggaccatggcccccaggcgccccggccagcgaagccgtgtctgtccttgaagtggaatctcctggcgccgcctcggaggcggcgtctaagccgctaggcgtcgcgtccgaagatgagttagttgccgagtttttacaggatcaaaacgcgcctctggtgtcaagagccccccagacatttaaaatggatgacctgttggccgaaatgcagcagatcgaacaatcaaactttaggcaagctccccagcgcgcgcccggtgtcgccgatctggctttgtcagagaactgggcacaagaatttcttgccgcaggcgacgccgtggatgtgacgcaagattataacgagactgactggtcccaagaatttattagcgaggtgacagaccccctgtccgttagccctgccaggtgggccgaagaatatttagaacagagcgaagagaagctctggctgggggagcccgaggggactgcgaccgacaggtggtatgatgaataccaccccgaagaagaccttcagcataccgccagtgattttgtggccaaagtggatgatcccaagttggccaactctgaagggacatcggatgcatgggtcgaccaatttacaagacccgtgaatacgagtgcgctcgatatggaatttgaacgcgcgaagagtgcgatcgagctgcaggcagaattagaggagatggccaaaagggatgctgaggctcatccctggctctccgattatgatgatcttacgagcgcgacatacgacaaaggataccagtttgaggaggaaaacccactgagagatcacccccagccctttgaagaaggcctgaggagactccaagaaggagacctccccaatgctgttctgttatttgaggctgcagtgcagcaggatccgaagcacatggaggcctggcagtatctcggtaccacccaggcagaaaatgagcaggagctgctagctattagcgcactaaggcgttgtcttgagctaaagccagataatcagacggctctaatggctctcgctgtctcatttactaacgagagcctgcaaaggcaggcttgcgagacgttacgagattggttgagatacactcccgcgtatgcacatctcgtatag

SEQ ID NO: 128224 - DNA, 1983 bp, Artificial Sequence
  Description of Artificial Sequence: Synthetic coding sequence
atgctgctatgcagggcacatagggtgctcggactgcgcggggctcgtgagcttgcagtgacgatggctatgcgggagctggtggaagctgagtgtgggggtgccaatccactgatgaagctggctggacatttcacccaggacaaggctctccggcaggaaggccttaggccgggaccatggcctcccggcgccccagctagtgaagctgcctctaagcctctgggtgtcgcatctgaagatgagctggttgcagagttcctgcaggaccagaatgcgcccttggtctctagggcaccccagacgtttaaaatggacgatctgttggcagagatgcaacagatcgaacagagcaactttcggcaggcaccccagcgtgcgcccggcgtagcggatctggccctgtcagagaattgggcacaggaatttctggcagcaggcgatgccgttgacgtgacgcaagactacaatgagactgattggtcccaagagttcattagcgaggtaacagacccgctttccgtctcgcccgcacgatgggctgaggaatatttagaacagtccgaagagaagttgtggttaggagaacctgagggtaccgctacagacaggtggtacgatgagtatcacccggaggaggacctacagcatacagcatctgacttcgtcgccaaggtagacgacccaaagttagccaacagcgaatttttgaaattcgttagacagattggcgaaggccaagtgtccctagagagcggggccgggagcggcagggctcaagccgagcagtgggcggctgagttcatccagcagcagggaacgtccgacgcgtgggtggaccaatttacacgacctgtgaacacttctgctctcgacatggaatttgaacgggcaaagagcgctatcgaatctgacgtggatttctgggacaagctgcaggcagaacttgaggaaatggctaaaagggacgccgaggcacacccctggctcagcgattacgatgacttaacttccgccacctacgacaaagggtaccaattcgaagaggaaaatcctctgcgtgaccaccctcagccttttgaagaggggctgcgacgcttacaagagggcgacctaccgaacgccgtcctgctgtttgaggccgcagtgcaacaggacccgaaacacatggaggcatggcagtatcttggaacaacccaggctgagaacgaacaagaattgctggctatctcagcccttaggcgatgtttggagctcaaacctgacaatcagacagccttgatggccctggcagtctcattcaccaacgagagtttgcaacgtcaggcgtgcgaaactctaagggattggctccggtatactccagcatacgctcaccttgtaacccccgctgaagaaggcgcagggggcgcaggtctaggacccagtaaaaggatccttgggagtctgctgagtgatagtttgttcttggaggtaaaggaactgttcctggctgccgtacgcttggatccgacatcaatagaccccgacgtgcagtgtggtcttggcgtgttatttaacctgagcggggagtacgataaggccgttgactgcttcaccgccgctctaagcgtcagacccaatgactacctgctgtggaataagctgggcgccaccctggcaaatggtaatcagtctgaggaggcagtggccgcgtatcggcgggcccttgaactgcaacctggctacatcagaagccgctacaacctcggaattagttgtatcaacctgggcgcccaccgggaagccgtcgagcacttcctcgaggcgttaaacatgcagaggaagtccagggggcctcgaggcgagggaggggccatgagcgagaacatatggagcactctgcggctcgctctaagtatgctcgggcagtctgatgcatacggcgctgccgacgctagggatctgtctactctactcaccatgtttggtctaccacaatag

SEQ ID NO: 128225 - DNA, 1920 bp, Artificial Sequence
  Description of Artificial Sequence: Synthetic coding sequence
atggctatgagagaactggtggaagccgaatgcggtggcgctaatcccctcatgaagctggccgggcatttcacacaggacaaggccctgcggcaagagggcttgcgccctggaccctggcctccaggagcgccggcctctgaggctgcgtccaagccactgggggtggcgtctgaggacgagttggttgccgaatttctgcaggatcagaatgctcctctggtaagcagagcacctcaaaccttcaaaatggatgatctgctcgccgagatgcaacagatagaacagtccaattttcgccaagccccacagcgcgccccaggggtggcagacttggctctgagcgaaaattgggcacaggagttcttggcagctggggacgctgttgatgtgacacaagactacaacgaaacagattggagtcaggagttcattagcgaggtaaccgacccgctatccgtgtccccagccaggtgggctgaggaatacttagagcagagcgaggaaaagctttggctgggtgaacccgagggcacggccaccgatcgttggtatgacgaataccatcccgaagaggacctgcaacatacagcctccgacttcgtagcaaaggtcgacgaccctaagctggctaacagtgaattcctgaagttcgtgcggcaaatcggagaaggacaagttagcttggaatccggcgccggaagcgggcgggcccaagcagagcagtgggcggccgagtttatccagcagcagggaacttcggatgcatgggtggaccagttcacgagacccgttaacacttccgcgttggatatggaatttgagagagccaagtcagccatcgagtccgacgtggatttttgggataaactacaagccgagctcgaggaaatggcaaagcgggacgcagaggcccacccatggcttagtgattacgatgatctgacatctgcaacttacgataagggctatcagtttgaggaagagaacccccttcgggatcatcctcagccctttgaggagggcctgcggagactacaagagggagacttgcctaacgcggtcctcctcttcgaagctgccgtgcagcaggaccccaagcatatggaagcctggcagtacttgggaaccacccaagctgagaatgagcaggagctgctggccatctctgcactgagacggtgcctggagctcaaacccgataaccagaccgccctgatggcccttgctgtgagttttacaaatgagagccttcagcgccaagcgtgtgagaccctacgggattggctcagatatacaccagcctatgctcatctcgtgacaccagccgaggagggtgccggcggcgccggcttgggcccatctaagcggatcctgggctcactcctaagcgattccctctttttggaggtgaaggaactctttctggccgcagtgaggcttgatcccacctccatcgaccctgacgtccagtgcgggctgggcgtcttgtttaacttatctggcgaatatgataaggctgtcgactgctttacagctgcgctttctgttcggcccaatgattacttattgtggaacaaattgggtgcgaccctggccaacggcaaccagagtgaagaggccgtagccgcctaccgacgcgctctggaacttcagccgggttacattcgaagtcggtacaatctcgggatttcctgtattaatttgggggcccatagggaagccgtggaacacttcctggaagccttgaatatgcaacgcaaatcccgcggcccgcgtggtgaaggaggtgctatgagcgaaaacatctggagcaccctgcgtctcgcattgtccatgctggggcagtccgatgcctatggggcagccgacgcccgggatctgagtaccttactcacgatgtttggattgcctcaatag

SEQ ID NO: 128226 - DNA, 1965 bp, Artificial Sequence
  Description of Artificial Sequence: Synthetic coding sequence
atggcaatgagggagctggtggaggctgagtgcggaggtgcgaatccgttaatgaaactggcaggccacttcacacaagataaggctctgcgccaggaaggcctgcgccctggcccatggccgcccggcgccccggcgtccgaggccgtgagcgtgctagaagtcgaatcacctggagcggccagcgaggcagcaagcaagcccctgggagtcgcgtccgaagacgaattagtggctgagttcctgcaggaccagaacgctcccttggtgtcccgcgcaccacaaacgttcaagatggacgacttactggccgaaatgcagcagattgagcagtctaattttaggcaagctccacagagggcccccggagtagccgatctggccctatccgagaactgggcgcaggaatttcttgcagcaggggacgcggtcgacgttacccaagattataacgaaacagattggtctcaggagtttatttccgaggtcacagatccattgtccgtctcacccgctcggtgggcagaggagtatctcgaacaaagtgaggagaaactgtggcttggcgagcccgaaggtacggcaacagacaggtggtatgatgagtaccatcccgaggaagatttacagcacactgcttctgacttcgtggcaaaggttgatgatccaaaactggccaacagcgagtttctgaaatttgttagacagattggcgaagggcaagtgtcactggagtccggagcaggatcgggccgtgcccaggctgaacagtgggcggctgaatttatacagcaacaggggaccagtgatgcgtgggtagaccagttcacaaggcctgttaatacttcggccttggacatggagttcgagcgtgctaagtccgctatagaatctgacgtcgacttttgggacaagttacaggctgagctggaggagatggctaagagagacgcggaggcgcatccttggctgagcgactatgatgatttgacatccgctacctacgataaaggatatcagttcgaagaagagaatcctctgcgggaccatcctcagcctttcgaggagggtctgagacgcctacaggaaggagatttgcctaatgctgtcttgcttttcgaagctgccgtccagcaggatcctaaacacatggaggcctggcagtacttgggtaccacgcaggccgaaaatgaacaggaactgctcgctatatctgccctgcgaaggtgtctggagctcaaacccgataatcagacagccctgatggcccttgccgtgagctttacgaacgagagcctccagagacaggcatgcgagaccctgcgtgattggttgagatacactcctgcctatgcccacctggttacgccagccgaagaaggtgctgggggggccggcctgggccctagtaaaaggattctaggatcactgctctccgattctttatttttagaagttaaagagctgtttttagcagccgtgaggctggatccaacctccattgatccagacgttcaatgcggccttggagtgttattcaatctcagcggtgagtacgataaggcggtcgattgcttcaccgcagcactgagcgtgaggcccaatgattaccttttgtggaacaagctcggtgctactcttgccaacggcaaccagtcggaggaggctgtggccgcctaccgcagggctctggagctccagccgggctatatacgttctaggtacaatttagggatcagctgcattaaccttggtgcccatcgcgaggccgtggaacactttctggaggctctgaacatgcagcggaaatcaagaggccctaggggggaggggggcgccatgtcagaaaacatctggtcaaccttaagactggccttatccatgctgggccagtctgacgcctatggcgcagccgacgcgagagacttatctactctgttgaccatgttcgggctgccccagtag

SEQ ID NO: 128227 - DNA, 1920 bp, Artificial Sequence
  Description of Artificial Sequence: Synthetic coding sequence
atggctatgcgggaactagtggaggcggagtgcggaggtgctaatccattaatgaagctcgccgggcatttcacccaagataaggccctccgtcaggagggcctgagaccaggcccgtggcctcctggggctccagctagtgaggcagcatctaaaccgctgggcgtcgcgtccgaggatgagctagtcgcggagtttttgcaagatcaaaacgcgcctttagtgagtagggcgccccagaccttcaaaatggacgacctccttgctgaaatgcagcagatcgaacagtctaacttcagacaggcgccacagcgggcccctggggtagccgatctagctctgtcagaaaattgggcacaggaattcctcgccgcaggcgatgcagtggacgtcacccaggactataacgagactgactggtcccaggagttcatctccgaagtcaccgatcccttatctgtgagtccggctcgctgggccgaggagtatctcgagcagtccgaggagaagctatggttgggcgaacctgaaggcaccgccaccgataggtggtatgatgagtaccatccagaggaagatctccaacatacggcgtcagacttcgtggccaaagtcgatgatcccaaactggctaacagcgaattcttgaagtttgtaaggcaaatcggcgagggtcaggtgtcgctggagtctggcgctggctcaggccgagcgcaggccgaacagtgggccgcggaattcatacagcagcagggaacctcggacgcttgggtggatcagtttacaagaccagtgaacacctctgcgctggacatggaattcgagcgagctaaatctgccattgagtccgacgtggatttttgggataagctgcaagccgagctggaagagatggccaagcgagacgccgaagctcacccgtggcttagcgactacgacgatctgacatccgctacgtacgataagggctaccagttcgaggaggagaatccactccgggaccacccacagccatttgaagagggcttaagaagactgcaggaaggcgacctgcccaatgctgtgttactgttcgaggctgccgtacagcaggaccctaagcacatggaggcttggcaatatttggggactactcaagcagaaaatgaacaggaactgctggcaattagtgccctgcggcgctgtctcgaattaaagcccgacaatcagacagcactcatggccctggcagtgtcctttacaaatgagtcccttcagagacaggcttgtgagacgctacgcgactggctgcgctatacgcctgcctacgcccacctggtaacacccgctgaggaaggggccggcggagcaggcttgggcccaagcaagaggatactgggttccctgctgtccgattccctgttcctcgaggtgaaggagctgtttctagcagccgtaaggctggatcctacaagcatcgacccggacgtgcagtgcggcctgggggtgctgttcaatttgagcggggagtatgacaaggctgtggactgctttaccgctgctctgtccgtccggcccaatgattatctcctgtggaacaaattgggcgctactctcgcaaacggaaaccagtctgaggaagccgtggccgcttaccgtagagcgctggagttacaaccaggttatatcagatcccgctacaaccttggcatctcctgtattaacctaggagctcacagggaagccgtcgaacacttcttggaagctttgaatatgcaacgaaagtcccgcggtccgcggggcgaaggtggagcaatgtcagagaacatttggtccacgctccggttagccctctcaatgctgggtcagtccgacgcttacggcgctgctgatgcccgtgatctttccaccttgctgacaatgtttggcctgccgcagtag

SEQ ID NO: 128228 - DNA, 345 bp, Artificial Sequence
  Description of Artificial Sequence: Synthetic coding sequence
atggccatgagagagttagtggaagccgagtgcgggggcgcaaatccccttatgaagttggctggacatttcacacaggataaagcgttacgacaggagggactcaggccaggtccttggcctcctggtgcaccagcatcagaggcagcatctaagccgctgggggtcgcctccgaagacgaactggtggctgaattcctccaggaccagaacgctccgctagtctcgagagctccacagacatttaaaatggatgatctgcttgcagagatgcagcagattgaacagagcaatttcaggcaggccccacagcgggctcctggggtcgccgatctggcgctttag

SEQ ID NO: 128229 - DNA, 309 bp, Artificial Sequence
  Description of Artificial Sequence: Synthetic coding sequence
atggccatgcgagaattggtggaagccgagtgcggcggcgcaaacccactcatgaagctggctggccactttacccaagacaaggccctgagacaggaagggttacggcccgggccctggccccccggggctcctgcatcagaggctgcctccaagccacttggtgtagcctctgaagacgagttggttgccgaattcctacaggaccaaaatgccccccttgtgagtagagctcctcagaccttcaagatggacgatctgctcgctgagatgcagcagatcgaacagagtaattttcggcaggcatag

SEQ ID NO: 128230 - DNA, 747 bp, Artificial Sequence
  Description of Artificial Sequence: Synthetic coding sequence
atggcaatgagagaactggtcgaagccgaatgtggtggtgcaaaccccctgatgaaacttgcaggtcacttcacccaggataaggctttacgccaagagggactccgccccggcccatggcctcctggggctcccgcatcggaggccgcaagtaagccactgggggtagcctctgaagacgaactggtcgcagagtttctgcaggaccagaatgccccactcgtgtctagagccccccagactttcaagatggatgacctgctagccgaaatgcagcagattgaacagtctaacttcaggcaagctccacagcgtgcgcccggtgtagccgatcttgctctctctgagaactgggcgcaggaattcctggcggccggagacgctgtggacgttacccaggattacaacgagacagactggtcccaagaattcatctctgaggtcacagaccccctgtcagtctcacccgctcggtgggctgaagagtaccttgagcagtctgaggaaaagctctggctgggggagccagagggtacagctacagatcgttggtatgacgagtaccatcccgaagaggacctgcaacacaccgccagtgactttgtagcaaaggtggatgacccaaagttggctaactcagaatttctcaagtttgtgcgccaaattggcgagggacaagtgagcctggagagcggcgctggctctgggagggcccaggccgagcagtgggccgcagaattcatctag

SEQ ID NO: 128231 - DNA, 315 bp, Artificial Sequence
  Description of Artificial Sequence: Synthetic coding sequence
atggcaatgcgggagcttgtggaagctgaatgcggaggggccaatcctttgatgaaactcgcaggccactttacacaggacaaggcactcaggcaggaagggctgcggcccgggccttggcccccaggggcgcccgctagcgaggccgcttccaagccactaggtgtagcgtcagaggacgaactagtggcggaattcctccaggaccagaatgcgccacttgtcagtcgggctccccaaacctttaagatggatgatcttctggccgagatgcagcagatagagcagtcaaactttagacaagccccccagtag

SEQ ID NO: 128232 - DNA, 1875 bp, Artificial Sequence
  Description of Artificial Sequence: Synthetic coding sequence
atgtatcagggccacatgcaagtggtgggcgttacattaaaaaagaaatggcactgcctccagaaatctgatctcaccctggcattagggaaaggatcgcgcgcagcagacaaagccgtggccatggtcatgaaggaaatcccccgcgaggagagtgccgaggaaaaaccccttctcactatgacttcccaattagttaatgaacagcaggagagccgcccactgctcagtccttcgatagatgactttctgtgtgagaccaaatccgaagctattgccagacccgtcacttccaacacagcagtgttgactacaggacttgacctacttgacctgagtgagcctgtctcccagacccagaccaaggctaagaagtccgagccatcatctaaaacatcctctctcaaaaaaaaagcggacgggtcagatctcatcagcaccgacgccgaacagcgcggccagcccttacgagtccccgagactagctccctggatcttgacatacagactcagctcgaaaaatgggatgatgtcaaattccacggagatcgaaacactaaaggtcatccgatggccgagagaaagagttcatcctcacgtaccgggtctaaagaactgttgtggagttccgaacatcgatctcagcccgaactctctggagggaagtcggccctcaactcggaaagcgctagcgagttggaactggtggctcccacccaggcaaggctaacaaaagagcatcggtggggaagcgctttactatccaggaaccactcactcgaagaggagttcgagagggccaaggcagcagtagagtcagacacagagttctgggacaagatgcaggccgaatgggaggaaatggcccggcgaaattggatttctgagaaccaggaagcgcaaaaccaggtcaccatctctgcctcggagaaaggttactatttccacacggaaaatccgtttaaggactggccaggtgccttcgaggagggattgaagcggctcaaggagggagatctgcccgttactattctgttcatggaggctgcaatcctgcaggatcctggagatgccgaggcttggcaatttttgggaatcacacaggctgagaacgaaaatgaacaagcagccatagtcgcattgcagcggtgcctggagctgcagccaaataacttgaaagccctcatggcactggccgtcagctatacaaatacgggtcatcagcaggacgcatgtgatgcacttaagaattggatcaaacagaacccgaagtacaaatatctcgtgaagtcgaagaaagggagcccaggcctcactaggcgtatgtctaagtcccctgtagactcttcagtcttggagggggttaaagaactgtaccttgaagccgcacatcaaaacggcgacatgatcgaccccgacttgcagaccggactgggggtgctgttccacctgagcggcgagtttaatcgtgcaatcgatgcatttaatgccgcactgacagtgcggcccgaagactattctctgtggaaccggctaggagcaacccttgccaatggggaccgctctgaggaagcagtcgaggcctatacgcgcgcacttgaaattcagcctgggtttatccggtcacgctataacctgggcatttcttgcattaacctgggcgcttaccgcgaagcggtttctaactttctcacggccttgagcctccaacggaagagccgcaaccagcaacaggtgcctcaccccgcgatctccggtaatatatgggccgctttacgcatcgcgcttagcttgatggaccagccggagctcttccaggccgctaacctcggtgacctggacgtgctcctgcgagcctttaatctggacccgtag

SEQ ID NO: 128233 - DNA, 1875 bp, Artificial Sequence
  Description of Artificial Sequence: Synthetic coding sequence
atgcaccagaatggaagtcaggtcgtaggggtcacccttaaaaagaaatggcattgcttacagaaatcagatcttacactggcgcttggaaagggatcacgagccgccgataaggcagtggccatggtgatgaaggaaattccacgcgaagagtccgccgaggagaagcccttgctgaccatgaccagccagttggttaatgaacagcaggaatcacgacctcttctctccccatcaattgacgacttcctctgcgagacgaagtccgaagctatcgcaagacccgtgacatcaaatacggctgtgttgactacaggactggacctgctcgacttgtctgagccggtctcccagacgcagactaaagccaagaagtcagaaccttctagtaaaactagctctcttaaaaagaaggctgacggatctgacctaatctcgaccgacgccgaacagcggggccagccactgagggtgcctgaaacctcctccctggatcttgatatccagactcagcttgagaagtgggacgatgtgaaatttcacggcgatagaaacaccaaaggccaccctatggcggagaggaagtccagtagttcgcgcaccgggagtaaagaactcctttggagtagcgagcatcgatctcagcctgagctgtcaggcggaaagtccgccctcaactccgaaagtgcatctgaactggagctggtggcacccacacaggcacggctgacaaaggagcatcggtgggggtccgctcttctgtcccgcaatcacagcttggaggaggaattcgagcgcgccaaggccgcggttgagagtgacacagaattttgggataaaatgcaggccgaatgggaagaaatggcaaggaggaattggatcagcgaaaaccaggaggcccagaatcaggtaaccatatccgcttccgaaaaggggtactattttcatactgagaatcctttcaaagattggcccggcgcgtttgaggaggggctgaaacgtctcaaggagggcgatctgcccgtcaccatcctgtttatggaggccgcaattttacaggaccctggcgatgcggaagcatggcaatttcttgggataacacaggctgaaaacgaaaatgaacaggctgcgatcgtcgccctccagcgctgtctggaattacagcctaacaacttgaaggccctgatggccctggcagtatcgtacaccaacaccggccaccagcaggacgcgtgcgatgcactgaaaaactggatcaagcagaacccaaagtacaagtatttggtgaagtccaaaaagggttccccaggcctgaccagacgaatgtctaaatctccagtggactccagcgtcctcgagggcgtcaaggagctgtacctcgaagccgcccatcagaatggggacatgattgaccctgacctccagactggcctcggagtactttttcacctgagtggcgagttcaatcgcgccatcgatgcctttaacgcagccctgactgtcaggcccgaggactattctctctggaaccgtctaggagcaaccctagccaacggggaccggtccgaagaggctgtggaggcttatacccgcgcactggagatacagcccgggtttatcagatcccggtacaatttgggtattagttgtatcaatctgggcgcgtatcgggaggctgtatccaactttctgacagcactctctctccagcgcaagagtagaaatcagcagcaggtgccacatcctgctattagcgggaacatatgggctgctctcaggatagctcttagcttgatggatcaacctgaactgttccaggcggccaatcttggagacctcgatgtgttgctccgcgcctttaacctggatccgtag

SEQ ID NO: 128234 - DNA, 1557 bp, Artificial Sequence
  Description of Artificial Sequence: Synthetic coding sequence
atggttatgaaggaaatcccccgagaagagagcgccgaggagaagcccctgctcactatgacttcccagttggtgaacgagcaacaggagtccagaccactgttatccccaagcattgacgatttcttgtgcgagaccaaatctgaggcaattgccaggcccgtgacatctaacacagccgacattcaaacacagctcgaaaagtgggatgatgtgaaattccacggagatcgcaataccaaggggcatcccatggccgaaaggaaaagcagcagtagtaggaccggatcgaaggaactgctctggtctagcgagcaccgcagtcagccagagctcagcggagggaaatccgccctgaactctgagagcgcaagcgagcttgagctcgtggcccccacccaagctcgccttactaaggaacatcggtggggatccgccctattatcccgcaaccatagcctagaggaggagtttgaaagggctaaagctgcagtggagagcgacacagaattttgggataagatgcaggcagagtgggaagagatggccaggaggaattggatcagtgagaaccaggaggcccagaaccaggtgacgatatccgcctctgagaaggggtactactttcacacagaaaacccattcaaggattggcctggagctttcgaggagggcctcaagagactgaaagaaggagacttgcctgtcactatcctctttatggaggctgccatccttcaggacccgggcgatgccgaggcgtggcagttcctggggattacccaggctgaaaacgagaacgagcaggccgctatcgtggcccttcagaggtgtctagagctgcagcctaacaacttaaaagccctgatggcattagcagtatcttacacaaataccgggcaccagcaggacgcatgcgatgctttgaaaaactggatcaagcaaaaccctaagtataaatatctggttaaatctaagaagggatctcctggcctgacccggcgcatgagtaaaagccccgtagatagcagcgtgttggagggagtgaaagagctctacctggaggctgctcatcagaacggcgacatgatagaccctgacctgcagactggattgggcgtgctcttccacctgtctggggaatttaaccgcgccatagatgccttcaacgctgcccttactgtgcggcctgaggattattcactatggaaccgactgggagccactctggctaatggggatcggagcgaggaagctgtcgaggcttataccagagcgctggagattcagcccggatttatacgctcccgctataaccttgggatcagctgcatcaacctgggcgcatacagagaggcggtgtctaattttctcacagcgctctccctccagcgcaaatctcgcaaccagcagcaggtaccacacccagccatcagcgggaatatttgggcagctctcaggatcgcactgtccctgatggaccagcctgaactgtttcaggctgcgaacctgggtgatctcgacgtgctgttgagagccttcaacctagatccgtag

SEQ ID NO: 128235 - DNA, 1809 bp, Artificial Sequence
  Description of Artificial Sequence: Synthetic coding sequence
atgtaccagggtcacatgcagggaaaaggttctcgggctgctgataaggcagtcgccatggtgatgaaagagatccctcgtgaagagtccgccgaagagaaacccctccttaccatgacatcccagctggttaacgagcagcaggagtccagacctctcctttctcccagtatagacgattttctttgcgagaccaagagcgaagccatcgcccgaccagtgacatcaaatactgctgtgttgacgaccggactagacctcctggacctgtcggaacccgtgtcccagacccagacaaaagcaaagaagtcagaaccaagttctaagacaagcagtctcaagaagaaggctgacggatccgatctcataagcacggacgccgagcagcgagggcaaccactacgagtgcccgagacttcttccctcgacttagacatccagacacaactggagaagtgggacgacgtgaagttccacggcgataggaatacaaaaggccaccccatggctgaaaggaaatccagtagttcacgcacgggaagtaaggagctcctgtggtcaagcgagcatcgcagtcagcctgagctgtcgggcgggaagtctgcacttaactccgagtcagcatctgaactcgagttggtcgcgccgacccaggccagactgactaaagagcacagatggggctccgcccttttaagccgcaatcattccctggaggaagagttcgaacgtgcaaaggctgccgtcgagagcgatactgaattctgggataaaatgcaggcagagtgggaggaaatggcccggcggaattggatatctgagaatcaagaagctcagaaccaagttacaatctccgcctcggaaaaaggatattactttcacacagagaatccctttaaggactggcccggagcgttcgaagagggactgaaacggctgaaagagggtgatctgcccgtgacgattttatttatggaggctgcgattctccaggaccccggcgacgccgaggcatggcagtttctggggattacgcaggccgagaacgaaaacgaacaagctgccattgtcgcactccagaggtgtctcgagttacagccaaataacctgaaagcgcttatggcgctggccgtgtcctacacaaatactgggcaccagcaagacgcatgcgacgcccttaagaattggataaagcagaacccaaagtacaaatacctggtgaagtccaaaaaagggtcaccggggctcactcgccggatgagcaagtctcccgtggatagctcagtgcttgagggcgtgaaagaactatatttggaggccgcgcatcagaatggtgacatgatcgatcccgacttacagaccggccttggagttctgtttcatctgagtggcgaattcaaccgagcaatagacgcgttcaatgcagccctgacggttcgaccagaggactactccctctggaatcggctgggcgccacgctggccaatggagaccggtctgaggaagccgtggaggcctatacgcgcgctctcgagatccaaccaggttttattcgctcacgctacaaccttggtatttcatgcatcaacttgggggcatacagagaggcagtcagtaactttctcacagccttgtctttacagaggaaatctcggaaccagcagcaggttcctcatcctgccatctctggcaatatttgggcagccctgagaattgcccttagcctcatggatcagcccgagctgtttcaggccgcaaacctcggggatctagacgtgctcctccgcgctttcaacctggacccatag

SEQ ID NO: 128236 - DNA, 1545 bp, Artificial Sequence
  Description of Artificial Sequence: Synthetic coding sequence
atgtcatctctgtcgctcaagcccctggtgcaggttagtgtgggcgcctttgtacaactggtgaatgagcagcaggagagtaggccgctactatcacctagtattgacgattttctgtgcgaaactaagagcgaagcaatcgccaggcccgtgacaagcaacaccgctgacatccaaacacagttggagaagtgggacgatgttaagttccatggcgacagaaatactaaagggcatccaatggccgaacgtaaatcctcctcatcacggacaggctccaaggaactgctgtggtccagtgaacacaggagtcaacccgagctttcaggagggaagtctgcactgaatagcgaaagtgcgagtgagctggaactggtcgctccaacccaggcacggctgaccaaagaacatcggtggggatcagccctactatctaggaaccattcattggaggaggagttcgaacgtgccaaagcagctgttgagtcagacaccgagttctgggacaaaatgcaggccgaatgggaggagatggccaggagaaactggatctcagagaatcaggaggcgcaaaatcaggtgacaatcagtgctagcgaaaaaggatactattttcacaccgagaacccattcaaggattggccaggcgcatttgaagagggattaaagcgcctgaaagagggagatctccctgtcactatcttgtttatggaggctgccatcttgcaggatcccggcgacgcagaggcttggcagtttttaggaattacacaagcagaaaacgagaatgaacaagccgcaatcgtggctctgcaacgctgtctcgagctacaacctaacaacctaaaagcccttatggccctggccgtgtcttatacgaacactggacaccagcaggacgcttgcgacgcattgaaaaattggattaaacagaaccctaagtacaagtacctggttaaatctaagaagggaagccctggactaacccgcaggatgagcaagtcacccgtcgattcttctgtcttggagggcgtcaaagagctgtacttagaagctgctcatcaaaacggggatatgattgatccggatttgcagaccggtctgggagtcctattccatctgtccggcgagttcaatcgagcgatagacgccttcaacgccgccttaaccgtgcgacccgaagactacagcctgtggaacagactaggagccaccctggccaatggtgatcgcagtgaggaagccgtggaagcttacactcgcgccctggaaattcagcctggcttcattaggtcccggtacaacttagggatttcctgcatcaatctgggtgcataccgcgaagctgtgtctaatttcctgaccgctttgagtttgcagcgcaaaagtcgaaatcagcaacaggtgccccaccctgccatttctggcaacatctgggctgctctcaggatagctctgagtctgatggatcaacccgagctctttcaggccgctaatctgggagatttagatgtgctgttgagggcctttaacctggacccttag

SEQ ID NO: 128237 - DNA, 1881 bp, Artificial Sequence
  Description of Artificial Sequence: Synthetic coding sequence
atgtatcaggggcacatgcagaaatctaaggaacagggctacggtaagctgtcttcagacgaggacctggagatcattgtagatcagaaacaggggaagggtagtcgcgcagctgataaggccgtagcaatggtgatgaaagaaatcccccgggaggagagcgccgaagagaagccgctcctgaccatgacctctcaactcgttaatgagcagcaggagtcccgacccctgctgagcccttcaatcgacgatttcctttgcgaaacgaagtctgaggccattgcaagacctgtgacctctaacactgctgtgctgaccacaggtttagacctgctcgacctctcggaacctgtgagtcagacacagacaaaagctaagaagtccgagccttcatccaagactagttccctgaaaaaaaaggcggacggatcagacctgatctcaacagacgccgagcagcggggtcagccccttcgcgtgcccgaaacaagcagcttggatctggacatacagacacaactggagaagtgggatgacgtcaagttccatggagaccgcaatacaaagggccatccaatggccgaacggaagagcagctcaagccggaccggctccaaagagctcctgtggagttccgaacatcgttctcagccagagttgagcggtgggaagagcgctctcaacagcgagtccgcctccgaactggagcttgtagctcctactcaagctcgcttgaccaaggagcaccgctggggctcggccctgctgagcaggaaccattcattggaagaggagttcgaacgtgcgaaagcggccgtggagagcgatactgaattttgggacaaaatgcaggccgaatgggaggagatggcccgcagaaattggatctcagagaaccaggaagcccagaatcaggtgacgatatccgcttcggagaagggatactattttcataccgaaaatccctttaaggactggccgggagcttttgaggaaggactgaaaagacttaaagaaggagacctcccagtgacaatcctgtttatggaagccgctatcttgcaggatccaggcgatgctgaggcctggcagtttctggggattacgcaggctgagaacgaaaacgagcaagccgccatcgtggccctccagagatgtctggagctgcagccaaataatctcaaggccctaatggccttagctgtatcctataccaacacaggacaccaacaggacgcatgtgacgcactcaagaactggatcaagcagaatccaaagtataagtatttggtcaagtctaaaaaaggttcccctggcctgacaaggaggatgtcaaaatctcctgtggactccagtgtgctggagggagtgaaagagctgtaccttgaggcggctcatcagaatggagatatgatagacccagatcttcagacaggactcggggtcctctttcacttatccggcgaattcaatcgggccattgacgcattcaacgcagcccttaccgtgcgaccagaagattatagcctgtggaatagactcggcgctactctggctaatggagatcggagtgaagaggctgtcgaggcatacacgagggcgctggagatccagcccggctttatccggagcagatacaatctgggcatttcatgtattaaccttggagcctacagggaagctgttagtaattttctgactgccctctcacttcagagaaagagccgaaaccagcaacaggttccccatcctgctatttctggaaacatctgggccgctcttcggattgccctgtctcttatggatcagcccgagttattccaggccgctaaccttggcgatctagatgtgctcttaagagcctttaatctagacccttag

SEQ ID NO: 128238 - DNA, 1752 bp, Artificial Sequence
  Description of Artificial Sequence: Synthetic coding sequence
atggtaatgaaggaaattccgagagaggaatcggctgaggaaaagcctttgctcacaatgacctcccagctggtgaatgagcaacaagagtcgagaccactgttgtccccaagtatcgatgactttctgtgtgagacaaaatccgaggccattgcccgacccgtgacatccaataccgctgtcctgacaaccggccttgacttactcgatttgtccgaaccagtaagtcaaacccagacaaaagctaaaaagagcgaacctagctcgaagacatctagccttaagaagaaagctgacggcagtgatctcatctcaactgatgcagagcagcgcgggcaacccttgagggtccccgagaccagttctctggatctggacatccagacccaacttgaaaaatgggacgacgtcaagtttcatggcgaccgcaatactaaggggcaccctatggctgaaagaaagagctccagctcgaggaccgggtctaaagagcttctgtggagttcagagcacaggtcccagcccgaactgagtggcgggaaatccgcactgaactccgaatcagccagcgaactcgaactggttgctcctacgcaggctaggttaacaaaagaacatcggtggggatccgccctactgagcagaaaccatagtctggaagaagaatttgaacgcgctaaagccgccgtggaaagtgatactgagttttgggacaagatgcaagcggagtgggaggaaatggcccgcaggaactggatttccgagaaccaggaagctcagaaccaggtgacaatttctgcctctgagaaaggctattactttcacacagagaacccctttaaagattggcccggcgccttcgaggagggtctgaagcgtctgaaggagggcgatctccctgttaccattcttttcatggaggccgccatcttacaggaccccggagacgcagaggcctggcagttcctgggtattacccaagcagagaacgagaacgagcaagctgcaatagtcgccttgcagagatgccttgagctccagcccaacaacctgaaagcccttatggctctggcagtgagctacacaaacaccggccaccagcaggacgcctgcgatgctttgaaaaattggattaagcagaaccctaagtataagtacttggtgaagtcgaagaagggaagtccaggactgacgcgtcgaatgtccaagtccccagttgattcatcagtgcttgagggtgtaaaagaattgtatcttgaagccgctcaccagaatggagatatgatcgaccctgatttgcagactgggctgggagtactcttccatctcagtggcgaattcaacagggcgatcgacgcctttaacgctgctctgaccgtgcggccagaagactatagcctgtggaatcggctcggagccaccctggccaacggtgaccgctcagaggaggcagtggaggcttatacacgtgccctggagattcagcccggttttatcagatccaggtacaatcttggcatctcctgtataaatctgggcgcgtatcgggaagctgtaagtaatttcctcaccgctctctctttgcagagaaagagccggaatcagcagcaggttcctcatccagccatcagcggaaatatatgggccgcgttgagaatcgcattatccttaatggaccagcccgagctattccaggccgcaaacctcggagacttggatgttctgctccgcgcctttaaccttgacccgtag

SEQ ID NO: 128239 - DNA, 1776 bp, Artificial Sequence
  Description of Artificial Sequence: Synthetic coding sequence
atgtaccagggacatatgcagaaatctaaagagcaggggtacggtaagctgtccagcgacgaggacctcgaaataatcgttgatcagaagcagctggtgaatgagcaacaggagtcaagaccgcttctcagcccttccattgatgacttcctgtgtgagaccaagtcagaggccatcgcacggcccgttactagcaataccgccgtgctcaccacgggcctcgacctcctggaccttagcgagcctgtgtcccaaacccagacaaaagccaaaaagtcggagccaagcagcaaaactagtagcttgaagaagaaggctgacggaagcgatcttatctctactgatgctgaacagcggggacagccactgagggtgccagagacatctagcctggatctcgatattcagactcaactcgagaagtgggacgacgtgaagttccatggcgatcgtaacactaaggggcacccaatggcagagcggaagtcctcctcatctagaaccgggagcaaagagctactttggtcttcagagcaccgaagccaacccgaactaagcgggggcaagtccgctttaaacagtgaatcagcctccgagctcgaattagtggcacctacccaggcgaggttaaccaaggagcatcgctggggatctgcactgcttagtaggaaccacagcctagaagaagaatttgaacgggccaaagcagccgtggaatcggatacagagttttgggacaaaatgcaggccgagtgggaggaaatggcccggaggaattggatcagcgaaaaccaggaagcacagaatcaagtcaccatcagtgcttcagaaaaaggatattattttcacacagaaaatccattcaaggattggccaggtgcttttgaagagggtctcaaaaggctaaaagagggggacttacccgtcaccatcttatttatggaggccgcgatattgcaggaccctggcgatgctgaggcctggcagttcttgggtattactcaggcggaaaacgaaaatgagcaggcagcaatcgtggctctccagaggtgtctagaactgcaacctaacaacttgaaagctctcatggcccttgccgtgtcctacaccaacaccggccaccagcaggacgcgtgtgatgccctgaagaattggattaaacagaaccctaagtataagtatctggtcaagagcaaaaagggaagtccaggacttaccagaagaatgagtaaaagccccgtggatagttccgtgctggagggagtaaaggaactctacctggaggcagcacatcagaatggcgatatgatcgaccctgacctacaaaccggcttaggcgtgctgtttcacctgtccggtgagtttaatcgggcaatcgacgctttcaacgccgcactcacggtcagaccggaggattactcactgtggaatcgtctaggggctactctggctaatggtgataggtctgaagaagcagtcgaagcatacactcgcgccttggaaattcaacccggatttatcaggtctaggtataacttaggcattagctgtatcaacctgggggcataccgagaggccgtcagtaatttcctgactgcgcttagcctgcagcgaaaaagtagaaatcagcagcaagttccccaccctgccatctctggcaatatttgggcagccctccgcatcgccctgagcctgatggaccagcctgagctgtttcaggcggcaaacctgggggatcttgacgtgcttctgcgagcatttaacctagatccctag

SEQ ID NO: 128240 - DNA, 2217 bp, Artificial Sequence
  Description of Artificial Sequence: Synthetic coding sequence
atggctctggccgtgctgagggtgctggagccattccctacagagacacctcctttagctgtcttgctcccccctggaggcccctggcccgcagccgagctcgggctcgtcctcgctctccgccccgcaggtgaatctccagccggcccggctctgctcgtggccgccttggagggacctgacgctgggaccgaggagcaaggccctggaccacctcagctactggtcagtcgcgcattactgaggcttctcgctttggggtccggagcctgggtgagagcacgcgcagtgcgcaggcctcccgctttggggtgggcgctccttggtacctcactcggaccagggctgggccctagagttgggccattacttgttcgcagaggcgagacgctccctgtgccgggccccagggtgctcgagacccgaccagcactccagggactacttgggcctggtactcgactcgctgttacagaactccggggtcgcgcccgcctgtgccccgagtccggggacagttctcgccccccacccccgccagtggtctccagtttcgcagtctccgggacggttcgcagactgcagggcgtgctcgggggtacgggcgactcccttggggtaagccgctcctgtttaagagggctcggactgtttcagggtgagtgggtctgggtcgcacaagcacgtgaaagtagtaacacctctcagccacacctggcgagagtgcaggtcctggagccaaggtgggatctgagtgaccggttaggccccgggagcggcccgcttggagaacctctcgctgacggcctagccctcgtgccagccacactggcatttaacttagggtgcgacccactggagatgggtgagctacgaatacagcggtacctggaaggatccatcgcgcctgaagacaagggctcatgttccctcctgcccggaccaccatttgctagagagctccatatcgagatcgtgtctagcccccactactcaactaacggcaactacgacggcgttctgtatcgccacttccagatcccccgagtggtgcaggaaggggatgttttgtgcgttcctacgatcggccaggtggaaattctggagggctccccagagaaactcccaagatggagggagatgttctttaaggtaaagaaaacagtgggcgaggcacctgatggacccgcatcggcctacctggcagatactacacacacttcactgtacatggttggctccacgctgtcccctgtcccctggctgccaagtgaggaatctacgctgtggtctagcctcagtccccctgggctggaagccctcgtgtccgaactctgtgctgtgctgaagcctcgactgcagcctggcggagccctgctgactggcacttcttccgtcctgctccgcgggcccccagggtgtgggaaaaccacagtcgttgccgcagcatgctcccacctggggctgcacctgctgaaggtgccatgtagctcactgtgtgccgaatccagtggggcagttgaaacaaagcttcaagccatcttctcccgggcccgtaggtgccgtcccgccgtgttattgctgacagccgttgatctccttggcagagatagagatggactcggagaagacgcccgcgtgatggccgtgctgcgtcacctgcttctgaacgaagatccactaaatagctgtccgcctttaatggtggtggccaccacgtcccgtgcccaagacctgccagcagacgtgcagacggcctttccccatgaactggaagtgcccgccctgtctgagggccagcgcttgagcatactgcgggcacttacagcccacctgcctctggggcaagaggtcaatctggcacagttagccagacggtgtgccggtttcgtcgtcggggacttatacgcgttattgacgcatagttctagggccgcttgcacacgtataaaaaattccggactggccggtggccttacagaggaggatgaaggtgaattgtgcgccgccggattccctctacttgcagaagatttcggccaggcgcttgaacagcttcagacagcccacagtcaggccgttggggcccctaaggtggaaaccaaatctctggaatgtctccccgggcctgggcttcagctgcacgccttgtcctcactgatgaattggactctgtggccacaagccgggggtgaagtcgaaattttggaggaatag

SEQ ID NO: 128241 - DNA, 2943 bp, Artificial Sequence
  Description of Artificial Sequence: Synthetic coding sequence
atggcccttgcagtgctccgggtgctggagccgtttccaacggagactccacctttggccgtactgcttccacccggtggcccttggcctgcggcagagctgggcctcgtcctagccctgcggcccgccggggaaagtccggcaggacccgccctgcttgtcgctgcactggaaggaccagatgccggtaccgaagagcaggggcctggccctccacagcttcttgtgtcccgggcactgttgcggcttctcgccttgggctccggcgcatgggtaagagctagggcggtgcggcgcccccccgccctcgggtgggccttgctaggaacgagcctggggcccggattgggcccccgcgtgggccccctcctagtgaggagaggagaaacactgccggtacctggcccacgcgtgctggagacgaggcccgcactgcaggggctcctgggacccgggactcgactggcggtcacagagttaaggggccgagctcgactttgtccggaaagcggagactcatcaaggcccccaccccctcctgtggtctcgtccttcgcagtgtcaggcaccgttcgccgcctacaaggggtgctcggcggcaccggcgattccctgggtgtgagcagaagctgccttcgcggacttgggttgttccagggcgagtgggtgtgggtggcacaagcccgtgagtcttcgaacaccagccaaccacatctggctagggtgcaggtgttagagccccggtgggacctgagtgaccgtttgggtccaggtagcggccctctcggcgagcccctcgctgatggactggcccttgtgccagctacacttgcatttaatctaggatgcgacccgttagaaatgggggagttgcggattcagaggtacctggaaggctcgatcgcccccgaggataaaggatcttgctctttgctcccgggtccccctttcgcaagagaactccatattgagatcgttagtagcccccattatagtacaaatggtaattatgatggcgttctgtaccggcattttcaaatcccaagggtcgtccaggagggcgacgtgctctgtgttccaacgatcggacaggtggagatactggagggctcaccggagaaactgccgagatggcgggaaatgttcttcaaagtgaaaaaaacagtcggcgaagcacccgatggccctgcaagtgcttaccttgccgacactacccacacgagtctgtatatggttgggagcactctatcccccgttccgtggctaccttctgaagaaagtaccctgtggtcctccctctcaccgcccggtctagaagcattggtgtccgagctctgtgcagtgctcaaacccagattgcagccaggcggagcattactcactggaacaagtagcgtgctactgcgggggcctcctggctgtggaaagaccactgtggtggccgctgcgtgctctcacctaggacttcatttactgaaggtcccttgctcttccctctgtgctgaaagctccggagcagtggaaacaaaactgcaagccatcttcagcagagccaggcggtgccggccggcggttctgttgctcactgcggtggacttgctcggccgcgatcgagacggtcttggcgaagatgcacgcgttatggcggttctccgacatctgcttctcaatgaggatccactgaactcatgtccacctctcatggtggttgcaactacgtcacgagcccaagacctacccgccgatgtccagaccgcctttccgcatgagctggaagtgcctgcgttgtcagagggccagagattgagtattctgagagctttgacagcccatctcccgctaggccaagaggtgaacctggctcagctggccagacggtgcgcaggattcgtcgtgggagacctgtacgccttactgacacattcctcccgcgccgcgtgcacacgaatcaagaattcagggcttgcaggaggtctaacagaggaggacgaaggggagctgtgtgccgcaggttttccgctgctggccgaggacttcggccaggcgctggagcagctgcaaacagcccacagccaggcagtgggcgccccgaagatcccatccgtctcctggcacgatgtgggcggcctgcaggaggtaaagaaagagattttggagaccattcagctccctcttgaacaccctgagctcctctcattagggctgcgccggagtggactgctgctacacggaccacctggaaccgggaagacacttcttgcaaaggctgtggccacagaatgcagcctgaccttcctctcagtgaagggccctgaactgatcaatatgtatgtgggccagtccgaagaaaacgtgagagaggtgttcgctcgcgccagagcagcagctccgtgcattattttcttcgatgagctggacagtctcgccccttccagaggaagatctggggatagcggaggggtcatggatcgagtcgtgtcccaactcctggctgagctggacggactccatagtactcaggacgttttcgtgataggggccaccaaccggccagacctgttggatcctgcactcttacgacccggccgcttcgataagcttgtttttgtgggcgccaatgaagatcgggcgtcccagcttagagtgctgtccgccatcactcgtaagttcaagcttgaaccttcagttagcctcgtgaacgtactagattgctgccctccacagttaactggagcagacctatactccctctgttcggacgccatgacagctgccctcaagcggagggtgcacgacttagaagagggactggagccagggagctcagcattaatgctgacgatggaagatcttctgcaagccgccgcccgcctccagccaagtgttagcgaacaagagcttctgaggtacaaacgtatccagaggaaatttgccgcatgttag

SEQ ID NO: 128242 - DNA, 972 bp, Artificial Sequence
  Description of Artificial Sequence: Synthetic coding sequence
atgagcgccgtctgtgggggcgcggctcgcatgctgagaacacccggccgacacgggtacgctgcggagttctctccatacttgcctgggcgtctcgcctgtgctaccgcgcagcactacggtatcgccggttgtggcacacttctaatcttggatccagacgaggcggggcttcgcctgtttagatcctttgactggaatgacggcttattcgacgtgacgtggtccgagaataacgaacatgtcctgataacatgctcaggcgacgggtctttacaactttgggataccgcaaaggccgctggtccacttcaagtgtataaagaacacgcccaggaagtgtactctgtggactggagtcaaaccaggggtgagcaacttgtcgtttctggatcatgggaccagaccgtcaaactgtgggatccaaccgtcgggaagtcactgtgtacatttcggggacacgaatccatcatatactcaactatctggagcccacatatccccggatgcttcgctagtgctagtggtgaccagacactcaggatctgggacgtaaaagccgctggtgttcgcatcgttattccggcccatcaggctgagatcctgtcctgcgattggtgtaagtacaatgaaaatctgctggtgacaggggctgttgattgctctctccgcggatgggatctgcgtaacgtgcgtcaacccgtgttcgagctcctgggacatacatatgccatacggcgggttaagttctctccattccatgcctctgttctggcttcttgctcatacgattttactgtgcgcttctggaacttctcaaaacccgactccttgctggaaacagtcgagcatcatactgagtttacctgcgggctcgatttctccctgcagtcccctacgcaggtggccgattgctcttgggacgaaactatcaaaatctatgaccccgcatgcctgacaatacctgcctag

SEQ ID NO: 128243 - DNA, 369 bp, Artificial Sequence
  Description of Artificial Sequence: Synthetic coding sequence
atgtctgccgtatgcggcggcgctgccaggatgctgaggactcctggtcgacatgggtacgctgcggagttctctccctacctgccaggaagattggcatgtgcaacagcgcagcactacggaatcgccggatgtggcacactgttgatccttgatcccgatgaagctggccttagactcttcagaagctttgactggaatgatgggctttttgacgtgacctggagcgaaaataatgagcatgtactcatcacctgctctggggacggctcacttcagctgtgggacacggccaaggcagctgggccacttcaagtttacaaagaacatgctcaagaatacgtgcagggaagttgtgtggtaaaatag

SEQ ID NO: 128244 - DNA, 843 bp, Artificial Sequence
  Description of Artificial Sequence: Synthetic coding sequence
atgagcgccgtgtgtgggggggccgcaaggatgctgcggacacccggtaggcacggctacgctgctgagtttagtccatacctgcccggccgcttagcctgcgctactgcccagcactatgggatcgcgggatgcggcacattgttgatactcgacccagatgaagccggccttagactattcaggtcattcgactggaacgacggtctgtttgatgtgacgtggagcgagaacaacgagcacgtcctcataacctgtagcggggatggcagcctccagctttgggatacggcgaaggccgctggacccctccaggtttacaaggagcatgcccaggaggtgtattcagtcgattggtcgcagacgagaggcgagcagctcgtggtgagcggctcctgggaccagaccgtgaaactttgggaccccacagtaggtaagtctctttgcacctttcgtggccatgagtccatcatttactctacaatctggtcacctcatattcccggctgctttgctagcgcttccggcgaccagaccctcagaatttgggacgtgaaggcagccggcgttaggatcgtgatccccgcacaccaggctgagatcctgtcatgtgattggtgcaaatacaatgaaaacttgctagtgacaggagccgtagattgcagcctgcggggctgggacttgagaaacgtccggcagcccgtgtttgagctgttaggccacacctatgcaattcggagagtaaagatggagtcttgccccgtgacccagactaggtcgcagctgactgctacatccgctttttgggtgcaagcggttctgcttcctcagccaaccgaatag

SEQ ID NO: 128245 - DNA, 912 bp, Artificial Sequence
  Description of Artificial Sequence: Synthetic coding sequence
atggccagctgggcaaagggcagaagctacctcgcccccgggctgctccaaggtcaggtggccatagttacaggaggggcaacaggaattggcaaagccatcgtcaaggagttgctagagcttggtagtaacgtggtgatagccagtcgaaaactggagagactgaaaagcgcagccgacgagcttcaagctaatctccctccgacgaaacaggcaagggttattcctattcagtgcaacattcggaacgaagaggaggtgaacaatctggtgaagtctaccctagatacgttcggcaagatcaatttcctcgtgaataacggaggcggccagttcttgtcgccagctgaacacatctcttctaaaggctggcatgcggtgttagaaaccaatctcactggcacattctacatgtgcaaggctgtgtactcctcctggatgaaggagcatggaggcagcatcgtgaatattatcgtcccaaccaaagccgggttccccctggccgtgcacagcggcgctgctcgcgccggcgtgtataacctgacaaaaagcctcgccctcgaatgggcgtgctcaggcatacggatcaattgtgtcgctccaggcgtgatttacagccagacagccgtggagaattacggtagttggggtcagagtttcttcgagggatctttccaaaagatcccggccaagcgaatcggggtacctgaagaagtgtccagtgttgtttgctttttgttaagtcccgctgcctccttcatcaccggtcagtctgtggatgtggatggtggtcggtccctttacactcatagttacgaggtgcctgatcacgataactggcccaaaggtgccggagatctctcagtagtcaagaaaatgaaagaaaccttcaaggaaaaagctaagctgtag

SEQ ID NO: 128246 - DNA, 1407 bp, Artificial Sequence
  Description of Artificial Sequence: Synthetic coding sequence
atggtggatacggaatcccctctttgtccactttcccccctggaagcgggcgacctagagtcgcccctgtccgaggagtttctgcaagagatgggcaatatccaagaaataagtcagtccattggcgaggactcctctggcagctttggattcaccgaatatcagtatctggggtcttgtcccgggagtgacggtagcgtcatcactgatacactgagccctgcctcgtcgccaagtagcgtgacatatccggtggtccctgggagcgtggatgaaagtccatccggagccctcaacatcgagtgcaggatctgtggagacaaagcctccggctaccattatggcgtgcatgcctgcgaaggctgcaagggcttcttccgcagaaccattaggctaaaattggtgtacgataaatgcgatagatcttgtaagattcagaagaagaacaggaacaagtgccagtactgccgattccataagtgcctgagcgtcgggatgtcccacaacgctatcagattcggcaggatgcccaggtctgaaaaagccaaactcaaggccgagattttaacgtgtgagcacgatattgaagattctgagacagcagatctgaaaagcttggcaaagcggatctacgaggcttatcttaagaatttcaacatgaacaaggtgaaggcgcgcgtgattctgagcggcaaggccagtaacaatccccccttcgtgatacacgacatggagactttatgcatggctgagaagaccctggttgccaagctggtcgccaacggaattcagaacaaagaggcggaagtgcgcatctttcattgctgccagtgtacctcagtggagactgttactgaattgactgagtttgcaaaagccattccaggtttcgccaacctggatctgaacgatcaggtgactctcttgaagtatggtgtgtacgaagctatcttcgccatgctgagcagcgtaatgaacaaggatggcatgctggtggcatacggcaatggctttattacacgggaatttctcaagtcactgagaaagccattctgtgacataatggagcccaagttcgatttcgctatgaaattcaacgctctggaactcgatgactccgatatcagcctttttgtagctgctatcatctgctgcggagaccgcccaggacttctgaatgtggggcacattgaaaaaatgcaggagggtatcgttcacgtgctgcgcttacacctccagtcgaatcatccagacgacattttcctatttcccaagctgttgcagaaaatggcggatttgcgacagctagtaacagaacatgcccaacttgttcagattattaaaaagacagaatccgacgctgccttacatccactgctgcaagagatctatagagatatgtactag

SEQ ID NO: 128247 - DNA, 1407 bp, Artificial Sequence
  Description of Artificial Sequence: Synthetic coding sequence
atggtggatacagagtcgcccttgtgtccgctaagtcccctggaggccggcgaccttgagagtccactgagcgaggagttccttcaggagatgggaaacatccaagagatcagtcaaagcatcggtgaggactccagcgggtcctttgggtttacagaataccagtacctgggatcatgcccaggctctgacggctccgtaatcaccgacactctgagtccggcctcaagcccatcgtccgtgacgtatcccgtggtgccgggatcggttgacgagtctccctctggtgccttaaacattgaatgcagaatctgtggcgacaaggcgtccgggtatcactatggcgtccatgcttgcgagggatgtaaggggttcttccgcagaaccatcagactgaaactggtttatgacaaatgcgatcggtcttgtaagatccagaagaagaatcgcaataagtgccagtactgccggttccataagtgcttgtcggtcggcatgagccacaacgcgatacgattcggaagaatgccccggagcgaaaaagctaagcttaaagctgagatcttgacttgcgagcacgatatagaagattccgaaacggcagatttgaaatccctcgccaaaagaatctatgaagcctatctgaagaactttaacatgaataaggtcaaggccagagttatcttaagtggtaaagcttctaacaatccccccttcgtcattcacgatatggagacattgtgtatggctgaaaaaacattggtggccaaactagtggccaacggaatccaaaataaagaggcagaggtgaggatattccattgttgtcaatgtactagcgtggagacggtaactgagttaacggaatttgccaaagcaattccaggattcgctaatttggatctgaatgatcaagtgaccctgttgaagtatggggtgtatgaagcaatttttgctatgctgtcctctgtgatgaacaaggatggaatgctcgttgcttacgggaatgggtttattactcgggaatttctgaaatccctcagaaaacccttctgcgacatcatggagcccaagttcgatttcgctatgaagtttaatgccctggagctagatgacagcgacatatctttgttcgtggctgccattatatgctgtggagacagacccggcctcttaaacgtcgggcacatcgagaaaatgcaggaaggaatagttcatgtgttgaggcttcacttacagtcgaatcaccccgacgatatcttcctatttcccaaactcctgcagaaaatggctgacctgagacagctcgtgaccgaacatgcacaactcgtccagattataaagaagactgaaagcgacgccgccctccatccgttactccaggagatctacagagacatgtactag

SEQ ID NO: 128248 - DNA, 1407 bp, Artificial Sequence
  Description of Artificial Sequence: Synthetic coding sequence
atggtcgacacagaatcccctttgtgcccactctctccccttgaggcaggagatctcgaatcaccactctctgaggagtttctgcaggagatggggaacatccaggaaatcagccaatcgatcggcgaggatagctcaggtagctttggcttcaccgaatatcagtatctcggcagctgtcctggctctgatgggtcagtaattacagacaccttaagtcccgcaagctccccctcgtcagtgacctacccagtggtgcctgggtctgtggacgagtctccctccggcgcactgaatattgagtgccggatttgcggggacaaggcgtccggatatcactatggcgtgcatgcgtgcgagggttgtaaaggcttctttagacggaccatacgcctgaaattggtgtacgacaagtgtgataggagctgcaaaattcagaagaagaaccggaacaaatgtcagtattgccggttccacaagtgtttatccgtggggatgtcgcacaatgccatccgctttggaagaatgccgcgatctgagaaagctaagctcaaggccgagatcctcacatgtgaacacgacatcgaagactccgagacggctgatctgaaaagcctggccaaacggatctatgaagcctatctaaagaacttcaacatgaataaggtcaaggcccgcgtcatactgtctggaaaggcaagtaataatccaccttttgtcatccatgacatggagacactgtgcatggcggaaaagacccttgtcgcgaagctcgtggctaatggcatccagaataaggaggcagaggtgcgcatttttcattgctgccagtgcacctcggtggagacggtgactgaattaaccgaattcgccaaggcgatccccggtttcgcgaatctggacctgaacgaccaggtaactctgctcaaatatggagtgtatgaagccatcttcgcaatgctgtccagtgtaatgaacaaagatggaatgttggttgcctatgggaacggatttatcacgcgcgaattcctgaaatctcttcgtaaaccattctgcgatatcatggagccgaagtttgatttcgccatgaagttcaatgccttggagctcgatgactccgatatctcattatttgtagctgccatcatatgctgcggcgacaggcctggcctgctaaacgttgggcacattgaaaagatgcaggaggggatcgtacatgtcctgcggttgcacttacagagcaaccatccggacgacatattcctgttccctaagttgttacaaaaaatggccgatctgcgtcagttggtgactgagcacgcacagctggtgcagatcatcaaaaaaacagaatcggacgccgccctgcaccccctgctgcaggagatctacagagacatgtattag

SEQ ID NO: 128249 - DNA, 1407 bp, Artificial Sequence
  Description of Artificial Sequence: Synthetic coding sequence
atggtagacacagaaagtcctctgtgtcctctgagcccactggaggccggagacctggagagtccgctttcagaagaatttttacaggagatgggaaatattcaggaaatcagtcagtcaattggcgaagacagctccggttctttcgggttcactgagtaccagtacctcggctcctgccctggctctgatgggtcagtgattacagacaccttgtctcctgcatcttcgccttctagcgtcacgtatcctgtggttccgggctccgtcgatgaatctcccagtggcgcactcaatatagagtgccgaatctgcggcgataaggcgagcgggtatcattatggggtgcatgcctgcgaaggctgcaaaggctttttccgcagaactatcagactgaagttggtctatgataagtgcgacaggtcctgtaagattcagaaaaaaaaccgaaataaatgccagtactgccggttccacaaatgccttagcgtgggtatgagccacaatgccattcgctttgggcgtatgccacgcagcgagaaggccaagcttaaggctgagattctcacgtgcgagcacgatattgaagacagcgaaaccgctgacttgaaatctttggccaagaggatctatgaagcgtatctcaagaactttaacatgaacaaggtaaaagcccgagtgatcttgagtggcaaggcctctaacaatccgccctttgtgatccatgatatggaaaccttatgcatggccgaaaaaacactggttgcaaagttggtcgccaatggcattcaaaacaaggaagcggaagtcagaatattccactgttgtcagtgcacgagcgttgagaccgttactgagttaacagagtttgcgaaagccattcccgggttcgccaatttggacctgaacgatcaggtcactctcctgaagtatggcgtgtacgaggcaatattcgccatgttgtcttcagtaatgaacaaagatggcatgctggtggcgtacggaaacggattcataaccagggagtttttgaagtctctgaggaaacccttttgtgatattatggaacctaaattcgactttgctatgaaatttaacgccctggaactggacgattctgacatctccttgtttgtggcggcaattatctgctgtggcgaccgccccggcctgcttaatgtaggccatatcgagaaaatgcaggagggcatcgttcacgtactgagactccatctgcagagcaaccatcctgacgatatctttctcttcccaaaattattacagaagatggccgatttgagacaattggtcactgagcatgcacagttggtccagatcattaagaaaacagaatctgacgctgctcttcacccattattgcaagagatttatagggatatgtactag

SEQ ID NO: 128250 - DNA, 210 bp, Artificial Sequence
  Description of Artificial Sequence: Synthetic coding sequence
atggtggacaccgagtctccactctgtcccctcagtcccttggaagccggcgacttagagtcccctctgagcgaagagttccttcaggagatgggtaatattcaggaaatatcacagtcaatcggtgaagatagtagcgggtccttcggattcactgagtaccagtatctaggttcctgcccaggatctgacggctctgtaattacatag

SEQ ID NO: 128251 - DNA, 402 bp, Artificial Sequence
  Description of Artificial Sequence: Synthetic coding sequence
atggtggatactgaatctcctctgtgccccctgagtccgctagaggccggtgatctggaatcacccctgagcgaggagtttctgcaggaaatggggaatatccaggaaatttctcaaagtatcggcgaggattccagtggttcctttggctttacagaataccaatacctgggatcgtgtcccggtagtgatggatctgtgatcacagataccctgagcccagctagtagcccgagttctgtgacatatcccgtggtaccaggatctgttgacgaaagtccatccggggcccttaacattgagtgcagaatctgcggcgacaaagctagcggctaccactatggcgtgcatgcctgtgaaggttgtaaggtggaggggagttggaatcgggcatggtggtag

SEQ ID NO: 128252 - DNA, 525 bp, Artificial Sequence
  Description of Artificial Sequence: Synthetic coding sequence
atggtggatacagaatctccgctctgccccctttccccgcttgaagccggcgacctggaatccccgctcagtgaggaatttctacaggaaatgggcaatatccaagaaatcagccagtcaatcggcgaagattcctcagggagctttggatttaccgaataccagtacctcgggtcttgccctggctctgacgggagcgttataaccgatacactgtccccagctagctccccttccagcgtgacgtacccagtcgtgcctggaagtgtggatgagtcccccagcggcgcattgaacattgaatgtaggatctgtggagataaagcctctgggtatcattacggcgtgcatgcatgcgaaggctgcaagggtttctttcgacgcactatcagattaaaactggtgtacgataagtgtgatcgctcctgtaaaattcagaaaaaaaaccgaaacaagtgtcagtactgcaggttccacaaatgcttgtctgtgggtatgagtcacaatgctttctgccacacctag

SEQ ID NO: 128253 - DNA, 30 bp, Artificial Sequence
  Description of Artificial Sequence: Synthetic coding sequence
atggttgataccgagtctcccctctgttag

SEQ ID NO: 128254 - DNA, 489 bp, Artificial Sequence
  Description of Artificial Sequence: Synthetic coding sequence
atgaacaaggttaaggcacgagtcatattatctggcaaagcttctaataaccctccatttgtcatccacgacatggagaccctctgtatggctgaaaaaacactggttgcgaagctcgtcgcgaatggcattcagaataaggaggcagaggtgcgaatctttcattgttgtcaatgcacctcagtggaaactgtcacagagctgacagagtttgccaaggcgattcctggattcgcgaatttggacctgaacgatcaggtaactttgctgaaatacggcgtatatgaggctattttcgcaatgttgtccagcgttatgaacaaagacggaatgcttgtcgcttatggtaatggattcatcacaagagaatttctgaaaagcttgcggaagcccttctgcgatattatggagccgaaattcgactttgctatgaagttcaatgcgctggaactggatgacagcgacatttccctgttcgttgcagcctag

SEQ ID NO: 128255 - DNA, 1326 bp, Artificial Sequence
  Description of Artificial Sequence: Synthetic coding sequence
atggaacaaccacaggaagaggcccctgaggtgagagaagaagaagagaaggaggaggttgccgaggcagagggtgctcctgagcttaacgggggcccccagcatgcactgccgtccagctcatataccgatctctcaagatccagctcacccccctcgctgctggaccagctccagatggggtgtgacggagcttcatgcggctctctgaatatggaatgtcgcgtgtgtggagataaagctagcggctttcattatggtgtgcatgcctgtgaaggttgcaagggattttttcgcaggacaatccggatgaaactggagtacgaaaaatgtgagcggagctgtaagattcaaaagaagaacaggaacaagtgccagtattgtcggtttcagaaatgtctcgccctgggaatgagtcataatgctattcgctttgggcggatgcccgaggccgagaagcgcaagttggtagccggtctcaccgccaacgaaggctcacaatataacccacaagtggctgacctgaaggctttttccaaacacatctacaacgcctacctgaaaaacttcaacatgacaaaaaagaaggcacgcagcattctgaccggcaaagccagccacactgctccttttgtaatccacgacatcgaaaccctgtggcaggctgaaaaggggttggtctggaaacagcttgtcaatggcctcccgccatacaaagaaatcagtgtccacgttttctacagatgccagtgtacaaccgtggagaccgttcgcgaactgacagaatttgccaagtccatcccctctttcagttcactcttccttaatgatcaggtgaccctgctcaaatacggcgtgcacgaggccatcttcgcaatgctggcctccattgtaaataaggacgggctcctagtggccaacggctcaggcttcgtgacccgcgaatttctccgttctctgcggaagcccttttctgacattattgaacctaagttcgaattcgcggtgaagttcaacgctcttgagctcgacgattctgatctagccctgtttatcgccgcaatcatactgtgtggtgacagacccgggttaatgaatgtccctagagtggaggctattcaggatacgattctccgggccttggagtttcacttgcaggccaaccacccagatgcccaatacctgtttcccaagcttcttcaaaaaatggctgatttaagacagcttgtcacagaacacgcacagatgatgcaacggatcaagaagacagagaccgagacaagccttcaccccctcctgcaggagatctacaaagatatgtactag

SEQ ID NO: 128256 - DNA, 1086 bp, Artificial Sequence
  Description of Artificial Sequence: Synthetic coding sequence
atggagcagccccaagaggaagcccctgaagtgcgcgaagaggaggagaaggaggaagtggcagaagccgagggggctcctgagctgaacggtggccctcagcacgcgttacccagttcctcgtatacagatctcagtagatcaagcagtccaccttccctattggatcagctccaaatgggatgtgatggggcaagttgtggtagtctgaatatggagtgccgtgtttgcggagataaggccagcgggtttcactatggtgtgcacgcttgtgagggttgtaagggatttttccgtaggaccattcggatgaaattagagtatgagaagtgcgagaggagttgcaagatccagaagaagaacaggaacaaatgccaatattgtcgatttcagaaatgcctggcccttggcatgtcacacaacgctatccggttcggaagaatgcctgaagccgagaaacgcaagctggtagccggattgacggccaacgagggcagccagtacaacccccaagtggctgacctcaaggccttcagcaagcacatatacaacgcatatcttaagaattttaatatgactaaaaagaaggcccggtccatcctcaccgggaaggcctctcataccgcaccctttgtaatccatgacattgaaaccctttggcaggccgagaagggcctggtctggaagcagctggtgaacggcctgcctccttacaaggagatcagtgttcatgtgttttaccgatgtcagtgtacgactgtggagactgtgcgcgaactcaccgagttcgccaagagcatccccagcttctcatctctgttcttaaacgaccaagttacgctcctgaaatatggcgtccacgaggccatattcgcaatgcttgcgtccattgtcaataaggacggactcctggtcgcgaatggatcagggtttgtgacacgggagtttttgaggagtttgagaaagccgttttcagatattattgaacccaagtttgaatttgccgtcaagtttaacgctttagaactggacgattcagacctcgccctgtttattgctgccatcatcctgtgtgggggagagtag

SEQ ID NO: 128257 - DNA, 1326 bp, Artificial Sequence
  Description of Artificial Sequence: Synthetic coding sequence
atggagcagcctcaggaagaggcgcctgaggtgcgggaggaagaggagaaagaagaagtggcagaagccgagggggctccagaacttaatggggggccgcagcatgccctgccaagttcctcctacacagatttatcacgatcttcaagtcctccctcacttttagatcagcttcagatgggttgcgacggcgcctcctgtggatcattgaatatggaatgcagagtgtgcggggataaggcctctggcttccactacggagttcacgcctgcgagggttgcaaaggcttcttcaggaggaccatccgcatgaagttagaatacgaaaaatgcgaaagaagctgcaagatccagaagaagaatagaaataagtgccagtattgccgctttcagaagtgcttggccctcgggatgtcacacaatgctattagatttgggcgcatgcccgaagccgagaagcgcaagctggtggcggggctgaccgcaaatgagggcagccagtacaatccccaggttgccgacttaaaagccttttctaaacacatatacaatgcctatcttaagaacttcaatatgaccaagaagaaagcccggagcattctaacaggaaaggcttcccacaccgcccctttcgtgatacacgatatcgaaacgctgtggcaagctgagaaaggcctcgtgtggaagcagcttgttaatgggctcccaccttataaagagatcagtgtgcacgtgttctaccgctgtcagtgcactacagtagagaccgtccgggagctcacagagtttgcaaagagtatcccaagtttttcttcactgtttctgaacgaccaggtgactctgctcaagtatggtgtccacgaagcaatttttgctatgctggccagcatcgtgaacaaggatggtttgctcgtggctaatggatcagggttcgtcacccgagagtttctgcgcagtttacggaagcctttcagtgatattatcgaacctaaatttgagtttgctgtgaagttcaacgctctggaattggatgattcggacctcgcactctttatagcagctattatcctgtgtggcgataggccaggccttatgaatgtcccaagagtcgaagcgatccaagatactatactgagagctcttgagtttcatctccaggctaatcatcctgatgcccaatatctatttccgaagttgcttcagaagatggccgatttaagacagttggtgaccgagcacgcgcagatgatgcaaaggattaagaagactgagaccgaaacatcccttcaccctctgttgcaggagatctataaagatatgtactag

SEQ ID NO: 128258 - DNA, 1032 bp, Artificial Sequence
  Description of Artificial Sequence: Synthetic coding sequence
atggaacagcctcaggaggaggctcccgaggttcgagaggaagaggagaaggaagaggtggccgaggccgagggcgcaccagagttaaacgggggacctcaacacgctcttcccagtagttcttatacagccattaggttcggaaggatgcccgaggccgaaaagcggaagttggtagcgggcctgacagcaaatgaggggtcccagtacaacccgcaggtagctgacctaaaggcctttagcaagcacatttataacgcctacctcaaaaacttcaacatgaccaagaaaaaggcacggagcatccttacaggtaaggcctcccacacggcaccgttcgtgatccacgacattgaaaccctctggcaggctgaaaagggcctggtgtggaagcagcttgtgaatggtctgcctccgtataaggagatctccgtgcacgtattctaccggtgtcaatgtacgaccgtcgagactgtacgtgagctgaccgaattcgcaaagtctattccatctttctcatctttgttcctcaatgaccaggtgaccctgcttaagtatggagtgcacgaggccatctttgccatgctggcatcaatagtgaataaagatgggctcctggtcgcaaacggaagcggctttgtaactcgcgaatttctcagatccttacgtaagccattctctgacattatagagccaaagtttgaatttgccgtaaagttcaacgccctcgagctcgatgactcagacctcgctcttttcatcgcagctatcattctctgtggcgaccgccccggcctgatgaatgtgcccagggtcgaggctatacaagatacaatactccgtgctttggagtttcacttgcaggccaaccatccggatgctcagtacctgtttcccaagctgctacagaaaatggctgacctccggcagctggtcacagagcatgcccagatgatgcagcgcatcaaaaagacagagacagagaccagtcttcaccctttgctccaagagatctacaaggatatgtactag

SEQ ID NO: 128259 - DNA, 1086 bp, Artificial Sequence
  Description of Artificial Sequence: Synthetic coding sequence
atggaacagccccaagaagaggctccagaagtgagagaagaggaggagaaagaagaggttgccgaggctgagggggctccagaactgaacggagggccccagcacgccctcccctcatcatcttataccgatctcagtcggtcttcctctcccccttctctcctggaccagctgcaaatgggatgcgacggggcctcatgtggatcacttaatatggaatgcagagtatgcggcgacaaagccagcgggtttcattacggagtccatgcctgtgagggatgtaagggcttcttccgacggacaataagaatgaagctggagtacgaaaaatgtgagcgatcttgtaagattcagaagaagaaccgtaacaagtgtcagtattgcagatttcaaaaatgtctggccctgggtatgagccataatgccatccgattcgggaggatgccggaggcggagaagcgaaagctcgtcgcgggcttgaccgctaacgaagggtcccaatacaatcctcaggtggctgacctcaaagctttttccaaacatatctacaatgcctacctgaagaactttaacatgactaagaagaaagcacgttcaattcttaccggcaaggcatctcacacagctcctttcgtgattcacgatattgaaacattgtggcaggctgagaagggactggtctggaaacaacttgtaaatggtcttccgccatacaaggagattagcgtgcatgtcttttatcggtgccagtgcaccacggtagagactgtgcgtgaattaaccgaattcgccaagagcataccttcgttctctagcctttttctcaatgaccaggttactttgttaaagtatggagtgcacgaggccatctttgccatgctcgcatctattgttaacaaagacggcctgctggtagccaacggctctggattcgtaacccgcgagtttctgcgctccctgcgcaaaccattctcggacataattgagcctaaatttgagttcgcagtcaaatttaatgcactggagctagatgacagcgatctggcgctgtttattgcagccatcattctatgtgggggtgagtag

SEQ ID NO: 128260 - DNA, 1209 bp, Artificial Sequence
  Description of Artificial Sequence: Synthetic coding sequence
atgcaccagagggaccttagccgcagtagcagccccccttctttactggaccagctgcagatggggtgcgatggcgcttcctgcggatctctgaacatggagtgtagagtctgcggtgataaagccagcggatttcattatggcgttcacgcctgtgagggatgtaagggcttcttcaggcgtacgattcgtatgaagttggaatacgaaaaatgtgagagaagctgcaagatacaaaaaaaaaacagaaacaagtgccaatactgcagattccagaagtgtttggcgctgggcatgtcgcacaacgctatcaggtttgggagaatgcccgaagcggagaaaagaaagcttgtcgccgggcttacagcaaacgaaggctctcagtacaacccccaggtcgcagatctgaaggcatttagtaagcatatttataatgcctacctgaaaaattttaacatgacgaagaaaaaggcgagatcaattctgaccggtaaggcttctcatactgcgccatttgtcattcatgatatcgaaaccctatggcaggctgaaaaaggcctggtgtggaaacagttggttaacggcctgccaccttacaaggagatttccgtgcacgtattttatcgttgccagtgcactacagtcgagacagtgagagagcttaccgaatttgccaagtctattccgagtttttcaagcttgttcctgaacgaccaggtgaccttgctcaaatatggcgtgcacgaggcaatctttgctatgctggcctcaattgtcaataaagacgggctcctcgtagccaacggcagtgggttcgtgacccgggagtttctgcgctcattacgaaaaccgttttcagatattattgaaccaaaatttgaattcgctgtgaagttcaatgctttggagctggacgacagcgatctggctcttttcatcgccgcgattatcctttgcggagatcgacctgggctaatgaacgtgccgcgggtcgaagctattcaagacactattctgcgggccctggagtttcatctccaggcaaaccatccagatgcccaatatctgttccctaaacttctgcagaaaatggctgatctacgtcaactagtcacagaacatgcacagatgatgcagagaataaaaaaaaccgaaacagaaaccagtctgcatcctctgttacaggaaatttataaggacatgtattag

SEQ ID NO: 128261 - DNA, 1017 bp, Artificial Sequence
  Description of Artificial Sequence: Synthetic coding sequence
atgaagctggagtacgagaagtgtgaaagatcttgcaaaatccagaagaagaacaggaacaagtgccagtactgcagatttcaaaaatgtctggccctgggcatgtcccacaacgccatccgctttggtcggatgccagaagccgagaagagaaagctggtggccggcctcaccgccaacgagggctctcagtacaatccccaggtggccgaccttaaagcattctctaaacatatttacaatgcttatttgaaaaatttcaacatgaccaagaagaaagcccgatctatcctgacgggcaaagcatcccacacagccccttttgttatacacgatatcgagaccttatggcaggcagagaaggggctcgtatggaaacagctggtcaatggactgccaccatataaggagatttctgtccatgtgttttaccgctgtcagtgcactactgtcgagacagtacgcgagctgaccgagtttgcaaagtcgattccaagtttttcctcactgttcctaaatgaccaggttaccctgcttaaatacggcgttcacgaggcaatatttgctatgttagccagcattgtgaacaaggatgggctactcgtggccaacggctctggtttcgtgaccagagagttcctgcgaagcctcaggaaaccatttagcgacatcattgaacctaagttcgaatttgctgtaaagttcaacgccctggaactcgatgattctgatctggccctttttattgcagccattatactctgtggggatagaccaggactaatgaatgtgccaagagtggaagccattcaggatacgatcctcagagcccttgagttccaccttcaggccaatcaccctgatgctcaatacctgtttcccaaacttttgcagaagatggcagatctgagacaactggtgactgaacatgctcaaatgatgcaacgtataaaaaaaacagaaaccgagacgagcttgcaccccctgcttcaagaaatctataaagacatgtactag

SEQ ID NO: 128262 - DNA, 1518 bp, Artificial Sequence
  Description of Artificial Sequence: Synthetic coding sequence
atgggcgagaccctgggggattcccctatcgaccccgagagcgacagtttcacagatacactgagcgccaatatctcccaagaaatgactatggttgatactgaaatgcctttttggcctaccaatttcggaatctcttccgtcgacctcagcgtgatggaggatcattcccacagctttgatattaagcctttcactacagtagacttcagcagcatctctactccacattacgaagatattccgtttacccgcacagaccctgttgtcgcagactacaaatatgatctaaaactgcaagaataccagagcgccatcaaggtggagccagcatctcccccatattatagcgagaagactcaactctataataagccccacgaggagccttcgaactcactcatggcgatcgagtgtagggtgtgcggtgacaaggctagcgggttccattatggcgttcacgcctgtgaaggatgcaaaggcttcttccgacgaactatcagactgaaactgatatatgataggtgtgatctgaattgtcgtatacacaagaagagccgaaacaagtgccagtattgtcgcttccagaagtgcttggccgtaggaatgtcgcacaacgcaatccgatttggcagaatgccacaggccgagaaagagaagttactggctgagataagctctgatatagaccagctgaaccccgaatcggcagacttgagagctcttgctaagcacttatacgattcatacataaagtcattccctctgaccaaggctaaagcacgagcaatattaacaggaaagaccaccgacaaatctccctttgtgatctatgatatgaattctctcatgatgggcgaggacaaaatcaaattcaaacacatcacacccctccaggagcagtctaaggaggtagccattaggatttttcagggttgccagtttagatcagttgaggccgtacaggagatcaccgagtatgccaagtccattcccggttttgtgaacttagatctgaatgatcaagtgactctgctgaaatatggcgtacacgagatcatctacaccatgctagctagcctgatgaacaaggacggggttctgattagcgaggggcagggattcatgacaagggaattcctcaaatccctcaggaaacctttcggagactttatggaacccaagtttgagtttgccgtgaaattcaacgccctggagctggacgattccgacttggctatcttcatcgcggtgatcatactctctggagaccggcccggtctgctgaacgtcaagccaatcgaggacattcaggacaacctgctgcaggccctggaactgcaattgaaactgaatcaccccgagagtagtcaattgttcgcaaaattactccagaagatgacggacctccgacagatcgtgaccgaacacgtgcagctcttgcaggttatcaagaagaccgagacagacatgtccttgcacccactcctgcaggaaatttataaagacttgtactag

SEQ ID NO: 128263 - DNA, 1434 bp, Artificial Sequence
  Description of Artificial Sequence: Synthetic coding sequence
atgaccatggtagacactgagatgccgttttggcccaccaactttggtatctcatctgtggacttgtctgtgatggaagatcacagccactctttcgatattaaaccgttcacgaccgtggactttagtagcataagcactccccattacgaggacatcccttttaccagaacagaccccgtagtcgccgattataagtacgacttaaaactccaggagtaccaaagcgccatcaaagtcgaacccgctagcccaccttactattcagagaagacacaattgtataacaagccccatgaagagccatccaacagtctaatggcaatcgaatgtcgcgtttgtggcgacaaagcttctgggtttcactatggggtccacgcttgcgaaggctgcaagggcttcttcagacgaactatcagactcaaattaatctacgatcgctgcgacttaaactgccgcatacataaaaaaagccggaataagtgccaatactgccggtttcagaagtgcctggctgtagggatgtcccacaacgccattaggttcggcagaatgccacaggcagagaaagaaaagctcctggctgaaatatccagcgacatcgatcagctgaatccagagagtgctgatttaagggcgctggctaagcacctgtatgatagctatataaagagttttcccttaacaaaggcaaaagccagggccatcctcacgggaaagaccactgataagtccccgttcgttatctacgacatgaattccctcatgatgggggaagataagatcaagttcaagcacatcactccactgcaggaacagtcaaaggaagtggcgatcaggatctttcagggttgccagtttcgcagcgtggaagcagtacaggaaataactgagtatgcgaagagcatccctggcttcgtgaaccttgatctgaatgaccaagtaacactgttaaaatacggggttcacgaaatcatctacaccatgctggcctctctgatgaacaaggatggcgtgctgatcagcgagggacaaggctttatgactcgcgaattcctcaagagtcttcgtaagccctttggcgatttcatggagcctaaattcgagtttgctgtgaaattcaacgcattggagttagatgattcggacttggctatctttatcgccgtgattatcctttccggggacaggccggggcttctcaacgtcaagccaatagaggacatccaggacaaccttctccaagcactggagttacaactcaaactcaatcatccagagtcttcccaactgtttgctaagctgctgcagaagatgaccgacctgcgacaaattgtcactgagcacgtacaactgctgcaagtgattaagaaaacagagacagatatgtctctgcaccctttgctgcaagagatttataaagacctgtactag

SEQ ID NO: 128264 - DNA, 753 bp, Artificial Sequence
  Description of Artificial Sequence: Synthetic coding sequence
atgaccatggtcgacacggaaatgcccttctggcctacaaactttggtatctcgtctgtggacctgtctgtgatggaagaccattcacactcattcgatatcaaacccttcactaccgtggacttcagctcgatttctacacctcactacgaggacattcccttcacaagaacagaccctgtggtcgcggactataagtacgacctgaagctccaggaataccagtcggctataaaagttgaaccagcatcaccaccgtactattctgaaaagactcagctctacaacaagcctcacgaggagccatctaattccctcatggctatcgagtgcagagtatgtggggataaggcgagtggctttcattatggagtgcacgcgtgcgaggggtgcaagggcttctttcgacgaactatccgcctcaagcttatttacgatcgttgtgacctgaactgtaggatccataaaaagtcacgcaacaaatgccagtactgcagatttcagaagtgtctcgccgtgggcatgtctcacaatgccattaggtttggccgtatgcctcaggctgaaaaagaaaaactcctggctgagatctccagtgatattgaccaactgaatcctgagtccgcagatttgcgcgccttggctaaacatctctacgactcttacataaaaagtttccctttgacaaaagcgaaagctcgcgctattcttactggtaaaactaccgataagagcaccgcacaggtgtgctag

SEQ ID NO: 128265 - DNA, 1434 bp, Artificial Sequence
  Description of Artificial Sequence: Synthetic coding sequence
atgaccatggtcgacactgagatgcccttctggcctacgaacttcgggatttcctccgtcgatttgagcgtcatggaggaccatagccattccttcgacataaagccatttactacagtggactttagttccatctctacaccccactatgaggatatcccattcacacggactgaccctgttgttgcggactataagtacgacctgaaacttcaagagtatcagtccgcgattaaggtggaacccgcatcgcccccctattacagcgaaaaaactcagctctacaacaaaccccacgaggagccatctaattctctgatggcaattgagtgtagagtttgcggggataaagcatccggatttcactacggtgtccatgcttgtgagggatgcaaggggttttttaggcgcactattcgactgaagctgatttacgatagatgcgacttaaactgcagaatccacaagaaaagccgcaacaagtgtcagtattgccgtttccagaagtgtttggcagtggggatgagtcataatgctatccgcttcggcaggatgccccaggccgaaaaagagaagctgctggctgagatttcctccgacatcgatcagctcaatcccgaatctgctgacctacgcgccctcgccaaacacctctacgattcttacatcaagtcctttcctttaaccaaagctaaagctcgtgcaatcctgaccgggaagacaactgataaatctccctttgtcatttacgacatgaactccctgatgatgggggaagacaaaattaagttcaagcacataaccccccttcaggagcagagcaaggaggtggcgatccggattttccagggctgtcagtttcggagtgttgaagctgtgcaggaaatcacagagtacgctaagtctatcccgggatttgtgaacctcgacctgaatgatcaggtgacactcctgaaatatggggttcatgagatcatttacaccatgctagcaagcctgatgaataaagacggagtgttaattagtgagggccagggtttcatgacacgggagttcttgaaaagcttgcgcaagccattcggcgactttatggaacccaagttcgaatttgccgtcaaattcaatgccttagagcttgacgattcagacctagctatttttattgctgtcattatcttaagcggagaccgccccgggcttctgaatgttaagccaatcgaggatatccaggacaacctgctgcaagctttggagttgcagctgaagttgaaccaccccgagtccagtcaactgttcgccaagctgctacagaaaatgacagacctccggcagattgtcactgaacacgtccagctcctgcaggttattaagaagacagagacggacatgtccctgcatcctctgctgcaggaaatctacaaggacctgtactag

SEQ ID NO: 128266 - DNA, 1434 bp, Artificial Sequence
  Description of Artificial Sequence: Synthetic coding sequence
atgacgatggttgacactgaaatgccgttctggcccacaaatttcggcatctcctctgtggatctttctgtgatggaggaccattcccactccttcgatatcaagcccttcacaacggtcgactttagctcaatatccaccccacattatgaggacattcctttcacccgcactgatccagtagtggccgattacaaatatgatctgaaacttcaggagtaccagtctgctatcaaagtggaacctgcttcacccccttattacagtgagaaaacccagctctataacaagccccacgaggagccatccaattcactaatggcgatcgaatgccgcgtgtgcggggataaagcttcaggattccactacggtgtacatgcgtgtgaagggtgcaaaggtttctttagaagaaccataagattaaaattgatttacgataggtgtgacttgaactgccgcattcacaagaagagccggaacaagtgccaatactgtcgtttccaaaaatgcctggccgtgggtatgagtcataatgcgattcgatttgggcggatgccccaggcggaaaaggaaaagctactggccgaaatttcctcggacatcgatcagctgaatccggaatccgcagatctgagagccttggctaaacacttgtacgattcctatattaaatcttttccactgaccaaggcaaaggctagggccattcttaccggtaagacaacagacaaatctcctttcgtgatttacgatatgaacagcttgatgatgggcgaggataagatcaagttcaagcacatcacaccactacaggagcaatctaaggaggtggccattcgcatttttcagggatgccagtttcgtagtgtggaggctgtgcaggaaattaccgagtacgcgaaaagcattcctgggttcgtgaatctggaccttaatgatcaagtgaccttgctaaagtacggtgtgcacgagattatatacaccatgctcgcgagcttaatgaacaaagacggcgtgctcatcagcgagggacaagggtttatgacaagggaattcctgaagtcattaaggaagcctttcggcgacttcatggagcccaaattcgaatttgcagttaagtttaacgcgctcgaactggacgattcagatctggcgatatttatcgcagttataatcttgagcggtgacagacccggactgctgaatgtaaagcccatcgaggacatacaggataacctgctgcaggctcttgaactgcagctgaagctaaaccatccagagtcttcccaactcttcgccaaactactgcaaaagatgacagatctgcggcaaatcgtgacagagcacgtgcaactgctgcaagtgatcaaaaaaacagaaacagatatgtctttgcaccccttactgcaggagatctataaggacctttattag

SEQ ID NO: 128267 - DNA, 1434 bp, Artificial Sequence
  Description of Artificial Sequence: Synthetic coding sequence
atgactatggtcgatactgaaatgccattctggccaacaaacttcggaattagtagcgtggatctgtccgtgatggaggatcactctcacagcttcgacatcaagcccttcaccacggttgacttctcttccatcagcacacctcactacgaagacatccctttcactagaacagatccagtggttgccgattataagtatgacttgaagctccaggaatatcagtccgcaatcaaggtcgaacctgcatcccccccgtattactctgaaaaaacccaattgtataataagccacatgaggagcccagtaattcactcatggctattgagtgtcgggtttgcggcgacaaagctagtgggttccactacggagtccacgcctgtgaaggatgcaaaggtttttttagacgcacaattagactcaaactgatctacgatcgatgtgacctcaactgccggatccacaaaaagagccggaacaagtgccagtattgtagatttcagaagtgtctggccgtagggatgtcccacaatgccattagatttggtagaatgccccaggctgaaaaagaaaaactgttagccgagatatcaagcgatattgaccagctcaacccagagtctgcagacctaagagccctggccaagcatctgtatgactcgtatattaaaagtttccccctgactaaagcaaaggcacgcgccattctcacaggtaaaacaacggacaaatccccctttgttatttacgacatgaattcgctgatgatgggagaggacaaaatcaaattcaagcacatcacgccacttcaggaacagagcaaagaggtggcaatccgaatcttccagggctgccagttccgtagtgtggaggccgtgcaggaaattacggagtacgccaaatccattccgggtttcgtgaacctggacctcaacgaccaggtgactcttctcaagtatggggtccatgaaattatttacactatgctagcaagtctaatgaacaaggacggcgtccttatttcagaggggcagggatttatgacccgggagtttcttaaaagcctccggaaaccttttggagactttatggagccaaaattcgaattcgcggtgaaattcaatgccctggagctggacgacagcgaccttgccatctttatcgcagtcatcatcctgagcggtgaccgtccagggctgctaaatgttaaaccgatagaggacatccaggacaacctcctacaggctctcgagttacaactgaaactgaatcatcctgagtcctcccagcttttcgctaaactgctccagaaaatgacggacctgcgccagatcgtgaccgaacacgtccagctcctacaagtaatcaagaaaaccgagactgatatgtctttacaccccctcttacaggagatttataaggatctctattag

SEQ ID NO: 128268 - DNA, 1452 bp, Artificial Sequence
  Description of Artificial Sequence: Synthetic coding sequence
atgaaagggttcagcgaaatgacaatggtagataccgaaatgccgttctggcccaccaattttggaatctcatcggtcgacctttccgtgatggaagaccattcgcactctttcgacataaaacccttcacaactgtcgacttctctagcatatctacgccccattacgaggatattccttttactaggactgaccccgttgtcgccgattacaaatacgacctcaagttgcaggagtatcagtccgctattaaggtggagcctgcctcacctccctactactccgagaagacccaattgtacaacaagccccacgaagaacccagtaattccctgatggcgatcgagtgtcgcgtgtgcggtgataaggccagcggattccattacggggttcacgcttgtgagggatgcaagggttttttccggcgtaccataaggctcaaactgatctacgaccgctgcgacctgaactgtcgtatccataagaagtcccggaataaatgccaatactgccgattccagaaatgcctggctgtaggaatgtcccacaacgctattagatttgggcgcatgccacaggctgagaaggaaaagctgctggcagaaattagcagtgacatcgaccaactcaacccagaaagtgctgatctccgggcccttgcaaaacatctgtatgattcctatatcaaatccttccctctgaccaaagcgaaagctcgggcaatcctgacagggaaaaccactgataagtcaccattcgtaatctatgatatgaacagtctcatgatgggcgaggataagataaaattcaagcatatcaccccactgcaggagcagagtaaggaggtcgctatccgcatattccagggctgtcagttccgctcagtcgaagcagtccaggaaattacagaatatgccaaatcaatccctggcttcgtgaatcttgatcttaatgaccaggttacactgttaaagtatggtgttcatgagatcatctacaccatgctggcatcccttatgaataaagatggagtcctcataagtgaaggtcagggttttatgacgcgggaatttctgaagagcctgaggaagccttttggcgatttcatggaacctaagtttgagttcgcagtgaagtttaacgctctggaactggatgacagcgacctggcaattttcatcgccgtgattattctttccggggacagacccggattgctaaatgtgaaaccaattgaagatattcaagacaatttactgcaggcactcgagctccaactaaagctgaatcatcctgagtcatcccagttattcgcaaagctgctgcaaaagatgaccgatttaagacagattgttacagaacatgtgcagctgctgcaggtcattaagaaaaccgagacggatatgtccctgcaccctctgcttcaggagatctataaggacctgtattag

SEQ ID NO: 128269 - DNA, 399 bp, Artificial Sequence
  Description of Artificial Sequence: Synthetic coding sequence
atgacaatggtggacaccgagatgccattctggcccacaaattttgggatctcctctgttgacctctccgtaatggaagaccattcacactcctttgatataaagcccttcaccaccgtggacttcagttcaatctccactccccattacgaagatataccatttacccgtacagaccccgtggtggccgattacaagtacgatctgaagctccaggagtaccaaagcgccattaaggtggaacctgccagcccgccgtactacagtgaaaagacccagctgtacaataaacctcatgaagagccctcgaattctctcatggccatcgagtgtcgcgtctgcggggataaggcatcgggctttcattacggagttcacgcctgcgaaggttgcaagtag

SEQ ID NO: 128270 - DNA, 300 bp, Artificial Sequence
  Description of Artificial Sequence: Synthetic coding sequence
atgaccatggttgacacagagatgcccttctggcccaccaactttggcattagcagcgtggacctctcggtcatggaggatcacagtcactctttcgacattaaacccttcaccacagttgactttagctcaattagtacaccgcattacgaagacataccctttacgaggactgaccccgtggtcgctgattacaagtacgacttgaaactacaggaatatcaaagtgctataaaggtggaacctgcttcgccaccatattatagtgagaagactcaactttacaacaagccccactag

SEQ ID NO: 128271 - DNA, 132 bp, Artificial Sequence
  Description of Artificial Sequence: Synthetic coding sequence
atgaccatggtggatacggaaatgcccttttggcccaccaacttcggtatatcaagcgtggacctctcagtgatggaagaccacagtcatagctttgatatcaagccattcaccacagtcgatttcagttag

SEQ ID NO: 128272 - DNA, 747 bp, Artificial Sequence
  Description of Artificial Sequence: Synthetic coding sequence
atggtagatacagaaatgcctttttggcccactaatttcggcatatcttctgtggatctctccgtgatggaagatcattcgcattcattcgacataaaaccttttaccactgtggacttcagttcaatctccacaccccactacgaggatattccattcacacggaccgatcctgttgtggccgactacaagtacgatctgaagctgcaggagtaccagtctgcaatcaaagtggagccagccagtcccccgtactattctgagaagactcagctgtacaacaaaccacacgaagagccaagcaacagtctgatggcaatagaatgtcgagtgtgcggcgataaagcctccggatttcactacggggtgcatgcctgtgagggatgtaaaggtttctttcgacggacgatccgcctaaagcttatttacgatcgctgtgatctgaattgccggatccataagaagtcccgcaacaagtgtcagtattgtcgctttcagaaatgtcttgctgtcggaatgagccacaatgcgattcgttttggcaggatgccacaggctgagaaagaaaaactgcttgcagagatctcttccgatattgaccagcttaatcccgaatccgccgacctgcgcgcattagccaagcacctgtatgattcctacattaagtcattccccttgaccaaggccaaagcaagggccatactcaccgggaaaacaaccgacaaatcaaccgctcaagtgtgttag

SEQ ID NO: 128273 - DNA, 2955 bp, Artificial Sequence
  Description of Artificial Sequence: Synthetic coding sequence
atggctggaaacgattgcggggccttgctggacgaggaactaagctctttttttctgaactacctggcagacactcaggggggtggttccggggaagagcaactttacgccgacttccctgagttagatttatcccagcttgacgctagtgattttgattcagctacgtgtttcggagaattgcagtggtgtcccgaaaactctgagactgagccaaatcagtacagtcccgacgactccgaactatttcagattgactccgaaaacgaggctttactggccgaactgaccaagacgctggacgacatcccagaagacgacgtgggactggcggcctttcctgctctggatgggggcgacgcattgagttgtaccagtgcgtcaccagcacccagctcggctccaccatcccccgcacctgaaaagcctagtgcaccggctcccgaggtggatgaactttcgctggcagattccacccaggataaaaaggctcccatgatgcagagccagtcccggtcctgcacagagctgcacaaacacctgacatcggcgcagtgctgcctgcaggacagagggctgcagcctccctgccttcaatctccccgcctgccagccaaagaggacaaagagcctggtgaagactgtccatccccgcagcctgctcccgcatcaccccgggactcccttgccctcggccgggccgatcccggagcccccgttagtcaggaggacatgcaggctatggtccagcttatccgatacatgcatacctactgcctgccgcagagaaagttgcctccccagacacctgagcccctgcccaaggcgtgcagtaatccatcccagcaggtacgatcaaggccttggtctcgtcaccactccaaggcaagctgggcagagttttccattcttagagagcttctggcccaggatgtgctctgcgacgtgagcaagccatacaggctggccacaccagtgtacgcatcccttacacctcgttctaggccaagaccccctaaagatagccaggcaagtccaggtaggcctagcagtgttgaggaggtcaggatagcagccagcccgaaaagcacaggcccccgaccctctttgcgcccactccgtctggaagtcaaacgagaggttcgacgcccggcacggctgcagcagcaggaggaagaggatgaggaggaggaggaagaggaggaagaggaggagaaggaggaagaggaagaatgggggagaaagagaccaggtcgtggccttccctggacgaaactggggcggaaactagagtctagcgtgtgtccagtgaggagatcacgtagacttaacccggaacttgggccctggttgacatttgccgacgagccgctcgtcccctccgaaccgcagggcgccctgccttcactctgcctggcccccaaggcttacgacgtcgaacgggaactggggtctcccaccgatgaggacagcgggcaggaccagcagctgctacgcgggcctcagattcccgccctggagtctccgtgcgaaagcggctgcggcgatatggatgaagacccttcttgccctcaactgcctccaagggattccccccgatgcctgatgctggccctgagccagagcgatcctacatttggaaaaaaatcttttgaacaaaccctcaccgttgaactgtgtgggaccgccggcctgaccccccccactacaccgccttacaagcccaccgaagaggatccattcaagcccgatattaagcattcactcggaaaagaaattgcgctttctcttccgtccccagaaggactgtcacttaaagccactccaggcgctgctcataagctgccaaaaaaacatccagaacgatctgaactgttgagccacctgaggcatgccacagcccaacccgccagccaggctggtcagaagcgcccgttcagctgcagctttggggatcatgattattgccaggtgctgaggcctgagggtgtcctgcagcgaaaagtccttcgttcttgggagcccagcggagtgcacttggaggactggccacagcaaggggcaccatgggcggaggcacaggcacccggccgtgaggaagaccgaagttgcgacgctggcgccccaccgaaggattccactctcctgcgtgatcatgagatccgggccagtttgaccaagcattttggccttctggagaccgcattggaggaagaggatttagcatcctgcaagagccctgagtacgacactgtgtttgaagactcttcctcctcctcaggagaatcttcatttttacctgaagaggaggaggaagagggcgaagaagaggaagaagatgatgaagaagaggatagcggcgtgagtcctacctgttccgatcattgtccataccagtctcccccttcgaaagctaataggcaattatgttcgaggtcaagatcgtcctccggcagttcaccctgccactcatggtccccggcaaccagaaggaacttcagatgtgaatctcgaggcccatgcagcgacagaaccccgtctatccgccacgctcgtaaaagaagagagaaggccatcggcgaaggtagggtggtgtatatccagaatctgagctctgatatgtcgtctcgagagctgaagcgccggtttgaggtgtttggcgaaatcgaggagtgtgaggtactcacacgaaatcgtaggggagaaaagtatggttttattacatatcggtgctctgaacacgccgctttgtcacttactaaaggcgccgcactgcggaagagaaacgaaccgtcattccagctgagctacggaggcctgcgacatttttgttggcctcggtataccgattatgattccaactcagaggaagccctgcccgcaagtggcaagtctaaatacgaagcgatggactttgatagcctcctcaaggaggcccaacagtccctgcactag

SEQ ID NO: 128274 - DNA, 2880 bp, Artificial Sequence
  Description of Artificial Sequence: Synthetic coding sequence
atgggcgggggttccggcgaagaacaattgtacgctgatttccctgaactggacctgtctcagttagacgcatcagattttgactcggccacgtgttttggtgagctacaatggtgccctgagaactctgaaacagaaccaaatcagtactccccagatgacagcgagctctttcagatcgatagtgagaacgaagctttgctggcagaactgaccaagacgttggacgacatccccgaggacgatgtcggcctggctgctttccctgccctagacggaggggatgccctgtcttgcacctccgcttcccccgctcctagctcggccccaccttcccctgccccagaaaagccaagtgctcccgcccctgaggttgatgagctctcactcgccgactccacccaggataagaaggcaccgatgatgcagtcccagagccgatcttgtactgaattgcataagcacctgacatcagcacagtgctgtctgcaagatagagggctgcagccaccgtgcttgcagagccctcgcctgccggctaaggaagataaagaacctggtgaggactgtccaagtccacaacccgcaccagctagtcctagagactctctcgcacttgggcgggcggatcctggagctcccgtgtcgcaggaggatatgcaggccatggtccagctgattagatacatgcacacttactgtcttccacagcgtaagcttcccccccagacacccgagccactccccaaggcctgcagtaacccttctcagcaggtgcggagccggccttggtcaagacaccactctaaggcttcttgggccgaattctcaatattgagggaactgctggcccaagacgttttgtgcgatgtaagcaagccatatcggctggccactcctgtttatgcatcacttacaccccgatcacgcccaaggcctccaaaagacagccaagcgagcccaggccggccctcctcagttgaggaggtacggattgccgctagccccaagagcacaggcccaagaccaagccttcgcccactccgacttgaagtaaagagagaggttcgtcgcccagcgagattacagcaacaggaggaggaagacgaggaagaggaggaagaggaggaggaggaggagaaggaagaggaagaagagtggggacgcaaacgacccggacggggcctcccgtggacaaagctcggacggaagctagagtcctccgtctgtcctgtgagaagatctagacggctcaatcctgagttgggtccctggttgacgttcgccgacgagcctcttgtgccaagtgaaccacagggtgctctgccctccctgtgcctggcccctaaggcatatgatgtagagcgggaactaggctctcctacggatgaggactcagggcaagatcagcaactcctaagagggccacagatccccgctctggagtcaccctgcgaaagcggctgcggagacatggacgaggaccctagctgtccccaacttccaccacgtgattccccgagatgtcttatgttggcattgtcccagagcgaccctacttttggcaagaagtcattcgaacaaaccctgacagttgagttgtgtggcacggcggggcttacccctcctacaacacctccttacaagcctacagaagaggatccatttaagcccgacataaaacattcactgggcaaagaaatagcccttagcctgccctccccggaagggctgagcttaaaggcaacacccggcgcagcccataagttgccgaagaaacatcccgagaggtccgagctgctgagccacctgcggcatgctactgcacaacctgcgtcacaggcaggtcagaagcgtcctttctcctgctcattcggagatcacgactactgtcaggttcttcggccagagggggtcctccagcggaaggtgctgcggtcatgggagccaagcggcgtgcatctagaagactggccacagcagggggccccttgggcagaggctcaggctccgggtcgagaggaagaccgctcttgcgacgccggggctcctcccaaggactcaactctcttacgagaccatgagatacgggcttcactcacgaagcatttcgggctgcttgagacggctctggaagaggaagaccttgcgagttgtaagagccctgaatatgataccgtctttgaggatagttcctcttctagtggtgaatcttcgtttctgcctgaagaagaagaggaggaaggggaggaggaggaagaagacgatgaggaggaagactccggggtgtccccgacttgtagtgatcactgcccttaccagagccccccatcaaaagccaaccgacagctgtgcagcagatcaagatccagtagcggatcttcgccctgtcactcatggtccccggccactcgccgtaatttccgatgcgagtccagaggcccgtgctcagaccgaacaccttctatcaggcacgccaggaagagacgagagaaggcgattggggagggaagggtcgtgtatattcagaacctaagctctgacatgtcttcacgggagttaaagaggcggtttgaagtgtttggggagatagaagaatgcgaagtactgaccaggaacaggaggggcgaaaaatatggctttattacctaccgttgtagcgagcacgccgctctcagccttactaagggggcagcattgcgaaaacgcaatgagcctagttttcaactgagttacggagggctgcgacacttctgttggcctcgctatacagactacgactccaactcagaagaggctctccccgcctccgggaagtccaaatatgaagccatggacttcgattcgctgttgaaggaggcacaacagtctctacattag

SEQ ID NO: 128275 - DNA, 2397 bp, Artificial Sequence
  Description of Artificial Sequence: Synthetic coding sequence
atggcctgggatatgtgcaatcaagattcagaatccgtgtggtccgatatcgagtgcgccgcattggtgggagaggatcagccactgtgtccagatctgcccgaattagatttgtccgaactcgacgtgaatgatttagataccgacagtttcctgggtggactgaaatggtgttcggatcagtccgagataatatcaaatcagtataataacgaacccagcaatatttttgagaagatcgatgaagagaacgaggccaatcttctagcagtccttactgagacacttgactctctcccagtcgacgaagacggtctcccctcatttgatgccttgactgacggagacgtcacaacagataacgaagcctctcctagctccatgccggatggcaccccaccacctcaagaggcagaggaaccatctctgctgaagaaactgctgctggctccagccaatactcagctgagttataatgagtgttcaggcctgtctactcaaaaccatgccaatcataaccatagaattaggaccaaccctgcgattgtcaagactgagaattcctggagcaacaaggcaaaatccatttgccagcagcagaagccccagaggcgcccgtgttctgagttgttaaagtaccttaccacaaacgatgacccgcctcacaccaagccaacggaaaataggaattcttccagagacaaatgtactagtaagaagaagtctcacactcagtcacagtctcaacatcttcaggccaagcccactaccctttccctgcctctcacccctgagagcccgaacgaccctaagggaagtccatttgaaaacaagaccattgaacgcaccctttccgtggaactctctggaacagccggcctgacgcctcctaccacaccaccacataaggccaaccaggacaatcctttcagagctagcccaaaactgaagtcaagttgcaagaccgtggtcccccccccgtctaaaaagccaaggtactctgagagctctggtacccagggaaacaactctacaaagaaaggtcccgaacaatccgaactctatgctcagttgagcaagtcttccgtcctaactggaggacacgaagagagaaaaaccaagaggccgagtctgaggctgtttggagatcatgactattgccaaagcatcaattctaagaccgaaattctgattaacataagtcaggagctgcaggactcccggcaactagagaacaaagacgtatcatccgactggcagggacaaatctgttcaagtacggactccgaccagtgttacctacgggaaactctggaagcatcaaaacaagtttccccttgcagcacccggaagcagctacaggaccaggaaatacgtgccgaactcaataaacatttcggacatccttcccaggctgtattcgatgacgaggcagacaagacaggcgagcttcgtgacagtgacttctctaacgaacaatttagtaaactgcctatgttcatcaatagcggactggccatggacggcttgtttgacgactccgaagatgaatccgataaactttcttacccttgggacgggacacagagttactccctctttaatgtgtctccctcctgcagttccttcaacagcccttgtcgggacagcgtaagccctcccaaaagcctcttcagccagagaccccagaggatgaggagcagatccagatccttcagcaggcaccgcagctgctccagatctccatacagtaggtccaggagccgcagccctggatcacgcagtagctcgagatcctgttattactacgagtctagccattatagacacaggactcatcgcaatagtccactttacgtgaggagccgttctcgtagcccttatagtcggcggccaaggtacgattcttacgaagagtaccagcacgagaggctcaagagggaggaataccgcagagagtatgagaaaagggagagtgagcgggccaagcagcgagaacgccagcggcagaaagccatcgaggagagaagagtgatttacgtcggcaaaattcggccagatacaacaagaacagagctccgagatcggttcgaagtattcggcgagattgaagagtgtacagtcaatctcagagacgatggcgactcctatggttttatcacttacaggtacacctgcgatgccttcgcggctctggaaaatggctacactttgcgcaggtctaatgaaactgatttcgaactgtatttttgcggtcgcaagcagtttttcaaaagtaattatgccgacctggatagcaattctgatgacttcgaccccgcatccaccaagtctaaatatgactcactggactttgattccctgctgaaggaagcacagcggtcgcttcgacgctag

SEQ ID NO: 128276 - DNA, 3072 bp, Artificial Sequence
  Description of Artificial Sequence: Synthetic coding sequence
atggccggaaacgactgcggcgcactgctggacgaagaactatctagcttctttctgaactacttagctgatacgcagggcggtggaagcggggaggaacagctctatgccgactttcccgaactggacctgagccaactggatgctagtgattttgactccgctacttgtttcggagagcttcaatggtgtccagaaaactcagaaacagagcccaaccagtatagccctgatgattctgaactgttccagatcgactcagagaatgaagctcttctggccgaattgaccaaaaccctggacgatatccccgaagacgacgtgggtcttgctgccttccccgctctagacgggggagacgcactctcgtgcacatcggcctctcctgcccccagctcggcccccccctccccagcgccagaaaaaccgtccgctcctgcccccgaggtcgacgagctgtctctgctgcaaaagctgctcctcgctacctcttatccaacaagtagctccgatactcaaaaagaagggaccgcctggaggcaggcgggcctacgctccaaatctcagcggccgtgcgtgaaggccgattctacccaggataagaaggccccaatgatgcaaagtcagtccaggagctgcaccgagctccacaaacacttgaccagcgcccagtgctgcctgcaggataggggcttgcaaccaccatgcctgcagtccccacgactgcctgctaaggaggataaagaacctggcgaagactgtccgagtccacagcctgctcccgcttctcccagagattctttagccctcggacgagccgaccctggcgctcctgtgtctcaggaggacatgcaggccatggtgcagctgatcaggtacatgcatacttactgcctgccccagcgaaagctgcctccccaaacacctgagccactgccaaaagcttgctccaacccatcacagcaggtgcggtccagaccttggagccgccaccattcaaaggcttcctgggccgaattttcaattctaagagagcttcttgcccaggatgttctgtgtgatgtgagcaaaccttacaggctggcaactccagtgtacgcaagcctgacaccgcggagccggcctcggccacctaaggactcacaggccagtcccgggcggccctcatccgtggaggaagtcagaattgcagcctctccaaaatccactggtcccaggcccagtctgaggcccctgcgactcgaagtaaaacgggaggttcgacgccctgctagactgcaacagcaggaagaggaagacgaggaggaggaagaggaagaagaggaggaggagaaagaggaggaggaggaatgggggaggaaaaggcctggccggggccttccttggaccaagcttggtagaaagctggagtcctcagtctgccctgtgcggcgctcacggaggctgaacccagagctcggcccctggctgacttttgctgacgaacccttggtgcccagcgaacctcagggcgctctgccctccctctgcctggcccccaaagcgtatgatgtggagcgcgagttgggcagtcccacggacgaggactctgggcaggaccagcagcttcttcggggtcctcagattccggcattggaatctccttgcgagtcggggtgcggtgacatggatgaggacccaagttgtcctcagctgccaccaagagatagccctcgctgcctgatgctggctctctctcagtccgacccgacattcggtaaaaagtcatttgagcagacactgacggtcgaactctgtggtaccgctggcctaacacccccaactacaccaccttataagccaacagaagaggaccctttcaagcctgacattaaacacagcctaggtaaggaaatcgcattgtctctcccatcacccgagggtctgtcactaaaggctacccctggcgcagcgcataagctccccaagaaacacccagaaagatctgagctattgtctcacctccggcatgccacggcccagcccgctagccaggcagggcagaaaaggcctttttcttgcagcttcggtgaccacgattactgtcaggtcttaagaccagaaggcgtccttcagaggaaggtactgcgtagctgggaacctagcggagtacacctggaagactggcctcaacagggagccccttgggccgaagcccaagctcccgggcgtgaagaagatcggtcttgtgacgccggagccccacccaaggacagcaccctgctccgggaccacgagatccgtgcttcactgaccaaacactttggcctcctggaaacagctttggaagaggaagatttggccagctgcaaatcaccagagtacgacacagtgttcgaagattcgtcgtcttctagtggcgaatcctcctttttgcctgaggaggaagaggaggagggggaagaggaggaagaggacgatgaggaggaggactccggtgtatcaccaacgtgctccgaccactgtccataccaaagccctcccagtaaggccaatcgccagctctgctcaagatcccggagcagtagcgggagctccccctgtcacagttggtctcccgccacacgtaggaacttcagatgtgagagtcgcgggccctgttcagaccgcaccccttctatccgccacgcccggaagcgccgcgaaaaggcaatcggggagggacgagttgtctacatccaaaatctttctagcgacatgagcagtagggagcttaagagacggtttgaagtgtttggcgaaatcgaggagtgcgaagtgctaaccaggaaccgccgtggggaaaagtatgggtttattacctatcgctgctccgagcatgctgctctctctttaaccaagggggctgctcttcgtaaaagaaacgagccgtcctttcagctgagctatggcggcctgcgtcacttctgttggccacggtacacggattacgatagcaacagcgaggaagcactgcctgctagtggaaaatctaaatatgaggccatggacttcgacagtctgctgaaggaggcccaacagagcctgcactag

SEQ ID NO: 128277 - DNA, 3054 bp, Artificial Sequence
  Description of Artificial Sequence: Synthetic coding sequence
atggctgggaacgactgcggggccctactggatgaagaactctcgagctttttccttaactatctggctgacacacagggcggcggctccggagaggagcagttatacgctgactttccagaattagatctttcccagttggatgcctcagacttcgactcggctacatgtttcggggagttgcagtggtgcccagaaaactccgagacggaaccaaatcaatatagtcccgatgattctgaactgttccagatagactccgagaacgaggcactcctcgcggagctgactaaaacactggacgacatcccggaagacgatgtaggcctggctgcctttcctgctctagatgggggggatgccctcagctgcacctccgcttcaccggcaccgagcagtgctcccccgtcgcctgccccagagaagccatctgcacccgcccccgaggtcgacgagttaagcctgcttcagaagttgttgctcgcaactagctatccgacaagcagctcagacactcaaaaagaagggaccgcttggagacaggccggcctgaggtctaagtcacagcgtccctgcgtgaaagccgatagtacccaggacaagaaagccccaatgatgcaaagccaatctcgctcttgcactgaactgcacaagcacttaacgagtgcacaatgttgcctccaggatcgcgggttgcagcccccctgcttacagagcccaaggttgcccgccaaagaggacaaggagccgggtgaggattgtccttccccacagcccgcccccgcgtccccaagggactctctggctctcggaagggcggacccgggggcacccgtttctcaagaggatatgcaggcgatggtgcagctgataaggtacatgcacacatattgtttgccacaacggaagctacccccgcagacaccggagcccctgcctaaggcttgttccaatccaagtcagcaggtccggagtcgtccttggtctcgacaccactctaaggcatcatgggccgagttctcaattctgcgcgagctgcttgctcaggatgtgctctgcgatgtgtctaagccctaccgactagccacacccgtttacgcctcccttactcctcgatcccggccccgccctcctaaggattctcaggccagcccaggaaggccatctagtgttgaggaggtcagaatagccgcctccccgaaatcaacaggccccagacctagtcttagaccccttaggcttgaagtaaaacgcgaagtcaggcgccccgccaggttgcagcagcaggaggaagaggatgaggaggaggaggaagaagaagaagaggaagagaaggaggaagaggaggagtggggtcggaagcgccccgggcgcggcctgccgtggacgaaactaggacggaaattggagagcagcgtatgtcctgtcagaaggtcccgacgcctcaatcccgaacttggcccatggctcacatttgctgatgagccgctagttcccagtgagcctcagggggctctgccctctctgtgcctggccccaaaggcttacgacgtggagcgagagctggggagtccaacggacgaggacagcggccaggaccagcagttgctcaggggtccacagatcccagctctggagtctccctgcgaaagcgggtgcggtgatatggacgaggacccaagttgtccccagctaccaccaagagacagtccccgttgtctgatgttggcgctcagtcaatccgatcctacctttggcaagaagtcatttgagcaaacccttactgtggagctgtgcggcactgccggactcaccccacctactacacccccatataaacctaccgaggaggacccttttaagcctgatatcaaacatagcctagggaaagaaatagccttatcattgccatcacccgagggcctctccctgaaggcgactcccggtgcagcacacaaactgcccaagaagcatcccgagaggagtgagctgctaagtcacctgagacacgccaccgctcaacctgccagtcaggccgggcagaagcggcccttttcctgcagctttggtgatcacgattactgccaggtgctgcggcccgagggggttcttcagcgtaaagtactgcggagttgggaaccatccggagtgcatctggaggattggccccagcagggggctccatgggctgaggcccaagcccccggacgggaagaagaccgcagctgtgatgctggcgcacctcctaaagactccaccctgctgcgggaccacgagatcagagctagccttacaaaacattttggtctgttggagacagctctggaggaagaggacctggcatcttgcaagagccctgagtacgacactgtgtttgaggactccagttcatcgtccggcgaatcgtcctttctgccagaggaagaggaagaggaaggagaggaagaagaagaggacgatgaagaagaagattctggggtctcccccacctgttccgatcactgcccctaccaaagtcccccgagcaaagcaaatcggcagctgtgcagccgcagccggagttcctcagggtcttcaccctgtcatagttggtcacccgccaccaggcgtaatttccgatgtgaaagtcgcgggccttgctcagaccggacaccttctattcgacatgctcgtaaacggagggagaaggcaattggcgaaggtcgtgtggtctatattcaaaacctgtcaagtgacatgagttctcgggaactgaagcgcaggtttgaggtcttcggcgagatcgaagagtgtgaagttctgactcgaaatcgccggggggaaaagtacggttttatcacctaccgctgcagcgaacacgccgccctgtccctgacaaagggcgccgcgctcagaaaaaggaatgagccctctttccagctgagctacggtgggctcagacatttctgttggccaaggtacaccgactacgggaagcccctgaagcctagccactctcttgttcgtctcaaagcttgggaagccgtgccttcattgaataaaacacagagctag

SEQ ID NO: 128278 - DNA, 471 bp, Artificial Sequence
  Description of Artificial Sequence: Synthetic coding sequence
atggccgtgggcaagtttttactgggatccttgctgttactgtcgctgcagcttggccagggttggggaccggacgcccgtggggtgcccgtggccgatggcgaatttagttctgaacaggtcgcaaaggccggtggtacttggctgggaacacatcgacctctggccaggttgcggcgggccttgagcggcccttgccagctctggtccctgacactgtctgttgccgagctcggactgggctatgcatccgaggaaaaagttatttttaggtactgtgccggcagttgtcctcggggagctagaacccagcacggcctggctttggcccgtttgcaaggccagggccgcgcacacggcgggccttgttgccggccgacccgctatactgatgtggccttcctggacgatagacatcggtggcagcggcttccccaattatctgccgccgcatgcggttgtggggggtag

SEQ ID NO: 128279 - DNA, 1422 bp, Artificial Sequence
  Description of Artificial Sequence: Synthetic coding sequence
atgggacaaagtggacggagccgacatcagaagcgggcccgcgctcaagcacagctgcgaaacttagaggcatacgccgccaatccgcactctttcgtttttactagaggatgcacagggcgcaacatccgccagctgtcacttgatgtcagacgggttatggaaccgcttacagctagccgcctacaagtgcggaagaaaaactctctgaaggactgcgtggctgtggccgggcccttgggcgtgactcactttctaattctgtcaaaaaccgaaacgaatgtctatttcaaattgatgagattgccaggagggcctacactgacattccaggtcaagaaatactctctcgttagagatgtcgtgtctagcctcagacgtcatcgcatgcatgaacagcagttcgcacacccccctcttctcgttctgaattcttttggcccgcatggcatgcatgtcaagctaatggccacaatgttccagaaccttttcccatctattaatgtgcacaaggtaaatctaaacaccattaagcggtgtttactgatcgattataatccagactcccaggaactggacttcaggcactacagcataaaagtggtacctgtcggcgcttctaggggcatgaaaaaacttctgcaggagaaatttcctaacatgtccaggttacaggacataagcgaactgcttgcaactggagctggtctttcagagtctgaagcagagcccgacggagaccacaacatcacggagttgccccaggcagtcgccggccgcggcaacatgcgggcacagcagagcgcagtgcggctgaccgagataggccctagaatgacactacagcttatcaaggtccaggagggggttggcgagggcaaggtaatgtttcactcctttgtttctaaaacggaagaggagcttcaggccatcttggaagccaaggagaagaaactccggctgaaagcccagaggcaggctcaacaagcccagaacgtccagagaaaacaagagcaaagggaagcccatcggaagaagagcctggaaggcatgaaaaaagctagggtcgggggctctgatgaggaggcaagtgggattcccagtcgcaccgcttcccttgagctcggggaagatgatgatgagcaggaggatgacgacatagagtacttttgtcaagcagtgggcgaggcaccctccgaagatttattccctgaggccaaacagaagaggctagccaagtcacccggtaggaaaagaaaacggtgggagatggaccggggtaggggtaggctctgcgaccagaagtttcccaaaaccaaggataagtcgcagggagcacaggcccggcgggggcccaggggcgcaagtcgcgacggcggtcgaggccgcggcagagggcgccccggcaagcgtgtagcatag

SEQ ID NO: 128280 - DNA, 1383 bp, Artificial Sequence
  Description of Artificial Sequence: Synthetic coding sequence
atgggacagtcggggaggagccggcaccagaagagggcgcgggcccaggcccagctgcggaatcttgaagcctacgccgccaacccccactcatttgtgtttacaaggggctgtactggcaggaatattcgacaactgtcattggatgtgcgtagagttatggagccgctgaccgcttcacgactccaagtgcgcaagaaaaattctctgaaagattgtgttgctgtcgcgggccctctgggagtcacacacttcctcatcctgagtaagaccgagactaacgtctactttaagctgatgcggctcccaggtggccctaccctcacgttccaggtcaagaagtatagcctggttagagatgtggtgtcgtcccttaggcgacaccgtatgcacgaacagcagtttgctcatccacctctactcgtgctgaacagctttgggccacacgggatgcacgtcaagctcatggcaaccatgttccaaaacttatttcccagcataaatgtgcacaaggttaatctgaataccattaaacggtgccttctgatcgattataaccccgattctcaggagctcgacttccggcactactctataaaggtcgtgccagtgggagcgagccgaggaatgaaaaagctgctgcaggagaaatttccgaacatgtcaaggctgcaagacatcagtgaattgctggccactggggctggcctgagcgaaagtgaggctgagcccgacggggaccacaatatcaccgagcttcctcaggccgtcgcaggaaggggaaacatgcgggcacagcaaagcgcagtgcgactgaccgagatcggcccacggatgacactgcagctgattaaagttcaggagggagtcggagagggtaaggtgatgttccactcttttgtttctaaaacggaagaagagttgcaagctatcttagaagccaaggagaagaagctgaggcttaaggcacagcgtcaggctcagcaagcccagaatgtgcagagaaagcaagagcaaagagaggcgcatcggaaaaagagtttggagggaatgaagaaagctcgcgtcggcggcagcgatgaagaagcgtccggtatcccatcgcggacagcctctttggagttaggagaagacgacgatgaacaggaggacgatgatattgaatatttctgccaagctgtgggagaagcaccgtcagaggatctgttcccagaggcaaagcagaaacgcttggctaaaagtccgggtagaaaacgaaagcgctgggaaatggaccggggacgaggccgcctgtgcgatcagaagtttcccaaaaccaaggacaaatcgcaggacggaggtagaggtcgtgggagaggccgacccgggaagcgtgtggcctag

SEQ ID NO: 128281 - DNA, 2385 bp, Artificial Sequence
  Description of Artificial Sequence: Synthetic coding sequence
atgggccaaagtggtcgaagtcggcaccagaagcgcgctcgggcccaggctcagctgcggaaccttgaagcctatgccgctaaccctcactcatttgtttttactcgcggttgtaccggtcgcaacatcagacagctgtccctggacgtgcgccgggtgatggaaccccttacagctagcagactgcaggtacggaaaaagaatagtctcaaggactgtgtggctgtagccgggcccctcggtgtgactcacttcctgatcctgtcaaagactgagacgaacgtttactttaaactgatgcggctaccagggggacctactctgacattccaggtgaaaaagtattcactcgtgcgcgatgtcgtctctagtctgaggcgccacaggatgcacgagcaacagttcgcgcatccccccctcctcgtcttaaattccttcgggcctcacggcatgcatgtaaagcttatggccactatgttccagaatctctttccaagcattaacgtgcataaggtaaacctgaacactattaaaagatgcctgctcatcgactacaaccccgatagccaggagttagacttccgacattactcaatcaaggtcgtgccagtaggcgcttctcggggtatgaagaaacttctccaagaaaagttccctaacatgagtaggttgcaggatatctctgaactcctggcaaccggcgccggcctcagtgaaagcgaggcagagccagacggcgaccacaacattacagagctccctcaggcggtggctggacgggggaatatgagagcccagcagagcgcagtcaggctgacggagattggacctcggatgaccctgcagctgatcaaggtacaggaaggggtaggtgagggcaaagtcatgttccattcatttgtgtccaagactgaagaggaactgcaggccatcctggaggccaaagagaagaagctgcgcttgaaggctcagcgacaggcccagcaagcacagaacgtccagcgaaaacaggaacagagagaggcccacaggaagaagtccctggaaggtatgaaaaaggcgcgggttggaggcagcgatgaggaggcctccggaatcccctcccgaacggccagcctcgagttgggcgaggacgatgatgagcaggaggacgatgatatagagtatttctgccaggctgtcggcgaagccccaagtgaggacctattcccagaagcaaagcaaaagagactcgcaaagagtcccggcaggaagcgcaagcgctgggagatggaccgcggggcaaagagttgtccggccaattttctggccgcagctgatgataagctttccgggttccagggcgacttcctgtggcccatcctcgtagtggaattcctggtggccgtggcatcaaacggattagccttgtaccgattttctatcaggaaacagcggccctggcacccagctgtcgtcttttcagtgcagctggctgtctcagatttgctgtgtgctcttaccctgccccctctggccgcctatctgtacccccctaagcattggcgatatggcgaggccgcctgtcgcctcgaaaggttcctttttacctgtaacttgttaggatcagtgatcttcatcacttgcatctccctgaaccgttacctcggaattgtacacccattcttcgctaggagtcatctcaggccaaaacatgcatgggcggtttccgctgccggctgggtattagcagcactgctagcaatgccgaccctatctttttcccacctcaagcgacctcagcagggcgctggcaactgctctgtagcaagaccagaggcttgtattaagtgtttgggtaccgcggatcacggactggcggcctatcgcgcatatagcctggtactcgctggccttgggtgtggccttccattgctgctgactctcgccgcctatggtgctttggggcgagctgtgctccgttcaccagggatgactgtcgcagaaaagctgcgggtcgcggctctggtggccagtggggtcgctctctacgcctcttcatacgtgccttatcacattatgagagttctgaacgtggatgcccggaggagatggagtactcggtgtccttcctttgccgacatcgcacaggcaactgcagctctggagctagggccttacgtgggatatcaagtaatgcggggtctgatgccgcttgcattctgtgtgcaccctctgctctatatggctgccgttccatccttgggctgctgctgtaggcactgtccgggataccgcgactcctggaatccagaggacgcaaaaagtacaggccaggcactccctttgaatgctacagccgctccaaagccctcagagccccagagtagggaactatcccaatag

SEQ ID NO: 128282 - DNA, 1374 bp, Artificial Sequence
  Description of Artificial Sequence: Synthetic coding sequence
atggcacagcctccaagactctcccggagcggtgcctccagcctgtgggaccccgcaagcccggccccaactagtggccctaggcctagactgtgggaggggcaggatgtgcttgcgcgttggacagacggcctcctgtaccttgggactatcaaaaaagtcgattccgccagagaggtgtgtttagtgcagtttgaggatgacagccagttcctcgtcctatggaaggacataagcccagcagccctaccgggagaagaactgctgtgctgcgtctgcagaagcgagacagtggtaccagggaaccggttggtgagttgcgagaagtgccgacatgcttaccatcaagattgccatgtgccgcgggctcccgctccaggtgaaggggaggggacttcatgggtctgtcgccagtgcgtgtttgccatcgcaacgaagagaggaggtgcgctcaagaagggcccctacgctcgtgctatgcttggaatgaagctcagcctgccctatgggctgaagggcttggattgggatgccgggcaccttagcaacagacagcagagctactgctattgtgggggtccgggtgagtggaatctgaaaatgttgcagtgtaggtcttgtctgcagtggtttcacgaggcatgcacgcagtgcttaagcaaaccactcctctacggggaccgattctacgagttcgaatgttgcgtttgtaggggagggcccgaaaaggttagaagactccagctgcggtgggtcgacgtggcccatctagtgttgtaccatctgtcagtttgctgcaaaaagaagtatttcgactttgatcgcgagattttacctttcacatcagaaaattgggactctttactgctgggagagctctccgacactccgaagggagaacggtcctctagattgctgtccgccttgaacagtcataaggatagatttatctctggccgggagattaagaagcggaaatgcctcttcgggcttcacgctcgcatgcctcctcccgtggagcctcccacaggcgacggcgccctcacacgggcgggaccatggggtcgaggccttacgagccctggtgaggctcccgaggccggtgcacgggcaccggaggaagaggccgaaggtgagagtggtggggccggagctacactcagctctgctcagagtgccagggccccgggtgctgagggggcgggcagtagcgcagaggggacagccgctgccccgtcaggatgcctcctcccctcgacgctgctgccagccccccaaggacccctcggaaccgtcgaccctcagacagggcatccatggaacttcaccctggtgtccccgcagaccagcttaaaagtgcctcccacccggtag

SEQ ID NO: 128283 - DNA, 1704 bp, Artificial Sequence
  Description of Artificial Sequence: Synthetic coding sequence
atggcccaacccccccggctttcacgcagtggggcctccagtctctgggatccagcatctccagcacccactagcggccctcgcccacggctctgggaggggcaggatgttctagctcgatggactgatggcttactctatttaggtaccataaaaaaggttgattcggccagagaggtgtgtctcgtccaattcgaagacgattctcaattcctcgtgctgtggaaggatatctcacccgccgccctgcccggggaggagctgctgtgctgtgtatgtcggagcgagacagtagtgcccgggaaccgcctggtgtcctgtgaaaagtgccgccatgcctaccatcaggattgccacgtgcccagagctcccgcccctggtgagggagaggggaccagttgggtctgccggcagtgcgtgtttgcaatcgcgacaaaaagaggaggagccctgaagaaaggaccatacgcgcgtgccatgttaggtatgaaattaagtctgccttatggcctcaaaggcctagattgggacgccggacacctgtccaaccggcaacagtcttactgctactgtggcgggccgggtgagtggaatctcaaaatgctgcaatgtcggtcttgtctgcaatggtttcacgaggcctgcacacaatgcctgtccaaacctctgctttacggggacagattctacgagtttgagtgttgcgtttgccggggaggtcctgagaaggttcggcgcttgcagttaagatgggtggacgtggctcatttagtcctttatcaccttagcgtatgctgcaagaagaagtacttcgactttgacagagagatactgcccttcactagcgagaactgggactccctgctgttgggagagctgtccgacacccccaagggcgagcggtcatcgaggctcctgagtgccctgaactcccacaaagatcggttcatcagcggacgggagatcaaaaagcgaaagtgtctgtttggcctgcacgctagaatgcccccgcccgtcgagcccccaactggcgacggggctctgacttccttcccgagcggccaaggaccggggggcggagtctcacgccctcttggcaagcgacgccgtccagaacccgaacccctccgccggagacaaaaaggtaaagttgaggagctaggcccaccgtcagctgtgaggaaccagccagaacctcaggagcagagagaacgcgcacatctgcagagagccttgcaggcctctgtctcaccaccatcccctagcccaaatcaatcctaccaggggagcagcgggtataatttcaggcccaccgacgcaaggtgccttccgtcatctcccataaggatgtttgcctcttttcaccctagtgccagcacagccggcacgtccggtgattccggccccccagacagatccccgttggagcttcatattggcttcccaaccgacatcccgaagtctgcgccgcatagcatgacagcatccagctcatccgtaagttcaccaagcccagggttgccacgtcggtcagcacctccctctccattgtgtagaagcctgtcgcccggcactggaggcggggtcaggggaggcgtagggtatctgtcgcgcggtgacccagtccgcgtgctggccaggcgcgtgcgacccgacggatcggtacagtatctggtcgagtggggcggaggcggaattttttag

SEQ ID NO: 128284 - DNA, 732 bp, Artificial Sequence
  Description of Artificial Sequence: Synthetic coding sequence
tagagtcttttgttgactgccacccggaccgtgtcgttccaaggagaacgtctaaggaggggtaacgtttgcctggtgtcgatgcttggctgcttgcctttatggtcaccactcctagaaatggagcattcgcctggccagggacccggcggcggtgtcagcagacctctaggtaagaggagacgcccagagccggagcctctccgcaggcggcagaaggggaaagtagaggagttagggcctccttcagccgtaaggaaccagcccgaaccacaggagcagcgagagagagctcacctccaaagagccttgcaggcgtccgtttcccccccttcgccatctccaaaccaatcttatcaagggtcatccggatacaattttaggcccactgacgctcgttgtctacctagtcctatccggatgtttgcttctttccaccctagcgccagcacagcaggcacttctggcgacagcggcccaccagaccggtcgccccttgagctgcacatcggcttcccaacagatattcctaagagcgcaccccattctatgacagcttcttcatcaagcgtgtcttccccatctcccgggctcccaagaagaagcgcccccccatcacccttatgccgtagcctttcaccaggcactggggggggagtcagaggcggtgtgggttacttatctcgcggggaccctgttagagtgctggcacggcgtgtccggcctgactag

SEQ ID NO: 128285 - DNA, 438 bp, Artificial Sequence
  Description of Artificial Sequence: Synthetic coding sequence
atggctcaacctccacgactgagcagatctggcgctagcagcctctgggaccctgcctcacccgcgcccacaagcggccctcgcccacgactctgggaagggcaagacgtgcttgcccgctggacagacggcctcctctacttgggtacaatcaagaaggtagattcagcccgcgaagtgtgtcttgtgcagtttgaggacgactcccaatttctggttctatggaaagacattagccccgctgccctgcccggggaggagttgctttgttgcgtctgtcgtagtgagaccgtcgtgcccgggaaccgcctagtgagctgtgaaaagtgccggcatgcctatcatcaggattgccacgtccccagagcgccagccccgggggaaggtgagggaacatcctgggtctgccgccagtgtgtgttcgctatagcaacatag

SEQ ID NO: 128286 - DNA, 546 bp, Artificial Sequence
  Description of Artificial Sequence: Synthetic coding sequence
tggggccatcctcagcaatgtgcaatctcaccatctcccagaagcagagggagcggtctgatctgtaggggacattgtagacctcagtgtctccaccacccccctgccctcacgcgcgtgacgcgtgcggcagcagctacaacctccggaccccagatgcctgcagcctgtccaggtcatcctatccgcatgttcgcatcttttcatccttctgcctccacagctggcacttctggcgacagtgggcctcccgaccggtcgccgctggaactgcacatcggctttcccaccgatatccctaaaagcgcaccgcacagcatgaccgcttcatcctcctctgttagcagtccgtctccggggctcccgcgacggtcagcccctccctccccactctgcagaagtttatccccagggaccggcggaggcgtgcgtggcggagtgggatatctttcccgcggcgacccagtgagggtgctggcaagacgggtgcgccccgatggctcagtgcaatatcttgtggaatggggaggtggcggcattttttag

SEQ ID NO: 128287 - DNA, 438 bp, Artificial Sequence
  Description of Artificial Sequence: Synthetic coding sequence
atggcccagcctccccggctgagccgaagtggagcctcatccctgtgggatccagcatcacctgctcccacgagcggtccccggccaaggctgtgggaaggacaggacgtgctagcaaggtggacagatggccttttatatctggggacgattaagaaagtggacagcgcacgagaggtctgtttagttcaattcgaggatgattcccagttcctggtcttgtggaaagatatcagccccgcagctctcccaggagaggagctgctttgttgcgtgtgcagatccgaaaccgtggtgcccgggaatcggctggtgtcttgcgaaaaatgtagacatgcttatcaccaggactgccatgtccctcgtgctcccgcgccaggcgagggggaagggacaagctgggtctgccgccagtgtgttttcgccatagccacttag

SEQ ID NO: 128288 - DNA, 1704 bp, Artificial Sequence
  Description of Artificial Sequence: Synthetic coding sequence
atggcccagccccctcgcttgagtcgcagcggggcttccagcctatgggaccctgcctctcctgcacccacctcaggcccacgacctcggctctgggaggggcaggacgtgctcgcccgttggactgacggactgctttacctaggaactatcaagaaagtggattctgccagagaggtctgtcttgtgcagtttgaagacgacagtcagtttctggtgctgtggaaggatatttccccagccgccctacccggagaggaactcctctgctgtgtctgcaggagtgaaacagtggtgcctggtaaccggctagtgtcttgcgagaagtgtcggcacgcttaccatcaggattgtcacgtgccgagggcccctgcccccggtgagggcgagggaacctcttgggtgtgcagacagtgcgtctttgcgatagctaccaagagagggggagcactaaaaaagggcccttatgctagggcaatgctaggaatgaagctgtccctgccatatgggctgaaaggtttggactgggatgccggtcacctgtcaaatcgccagcagagctattgctactgcggagggccaggggaatggaacctaaagatgctgcagtgccgctcctgcttgcagtggttccacgaagcatgcacccaatgtctttcaaaaccattgctatatggtgaccgtttctacgaattcgagtgctgtgtgtgtagggggggcccggagaaggtacgtagactgcagttgaggtgggtggatgtggcacaccttgtcttgtatcacctgtctgtctgttgtaagaagaagtattttgattttgaccgtgagatcctgccttttacctcggaaaactgggatagcttgctcctcggcgagctgagcgacacccccaagggggaacgctcctccaagctcctcagtgcactgaactcccacaaggaccgtttcatcagcggcagagaaattaaaaagcggaagtgcctgttcggactgcatgctagaatgccacctcccgtagagcctccgacaggcgacggcgcacttacctctttcccatccggccagggccctggggggggggtgtctagacccctggggaagcgacggagaccagaacccgaacctctgagacgaagacagaagggaaaggtggaggaactgggtcccccgtcagcagtgagaaaccagcccgaacctcaggaacagcgggagcgggctcacttgcagcgcgccctgcaggcctctgtgtcacccccgagtccgtcccctaaccaatcctaccaggggtcttcgggatacaatttccgtcccaccgatgctcgttgcctgccctcctcccctatccgtatgtttgcgtcctttcatccatccgctagtactgcaggtaccagtggtgactccggacccccagacagatcacccctggagctgcatataggcttccctaccgacatccccaagagcgcgccccacagtatgacagcgtcctcctctagcgtttcttccccttcgcctggcctccctagaagatccgcccctccctcaccactttgccgtagcctgtctcccgggaccggcgggggcgtgcgtgggggggtgggatacctgagtagaggcgaccccgtgagagtgctggccaggcgggtcaggcccgacggctcggttcaatacctcgtagaatggggcggagggggaattttttag

SEQ ID NO: 128289 - DNA, 684 bp, Artificial Sequence
  Description of Artificial Sequence: Synthetic coding sequence
atggcccaacccccccgtctctcacgatctggagcaagcagcctctgggacccagcttcccccgcaccaacctcaggacctcggcctaggctgtgggaagggcaggacgtgctagctagatggactgacggcctgttatacctgggaacgattaagaaagtcgattcggctagggaggtgtgccttgtacaattcgaggatgactcccagttcctcgtgctctggaaggacatatctcctgctgcattacccggcgaggaactattgtgttgtgtgtgtaggagtgagactgttgtacccggtaacaggctggtcagctgcgagaaatgtcgtcacgcctaccatcaggactgtcacgtgccccgggctccagctccaggagagggtgaaggtacctcttgggtgtgccgccagtgcgttttcgccatcgccactaaacggggaggagccctgaaaaaagggccctatgcaagagcaatgctgggtatgaaactgagtcttccttatggactaaaagggttggattgggacgccggccacttatccaatcgacagcagagctactgttactgtggcggccccggcgaatggaatctgaaaatgttgcagtgtcggagctgcttgcagtggttccacgaggcctgtacccagtgcttaagtaagccactcctctatggggattag

SEQ ID NO: 128290 - DNA, 684 bp, Artificial Sequence
  Description of Artificial Sequence: Synthetic coding sequence
atggctcagcctccgagactatcaaggtccggagcgagttctctgtgggaccccgcctctccagcccccacctctggcccaaggcctcgcttgtgggaagggcaggacgtcctggcgcgctggacagatggtctgctatacttgggaacgataaagaaggtagacagtgcccgggaggtatgtctggtccaattcgaagacgactctcagttcttagttctttggaaagacatcagccctgccgcgttgccaggcgaggagcttttgtgttgcgtatgtcgcagcgagactgtggtcccaggcaataggctggtttcgtgcgagaaatgcaggcatgcttaccaccaggattgtcatgtgccgcgagctccagcgccaggagagggcgaggggacctcgtgggtctgtcgacaatgcgtttttgctatcgcaactaagcgggggggtgccctcaaaaaaggcccatatgcccgcgcaatgttggggatgaagctgagcctgccatatggcctgaagggcctagattgggatgccggtcatctgagcaaccgacaacagtcttactgttactgtgggggtccaggggaatggaaccttaaaatgctgcagtgtcgttcttgcctgcagtggttccacgaagcctgcactcagtgcctgagtaaaccactcctgtatggggactag

SEQ ID NO: 128291 - DNA, 1374 bp, Artificial Sequence
  Description of Artificial Sequence: Synthetic coding sequence
atggcacaacccccccgtctgtccaggtccggggcatcctccctgtgggatccagcctcaccagcacctacctcgggacctagaccccgcctctgggagggtcaggacgtcctggcgaggtggactgacggtctgctctacttgggaactatcaaaaaggtagattccgcacgcgaggtctgtcttgttcagtttgaagacgatagccagttcctggtgctgtggaaggatatatcccctgcagccctcccaggcgaagaattgctgtgttgtgtgtgccgaagcgagaccgtcgtgcctggcaacaggctggtttcgtgcgagaagtgccgacatgcctaccatcaagattgtcacgttccgcgtgcccctgcccctggtgagggggagggcacttcgtgggtctgccgccagtgcgtattcgcgattgctactaaacggggcggagctcttaaaaagggcccctacgcgagagccatgttgggcatgaagctctcactgccgtacgggctgaaaggactggattgggatgccggccacttgagtaaccggcaacagtcctactgttactgtgggggccccggcgaatggaacctaaagatgctacaatgccgttcgtgtctgcaatggtttcatgaagcctgcacccagtgtttaagtaaaccgctgctctatggcgacaggttctatgagttcgagtgctgcgtctgcaggggaggcccagaaaaagttagacggctgcagctgaggtgggtggacgtggcacatctagtactataccacctgtcagtctgttgtaagaaaaagtacttcgattttgatagagagattttgccttttactagtgagaactgggactcattattgctgggtgagctcagcgatactcctaagggcgagagaagctctaagcttttgagcgccttgaactctcacaaggaccgattcatttcaggacgggagattaagaaaaggaaatgtctatttggcctgcatgctaggatgcctcctccagtcgaaccccctaccggagatggtgcgttaacccgcgccggaccatgggggcgagggctgacctcgccaggcgaggctcctgaagctggcgcgagggcccctgaagaggaggcggagggagagtccggaggagcaggggccaccttgtctagcgcccaaagcgcccgcgctccaggagcagagggcgccggatcatcagcagaagggaccgcagcggcccccagcggatgtctcctgccctcgactttgctgcctgcaccacagggccctttaggcaccgtcgatccccagacggggcacccatggaattttaccctcgttagtcctcagacttctctgaaggtccctcctaccaggtag

SEQ ID NO: 128292 - DNA, 1497 bp, Artificial Sequence
  Description of Artificial Sequence: Synthetic coding sequence
atggcagcagccgccgggcccggcgctgccctgagtccccgcccttgcgacagcgaccccgccacccccggcgcccaatctcccaaagatgacaacgaagacaattctaacgacgggacccagccctccaagaggcgccgcatggggtccggggacagttctcggagctgtgaaacctccagccaggatctgggtttctcttactatccagctgaaaaccttatcgagtataaatggccccccgatgaaaccggtgagtactatatgctccaggaacaggttagtgaatatcttggggtaacgagcttcaaacgcaagtatcctgacctggagcgacgcgacctgtctcacaaagaaaaactctatctgagagagctcaacgttatcactgagacccagtgcacgttaggcctcactgcactgcggagtgacgaagtgatagatctgatgatcaaagaatatccggcaaagcacgccgaatacagcgtgatcttacaggagaaggagaggcaacgtatcaccgaccactacaaagagtacagccagatgcaacagcaaaatactcagaaggtcgaggcaagcaaggtccccgaatacattaagaaagctgccaaaaaggctgccgagttcaacagcaacctgaaccgcgaacgaatggaagagcgacgcgcctattttgacctgcagacgcacgttatccaggtcccacagggcaagtataaggtcctcccgactgagcggacaaaagtgtccagctaccctgttgcactaatacctggacaattccaagaatattataaacgatactccccagacgagctgcggtacctacccttgaacaccgctctgtacgagccacccctggatcccgagctgcctgctctcgatagcgacggcgattcagatgacggagaggatggtaggggggatgaaaaacgcaaaaataaggggacatcggactctagcagtgggaatgtgtcggagggagaatccccaccagattctcaggaagacagctttcagggccgtcagaaaagcaaggacaaggccgctacccctagaaaggacggccctaaaagatccgtgctgtctaaatccgtgcccggttataagcctaaagttattccaaatgcaatatgcggcatttgtctcaaggggaaagagtcaaacaaaaagggcaaggccgagtcactgatccattgtagtcaatgtgagaacagcggccaccctagctgcttggatatgactatggaacttgttagcatgataaagacgtatccttggcagtgcatggagtgcaaaacctgtatcatatgtgggcagccacaccatgaggaggaaatgatgttttgcgatatgtgcgacagagggtaccatacattttgcgtcggacttggggcaatcccatcaggcagatggatttgtgattgctgtcagagagctccacccacgcctcgcaaggtcggacggagagggaagaactcgaaggagggttag

SEQ ID NO: 128293 - DNA, 1491 bp, Artificial Sequence
  Description of Artificial Sequence: Synthetic coding sequence
atggccgccgccgcaggaccaggcgcggccctgagtccaaggccttgtgattcagatccagctactcccggcgcccagtcaccaaaagatgataacgaggacaactcaaatgatggtacgcaaccatctaagcggaggaggatgggtagtggggatagcagtcggtcctgtgaaacatcatctcaggacctcggcttcagctattatcctgctgaaaatctgatcgagtataaatggccccccgacgagacaggcgagtattatatgctgcaggaacaggtgtcagaatacttgggagtgacttcctttaaacgaaagtaccctgaacggcgagacctctcccataaggagaaactttatctgcgggagctcaacgtaataacggagacacaatgcacgttgggactcaccgccttaagatccgacgaagtaatcgatctaatgattaaagaatatccagccaagcacgcggagtatagtgtgatcctgcaggaaaaggagcgtcagcggattacagaccactacaaggagtactctcagatgcagcagcagaatacccagaaggtagaggcaagtaaggttcccgagtatattaaaaaggctgcaaaaaaggctgccgaattcaattctaacttgaatcgcgaacgtatggaagagcgaagagcgtacttcgatctgcaaacgcacgttatccaagtgccccaggggaaatataaagttctgcctaccgagcgcaccaaggtaagttcttaccccgttgctctgatccctggtcaattccaagagtactataagagatacagccccgacgagctacggtacctgcccctgaacacagcgctgtacgagccccccctggatccggaactcccagccctggactccgacggtgactccgatgacggagaggacgggcgcggcgacgagaagcgaaaaaacaagggaacaagcgattcctcatcaggaaacgttagcgaaggcgagtccccacccgattcacaggaagattctttccaaggccggcagaaatccaaagacaaggctgccacaccccgaaaggacggtccgaagcgaagcgttctgagtaagagcgtcccaggttataagcctaaggtgattcctaacgcaatctgcggaatctgtctgaagggcaaagagtctaacaaaaaagggaaggccgaaagccttatacattgctctcagtgtgagaactccggccacccgagctgtctggatatgacaatggaactggtgtccatgatcaaaacctacccctggcaatgcatggagtgcaaaacctgcatcatctgcgggcagcctcaccatgaagaggaaatgatgttctgcgacatgtgcgaccggggataccacactttttgtgtaggtttaggagccatccctagtggacgttggatttgtgattgctgtcagagggctcctcccacacccaggaaagtgggccggcgggggaagaattcaaaagaagggtag

SEQ ID NO: 128294 - DNA, 879 bp, Artificial Sequence
  Description of Artificial Sequence: Synthetic coding sequence
atggagaagagaacgtgcgcactgtgtcctaaggacgtggagtacaacgtcctttatttcgcccagagcgaaaatattgcagcacacgaaaattgtctcctctactcctccgggttggttgaatgcgaagatcaggatccactcaaccctgatagatcatttgatgttgagagtgtgaagaaggaaatccagcggggccgaaagctgaagtgtaaattctgccataagagaggagcaacagtgggatgcgacctaaagaactgcaacaagaattaccacttcttctgcgccaagaaagatgacgccgtgccacaatcggatggggttcgcggtatctataagctgttatgccaacagcacgctcagttccctattatagcgcaatccgctaaattttccggggtgaagagaaagagaggcaggaaaaaacctctgtcaggcaaccacgtgcagcctcccgagaccatgaaatgcaatactttcatccgtcaagtcaaagaggaacatggacggcacacagacgcgaccgtgaaggttccgttcctgaaaaaatgtaaggaagccggccttcttaactacttattggaggagatacttgacaaggtccacagcattccggaaaaactgatggatgaaaccacctcagagagcgactatgaagagatcggaagcgccctgttcgactgtcggttattcgaggataccttcgtaaattttcaggccgcaatcgaaaaaaagatccatgccagtcagcaacgatggcagcagctaaaggaggaaatcgaattgctccaggacctcaaacagacactttgttcattccaggaaaaccgcgaccttatgagctcttccacctcaatctcctccttgtcctattag

SEQ ID NO: 128295 - DNA, 996 bp, Artificial Sequence
  Description of Artificial Sequence: Synthetic coding sequence
atggctcaggcttcaccaccgagacccgagcgggttttgggagccagcagtcctgaggctcgccctgcccaagaagccctgctgttgcccaccggggtgttccaggtggcggagaagatggagaagcggacgtgcgcgctgtgcccaaaagacgtggagtataatgtgctttactttgcacaatcagagaatatcgccgcacacgaaaactgtttactttactcttcgggactggtggagtgtgaggatcaggatcctctcaaccccgaccgcagtttcgacgttgaatctgttaaaaaagaaatacagcggggcaggaagctgaaatgtaagttctgtcacaagcgaggcgcgacagtgggctgcgacctgaaaaattgtaataagaactatcactttttctgtgccaagaaagacgatgccgtgccccagtctgatggcgtgagaggcatttataaactcctctgtcagcaacatgcccagttccccatcatcgcccagtcagcaaaatttagcggtgtgaagcgaaagagagggaggaaaaaaccactgtcagggaaccacgtgcagcctccagaaacgatgaagtgtaatacgtttatcagacaggtcaaagaagagcacgggagacatactgacgctactgtgaaagtgcctttcctgaaaaagtgtaaagaggccgggctactgaattatctgctggaagagatccttgataaggtccactccattcccgagaaactgatggatgaaactacctctgaaagtgactatgaggagatcggatcagccctcttcgattgccgcctttttgaggatacattcgtaaattttcaagccgcgatcgagaagaaaatccacgcctcacagcagagatggcagcagctgaaggaggaaattgaattactccaggacctcaagcaaacactatgttcgttccaagagaacagggatttaatgtcatcatctacatctatctcgtccctctcttattag

SEQ ID NO: 128296 - DNA, 861 bp, Artificial Sequence
  Description of Artificial Sequence: Synthetic coding sequence
tagaggcccggtcctagggggtgcagcgcccctgctgcgagacgccccggcccccggaggagacgctcttcgtttccgccactgtactccagtggacttgtggagtgtgaggaccaagaccccttaaaccctgatcgtagctttgacgtggaatcagtgaagaaggagattcagagagggcgcaagctcaagtgtaagttttgccacaaacgcggcgcaacggtagggtgtgacttaaaaaattgtaataaaaactaccactttttctgcgctaagaaggacgatgctgttccccaaagcgacggagtgcgagggatttacaagcttctgtgccagcagcacgcccagttcccaatcatcgcacaatctgcgaagtttagcggcgttaagaggaagcggggcagaaagaaacctctgtcagggaatcatgtgcagcctcccgaaacaatgaaatgcaatacctttattaggcaggttaaggaagagcacgggcggcacactgatgctaccgtgaaagtgccgttcttgaaaaagtgcaaggaggccggactcctaaactacttactggaagaaatcctcgataaggttcacagtatacccgagaagctcatggatgaaaccacgagtgagtccgactacgaggaaatcggttccgccctgttcgactgcagactttttgaggacacgttcgtaaatttccaagctgccattgagaaaaagatccatgcgagtcaacaacggtggcagcagctgaaagaagagattgaactgctacaagatctgaagcaaactctatgttctttccaggaaaatcgagatctcatgtcaagcagtacatccattagcagcctgtcctattag

SEQ ID NO: 128297 - DNA, 507 bp, Artificial Sequence
  Description of Artificial Sequence: Synthetic coding sequence
atggagaagcgcacctgcgctctgtgccctaaagatgtcgagtacaacgtgttgtacttcgcgcagagcgagaacatcgccgcacacgagaattgcctgctttactcgagcgggttggtggagtgcgaagatcaggatcccctgaaccccgacaggtcatttgacgtagaaagtgtgaaaaaggaaatccagagaggacgtaaactcaaatgtaagttttgccacaagagaggggcgacagtgggttgtgatcttaaaaattgtaataagaattatcactttttttgcgcaaagaaggacgatgccgtgccacagagtgatggagttcgaggtatctacaaactcctgtgccaacagcatgctcagttccccataattgctcagtccgctaagttttcaggcgtcaaaagaaagaggggacggaagaagcctctttcggggaatcacgtccagcctccagagaccatgaagtgtaatacttttattcgccaggtcaaggaggagtag

SEQ ID NO: 128298 - DNA, 297 bp, Artificial Sequence
  Description of Artificial Sequence: Synthetic coding sequence
atggaaaagagaacttgcgctctctgcccaaaggatgtggagtataacgtcttatacttcgcgcaatctgaaaacatagcagcgcacgagaactgtctgctttatagctcagggctcgtcgagtgtgaagaccaggatcctctcaacccggacaggtcatttgacgtcgagtcagttaaaaaagagattcagcgaggtaggaaacttaagtgcaagttctgccataagagaggtgcgaccgtaggatgtgatctgaagaattgcaacaagaattaccattttttctgcgccaagtag

SEQ ID NO: 128299 - DNA, 879 bp, Artificial Sequence
  Description of Artificial Sequence: Synthetic coding sequence
atggagaaacggacctgcgcactttgccctaaagacgtggagtataatgtgctgtactttgcccagtctgaaaacattgctgctcatgaaaattgcttgctgtattcttccggcctagtggaatgtgaagaccaagacccccttaaccccgacagaagtttcgacgtggagagcgtcaaaaaggagatccagcgagggcggaaactgaaatgcaagttttgtcataaacggggcgccaccgtcggatgtgacttaaagaattgtaacaagaactatcactttttctgcgcaaaaaaggacgacgccgtccctcagagcgatggagttcgcggaatttacaagctgctgtgtcaacagcacgcgcaatttcctataatcgctcaaagcgcaaaattttccggtgtgaagaggaaacgcggaaggaagaagccattgtctggaaatcacgtacagccaccagaaacaatgaagtgtaatacttttatacggcaggttaaggaagagcatggaagacatacagacgcaaccgtcaaggtccccttcctgaagaagtgcaaggaggccggcctgttgaattacttgttagaggagatacttgacaaagttcattccatccctgaaaagctaatggatgagaccacctctgagtccgactatgaagaaataggctccgcactctttgactgcaggctgttcgaggacacattcgtaaactttcaggccgcgatcgagaagaaaatccatgccagccagcagcgctggcagcaactaaaagaggagattgagttattgcaagacctgaaacagaccttgtgttcctttcaggaaaaccgggaccttatgtcttcttccacctccattagttcccttagctactag

SEQ ID NO: 128300 - DNA, 624 bp, Artificial Sequence
  Description of Artificial Sequence: Synthetic coding sequence
atggagaaccgcgcattagatcctggaacccgcgactcttacggggcaacttcccatctaccaaataagggagcactagccaaagtgaagaacaattttaaggacttgatgagtaagctgacagagggtcaatacgtgttgtgcagatggacggacggactgtactatttaggaaaaattaaacgggtctcctcttccaaacaaagttgtttagtgacctttgaggataacagcaaatattgggtcttgtggaaggatatccagcatgcaggcgtgcccggggaagaacctaaatgtaacatctgtcttggtaagacgagcgggcctcttaacgagatcctcatatgcggtaagtgcggcctggggtaccatcagcaatgccatatacccattgcgggaagcgctgatcagcccttattaacaccctggttctgccgtcgctgcatctttgcactagcagtgagagttagtctgcctagtagccccgtccccgcaagtcctgccagctcgtccggagcagaccagcgcctcccaagccaaagcctgtcttccaagcagaaggggcacacatgggctctcgagacagacagcgccagcgccacggtgttgggacaggatctttag

SEQ ID NO: 128301 - DNA, 1743 bp, Artificial Sequence
  Description of Artificial Sequence: Synthetic coding sequence
atggaaaacagggccctggaccccggcactcgcgacagttacggggctacctctcatctgcctaacaagggggccctggccaaggtgaaaaataattttaaggatctgatgtctaagcttacggaagggcaatatgtgctctgccggtggacagacggactgtattacctgggaaagatcaagcgcgtcagcagttccaaacagagctgtttggtaacttttgaggacaactccaagtactgggttctatggaaggatatccagcatgctggggtaccaggggaggaacctaagtgcaatatctgtctcggcaaaacatctggacccctgaatgagattcttatttgcggaaagtgtgggttgggctatcaccaacagtgccatatcccaatagccggaagcgccgaccaacctttgctgactccttggttttgtcgcagatgcattttcgcactcgctgtcagaaagggaggggctcttaaaaagggcgctatcgcgaggacactgcaggctgtgaagatggtgttgtcctatcagccagaagagttagaatgggattctccccaccggacgaatcagcaacaatgctattgctattgcggtgggcctggggagtggtacctgcgaatgttgcagtgctacagatgccgacagtggttccacgaggcatgcacacaatgtctgaacgagcctatgatgttcggcgaccgattctatctgttcttctgttctgtttgcaatcaaggacctgagtacattgagagactgccactccgctgggtggatgtggtgcacctggccctttacaatctgggcgtgcagagtaaaaagaagtacttcgacttcgaagagatactggcgtttgtaaatcaccattgggaactgcttcaactcggaaagctgacatccactcctgtcactgacaggggtccacacttattgaatgcccttaatagctataaaagcaggtttttgtgcggcaaggagattaaaaagaaaaagtgcatctttcgcctccgcattcgagtgcctcctaatccccctggcaaactcctccctgacaagggtttgctgcccaacgagaactccgcttcatcagaattgcggaagagaggaaaaagtaagccgggccttctaccccatgaatttcagcagcagaaaagacgcgtttacagaagaaagcggtcgaagtttctgctagaggatgccattcctagttctgatttcacttctgcctggtccaccaaccaccacctggcatccatttttgattttactcttgacgagatacagtcattgaagtccgcttcatctggacagactttcttttccgacgtcgacagcaccgacgccgcatctacgagcggcagcgcaagtaccagtttgtcctatgatagccgctggacagtcggatcacgcaagaggaaactggctgctaaggcttatatgccactgcgcgccaaaaggtgggccgccgaactcgacggccgctgcccttccgacagctccgctgagggggcctccgtgcccgagaggccagacgagggcattgattcacacacctttgaatcaatctctgaggatgactcgtcactgagccacctcaaaagcagcataaccaattacttcggtgcagccggccgacttgcctgtggcgagaagtatcaagtgctggccagacgagtgacacctgaggggaaggtgcagtatctcgtagaatgggaaggtactacaccctattag

SEQ ID NO: 128302 - DNA, 1116 bp, Artificial Sequence
  Description of Artificial Sequence: Synthetic coding sequence
atgctgcagtgctaccgctgcaggcaatggttccatgaagcttgtactcagtgtctgaatgagcccatgatgttcggcgataggttctatctatttttctgctcagtgtgtaaccaagggccggagtatattgagcgcctgccactccgttgggttgatgtcgtgcacctggcactgtacaatctgggtgtccagagtaaaaagaaatactttgactttgaggagatcttagccttcgtgaatcatcactgggagctgctacagcttggaaagctgacatcaacccctgtaacagatagaggcccacatcttctgaatgctcttaacagctataagtctagatttctctgtgggaaagagattaagaaaaagaaatgtatctttaggctgcggatcagagtccctcccaacccaccaggcaaacttctcccagataagggcctgttaccgaatgagaactcggcgagttcggagctccgtaagagagggaaatctaaacccggactacttccccatgagtttcaacagcaaaaaaggagagtgtatcggagaaagcggtctaagttcctgctcgaggacgccataccaagcagcgactttacctcagcctggtccaccaaccatcatctggcctccattttcgatttcacccttgacgagatccagagcctcaagagcgcctcttctggccagaccttcttcagcgacgtagactcaactgacgcagctagcacgagtggtagtgccagcacctctctatcatacgatagccgttggaccgtgggctctaggaagcggaagctggccgccaaggcctatatgcctttgcgcgcaaaaaggtgggccgctgaactggacggaagatgtccaagtgactcctcagccgagggtgctagcgtgccagagaggccggatgagggaattgacagccatacgtttgagtctatatccgaggacgacagcagcttatcccatctcaagtctagcatcaccaattatttcggagccgcgggcaggctcgcctgcggggagaagtatcaagttctggccaggcgagtgacaccggagggaaaagtccagtacctggttgagtgggaggggacgaccccttactag

SEQ ID NO: 128303 - DNA, 501 bp, Artificial Sequence
  Description of Artificial Sequence: Synthetic coding sequence
atggaaaatagagcccttgatcccggcacacgcgattcttatggcgcaactagccaccttcctaacaaaggagcacttgcaaaggttaaaaataatttcaaggacctgatgtccaagctcaccgaaggtcagtatgtgctgtgcaggtggaccgatgggctctattatcttggtaagattaagagggtctcctctagcaaacagagttgcctcgttacctttgaagataatagtaaatactgggtactgtggaaagacatccagcacgctggtgtccccggtgaggagcctaagtgtaacatttgtctggggaaaacgtcaggacccttaaacgaaatcctcatctgcggaaaatgcggtctcggctatcatcagcaatgccacattcccatcgccggcagcgctgatcagcccctgctgacaccctggttttgtcggcgttgtatctttgccctcgctgtcagaaaaggcggcgccttgaagaaaggcgcaattgcgtag

SEQ ID NO: 128304 - DNA, 324 bp, Artificial Sequence
  Description of Artificial Sequence: Synthetic coding sequence
atggaaaaccgggctctggatccaggcacgcgggattcatatggagctacgagccatctgcctaacaagggtgctctcgctaaagtgaagaacaacttcaaggacttaatgtctaaactgacagaaggccaatatgtcctatgtagatggactgatggtctttactacctcgggaagattaagcgggtttcctcaagcaagcaaagctgtctggtgactttcgaggataacagtaaatactgggtcttatggaaggatatccagcacgccggggtgcctggtgaagaacccaaatgtaatatttgcttaggaaagacaagctag

SEQ ID NO: 128305 - DNA, 1692 bp, Artificial Sequence
  Description of Artificial Sequence: Synthetic coding sequence
atggagaatcgagcactggatcctggtactcgcgacagttacggcgcaactagtcatctgccgaataaaggcgcactggcaaaggtgaagaacaattttaaagatctgatgtcaaaactgaccgagggccaatatgtgctgtgtaggtggaccgacggcctctattacctaggcaaaatcaagcgggtttcctctagcaagcagagctgtctcgtgacatttgaggacaattcgaaatactgggtgttgtggaaggatatacaacacgcgggcgttcccggcgaggagcccaagtgcaacatttgccttggaaaaacatctggacctctaaacgagatattgatctgcgggaagtgcgggttgggatatcatcaacagtgtcatattcccatcgccgggtcagccgaccagcctctcctcacaccctggttctgccggaggtgcatttttgctcttgccgtgcggaaggggggagctctgaagaagggcgcaattgcccggactctccaagcagtgaaaatggtactgtcctaccagccagaggaactcgaatgggactctccccatcgcacaaaccagcagcagtgctattgctattgcggggggccaggtgagtggtacctgaggatgcttcagtgttacaggtgccgtcagtggttccatgaggcgtgcactcaatgcttaaacgagcccatgatgttcggcgaccggttttatctgtttttctgttcagtgtgcaatcaaggccccgagtatattgagcggctgccactgcgttgggtcgacgtggtccacctcgcgctgtacaacttaggtgttcagtctaaaaaaaagtactttgattttgaggaaatcttagccttcgttaatcaccattgggagctattacaactcggcaagctgacaagcacacccgtgacggaccgcggtccccaccttttgaatgccttgaacagttacaagtcccgattcctgtgtgggaaagaaatcaaaaagaagaagtgcatatttcgtctcagaatcagagtgccgcccaacccccctgggaagctgctgcctgataaaggattgctgccgaacgagaactctgcatcctctgagctgcgaaagcggggcaaaagcaaacccggactcctgccccacgaatttcagcaacagaaaaggagggtgtacaggagaaaacgcagcaagtttctgttagaagatgcaattcctagttctgactttacatccgcgtggtcaacaaaccaccatctggctagtatcttcgatttcacactagatgaaatccagtctcttaagtccgcttctagcgggcagacttttttcagcgacgtggactctaccgacgcggcctctacatcaggctctgccagcacgagcctctcttacgatagccggtggacggtgggttcccgcaagcgcaaattggccgccaaggcctacatgccgctccgtgcaaagcgatgggcggctgaactggacggacgctgcccttcggatagctcagctgaaggggcatcagttcctgaacgtccagacgaggggattgactcacataccttcgaatctatatcagaagacgatagttcgctatcccatctcaaaagctccatcacgaattactttggcgctgccgggagattagcatggggtgaagtgcccggcgtgggcagtgagggacacacctag

SEQ ID NO: 128306 - DNA, 3291 bp, Artificial Sequence
  Description of Artificial Sequence: Synthetic coding sequence
atggccaccgttcctgtttactgtgtgtgcaggctgccttacgatgtaacacggttcatgatcgaatgcgacgcttgtaaagactggttccacgggtcttgcgtgggtgttgaggaggaagaggctcccgatatcgatatctatcactgccccaactgcgaaaagacccacggaaaaagcacattaaagaaaaagaggacctggcacaagcacggccccgggcaggcccctgatgtgaaacccgtccagaatggctcccagctgtttatcaaggagctaaggtcaagaacctttccatcagcagaggacgttgtggccagggtaccaggaagccagttgacactcggttacatggaagagcatggattcaccgaacccatactggtgccaaaaaaagacgggctgggtctcgcggtgccggcccccacattctacgttagcgacgtggaaaattacgtaggcccagaacggagcgtggatgtgaccgacgtaacgaagcaaaaggattgtaagatgaagctgaaagaattcgttgattactattactccactaacagaaagcgcgtactaaacgtgaccaaccttgagttcagtgacacccgaatgtcgtcctttgtggaacctccagatatcgtgaagaaactctcatgggtcgagaattattggcccgatgatgcacttctcgcgaagcccaaagtgaccaaatattgcctgatatgtgtgaaagacagttacactgatttccacattgacagtgggggtgcatccgcctggtatcacgtactgaaaggagaaaagactttctaccttattagacctgcttctgcaaatatttctctatatgaacgatggcgctccgcatccaatcactccgagatgttctttgctgatcaagtggataagtgctacaaatgcatcgtaaaacaaggtcaaaccctctttatcccctcagggtggatctatgccacactgactcctgttgattgcctcgcattcgccggacactttttacactctctcagtgtggagatgcagatgcgcgcttacgaggtggagcggcggctgaagctaggatccctaacacagttcccaaacttcgaaaccgcttgttggtacatgggaaagcatttgctggaggcctttaaggggtcccacaagtcaggcaagcaactccctccgcacctggtgcagggagccaaaatactgaacggggccttccgaagctggacaaagaaacaagctctggctgaacatgaggacgaactgcccgaacacttcaagccgtctcagctgattaaagatctcgctaaagaaattcgattatccgaaaatgcctcgaaagctgtgagacccgaggtgaacaccgtggcttccagtgacgaagtatgtgatggcgatagggagaaggaggagcctccctcacctattgaagccaccccaccgcagtcactgttggagaaagtcagcaaaaaaaagactcctaaaacagtgaaaatgccgaaaccctccaagatccccaagccacctaagccccccaagccgccccggccgcccaagacactcaagcttaaggatggaggcaagaagaagggaaaaaagagtagggagtccgctagccccacgatccccaatctggacctcttagaagctcacaccaaggaagcactaaccaagatggagccccccaaaaagggcaaggccaccaaaagcgttttatcagtgcctaataaggatgtcgtgcacatgcagaacgacgtagagaggttagaaattagggagcaaacaaaatccaagtctgaagcgaagtggaaatataaaaatagcaaacctgattcactgctgaaaatggaggaggagcagaaactcgagaagtcccctctggcgggtaacaaggataataagtttagtttctccttctccaacaaaaaactgctgggatcgaaggcactgagacctcccactagtcccggcgtttttggtgctctgcagaattttaaagaggacaagcctaagcctgttcgagacgagtacgaatacgtaagtgacgacggcgagttgaaaattgatgaatttcccatcagacgaaaaaaaaatgcgccaaaacgcgatctgtccttcttactggacaaaaaagctgtgttgcccacacccgtcactaaacccaagctagactccgcagcctacaagagcgacgactcctcagacgaaggctccttacatattgacacggatacgaagcccggacggaacgctcgcgtcaagaaggagtctggcagtagcgccgctggaatactagatcttcttcaggcctccgaggaggtgggtgcattggagtacaatccgtcatcccagcccccagccagtccatccactcaagaggcaattcaaggtatgctctctatggcaaacctgcaggcctcagattcatgcctgcagacaacttggggggcggggcaagctaaaggttctagcttggcagcgcacggggccaggaagaatgggggcggttcagggaaatcggcggggaagaggttgctgaaacgcgcagcaaagaactcagtggacttggatgactatgaagaggagcaggatcatctggatgcatgctttaaagattccgattatgtctacccgagcttggagtccgacgaggacaatcccatttttaagagccgttccaagaaaagaaaaggcagtgacgatgcgccatactcccccaccgcaagggtaggccccagcgtgccgcggcaggatcggccagtaagagagggcactcgggtggccagtatcgaaaccggccttgccgccgctgcagcgaagctgtcacagcaggaagagcaaaaatcaaaaaaaaaaaagagtgccaaaagaaagctgactcccaacacaactagccctagcacctcaacctcaatctcagccggcaccacctctacatccaccacacctgctagtaccaccccagccagtaccacccccgcaagcacgtctaccgcaagttctcaggcatcccaggagggcagctcacctgagccccctcctgagagccattccagctcgcttgcggaccatgaatacacggcagccggcacatttacgggcgctcaggcagggcgcacctctcaaccaatggcaccaggagtcttcttaacccagcgtcgacccagtgcctcatcaccgaacaataataccgccgccaaaggcaaacgcactaaaaaaggaatggccacagcaaagcagcgccttggaaagatcctcaagatccacaggaatgggaaactgctgctctag

SEQ ID NO: 128307 - DNA, 984 bp, Artificial Sequence
  Description of Artificial Sequence: Synthetic coding sequence
atggcaactgtccccgtgtactgcgtttgcagactcccctacgacgttacccgttttatgattgaatgtgacgcttgtaaggactggttccatggctcctgtgtaggtgtagaggaggaggaagccccagacatcgacatttatcactgtccaaattgtgagaaaacacatggaaagtcgactctaaaaaaaaaacgtacctggcataagcacgggcccggccaagcgccagatgtgaagccgaagaactctgtggatctcgatgactatgaggaagaacaggaccacctggacgcctgctttaaggattcggattacgtgtaccccagcctggaatcagacgaagacaatcctatttttaaatccaggtccaaaaagcggaaaggctccgatgacgctccatattccccaacagcgagagtggggcctagcgtgcctcgccaagaccggccagttcgggaaggcacgcgcgtggcaagcatagaaacgggcctggctgccgccgccgccaaactctctcagcaggaggagcagaagagtaagaaaaaaaaatcagctaagcgtaagttgacacctaacacaacctccccctccacgtcaacttcaatttccgcggggacaacatctacctctactaccccagcttcaaccactccagcttccacaacacccgcatctacatcaacagcttccagtcaggcttcacaggagggtagcagccctgagcctccccctgagtcccactcatcgagccttgccgatcacgagtacacagcagcaggtacgtttactggtgcccaagccggccgcaccagtcaacccatggcgcccggcgtgtttctgacacaaagacggccatcagcgagttctcccaataacaataccgctgcaaaagggaagcgaactaaaaaaggaatggctacagcaaagcagcggctgggaaagattctcaagatccacaggaatgggaaactgctcctgtag

SEQ ID NO: 128308 - DNA, 2046 bp, Artificial Sequence
  Description of Artificial Sequence: Synthetic coding sequence
atggaactccaaaccctgcaggaggcactgaaggtcgagattcaggtccatcagaaattggtggctcagatgaaacaggacccccagaacgccgacctgaagaagcagctacacgaactgcaggccaaaattaccgcactttctgagaaacagaagcgagtcgtggaacagctgcggaagaatctgatcgtgaagcaagaacagcccgacaagttccagatccagcctctccctcaaagcgagaacaagctccagacagcacagcagcaaccgttacagcagctgcaacagcaacagcagtaccaccatcatcatgcccaacagtctgctgccgcatcacccaacctcacagcaagccagaaaaccgtcacgaccgcttctatgatcaccacaaagactctgcctctggtgctgaaagcggccactgccaccatgcccgcctccgtggtgggccagcgcccaaccatagctatggtcaccgccatcaactctcagaaggctgttctttccacagacgtgcagaacacgcctgtcaatcttcaaacatcgtcaaaggtgactggtccaggggctgaggctgtgcagattgtcgccaagaacaccgttacgcttcaggttcaggctactccaccacagcccatcaaagttcctcaatttatcccccccccccggctgacgccccgcccaaactttctcccgcaggttagaccgaagcccgtcgctcagaacaatattcccatcgcgccggcccctcccccgatgctcgcggccccccagttgatccagcgtccagtgatgctgaccaagtttacacctacaaccctgcctacgtcgcagaattccatacacccagtgcgcgtggtaaacggccagaccgctacgatcgccaaaaccttcccaatggcacaacttacctcgatcgttattgctacacccggcaccagacttgctggaccccagacggtgcagctcagcaagcccagtttagagaagcaaaccgtcaaatcgcataccgaaacagacgaaaagcagaccgagtctaggacgattaccccaccagccgctcccaagcccaaacgagaagagaatccccagaagctagcctttatggtgtctctggggctggtgacccatgaccacctggaggaaatccagagcaaacgtcaggagagaaaaaggaggaccactgcaaaccccgtctattcaggagctgtgtttgaacccgagcggaaaaagagtgcagtgacctatctgaacagcactatgcatcccggcactagaaaacgcggaagaccccctaaatacaatgctgtactaggtttcggtgcactgacccctacttctcctcagtcatcccatccagattcccccgagaacgagaagacggagacaaccttcacattccctgctcctgtgcagcccgtgtctctcccatcccccacttccacggacggggatatacacgaggatttttgctctgtgtgtcggaagtcaggccaactgctgatgtgtgacacgtgcagtcgtgtgtatcatctggactgcctcgatcctccccttaaaacgatccccaaaggcatgtggatctgccctcgctgtcaggatcaaatgctaaagaaggaggaggcaatcccctggcctggtaccctcgctatcgtgcactcttacatcgcttataaggctgctaaggaagaggagaagcagaagcttctgaaatggagtagtgatttgaagcaggaacgagagcaactggagcagaaggttaaacaactgtccaactctatctccaaatgcatggagatgaagaacacaatcctggctcgtcagaaggagatgcactccagcctcgagaaagtaaagcagctcatccgtctgatccatggcattgatctgtccaagcctgtggattctgaagctacagtcggtgctattagtaacggaccggactgcactcctcctgccaacgcggccactagcacgccagctccctccccctcaagccagtcctgcactgctaattgtaaccaaggcgaagagactaagtag

SEQ ID NO: 128309 - DNA, 1905 bp, Artificial Sequence
  Description of Artificial Sequence: Synthetic coding sequence
atggagctccagacgttgcaagaggccctcaaggtcgaaatacaggtgcaccaaaagttagttgcacagatgaaacaggacccacagaatgccgatctaaagaagcagctgcacgagctccaggccaaaattactgcactgtccgagaaacagaaacgagttgtcgagcagctaaggaagaacttaatcgtcaagcaggaacagcccgacaagttccagattcaacctctgcctcaaagcgagaataagctgcagacagcccaacagcaaccgctgcagcagcttcaacaacagcagcaataccaccaccatcatgcacagcaaagcgccgccgcgagtccaaacctgacagcaagccaaaagactgtgaccactgcatccatgattaccacgaaaacactgcccttagtgctgaaggcagccaccgccaccatgcccgcctcagttgtggggcagcgccctacaatcgctatggttactgcaatcaatagccagaaagcggtgctgtcgactgatgtgcaaaacactccagtgaacttgcagacctcctcaaaagtgacgggccctggggccgaagcagtccagatcgtcgccaagaatactgttacactccaagtccaggccactccacctcagccaataaaggttccacagtttataccacccccgaggctcacacctcgtccaaattttctgccccaggtccggcctaaacccgtcgctcagaacaacatcccaatagcccctgctccacctccaatgctggccgctcctcagctgatccagcgcccagtaatgttgactaagttcacccctaccactctccctacgtctcagaattctatccatcctgtgcgggtggtgaatggccagaccgccactattgcaaaaacttttccaatggctcaactgacctctatcgtaatcgcaacaccgggtaccaggcttgctggcccccagacggtacaactctctaagccatcacttgaaaagcaaacggtgaagagtcataccgagacggatgaaaagcaaacggaaagccgaacgatcacgccacccgccgcacccaagccaaaaagagaagagaacccccagaaacttgcatttatggtgtcactgggcctagtaactcatgatcatctggaagaaatccagtccaaaaggcaggaacgcaagcgacggacaactgccaatccggtttacagcggcgccgtcttcgaacccgaaagaaaaaagagtgccgtcacctacctaaactccaccatgcaccctggcacaaggaagcgcgctaacgaggagcactggcccaaaggggatatccacgaggacttctgtagcgtgtgcagaaaatccggccagctcctgatgtgcgatacatgtagccgggtgtaccacctggactgcctggaccctcccttgaagacaattcctaaaggaatgtggatctgtcccaggtgccaggatcagatgttgaagaaagaggaagccatcccatggcccgggactctagctatcgtgcacagctacatcgcatataaggccgccaaagaagaggagaaacagaagctactcaaatggagcagtgacttaaaacaggagagagagcagctcgagcaaaaagtgaagcagttatccaacagcatttctaagtgcatggagatgaagaacactatcctcgctcgacaaaaggagatgcacagttctcttgagaaggtgaagcaacttatcaggctcattcacggtatcgatttgtcaaagcccgtggattctgaggcaaccgtcggggccatcagcaacggtccagattgtacacctcctgctaatgcagcaactagcacacccgctccttcgccttctagccagtcttgcacagccaattgtaatcagggggaagagactaagtag

SEQ ID NO: 128310 - DNA, 2043 bp, Artificial Sequence
  Description of Artificial Sequence: Synthetic coding sequence
atggagctgcagactctccaggaggctctcaaagtggagatccaggtccatcaaaagctcgtcgctcagatgaaacaggaccctcagaacgccgatcttaaaaaacaacttcatgaacttcaggctaagatcaccgctttgagcgaaaaacaaaaacgagtggtggagcaattgcggaagaaccttattgtgaagcaggagcagcccgataaatttcaaattcaacccttgccccagagtgagaataagctccagacagcgcagcagcagcctctccagcaactgcagcagcaacaacagtaccaccatcaccacgcccaacagtccgcggccgcttctccgaaccttacagcatctcagaagacagtaaccactgccagtatgataacaacgaagacccttcctctcgttctgaaggccgccacagcaactatgcctgctagtgtggttgggcaacggcctaccattgccatggtgacggccattaacagtcaaaaggccgtgctgagtactgatgtgcagaacaccccagtgaacctgcagacaagttctaaggtcacggggccaggagcggaggccgtgcagatcgttgcaaagaatactgtgactctagtgcaggccactcccccccagcctataaaggttcctcaatttatccccccacctaggctgacacctcgacccaattttctgccccaagtgcggcctaaacctgtggcacagaataacatacctatagccccagccccacccccaatgctggccgccccacagctaattcagagacctgttatgctcaccaaatttacacctaccactctgccgacatcacagaactctatacacccagtgagagtggtgaacgggcagaccgcgaccatcgctaagaccttccctatggcccagttaacatctattgtgattgccacccccggaaccaggttggccggcccccagacagtgcagttgtcaaagccctccctggaaaaacagacagtcaagagtcatacggaaaccgatgagaagcagactgagagtaggactatcacccctcctgcggctcccaagcctaagagggaagagaacccacaaaagctagccttcatggtttcgctcggtcttgttacacacgaccacttagaggagatacagtcaaagaggcaggagcgcaagcgtcgaactaccgccaatccggtctattccggggcagtgttcgagcctgagagaaagaagtccgcagtgacctacctgaattccactatgcaccctgggacccgtaagcggggaaggcccccaaaatacaatgcagttctcggatttggcgctctgacccctacttcacctcagagcagccatccagacagcccagagaacgaaaaaactgagacaaccttcacttttcctgcccctgtgcagccagtgagcctgccctctcctacaagcacagacggcgacatccacgaggatttctgtagcgtgtgccgcaagagcggccaactactgatgtgtgacacctgcagtagagtgtaccacctggactgcctggaccctcctctcaagacaattcctaagggaatgtggatctgcccaaggtgtcaggaccagatgcttaagaaggaggaggcgattccgtggcctgggactcttgcaatcgtccacagctacattgcctataaggccgccaaagaggaggaaaagcagaaactattaaaatggtcatccgatctcaagcaagagagagaacagctggaacagaaagtgaaacagctgtcaaattccatatctaagtgcatggagatgaagaataccattctggcgcggcaaaaggagatgcacagttcattggagaaggtcaagcagctgatacgcctgattcatgggattgacctcagtaaacctgtggactctgaagccaccgtcggcgccattagcaacggtcccgactgcacgccccccgccaatgcagccacctcaactcccgcgccaagcccttcctcccagtcttgcacagctaattgtaaccagggcgaggaaactaagtag

SEQ ID NO: 128311 - DNA, 81 bp, Artificial Sequence
  Description of Artificial Sequence: Synthetic coding sequence
atggaacttcagaccctgcaggaagccttgaaggttgaaatccaggttcatcagaaacttgtggcacagatgaaacagtag

SEQ ID NO: 128312 - DNA, 36 bp, Artificial Sequence
  Description of Artificial Sequence: Synthetic coding sequence
atggagctgcagacactccaggaggccctaaaatag

SEQ ID NO: 128313 - DNA, 306 bp, Artificial Sequence
  Description of Artificial Sequence: Synthetic coding sequence
atggagctccagacactccaagaagcgctgaaagtggaaatccaggtccaccagaagctcgtcgcccaaatgaagcaagatccacagaacgctgatctgaaaaaacagctccatgaactacaggctaagatcactgccttaagcgaaaagcagaaacgcgtggtggaacaattaagaaaaaacttaattgttaagcaggaacagcctgataagttccagatacaaccactgccccagtccgagaacaaacttcagaccgcccagcagcagcctcttcaacagctacagcagcagcagcagtattag

SEQ ID NO: 128314 - DNA, 30 bp, Artificial Sequence
  Description of Artificial Sequence: Synthetic coding sequence
atggaactgcaaaccttacaagaggcctag

SEQ ID NO: 128315 - DNA, 156 bp, Artificial Sequence
  Description of Artificial Sequence: Synthetic coding sequence
atggagctccagaccttgcaagaggcgctcaaagtggagatccaagtgcaccagaaactggttgcacagatgaagcaggatccgcagaatgccgacctgaaaaagcagctgcacgagcttcaggctaaaataaccgcattaagtgagaagcagtag

SEQ ID NO: 128316 - DNA, 477 bp, Artificial Sequence
  Description of Artificial Sequence: Synthetic coding sequence
atgcttgaggctatggcggagccaagccctgaagatccaccgcctacattaaaaccggaaacccaaccgcccgaaaagcggcggcgaaccatcgaagacttcaacaagttttgcagttttgtgttggcctatgcaggatacatcccaccatctaaggaagagtctgactggcccgccagcggctcttcttctcccctcagaggcgagagcgccgctgactctgatggttgggactctgcaccatccgatctgcggaccatccagacattcgtgaaaaaggcaaagtcctccaagcgcagggctgctcaagcaggaccaacccagccgggccctccccgctcaacattcagtcgtcttcaggcgcccgatagcgctactctgctggagaagatgaaattaaaggattcgttgttcgatttagacggccccaaggttgcatcccccctcagtccaccttgcgcagccaacactccatag

SEQ ID NO: 128317 - DNA, 1212 bp, Artificial Sequence
  Description of Artificial Sequence: Synthetic coding sequence
atgctggaggctatggctgagccatccccagaggacccaccccccactctgaagccagagacacagcctccagagaagcgcagacggactatcgaagattttaacaaattctgtagctttgtgctggcctacgccggttatatcccaccctctaaagaggagtccgattggcctgcttctggttcctcttctccactgaggggagagtcggctgccgattcagacggatgggactccgcaccctcagatctcagaacgattcaaacctttgttaaaaaggcaaagagttcaaaaagacgcgcggcgcaggctgggccaacccagccaggccctcctaggagtacattctctagactccaggctcccgacagtgctacattattggagaagatgaaactcaaagattccctctttgatttggatggacccaaggtggcttctcccttatcaccaacgagccttacccatacctcccggccacccgctgctcttacacccgtacctttgtcgcaaggggatctgtcccatccaccacgcaagaaggatagaaagaatagaaagctcgggcctggcgctggcgccgggtttggcgttttgcgcagacccaggccaacgccaggcgacggagaaaaaaggtcacggatcaaaaaatcaaagaagaggaaattaaagaaggcagagcgcggcgaccggctgccccccccgggccctccacaggcgccaccatcagacaccgattccgaggaggaggaagaggaagaagaggaagaagaagaggaggagatggcaaccgtcgtgggcggagaagcacccgtgccagttttgccaactccaccggaggctccaagaccacctgctacggttcaccctgaaggggtgcccccagctgactctgagtccaaagaggtggggtctacagagacctcgcaggacggagatgcctcatccagcgagggcgagatgcgcgtcatggacgaggatatcatggttgagagcggtgatgacagttgggatttgatcacctgctactgtaggaagccttttgctgggcgtcccatgatcgaatgtagtctgtgtggcacctggatccatctctcatgtgctaaaattaagaagaccaatgtgcctgacttcttttattgtcaaaagtgcaaggaactcaggccagaggcaagaagactaggagggccacccaagtccggagagccctag

SEQ ID NO: 128318 - DNA, 1200 bp, Artificial Sequence
  Description of Artificial Sequence: Synthetic coding sequence
atgcctggggactgtcgccgtgatccaccacctaccctcaaaccagagacgcagccccctgagaaacgaaggaggactatagaagacttcaataaattttgcagcttcgtcctggcttatgcaggctacattcctccctccaaagaggagagcgattggcctgcatctggcagctctagcccacttcgcggagaatccgctgccgactccgatggttgggactcagcgccgtcggaccttcgaacgattcaaaccttcgtgaaaaaggctaaatcttccaaacgccgagctgcgcaggcggggcccactcagcctgggcctccgaggtctacatttagccgtttgcaggccccggattccgccacgttgttggagaagatgaagctcaaggattccctgttcgatctagatgggccgaaggtcgcctcccctttgtcacccacttcacttacccatacttccaggccccctgccgccctcacacctgtgcctctatcccagggagatctctcacaccctcctaggaagaaagatagaaaaaacagaaagctgggtccaggtgccggagcaggctttggagtgctgaggcgaccgcgcccgacaccgggggatggggagaaaagatctagaatcaaaaagagtaagaaaagaaagcttaagaaagcagaaaggggtgacagactgccccctccaggcccgcctcaggcccctccaagtgatacagattctgaggaagaggaggaggaagaggaagaagaggaagaggaagagatggccacagtcgtaggcggcgaggcaccagttcctgttctcccaacccctcctgaggcacctcgacccccagcaacggttcaccccgaaggagtccctccggctgattccgagtctaaggaggtggggtccaccgaaaccagccaggacggagacgcttcaagttccgagggggaaatgagggtcatggatgaggatatcatggtggagtcaggtgacgatagttgggacctcattacgtgttactgtcgcaagccctttgcgggccggcctatgattgagtgttcattgtgtggcacatggatccacctgtcctgcgctaagattaagaagaccaatgtgcctgactttttctactgtcagaagtgtaaagagctgcggcccgaagcccggagactcgggggccccccaaagagtggggagccttag

SEQ ID NO: 128319 - DNA, 6120 bp, Artificial Sequence
  Description of Artificial Sequence: Synthetic coding sequence
atggacattgtggacaccttcaaccatctgattccaactgaacacctcgatgatgctctattcctgggctccaatctggagaatgaggtctgtgaggatttcagcgcatcccaaaatgtgctggaggactctttgaaaaatatgttgtccgataaagacccaatgttggggtctgctagcaaccagttctgtctgcctgtgctggattctaacgaccccaattttcagatgccttgctcaaccgttgttggcttagacgacataatggatgaaggggtggtgaaggaatctggaaatgacaccatcgatgaggaggaactcattttgcccaatcgtaacctgcgcgacaaagtggaggaaaactccgtgcggagccctcggaaaagcccaaggctcatggcgcaggaacaggtgcgttccctgagacagtctacgattgccaagcggtcaaatgcggcacctcttagcaacaccaaaaaagcttctggaaaaactgttagcacggcgaaagctggagtgaagcagccggaaagatcacaggtgaaggaggaggtgtgcatgtccctgaagccagaataccataaagagaataggcgatgctctcgtaatagtggccaaatcgaggtcgttcccgaagtcagcgtctccagtagccactcatctgtgtcctcttgcctcgaaatgaaggatgaggatggtctggactccaagcacaaatgcaacaatcctggggagatcgatgtgccttcccacgaattgaattgctctctcctgtctgagacctgtgtgaccataggagaaaaaaagaacgaggctcttatggagtgcaaagctaaacccgttggaagtccattattcaagttctccgacaaagaagagcatgaacaaaatgacagtatatcaggcaagaccggtgagacagtggttgaggagatgattgccacacgtaaggtcgaacaagactctaaggaaacagtgaagttgtcgcatgaggacgatcatatcctggaagatgccggatctagtgatatatcttcagatgccgcatgcacaaatccaaataagactgaaaatagcttggtgggtttgccaagctgtgtcgacgaggtgacagagtgtaacttggaactcaaggacaccatgggcattgcagacaagaccgaaaacactcttgagcgcaataagatcgagccactcggctattgcgaggacgccgaatctaaccggcagcttgagtctaccgagttcaacaagtcaaatctggaagtagttgatacctctacctttggacccgagagtaacatcttggaaaatgctatctgtgatgtgccagatcagaatagcaaacagctgaacgctatcgagtcaaccaagattgagtcccacgagacagctaatctgcaggacgaccggaattcccagagctctagtgtgtcttatctggaatctaagtccgtgaagtccaagcatactaaacccgtaattcacagcaaacagaacatgactactgacgccccaaagaagatcgtagccgccaaatatgaggtgatccactccaagaccaaggtgaacgttaaatccgtgaaacggaacaccgatgtcccagagtcccagcaaaacttccatagacccgtgaaggtacgaaaaaagcagattgacaaggaacccaaaattcagtcctgcaattccggggttaaatccgtaaaaaaccaggcgcacagcgtcctcaagaaaacactgcaggaccagacactagtacaaatatttaaaccgctgacacattccttgtcagacaagtcacatgctcacccgggatgtctgaaagagccacatcacccagcacagactggccacgtcagccatagctcacagaagcaatgtcataagccccagcagcaggcgccagcgatgaagactaacagtcatgtgaaggaggaattggaacatccaggggtagaacactttaaggaagaggacaaacttaagttgaagaaacctgagaagaaccttcagcctagacagcgcaggtcctctaagtccttttcactggatgaaccaccgctgtttatccctgacaacatagccacaatccgacgtgaaggctcagaccactcctcttcattcgagtccaaatatatgtggacaccaagtaagcagtgcggtttctgtaaaaagccgcacggtaacaggtttatggtgggctgtggtcgatgtgacgactggttccacggcgactgtgtgggcctctccttatcccaggcgcagcagatgggagaggaggataaggaatacgtgtgcgtcaagtgctgcgcagaagaagacaaaaaaacagagatactcgacccggataccctagaaaatcaggctactgtcgagttccactctggcgacaagaccatggaatgtgagaagttgggtctctccaagcatactacaaacgatcgtaccaagtacatcgacgacacagttaagcataaagttaagattttaaagagggagtccggtgaagggcgcaactcaagcgactgtagagacaatgaaatcaaaaaatggcagttggctcctctcaggaagatggggcagccagtactgcctagacgaagctcggaagagaagagcgaaaaaattcccaaggagtctaccacagtgacttgcacaggagagaaggcaagcaaacctggtacgcacgaaaaacaagagatgaagaagaaaaaggtcgaaaaaggagtgttgaacgttcaccctgcagccagtgcttcgaagcccagcgcggaccagatcaggcaaagcgtgcgacactccctgaaagatatactcatgaagaggctcacagatagcaatctgaaggtgcctgaggaaaaagctgcaaaagtcgccacaaagatcgagaaagagctgttctctttttttcgcgatacagatgccaaatacaagaacaagtatcgtagcctcatgttcaatctcaaagatccaaagaacaacatcctgttcaaaaaggtgctgaaaggggaggtgacacccgaccacctcatcagaatgtccccagaggagctggcgtcaaaagagttagctgcatggcggcggagagaaaacaggcataccatcgaaatgattgagaaagagcaacgcgaagtagaaaggcgccccataaccaaaattacccacaagggcgagattgaaatagagagcgatgcacctatgaaggagcaagaagccgccatggagatacaagagcccgctgccaacaagtccttggagaaacctgaaggatccgagaagcaaaaggaagaggtggactctatgtctaaggacacaacgagtcagcataggcagcatctttttgacttgaactgtaagatctgtatcgggcggatggcccctcccgtggatgacctcagtccaaagaaagtcaaggtcgtggtgggtgtagctcgaaagcatagcgataacgaggccgaatcaatcgctgacgcattgtcttccacctcaaacatcctggcttcggagttctttgaggaagagaaacaggagagcccgaaaagtactttttcacctgccccacgcccggaaatgccaggaacggttgaggttgagtcaacattcctggcgcgtctgaatttcatctggaaaggctttatcaacatgcccagcgtcgctaagtttgttacaaaggcatatcccgtatcaggatcccctgaatatctaacagaagacctccctgatagcatccaggttggagggaggattagtccccagactgtctgggactacgtagagaaaattaaagcctctgggaccaaagaaatctgcgttgttaggtttaccccagtgactgaggaagaccagatttcttataccctactgtttgcctattttagttcccggaagcggtatggcgtagccgcaaacaatatgaagcaagtgaaagacatgtacctcattccgttaggagccacagacaaaatcccccaccccctcgtcccgtttgacggacccggcctggagctccataggccaaacctgttgttagggttgattatacgccaaaaactgaagcggcaacacagcgcgtgtgccagtacttctcacattgctgaaaccccagagtctgccccaccgattgccctccctcccgataagaaaagcaagatcgaagtgtctacggaagaggcccctgaagaggagaatgattttttcaatagcttcacaactgttttacacaagcagcgtaacaagccgcagcaaaatctccaagaagacctgcctactgctgtagaacccctgatggaagttaccaaacaggaaccgccgaagcccttgcgatttctgcctggtgtgcttataggttgggagaaccagccgaccactctagagctcgcaaataaacccctgccagttgacgatattctccagtccttgctaggtacgactggacaggtgtacgaccaggcccagagtgttatggagcagaatacggttaaagaaattccgttcctgaacgaacagaccaattccaaaattgagaaaactgataacgtagaggttaccgacggcgagaataaagagattaaagtaaaggttgacaatatctccgaatcaaccgacaaatcggctgagatagaaacttccgtggtagggtctagtagcatcagcgccggcagccttacttcactgtcactgagaggtaagccgcctgacgtgtcaacagaggcatttctaaccaatctgtccattcagtccaagcaggaagaaacggtggaaagcaaagaaaagacgctgaagcggcagctgcaggaggaccaggagaacaatcttcaggataatcaaacctccaattcctcaccatgtcggtccaatgtggggaaaggcaatatcgatggcaatgtgtcttgttctgaaaacctggtcgcgaataccgctaggtctccacagttcataaatttgaagagggacccgcgacaggcagcagggagatcacagccagtgaccacttccgagtcaaaggacggcgactcttgcagaaacggagaaaagcatatgctgcccggcttaagccacaataaggagcacttgacagaacagataaatgtcgaggagaagctctgtagtgccgaaaagaactcgtgcgtgcaacagagtgacaatctgaaggtggcccaaaattctccttcagtggagaacattcagacgtcccaggccgaacaggcaaaaccactgcaggaagacatattgatgcaaaatattgagactgtgcatccgtttagaagagggtcggctgtggcaacctctcatttcgaggtagggaacacatgtccttccgaatttccatcaaagtccatcacatttacttctagatctacgtcccctcgcacatctacaaacttcagtcccatgcgcccccagcaaccaaatctgcagcatctgaagtccagcccacctggatttccctttcctggacctcccaactttccccctcagtctatgtttggattccctcctcatctaccacctccactgctaccccccccgggcttcggctttgctcagaaccccatggttccctggccccctgtcgtgcacttgccaggccagccccagagaatgatggggcccctgtctcaggcaagtagatatattggaccccagaatttttaccaggtgaaagatattcggaggccggagagaaggcactctgacccgtggggcagacaggaccagcagcagttggacaggccatttaatcgcgggaaaggtgaccgccagcgattctactctgactctcatcaccttaagcgggagaggcatgaaaaggagtgggagcaggaatccgagagacatagacggcgcgaccgaagtcaggacaaagaccgcgatagaaagtctcgggaagaagggcataaagacaaggaaagagcgcgcttgtcacatggggaccggggaaccgacggcaaagccagtcgcgatagtcggaacgtggacaagaaacctgataagccaaaaagcgaagattatgagaaggacaaggagcgggagaaatcaaagcatcgagaaggggaaaaagaccgtgatagatatcataaagatcgtgatcatacggatagaaccaagtccaaaaggtag

SEQ ID NO: 128320 - DNA, 6120 bp, Artificial Sequence
  Description of Artificial Sequence: Synthetic coding sequence
atggatatcgtcgacaccttcaaccatcttatccccaccgaacacctagatgatgccctcttcctgggaagtaacctcgaaaacgaggtttgcgaggacttctccgcctcacagaacgtgctggaagattctctcaaaaacatgctgtcagacaaagacccaatgctgggcagcgccagcaatcaattctgtctgccagtcttagacagcaacgatccaaattttcagatgccttgcagcactgtggtaggcctggacgacattatggacgagggcgtcgtgaaagaatctggtaatgacacaattgacgaggaggagctcattctgccgaataggaacctcagggataaggtggaggaaaattccgtgagaagcccacgcaagagtcctagactgatggcccaagaacaggttcgatcgctgcgccagagtacaatcgcgaaacggtctaatgcagcccctttgtcaaacacaaagaaggcttccgggaaaaccgtgtctactgcaaaagcgggtgtgaaacagcccgaaaggagccaggtcaaagaggaggtgtgcatgtccctaaaaccagaataccacaaggagaatcggcgttgtagccgcaactccggccagatcgaggtggtgcctgaggtgagtgtgagcagctcgcactcctccgtgagctcatgcctggagatgaaggatgaggatggactggattctaagcacaaatgcaataaccccggcgaaatagatgtgccaagtcatgagctcaactgctcattattgtccgagacttgtgtgacaatcggtgagaagaaaaatgaggccttgatggaatgtaaagctaaacccgtcggctctcccctgttcaaattctccgataaggaagagcacgagcagaacgacagtataagcggaaagactggcgagactgtcgtggaggaaatgattgctacacgcaaggttgagcaagacagcaaggaaaccgtgaaactctcacacgaggacgaccacatcctggaggatgcaggaagctctgatatctcctctgacgctgcctgcacaaaccccaacaaaactgagaacagcttggtcggcctccccagctgtgtggatgaagtgacagagtgtaatcttgaactgaaggatacaatggggattgccgataagactgagaacaccctggagcgcaataagattgagccactaggatactgtgaggacgccgagtctaatagacagttggaatcgacggagttcaacaaatctaacctggaggtcgtggacacgtccacattcggacccgaatccaatatcctagagaatgctatctgcgacgtgcctgatcagaattcaaagcagcttaacgccatcgaatccactaaaattgagagtcatgaaacagctaacctgcaagatgatagaaattcacagtcctcatccgtgagctacttagagagcaagtctgtcaagtcaaaacatacaaaaccagtcatccactccaaacaaaacatgaccactgacgctcctaagaagatcgtggcagcgaaatacgaggtgatacactccaagactaaagtcaatgtcaaatcagtgaagagaaataccgatgttccggagagtcagcagaatttccaccggcctgtgaaagtgcggaaaaagcagatcgacaaggagcctaaaatccagtcatgtaattctggggtcaaatctgttaaaaaccaggcccacagtgtgttgaaaaagacacttcaagatcaaacactcgtacagatcttcaagccactgacccatagcctgtctgacaagagccacgcacacccagggtgtttgaaggagcctcaccacccagcccagactggccacgtgagccattcaagtcagaagcagtgccacaaaccgcagcagcaagcacccgcgatgaaaactaatagtcatgtgaaggaagaactcgaacacccaggcgtcgaacactttaaggaagaagataaattgaaactcaagaagccagagaaaaaccttcaacctcggcaacgccggtcatctaagtctttttccttagatgagccccctctatttatccctgacaatatagccactatcagacgggagggttccgaccattcatcttcttttgagagcaaatatatgtggactccgagcaagcagtgtgggttttgcaaaaagccccatgggaacagattcatggtgggctgcggcagatgcgacgactggttccacggagattgcgtgggcctctcactgtcccaggcccagcagatgggcgaggaagacaaggaatacgtatgtgtgaaatgttgtgccgaggaggataaaaagaccgagatcctggatcccgatacgttagagaaccaggctaccgtcgagttccattctggcgacaagaccatggaatgcgagaagctcggactgagcaagcacaccaccaacgaccgcaccaaatatattgacgatacggtgaagcacaaggtaaagatcttgaagcgggaatcaggtgagggtaggaactcttcagattgtcgtgacaatgaaatcaagaaatggcagctggccccgctgaggaagatgggtcagcctgtcttaccgaggagaagcagcgaagaaaaatcagagaaaattcctaaagaaagcaccacagtgacctgcactggggagaaagcatcaaagcctgggacacatgaaaaacaggaaatgaaaaagaagaaggtcgagaagggcgtgcttaatgtgcaccccgctgcaagcgcttctaagccatctgccgatcagatacggcaaagtgtgcgccatagcctgaaagatattctgatgaagagacttaccgatagcaatcttaaggtccccgaggagaaggccgctaaagtagccacaaaaatcgagaaggaactgttttcttttttccgagacactgatgcaaagtacaaaaacaaataccgaagtctgatgttcaatctcaaggaccccaagaacaatatcttgtttaagaaggttcttaagggcgaggtgaccccagatcatctgattagaatgtcacctgaggaactggcatctaaggagttggctgcatggagacgccgggagaatcgccacaccatagaaatgattgagaaggagcaacgtgaggtggaacgccggcccataaccaaaataactcacaaaggggaaattgaaattgagtccgacgctcctatgaaagagcaggaggcggccatggagatccaggagccagccgcgaataagtcgttagaaaagcccgagggcagtgagaaacagaaagaggaagtggattccatgtccaaggatactacatcccagcacaggcagcacttattcgatctgaactgcaaaatttgcatcggccgcatggcgccccccgtggatgatctctctccaaaaaaggtgaaggtggtggtgggagtcgctcgcaagcacagcgataacgaggccgagagtattgccgacgccctgtcttccacctcgaatattctcgctagcgaatttttcgaggaggagaaacaagaatctcctaagtctacgttttcaccagcccccagacccgaaatgcccggcaccgtggaagtggagtcaacatttctggcccgcctgaacttcatatggaagggttttatcaacatgccttcagtggcaaaatttgtgaccaaggcctaccctgtgtctggcagtcctgaatatcttaccgaagatttgcccgactcaattcaagtcgggggtcgcatcagcccacaaaccgtatgggattacgttgagaaaatcaaggcgtctggaacaaaagagatttgtgttgtgcggtttactccagtcacagaggaggatcagatttcctatacgttgctctttgcctacttctcaagcagaaagagatatggagtcgctgctaataatatgaagcaggtaaaggacatgtacctgatccctctgggtgcaactgacaagattccccatcctctggtgccgtttgacggcccaggactcgaactgcaccgacctaatcttctcctgggcctgatcatcagacagaaactgaagagacagcatagcgcatgcgcttccacttcacacattgccgagactcccgagagcgcaccacctatcgcgctccccccggacaagaagtccaaaatcgaagtaagcactgaggaagctcccgaggaagagaacgacttttttaattccttcaccacggtactccataaacagaggaacaagcctcagcagaacctccaggaggacctgcccacggccgtagagcctttgatggaggtcacgaaacaggagccccctaagcctctcaggttcctccctggagttcttattggatgggaaaatcagcccaccacactggagcttgccaataagccactgcctgttgacgacatcctgcagtcgcttctcggaaccactggccaggtctacgatcaagcacagtcggttatggagcagaacaccgtaaaagaaatacctttcctgaacgagcaaacgaattctaaaatagagaagacggataacgtggaggtgacagatggagagaataaagaaatcaaggttaaggttgacaatataagcgagtccacagataagtcagcagagatagaaacttccgtggtaggctcctccagtatctccgcgggttcacttacgtccctctccctgcgcggaaaaccaccagacgtgagcacagaagctttcctgaccaacctctctatccagtcaaagcaagaggaaacagtggagtcaaaggaaaaaacgctcaagagacagctgcaggaagatcaggaaaataatctccaagataaccagaccagcaatagcagtccctgcaggtccaatgtgggcaagggtaatattgacgggaacgtctcctgtagcgagaacttggtcgccaatacagctcggtcaccacagtttatcaacctgaagcgagaccctcgccaggcagcggggcggagtcagcctgtgactacatctgaatcgaaggatggtgactcttgcaggaacggagagaaacacatgctaccaggccttagtcacaataaggagcacttaacggagcagataaacgtggaagaaaaactatgttcagctgagaagaactcctgcgtccagcaatctgacaatcttaaggtcgcgcagaactctccctcagtcgaaaatatccagaccagtcaagccgagcaggcaaagccactgcaggaggatatcctgatgcaaaacattgaaaccgtgcacccattccggagaggaagtgcggttgccacctctcactttgaagtaggcaacacctgcccgtccgagtttccatctaaatctattacattcacttcccggagcacctcgccccgaacctctactaacttttctcccatgcgcccccagcagcctaatttgcagcatttaaaatcaagcccaccaggattcccttttccagggccccctaattttcctccccagtctatgtttgggtttcccccccacctgcccccccccctgctcccgcctcccggatttggctttgcccaaaatcccatggttccttggccacctgtcgttcacctgccaggccaacctcagagaatgatgggtccactgtcccaggcaagcaggtacatcggtccccagaacttttatcaggtcaaggatattaggagacctgaacgccggcattccgacccttgggggagacaagatcagcagcagctcgacagaccattcaaccgtgggaaaggagaccgtcagcggttttattccgactcacatcacctcaagcgagagcggcacgaaaaagagtgggaacaggagagcgagaggcacagacggcgagacagaagtcaagacaaggaccgggatcggaaatcacgcgaagaaggtcataaggacaaagagcgtgccagattgtcccacggagaccgaggcaccgatggcaaagccagtcgggatagcaggaacgttgacaagaaacccgataaacccaagtccgaagattatgagaaggacaaagaacgagaaaagagcaaacaccgcgagggcgaaaaggatcgagatagatatcacaaagacagagaccatactgaccgcactaagagcaagagatag

SEQ ID NO: 128321 - DNA, 1098 bp, Artificial Sequence
  Description of Artificial Sequence: Synthetic coding sequence
atgtcgagtagtgtcgagcaaaaaaagggccctactcggcagcggaagtgcggattttgcaagtccaatagggataaagagtgcgggcagctgctcataagcgagaaccaaaaggtcgctgcccaccacaaatgcatgctgttcagtagtgctctggttagctcccacagtgacaacgaatctctcggtggctttagtatcgaggatgtgcagaaggaaattaagcgcggcactaaactcatgtgttcattgtgtcactgccctggtgccactattgggtgcgacgtgaagacgtgccaccggacataccactaccattgcgctctgcatgataaagcccagattcgagaaaaaccctcgcaaggcatatatatggtttattgccgcaagcacaagaaaaccgctcataactcagaggcagatctggaagaaagcttcaacgagcacgagctggaaccttcctcacccaagagtaagaaaaagtcccgcaaaggcagacccaggaaaaccaatttcaagggcttgtctgaagatacccgttccacaagcagtcacggcacagatgagatggaatcctcctcctacagggataggtcccctcaccgcagcagccctagcgacaccagaccaaagtgtgggttctgccatgtgggggaggaggaaaacgaggccagagggaagctgcacatttttaacgccaagaaagccgcggcgcactacaagtgtatgctgttctcctctgggacagtccaactgacaaccacgtctcgggccgagttcggtgatttcgatatcaaaaccgtcctccaggagattaaacgtgggaaaagaatgaagtgcactctctgctcccagccaggggcgactattggctgcgaaataaaggcctgtgtaaagacgtaccactaccactgtggtgtgcaggacaaggccaaatacatcgaaaatatgtcgcgcgggatttataaactttactgtaaaaaccattcaggcaacgatgagcgtgacgaagaggacgaggaacgtgagagtaagagtagagggaaagtggagattgatcagcagcagttaactcagcagcagcttaacgggaattag

SEQ ID NO: 128322 - DNA, 975 bp, Artificial Sequence
  Description of Artificial Sequence: Synthetic coding sequence
atgtcttcctctgttgagcagaagaaaggacccactaggcaacgaaagtgcggcttttgcaagagtaacagagacaaagaatgtggacagctgctaatttcagagaaccagaaggtggctgcccatcacaagtgcatgttgttctcctccgccctggtgagttcacatagtgataatgaaagcctgggggggttctccattgaagacgtgcaaaaagagattaaaagaggtaccaaactgatgtgttccttgtgccactgtccaggtgcaacgattggctgcgacgttaagacttgtcatcgcacataccattatcactgcgccctacacgacaaagcccaaatccgcgaaaaaccgagccaggggatttacatggtatattgcaggaagcataagaaaactgctcacaatagcgaggcggctgatctcgaggaatccttcaatgaacatgagttggaacccagctcccctaagagtaaaaagaaatccagaaaaggccgccctagaaagactaactttaagggactgtctgaggataccaggtccacctcctcccacggtaccgatgagatggagtctagcagttacagagataggtcgcctcatagatcctcgccctccgacactaggcccaaatgcggcttctgccatgtcggtgaggaggagaacgaggctagaggtaaacttcacatctttaacgccaagaaggccgccgctcattataagtgcatgctctttagcagcgggactgtacagttgacaactacttcccgtgcggaattcggcgacttcgatatcaagactgtgctccaggagatcaaacgcggtaagaggatgaaatgcactctttgctcacagcctggagcgacgatagggtgcgagatcaaggcatgcgtgaagacctaccattatcactgtggcgtgcaggataaggcaaagtacatcgagaacatgtcaagagggatctataaatag

SEQ ID NO: 128323 - DNA, 939 bp, Artificial Sequence
  Description of Artificial Sequence: Synthetic coding sequence
atgtcttctagcgtggagcaaaagaaaggacctaccagacagaggaagtgcggattctgcaagtccaaccgcgacaaagagtgtggacagcttctgatatccgaaaaccagaaagttgccgcccaccacaagtgcatgctgtttagttccgccctagtttctagccacagcgacaatgaatctctgggtgggttttctatagaggatgtgcagaaggagattaagcgcggcactaagctgatgtgtagtttatgtcattgtccaggcgctacaatcggttgtgatgtgaagacctgtcataggacgtatcactaccactgtgcactgcatgacaaagctcagatacgggagaaacccagccagggcatctatatggtttattgtcgtaaacacaagaaaaccgctcacaactcagaagcagcagaccttgaggagagcttcaacgagcatgaactcgaaccctcatcacccaagtctaagaagaagtcccggaaaggacgccccagaaaaaccaacttcaagggcctgagtgaggatactcggagcactagcagccatggaacagatgagatggaatcaagtagctatcgcgatcggagcccccacagaagttccccttccgacactcgtccgaaatgtggcttctgccatgtcggggaggaagaaaacgaagcgcgaggaaaactgcatatctttaatgccaaaaaggctgcagcacattataagtgtatgctgttcagctccggcactgtgcaattgaccaccacctcacgcgctgagttcggggattttgatattaagaccgttttacaggagataaaaagagggaagagaatggtctgtagtttctacatctgttacgcaaccctgcacctgatttgctgctttaaatttcgcgttcacccaaagttcatccagtcttcggaaaacctcaagtag

SEQ ID NO: 128324 - DNA, 1098 bp, Artificial Sequence
  Description of Artificial Sequence: Synthetic coding sequence
atgagctcaagcgtcgagcaaaaaaaggggcccacacggcaaaggaagtgtggcttctgcaagtctaaccgagacaaggagtgtgggcagcttcttatctcagagaaccagaaagtcgcagctcaccacaagtgcatgctgttcagttctgctctggtctcttctcattccgacaacgagagtctcggaggcttttccattgaagacgttcagaaggaaattaaaagaggaacaaagctgatgtgctcgctctgtcattgccccggcgcaacaattggctgtgatgtgaagacatgccatcggacctaccactatcattgcgcgcttcacgacaaggcacagattagagagaaaccatctcaggggatctacatggtgtactgtagaaaacacaaaaaaactgctcataactctgaagctgacctggaggagtctttcaacgagcacgaattggaaccgtcttcgcccaaaagcaaaaagaaatcaaggaaggggaggccacgcaaaaccaacttcaaggggttatcagaggacacaagaagcacttcgtcacatggcacggacgaaatggaatcctcgtcctacagagacaggtctcctcataggtcatccccttccgacacacgcccgaaatgcggattttgccacgttggggaggaggagaatgaggctagaggcaaattacacatcttcaacgctaaaaaagcggccgcccactataagtgtatgctgttttccagtggtacggtgcagctgacaactacttcacgggcagaatttggagacttcgatatcaagactgtcctgcaagaaattaaacggggtaagagaatgaaatgcaccctttgcagccaaccgggcgctacgatagggtgcgaaattaaagcctgcgttaagacctatcactaccattgtggagttcaagacaaggctaagtatatcgagaacatgtccaggggaatttataagctttattgcaaaaaccactccggaaacgacgagcgggacgaagaggacgaggaacgcgaatcaaaaagcagaggaaaggttgagattgaccaacaacagctgacccagcaacagctgaacgggaactag

SEQ ID NO: 128325 - DNA, 1101 bp, Artificial Sequence
  Description of Artificial Sequence: Synthetic coding sequence
atgtcctcgtccgtggaacaaaaaaaaggcccgactcgacagaggaaatgcggcttttgtaaatcaaatagggataaggaatgcgggcagctgctcatctcagagaaccagaaggttgcagcccaccacaaatgcatgctgttctcctctgcattggtcagcagtcatagtgacaacgagtctctcggcggcttcagcatagaggacgtgcagaaggaaatcaagcgggggaccaagttgatgtgcagcctgtgccattgccccggagccactattggatgcgatgtgaagacttgtcaccggacttaccactaccactgtgccttgcatgataaggcccagattagagagaagcccagtcagggtatatacatggtctactgtcgtaaacacaaaaagaccgcacacaattccgaggccgccgatctcgaagagagcttcaatgagcacgagcttgagccgtcaagcccgaaaagcaagaagaaatccaggaaggggagaccgaggaagactaactttaaaggcctgtccgaggacactcgctctaccagctctcacggaacagatgaaatggaaagctcatcgtatagagatcgttcaccccacaggagcagccccagcgacacccgccctaaatgtgggttctgccacgtgggtgaagaggaaaatgaggctcgaggcaagttgcacatattcaacgctaagaaggctgctgcgcactacaaatgcatgctgttttcatccggaaccgtgcagctgacaactacctccagggcagagttcggggactttgacatcaaaaccgtgcttcaggaaatcaagcgcggcaaacgcatgaaatgcacactgtgcagtcaaccaggggccacaatcggctgcgaaataaaagcctgtgtcaagacatatcactatcactgcggcgtgcaggacaaggccaaatatatagagaatatgagccggggcatatacaaattgtactgcaagaatcattccggaaatgacgaaagagacgaagaggatgaggagcgcgagtctaagagtcgtgggaaagttgaaattgaccaacaacagctgacgcagcaacaattaaacggaaactag

SEQ ID NO: 128326 - DNA, 996 bp, Artificial Sequence
  Description of Artificial Sequence: Synthetic coding sequence
atgtcctcttcagtagaacaaaagaagggcccgacgcggcagcgaaagtgtgggttttgcaaaagcaaccgcgacaaggagtgcggccagctccttatcagcgagaaccagaaagtggcggcccaccacaagtgtatgatgtgcagtctgtgccactgccccggggccacaattggatgcgacgtaaaaacgtgccacaggacgtatcattaccattgcgccctgcacgataaggcacagatccgtgagaaaccctctcagggcatttatatggtgtactgccgaaagcataaaaagacagctcacaactctgaagcggacctagaagagtcattcaatgaacatgagctcgagccatcatctcctaagtcgaaaaagaagtcccgtaagggacggccccgcaaaactaattttaagggcctctctgaagacactcgctccaccagtagtcatggaaccgacgaaatggaatcctcttcatacagagacagaagtccccacaggtcctctccaagtgatacaaggcccaagtgcgggttttgccatgttggagaggaagaaaatgaagctcgcggaaagctccacattttcaacgctaaaaaagcagcagctcactataagtgcatgctgtttagttccggcaccgtgcagctcaccacaacatcccgagcagaattcggcgactttgacatcaaaacagtgcttcaggagattaagaggggcaagagaatgaaatgcacgctgtgttcacagcccggagcaactattggctgcgagattaaggcatgtgttaaaacttaccattaccactgcggggttcaagacaaagctaagtacatcgaaaatatgtccagaggaatctataagttatactgtaagaatcacagcgggaatgacgagcgcgatgaagaggatgaggaaagagaatccaagagtcgcggcaaggttgagatcgaccagcagcagctcactcagcaacaattaaatggaaattag

SEQ ID NO: 128327 - DNA, 3075 bp, Artificial Sequence
  Description of Artificial Sequence: Synthetic coding sequence
atggcctcagtcccggtttactgcctgtgccgcttgccatacgatgtcacaaggttcatgatcgagtgcgacatgtgccaggactggttccatggttcctgtgtcggggttgaggaagagaaggccgctgatatcgatctctaccattgtcccaattgtgaagtcctgcatggccctagtatcatgaagaaaaggcgcggaagctctaagggacacgacacccacaagggcaagcccgtcaagactggatcccccaccttcgtgagggagctcaggtcgaggacttttgactcctctgacgaggttatcctgaagcctaccgggaaccagctgacggtcgagttcctggaggagaattctttctcagtgcctatcttggttctgaagaaagacggattggggatgactcttcccagtccatcctttaccgtcagagatgttgagcactacgttgggagtgacaaggaaatcgacgtgatcgatgtcacccggcaggccgattgcaagatgaagttaggggatttcgtgaagtattactactctggaaaaagggaaaaagtattgaatgtgatttctctcgagttcagtgacacacgtctgtcaaacctagtcgaaacccctaaaattgtgcggaaactgagttgggtggaaaacctgtggcccgaagagtgcgtcttcgagaggccaaacgtccagaaatattgtttgatgtccgttcgggattcttatacggacttccatatcgactttgggggtacctcggtgtggtatcatgtgcttaaaggagagaagatcttctaccttataaggcctaccaatgcaaacctcacactgtttgagtgctggtcatcatccagcaaccagaatgagatgttttttggcgaccaggttgacaagtgttataaatgctcagtgaagcaaggacagactctgttcattcccacgggttggattcacgccgtgctgacgcctgttgattgcctggcctttggaggtaactttctgcacagcttgaatattgagatgcagttgaaagcctacgagatcgagaagcggctctcgacagcagatctgttccgcttcccaaacttcgaaactatctgctggtacgttggcaaacatatcctggatattttccgcgggttgagggaaaatcggcgccatcctgcatcgtatctggtgcatggtggcaaggccctgaacctggcttttagagcctggactcgcaaagaggccctccccgatcacgaagacgaaatcccagagacagtgagaacggtacagctgatcaaggacttggcgcgggaaatccgcctggttgaggacatattccagcagaatgtcgggaagactagcaacatttttgggcttcaaaggatctttcctgccggttctattccgctaacaaggcctgcccactcaacctcggtcagcatgtcaagactttcattgcccagtaagaatgggtccaaaaagaaaggactgaaacccaaggagttatttaagaaagccgagcggaaaggcaaagaatccagcgccctcgggcctgccgggcagctgagctataatttgatggacacctacagccatcaagcgctgaagacaggcagcttccaaaaagctaaattcaacattaccggtgcctgcttgaacgactcagacgatgacagtcccgacttagatttggatgggaatgagtctcccctagcactgctgatgtcaaacggatcaaccaagcgggtaaaaagtctatccaagtccaggaggactaagattgccaaaaaggtagacaaggctagattgatggccgagcaggtaatggaagatgaatttgatcttgatagtgacgatgagttacagattgacgagcgactcggcaaagaaaaggcgacgctgataatacgccccaaattcccaaggaaattaccaagagcaaaaccctgttcagatcctaatcgcgtgcgagagcccggcgaagtcgagttcgacatcgaggaggactatactacagatgaagacatggtcgagggcgtggaaggcaaactcggcaatggatctggagctgggggcatccttgacctgctcaaagcatcaagacaagtgggcggccccgattatgcagccctgacagaagcacctgcctctccgagcactcaggaggctatccagggcatgttgtgcatggcgaatctccagagctcaagttctagtccggctacaagttccttgcaggcctggtggacaggtggacaggaccgatcctccggaagttcctcttctggcctgggaactgtgagcaactcccccgccagccaaagaactcccggaaagagacctataaaacgcccggcgtattggcggacagaaagcgaagaggaagaagagaatgcgagtctggatgaacaagactcactgggggcctgctttaaggatgctgaatacatatatccctccctggagagtgatgacgacgaccccgcccttaaatcccgtccgaaaaaaaagaagaactctgatgatgcaccgtggtccccaaaggcacgagtaactcccactctgccgaaacaggatagacctgttcgtgagggaactagggttgcctctattgaaaccgggctggcagctgctgctgcaaagctcgcccagcaggaactccaaaaggcccaaaagaaaaaatatattaagaaaaagcccctcctgaaagaggtcgaacaacccaggccccaagactcaaatctgagcctgacagtgcccgcgcctacagttgccgctacgcctcagctggtcacgagctccagtccactgcctccgccagaaccgaaacaggaagcactgtccgggagcctggcagaccatgaatacactgccaggcctaatgcgttcggcatggcccaagcaaacaggagtacaacccccatggccccgggcgtctttcttacgcaacgaagaccatccgtaggatcccagtcaaatcaggccggccagggaaaacgtccaaagaaaggtttagcaactgcgaaacaacggttgggccgcattctgaaaatccacaggaatggtaaactactcttgtag

SEQ ID NO: 128328 - DNA, 2847 bp, Artificial Sequence
  Description of Artificial Sequence: Synthetic coding sequence
atggcctccgtccccgtgtactgcctatgccgactcccatatgacgttactaggtttatgatcgaatgtgacatgtgtcaggattggttccacggaagctgcgttggagtggaggaagagaaagctgcagacattgacctctaccattgtccaaattgtgaggttttacatgggccgagtatcatgaagaagcgaagggggtcgtctaaaggtcacgatacgcataaaggaaagccggtcaaaacagggtcccctacttttgtgagggagctccgctcccggacctttgactcctctgacgaggtaatcttgaagccaaccggcaatcagctgacagtggagttcctagaggagaattcattttctgtcccaattcttgtccttaagaaggacggactcggcatgactttaccatctccctctttcacggtgagagacgtggagcattacgtgggcagcgacaaggaaattgacgtcatcgacgtcaccaggcaagcagattgcaagatgaagcttggggattttgtcaagtactactactccggaaaacgggagaaagtgctcaacgtgataagcctggagttcagcgatacaagattgagcaacttagtagagactccaaagatcgttcgcaaactgagttgggtagaaaacctatggccagaagaatgtgtgttcgagcggcccaacgtgcaaaagtactgcctaatgtcagtacgcgattcatacactgatttccatattgatttcgggggcactagcgtttggtatcatgtcttgaagggagagaagattttttacctgataagacccacaaacgccaatctgactctgtttgaatgctggtcttcatcaagcaaccaaaatgagatgtttttcggggaccaagtggacaagtgctacaaatgctccgtaaaacaaggccagacgctcttcatccccaccggctggatccacgccgttctaactccagtcgactgcctggccttcggcggcaattttttacactcactgaacattgagatgcagctgaaggcttatgagattgaaaagcgcctctcaaccgctgacctgtttcgattccctaacttcgagacgatttgttggtacgtggggaagcacattctagacatattccgaggactacgggagaatagacggcatcctgcaagttacttggtccatggagggaaagctctgaatctagcgttcagagcgtggacacgaaaggaggccttgcctgatcacgaagatgaaattcccgagacagttaggacagtgcagctcattaaggacctcgcccgggaaatcagactggttgagtttaatatcaccggagcttgtctgaatgattctgatgatgactcccccgatcttgacctcgatgggaacgagtccccattggctcttctcatgagcaatgggtccaccaagcgagtcaagtctcttagcaaatctaggaggactaagatcgccaaaaaggtggacaaggcgaggctcatggccgagcaggtcatggaagacgaattcgacctcgatagtgacgatgagctccaaatagacgagcgacttggcaaggagaaagccacactgatcataaggcctaaatttcctcggaagctgcccagggccaagccatgctccgaccctaaccgggtaagggaacctggtgaggtcgaatttgacattgaagaagactacacaacagacgaggacatggtcgaaggagtagaaggcaagttagggaacggaagtggcgctggcggcattttggatcttctcaaggccagtagacaggtggggggcccagattacgctgctctcaccgaagcacccgcttctcccagtacccaagaggccatccagggcatgttgtgtatggcaaacttacaaagttcctctagcagccctgccacgagttcattgcaggcatggtggacaggaggccaggaccgctcttcaggctcaagctccagcgggcttggtacggtctctaatagccccgcatcacagcggaccccgggcaagcggcccatcaaacggcctgcttattggcgaacggaaagcgaagaggaggaagaaaatgcgtcccttgatgagcaagactccctcggtgcatgtttcaaggatgcagagtatatctatccctctttagagtccgacgatgacgacccagccctgaagagcaggcccaagaagaaaaaaaactcagatgacgccccatggtcacctaaggccagagtcacccctactcttccaaaacaagacaggcccgtgcgggaggggacccgagtcgccagcattgaaacagggctggcagccgccgcggctaagcttgcccagcaggaactgcagaaagctcagaagaaaaagtatattaaaaaaaaaccactgctgaaagaagtggaacaacccagaccacaggactccaacctgtcactcacagtgcccgcccccacagtggctgcgacccctcagctggtaacctctagtagtcctctgcctcctcctgaaccgaaacaggaagcactgtcaggaagtttggccgaccacgagtacacagctcgacctaacgctttcggaatggcacaggctaaccggtccacgacgcctatggctccgggcgtcttcctgacccagcgccgtccctctgtcgggagccagtctaatcaggcagggcagggcaaacgtcccaagaagggattggccacggccaaacagcgtttgggccggatcctaaaaattcacagaaatggtaaactcttgttgcggcaggtaattgtgcaggccgaatgtaggcaggccatccatgaacccaagttgaagagacgtgacgcacacccttag

SEQ ID NO: 128329 - DNA, 3183 bp, Artificial Sequence
  Description of Artificial Sequence: Synthetic coding sequence
atgaataggtcacgagcgattgtgcaacggggccgggtactgccccctcccgccccccttgacactaccaaccttgcaggcagaaggactttgcagggtagggccaagatggcgtcagtccccgtgtactgcctctgcaggctcccttatgatgtcactcgctttatgatcgaatgcgacatgtgccaagattggtttcacggctcctgcgtgggtgtggaagaggagaaggcggcggacatcgacctgtatcactgcccaaattgcgaggtccttcacgggcccagcattatgaagaaacgccgaggctcctcaaagggacacgatacccataaaggaaagccagtcaagactggttcccccacctttgtacgagagctcaggtctcgaaccttcgactcgagcgatgaggtcattctgaagcccactggcaaccagcttacagttgagttcctagaggagaattcattcagcgtgcccattctggtgctcaagaaggacggcttaggtatgaccctgccaagtccctcattcactgttcgcgatgtggagcactacgtgggatccgataaggagatcgatgtaatcgatgtcacacgccaagccgattgcaaaatgaagttgggcgactttgtgaagtactactatagtggaaagcgagagaaggtactgaatgtgatctcgctggagttctctgacacacgcctgtctaatctggttgaaacacccaagatcgttaggaaacttagttgggtggaaaatctgtggcctgaagagtgcgtattcgagcggcccaacgtccagaagtattgtctcatgagtgtgagagacagttacaccgacttccacattgattttgggggaacgagcgtttggtaccacgtactgaaaggagagaagatcttctacctaataagacctaccaacgctaacctgactctatttgagtgctggtcttcttctagcaatcagaacgagatgtttttcggggaccaggttgacaagtgttataagtgcagcgtgaagcagggtcagacccttttcatcccaacgggctggatacatgctgtgctgactccggtcgattgtctggctttcggggggaatttcctgcattctcttaacatcgagatgcagctgaaagcatacgagattgagaagaggctctcaacggccgacctgttccgcttccctaactttgaaaccatctgctggtacgtgggcaaacacattttggatatctttcggggcctgcgggaaaatcgccgacatccagcctcgtacctggtgcacgggggcaaggcactgaacctggcctttagagcttggacaagaaaagaggccctgcccgatcatgaggacgaaatacccgaaaccgtacgcaccgtgcagttgataaaggacctcgcccgagaaatccgcctcgtcgaagatattttccaacaaaacgttggaaagacatctaatatttttgggttacagcgcattttcccagctggcagcatcccactcaccaggcctgctcattcgacaagtgttagcatgtctcgactctctctgccatcaaagaatggcagcaaaaaaaagggcctaaagccaaaagaactgtttaaaaaagctgagaggaagggtaaagagagcagtgcactcgggcccgccggtcaacttagctacaacctgatggatacctacagccaccaggctctcaagaccgggtctttccagaaggcgaagtttaacattaccggcgcatgtttaaatgattccgatgatgacagccccgacttggacctcgatggtaacgaaagtccactggcgctgttgatgagtaacggctctactaagagggtaaaatctctttcgaaaagccgacgaactaaaatcgctaagaaagtcgataaagctagactgatggcggaacaggtgatggaagatgagttcgacctggattcagatgatgaattacaaattgacgagcggctggggaaggagaaagctaccctgattattaggccaaaattcccccgcaagctgcccagggcaaaaccttgcagtgacccgaacagggtgcgggagcctggagaagtggagttcgacattgaagaagactacaccacagacgaagacatggtggagggagtggaaggtaaactcgggaacggaagtggtgcgggtggcatcttggatctgctaaaggccagtcgacaggtcggcggccctgactacgcggccctgactgaagccccagcctcccctagtacccaggaggctatccagggcatgctctgcatggctaacctccagtcaagtagtagttctcccgcaacttcgtctcttcaggcttggtggacaggcgggcaagaccgtagcagcggctcttcctcatccggcttgggcactgtgagtaactctcctgccagccaacggacccctggcaaaaggcccatcaaaaggcccgcatactggcgaactgaatctgaggaggaggaagagaatgcctccctggatgaacaggattctttgggcgcatgttttaaagatgctgagtatatctacccttccctggagtcagatgacgacgatcccgccttaaagagtcggccaaaaaagaagaaaaattccgatgatgcaccatggtcgcctaaagctagagtcactccgaccctgcccaaacaggaccgtcctgtacgggaggggactagagtggccagtatagagactggactggcagctgcagccgccaaactggctcagcaagagctgcagaaagcccagaagaaaaagtatattaagaagaagccacttctgaaggaagtcgaacagcccagaccccaggacagcaatttgtctctgacagtgcccgcccctacggttgctgctacccctcaactcgttacctccagcagtcctttgcctccgcccgaacctaagcaagaggccttatctgggagtttggctgatcacgaatacacagctagacccaacgcctttggcatggcgcaagctaatcgctcaacaacacctatggcgcccggggtctttttaacacagcggcggcctagtgtcggctcgcaaagcaaccaggctgggcagggcaagcgcccaaaaaaagggctcgccaccgctaagcagcggctcgggcgaatcttaaagatacaccggaacggtaagctcctgctgtag

SEQ ID NO: 128330 - DNA, 912 bp, Artificial Sequence
  Description of Artificial Sequence: Synthetic coding sequence
atggatacctatagccatcaggcactcaaaacaggttccttccagaaagccaaattcaacatcaccggggcatgcctgaatgattccgacgacgattctcctgacctcgacttagacgggaatgagagccctctggcactcctgatgagcaacggaagtaccaagcgtgttaagtcactgagcaaatccaggaggactaagatcgctaaaaaggttgataaggcgagattgatggctgaacaggtaatggaggacgagttcgacttggacagcgacgatgaactccaaatcgacgaacgtctagggaaagaaaaagctacattaattatccgaccaaagtttcccaggaagctcccgagggccagtctggctctcacacctactgaatttgttaaccaggagaagctgtcccttacgcttaggcgcacaattcagcaaatgagaacttggtggaaaggactgaaggcgtctctgggcatggtggtggccctggttgcattcctcatttgctcccggcctgctggacggtggggcgatttaaccatgctgccttctccccgcccccagctgctgccggcccttcgaaggccgagtcgcgcctgttgtgcttggcctacctgctcaccccacaggccgcacagattacccctggcatgtcgacccggcggtctgggagacaggattgaagcagtaggtgccccggcggtgggctgggctcagtgcctcaccgtcctgctcccatcagctcctcagggtagcggacctagttctgggcaacacaccggtgaaccaagggcccgtcgaaggcgccgaacacctgtttggatgaaccggacagcgtgggaacgggcatctcgaatgcaatccatttctattctccattggtccctgatgatgatgaccctgctctag

SEQ ID NO: 128331 - DNA, 2862 bp, Artificial Sequence
  Description of Artificial Sequence: Synthetic coding sequence
atagtgcagagaggccgggtgttacctccacccgcccccctcgatactactaacctggcaggccgcaggactctgcaaggccgagcaaaaatggcttccgtgcccgtgtactgtctgtgccggctcccgtatgacgtcacaagatttatgatagagtgcgatatgtgccaggattggttccacggctcgtgtgttggtgtggaggaggagaaagctgctgatatagacctgtaccattgccctaattgcgaagttctgcacgggccatcgattatgaagaagcggcgaggatcgtccaaaggacacgacactcataagggcaagcctgtgaagacaggtagtccaaccttcgtccgcgaattaagatcgagaacgttcgactcttctgatgaggtaatactgaagcccaccgggaaccagctcacggtggagtttctggaggagaactcttttagcgtccccatcttggtacttaagaaagacggcctgggcatgaccctgccaagtccctccttcaccgtccgcgacgttgagcactacgttggttcagacaaagagatcgatgtgatcgatgtcacacgacaggctgactgcaaaatgaaactcggcgacttcgtgaagtattactactcaggcaagagggaaaaggtgctcaatgtgattagcctggaattttctgatactcgcctatcaaaccttgtagagaccccgaagattgtccgcaaactttcctgggtcgagaacctctggccagaagagtgtgtgtttgagcgtccaaacgtgcaaaaatattgccttatgtccgtgcgggacagctacacagacttccatatcgatttcggaggaacttcagtctggtaccacgtgctaaagggggaaaagattttttatctgatccgaccaaccaacgcaaacctgacgttattcgagtgctggtccagctcatcaaatcagaatgagatgttttttggggaccaggtggataaatgttacaaatgctcagttaagcaggggcaaactctctttattccaactggctggatccatgccgtattgacgcccgtcgattgcttggcctttggaggcaatttcctgcatagtcttaacatagaaatgcagctcaaggcttacgagattgaaaagcgtctgagtactgcagacctgttccgcttccccaatttcgaaaccatatgctggtatgtcggtaaacacatcctagatatctttagggggctgcgggaaaacaggcgccatccggctagctacctggtccatggagggaaagcccttaacttggcctttcgggcctggactagaaaggaggccctgccagatcacgaggacgaaatccccgagacagtaaggactgtacaattgataaaagacctggcaagagagattagactggtggaattcaacattaccggagcatgcctcaatgattccgatgacgacagtccagacttagacttggacggcaacgagagtccgctcgctctactaatgtctaacggctccacaaagcgggttaagtccctgtcgaaatcacgtagaacaaagattgctaaaaaagtggacaaggccaggctgatggccgagcaagtcatggaagacgagttcgacttggactctgatgacgaactacagatcgacgaaaggctaggcaaggagaaggccacccttatcatccgccccaagtttccgaggaaactcccgagagccaaaccttgttcagatccgaaccgagtacgcgagccaggggaggtggagtttgatatcgaggaggattacaccacagatgaggacatggttgagggagttgagggtaagctcgggaacgggtctggagccggtggcattctggacctgctgaaagcgagcaggcaggtcggaggacctgactacgctgctctgacagaagctcctgcctctccttcgacccaggaagcaatccaaggcatgctgtgtatggcaaacctgcagtcatctagcagctcgcctgcaacctcctcgctgcaggcttggtggaccggtggacaggatcgctcctctgggtcatctagttctggattgggcaccgtttccaactcacccgcctcccaacgcacacctggcaagcgaccaataaagcgccctgcctactggcggaccgaatctgaggaagaagaggagaacgcttccctggacgagcaggactccctgggtgcttgtttcaaggacgcggaatatatttatccctctctagagtccgatgatgacgaccctgcactcaagagcaggcccaaaaaaaagaagaattctgacgatgctccgtggagccccaaggctagagtgacccccacactgccaaaacaggatcgcccggtgcgagagggaacgagggtggcgtcgattgaaacaggcttggctgcagcagcagccaagctggcccaacaggagctgcagaaagcccaaaagaagaaatacatcaagaagaagcccctgcttaaggaagtggagcagcccaggccacaggattccaacctatctctcacagtccccgcccccaccgtggcggctacccctcagctggtaacctccagcagcccgctgccccctcctgaaccgaaacaggaagcactgagtggaagtttagccgaccatgagtatacggcccggccgaatgcgttcggcatggcgcaagcaaatcgtagcactaccccaatggctcccggagttttcctcacccagcgtcgtccttccgttggcagtcagtctaatcaggcaggtcagggaaagcgccctaaaaagggcctggctaccgccaaacaacggttagggcggattctcaagatccatcggaacgggaagctgttactgtag

SEQ ID NO: 128332 - DNA, 345 bp, Artificial Sequence
  Description of Artificial Sequence: Synthetic coding sequence
atggcctcagttcccgtttactgcctttgcagacttccctatgacgtgactaggtttatgatcgaatgcgacatgtgtcaggactggtttcacggaagctgcgtaggcgtggaggaggagaaagcggctgatatcgatctgtatcattgcccaaattgtgaagtgctgcacggtcctagtattatgaaaaaacgaagaggcagttctaaaggacacgacactcacaaaggcaaaccagtgaagacaggctctccaacctttgttagggagctgaggtcaaggacgttcgatagcagtgatgaggtgattctgaaaccaaccgggaatcagctcacagtagagtag

SEQ ID NO: 128333 - DNA, 381 bp, Artificial Sequence
  Description of Artificial Sequence: Synthetic coding sequence
atggcctccgttccagtgtattgcctgtgtcgactcccctatgacgtgacacgtttcatgatcgagtgtgacatgtgtcaggactggttccatggatcttgcgtgggagttgaggaggagaaggcagccgatatcgatctctatcactgtcccaactgcgaagttttgcacggcccttcaatcatgaaaaagagacgcggcagcagcaagggtcacgacactcacaaaggcaagcctgtgaagactgggtcaccaaccttcgtgcgggaactccgctctagaactttcgattccagcgacgaagtcattctaaagcccaccgggaatcaactgacagtggagttcctggaagagaactcttttagcgtgcctatcctgtag

SEQ ID NO: 128334 - DNA, 294 bp, Artificial Sequence
  Description of Artificial Sequence: Synthetic coding sequence
atggcttcggttcccgtgtattgtttgtgtagactaccctacgatgtcacgaggttcatgattgaatgtgatatgtgtcaggattggtttcacggctcatgcgtcggcgtagaggaagaaaaggccgccgacatcgatttgtatcattgtcccaattgcgaggttctgcacggcccctctatcatgaagaagaggagaggctcctctaaggggcatgacacccataagggtaagcctgtgaagaccggctcgcccacattcgtgagagagctgagaagccgcacttttgattag

SEQ ID NO: 128335 - DNA, 348 bp, Artificial Sequence
  Description of Artificial Sequence: Synthetic coding sequence
atggcatctgtacccgtttattgtttatgcaggctgccctacgacgtcacaagattcatgattgagtgcgacatgtgccaggattggttccacggctcttgtgtgggcgtggaagaggagaaggctgctgacatagatctctatcactgcccaaattgcgaggtcctgcatggcccaagtatcatgaagaaacgcagaggtagctccaaagggcacgacacccacaaaggtaagcctgtcaagaccggctccccaacttttgtgcgcgagctcagatcccgtacctttgactcatctgacgaagttattctcaagccaactggcaatcagctaacggtggaattctag

SEQ ID NO: 128336 - DNA, 294 bp, Artificial Sequence
  Description of Artificial Sequence: Synthetic coding sequence
atggccagtgtgcccgtatactgcctctgtaggttaccgtacgatgttacccgatttatgattgaatgcgatatgtgtcaggattggttccacggctcctgtgtcggagtggaagaagagaaggcagccgacattgatctgtaccactgtccaaattgcgaggttctccatggcccctccataatgaaaaaaaggcgcggaagcagcaagggacacgacacacacaaagggaagccggttaagactggaagccctactttcgtgagggagttgagatctcggaccttcgactag

SEQ ID NO: 128337 - DNA, 447 bp, Artificial Sequence
  Description of Artificial Sequence: Synthetic coding sequence
atgaacaggtccagagcaattgtgcagcgagggcgggtgctgcccccacccgcaccacttgacactactaacttagcaggcaggcggacactgcaagggagggcaaagatggcctccgtgcccgtctactgcctctgtaggctgccatatgatgtcacgcgcttcatgatagaatgcgatatgtgtcaagattggtttcacggaagctgtgtgggagtcgaagaagagaaggcagctgatatcgacttgtatcactgccctaactgcgaggtcctgcacggaccatctattatgaagaaaaggcggggctccagtaaaggacacgatacccacaagggcaaacctgtaaagaccggctctcccaccttcgttcgggagctgcgttcaaggacattcgattcctctgacgaggtcatcctgaaaccgacaggaaaccaactcacgtag
